United States Patent 6,747,137 (NUCLEIC ACID SEQUENCES RELATING TO CANDIDA ALBICANS FOR DIAGNOSTICS AND THERAPEUTICS) - sequence listing, part 3

SEQ ID NO: 3785 - DNA, 471 bp, Candida albicans
ctcatggtgaaaaaaaaaaaaaaatcaacgaaaaaaaaaaaatttctcaacaacctgttctttatggctcttgcagaaactgttattagaaaagtcaagaaacttggccttgtgccaaaggcaattgccattcttccaaggttgtctttattagtggcagcactcagtgtgttatggttggttacgttaccacaagatgggaattaccgtaatgtttacatttcagagaacgcgttaatgccagcgcaggccaattcgtattttagggagagcgaatggaatattgttcgcgggtatagagaggagattgggaagatggtagagtggagtgtggccgaccgtaatgaggtgattgcgtcgtggcttgttgattcggggctacaaatttcgtaccatgaaaatgggttcgccaacaatactttgtatgcgattatgcatgctccacgaggtgttattgtcatcggagggtga

SEQ ID NO: 3786 - DNA, 726 bp, Candida albicans
agacttaagaaacaaaacatttggcaagcattatatactggtggatcgattttacctacaccattgacaacttgtcgttatcaacatcgcccaatcaattggtcgaaattgcatgatgtggggttcagtcatttacctccaaatcaaactaaaagcagtatggtggcaagttatacattacctaataatcctaaattgaaaggtttacgtccaatgactgggaaagatgtttccaccgtattatctttattgtataaatatcaagaacgatttgatattgtacaactttttaccgaagaagaatttaaacattggatgttgggtcatgatgaaaattcagattctaatgtggttaaaagttatgtagttgaagatgaaaatggggttattaccgattatttttcatattatttgttaccattcacagtattagacaatgctcaacatgatgaattaggaattgcttatttgttttattatgccagtgattcctttgaaaaaccaaattataaaaagagattaaatgaattaatcactgatgcattaattaccagtaaaaaatttggagttgatgttttcaattgtttaacttgtcaagataatacttatttcttaaaagattgtaaatttggtagtggtgatggttttctaaattatcatctttttaattatagaacattccctatggatggaggaattgatttcaagacccaagaatttgtctaa

SEQ ID NO: 3787 - DNA, 630 bp, Candida albicans
  unsure (574),(603): Identity of nucleotide sequences at the above locations are unknown.
atccaatatatattaaaatatataaacacagaagaagttgacgacgacagtaatgctaaaccaagaacaagtttgaaaagactggaaattcatttgattgtgcttttacttatcaatatattattcaatcccgcatttaccggtggaaatgttttgccaatgaaaatattccaaaaagtcattattagttttataatttcaagtttctttacattcccaattattagtttcactccggggattattgttattttaatttttggcggtatattatacggattcacaatcttccaattaacaccaattttaaatgataatgatgtaaattggttatacaattatgtcatgaaagatgaaacaagagttcacattatctcaatatgggtggcaatgtcagtgaccattatcccaatggtgttttattttgccaattatttgaggcttaatactagaagaaagatttggcatggcttaatggtaattgcattatgtttcaccccagaaatattatttggtcaaattgaatttacattaataagtttattaggaacattaattgtattcatggtagtgngaggtattagatccaacagatttcttttntttaccagcacgccgcgatccatagag

SEQ ID NO: 3788 - DNA, 972 bp, Candida albicans
acacatttaattatggctcctttgacaattgcagtaggtgaagcaaaacctggtgaaacagctccaagaagaaaagctgctcaaaaagatggtgccgtcatgcgaccaaccgattctaaagccaccaccatgccagaatttattgatgaatgtttcaaaagaaatggtaataaagatgctatggcttggcgtgatttgaaagatgtcattgttgaaactaaacaaatcaccaaagttatcgatggtaaaccaactaaagtcaataaagattggacatattatgaaatgggtccttataattatatcaaatatcctgaattgttgaaattggtacaaaattattctaaaggattattagaacttggattattacctgatcaacaatctaaattgatggtttttgccggtacttcacataaatggatgcaaacatttttagcagcaagtttccaagggattcctattgttactgcttatgatactttaggagaatctggtttgactcattctttagtacaaactgaatcagatgcaattttcactgataatcaattgttgtcccaattgattcgtccattacagaaagcctcttcagttaaatacattattcatggcgaagaaattgatcctaaagatggtagacaaaatggtaaattatatcaagatgctaaatctgctaaagaaaaaattctagaaattagacctgacattaaatttatttcttatgatgaagtgattcaatctggtgctaatgccaaagataaacaatcattacattatccaaaacctgaagatccaatttgtattatgtacacttcaggatctactggtgaccctaagggggttgttattaccaattctaatattattgctgccattggtggtatttcttgtaatgccggtagagatttgattcgtccaactgatcgattattcttcactcacgggagctggccgcatccgcattattta

SEQ ID NO: 3789 - DNA, 1038 bp, Candida albicans
ttgattgaattcaaaccaacagttatggttggtgttgctgcagtttgggaatcggttcgtaaaggagttttatcaaaattaaaacaagcttctcccatacaacaaaaaattttttgggccgcattcaaagctaaaaccacttttaaacattttggtatccctggtgctgatatgtttgatgttgtgttcaaaaaagttaaaagtgccactggtggtcaattacgttatgttttaaatggtggttcaccaatttctgttgatgctcaagttttcattagtactttgattgctccaatgttgttgggttatggtttgaccgaaacttgtgctaatgccgctattttggaacatactcatttccaaattggtactttgggtactttggtgggatcaattactgctaaattggtagatgtggctgatgctggttattatgctaaaaataatcaaggggaaatttggttgaaaggtggtcccgtggtttcagaatattataagaatgaaaaggaaactaaagaagcttttactgatgatggatggtttaaaactggggatattggtgaatggactagtgatggtggattaaaaattattgatcgtaaaaagaatcttgttaaaactttgaatggggaatatattgctttggaaaaattggaaagtgtttatcgttcaaatcatttggtacaaaacttatgtgtttacgcagatcaaagtaaagttaaaccaattgcgattgttttacctattgaaaataatttacgacaaatgttgaaagaagaaaaagtgattgataatgctgaaactgaagaatttgctcatttggtacacgataaaaaagttactaaagcggttttaaaacatttattgactactggtaaacatcaaggattaaaaggtattgaattacttcaaaatgttgtattatcagatgatgaatggactccacaaaatggatttgttacttcagctcaaaaattacaaagaaagaagattttagaaagttgtaaaaaagaagttcaagaagcttataaagaataa

SEQ ID NO: 3790 - DNA, 2031 bp, Candida albicans
aatagtaaaccattgaatatgaattttgctagaactgaaagacgtaaatcaatggctgaacgtagaccaagtactgtctatactccaccggtaatcccacatttagcaggattagaaaaacctcaagatcaatatttaaaaatggataattgtgatgtattaattattggtactggattacaagaaagcattttggcagcagcattatcttggcaaggaactcaagtattacatattgatagtaacacatattatggagattcttgttccactttaacgattgaacaattgaagaaatggtgtggtgatgttaattcagggaaaatccatcaatttcaagatgctcagatttatattcctggtggtaaacaaagtaatcaatatacttcaaaagattatggaattgatttaacccctaaaattatgttttgtcaaagtgatttattatcattacttattaaatcacgagtttatcgatatttagaatttcaaagtttatcaaatttccatgtttttgaaaatgatgatttccaacaaaaagttaatgctaccaccaaacaagatatcttcacggataaatcattatcattaatgactaaaagatatttaatgaaatttttgaaatttttattattggatcctgattataaacaacgagttaaaccttatgctgatactccaatacaagtttttttacaacaagaatttaaattagaagagccgcaaattaatgaattggtttattctattggattaagttataaagaacaaacatcgactaaacaagcattaattagaatgaaaagatttttaagttcatttgatgtttatggtaaatttccttgtatggtgtcgaaattcggtggtcctggtgaattactgcaaggtttttgtcgaagcgctgctgttgctggtacaacatataaattaaacaccaatttaaccgattttgatccaatttctaaaattgctcattttaatgatggttcacatattaaaattaatgaaaaaattataatttctccgactcaattaccaaaatttttacaaagttcttataataaagtggtggaaaatttacaaccttattatgtcacaagattagtcacagttgttcgtcgtgattgtaaagaatggatgtcaggtaatgaatcactggctatagttgttttcccacctcattcattaccaacggataatcaacattcagtacaagtgattatacaaaatggcaattccggggtttgtcctgatggtcaagccatttggtttagtagtacagtcgaacaggatttgagccgtgctaaagttgatttagaatctgcttttgaaaaaatggagacatcattattaagagaaagttcagaagaaattgttaatgatatattaggtgataataataataataataataatgattttgttatgaatgctcaaggcactactaccccagtattagttaattcatttaaattaggttcatcattaattaattttgttcctaaagataaattggaaattgtttgtaaattaggatacgttgaaaaaacttttattaatcctgatttatccaatattttcaaaccaactaaaaccaataatattgtttataaagatgttgaagatgctaataatgaaattatttttactaatatgccaagttcagaattaagttatgatggaattataactgatgttaaatctatatatcaaagaattactgggaccactgatgatttctttgatgttgattttgaagatgaagaagatgaatatgatagaaataatcaaccagtagttcaaccaaaaagaagttcagttgttggtgggattgttggtggtggatccattactagtcttactgctcttagagaacaacataatgaaaataatcatagtgataatgcaattgatagtgatgaagatgaagatgaagatataaatgatatgaatgatatgaatgataatgaagaagaagatgatcatggaaggggtccagaaccttttggtgctgatgaaatggaactctaa

SEQ ID NO: 3791 - DNA, 630 bp, Candida albicans
caattgcatgatggtagtttccacggagataagtattttgaagtagacattagatttgtgtatactgcagtctcatctttttcgttattgaatgcgttaacagactccattgctgatacagcaagtgcattcattatgcaatgttttaactttgatggtgggtttggattgattcccgggtccgagagtcatgctgcacaagtgttcacgtgtgtgggggcattggccatcatgaataagttggatttactagatgtggcaaataagaaggtcaagttaattgattggttaactgaacgacaagtgttacctagtggagggtttaatgggcgtccagagaaattgcccgacgtatgctatagttggtgggtgttgtcctcattgtcaattctaaaacgcaagaattgggttgatttgaagattttagagaatttcatattgacttgtcaggatttggagaacggcggattcagtgaccgccctggtaatcaaacagatgtatatcatacatgttttgccattgctgggctaagtttaattgattacaagaaatacggatttaaagagattgatcctgtttattgtatgcctgtggaagtgacatctaaatttgtacgtaggctggcttga

SEQ ID NO: 3792 - DNA, 426 bp, Candida albicans
ataccgttgtgtattttgtttggtagcactgcatatcgtgatatatcctatatacaggaatttttcttggtgttgttcagctttgattctaatttttttttatcctttcttttcaattttaaacgaggattattcatacaccaaaattcaaccccaattgataaaccatattacttgatctcagtatctgcaaaaatttttgattataaaacaatgtccaatttaccgccagatgaaaaagttattctatttgataaatccaaacatgtgcaatatatagtggaacaggaatcgcatcgatcctttgaatattggttgagtgagcatttacgaatgaatggattatactggggggtgactgccttgatcacaatgaatgaactatcagcattggcccaacaagatgtgattgattatattatgtga

SEQ ID NO: 3793 - DNA, 672 bp, Candida albicans
aaccaaaacgagtccaattcttcaatatacaacgatgtgaaccacgatccaacaatttttgaaaacaagaacgaaccaattaaagtcaacctaatcagccattcgatgggcggtttggatagtagatacttattctccaagatacacaaagagaatgagaactataaggtggcgtcacttacgacaatttcgactccacaccatggctcagaatgtgctgattttattgtggatttaattggcaacaatcagatattaaaaaatgtatgtccacagtctatttttgatttgacaacgtcaaatatgaagaaattcaatcaatcagtaaaagatgaccccaatgtccaatatttttcgtttggtgccagattcaatcctcggtggtataatttgttcagcttgacatggttagtaatgaagtatgaaatcaaaaaggataaagctcgcgagttgcgccgtctaattgacaatgacggtcttgtgagtgtggaaagctcaaaatggggacagtacataggtactttagatgaggtcgaccatttagatttgatcaattggacaaacaaagcccggagcacttttgataaagtgatgtttgcccaagatcctacattcaaccccattgcattgtatttagatattgctgataaattagctgaaaagggattataa

SEQ ID NO: 3794 - DNA, 861 bp, Candida albicans
attatctcatattacagccttaaccaaatctcccaatggaatgttaatgtattcataccaccaattaatccaacatccaccaccaaacaaaagatcccagtattgatttatctttgtggattgacctgtactccacaagacgctactgaaaaatcatttttccaatattgggccagtaaatatggtttcaccattgttttccccgatacatcacctcgaggagctaaaattgaaggagaagatgattcatgggattttggtactggtgctgggttttatgttgatgctactcaatcgccatggaataaaaattatcaaatgtattcatatattcataaagaattattagataaattgagtgaacaatttattgaattagattttgaaaataatattggaattacaggtcattcaatgggtggtatgggtgctttagttgggtttttaactcaacctaaaaaatataaatcaattagtgcttttgctccaattagtaatccaagtattgttcaatggggtgaaaaaaattttggtaattatttggggaatgatgataaacagaattggtataaatatgatcctacacatttaattaaacaatatactactactaatgattatcaaccatcaattttaattcatcaaggtttaaatgataatttttatgctgatcaattgaaaccagaaaattttgttaaagctgctaaagaagcaaattataaaggtgaaattgatttaagattagttgatggttatgatcatctgtattttttcattagttcctttgttgaagaccatgctaaacatcatgctaaatatttaggattaacaaccaccaccaccacaactaaaaatgattaa

SEQ ID NO: 3795 - DNA, 621 bp, Candida albicans
agtgcggattcttccagcgggcgtgggtcaagacatgatacagagaaccgaaaaagggcaaaattgggattaccgctcttgtctaaaactggaaatgctgttaatggtaacgaatcacaagaattgcctgtcagtgccacattacctatttccgagggaattgacacggatttcagtttggataaagagttccctactgtatctttgagtgaacccgctgctagagatatcatcaacaatttgacaacccctgatgctgctgtaagtaactttgttgatccatatgaatttgaagatccaattgatcctgatttctatgaagcacgatggaatgaatttgcaagaagaaacactgatatataccgtatggtgttccattgtcaacctgatgatgtggtgggtagatggtcagagtacacacactttacaaaattacagagtatgtttatgaaagcccaggatacagacaccgaccaaggtcaactggcagaaaactactccgatgaaaaagtcgaagctggtgataaccaagaaccacgacgtgcaaacaattcccaactagaaaaaattgacgaagcgagtgaagaccagtatggtttgttacgtatggcaccaccatag

SEQ ID NO: 3796 - DNA, 1089 bp, Candida albicans
aatggggataattggaccaacacatacggtttactgggggggtatagatttatgttatggaagatacgacacgccagatcacgcattaacagacgattcagtgtgattttttccaatatcgcacaggacgatagaatcacagcagaaaactttgcgaatttccaagttttcgtgggtaaagattattccaatcttagagttaaagatttcctggaactcgaaaagccatatgaatccatgtacaacagaaatattgtccctcgtatgccttggcatgatgtccatatgtatacatgtgggcagaccgcaagagatttgtccagacattttgttcagagatggaactatttaatcagacaaaagcggccaagtagactcactccacttttattgcctccatctgatttgactgaagaagaggtattagctcatggattggatggtacatgtgaggtgcagttgttaagatcatccggaaattggtcacttggtttgaaagaacacgagcaaagtattcaaaatgcgtatcttaaattaatagaaacttcagagcattttgtctatattgagaatcaatttttcgtaacagcttgtttcatcgacggtacagaaattaagaatagaattggtgatgcgttggtcgacagaatcattcgagcacatagagaaggtactaattggaaggctattattgtcatacctttgatgcctggttttgaagctcaagttgatgaagcagaagggtcttctgttcgtgtgatcatgcaatgtcaatatatgtcaatttccagaggtgaaacgtctatttttgcaaagttgaggaaaaagggaattgatccagaccaatacattcaatttttctccttgcggaaatggggtagaataggatcaaacagaactttagttaccgagcagttgtatattcatgcaaagacgatgattgtcgatgacagatcggttatcattgggagtgccaacatcaacgagaggtctatgcgtggtttgcgtgattccgaagttgctgcagttgttcgtgacaaggaaatggtaaagagtaaattttcaccacagggctggaagatccgcgtc

SEQ ID NO: 3797 - DNA, 603 bp, Candida albicans
atagtgatttcaaaatcagtgccagaaatttggagattgcaaaacagagatgatgatgattcattgtttgacaattcttcggttgcccagcaacaaatgcatgaaaatgaaaacaagtttttcccacatttgaaaatcactttggaaaatagagaaagaaaattagtgatgctgccaaaatctcaaagagagcattctctttggattgattctcttagaattatgcaaaatctgacaatatggtcccaaaataagagatttgattcttttgccccagttagagaaaattgttttgctcagtggtttgttgacgctagagactacttttgggctgtctccactgctttggaaatggccaaggataccattatgatacacgattggtggctttctccggaattatatcttcgaagaccagcaaatggtaaccaacaatacagaattgatagattgttgcaaagaaaagctaaggaaggtgttaagatttttgtgattatttatagaaacgttggtacaacggttgcaactgactcattatacacaaaacattccatattgtctcttgatgtagagaatattgaccttattaggtcacctttctaa

SEQ ID NO: 3798 - DNA, 858 bp, Candida albicans
caggtatgtccactgggtgctcctgcaatcaatttaatggcctcgtgtctattagaagatgaacatggtataaccagagccccgttattgttgtcagtgcttgggttcaagttgagcgacgttactccaaaagagacaagcagaaacaggagatttagaattgatttagaatacggaattgacaagcacagaatgaaatggagtattgagagaaacgccactgacttggcttatttagcttacaaactcgagagaacaagaattgtaagtagagttgtgggaaacaaatctcaaccattacccagacttccaattccaccaattcgaaaattggataacaaaagaagcaaaaagactaaaagtgttttatctgatctgcgtgcaagagacgaccgcatgtcagtaccagatattaacgataaccactcgctttcaccagtaccatcagctttgtctagagtgagactgcgtttgggaagtataacatcagtgggctcacttgaaaagcatccagagttgcttgagctcagacggaaaaagaatgcacaatttatgaaagatgttgagagttatttgaaggaattgattgaaattacagagttaaaaaccctggcaaatattttgtttactttctttgagttgtcaccgctctcgtcattattgagttatgaatctggctatactggtaagcagggtccagtccatattggggggactgctaaagcacaaggttggagagttggccatttcaaagtaaacgatttgaaaggaatctacgagagaagagttgaaaagtggatgcttgtgagaaacagttacatcacatttgtgtcggttatcaagtcgattacacgttag

SEQ ID NO: 3799 - DNA, 1593 bp, Candida albicans
cttgaactttctacatacatgagtgaagagaatccgccgcagcaagatcaacaggcgccaaacgtatctgataaacctcagggagatctgttaataactcctcgtgaaacacatttccacaatgtattcgtgaaatatttgataatgcttattagtgccgtgggatcagttatatacacaactgtgctatgtactggttctatactcaatcattggtttgatattgttactggaagggaaaagaccgtacttgcagatatcgagcaaagaagtcacggatacgtgcctcgagaaccatacgatgaattgtcgaaaatgaaacccactagtgatttacagtattatttgcagcagttgaatttggatttgcaagagtacagggttaccacatgtgacgggtacatcttaaccctacatagaattattgatcccagggagctggaagaacagaggcagcaaagaaaacctgttcttttgcaacatggcttattgtcatgtagcgggacatggatagtgagtggcaagaattcattaggatactattttcatgagcaaggctatgatgtttggatgggaaataatcgatcgtggttcataccgcaacacaaaactttgagtgggagtctttacaacaatgaacaatactgggactggggagtgcaagaattggcgtaccatgatttaccggctctaatatcaacagttttggcgaataagaaatatttccaaaaattggttttattggggcatctgcaaggtggactccagagttttttgatgctcaagaatccacgtttgggagaaatacacgagaaagttgagctcttctgtccattggctcctgcagtatatccaggaaagttattctatactcgtcaattcattaaatttattaataaccgtagtgaattcatgtggttgatattgtttggatgttgtgcatttttgagaaatttgtgtcttgtgagacactacattgcaagttcatggttgtttgggaagttgtcgtactacatgtttaagtatttgtttggatggactgggagaaattggggaccatataaaaaagtgtggcatttctgtttcattttcaatatgagttatgcatcggtagaactaatgaagtattacttgtcaaagcattccgattgtgggtttaccaccttgttacaaccaaaagctgcctattcgagtgatgcacattttaccgagaatgtcactgacgacaaaaaaagttatttccagtttgacactacctggttcagtggcattaaggttcctatgattgtatttataggtgacgaggattttttggtagacggagaaaaagttgttgcacatatgagaaagtatgaacccggatatagagaaggaagtaattttgaggcagtttcgattcccacttacaatcatcttgatatcgtatgggcagaggatgttattggaaccattggatatactatatgtaacaaattaaaacaaatgaaagctcgcgatgtgcaagaggggcttacgctggaaagtaaagaacaggctgttaccatcccggaaggatcttccggtcatcaccaacagcaagaagaatgggtttga

SEQ ID NO: 3800 - DNA, 1239 bp, Candida albicans
acaaatacatttccagagaagatctttttttattgtttcgtaataaatcatctgttttcgctttttctcccaacaatgaaggttaatttgaaactaataatagggtccattttgataagccaagcacaagcaatttggccatttgactcgtccgggtcttcaagttctctggattcatctccatcggaaacaggctcatctggtggaacatttccttttgacttgtttggttcaggctcgtctctgactcagtcatcctctgcccaggcatcatcaactaagagtacatccgattcagcaagttctacagattcctcattgttctctagtagcaattcaggcagttcatggtaccaaacgtttttagacggggattcgggagatcaaaagacagactatgctccatttaatttgacatgtccttcaaaaaaaacatttatacgaacagcatccgagctatctcagcaagaaaaagactatattcacaagcgtcaggaaacaacaaataaaaacttgatagactttttgagtaaacgtgcaaacctttcagattttgatgctaaatcatttatcaatgataatgcgccaaatcataatatcaccattgggttgtcattcagtggtggagggtacagagctatgttagctggtgcaggtcaaatattgggtttagatggacgatacgaagatgctaataatcacgggttaggtggattattagatagttcaacgtatgtggttgggttgtctggtggtaactggttagttggactgttggcattgaacgattggctttcagttggagatatagtgaatgggaaatcaaccatttggcagttacaagactcaatacttaatccaagtggtatgagaattgacaagactattgcttactattacggattggcccaagcagttcaggccaaagaggatgcagggtttcaaacctcagtaacagatacttggggtagagccttatcttatcaattctttgaagaggacgacagtggaactggtggagccaacatcacctggtcaagtattcgtaacctttccagttttcaggaccatctgatgccatatccaattgtggttgccaatggaagaacacctggaacatacattattaatgaaaattctacaatattcgagatcagtccttacgaattggggtcatgggacccttcattgaaatcgtttagtgatattcagtatcttggatcttcagtaaacaacgga

SEQ ID NO: 3801 - DNA, 186 bp, Candida albicans
ttaccgaaggatacactttatttgtgtgacgggggggaagatttacaaaacgttcccttttatccattaatccaaaatgagggtggtgttgatataatattggcatttgatatttctggtgataataattcaagtgggccccaacgttatttcgatacgggaaacttacagacgacaattttttaa

SEQ ID NO: 3802 - DNA, 1833 bp, Candida albicans
gaaatgctagtttggcaaagtatcttgttatttcttgttggttgtgtcttatcaaaatcaccaactaacctttatacaccaggttatgttcagtgtcctgaaggtaaattaactaggtcctcattggatggtatcaattccaatgaaaaagcatacattgatagaaggtatgcaaatgccaaaagtgaattaagcaagtttcttcataatgccaaaatagttgatttcgatgttgatgggtttttggaaacagcaaacccaacaattggacttgcatttggcggtggaggctacagagctatgctagttggtgctggtgaattacttgctttagattcacgagcaactaatccttcagttttaagtgggatcttgcagagttcaagctatattgttggtttatctggcggctcatggctagttggaagtcttgccagtaatgatttgataccagtggatcaacttttacgagaagacaaattgtgggatatacaaaattcattagttgcatactatggagtaaatattgttagaaatactgcaatgtggggtaacattaatttgcaggtccaaaccaaacaattagctggttttactgtcagtataacagatgtctatgggagagctttgagtcaccaattgttaacaaattttgacaatcaaggggcttcatttttatggtcagatgtaactgagaccacatcattccaaaataatgaaatgccatatccaatactaaccgcgttgggaagggaaccaaacactgtgctcatgaatttcaattctaccgtatttgaattaaccccttatgaagtgggttcatgggatccaagtttgagaagctttgttgataccaaatatattggaaccaggcttgatgatggggctcctgtctctaaaagatgtgttaatgggtttgataatgcagggtttttcatgggcacatcctcatctttatttaatatagtgttgcaacaacttaataacatgccaatcccaccattccttaaagagctcattagcaaattcaccctcgaccctgttgaaaagttaaatattgatattgcacaatacaatccaaatccatttcacaaaagcaataattccgataccaaaatagcacaatctcgaacactatatttggcagatggaggtgaagacggtcagaatgttcccttgcttccattgatccaccgtaaggtaagcgcaatctttgcctttgatcaatcggcagataaaaacaattggccagatggatcagctttaatcaaaacttttgaacgacaattctcatcacaaggagatggcattgccttcccatatgtcccagatcagaacactttccggaacttaaatttaactagtaagccaacgttttttggatgtgatgcccagaacttgacatcattaactgaaaatatctatgatgttcctgtggttatatatcttgcaaatcgtccattcacatacttttccaatacatctactttcaaactcaagtattctgatacggaacgacaaggaatgatttcaaatggatatgatgttgcatctcgcttgaatggtaaattggacaacgagtgggcagcttgtgttggttgtgccattatacgcagagaacaagaacgtctaggaatcgaacaaacggaacaatgcaaaaagtgttttgagaattattgctgggatggtacaatatacaaaggtgaacctttgggcgacaacttcagtgatgaaggcttaacaacgagcgcggcagactataatctgaataatgtggctggaattaatgacggcggtattgcgttggttaaacgagatgatctcagtaattga

SEQ ID NO: 3803 - DNA, 1914 bp, Candida albicans
ctaactccacaaatcatggaattattaaatatcatagtggtattgtttctatcaatttatactaatccaataatagcttggtccccaactgattcttatgcaccaggagaaattcaatgtccttcaaattcatcattaactagaaatgccgattcactttcacctcaagaacaagaatggttaaaaggtagaagtccaattgccaatgaaaatttaatttcatttttaaatagtgctaatatgacagattttgatccagaatcatttattaatggattaaatcgttcgattaaaattggtctttcattttctggtggtggatatcgtgccatgttgaatggagctggacaattagccgcattagataatagaactagaggtggttttgaatcaggattaggtgggttattacaagcatcgacttatttagttggattatcaggagggaattggatggtaggtaccattgcttataataattttacttcagtacaacatatattagatcaagattcaatttgggatttaagtcattcaattatgaatcctggtggttggaatattaaaaaaacttataattattataaaaatatttctgatgccttagatgataaaagaaatgctggatttgatgtttcaattactgatacttggggtcgagctttatctcatcaatttttccctggattagatgatggtggtgatgcattaacttggtcaacattacaagatgtcgatgttttcaaaaattatgaaatgccattcccaattgttgttgctgatggtagaactcctgggacttatgttattagtggcaattctactgttttcgaatttaatccatttgaaatgggatcatgggatcctgcagtttatcaattttctcaagtcaaatatcttggtaccgaagttaaagatggtaaaccatcactgaatggtaaatgtattggtgggtttgataatgcgggatttatcatggggacttcttcttcattgtttaatcaattcattttacaaattaatactacatcattatcatcaacgattaaatcacttcttacatcgattttacaagatctttctaatgatgataatgatattgctgtttataagcctaatccatttaaagatagtgatgttgctggatcgaaatccattgcttctaatgatactttatatctttgtgatggtggtgaagatcttcaaaatatccctctttatccattattacaagaacaacgtcaagttgatgttattttcgcttatgataattcggctgatacaaaccaatattggcctaatggtgcctccatggtagcatcataccaaagacaatttgggaatcaaagtaatggtactagtttcccatatgtacctgatgtggccacatttgttaattctaatttaactgccaaaccaacattttttggttgtgatgccaaaaatttaacttcattaacaacaactcaaaataaaactagtgtttatgatattccacttttagtttatactgctaatcgtccattttcttattggtccaatacttcaacgttccaaatgaaatatgaaactaaagaacgtaatgccattattcaaaatggatttgaagtggcaacaagaatgaatttaactttagataatgaatggaaagcttgtgttggttgtgccattattagaagacaacaagaaagacaaggtcttgaacaaagtgatcaatgtaaaaaatgttttgaaaaatattgttgggatggtaaactaacaactaatgctgatgctatcaatattaattttactactgaaggtactactaatgataccgaatcaatgaaagttaatagtggggtgttaacaagtgtaagttggtcattatgggccatgatgttagcagctttaagtgtatttatccttggataa

SEQ ID NO: 3804 - DNA, 627 bp, Candida albicans
ggtagggataggggagacaaactggtattttttgggtgcaattgttcagacttggaagatttggtagcttggcatgaaaacgataaaataaatgttaccgatgttccattagttgtgtacacatcgaacactcgcatgagttacaattcaaacttttccactttcaagttatcttattctgaccaagagaaatttggtgctatcaggaatgggtttgaaacggtaacaagatataatttaacggacgacgaaaattggtcaacgtgtgttggctgtgcaataattagaagacaacaagaacggttaggtgaggagcagtccgatgaatgtaaaaaatgtttccaagaatattgttggactggtggattcaaagacgctgcctctgtctctagtgttagtggaatttcaggacttgcagctaaaacccacacaagtggcggtacattttctacgacccaacaaaccagtaccactaccggatcatcttcaaatggagttcttcgtaaacggggatcttcttcgtcctcgaaaaagaaaaatggtggagacttggttaatggtggtgtactttcttcaattttccttgtttttaatagtttgctaggattaattatagcgtatttgtag

SEQ ID NO: 3805 - DNA, 990 bp, Candida albicans
  unsure (2): Identity of nucleotide sequences at the above locations are unknown.
anacaaaaatacttgcatttctataaagaattactaattgaagtcagagataaaaagaaagctggattccatacctcatttacagattattggggtcgagcattggttagaagaatcttcaaatctacagcaagaactccgggagcaacaatatctgctgccacacacgtattgacttcattcaaagaatacgaccaacctttccccataatcggaaccattgaaaaagatcctagtaatccagaattttcaacaaattttgaatcccattgttttgaattcaccccatttgaatttgggtcttgggattcatatttacatgcatttattccaattaaatatttgggaacatcattgaaagctaatgtaccaaccaagaaatcaaccactgcaaatcattcttattgtgtttctggttttgataatgttgggtttattacaggtacttcttcgtcacttttcaaccatgtatttttttcagtgtataagttactcgaaagttatgaactggatgcagtgtcattaatcgaaacaacattgaaatcacttggattgagttcagaatggaaggcattgaaaaaccccaaactacacgctgattatgccttgtattcacccaatccatttttccaatatggcaagaaaaacactagtatctgggaaagtccagatttgtatttagtagatggcggagatgatggacaaaatatacctttccatccattcttgaatgtagccagaaatgtagatattatattggcatacgatatgagtaatgaaagggataattaccctaatgggaccgtacttgcacgaacatcacaacgttataaacacacaaacaacaccaatattgaaataccgtatttccgcctacctgatggcatcataaacaaaccaataatcaaatcaatattctctaaagttcctacaccaaaaaaattcatcactcatgggattgagcaagtatccaatatttcttggttgtga

SEQ ID NO: 3806 - DNA, 1587 bp, Candida albicans
attcgttgtgagcacactccaatccaaatattggtcttgcatttcagtggcggagggtatagaccaatgttgattggagcaggtgaaatcagtagcttggactcaggaacaaaaaccaatactccagttttagcaggcattttacaagcttcgagttatattgctgggttatcaggtggatcgtggttagttggaagtcttgcaagtaataatttgaactctgttgatgacatgttatctcaaggtttgtgggaactcacacactcatttcttagttactatggcattgaacatcctataaagcaagttgaagaatgggttaatgttggtaatcaagttgccagcaaaagaaatgcaaattttaacgtttctttaactgacatatatggaagactattaagttaccctttgctcacaaacacagaagacgaaggtgatgcttatttgtggtcagatgtaacgagtgcttcaaacttccaaagccaccaaatgccgtttccaatattgatcagtgatggtagagctccagatactaccattattaatctcaactccactgtgattgaattaactccatacgaatttggttcatgggatcctagtttaaatgaatttgttgacactagatatttgggaacaaaattagacaatggtcgtccaactggtaagtgttataatggatttgacaatgctgggtttttcatgggtacttcttctgctcttttcaacgaagcggtgttgtctatcactgaagctaacatacctagctttttaaaagatataattgatgatattttggtagatccaattctcaagtccaacatagacgtgtctgcttacaatccaaatccatttttcaaaagttctggcagcaatactgctatttctcaatcaaaaaatctttatttagttgacggtggagaagatgcccaaaacattccaataagtccctggttgcatcgtaacgtaagtgatatatttgcctttgacaattccaatgacgttttaaactggccagatgggacttcgttggtgaaaacttatgaacgtcaattctcatcacagggtaatggtattgctttcccatatgttcctgatcaatacactttccgtaatttgaacttgactagcaaacctacattttttggttgcgatgcaaaaaacttgacttcattgacaaaggatatttatgatgttcccttggttatatacttggcaaatcgtccattcacttactggtctaatacatcaactttcaaattaacatacgacgataacgaaagacaaggcatgatttccaatggatttgaaattgccactagatcaagtggatccttggatgatgaatgggcagcatgtgttggatgcgccatcatacggagagagcaagaaagacaaggtattgaacagacagaacaatgtaagagatgctttgaaaactattgctgggatggtaccatctataagggtgagccattaggtgaaaactttagtgatgatggattaactaatagtgctaccgaatataacctgaataatgtagctgggtttaatgacggaggaactctgattttgaaaaaggcataa

SEQ ID NO: 3807 - DNA, 609 bp, Candida albicans
caaactatgaaaaaccagactttatgtcaggaagaattacattatattactcaacgtaatgccaaaacggaaatatccctcaaatcattattatatagaaatagaatccccaattttgacattgaaacattttggtcaattaaaaccaaaccaattcaaatagcccttgctatatctggtggaggttatagatcaatgttaacaggtgcaggggtgatattggcattagatgatagatatccaaattcatcattatgtttaaatggtttattacaaagtactagttatattgctggaatatcgggtggatcatggttagtaatgagtaattttattaatgattttgaacctattcataaattacaaaatttgattccagaagaatgggatttaagtgaactgttattacaaggggtacctaattttgatacttcagatttacaaaaaaccccactacaacaacaacaacaacaacaaagaaataaatacaagagtaaaaaacaaggaatgtttagtagtattttggatttgttcacatcaatgaaaagcgccagcaccagtagtagcaccagtagtagcaccagtagtcgtggaagtagtactgggagt

SEQ ID NO: 3808 - DNA, 2142 bp, Candida albicans
ctttcctttttaattaatctcaatatcaaaattatgaatttgctaatttctttattgctattaagtatttccttagtattagggtcatctccaagtggtggatatgctccaggaatcgttcaatgtcctatcaattccaattccaattcaagttcaagttcgagtcggaatacaactttttcatttatccgtgaagccgattccatatctgatttagaaaaacaatggattaaacaaagacaattaaaagttaacaaatctttaattgaatttttaaaatcagccaatttatcaaattttaatcctcaaaatttcattgatgcaaaagattaccaggggattaatttaggtttagcattttctggtgggagttatcgtgccatgcttaatggtgctggtcaattaatggcattagattcaagatcatcatcatctccatcagagtcgggatcaggatcaggatcattaggagggattttacaaagtgctaattatattggtggattatctggtagttcttggttacttggatcattagcaatgcaaggatggccaactgtcgaagaagttgtttttgaaaatccccatgatgtatggaatttgactagttctagacaattggtcaatcaaacgggattatggactattgtgttccccgtcatgtttgataatatgaataaggcattaagtcatatgaatttttgggacaataatgctgatgggattaaatttgatttagaagccaaagagaaagctgggtttgaaacttctttgaccgatgcatgggcaagaggtttagctcatcaattgtttcccaaaggtaaagacaattatggtagtagtgaaacttggagtgatattagaaacattgatgcatttgccaaccatgacatgcctttcccgtttgttactggattaggaagaaaaccaggtacaacggtttataatttgaattctactgttattgaaatgaatccatttgaatttggttcttttgatccttcattgaatacatttactgatataaaatatttgggtactaatgttagtaatggtgtccccgttgatttatgtgttaatggttttgataattctggttttattgttggatcttcatcttccttgtttaatctgtttttgaatactttggtttgtgataattgtaattcattgaattctgtcatcaaatggatactcaaaaaattcttgacttatttatctaaagctcatgaagatgtggctctttacaaaccaaatccatttttcaattcccaatacgccaaatcggataatatcactaccagtgacacattatatgttatagatggcgggattggaggtgaagttataccattgtctacattaatggtaaaagaaagagctttagacattgtgtttgcctttgatagtgataccaacaccaaaacaaattggccagatggatcagcattgatttcaagctatgaacgtcaattttctcaacaagggtcttctagtatttgtccttatgtccccgatacgaaaacatttttggaaaaagggttaactgcaaaaccaacattttttggatgtgatgccaaaaatttgactgcattagagaaagatggtgttatccctccattagtggtttattttgccaatagaccttatgaatattattcaaatgttagtacatttgatttgacatttactgatgaacagaaaaagggtcttatcaagaatggatttgatgttgccaccagattaaatggaaccattgatcctgaatttaaaagttgtattgcttgtgctgttattagaagagaagaagaaagacgtggtattgaacaactggatcaatgtaagaaatgtttcaaaaattattgttgggatggtacttatgctagcggacctgctgaaaattatgtcaattttactgattcaagtttaactaatggaagcacagtcttttatggtaaagcagatgcaaaagtttcttcatcaaaaggtggattgtttggattcttgaaaagagatactcaaaacaacgatgagaaagaagaatttatcggtgttgtacgtgaaagtaactctgatagtttgacattatccaaatatttaacaattgcatcattatttactttgtatttggtaattatgtga

SEQ ID NO: 3809 - DNA, 306 bp, Candida albicans
atttcattatattcattatttgccgctgataagaaacctttaagaatattaagaaatggttgttttaaatatttccaaagaggtggagaatgtgttaacgggccaattggattattgagtggcatgttaccattcccaatgttgttattcaaccattttttcagtgttgccttctattcggtttatttgaattttatagaaagaggacttttgggattcccattggcattatttgaggcatttgaagtgttgttcactgcaattgtaatctttactccatatttatggaacgagattgtaagatag

SEQ ID NO: 3810 - DNA, 255 bp, Candida albicans
gaaactcttgttgttcgatcggcttgggctttgatagggttgatattgggaaattatcctgatgaagagccaatcaaaagaggaattcaatttttgatgaaacgacaattaccgactggtgagtggaagtatgaagatattgaaggtgtatttaatcacagttgtgcaatagaatatccttcatataggtttttatttccaattaaggcattaggtttatataaaaacaagtatggtgataaagtgttagtttaa

SEQ ID NO: 3811 - DNA, 747 bp, Candida albicans
aaggtccaatgtttagaacaattggatagtaaagtgctatttattttagcaagaatggagatacttgagccgtatagagttgagatgatacgttatattgtcaacactgcacacccagtcgatggtggttggggacttcattctgttgataaatatacttgttttgggacaaccatgaattatgtatgtctccggttattaggaatggaaaaggatcatccagttttggttaaggcgagaaaaacattacatcgtttgggtggtgccattaagaatccacattggggtaaggcttggctatctattttgaatttatatgaatgggagggtgtgaacccagctccaccagaactttggagattaccgtactggttaccaattcatccagcgaaatggtgggtacatactagggctatctatttgccattgggatatacgtctgcaaacagagttcaatgtgagcttgatccacttttaaaagagatcagaaatgaaatttacgttccaagtcaattaccttatgagtcaatcaaatttggtaaccagagaaataatgtttgtggtgtcgatttatattacccacatacaaagattcttgattttgcaaattctatattgagtaaatgggaagctgttagacctaagtggttattgaattgggttaacaagaaagtttatgatttaattgtaaaggagtatcagaatacagagtgtcttcaccacggggctggacggtaccgcgcttac

SEQ ID NO: 3812 - DNA, 1218 bp, Candida albicans
  unsure (1209): Identity of nucleotide sequences at the above locations are unknown.
aattcatcaattcaaaaagatatatattattctcttcccaacccaatattttttcaccacctgttgtcaaatttattccacattaaaccaccaatatatacaatgggcaaatttttacaattattatcacatcctattgaacttaaagcagttatacaactttttggatttagacaaccattacatccaggtaaaagagatgttaatgataaagaattggttagatgttatgaattattgaatctaacttcaagatcatttgctgctgtcattgaagaattacatccagaattacgtgatgcggtgatgatcttttatcttgtattaagagcattagatactattgaagatgatatgacgattaaatcatcaattaaaatccctttgttgcgtgaatttgatactaaattgaatactaaaaattggacatttgatggtaatggacccaatgaaaaagatcgaactgttttagttgaatttgataagattttgaatgtttatcatagattaaaacctcaatatcaagatattattaaaagtattacttttaaaatgggtaatggtatggcagattatattttagatgaagaatttaatgttaatggtgttgccaccgttgaagattataatttatattgtcattatgttgctggattagtaggtgaaggtttaactaatctttttgtattggctaattttggtgataaaacattgacagaaaataattttgctaaagctgattccatgggattatttttacaaaaaacaaatattattagagattatcatgaagatttacaagatggtagaagtttttggcctcgagaaatttggtctaaatatactgaaaatttacaagatttccataaagtaaaaacccctgccaaagaatttgctggagtaagttgtattaatgaattagttttaaatgcattgggtcatgtcactgattgtcttgattatttatcattagttaaagatccttcttcattctcattttgtgctattcctcaagtaatggcagtggctactttagctgaagtttataataatcctaaagttttacatggagtggtcaaaattagaaaaggtactacttgtagattgatattagaaagtagaacattaccaggggttgtcaagattttcaaagaatatattcaagtgactaatcatcaatcatcagtaagtgtccaccagccggtaagnggacattgc

SEQ ID NO: 3813 - DNA, 1224 bp, Candida albicans
  unsure (84): Identity of nucleotide sequences at the above locations are unknown.
agtagagctaacacccgttgtccatcaaaaggcaatcttccctccccgggaacgcgagtgaacccagatgcgaggggggagaanatgcccttcctcccgcgccaacccattccttctttacaacacaaccaattaccaattaccaaaaaccaactcattcacttcacaatgtctgataaacttgctgctagagaaagatttcttgatgtttttgaagatttagttgaagaattgaaacaaattttagtttcttataatatgcctcaagaagccattgaatggtttgttagaagtttaaattataatactccaggaggtaaattaaatcgaggattatctgtagttgatacatttgccattttgaataatactactagtgataaattaaatgatactgaatataaaaaagttgcattattaggttgggccattgaattattacaagcatattttttagttgctgatgatatgatggatcaatctaaaactagaagaggtcaaccatgttggtatttagttgaaggagttaacaacattgctattaatgattcatttatgttagaaggggccatttatatcttgttgaaaaaacatttccgtcaagatccttactatgttgatttattagatttatttcatgaagtcactttccaaactgaattaggtcaattattagatttaattactgctgatgaagaaattgttgatttagataaattttctttggaaaaacattcatttattgttattttcaaaactgcttattattcattttatttacccgtggcattagcaatgtatatgagtggtattaatgatgaaaaagatttaaaacaagttagagacattttgattcccttgggagaatatttccaaattcaagatgattatttggattgttttggtactccagaacaaattgggaaaatcggtactgatattaaagataataaatgttcttgggttattaatcaagctttattgattgctacccctgaacaacgtcaattattagatgataattatggtaaaaaagatgatgaatcagaacaaaaatgtaaagatttatttaaacaattgggtattgaaaaaatttatcatgattatgaagaatcaattgttgctaaattaagaaaacaaattgatcaaattgatgaatctagaggtttaaagaaagatgttttaactgctttcttaggtaaagtttataaaagatctaaatag

SEQ ID NO: 3814 - DNA, 942 bp, Candida albicans
  unsure (2),(69): Identity of nucleotide sequences at the above locations are unknown.
tntatggatggatttggaacaaggtcaagccatattcaaagaagctttccattcaaacttctggattgnctcggtttacaacatattcaaacggcctttgttggaacttcattatttatacgattcagaactattactggtgatgccatgggaatggatatgatttcaaaaggggttgaatattcattgaaatatatggttgaagaatgtggttgggatgatatggaaattgtttccgtgtcaggtaattattgtactgataaaaaaccagcagccataaattggattgaaggtagaggtaaatctattgttgctgctgcccgaattcctgctgatgttgtcactaaagttttgaaatctgatgttgatgccttggtggaattaaatatttctaaaaatttggtgggatcagccatggctggttcagtgggaggatttaatgctcacgcagcaaatttagtgacagcagtatatttagcatgtggacaagatccagctcaaaatgttgaatcgtccaattgtatcaccttaatggaaaaggataaagaaacgggtgatttgaacgtttctgtgtcaatgccttcgattgaagtaggaaccattggtggaggtacgattttagagcctcaaggagctatgttagatttattaggtgttcgtggtcctcatccaactaatccaggtgcaaatgctcaacaattggcgaaaattgttgcctcagcagtattggccgctgaattatctctttgttctgctttggctgctggtcatttggtccaatcacatatgcaacataaccgtagtaaagcacctgctgctggtgctactactactactactccggcaattactgattctaaagctagtaatggaagtattgcaagtaatgggaaagatttgaaacgtcttgaagaaggttcagtaacatgtattaaatcttag

SEQ ID NO: 3815 - DNA, 1014 bp, Candida albicans
ttggatttaaacataaagtatcaattgctactattgttgccaattcttcaacagcatcacccagaagatgtccctcatgttgttggtaaagcagaatcttctcattgtttaagtatgttgagagatcatttagtggttattggtggattactttcatgtgccatatatgctcatcatttaaccgggttgagaaatttttgtattttaagttcattgattttatcatttgatttgattttagtttatacatttttttccgccattttaggtttaaaagttgaaattaatcgtgctcgtcgtactgaagatttacagaatgcattggaagaagaaggtatttcttcattggtggctgcaagagttgctgaacaatcagctactattgaacatcctaatgaacataattttttcaaatcaaataattcttccattgcttattttaaagtcataatgagtcttggatttttcgctttccatgcattttggttaggcagttcttggttatatagtactactgacggtggtgaaagttttagtcgtttttcattcctttccaatattccaactttaagtcaagatatttctcagcaaattcctattggtagaaaaggtactgtggtaaccattttaccaacgatattttttatgccttcaggatttatggtacaattggaagatttcatttatcttgtgttgagtaaatttagcagtgccattagagatagtataatttccaagtttttggtgtttggatttgctctttcaattgttactaatgtttattttttgaatgctgctcgttatcaagttagtgctactcataaattaattgaaaaagaaatttcccgtcctcaggatagtagtgtcaccgccactactaccactactgcaaccggtactacctcttctggtgctgccacttccaaagctattggcaataacaaagggttgaaatcagttcaagaaattcctgacaatgaagatgattttcaacaacccgtggcagatcatagt

SEQ ID NO: 3816 - DNA, 870 bp, Candida albicans
ttagagagatccattatgcttagttttctaacagaagtgactggtgctatagcacaaacttctgctcgtcgaccaattcaatttatggttgtacctgctttattagcatccatcgcgtatttatcaatcattgacgattatattcctgaacatattaaatctagttctggttcatcgggtataagttattatcatccttatacttcttctcattataaatctcaacccgatttggataaatggactgctattgataaagaacatattaatgatgatatttacactcaagctaatcaaattagtgttataccattaagatttagaagatttcaagatgttgttcctaatgttcctaatgccattcacatttctgataatgaacaaatattaattgtcccaactgatcaaattgaaaattctttagatcaattacaagaaatcactaataatggtattacttggaaagcaagaaataatgacaaattggcaaaatattatgattatattagatatggtttaaataaagttcaagatgccattcaacatgcagaaaatttcgatatacttttaatatttgtcgcctatcttggtatgtggtatgcattaattaaagtatttgttgatatgagaaaaattggctcgaaattttggttagcattttcaactttaacatcatcaacatttgcatttttattggctttattggtgtccaataaatttttacatactaaagtttcattattaagtctttcagaaggaattccatttttggtttcagtaattggatttaaacataaagtatcaattgctactattgttgccaattcttcaacagcatcacccagaagatgtccctcatgttgttggtaa

SEQ ID NO: 3817 - DNA, 402 bp, Candida albicans
  unsure (10): Identity of nucleotide sequences at the above locations are unknown.
gaagaaacanatgttttgagaaagttggtgaatattaatcatggtttattggtagcgctaggtgtatcacatccagcattggaaacagtaaaaattattggtgataaacatagaattggggcgactaaattgacaggtgctggtggtggaggttgcgcgatcactctagtgaacgacgatgtagaagaatctgtcatacacaatgctatcaaagagtttgaagacagtggatacgagagtttcgagacttcgttaggtggtaaaggagtaggtattttgttccatgaagatttagacgatgccacaaagttctcagagtcccaaatttgcaattacgtagatcgtgccgctattgaggattcgttaggaatggcaaatgtgaaagaatggaagttttggtga

SEQ ID NO: 3818 - DNA, 654 bp, Candida albicans
ctaatgtcacaattgccatttattgttggtgctccaggtaaagtgattatttttggtgagcatgcggctgtctacggtaaaccggctattgctgcggccttgagtttgagatgttatcttttggtttccccttcatctgattccaataccattagattgcaattccctgatatcaaattggatcactcttggaatatcaaagatttgccatgggaggagatcaaaccatatttgacttatgacagtgcaaacaaaccacaaataccttcagaattggttcctgaaattgtggacaagttatcaagttttttgaatggttttgataacaaaatgcattattatgcttgcttttgttttctttacttgttgatgaatttatgtgattcaaaagtgtcgggaatgaattttattgtcagatcaactttacccattggtgcaggattgggatcatctgcttctacatctgtatgtttatcatcagctttggcacttatgggtggttggatcaacaaaccgctgttgcatgaaaatgataagttggatacagctgatatacctgatttggagtttattgataagtggtctttaattggtgagaaatgtttccatggtaatccatcagggattgataacgcagtggctacttttggatga

SEQ ID NO: 3819 - DNA, 1230 bp, Candida albicans
  unsure (1194): Identity of nucleotide sequences at the above locations are unknown.
gagcgctggtccttccagcctcgtggtgaagacaaagcatttagtgcacctggaaaagcatttcttgctggtggatatttggttcttgagccaatttatgatgcttatgtgacagcattgtcatcacgaatgcatgcagttataacaccaaaaggaaccagtttgaaagaatctagaatcaaaatttcttcaccccaatttgcaaacggagaatgggaatatcacatatcatcaaatacagaaaaacccaaagaagttcagtcacgcataaatccatttttagaggcaactatattcatcgttttagcttatattcaaccgaccgaaccatttgatcttgaaatcatcatttactcggaccctggatatcattcacaagaagatactgaaaccaagacatcctctaatggagagaaaacatttctttaccattctcgtgccattaccgaagtggaaaagaccggattaggttcatcggcaggattagtgtctgttgtggccacaagtttattgtcccatttcattcctagtgttatcagtacgaataaagatattttgcataatgttgcacagattgcacattgttatgcccaaaaaaagataggatctggatttgatgttgcaactgcaatttatggtctgattgtatatagaagatttcagccagctttgataaatgacgtgtttcaggttctagaaagtgatcctgagaagttccccacagagttgaaaaaattgattgaaagtaactgggaattcaaacatgaaagatgtacattaccatacggaatcaagttattaatgggtgacgtcaagggtggctcagaaacacccaaattggtatcacgagtactccaatggaaaaaggaaaagccagaagaaagctctgttgtgtatgaccagcttaatagtgccaatttacagtttatgaaggaattgagggaaatgcgtgaaaaatacgactcagacccagagacttatattaaagagttagatcattctgttgagcctttgactgttgcgattaagaacatcagaaaagggttacaagcattaacacaaaaatcagaggttccaattgaacctgatgtccaaacccagttgttggaccgttgtcaagagattcctggttgtgttggtggtgtggttccaggtgctggtggatacgatgcaatagctgtattaatgtggganaatcaagtgggaaattttaagcagaaaactccttga

SEQ ID NO: 3820 - DNA, 765 bp, Candida albicans
  unsure (762): Identity of nucleotide sequences at the above locations are unknown.
attccaacttcagaatattcattcagatctgaacatttctttttctccgatcatcaattggcaatgtcaaaagcatttagtgcacctggaaaagcatttcttgctggtggatatttggttcttgagccaatttatgatgcttatgtgacagcattgtcatcacgaatgcatgcagttataacaccaaaaggaaccagtttgaaagaatctagaatcaaaatttcttcaccccaatttgcaaacggagaatgggaatatcacatatcatcaaatacagaaaaacccaaagaagttcagtcacgcataaatccatttttagaggcaactatattcatcgttttagcttatattcaaccgaccgaagcatttgatcttgaaatcattatttactcggaccctggatatcattcacaagaagatactgaaaccaagacatcctcgaatggagaaaaaacttttctttaccattctcgtgccattaccgaagtggaaaagaccggattaggttcatcggcaggattagtgtcagttgttgccacaagtttattatcccattttatccccaatgttatcagtacgaataaagatattttgcacaacgttgcacagattgcacattgttatgcccaaaaaaagataggatctgggtttgatgttgcaactgcaatttatggtctgattgtatatagaagatttcagccagctttgataaatgacgtgtttcaggttctagaatttgatcctgatgatctccccagagcnttg

SEQ ID NO: 3821 - DNA, 1050 bp, Candida albicans
acccttaagtattgggggaaacgagacaagtcgttgaacttgcccaccaactcgtccatctccgtcaccttatcccaagacgatttgcgaaccttgacaaccgcttctgcatctgaatcattcgaaaaagaccaattgtggctcaatggaaagttggaatcattagatactccacgtactcaagcgtgtttagcagacttgagaaagttacgtgcctctatcgaacaatcccccgacacccccaagttatcacaaatgaaattgcacatcgtctcggaaaacaatttccctactgccgcaggtttggcatcgtccgctgctggctttgcagcattggtttcagcaatcgcaaagttatacgagttgccccaagacatgtcggaattgtcgaaaatcgcccgtaaaggctccggctcagcatgcagatcgctctttggtgggtttgtggcctgggaaatgggtactttacctgacggacaagaatcaaaggccgtggaaattgccccattagagcactggccatcactcagagcggtcattttggtggtcagcgacgacaggaaagatacacccagcaccacaggaatgcagtcgactgtcgcaacctcagacttgtttgcccaccgtattgctgaggtcgtcccccaaaggttcgaggccatgaaaaaggctatcctcgacaaagactttccaaagttcgctgagctcaccatgaaagattccaactccttccatgccgtttgtttagactcctaccccccaatcttctatctcaacgatacgtccaaaaagattataaaaatggtagaaaccatcaaccagcaagaagtcgttgctgcatacacttttgacgccggtccaaatgcggtcatttactacgacgaggccaaccaggacaaggtcttgtccttgctctacaaacatttcggtcacgtcccaggttggaaaacccactacactgctgaaactcctgttgctggtgtttcgcgtatcattcaaacgtctattggcccggggcctcaagaaactagtgaatcattaactaaataa

SEQ ID NO: 3822 - DNA, 186 bp, Candida albicans
aattataatgaggttaaagatttcaaatatgtcagtgctgatgaattgaaagtcatgtttgaagatgactccttggtgtttaccccatggttcaaattgatttgccaatctttgttattcaaatggtgggataacttggacaatttagatcaattcaaagatgaagaaatccatcgtttactctga

SEQ ID NO: 3823 - DNA, 543 bp, Candida albicans
tttccccgaaaatgctcgttgatccgtctactccgaggtgaagactctgagagcagtgattctgatttatttgatggtcatgatgaagaacaaattagattaatggaagaattgtgtatcgttttagattatgatgacaagcctgttggtgcaggaacaaaaaaattgtgtcacataatggataatattaatgctgggttgttacatcgtgcattttctgtgtttttattcaatgaagatgggaaattattattacaacaaagagctgatgaaaaaatcactttcgcaaacatgtggacaaacacttgttgctctcatcctttatgtgttccaagtgaattgggtgttgattcgtcattggaaggtgctaaagatgtctacaatttgactaatgctgttaagggtgctaaagttgctgcacaaagacaattggaacacgaattgggaataccatttgaagatgccccaatagaaaatttcacctacttgactagaatccattacaaatcaccaagtggtgacgaatcttcccaatggggggaa

SEQ ID NO: 3824 - DNA, 465 bp, Candida albicans
cgacaaagtggtaaccgtaaaatgtcgttattggatgacccaaatgctcgtgctggcacttcaaccaccgtcagcaatgatccatactcgggaagcaaatttttggtgtggcaagtggctccaagacctaaagttccattcaatttgactgcatttgctgttaccttgaatgggcttgatgataagttgaaaccatggttacctccaactgatacaagattgaggccagatcaaagagacatggaagaaggtttatatgatcgtgcagctgatgaaaaacatcgtgttgaggttaagcaaagacaagccagaaaacagagggaagataacaaagagacctatgtaccgaattggtttgttaagagaaagcatccagtgactggtgatatgttttgggagtataatggaaagtattggcctagaagaaaggcacaagatttggcgaacacgggagacatattttag

SEQ ID NO: 3825 - DNA, 693 bp, Candida albicans
aaactgccagctacagtactgattgttaatgatatttttgcctatttatgtggaatcacattcggtagaacccaattgattgaaataagtccaaagaaaaccgtcgaagggtttgttggtgcttggatatgtactggtattgctggggtcattgcatcacatatattatccaaatcagattatatgatttgtccagcacagaatttgtcaactcatttatacaatttccctcattgtgacttgaatcctatttatatacctcaagtatatcaacttccagctaatattgtggagcttactggacacgagctcattacttttaaaccattctatttccatgcagcaattttagccacttttgcttcattgattgctccatttggtggattcttcgctagtggattaaaacgtgcatttggtatcaaagatttcggtgatactattcctggacatggcggtataactgatagatttgattgtcagtttttaatgggatcattcacatacttgtattatcatacttttgtctccaatcaaaacgttaatttaggtcatgttttacaattggccataatgaacttatctgtaccacaattacttcaattaatcaagagtttgttgaaatatttgaaccgtgaagaagtacttacttctgaacaattgctgcgtatttttgatatattggaaaattga

SEQ ID NO: 3826 - DNA, 738 bp, Candida albicans
  unsure (12): Identity of nucleotide sequences at the above locations are unknown.
tataggttatcntactcttatatcatgatttcaaatggaaaagacactagtctaaaacaagttgaggctgaggttagcaccaaatcaacttcaattaccccaaccaaaaatgaattgtttaattctacctctaaaccaaccccaacaaatgacaagagtaccgaacaaactaaagagcagctagtggttaatgaaaaggaaaagaaaaagcaggcatttgtcactagaacaatttggacatttgttatgattggtgggttcttcgccatattagcatcaggtcatctagcattaattattatggtttcagttttccaaatgttaacattcaaagaagttatagcattgacatctgaaccagcaagagataaaaaaatcccttggaacagatcattgaattggtatttcttgggtacgacctggtattatttagatttcccggcattgtttgattttttccaagaatcagtttattcaagcaaatttttgacattattagtgaaaaaccataaatttatcagttattcattgtatattgctgggtttgtattttttgtttggacattgaaaaaaggatactatagatttcaatttgcacaattttgtgtgactcatatgacattattattggtagttttccaagatcatttgattattgataatatattacagggtataatttgtttctttttgccagctacattagtgttttcaccaggcggtcgggatccgacttaa

SEQ ID NO: 3827 - DNA, 270 bp, Candida albicans
agacaacgtggtcccttaagtattccaaaccctaaacaatttgtcacttctactttgaatggtgttggccgtcgtaatggtgctcaagaaagatttgcaacttcaactccatactggactcatgccttgatgcattttgcaatcgataatactgttggtgtttattcaaaaattgctaacaaattgaacttgcaaatgcatcaatctatccgtcgaagagctctaaagaaggctgctagattggctgctgctgctgaaaagaaagattaa

SEQ ID NO: 3828 - DNA, 675 bp, Candida albicans
gaaaactatttaaaattggaaaaagctgtgtttgatttacctgttaccatattgattaataatgtcgggcaatcccactctattccagttccattcttgaaaactgaaaagaaagaattgaaagatattattactattaacactactgccactttaagaatcactcaaattgttgctccaattatcgtttccaccgttgaaaacccacacccaaaacaattgcgtggattgattttaaccatgggttcatttggtgggttattaccaacaccatacttggccacttattccggttcaaaatcctttttgcaagcctggtctgctgccttggctggtgaattacaagctgatcatgttgatgttgaattggtcatttcttatttagttgcttctgccatgtccaaaattaaacgtacttccttaagtattccaaaccctaaacaatttgtcacttctactttgaatggtgttggccgtcgtaatggtgctcaagaaagatttgcaacttcaactccatactggactcatgccttgatgcattttgcaatcgataatactgttggtgtttattcaaaaattgctaataaattgaacttgcaaatgcatcaatctatccgtcaaagagctctaaagaaggctgctagattggctgctgttgctgaaaagaaagattaa

SEQ ID NO: 3829 - DNA, 750 bp, Candida albicans
cttcaacgacattggtgggcaatgaaaaagaaaaaaaaattttttgcgtgtaattttttttttctttgttgttccacactcatgattagactttatccaggcataagacctttgcgtacaggggttgttcacttttccaccaaacaggctatacggtcatcgttgtggactataccgaatgtgttgacatatacacgtattattactacaccgtttattggatactatataactactggccagtctactgccgcgttgctgttgttcacgtactcgtgtgtcaccgactttgttgacgggtacattgctagaaagtacaacatgaagtcgattgtggggtcgattgttgatccgttggccgataagttgcttatgacggtgtgtacggtgtcgttggggtatgttcatgcgattcctccggtgatagcaagcataataattggccgcgatgtgatgttgagttttatgtcgttctactataggtacaagagcttgccggcgcccaagacgtttgataagtttattagcattggccagattccgactataagtgtgcaccccaatatgttgggcaagatcaatacggcgttgcagatggtgtacattgggagtttggtgtaccgcccgttggttgagtcggttgtttctggggccgtttatgatgggttggggttggttgtgggggcgaccacattggcgagtggggccaactacttgtttagcaaaagttcatggagatatgtaaaatga

SEQ ID NO: 3830 - DNA, 942 bp, Candida albicans
cattttatccccccactcatattcatacttcatactcgtactaataaaatttcaacaattatgtcagccgtttcatcattctttactaaactcaagttttatctcaaatcaggactttatggaacccttgttgctggatgtgccatatatggtgtattagcatcgattatattaagaattgttaataaagctgaatatgctcaatatgcagttgctaaagcttgttattatgttgttagtttatttttgggattaaaaattaatattaaaaatgaaaaatatttacaaaatcttcctgctatagttgttgctaatcatcaatcagcattagatatttatgttttagggaaagtttttcaacctggttatactgttactagtaaaaaatctttaaaatatgttccatttttaggttggtttatggcattatcaggaacattttttttggatagatctaaaagtgcttctgctaaaaaagttttagatggagctttaactggattgaaaaatcaagggaaagcattatttattttccctgaaggtactagatcagctactgaggatttaaccatgttaccatttaaaaagggggctttccatttggctagacaagcgggaattccaattatccccgtggtggtttcgaatacttcaacgattttcaattctaaacggaaaatatttaatactggagaaatcaatattgaagttttaccaccagtttcaacttctgattgggaaactcatgaagatgtcactaatgcttgttataatattagagatgatatgattaaaactttgaaaaaattgggtaattctaaaataccgggatctaaaccaagagaagatttttatccttctgaatcggaaaaatattcagaaaccgatgtggaaataattaatgaacaaactccattaaaagctactgctgtttctgattaa

SEQ ID NO: 3831 - DNA, 1254 bp, Candida albicans
cataagcgtggtctgcgattccgaggtgaaaacaaagtacaggccacttcagatgagttgccagtcaatgaagaagtaaaggaggaggaagtacctttggcgctgactgaggagcaagaggaaactccatcaattgttgtaaatgaggaagctacaagctctttgaacttggatgagaaatcatctattgctcctccaacagtaattgagaataaagaagtagaagttttggaattggatgagaagctggttgctccttcagatgtaaccaaaatcgaggaaacaaacaatgttgaagagggagtgtctccattgacagttgaagagctgaaaccagcggctccagttgaaccacaagtaccaggtgatgaaggtcttactgaagtgcaaaggagagtaaaccatttacttcaagaagaaggttcattccttggttatgaaaacccgccaagaaagaaattatcaatggatgaagataatagaccaaaagtcgggttgtgggggatcttgaaatcgatggtgggtaaggatatgacgagaatgacccttccagtatcattcaacgaacccatttctttgttacaaaggttggcagaagatattgagtacaattcgttgttaaacacagctgcagggtatgatgactcaacattgagattgatatatgttgccacttttgctgcaactgagtattcttcaaccatagacagaattgctaaaccatttaatcccttgttaggggaaacttttgagtattccagacctgaccaaaactttagattatttgtggaacaggttagtcatcatcctccgattagtgcttgtcgagcagagtctcccaaatgggactactacggagaaaatgcagtagactcaaaattttatgggagatcatttgattttaagcacttgggtaagatgttttgtgttattagaccggataagggagtaagaaataagaatggggaattagttgaagaagaattgtacagttggaaaaaagttaacactgctgtggtgggtattatgcttggtaaccctactgttgataactatggtaaaatggttgttgaaaaccatactactggtgacatcattaccgttgatttgaagcaacgtggttggagagcttcgtctgcttatcagttgtcaggacacgctttagatagagatggtgttgcccaatgggccatgggaggtcattggaattcaaagattttcgcaaagaaaattgtaaatggtaatatcaactaa

SEQ ID NO: 3832 - DNA, 2349 bp, Candida albicans
cttcctgcaaacccaacattacaaacacaggaaattgttcagttgaaagaaacaatattgcattatgctgtgcaagtggcatccttggccactattcaacaccttgtgaacaattgtgaaaagtattcattggacatcaacgctcaagatacacagggtaacactccattacatttagcagcatcgtcttcccggttagatgtggtgaagtatttgttactgttgcctacgatcaatgatacaatcgtcaatttggatagaaagcaaccagtagaggtttgtaaagatacaaatattgcccaattaatgcagtttgaaagggcaaagtttgttgagaaggcagccaccaacttacgaatttacttcagtaatagagactttgataatttagaaaatattttaatagctaatcctagagcttcggaattgttggatatcaatgggactgagccacaaactggtaataccgttttacacgaatttatcaaaaaagatgatttggcaatgtgtgactggatcttgaaacatggaggcgaccctttcaaaagagataagcatgggaaattacctattgatttggtaaactccaagaatgaagcactcaaaaagttactcaaggcagcttcgaaagaccaaaccattatggaccctgttgctacaactaacaatgctataaaaactggtggtgcgcccgtatataaaggttacttgcgcaaatggaccaattttgcttcaggatacaagttgagatactttgttttagaccataatggaatcttgtcgtattataccaatcaagatgacaccaacaattcatgtcgtggatcacttaaccttggatatgccactttgcatttggactcttctgaaaaattgaaatttgaaatctatggtaaaaatggattgagatggcatctcaaagcaaatcatccaattgagaccaatagatgggtatggacattacaaaatgctatcaccatagccaaagataacattaaaaagagaaaccttaacggcgaacgtagaagtaccccgtcaccagcaacaatcgaactggcaacaacaaatgaaacagatactcaacatgaacacagcaatgaaccagagaaaaaacgacaccgtcttagaattcctggtagaaagaaacacaaacgtatttctagtctgtcttcatttgagtctggcgatgaatcaactggtgaattatctcgctcatctaccttcaagaacaatttgaaagatatcaaagaaggatcaaggttgactggtatttcaaccactcaaggtgctccatttgagttactgtcaacacgtaaaaccagtcacgaggatcaatatagctatcaagaaactgataacgaaaattttgattatgatattgatgattatgatgctggcgactatgatagtgaaacagaagctagtgttgatatcgatcaattgaatgattcaattgctactactagaagatctttacaagttgaattgacatcattattggagttgatgaaaagtttgcaagacgataagttattatccaacgacgacgccaaagttaatgaaatatgtgttattggtggaaataccattaaaggtattcatgacttgatggccaaatatgatatcagtgtagatgctaggtatggaaaattgaaaaaaaacttggaccgacaattagaagtaaatgctttatgggaaagatcaatacgtcaattagaaaatgaaattgccgaaaaggattcgaaattggcacatttacaaggtcaaaggaaacaattaaagaaatactttactacttcaagtgctgctatggcaaaatctgcaggtacggtgtccccagctccttctaacaagaacttgagtaacgaagaaaagcaacctgagaacaaacaagcattgacagaagttttgagagaagaaccagatgaaacgcaaattgaagaagtcgatgaaaagttggacaagttactgaatataaaagaaagacaagtggtggaagaagcaccacaaatgccaggtgcacttcccgatgaagtaattgaaaaatatttgggcgaagactcagacgaagatgacgaattttttgatgctgatgaatttgaagaagatggcttggaaaatgttgagttaggaggagttgctgctgctttgggagctgcccaagcaaaagtagaggccacttcaaatgagttgccagccaacgaagaagtaaaggaggaggaagtacctttagcgctgactgaggagcaagaggaaactccatcaattgttgtaaatgaggaagctacaagctctgtgcacttggatgagattcatctaattgacccgccacgggtagaattaaagagt

SEQ ID NO: 3833 - DNA, 369 bp, Candida albicans
aaaaattgggatttattgtatatggagctgatgattatccctgtgataccatttttattgtttgtgccttcaaaaatgccagctgtatctcgtatgctttatgatatgggtatagcagttgttattgttagttatccagcaacccccttgacgagtgcacgtgccagattatgtgtcagttcggcgttgaccaaagaagatttagattatgtgttggccaaaattagtgacattggtgatttggtatttttgaaattcagtagtggtattgctggtggatgtaaagttcctggtgaaccacctcggtggtcaattgaagatgttttagctactaatgtcgaagattgtaaaaaaccaaaactaatgtaa

SEQ ID NO: 3834 - DNA, 936 bp, Candida albicans
aattatcttgggtttgctcaatcaagtggtgtttgtactgatttttctgttaaatgtgttgatgattatggaacctctggttgttcaccaagactttattgtggaaccactgatttgcaccgtcaatgtgaagaggtcattgctgattttgttggtaaagaagatgctatcattgtcagtcaaggttacgggactaatgccaatctatttgcgtcaattgcagactctaaaactttggttatatccgatgagttaaatcatgcatcaattagatttggaatcagattatctggggcttcggtcaaagtgtttaaacataatgatatgaatgatttggaaaaccttatacgtaatcaaattgctcaaggtcaacccaaaactcataggccatggaataaaatcattgttgctgtcgaagggttgtattccatggaaggtaatatgtgtaatttgccagagattgttagaattaaagacaagtacaagtgctatttgtttgttgatgaagcccattctattggggcgttaggacctgaaggaagagggatttgtgattatttctcagttgacccagctatagtcgatgtattaatgggtacattgaccaaatcttttggtgccactggtggatatattgctggtgataaaaccttgattgaaaaattgagactcaattatataagtcaaagctattcagaaggagtgccaccgccagttttaggacaaattatttcttcgttgaaagtgattaaaggtgaattaaatcctggtgaaggtaaagaaaggttacaaagaattgcctttaattctcgttatttaagattgggtttgaaaaaattgggatttattgtatatggagctgatgattatccctgtgataccatttttattgtttgtgccttcaaaaatgccagctgtatctcgtatgctttatga

SEQ ID NO: 3835 - DNA, 336 bp, Candida albicans
ctttttcttttttgttccaaaatgatatctgaaactatggtagaaaaaaatgggaagctttacctgagaaatattccaaacgctccagaagataatagacctttaagtgagagaagtgatcgagagtatggtaaattgacatcaaacgattatttatatgtgtcaaaacatccattgggagagccattaccaactccaatagatgatgaaccaccttacattatattaattgccacatatatcaattatttaattttaattatcattggtcatactcgtgattttttcggtaaaatttttaaacctaaagaatacgaacatctagttggaaaaaga

SEQ ID NO: 3836 - DNA, 858 bp, Candida albicans
attcaacattaccgcatttttgaaattagttatcaattcaatcttaaaataaataaccctcgttcatcatttgatattgaccctttacacaaaccaattagtaacaatcatgaacaacaccattcaggggctaaccatactatcaaatcaccacaaccagtatcacaaccaactgcagaccctatttcgatacctcaaaaaacaaaaactataacaagttcaacaacaacaacaacaacagaaaccccgaaaaatattcgaagacacacttctcctatgcctatgcctatgctaccgagaagaagtttggatggtcacgttggatcatcaaaattacaaaaactcacttcaagaactgattctgccattgccttgactcgacattcaataaatatagatagaccaaccaatagaagtacatttggtggaacgggttcaccacgtgctttacctataagttatactcatgaaattcaacgaatgagagattcaattttattgaaacgacatatgaagaaaagaccaactgaagaagataaagtgttggtggggaataaaatcagtgaaggtcatgaaaattttgtcatggcatataatatgttgacgggtataagagtggcagtttatagatgttctggagtaatgagaaaattgactgaagaagattttaaagcgactaaaaaattatcatttaattttgatggtagtgaattaactcatagttctaaatatgattttaaatttaaagattattgtcctgaagttttccgagaattgagacaaatatttggtattgatcatgctgattatttagtatcaataaatggaaaatatattttgtctgaaagagctgacccg

SEQ ID NO: 3837 - DNA, 582 bp, Candida albicans
  unsure (542),(578),(579): Identity of nucleotide sequences at the above locations are unknown.
atttccgttttattattaaaaccattcatcattctgaacataaaccaattgttaagaatgttaaaagattatcatcatcatgttaaagataatcctaatacattaatatcacaattttatggattacatcgagtgaaaatgccattatttggtggtgggagtcgtaaagtacattttgtggttatgaataatttattcccacctcatcgtgatattcatcttaaatatgatttaaaaggatcaacttggggtagaaataccaccatctttccgggatgggatgaaaaagaattatcaaaacatacattaaaagatcttaattggttagaaagacatcaaaaaattcaatttggtcccgaaaaacgacatatttttttcaaacaattagaagcagatgtgaaattattacaaaaagtcaatgtaatggattattctttattattaggaattcatgatgttaaaaagggaaatactgctgatattgaaaaacaattatcagtttttgaacctaaatcttttgataaacgtgcccttataaatantaatcctagagatgtacatcgtcaacaagattcacnntaa

SEQ ID NO: 3838 - DNA, 1011 bp, Candida albicans
tcccaagctatgtcaacaaatactatatatgatgatcattatataaaaatgaatacacttttcaaatcgatatatactcaaactaaacttaatatttatgaatttttatttgctatttcatttctagtaaattttatacttggtcgattcattcatttttcagcacctgatgaagaagtttataattattataataataaacggaatatattgaatcaatggtttgttaaaaaaggttggggttggacaactttggtgattattttattttattccaatatcatttataaacaatacaacagcaaagcaacaactaatactactactactaataataataacaacaacaaacaaggggtgatagttcagacaattcgtaatgcggttattaattatattgttgttactatatggtggatatttttcactcaatggtgttttggattacctataatggataaaatttttgtattaactggagggaaatgtagtattgacaccaatagtatggcacatttcaatcctaatcatcatcatgttcatgccaattttgtacaaaaattggaaaatatttgggaatctaccgggataacttcctataattgtcgtagaattaaaggaagtcaatggataggtggtcatgatcctctgggtcatgtatttttaatgattcattcatcattatatttatttaatgaaatgattaattattggcctggttggacttatattaaacataatatttctcaaatattgacaagtggtaatgataatggtaatgataatggtaatggtaatggcaatggcactagatctttaagtattggtgataaattgttattattatggaatactccacaattgataattggagggttgattggattatggtggtttatgttattaatgacaaatatttatttccatatgagtttagaaaaattggtaggtttgggatttggttatattggtgttgcaggattatattggataccgagatggttattataa

SEQ ID NO: 3839 - DNA, 726 bp, Candida albicans
tgccgacagtcattattaagtacagagtccatctgccatttaaagagaatacaagtgacaattccgacgcaacctttcaacgataagaactcttccactaattgcaacaatccactagtgtctttcttaacctacgggcaatcacaccagaactatcatcatgaatttccgcatgattatcgtgttgacaatagttatttaacttatgaccctacaaaatggttcatatggattttggagcagttgggtgcagtagatgagttatctcgaactcctggtaacttgattgtgcagttgaaattacaacagcaacaactaattattaatagaacaaagagtcaattgaactggggcacgccgatttccaagctacctttaatttcaccaagtgatttcaaaaagattatatcatcaacctcgaacaaggatcgtatatatatagttatccagaatatcattcacgatataactccattcatggaccagcatcctggaggggtggcccttttgaaggcttcacatgggaaagatgccacaaaagctttttatggtggtgtatatggtcatctgactgccgcggtgaacttattagcaacaatgaggattggagtcttggatgacggcgatgacgaagaagtttggagacgagttgccagagaagaaagggaagtgtcgaattctactgactctagaccaggccaccatcacactgctgaagcagcatag

SEQ ID NO: 3840 - DNA, 927 bp, Candida albicans
catttcacaatgactacagttgaacaacttgaaactgttgatatcactaaattgaatgccattgctgctggtactaataagaaggtgccaagagtagtggctgctgggttaggtggtaaattaatgggtacctccgatttagttaaggtcactgccgaagaaatcaccaaagactcaatggaatcattggccgaaaaggatgccagagaaaaggcaaaatatgccaacaagaaacacatttcagaagagccatggactttagacaattttgccaaaaaaatcaattggcttaacatgattttggttgttttcatccctgtatttggagcttactgcgcctggaattacccaccccaatggaagactctagtgttgacatttgtcatgtatgcctttagtgggatttccattactgctggttaccatcgtttgtattctcataaatcatatgatgctgctttgccagtgagacttttctttgcctttttcggtgccggtgccattgaaggttcaatcaaatggtggggtcattctcatcgtattcaccacagatacaccgatactccaagagacccatatgatgccagaagaggtttctggttttctcacatgggatggatgttgactaaagccaacccaaagaacagagctagagccgacatttctgatcttgttgccgactgggttgtcaccttccaacacagacattatttgttgctcatgattacagctgcatttattttcccaactttggttgctggattgggctggggtgactactggggaaggttcatttatgctggtattttgaaaggttttgccattcaacaagctactttctgtgtcaactccttggcccattggattggtgttcaaccatttgacgatagaaaacccctcgtgatcatgtgtgaacagcatttgtga

SEQ ID NO: 3841 - DNA, 381 bp, Candida albicans
acaagtttagtccaacaacaacaaaagaaacttgatagaatgaagaacaaattgaactggggtgcagaaatcgaaaaattaccagtctggactagagaagaattcaacgaaagagctaaacaagaaggattgattatcatttctggtataattcacaacgttaagaacttcattaaagaacaccctggtggtcaagctcttgttagggcttctttgggtaaagacgccacaaaggccttcaacggtgctgtatatgctcattcaaatgctgctcacaacttgttggcaaccatgagagttgctgtagttaaagatggtgaagttaacgctgacacttttgatttacaagaacaaatgatggagaaggaaaagcaatcttag

SEQ ID NO: 3842 - DNA, 795 bp, Candida albicans
ttgaatgatttatttagtaaatgggttgaatatgggattccatcatttggtaattgggcatttttcactgggtttattttgattcaagctttattttatgtcactttacccggtgtttggactaaaggacaaccattgactcatttgaacaataaacaattgccatatttctgtaatgccatttggtcattctacactagtattgtattgctgttagttttacatttcactggtgtgttaccagtttattacatgttggataatgttggtggtattatgaccactgccatattttatggtatttcgttatcaattattttgtatttgatttgcatttttgttactggtgattaccatcgtatgactggtaaccatatttatgacatgtttatgggggctccattaaatcctagaattggtaaatatttggacttgaaaatgtttttcgaagttagaattccttggtttattttattcttcttatcatttggattatgtttcaaacaatatgaaacttatggatacgtgactcctcaagcttgctttatgctttacgcccattggttatacgccaatgcttgtgccaaaggtgaagaattgattgtgccaacttgggatatggcttatgaaaaattccggtttatgttattgttttggaacattgctggggttccattcagttactgtcaatgtatcttgtacattgcttatcaagaaacagaaatttcccaatggtctattggatataatgtatcctggtttgtgttaattactaacgcttactatttcttttga

SEQ ID NO: 3843 - DNA, 903 bp, Candida albicans
gtaggatctcgacccctggttaagattttcaaaggtgatttaacttccgataaagatgtctctgatgctataaatcaatctaaatgtgatgtaattgttcattcagcttcaccgatgcatggattacctcaagaaatttatgaaaaagttaatgttcaaggaaccaaaaatttgctttcagtagcacagaaattacatgtcaaggctttagtctacacctcctcagctggtgtgatatttaatggacaagatgttattaatgctgatgaaacttggccataccctgaagttcatatggatggttataacgaaacaaaagccgcagctgaagaagctgtcatgaaagccaacgataatgatcaattgcgtactgtttgtttacgtcctgcgggtatttttggacctggtgatcgtcaattggttcctggattaagagcaagtgctaaattaggacaactgaaataccaattgggtgataacaataatttgtttgattggacatatgttggaaatgtagccgatgctcatgttttggcagcacaaaagattttagataaatctacaagagacgacattagtggtcaaacattttttataactaatgactcaccaacatatttttggacattggcaagaactgtttggaaaaatgatggttacattgataaatattacattaaattgccatatccagtagcattgactttaggttatattagtgagtttgttgctaaaaatattttgaaaaaagagccgggtattacaccatttagagttaaagttgtgtgcgccataaggtaccataatattgctaaagctaaaaaattattaggctataaaccagaagttgatttggaaactggtatcaactacactttagattggatgaatgaagatttgtaa

SEQ ID NO: 3844 - DNA, 648 bp, Candida albicans
agtactaaccatatgataggccacgcgggggcaatgttacaagcacgtcaattgggtaaggagttgtatgttggtgtacactctgacgaagaaattttggctaataagggtcccacagttattaaattggatgagagaattactgctgttgaagcatgtaaatggaccacaaaggcaattgccaacgcaccatatgttactgatcccaaatttatggatgaatatgggtgtccatatgttgttcatggagacgatataacaactgatgccaatggtgaggactgttatcaggtagtcaaggatatgggcagatttgttgttgttaaacgtactccgaacatttccactactgatttggttggcagaatgttgttaatgtccaaagaccatcactatccagcaattctgagaactaccgaaagcttgttgaccaaagacaatttggatagatttaaacgatacgccaccgacgagactgggttgaatccaggatctggtgtttatttgaatcgtggcgaattggaagagatagttagtcctaaagctgagattggtgatattgtatacattgacggtggctttgatttttttccacccggaacatatggagataattcaaaatggaacaaccagaggccacaaagttag

SEQ ID NO: 3845 - DNA, 960 bp, Candida albicans
ggatcattaccccgacctccaggtgaaaatagaatcaaattatatggattatacaaacaagcaacagaaggtgatgtggatggagttatgcttcgtccagttggatttacagcagaagatgaaggtgccaaaaagaaatgggatgcatggaaacgtgaacaaggattgagcaaaactgaggcgaaaaagaggtatgtttcatatcttattgaaaccatgagagtttatgccagtggaactctggaagcacgagaattattaaatgaattggaatatttatgggaacagattaaagatttacctagtagtgatgaagaaactgaccatcatcatataccgttaccttcaagatcccccacatttagtcaaactgacagattttccaatagaacccctagtataactggagcgagaactactggcactagtaatttgaataacatctattcccactcgaggagaaatactacattatctttgaacgaatatgtccaacaacaaagaatgcaacaccaaaatcagcaacagctacatgatactacgtctcaaccaggagctcctgttggaggcggcggcggtgggggcgggtctatatattcattacctggaagaatgggagctaacaatgttattgaggatttcaaaaattggcaaagtgaagttaatatggtcataaacaagttaacaagagagtttttcaactctagacgagaagttcaagggaatgaaaatggcgatccatctacaggagatagagatgaagaattggatgatgttgagatcatcaaacgaagaataattcatattttgaaatttgtgggttggaatgcgttgaaatttcttaagaatttcgcagttagtttaattacgtttatgttcattgtttggtgtattaaaaagaatgttcatgtggaaagaacatacgtgaaacaaccaacaaataatgctaataaactgtaa

SEQ ID NO: 3846 - DNA, 234 bp, Candida albicans
gctaatcaagtttctaatttatctaaaagaccaagtgatgatgaattattgaaattatatggattatataaacaagctactgttggtgataataatactgataaaccaggtacttttgattttaaaggtaaatataaatggcaagcttggaaagatttagaaggtaaaagtcaagaagatgctgaaaaggaatatattgatttagctactgaattgatcagtaaatacaattaa

SEQ ID NO: 3847 - DNA, 921 bp, Candida albicans
agtattcaatttatttatttatttgtttgtttgaagtttataatgtcttccattagtaatgtttatcatgactattcgagttttctgaatgcaactactttttcccaagtttatcaaaatttcaatcaattagataatttaaatgtttttgaaaaattatgggggtcatattattattatatggccaatgatttatttgctactggattattattttttttaactcatgaaattttttattttggtagatgtttaccatgggctataattgatagaattccttattttagaaaatggaaaattcaagatgaaaaaatccctagtgataaagaacaatgggaatgtcttaaatcagttttaacgtctcatttcttagttgaagctttcccaatttggtttttccatccattatgtcaaaaaattggtattagttatcaagtaccattccctaaaattactgatatgttgattcaatgggcagtattttttgttttggaagatacttggcattattggtttcatagaggattacattatggggttttctatagatatattcatagacgacatcatagatatgctgctccatttggattggcagcggaatatgctcatccagttgaagttgccttattaggattgggtactgttggtattccgattgtttggtgtcttatcactggtaacttgcatcttttcacagtttccatttggatcattttaagattattccaagccgttgatgctcattccggttatgaattcccttggtctttacataatttcttgccattttgggctggtgctgatcatcatgatgaacatcatcattatttcattggtggatactcttcatcttttagatggtgggatttcattttggataccgaagctggtccaaaagccaaccagggtagagaa

SEQ ID NO: 3848 - DNA, 969 bp, Candida albicans
aaaatggaagttttgcatcaattaactactaatcatacttcaaatttatctaatttgataaataatcatccaacaagtttttcatcaattttaaaagaagttgatattactaatcatagtttaacttatattgaaaaattatgggcctcatattatatttatatgaataatgatattttagctacagggttattatttttcattactcatgaattaatgtattttggtagatgtttaccatggtttattattgataaaactccttggtttaatcgttataaaattcaaccaacaaaaattcctactaatcaagaacaatgggaatgttttaaaacggttttaaaacaacattttcttgttgaagctttacctatttggttattccatccagtatgtgctaaattaggtattacttatgatgttccattccccaattggaaaattcaagctatacaaattgccatttttttcatttgtgaagatttttggcattttgtattccatagtttatttcatcaaggttggttttataaaaatattcataaagttcatcataaatatgctgctccatttggtttagcagcagaatatgctcatccagtcgaagtcatggccttaggagtggggacggtggggttccctattttatatgcttatttggccacagtttatactaatatgccaccacttcatttatttacattgacaacttggattgttttaagattattccaagccgttgattctcattctggttatgattttccttggtcattaaataagttcttcccactttgggctggtgctgctcatcatgatgaacatcatcattatttcattggtaattatgctagttcttttaccctttgggattggttattccaaactgaatgtggtacttatgctagaaaaagaagagaaagaaatagtcaagctagtgctgaaagtaaacataaaaaaactttatag

SEQ ID NO: 3849 - DNA, 318 bp, Candida albicans
ataccttccatgctgctgtttaaaaatatgccaccgccgcacttatttacattgacatttttgattgttttaagattattccaagccgttgattctcattctggttatgattttccttggtcattaaacaagttcttcccactttgggctggtgctgctcatcatgatgaacatcatcattatttcattggtaattatgctagttcttttaccctttgggattggttattccaaactgaatgtggtacttatgctagaaaaagaagagaaagaaatagtcgaggtagtgctgaaagtaaacataaaaaaactttatag

SEQ ID NO: 3850 - DNA, 660 bp, Candida albicans
gggtgggttaaaaaagcaattttactgaaaagggttggattgaaatttacaattattggtaccccagttagtgtttcatggacatcaccaacggaaaatcattcagttcgtgattggattggtttatacaaaattgttcaaacatcatattcaagaaataaaaccattctttcatcagccggtagatggacttggtgtaaagaacctaaaggatcatttatatttgataaagagaaattattttgggaagaaggagtttatgaatttagatatcatttagatagtaaacatgatgttgcatatatttctgaaccatttgaaattaaaagtattgaattaaaagtgccggaatttaaagaggatgccataaaatttgctgaaaatttgaaattagagatatttgataaagttatcaaacttaccgatattagtgaagcgatttctccaattgcaaatcaatcagataatgttattgaagtttataaattaatcagttctatgatttcaaaatcaacgaaaattaatattacttataaaatattcttaaatcaaggtgatgatgatttattatcaattaaagatgttgctattaaacttattaatattaaacatgtattagaagaattatcatacaatatcactgataaaaaagatgtataa

SEQ ID NO: 3851 - DNA, 672 bp, Candida albicans
  unsure (671): Identity of nucleotide sequences at the above locations are unknown.
atttttcatttaaaaatttttttttttttttttgaacttttaatgactttcacaatcaataatacaaattccacagtttttgattcaaccaataacgaaaacatgactatttcggaacctgttcaacctgttctgaaaggaccaaaaggtataaccttttctggagaaacctttattgttcctgaaactcatgatatggtgaaaactttatttgaccccacagttaagaaatcaaattttgaattaattatattgagttgcttattttccaatttgttagtgtttttaattcctaataatcaaattagaatttatatattcattgccttgtatatattttggagattatcttataattttggtattggttggttattacaaaatcaatctaatcataatttgttagtgtcatggtcacaaaaatatcatttatttgaccctgaaaataaaggggctttggctcaatctattcaaaatgaaattaaaagtcaaaggggagaaaattatgatattaaatccatgccagtggaattcaatacttggttgattttcagaaaatttgttgatttaatattaatgctggattttattacattttgttgtgttgtttattgttcagcaattaaagatgattatcaatttattaataatcaatcattttggttagtttna

SEQ ID NO: 3852 - DNA, 1116 bp, Candida albicans
ttgaaaacgaggaccgaagcaacaaacaaagtcgtaaaagatacttatctcgcgaaaaaggttgttggaacacaattagatttgaagaaatttaaagccatgtctttaagtttacagttgcatgatcaaaaatatattggtaaatatgcacccaagttaaaaattagagttaggtttgaaacttatacagaattgcgtaagaaattttggagagttttattagaagaaagtaattcgaccccagaaaatcgcgacagttgcgattacattgaattaatttctttattagatacattgggatgtgttaatagtgatgaattggtggaattattttattccaatttggggaaactgtcttggggaggtgatttattaacttttgatgaaatcattgatcaaatggaaacctacgtcaatcaaaatgttgagagtggtaaagttaaaatatttgaatttgaaaagtgtccaatttgtaatgaaaaaagagtttctaagaagcaagatctagacataattactcattttgctatatgtgctagtaaggattggagtgtggttggtaaattacttctgtcgtcgtatgttacacctactcaggctacgaaaaaatggtttaccaaggcattgattaagttgacgtatgggaaatacaaactaggtgggaattcagccaatattttggttcaggatagaatgacaggaattatagtagaagaaaaaatgagtgtttatgtgagattgggtataagattattgtataagggtttagataaagctagatctaaaagagtgagaattttattgaaaaatatgtcaatcaaacagggtaaaaaatttgatgcaccacaactgaaatcagatatagcttcatttattaagtttcataaacttgaccttgacgaatgtgaaatagatgacccatcgcaatttgctacgtttaatgactttttctatcgaaaactaaaaccgggtgctagagaaatagaggatgaaaaaaattccaaaattgttactagtccggcagattgtcggtcggtggtttttgaatcaattgataaggcaacacagttgtggataaaaaggtgcagggtttactatacccaaattgattcataa

SEQ ID NO: 3853 - DNA, 720 bp, Candida albicans
aaaggtgcagggtttactatacccaaattgattcataatgatcatctgatgcgtgtatcttcctatacattgggtattttccgattagccccacaagattatcatcggttccattcaccagtcgatggagttattgaaagtattaaacatattgatggtgagtattataccgttaacccaatggcgattcgatcggaattggatgtatttggggagaatgtcaggaccattgttacaatcaaaacaaaagattttggaaatatatactttattgctgttggtgctatgatggttggatcgattgttcttacaaaagatacaggatacgagatttcgaaaggcgaagaattgggttacttcaaatttggagggtctactgttttattattaattgaaagtgagaagttcaaatttgataccgatcttgttaagaattcgtcctccggtttagagactcttcttcgagtggggcaaagtattggtcatagcccagacgttgaagaatacaagcgtgaccatatctcatttgacaaattggataaatccaaacaacttcgattgattagagtattgactggtggtgatttgaaagacaaacataagttaagtaattgggaagctaccaaaatagatatggaagattttcaagaaattgaagatgaggaaatatttaataaagatatgcccgatgaagatgcatcgatcaaaagtgaagattaa

SEQ ID NO: 3854 - DNA, 576 bp, Candida albicans
gacgcggtccttccaggccgtggtgaagacttttcagatgcatcgtttctttcagatggtggatatgcaagtgatgcgtctgctaacttgtttgaccaaaaagagacatcgtcagatctgaagaaatcaagaataaagtctaaaatgagacttcgtagatcaaaacaagaatatgaaaatttcgagttggcaagtcgccaggtacttggtgttgtatttattgaaattgtctcgtgtgaagatttaccaccttacaaaaattttactcgtacatcttttgatatggatccctttgtggttgtgagttttggtaagaaaacttttagaactggctggaaaagacatactttgaatccggtttttaacgaaagattagcttttgaattgcttcctcatgaaagtaatttcagtattcagtttctagtacttgataaagatcatttctcgtttcatgataatgtggctcatatttctttgccgttgagaacattaactgagtatgcaacagcaaaaccaactgaaggtgacagttctgatgtcaataccagcgatagtactagttttagtcaaacagga

SEQ ID NO: 3855 - DNA, 1377 bp, Candida albicans
aatatggctagacttactagaaagaggacaattgagaaagaactcaatggatcgtctagagtcaccagaactttatcaatggaatcgatttcttcgttatttaaacgaaataaaaaaagaaaacataatgatggcaacgattcaagcgtgaattccagtgataatgaaaacatcaacataactgatgatgaagaacaagatcacattgacactaaaccaaatcacaagaaaagaaaaatcaaaacaaaggcagaagaagaatttgaagccaatgaaaagaaattggatgaagaattgccaattgatttgcgcaaatatagaccaagagggtttagattcaatttacctcctgaagatcgtccaatcaggatttatgctgatggtgtttttgatttatttcatttgggtcatatgaaacaattggaacaagctaaaaaatcatttcctaatgttgaattggtttgtggaattccatctgatattgaaacccataaacgtaaggggttgacagttttgactgacgaacaacggtgtgaaactttaatgcattgtaaatgggtcgatgaagttattcctaatgctccttggtgtgttacccctgagtttttacaagaacataaaatcgattatgttgcacatgacgatttaccgtatgcaagtagtgatagtgatgatatctataaacctataaaagaacaagggaagtttttgacaacccagagaacagaggggatttctacttccgatataattaccaaaatcattcgtgattatgataaatatttgatgagaaatttttctcgaggtgccactagaaaagaattgaatgttagttggttaaagatgaatgaactagaatttaagaaacacattaatgatttcagaacttattggatgaagaataaaactaacatcaacaatgtctcacgtgatttgtattttgagattagagagtttatgagaggtaaaaaatttgattttcaaaaatttattgaagatggcaatagtcaaaacagtagtaatcacggcagtgatgaagaatcaacaaattcatccaaagtgagttctccattgagtgattttgcatcaaaatatattggtaacagaaacaaagatttgaaccgtaaaggtattttgaacaatttcaagggctggataaaccgtgacgatcattctgaacaggaaaccgaagaggagatcaaaccaatagttattaagccaatcagaagaagtcgtagattgagtggtggtagtagtaccagtagtgtccctagcacgcctgtaaaaagaactgctagtagtgcttcaactacaccaaaaagaaagtcaccattaaagaagtcatctagtgttaaaaacaccccaaagacaaaataa

SEQ ID NO: 3856 - DNA, 1455 bp, Candida albicans
  unsure (1379): Identity of nucleotide sequences at the above locations are unknown.
agaatttattttgatcctcctaatttcaaaaatttagaatatttttccataacaccgatattattacaatgtatgggaccaaatttgggtaaaagtcaagatgatcaattattcaataaactcaaacaatttgaatatcaaaatccacttaaaactaaaaaagatgatcaaagttttatatcggatgatttagtgcttgataaaatcaatcatttatatcgaaatcgattattatataaacgattccattcaaatcgttcatttagagcattaaatctgaaaaagttcaatgtttttataattcaaaatatcattattccgataattaaattcattcaaaaaatgttaattatgatgataaccataattaattataaatttttgaacttaaaatctgggtccaattatgatgatggattaagtttagttggggtttcgagagttttccgtcaattagatttacgattaaaacaatttaattatttcccaactcaattcttgtgttattattatgataaaaatattttatattcccgaaattctttaaaattaccaatatttaatgataatttaaacattaataattccaattatattaatttatataattcgatttggttaatttttaatgatattttaattggagttacattatatcatatgataatggataattttacctcaattattaaatttattcgatttagggttatggaaaaatatttatttttagaattaatgaaattaattacttggatatcaacggaaaatcctgctggatttaaattaaatactgatttagggaaattcttaggagatttatatatttggaccattggattttgtcaaaatattatcttaaaacttgatagaggcagccaacatttcaattatatttccttgatgtcaaaaatacttggattattatgttattatggaggttgttcatttttattaagttttttaattgatgggattaatttaattaccttacatatttatggtttttattattgttcagcaaaaatatatcgacgtcaattagagataatcaaatcattatttcaattatttcgtggtaaaaaatataatgttttgagaaatagaattgataatttaaataattatgaacttgataataataataataataatactactgctattgatgggtttgggtttgatattgatcaattattgttagggacattattatttatgatgatgatttttttattacctacggtatttgcgttttatcttgtatttttcattatgcatttattaattttaatgtcattaaatttattggaaaatttacaaattataatttgttttattccattatttgttatattattgaaattgaaaaattctanacgattacaaggtggaataaaatttgaatttataaaattttatcagggggatgacaatatcaaaattatcaaataa

SEQ ID NO: 3857 - DNA, 534 bp, Candida albicans
  unsure (503): Identity of nucleotide sequences at the above locations are unknown.
gaaggttgggcccacgttacattaggggagcatgagaacgaagtgtacgaaatgaaccaaccaaatgttaattgtcgaggaatactttttggcaaaatgaaaatggagttgggcgaccacatgtacgtgaaatgtcgaaagactggtctcgaagcagatattgatttcaaaaccaagggttttattagtggcacttatgatgcaattgaaggtgttataaagaattcaaaaacttctgaagtgttgtaccagataacaggtaaatggaacgaggtcatggaaatcaaggatcttaagacaggtaaaaaaagggttttggttgatacaaagagttctgttccagtaaagccaagagtcagaccattggaagaacaaggtcaatatgagtcaaggaaactttggaaacctacaattgacgcacttgccagaagagatcatacagttgcaactgaagagaagtttgcagtcgaagatgaacagcgtaatttgccaaacaagagatnttcactacggagcgcacgaaccaagctatat

SEQ ID NO: 3858 - DNA, 642 bp, Candida albicans
  unsure (9),(12),(13),(19): Identity of nucleotide sequences at the above locations are unknown.
ttgtactanttnngcgtcncgctccctcccaaaaaactccggaggttcttgttttttaactgtattcagtacgaagtcaagttcaccatgggtttaacatcgaaattagaaaaactcaaacttaaagagttgactggtcatgaagcagctgtcaaatctaatgtggtcaatggagctgatactgatgataccgatgatatcgatgaaatggataacgagggacagtcaattcttatgggaatcattgctcagttgagaccaggaatggatttgtcaagaattactctaccaacttttattttagagaagaaatcgatgttagagaggattaccaatttttttcaaattccagacatgttgttgaaggccaacagaacttcagatgatgtcgaaaggtttgtttcagttcttgcgtggtatttggcaagctggcatattgcaccaaaggcagttaaaaaaccgttgaatccagtattaggagaaactttcaactgctattgggagaatatttcggatgattgctcggcttactatatttcagaacaagtttcccaccatccacctaagtcttcttacttttatttagttcctgaggctaaaattaaagttgatggaattcttattcctaagtctagatttttg

SEQ ID NO: 3859 - DNA, 2538 bp, Candida albicans
aatatggaaactttagaagttcattccaaagatttccttattaaatggattaatgctccagataattcaattatcgattgggaagctaaaccattgaaaaaatcaatcaatttttcattttataaaaagaaagaagaatcactcaatcaatcagaaacgtctttattagatacaaattcaactgctgcacttgaaccaccaactgcaattgcaccaccaccacaaagaacaaggtctagatctgcctcgactgcttcagtcaatcaatttactaaatcaaatgacgtttatcgatcaaaatctagagcttcaactttattatcaatcaatgaatcagatttaatattaatcaagaattataataaattagttgccaatgaattgattcatgggaaatttgaagtagaaaaaggtgggatgtttgcctttgtttttgataattcattttcgaaaacaattgctaaactggttcaattttctgctaaaatcgttagtaaatctaaatcagaagaacatattgctcaacaaaaagttgttgctgaagttcatgatcaacatttatttgatgaaaatgacgttgctccaggagaaactttacaaagtatcatgttgaaaaaaagaagaaagaaattacaaggttttactaaacgttattttgtattgaattttggtagagaaactttgtcttattttaaagttgatgataataagttgagaggtcaaatgccagtgaaagactgtatagtatcggccaatccatcttctcgtgaatttattattgattcagggatggaagtttggcatttgaaagcaattaataaagctgattttaatgcttgggttaatgcctttaatactgttaaaaaggaagaaactgttgtaccaacgtcgaccaccgaagaaagtgattcaaaagaacctgttattgcaagtactccattaggtgcatctaattctgaattacaattgattgcacaaaaattagcacaattgaaaacggaaaatccatcacctttagctaatgaaattcatcaagatttccttaatttacttacaagggccaaaggacaaagttcctcttcacctggttcagctgatgttcaatcagtgttttcttccgatttccatgatgctgttgatcattttgacgaaactggtgtttactttttggatgatgaaggtaaaatccaagaagatgaagaagtcgctgacgatggagaaagttcgtcagaagaagaagaagaagaggatgaggagtttgtacaagttgctcctagtggtgtacatgcagatcaaggaattgttcaagataaggagttgcctcaaccaacagttgaagctgatgatgacaacttgtatccattaccacacgatccagtttcaagatcttcagatattccaatatgtacccatacaccaccctcaatattgagttttgtgcgtaagaatgttggtaaagatttatctactatagcaatgcctgttacttacaatgaacccaccactgtgctacaaaaatttgctgaaatgcttgaatatcctgaagttgccactaatgctttaatctctgatttccaagatgaatcaggagaaaaattattacgtgtggctgcatttgctttgagttatctttctacacaacgtgccaaagaaagaaataagcgtaaacctttcactccattattaggagaaacttatgaattagtacgagaagatctcgggtttagattaatatcggaaaaagttagtcatagaccaccagtgtttgcttaccatattgatactgaacattggactcttgattatgctttatcaccaggtcaaaaattctggggtaaacaatctgaagttaccactaaaggtacggtatatttgaaggataaatcaactggtgaagtgtttacatggactcaaccaaccactatgattaagaatattattgctggtgaaacatatgctgaaccaacaggatcagtaacaatcaaatcctcaaatggttataaagctgtagctgaatttgccaaaggtggtatgtggagtggtagatcagaaggtgttattgtgaaggcatttgacaatagaaagaaggaattgacatatagtgttgaaggtaattggactgaatcatttacattaaagactaaatccactgaaaagactatatggcaagctggggaattattaccacaatatcaaaagaaatttggttttacagaatttgctggtactttaaataagattactgaaatggaaaagggtaaacttgcacctacggattctagaaatagacccgatttacaactttatgaaaagggagatacagacactgcagaaactttgaaaaacaaattagaacaagatcaaagagacagaagaaaacaattagaaactgctggtgaagaacatattccaaaattctttaaacttaaaggaaatggacctgtagatgaagcagaatgggaatttattcaaggtgaaaaaagttattggaatacaacaaagaaaggtgactgggatgatttgattaaattgtggtaa

SEQ ID NO: 3860 - DNA, 699 bp, Candida albicans
gttactaacacctattcaggtattggcaaagcaattgcagaagtgcttttgaaagaccctaatacaaaagtcgttgttgtggcaagaacagaagcaccattggaagctcttgcaaacaaatatggttcagatagagttgactttgttgttggtgacatcactgactcgtcaacttcggaaaaagcagttaagctggctatttcaaaatttggacaattaaactcaattattgcaaacgcaggtgttttggaacccgttggtcctatcgaatccacttctgttgatgattggaaaaggttatatgatatcaatttgtttgctgttgttgaattgataaagcacagtttgccacatttgaaaaaaaccaatggtaaggtcattgctgtttcctctggagcagccacaaaagcttacagtggatggtatgcatatggttcctctaaagctgctttgaatcatttgattttatccttagctagtgatgagaaagatgttcaagctatttcaattgctccaggtgtagtggacactgaaatgcagacggatattagagagaaattcggaaagaatatgaccccagaaggtttgcaaaggtttgtcgacttacatgaaaataagcagttggcctctcctgaggaaccgggaactgtatatgccaaattggctttgccaagaatggtcagaggaattgaatggtaa

SEQ ID NO: 3861 - DNA, 798 bp, Candida albicans
aggtacgttttaatgaacaaaatctatgatgttgagacttccaatttgaactttagtactaactcaaataaaggcattggtaaggctatcgccgaaattcttttaaaaactccatcttcaaaagttgtgattgttgctagatctcaagctccattggaatctttccaaaagcaacacggctcggacagagtagcatttgttgctggtgatattacagatccagcaacatctaacattgctgttgaaactgccatctccaaatttggtcaattaaatgctgtcattgctaatgctggtgtgttggatccaataggcccgattgaaaacacctctgttgaccaatggaaacaattgtatgacattaatgtattttcagttgttgaattaatcaaacacagtttgccacatttgaagaaaaccaacggtaaagtcattggtgtttcatcaattgcagcctttacagctttcaatggttggtatgcttatggttcttccaaggctgcattgaaccatttgatgtactctttggcttctgaagaaaaagaaattcaagccatcgctgtcgctccaggtgtcgttgacactgaaatgcaaaatgacattagagaaaaatttggcaaaaatatgaaggaagaagctctccaacaatttgttgacttacacaagaatgaaaagttggtctctccagaagaaccaggtacagtttacgctaacttggccttgaagggttggtcagaagatttgaacgggaaatacttagattttgatgatgccctccttaaagactatcaattgtaa

SEQ ID NO: 3862 - DNA, 1218 bp, Candida albicans
aatatatataaagtaaaaggaatttcttttattttgtatttagagaaccctttccgctctctttttctttttgatttgtttctttgtttgtttgtttctttctttctttctttcttctctctttttataataaatattcttgctttatctattataatgttggcaaaattcaaattaccaaatgctgaggtatggaaaactttcccaccattcgatacaccagttcctccaagtccatttgagaatgaatttttaaataaaatatactatgcatcaatgaatgtaactactcctttaaccattgccattatttatttcacttcggttcatttcattaattcaattattagaaataaacaaattgctaaatacaactccaaaacttcttcagaatcaaaagtcgacataactaaattggatgataaaaaattacaaaaaattttaccaacggttcctaactcaattgctaaaacttcaattttcaaattatttgtttttttacataatgttttcttatgtttatattcaatttggacatttttaggtatgtcacatactattgccaccacaatgaatttatttgaaggcaattttttacaatcattagttaattatcaacctaaaaaattagatattttccttcattcagtatgtgatcctaaaattgggattttttcaagacttttaactaatgaaaaaggtttacataatttagaagtatttggttggtggttttatatttccaaattttatgaagttttagatactgccattattttattaaaaggaagaccaagttcacttttacaaagttatcatcatgctggggctatgatgtgtatgtgggccggtattagatatcaatctccaccaatttggatttttgtggtatttaattcatttattcattcattaatgtatttttatttttcattaagttgtttgaaaattagaatacccaattttttcaaaagaatcttgacaacgatgcaaatcactcaatttattgttggtggttcaattgccattttacattcatttgtttggattgttgatactagtcatgtcattagtcccgataatttgaaatgggttatttgtattaatactccaaatcaagcattacctattttaattaatgttctttatttattaccattaactgcattattcactgctttctatattgaaagttatttgaaaaaaaaatctgcataa

SEQ ID NO: 3863 - DNA, 318 bp, Candida albicans
  unsure (17),(317),(318): Identity of nucleotide sequences at the above locations are unknown.
tttaatatacttggganaaaatttccacaatatattgatttaaaaggaaaattatttggaaatgatattattcaaaatcaattgatttattccattatttgtatttctttcaatccaattttttggaatattgttgctcgattagaatacaaaacccattttttaaccaaaatttgttttaattcagctaaattgggttgttatgtattagcaatcacaattttttcattaggaatttatcgtgatcatgtttattatcaagcattagaaactcaacctacttatcaaccttttgcccctccccctcctcccccctnn

SEQ ID NO: 3864 - DNA, 1014 bp, Candida albicans
tggatccaggcagaattagtgagtcgggaactcataccgagtagcagttttattggcacgaacagtggccacgatgctttagaagatgtgagcaggtttttctttggtgaacacgacacagaaaagatgtttgaaacattggaaccattacatcagatgttgcaaaaggaccaggaaacgatgagagaacagccatttgcaattgcttttggcagggagttgacagatgcatacgagtgggtactcaactttagaagtactagagacataaccaatttgaatcaagcatgggatatatactacaatgtctttagaagagtaagcaaacaggtgcagctgttagctagtcttgagttgcagtatgtatctccggacttaaagcatgctcaagatttggaattggctgtaccaggtacttaccaagcaggcaaacctgtgatcagaataatcaaatttgatcctactttttcgattatttcatctaaacaaagaccgagaaaattatcgtgcagaggaagtgatggtaaagactaccaatatgcgttgaaaggacatgaagatatcagacaagataacttagtgatgcaattgtttggtttggttaatacgttgttggtaaatgatccggaatgtttcaagagacatttggatatacaacaatatcctgctattccattatcaccaaaagtgggattgcttggttgggttccaaatagtgacactttccatgtattgatcaaaggctatcgcgaatcaagaaatataatgttgaatattgaacacaggcttttgttgcaaatggcacctgattatgatttcttgacattattgcaaaaagttgaagtgttcacaagtgcaatggataattgtaagggacaggatttgtacaaagtgttatggctcaaatctaaatcatccgaggcgtggttggaccgtacaacaacatacacgagatcattagctgtaatgtctatggttgggtatatatcaggtttgggggatacgcacccactt

SEQ ID NO: 3865 - DNA, 852 bp, Candida albicans
atgaagtttgggccaaatggggtcaattttccataccagacccgggtccctgaaatcagattagccaggtctgaaatgcttgattacagggctggaaactttgatccacaattttcacaaccaaacaatgtaagtttattgttcattgcgttgaatgatgaagtttttggtgttagaaaagtggctatacagatattggggagattatcgtgcattaatccagcatatattgttccatctttaagaaagactcttattcaactattatccaaattggagtattctaccaccagtagaaaaaaggaggaaagcgccattttgttgtctttacttattagcaactcgaaggaattaactagaccttatgtgaagcctatagttgatgctttgcttcccaaggctaaggatttgagctcttctgtggcttctagtgcaataaaatgtttgggagagttgtcggttgtcggaggtgaagatctcaaaccatttatcccggacttgatgccgttgatcctagatacttttcaagatcagagctcatcttataaacgggatgcggccttgagaaccttgggccaactagcattttcctcaggatacgtcattcaacctttacttgattatcctcagttgttagggatgttagtagcaatcctaaaactggaaacgtctccagatatcaaaagagaaacagtccgattgttaggcattttaggggctcttgatccttacaaacatagggaagtcgaacaaaactcaaagaatataccagttgagcaaaatgcgccccctgtggatgtcgcgttgttaatgcaaggaagtcttcaccacggggctggaaggacccgcgat

SEQ ID NO: 3866 - DNA, 552 bp, Candida albicans
tcaatgtcagcatcagcatctacatcagcacaactacaagtggttgatggtgttgctctaacagagattttcaaaggacttacttcgacgtcggaagaagagagatcaaaatacgcagtagaattacacaactacctatcttcaattgcacgagatttgtcctcagaacaatttaacagatataacaacgacatcaacaagacaatatttgacttattacatggtgaaaaaacctctgagatattaggtggtatagctgccttaaatgcattgatagaatttgattctggagtgggaaaagaaaatgcagggaaaacagcaagattttcaaattatcttggttctttgatattgtgtaatgacttggtcattatgaaacaagctattcgtactttgggtaagttagccacgttaggtggaaatctcactggtgattttgttgattttgaggccaaaagagctattgaatggcttcaaagcgatagcaaacaacacgagaatagaagacatgcattatccgtcttcaccacgggagtggcggatacgccttaa

SEQ ID NO: 3867 - DNA, 606 bp, Candida albicans
  unsure (596): Identity of nucleotide sequences at the above locations are unknown.
accgcatatcggtacttccaggccggtttgaatatgatgttggaccggattagtgggaaagtcatccatattgatttcggagactgttttgaagcagcaatattacgtgagaagtatccagagagagttccgtttagattgacgagaatgcttaattatgccatggaagttagtggaatagagggctcgttcagaatcacatgtgaacatgttatgagggtgttgcgtgataataaagagtctttaatggcaatattagaggcctttgcttacgatcccttgataaattgggggtttgatttcccaacaaaggcgttggctgaatcaacgggtatacgtgttccacaagtcaacactgcagaattattacgcagaggacagattgacgaaaaagaagctgtaagattgcaaaagcaaaatgaattggaaataagaaacgctagagctgcattagtgttgaaacgtattaccgataagttaactggtaacgatatcaaacggttgagaggattagatgtgcctactcaagtcgataaatcgattcaacaagccaccagtgttgagaatttgtgtcagcattacattggttggtgtcncgtttggtaa

SEQ ID NO: 3868 - DNA, 1083 bp, Candida albicans
aaatttatccagcgaacatgcacttttctttcgttgaagtttcaggtaatcaatatgggattaacagctaaattagataagttgaagttaaagacaacttcggaagatattgaagatgactcaggtcatgctaaacctgacaattctgatgatattgatgaagttgacagtgaataccagaatatattattgagtattattgctcaattgcgaccaggcatggacctttcaaagatcactcttccaacatttatattagagaagaagtccatgttagaaagaattacaaatttttttcaaattccgaaattattaattgactccaacagcattgaagaccccttagatcgattcatcggggtacttagatggtacttagcaagctggcatatttctcctaaagctgtaaaaaaaccattaaatccggtgttgggtgaagtttttacttgctactgggacgaattaccaaacaataaatcagcgtactacttgtcggaacaaatctcacaccaccctccaaagtcttcctatttttatatcatgccggaggagaagatcagagttgatggtgtagttattccaaaatctagatttcttggtaactcgtctgcagcaatcatggaagggtgcggatatgtaactcttggtaaatgggacaacgaggtttacgtaatgaaccaaccaaatgtttatgtcagaggtattttatttggaaaaatgaggacagagttgggtgaccacatgtacgttaaatgtgaaagaaatggattggaggctaatattgaatttaaaacgaaaggctttatttatggtacttacgatgcaattgaaggaatcatcaaggattcggaaacacagaaagaactatttcagatttctggaaaatggaatgaagtaatgtatataaagaacattaaaacaggtaagaaagaagtgttatatgatacaagaggttccaagacacttaagcctaaagttagacctttagaggaacaatgggattttgaatcacgtaaactttggaaaccaacaattgctggtttggcgaaaagaaccacgaacttgcaacagaagagaaactga

SEQ ID NO: 3869 - DNA, 327 bp, Candida albicans
actttggaaaccaacaattgctggtttggcgaaaagaaccacgaacttgcaacagaagagaaactgaatgttgaaaatgaacaaagaataaaagcaaaaaagcgaatagaggatggggtagagtttcaccctaagttctttcgagaagtaaacgaaaatgataatggagttaaaaatcttgaatacgttatttataaggagtttgatttaaagggggatcccgaggttttgagggagagattgttaacagttgctccgattgttccaggacagaagtttgatgagaaatttcattacccggcttttaaaaaaccggaaagtaattaa

SEQ ID NO: 3870 - DNA, 1122 bp, Candida albicans
gttcaatctttttttctttctttcggattcggtttagctaattttactaccatggatatcgtactagaaatttgtgactattatctttttgataaagtttatgctgatgttttccctaaagatggtgctgttcatgaatttttgaaaccagctatacaatcattttcacaaatagatttcccaagtctcccaaatttggattcatttgatacaaattctactttgatttcttcaaataatttcaatattagtaatgttaacccagcaactattccaagttatttattttctaaaattgctagttatcaagataaatcagaaatttatggattagctcctaaatttttcccagctaccgatttcattaatacttcatttttagccagatcaaacattttcagagaaactttatcacttttcattatcactactatatttggttggttattatatttcattgtggcttacttatcatatgtttttgttttcgataagaaaattttcaaccatccaagatatttgaaaaaccaaatgtctttggaaattaaacgtgccactactgccattccagttatggttttattaactatcccattctttttattagaattaaatgggtattccttcctttatttagatatcaatgaatgtactggtggttataaagctatcttgtggcaaattcctaaattcattcttttcaccgattgtggtatttatttccttcatagatggttacactggccatctgtttacaaagtgttacataaacctcatcacaagtggattgtttgtactccatttgcttctcatgctttccatccagttgatgggttcttccaatctttaccttaccatctttacccattattattcccattgcataaagtattgtacttgtttttgttcacttttgttaacttttggactgtcatgattcatgatggtagttactggtctaatgacccagttgtcaatggtaccgcttgtcacactgtccatcacttgtatttcaactacaattacggtcaattcactactctttgggatagacttggtaactcttacagaagaacagatgattcatggtttgtgaaagatgccgaggcccatgaagattag

SEQ ID NO: 3871 - DNA, 1926 bp, Candida albicans
ggtcttacgacatttaaattaattttagtagtagtagtagtaatagcggtggtgttgatggtggtggaggaagaaggggttacatttatcaacaacaacaattggagtaagagagcaaaaaaaaaaaaaatttcccccaacaatcttatcaagaagtttaagtctttatcttttatatatacattgtatactagccctccccaattcatgatggagatatcaccagctaatattaaagaacaatcacgatccagatccagatcaagaactagaaattcaacggcaaattctcgatcaactagtgccactagaagacctagtttatcttccacccatagaagatcattatcttcatcatcattaaacaaattaactataaccaccacacaagttgatcaagaaagatcagttccttcagttcaagtttatttagataattcattaccattagattttttcaaacaagatattattgcacttactaaaactttaaaaattagtaaatggcataaacgtcaattaacaattaataatttaagtattaatagaatttcgggagcattgactaatgctatttataaaattgaatatcatgatgaatcacaaaacattcatttaccaacattattattacgagtatatggaaaaaatgttgatgaattaattgatagagataatgaattagccatattaattaaattatctcaaaaaagaattggacctagattattaggaatcttcagtaatggtagatttgaacaatttttagatggatttattacattaaataaagaacaaattagagatgaaattctttcacaaatgttaggtagaagaatgaaagatttacattataaaattgaattagatgctaaagattatgaaagtaaacaaccaacttgttggaatttaattgataaatggttgaaaatttttgagcaagaattattacctggatatttagaagttaattataaccttcaagatattttcattgttccatttgatcaatttaaacaaattattacaaaatataaacaatggttatttaataaatatgatgataaacactttaccaataattataaattttgtcataatgatactcaatatgggaatttattattacatgaatcatttaatcccaaagatatagttgtatcaacatcagatactacaaatagttcgaataatattattgatggcgaagtcactattaaatcaacttccaacaaaaaagatactaatttagtggttattgattttgaatattctggagctaatttccctgcttatgatatcgttaatcatttttcagaatggatgtctgattatcatgatccagagaaatcttatttcattcatcaagagaattatcctaatcaattggaacaaattaatttaatcaaatcatatatcgaatatgatttccaatatccttcatcaaatttaaaaactggtaaaactcctgaagatttgattaataatactactaatccaatatcaattattcaatatgaaattgaaaaattatataatgaatgtatttattggagagcaacagtacaaattttttggtgtttatggggattaattcaaaatggtccattgaaaaaaccattaaattctaatgcattatctgaacaaggtattaattcaacttataatattactgttggtgggattgaaaatttggatatttccgaccatactcaagatgaaatagcaggctcaaacaatgacgctcttattgaagaaattatcacttcaagtgatgatgattttgattatttgaaatatgctaaccaaaaggtagcattaatatttggtgatcttattcaatttggtataattgatgaaaaagaagttgatgaaaaatatttatctataattaaatatattgatactaaaacttttgatatttaa

SEQ ID NO: 3872 - DNA, 969 bp, Candida albicans
aatttaaccttttccgaagaccctacccaaagatcttggatcagaagcaagcttgagaaaagaagacattatgctaaaccaattgaagaaggatctccaatgcggtctttgggtttaggtcagattgtacaatccaattccagtagattcaaaccaggggacattgtatatggaatcattttatggggggactactctgttttggaagacacttcattgtataacagtattgatacatcactcggattaccattggagtattatctttctgttttgggaatgacttccttaacagccttttttgggttaacagaagcaggtgatttgaaacagtatttgaatagtccacctggaaaaggtccaattgtttgcgtgtcggcagcctcaggtgctactggatctgtagtagttcaaattgcaaagaacttgttgggcgcatccaaagtaattggtatttccgggtccagtgaaaagtgtcaatgggttgagaaattgggagcagatatatgtgtgaattacaaggacccaaactatcaagatcaaattgaaaagtttcttggtgatgagtttattgacacttattttgataatgttggaggggatatcctcagctttgtattgacaaaggtcaagaagtttggaaatgttgttgcttgtggctctattgccggatacaataaccgtgaagcactgaaggtttcaaattggggtgagattacagtgaactcattgacagttcgaggattcattgtcaccgactaccaggaacatttccctaaagctattggcattcttaccgacgcagtcaaagctggaaaaattcgtactgacggtgcttatcatgttgagaatttacacggacatgaccttatccatcgattggaaaatataccaaaaatatggaacaaactttttgaagacaacaaaccaaatggaaagatgatcactaaagtagccttagatatatag

SEQ ID NO: 3873 - DNA, 1164 bp, Candida albicans
ttaattcataatctaagattcaactcattaacaatgtctccagttcaattagcagaaaaaaattacgaaagagatgaacaattcactaaagctttacatggtgaatcttataaaaaaactgggttatcagctttaatagctaaatctaaagatgctgcttctgttgctgctgagggttatttcaaacattgggatggtggtatttctaaagatgatgaagagaaaagattgaatgattattcccaattgactcatcattattataatttagtcactgacttttatgaatatggttggggttcttcattccatttttcaagatattataaaggtgaagcttttagacaagctactgctagacatgaacatttcttggcccataaaatgaatcttaatgaaaacatgaaagttttagatgttggttgtggtgtaggtggtcctggtagagaaatcacaagatttactgattgtgaaattgttggattaaataataatgattatcaaattgaaagagctaatcattatgctaaaaaataccatttagatcataaattatcttatgttaaaggtgattttatgcaaatggattttgaaccagaatcattcgatgctgtttatgccattgaagctaccgttcatgctccagttttagaaggagtttattcagaaatttataaagttttgaaaccaggtggtattttcggtgtttatgaatgggtcatgactgataaatacgatgaaactaatgaagaacatcgtaaaattgcttatggtattgaagtcggtgatggtattccaaaaatgtattctcgtaaagttgctgaacaagctttgaaaaatgttggatttgaaattgaatatcaaaaagatttggctgatgttgatgatgaaattccttggtattatccattaagtggtgatttgaaattttgtcaaacttttggtgattatttgactgttttcagaacttcaagaattggtagattcattactactgaatcagttggtttaatggaaaaaattggtttagctccaaaaggttctaaacaagttactcatgctttagaagatgctgctgttaatttagttgaaggtggtagacaaaaattgtttactccaatgatgttgtacgttgttagaaaaccattagaaaagaaagattaa

SEQ ID NO: 3874 - DNA, 840 bp, Candida albicans
gaaagaagatttatcatcacagaagggttgtttgccaattccggtgatattgccaacttgccaagaatagtggaattgaaaaacaagtacaagtatagactctttttggacgaatcattgtctattggtgttttaggtggcactggtaagggtttgccggaacactatggggtttcaagagatgaaatttccatcactattggttccatggctaattcttttgcgtcatctggtggattttgtgttggtgttaatccaatggtgcaccatcaaagaatctcatccaatgcctatgtctttagtgcatcgttgcccccatattcggccaaagttacttcccaagcaattagagaaattctggcaccagaaaacttggatccgaccactggaaaatcgaaattaatggttcaattgcataaaaagactgttgacgtgtacgacagattggaagctgcacttgaaaagttaccaatgcacatcgtgtcatcccctcaatcgcctatgatacatttgagattgagagagaaggtcagagaacaattgaatttgccattgatgtatggtaactccacatttatcaccacggggaagcctgcaaaattgttgaatgagtttgacgagtatttgaatttggaaagttttatcttacaaaaagttattgattatgttttggaacatgaaggcatattaataaccagaagtaagttgattttagaacatgaaaacttgccagtgttgccaccacatttgttgataatgataaacattggtgttaaagaagaagaaactcaatcgtgttgtggaggtcttgccaaaaacaatcgaaaatgtttttattaa

SEQ ID NO: 3875 - DNA, 534 bp, Candida albicans
ctttcaatgaaatcgtcaaaattgaatccagtcacaacccataaggagttcaatggtatttctggggcgctaggtataacaattggattgcctaccctcactgtattgttctatttgttgtgcaaccaaacgtattcgattcatggaatcaatgtcgatttcgccaaaattaaaagtcaattaccaatcactcaagatgaattatggcagctagtatttgataaaacatgctggctggcctatttagcttggtttttcattttggtcattttagattacttgttacctggcaagtcattaaatggagtgaaattaagagatggcactgttttaaattataaaatcaatggtttgagcatgggttccttattaattgttttgctattggcacggttattccaactgaacagcgacagctctcttgaatattatttaccggaattacaatttatttacgacaatcaattacagttgatcattatttgttttttgttttcttttaagctagccgtcaccacgggcagaaatccgcgt

SEQ ID NO: 3876 - DNA, 726 bp, Candida albicans
tatcaatgtttaatcatgccgtcaatagatcaagaaataccaccgtcgccgacttcactttcgccgtcttcaccatcaataatagacaagatatcatcagttaaaaatgacgacaacaatcgcaccaagctttatctgatatattctttagaccaagtcaagatccatgacaaacctaatgacttatggatgatattatataacaaagtgtacgatataactaatttcacctcggttcaccctggtgatgttgaagtattacttgattgtggaggtgctgacgcgactgaagcgtctgaggatgtcggccactcatattttgcatttcaaatgttgaaaccttatttaataggtgaattgcaattactggataaaaaaaaatatgaaagcaaattattatctgcaccgaaaattgaagtcacttctgataataataacaccaacggcattactagcaagaaaggtaatactgataacaatggtattctcactaatggcaaacacattaaaactaaaaaaaccaataacaattccaacaacaatgacaatataaccactaaagacatccatcggaccgggatcaccaaaagcaaaaagaaaaggcgaaacaataataaaccaaacaaaattagagagcatttcagaatgctatcacttggtatattggcgcttgtttcattgatattgtttttatacatccaaaggtttagatggttacatatgtga

SEQ ID NO: 3877 - DNA, 1290 bp, Candida albicans
caatggccgccccggctggtgaaaatgcttgaagctcggattggtccaagatcagatgtatatagtgaagagccaagtttgaaaaaatgtcaatgggaatttgaaaaagatatggagaattttattcaaattgctgaaaaaatagttttcgaatacgaatggtctagatttgattccttggtattgccatctagtttcccatatggaggtatggaaatccccaatatgactcaattgacaccaactttaatcagtggtgatcgtactcaaaccaaagtcatggcccacgaattggctcattcatggtccggtaatttagttaccaatagttcctgggaacatttctggctcaatgaaggttggactgtatatttagaaagaagaattattggtgccattgcagcagctgaagccaaagaagaaggtagaaaagatgcagagaaatatggtgaacaagtgagacatttcaatatgattaatggatggaatgaattagctgatacctgtgaaacatttgataagagatataccaaattggttttggatttagagaatggtgatccagatgattcgttttctagaattccttatgaaaaagggtttttcttcttgtatcatttagagactaaattgggaggtataaaagaatttgacccatttattaaatattattttaacaaattcaaatatcaatctttgaatactgctcaatttgttgatactttgtatgaattctacgaaccaaaaggtaaagccgaaattttggacaacatagattgggaaacttggttatttgtttccggacttccagaaaagccagaatttgatgtaactttggccaatcaagtatatgctttggtagataaatggttcgcttatgtcaaaaatggaggtgaacttccaggtgacgaaactgccgattttgaaggtgagcaagacatgttgtttttggaaaccttgacagaaaaattcaagactcttgatgttaaacctgaaattattagattgttcccagaaatataccctaaatatggagcaagtaaaaatggggaaattatttctcgttggaacgaattgttgattagttatggtaaatactcatcccaagataaattggtgcaatcatttgctagttggttgggtacaattggccgtatgaaatatgtcagacctggatatttgttgttgaggaaaggcattagtcatgaatttgctttagaggtgtttaagaagtacgagcatatttaccaccctatttgcagaaccatggttaaaaaagatttgagttaa

SEQ ID NO: 3878 - DNA, 357 bp, Candida albicans
tacgttggtactcacaaaaaaaagtgtagaaacttgtgtcatctctttttcttttcattactcctttctagtcttctattaatatccacaactaacatgactagagcaattgtcgaaagcatcaaaaaacgtttccacgaattggatccatgtaccaactcgaattattccaagttcaaagttattcacacagatttgactttgacagtttcttttgaatccaaaacattggacggaacagttgtttatgatttgaaaaacttggataatgcaagtgaagttatattggatacatctgcattaaacataaaaagtacaaaattcaactcttcaccacggggctggaaggacccgcgc

SEQ ID NO: 3879 - DNA, 1260 bp, Candida albicans
tttaagcgagacttgtttaaagttggattagtcgatttggcaatgtatttatctacttattttgcctttttcgtgcaatatgcttgtaaaaatggatatttatcatggaaaaaagttggctggtggctacaagcagcatttgatggtttatttttatttttttggttatggatagctctggaatattgcttggatttcccatggattgccaaagtatttttagtgctccacagtttggtatttattatgaagatgcactcttacgcattttacaatggatacctctggctgatttacaaagaagggttatactcagagaaatatcttgataaattaacaaatggaaaagttacattaccaaaaggacacaccaaaaacgaaacagaaaaagtacttcaggaaagtatagctttcaccaaatatgaattagaatatcaatcccacgctactacagagaatcccgacgatcatcatgtattcgatatagatcagacagataagtcaattgccaaactacaacaagaagggttgatcaaattcccacagaatataactttattcaattattttgagtacagcatgttcccaacattggtgtacactttaaatttcccaagaacaaaaagaattagatggtcatatgtatttggtaaaacgtttgggatttttggtcttattttcttaatgatccttattgctgaaaacaacttgtatccaatagttcttagatgtgagattgccagaaagttgccagtactggaaagaatcccacaatattttttcttattgatggatatgatcccaccattcttgatggtatatttgtttacgttctttttgatttgggatgccattcttaatgcaattgccgaattgtcgaaatttgctgatcgtgatttttatgggccctggtggtcatgcactgatttttcagaatttgccaatcaatggaatcgttgtgttcacaagtttctcttgagacatgtttaccattccagtatcagtgcattcgatgtgaataaacaactggcagcaataatcacgttcttattgtcgagtttagtacacgagcttgtgatgtatgtcatttttggaactttgagaggctatttgttattattccaaatgtcacagataccattgattattatgagtagaagtaaatttatgaaggacaaaaaggtgttaggtaacataatttgttggtttggttttattagcggtccaagtattatttgtacactttatttagtgttttaa

SEQ ID NO: 3880 - DNA, 1335 bp, Candida albicans
aataacatatcctcttccagcccacagtatattttctcgtccagtcaaaactccaaatccagttctgaagaaacagctaaatcgtcatcctggacctcatttttaaagtcaattgcctccttcaatggagatttatcgtccttgacagcaccaccttttatcttgtcccccacttcattggtggaatattctcaatattgggccgagcatcctgatttatttattgccccaagtttaatcaaaaccacggaaaacccaaccaaagaagaaattgaagctatcaatttacagcaaatgatagccgttacaagatggtttatatctacattaaagtctcaatattgctcaagaaacgaaagtatgggtagtgaaaagaaacctttaaatccatttttgggtgaagttttcgtaggaaaatggcaagatgacaagacaggagagaccgacttggtgtctgaacaagtcagccatcatccaccggtgactgcatatgccattaaaaacaaaaagcacggggttgttttacaaggttacaatggtatcacatcaagtatttctactacttctataaatatcaagcaatacggacatgccttgttgaaatatccagaaatagatgaaacatttttgatcaccttgccacctttgcatattgaaggtttgattactgctgctccttttgttgaattggaaggtatctcatacatacaagcatccagtggtcacattgccgtaattgaatatagtggacgtggttggatttccggtaagaagaacacttttaaagcaagaatttaccgtgatgcgtatgctagtgccagcaaagaaaatgccttggtgactattctgggtcaatggtcagggaagtcatatattggtaaaggttcttctactccaacttccaaaaatgacgtgttttacgatgcaagcaaaaccccaactcatcatttgcaggtgaagcccatcgaagaacaacataaattagaatccagaaaagcttggtttaaagttgcagaagctattaagaagtccgactacaatttaattgcaactgaaaaaacgttgattgaaaatgagcaacgtaaattaagaaaacaggaaaaagacgcaggcataacttgggaaactagatggtttgataaaattgattacttaaacaaggatgcagatgcacctattaaagatgaatttacaaacttgaccaacatttcaaacttatccatccataatgcaccttcaggaactttgaaagactcaaagtatgaccatggtgaagccaagcattggagagttaacttgaaaaagttggaagatgaaaaagaaatagtcttttaa

SEQ ID NO: 3881 - DNA, 798 bp, Candida albicans
gtgactaccatggaagaaatacatataagctcttccattttgcaagatagtgattcagctcccccaaaccattttcagcatgctcaacagcaagagcaaccatcatggaagaaattgctatacttgcaacaaccatttccagacaattacactgatcaatcttttctatctcaattgaagagaaacacaactgttgccaaatattcctacaaaaatttggtacaggcgttttcatttattgttttctatatctcgtgcatccttttagttattttgatgtttattggaatatatgagaagcaatgggaccccataatacccacattaattagcaccggtatttccctattcggttttttcagtttaaagaatctatcaatgaacatgaggtcgttgatggtaattacatttatactccttattgtgtctccaatattgaaatcgctaacaaaatccacttcatcggactcaatttgggcaatttcctgcgtgttgtgtttagcaaactcgatatttcatgactattcaatgaaagtgagttatcgtccaatagtttccacaaacatatctttatcaaacgctattgtgttggcgtctagattgagcacgacattagacgtatttttgtttgtgttgttcgctattgaagttaatatactactaccgttatttgatgcaaagatccgactcctgggtctagaaactattcattggccaatagcatttctaacttttaatttgaccagttatttgatgtatatcttgttaaactataaatctttggtttactggatttag

SEQ ID NO: 3882 - DNA, 498 bp, Candida albicans
agacgaagatatttggaaatgattaaagataaaactggtgggttgttcagattggcaatcaaattattgctgttgtattcagatgtcacagaaaacgatcaattaatatcccttgcaaatttaatgggcattttgtatcaagttagagacgattatttgaatttagtggatgccaagtattctgcgatgaaaggcactacatgtgaagacttgatagagggaaagttatcattgcctatattacattgtctaagaaccactaaggattcacctgtacacaaaatactatatgattacgactctagctccgatcgtgtttcccaaaattctttaattgacttaagtttaagctttatgaaaaatgagtccaaatctttggagtatacattgaatttaattaaggtattggaaaagaaattaagacaattgattttgaagtatcctgagctggagaactctgcattattgaaaattgttgaacgtttatgtgatctttaa

SEQ ID NO: 3883 - DNA, 486 bp, Candida albicans
cactctagatatctctttgccacttccctttacattttattttcaaattacaacatgcaactagacattaacaaattaattcaacctactgaagcctacgttccagaatcttcagatccgatagtgcaaccttatacatatatatccgaaacccctagcaataatcaaaatgttagaactcggtttttacatgcattcaatgatttgttttacaagatttctgatgagtccttacttgcaagaataagtgaaattatttcagttttccataactcttcattattgatagatgatattgaagatgattccaaatatcgacgcggggtcccagtggcacatgtaaaatatgggatcccaacaacaataaattgtggtaatctaatgtattttgtggcgttacaacaagctcaacaattaagtggaccgcatgggagtatggaagtaaagttcacatcgtcacaaattttaattgacgagttgcttaat

SEQ ID NO: 3884 - DNA, 747 bp, Candida albicans
tattccatcaccttaccttctatttttgttcccaccataaccataaccataaccatgccatccgccaaatcgtcagatctttctcctacgaaaactaattttgaatcgactactaaacaaaaagtttcagttcaagatatttttttatacattcctaatttgattggatatttaagaataataactgccattatatcatttttatgtatggctaatcatccagtggccaccttaattttttatggaatttcgggatttttagatgcatttgatggatatgccgctagaaaattcaatcaaggtactagatttggtgctgtattagatatggtaactgatcgatgtgccactagttctttaattgtttatcttggagtgttatatcctcaatacacggtattttggcaaatactagtcagtttagatttatcatctcattatatgcatatgtatgctatgttatcagctggttctacttcacataaaaatgtcgatgaaactcaatcgaaattattatcattatattataataatcgattggtattattttttgtttgtcttataaatgaattgttttatatggcagtttatttacattattataaatttttttggttaggtacagtcatgctagtggcaagtactccaatttggttattcaaacaaattgctaacattatacaattgaaaaacgcatcattaatattggcaagaatggatgctcatgatcatagtaaaagagattag

SEQ ID NO: 3885 - DNA, 456 bp, Candida albicans
accaatatagattatatcccaaacaagatgtctgaatcagctactgataaatcacaattgtcaaaatttgaacaacactatttttcatcctacgatcattttggtatccacgaagaaatgttaaaggatacttcacgtaccttgagttaccgtaatgccatgtacagaaataaggatttgtttaaagacaaaattgttcttgatgttggatgtggtactggtattttgtctatgtttgccgttaaagctggtgccaaacatgtatattcagttgatatgtcgtctattattgacaaggccaaggaaatcgtggagttgaatggattcagtgataagattactttgttgcaaggaaaattagaagacatcaacttgccagttgacaaagttgacataataatatcagagtggatgggttatttcttgttgtacgaatctatgttggatacagtctaa

SEQ ID NO: 3886 - DNA, 591 bp, Candida albicans
  unsure (91): Identity of nucleotide sequences at the above locations are unknown.
tatgccagagacagatatcttgttgaaagcgggttgattttcccagacaaatgtcaaatgtacattgctggtattgaagatgcgcagtacnaagatgaaaagatacattattgggaggatgtttatgggtttgactacactccatttattaaaactgccatggaagaaccattggttgacactgtcaacaatcaatctttgattaccaaaggtacacagttttttgaatttgacattaataccgttacaaaagagcaattatctattaagagaaagtttgagttacaagcaattgataatgattactgtcatgcctttattgtgtactgggatgctgtattcccaggtaaacaaagagtcatcttaccaactggaccaatgcaccaatacacccattggaagcagacagttttttacatggatcaagtcttggatctcaagaaaggagacactattaacggtgaaattacagctgtaccaagtaaaattaatccaagggaacttgacattgatatctcatgggaagtaaaaactcaagccaatgataaatcaagagaattgaagggtggatacacttactttttacgttag

SEQ ID NO: 3887 - DNA, 999 bp, Candida albicans
aataacctcaaaccaacaatggctaaagcaccaaagaagaaattttcaactgcatctaaccctactgctaataaagttgcagctgaaaaacatttgaattcagtatttaaattcaacactaatttaggtcaacatattttgaaaaacccattagtggcccaaggaattgttgataaagctcaaattaaacctagtgatatagtattggaagtaggtcctggtactggtaatttgacggttcgtattctacaaaaagctcggaaagttattgctgtggaaatggatccaagaatggcagcggaattaactaaaagagttcatggaacacctcaagaaaagaaattggaaattctattaggagatttcatgaaaactgatttaccgtattttgatatttgtatatccaatactccttatcaaatatcatcaccacttgtattcaaattattaaatcaacctagaccaccaagagtatcgattttaatgtttcaaagagaatttgctcaaagattagtggccaggcccggtgaagaattatattgtcgattatcagcaaatgttcaaatgtgggcaaatgttactcatataatgaaagtagggaaaaacaatttccgaccaccaccacaagttgaatctagtgtggttagaatagaaattaaaaatcctagacctaatattgattttaatgaatgggatggattattaagaattgtttttgtaaggaaaaataaaactatagcggccgggttcaaatcttctaatgtgattgaaattttggaaaaaaattataaaacttttttggcaactcaagaaagtaataataatgattctatgatggtagatgataaatcaatttctttgaaagatgttgttaaaaataaaattactactgttttgactgaaactgggttttccgataaaagagccggtaaattggatcaaactgatttcttaaaattgttatacgcatttcatcaagtaggtattcattttgcataa

SEQ ID NO: 3888 - DNA, 948 bp, Candida albicans
  unsure (431): Identity of nucleotide sequences at the above locations are unknown.
ttgcgcacccagaaaaaaataatactaatccgagtcaactattctttttgctcatcatcatcatcaccaacaatgacttcaaccaacttagaaggtactttcccattaatcgctagaggtaaagttagagatatataccaagtagacgacaacactcttttgtttgttgccaccgacagaatttctgcttacgatgttattatggccaatggtatccctaataaggggaaaatcttaaccaaattatctgagttctggtttgcctttttacctattgaaaatcatttgattaaaggagatatttttgaaaaatatccacaattggaaaagtatcgtgaccaattagaaggaagatcattacttgttaggaaattgaaattaattccccttgaagttatcgtaagaagatacattacaggttcacgttgganagaaatacacaaaagcaaaactgttcatggtattccaattggtgatgtggtagaatcacaacaaatcactccaattttcactccttccactaaagcagagcaaggagaacacgatgaaaatattaccaaagaacaagctgacaagattgttggtaaagaattatgtgatagaattgaaaaaattgctattgatctttataccaaggcaagagactatgctgctactaaaggtatcattattgccgacacaaaatttgaatttgggttggatggtgacaaaattgttcttgttgacgaagtgttgaccccagactcttcgagattttggagtgctgccaagtataaactcggacaatcacaagaatcctacgataaacaattcttaagagattggttaactgctaatggtgttgctggtaaagatggtgtagccatgccagaagatattgctgtacaaactaaacagaaatacgtagaagcctatgaaaacttgactggtgaaaaatggcaagattaa

SEQ ID NO: 3889 - DNA, 393 bp, Candida albicans
ctgggaaatttgataagttatccaccaaaacagaagattcacatcaagaaacaacaaacacaaaaagatgacgtcgatgacattgacgttgaactagaaaatgataagaccgaaataaactttgatgatcagtacgtgttatttcaacttccaaagcatttacctacttatactcaaccaccaagtgccgtgaagttggaacccggtgttcaatcagttgaagtagacgagcctgcaactgaagaaaaagaaatttcaaaacttgctacaaataattcaaagctacgtgggaaaatgggaaagatcaacattcatcaatcaggcaagatcacaatagatttgggtaatgacattagattaaatgtgacaaaagtggcaccaactgatttctag

SEQ ID NO: 3890 - DNA, 771 bp, Candida albicans
aaaaaatacctatttcccatgagtcgtcaatttccatactcgagtgcgccgctccgttccgtcaaggaagtgcagtttggtttattatcaccagaagaagtaagggccatatcagtggcaaaaatagagtatcctgaaacgatggaccaaaccacaaagagaccaagagagggaggattgaatgatccacgtctaggatctatcgatagaaatttcagatgtcaaacatgtggtgaagatatggcagagtgtcctggtcattttggtcacattgaattggctaaaccagtgttccatattgggtttattgctaagattaagaaggcctgtgaatctgtgtgtatgcattgtgggaaattattgttagacgaaaccaatccagctatggcccaggctataaaaatcagagatcctaaaaagagattcaatgcagtgtggtccttgtgtaaaacaaaaatggtgtgtgaaaccgacaataacgaggatgaaatgaccgaccaaccttctcgtggcggatgtggacacccacaaccaactattcgtagagatgggttgaaattatgggggacatggaagcaaaacaagaattacgacgacaacgaccaaccagaacgtcgtttgttgaccccactggaaatcttgaatgttttcaaacacattagccctgaagattgttacaagatgggattcaatgaagattatgctagacctgaatggatgttaatcacacttttacccgtgttttcacagtgccgtaggccacaatgtggg

SEQ ID NO: 3891 - DNA, 1116 bp, Candida albicans
tactggattccaaattgggacggtgtgatcccgccaccagctgttgtaaagccaaaacaattgtggaccgggaagcaattgttgtcgttggcaattccaaagggtatccacttgcaaagatttgatggtggtagagacttgttgagtcctaaagataccggtatgttgattgttgatggtgaaattatgtttggtgttgttgacaagaaaactgttggggccaccggaggaggcttgattcacacggttatgagagaaaagggacctaaagtgtgtgctgaattgttcagttctattcaaaaagtggtcaactactggttattgcacaatgggttttccattggtattggtgatactattgcagatgcgcaaaccatgagagacgttaataagactattcaagaagccaagcaaaaagtgcaagagatcattattgatgcccaacataacaaacttgagccagagccaggtatgacattgcgtgagtcctttgaacataacgtatcacgtgttttgaatcaggcccgtgacactgctggtagatcagcggaaatgagtttgaaagatttgaacaatgtgaaacaaatggttacttcggggtctaaaggttcgtttattaatatttctcaaatgtctgcgtgtgttggtcaacaaattgtcgaaggtaaaagaattccattcgggtttggtgatcgttctttgccacattttacaaaagatgattattcacctgaatctaaaggttttgttgaaaattcttatttaagagggttaactccacaagaattctttttccacgccatggctggtagagaaggtcttattgatactgctgtgaaaacagcagaaacaggttatattcaacgtcgtttagtcaaggcattggaagacattatggttcactacgatggtaccaccagaaactcgttgggagacattatacaattcatctatggtgaagatggtatagatggtacccaagttgaaaagcaatcagtcgatacaatcccaggatcagacgaaagttttgaacgccgttacaaaatcgatgttttggatactgaaaatgtcatgtcttcacacacggcggctggaaggtcaacgtacgtgcagcac

SEQ ID NO: 3892 - DNA, 735 bp, Candida albicans
aggatattgcaggacaaccaacgggctcttcaaaaaaccgttgttccaataaaatctattagagcaagattgaaaggtaaagaaggtcgtttaagaggtaacttgatggggaaacgtgttgacttttcagctcgtactgtcatttcaggagatcgtaatttggatttagaccaagtgggtgtgcctatttccattgcaaagacattgacttatcctgaaattgttacaccttataatatccacaaattgactgagttggttagaaatgggccgaatgagcaccctggtgccaagtatgtgataagagatacaggtgatcgtattgacttgagatacaataagagggcaggggatatagccttgcagtatggatggaaggtcgaacgtcatttgatggatgatgatccagtgttattcaatcgtcaaccttcgttgcacaagatgtcgatgatggcacatagagtcagagtcatgccttactccacgttcagattgaatttatcggtgacatcaccatataatgcagatttcgatggggacgaaatgaacttgcatgtcccacaatcaccagaaacgagatcagagttgtcgcaaatttgtgcggtacctttacaaattgtctctccacagtcgaataaaccagtgatgggtattgtccaagacacattgtgtggtattcgtaagatgacgttaggtgatattttcattgaatatgatcaggttatgaacatgtga

SEQ ID NO: 3893 - DNA, 1341 bp, Candida albicans
gcgcggatccgtccagcccctgctgaatactacccagacgaaactggtgaattcaagcagggcaaggaatgggttttagaaaccgatggtgttaatttggcagatgttatggccgtgcctggtgtggattcgacacgtacttactctaatgattttattgaggtgttgtctgttttgggtattgaagctacgagatcgtctttgtacaaagaaattttgaatgtcattgcgttcgatggttcatacgtcaactaccgtcatatggcattgttggtcgatgttatgacttcccgtggtcatttgatggcaattactcgtcatggtattaacagatccgatacaggtgcgttgatgcgttgttcgttcgaagagaccgttgagattttgttggatgcagcagctgctgccgaattggatgattgtaagggtatatcagagaatgtgatgttgggacaaatggcacctttgggtactggttcctttgacttgatggttgatgacagaatgttgcaaaaggcaccatcgagtatggctatggatgatattgctgatggtggtggtgctactccatataaggactacgagaatgctagagatgagaacattgacattgacgcaggtgctggattctcaccaattcacattgcccaaatgaatgaaggaaatattggagggttgacgtcatatggtggccagcctacctcgcctgctgccacgtcgccatttagttatggatataactcgattacatctccagggtacacttcaccaggatatggttattcaccaacgagtccaagttactcaccaacgagtccaagctacgctccaacgagtcctgcatactcaccaacgagtccaagctacgctccaacaagtcctgcatactcaccaacgagtccaagctacgctccaacaagtcctgcatactcaccaacaagtcctgcatactcaccaacgagtccgtcctattcacctacttcaccacaatactcacctacttcaccaagttattccccaacatctccatcctactctccaacgagtccaagctattctccaacgagtcctgcatactccccaaccagtccatcttactcgccaacgagtccgtcctattcacctacttcaccacaatactcacctacttcaccaagttactctccaacttcaccacagtactcaccaactagtccttcatactcaccaacatcgccacagtattcgccaacgtctccgcaatactcgccaacgtctccgcaatactcaccaacatcgccacagtattcaccaggctctccgggatatgagccagagcctcctaagaaggatgaaaattag

SEQ ID NO: 3894 - DNA, 732 bp, Candida albicans
ggacgcggatctcttacccgtggtcaggcctggaagaattgttcttggggtgaaagattgtgtatgaaattattggttgttcgtggtgacactccgttagtcaaggaagcacaagagaatgcaacgttgttgttccagtgtttgttgagatccagattggctgccagacgtgttattgaagagttcaagctcaaccgtgcatcttttgaatgggtaatgggcgaaattgaaacgcaattccaaaaatctattgttcatcctggtgaaatggtgggtgttgtggcagctcaatctattggtgagcctgccacccaaatgaccttgaatactttccattatgctggtgtctcatcaaagaatgttacattgggtgttccacgtcttaaggaaattcttaatgttgccaagaacattaaaacaccagcaatgacagtgttcttggacccagaagttgcttctgatattgaaaaggcaaagattgtacaatctgccatcgagcatactacattgaagaatgtcacttcatcaacagaaatttattacgaccctgatcctagaacaactgttattgaggatgattatgatactgtggaagcatattttgctattccagaccaaaaggttgaagaatctattgacaagcagtcaccgtggttgttgcgtttggagttggaccgtgcgaaaatgttggataaacaattgaccatggcacaagttgcggaaaagatttcg

SEQ ID NO: 3895 - DNA, 2163 bp, Candida albicans
  unsure (2122): Identity of nucleotide sequences at the above locations are unknown.
ctcctcttcctcttcatcaaccacccatcacctccacctatgtcccactctataccaataacatcactgccacctccagcacttaaaaagttgaaactcccaaatggatcagaagaaccatctgaatttgaaagagaattgctcgacataacccaagctgttcacgattctacagatcaaacatgggatagaccaccattaccatcatctttcgaagacatatctttccaacaactagatgcagaagaataccatgatcgtggaaatacatatgctaggttttttggtatcacacaagaaggacactctgtcttgtgtaatgtaactgggttcatccactacttttactgtcctgtccctaaaggattcgaagaaaacttgacagaattcacaaactatttaaaggctaccttcgatggtattgaacgggttgaaataacatctaaagaatcaatttgggggtatagtaacaatatcaaaactccatttttcaaaatatttgcgaaaaacaacatatccaaaataagatctgctttccaaaatggacaagtacacaatatcgacccgtgcattacttatgacaacatcaactatttatcaagattaatgattgattgtaagattaccggtatgtcttggatcacattgccacgtgacaaatataaaatagtcaataataaaatctcaacctgtcaaattgaatgttcaatagattaccgtgacttgatatcacaccctccagaaggggaatggttgaaaatggctccacttcgtatcctatcattcgatattgaatgtgctggaagaaaaggtgttttcccagaagctgaacacgatccggttattcaaatcgctaatgtggtgcagaaatccggtgaatcaaaaccgtttgtgagaaacgttttcactgtcaatacatgttcgtcaattattgggtctcaaatttttgaacaccaacgagaagaagacatgttgatgcattggaaagaattcatcaccaaagtagatcctgatgtgataattggttataatacagcaaactttgatataccatacgttttaaatagggccaaagctttggggttgaacgatttcccatttttcgggagattgaaacgggtcaaacaagaaattaaggacgctgttttcagttcaagagcatatggtactagagaaaacaaggttgtcaacatcgatggaagaatgcaactagacttgctccagtttatccaaagagaatacaagttgcgatcatacacattgaactccgtttctgcacattttttgggtgaacaaaaggaagatgtccaacactctatcattactgatttgcaaaatggaaccaaagaaacacgaacaaggttggctgtttattgtttgaaggatgcctttttaccattgagattactagacaaactcatgtgtttggtcaactacactgaaatggcaagagtcactggtgtgccattttcatatttgttatccagaggtcaacaaatcaaagtcatttcacaattgttcagaaaatgtttacaagaagatattgttatccccaatttgaaaagtgaagggtcaaatgaagagtatgaaggtgcaacagtcattgaaccagaacgtggttactacgatgtaccaattgcaactttggatttcagttcattatacccatcaatcatgatggcacataacttgtgctatactacattgctcaacaaaaattccataaaggcatttgggttgacagaagatgattacacaaaaactcccaacggcgagtactttgtacattcaaatttgagaaaaggtattttacccaccattttggacgaattgttaactgcaagaaaaaaagctaaagctgatttgaaaaaagaaacagatcctttcaaaaaagatgtccttaatggtagacaattggcattaaagatttcagcaaactcggtgtatgggtttactggtgccactgtagggaaattgccctgtttggcaatctcttcgtcggttacagcatttggacgtgaaatgattgaaaagacaaaaaatgaagttcaagagtactactctaagaaaaatggacacccatatgatgccaaagtgatctatggtgataccgactttggtnttcacctacaggaggcgccaggaccactagttgttaaagaa

SEQ ID NO: 3896 - DNA, 480 bp, Candida albicans
caaataaacagaacactaacacaggaagagaacatgtcgacctacagatcaaaaagagctattccatcggctataaatactccaacaacagtaagagtacacagggtaaatgacacaacaagttcagaggcagaaagaattttaacaagcttcattgatgccagtgagataaacatttcaggaaaaggtaccgcagaaactaataccacaggtatttctggaggaaacgaaagtccggctattgtgtcacaattgaaaagaattcaaagaagcttgagaggattgcctccacttatgagtgaagaacagtttaccaagtcgaatgcgtctttagaagattctgaacgtcccaacaaaaagatcaagtttgatgaatctgatgacaatttatccactgagaaagtaacagaagacgaggaagataagttgaatgagaacatagaagaagtggtgtctgaagacgaaaaggcagaacactaa

SEQ ID NO: 3897 - DNA, 675 bp, Candida albicans
ttccggatgttccaaattcagttagatatggttttaattggtccttccaaggtgccgggaaaagtaactcaagccccaaatgtggaggaaaaattctgtgcttttcatttacccactggtgatatgttaagagcacaagttgctgctaacaccgctttaggtgttgaagcaaagaaaatcatggaccaaggtggtttagtgtctgatgaaattatgttcaacatgatcatatcagaattggaacacaaccgagaatgttccagaggtttcattttggatgggttcccaagaaatattcctcaagctgaaaaattggactctatgttggaaagcagaaagactccattggaaaaagctgttgaattgaagatcgatgatgaattattggttgctagaatcaccggtagattggttcacccagcttctggtagatcttaccataaacttttcaacccaccaaagaaagatatgacagatgatgtcactggtgaaccattagttcaaagatccgatgacaacgaagatgccttgaaaaagagattggtcacctaccacaaacaaactgagccaattgttgcatactaccaaaagactggtatctggagtggtgttgatgcttctcaaaaaccaactaaagtttggtctgacattttgaaatgtttaggtcaaaactaa

SEQ ID NO: 3898 - DNA, 819 bp, Candida albicans
atgaggcagaaatacatcagagtcaaaataattacagattttgaaaaaaaaaaaaccaaaaaaaaaaaatttagagaatcaagtaacacgaagttgaattatattttgcaagctattcgaagaataccttatttcataaacaccaacatagaaatgactttgaacataacagttttgatatcgggatccggtacaaacttacaagcacttatagatgctcagaaaaacaatcaattgaaaggtcaaattactcaagttatatcgtcatcggaaactgcatatggattaaaaagagctcagcaagcatgcatacctacaaaaactcatgtattgaaaacctactacaagggaaccactaaagatcaaaccgacgtgcgtaagcaacgcagagaacaattcaacgttgagttagctaatttactcatcaatggtcaaattcaaggttcggatgccctgtacacaaagccagatttgattgtttgtgctggatggatgttgattttatcaccaagtgttttacaacctttggagaaggcaggaatcactattattaacttgcatcctgcattacctggtgcattcgacggaacccatgccattgatcgttgctggaaagctggtcaagatggagaaattacaaaaggtggagttatgatccacagagtcattgctgaggtggatagaggcactcctattttggtcaaggagcttgatttgattaaaggtgaatctttagaagaatatgaagagagagtgcataaagtggaacacgtcgccatagtgttttcaacacgccgtggggcatccgcacttgctaac

SEQ ID NO: 3899 - DNA, 411 bp, Candida albicans
tataattttagtactgttgaagaattcaaacaattaattgatgagaacaaattcattgaatgggcccaattttcaggtaattattatggcacaacaattaaagctgtcaaagatgttgctgaacaaggtagaatttgtttattggatattgatatgcaaggggttaaatcagttaagaaaaccgatttgaatgctagatatctttttataagtcctccttctattgaagaattgaaaagtcgattgactggtagaggtacggaaactgaagatagtttacaaaaaagaattgctgctgcttctgatgaaatggaatatgcccaaactggtgctcatgataaaataatcgttaatgacgatttagataaagcttatgctgaattcaagaaatttatcgttgatgaacaataa

SEQ ID NO: 3900 - DNA, 948 bp, Candida albicans
  unsure (859): Identity of nucleotide sequences at the above locations are unknown.
ggtggcggcgcaataccgggcagtctcggccgtgtaagactagatgttcaattgagattattaaaatcattaatgcatcgtcctgaaattggcactaaacccaaaattgaatcaagtcaaaatctgaatccatttcttaaaccagaaccagaattaactattgttgataattataatgatgatgaatttaaaattgtttttaataaattccctgtagttcctcgacatttcatgttaattactaaagaatttaaatcacaaaatactccattatcaccatcggaattaatggctacttataaaattttacaagcattgaaaaatcaaaatcaaaatcaaaatcaaaatcaaaacctggatcaaaacaccgaaaattggtttgcattttataattgtggaccagaaagtggagcatctcaacctcataaacacattcaattcatgacattaccatcacgtgaacaattcaaaccatatgctgaaactcttttccaaaacaaagaagacgatgaacaacaacaagaaccacaaaagattgaaccaaaacaaaataaagatttaccatttgctcattttttcatccctatagttgctgatgatgtggttgatgaagaggaattgcctaatttatttagttcaattttaccaaaaacattaactgaattaagagaaactgagacaaaccatatatcatataattttattatgacattgaattatatgtcaatgattcccagatctaaagggaaatatggtggtgatgaaaataaagatgaagataaagataaagataaattagggattaattcatgtggattccaaggattgattttatgtaaaaatcaagaattatttgatntagttaaatcagttgggccattacaaatattaaaagatgttggtttacctaatagtagtcataaaactactactgaatatgattattaa

SEQ ID NO: 3901 - DNA, 2661 bp, Candida albicans
tctttttcttttgattttttctttcttccttattatattttctttatttcctttttatttacttcccaagtctttctttttaaatcacaatcaacaatgtatgtttataagagagatggccgtaaagagccagtacgtttcgacaaaatcactgccagagttcaaagattatgttacggtttgaatccaaaccacgttgaaccagttgctattacccaaaaagttatatcaggtgtttaccagggggttactactattgagttggacaacttggctgcagaaattgctgctacaatgacaacaattcacccagattacgctgtcttagccgctagaattgccgtatcaaatttacataagcaaaccaccaaacagtattccaaagtgtctaaggatttatatgaatacattaatcctaagactgggttacactctcctatgatttccaaggaaacctacgacatcattatggaacacgaagatgaattaaactcagccattgtttacgacagagattttaactacaattattttgggttcaagactttggaaagatcatatttgttacgtatcaacggtaaggttgctgaaagaccacaacatttgatcatgagggttgctgtcggtattcacggtaatgatataccaagggtcattgaaacctataacttgatgtctcaaagattcttcacccatggttctccttgtttatttaacgctggtacaccaagaccacaaatgtcctcatgtttcttgcttgctatgaaggatgattctattgaaggtatttacgacactttgaaatcgtgtgctttgatctcaaaaagtgctggaggaatcggtttacacatccacaacattcgttctaccggtgcttacattgctggtaccaatggtacttctaatggtattattccaatggtaagagtattcaataacactgcacgttatgtcgaccaaggtggtaacaagagacctggtgcctttgccttgtacttagaaccatggcacagcgacatttttgatttcattgatattagaaagaatcacggtaaagaagaaatcagagccagagatttgttcccagctttgtggattccagatttgttcatgaaaagagttgaacaaaatggtgactggactttattctcaccaaatgaggccccaggcttggctgatgtttatggtgacgaattcgaagaattatacaccaaatacgaaaaagaaaaccgtggtagacagaccatcaaagctcaaaaattgtggtatgctattttgggagcccaaactgaaacaggtaccccatttatgttatataaagattcatgtaacaacaaatccaaccaaaagaacttgggtattatcaaatcttccaacttgtgttgtgaaattgttgaatattctgctccagatgaagttgctgtttgtaacttggcttccattgccttgccatcatttgttgaaaatgatgaaaaaagtacttggtacaactttgacaaattacatcaggtcactaaggttgtcacccgtaacttgaacagagttattgaccgtaaccattacccagtcccagaagctgaaagatcaaacatgagacacagaccaattgctttgggtgttcaaggtttggctgatgcctttatggaattgagattaccatttgactctcaagaagctagagaattgaacattcaaatttttgagactatctaccatgctgctgttgaagcttcaattgaattggctaaagaagaaggtgcctacgaaacctatccaggttctccagcctctcaaggtttattacaatttgatttgtggaacagaaaaccaactgaattatgggattgggatacattaaaacaagatttggccaaacatggtatgagaaactccttgttggttgcaccaatgcctactgcttccacatcacaaattttgggtaacaatgaatgttttgaaccatacacttctaacatttactctagaagagtattagctggagaattccaaattgtcaatccatatttattgaaggacttggttgatttgggtgtctggaacgacgctatgaaaagtagtattattgctaacaatggttctatccaagccttaccaaacatccctgatgaaatcaaggcattgtacaaaactgtctgggaaatctcacaaaaacatattatcgacatggctgctgatagagcagcatttattgatcaatctcaatcattaaacattcacatcaaagatccaacaatgggtaaattaaccagtatgcacttctacggttggaagaaaggtttaaagactggtatgtactacttaagaacacaagctgccagtgctgctattcaatttaccattgatcaaaagattgctgagactgccggtcatacggttgcaaacttggacaaattaaacattaagaaatatgttaacaaaggaagagttgagagtgagaataccagtgatgctccatacaagtcaccatcaaccgaaccaacctcattagaaagttcagttgctgatttgaaaataaaagatgaaggtgaaaagccagctgaagacaaaaccattgaagaactcgaaaatgacatttatagtgccaaagttatcgcatgtgctattgataatccagaatcttgtacaatgtgttctggttag

SEQ ID NO: 3902 - DNA, 2253 bp, Candida albicans
agtcatttatcatcccgattacgcgatattggctggaagaatagagacagaaagctttatttaaaagtaccttatagttttagtgaaaatgtggaaagattacgaaaatatcgaccacggaaatccaactcgtattctccaatatcatctgctttttataaggtagttaagaaacatggagagtttttagataaagtcattgacaaaactagagattacaacttgacatattttgggattaaaacattggaaagttcataccttttgaaaattgatggtgaagtcgctgaattgccccagtatttatttatgcgcgttgccataggaattcaccaaaacgatatagacgctattgccgaaacatatgatttgatgtcccagaagtactttattcatgctctgcccacattgtataatgctggtagtgaattcaactatttatcatcatgtttcctagtagccatgaaagatgattcgatagatgggatattcaagactcttaatgaagcggctctaatttccaaagcttcaggaggaataggtattcatgtgcacaacattagatccaatggctcgtatattgccagcaccaatgggaattcaaacgggttggtacccatgttgcgtgtttacaacaatactgcaaggtatgtcgatcaaggtgggggtaagcgtccaggagcatttgccatatatatagagccatggcatggtgatatatttgatattttagaaatgcgaaaaaatcatggaaacgaagaaatgagaactagagatttgttttatggattatggatacctgacttatttatgaagcgtgtgaaagaaaattctgactggactttgttttcaccaaatgaagctgttggcctaagtgatgtttacggcgaggaatttgaaaaattatactgcaaatatgaatcagaaggttttggaacaaaggttagtgctcacaaattatggctagccattttgcattctcaaacagaaacaggtggcccctacatgttatacaaagacgcctgtaacacaaaatccaaccaaaaaaatattggtacaataaagtcttcaaatttgtgttgtgagattgttgaatattcgtcaccaaaagaaaccgctgtctgtaatttggcatcccttgcattaccgacgtatttgaaaacaacagaagatgctattggatttgattttgaaaaattgcactctgtcaccaaagtgttgacaagaaatttgaatagagttattgatgtaacaaaataccccgttgaaacagcagaatactcaaataaaagacaccgtccaattgctttaggtgtacaaggtttggcagacctatttgctgaacttcggttaccatttgattccgcaatggccaaaacattaaatattcaaatatttgaaactatataccatgctgcacttgaagcctcggttgaactagcaatgaaagagggcccatatgaaactttccagggctcaccggcatcaaagggaatattacaatttgatatgtggaatcataaaccttctccaatgtatgattggcatgctttaaaggacaacattcaaaattttggcttaagaaactcattactagtggcaccaatgccaacggcatccacctcacaaattcttggattcaatgaatgctttgaaccttacacttcaaatttgtataatcgtcgagtattagctggagagtatcaaattgtcaataaatatttaatcaaagatctaatggatcttggcatttgggattcagctatgagaaataagattattatggaaaatggttcaatacaaaacatacccaacattcctgacgaaatcaaacaactatataaaaccgtttgggaattgtcacaaaaggtgatcattgatatggctgcagatagaggaaaatttgttgatcaactgcaaagtatgaatatacatttgcgtaatcctacaattggtaagttgactagctgtcatttttatgcttgggaaaaagggttaaaaaccggtatgtattatctaagaactcaagcagcttctagagctatacagtttacagttgatgctaaagaagctgaaaaagttggcaccaaagtgccccaaaagtcattaaaacggaaaaaatacatggaaccccaacctcgcaagaagaccgcctattcaacacccgattcagaattatatgatattcacgattcaactccaattacttgtaatatagaagatttagagagctgtcaatcttgctctggctag

SEQ ID NO: 3903 - DNA, 2493 bp, Candida albicans
attcaaaatcttagaaacttctccaaaacttattcatttgagatttttattgaatatattccccaacacaattcagctttaactatgtcattaaacattcttgttattggtaatggaggtagagaacatgccattgtatggagattattacaatcaccaactgtgaaccatatttatgttgccccaggaaatggaggtaccattagtgaatcatcatcttctaaaatcactaatgtaccaataagttcatcacctaaagatttcaataaattacaacaatttgccgttgaaaataaaatcaatttagttattccaggaccagaacagccattagttgatggtattgccgatatattttatgctgttggtattcctgtttttggaccaagtgccaaagctgctaaaatggaaggttctaaagctttttcaaaagaatttatggataaacataacattccaaccgccagattccaaaatttcactgatgttgccaaagctaaagaacatattcaatctattgattataaaattgttttgaaagctgatggtattgccgctggtaaaggtgttttaatcccagaaactactgaagaagcattacaaggattaaatgaaattatggttgataaaaatttcggtgatgctggtaatgaaattgttattgaagaatttttagaaggggatgaattgagtatattgaccattaccgatggttattccttttataatttgcctgctgctcaagatcacaaaagaattggtgatggtgataaagggttaaacactggtggtatgggtgcttatgctccagcaccaattgctacccaagatgtattgaagaaaattaatgatcaaatcatcaaaccaactattgatggaatgagaaaagatggattcccaatgtgtggggttttatttactggtattatgttgagtccaaccaaagaaccaaaagttttggaatataacgttagattcggtgatccagaaactcaaactgttttacctttattatctgaaaataccgatttggctcaagttatgttagctgctgcccaacatagattggattccgtcactatcgaaaccaaaccattatattccactaccgtggtaatggcagctggtggatacccagaagcttatggtaaaggtgatgaaatcactattaaaaaaccattacctcaagacacttttattttccatgctggtactagtgtaaatgatcaaggtaaaattgtcacttctggaggtagagttattgcctccactgctattgctgaaactttaagacaatcagtcgataaagcctatgttggtgtcaatgaacacgtttcatttaataaaaaatacaatagaaaagatattgctcatcgtgccttccgtgatgccgacaaagctgctagtactagttctggttctggttctggtgtcacttatgctgatgctggtgtctctgttgataatggtaatttattagtggaaaacatcaaggctaaagtcaaatctactgctagaccaggagctgattctgatattggtggatttggtggattatttgatttgaaaaaagctggttacaacactgatgacactttattagttgctgctactgatggtgttggtactaaattaagaattgcccaaattatgaatattcacaacactgttggtatagatttagttgctatgaatgttaatgatttagttgttcaaggtgctgaaccattaattttcttggattattttgccactggtaaattagacattgaagttgctgcacaatttgttgatggggttgctaatggttgtatccaagccgggtgtgccttagttggtggtgaaacctccgaaatgcccggtatgtacgatgaaggacattatgacactaatggtactgctgttggtgctgtattgaaagataaaatattaccacaaatcaataatatgaaatctggtaatgtattgattgggttaaaatccgatggtattcattctaatggattttcattagtgcgtaaaattattgaaatcagtgaatatgaatatcaatcaccagcaccatggaaacaaggttctacaattggtgaagaagttttggttccaactaaaatttatgttaaacaattattatccagtataaatcaaggattattattaggtttagctcatattactggtggaggattagtagagaatattcctcgtgctttacctaaacatttacaagctactgttgatattaaacaatggcaagtaccagagattttcaaatggtttggtaaacaaggtaatgttccttatgaagatattttgaaaactttcaatttgggtattggtatggtattgattgtagaaaaagaaaatgttgataaagtattgaagaatttggaagaatccggtgaaaaagatgctgttgtcattggtgaattggttgaaagaaaacaaggtgaaccaggttgtgttgttaataatattgatggattgtattag

SEQ ID NO: 3904 - DNA, 432 bp, Candida albicans
cggctaatctctttgtataaatataccttacggcctagctatcacacttacgactctttaggggaggataataaaaataaatcagtaatcaatatggcatcctttagattttgtgcagaatgcaataatatgttatatccaaaagaagataaagaaggtcaaagattactttatgcttgtcgaaattgtggatatactgaattggcagaaaaccccaaagtatatcgtcatgaattgatgactaatataggtgctactgcaggtgttgttgaagatattggaaatgatcctactttacctcgatcagataaagaatgtccggattgtggacatcatgaatgtgtgtttttccaaagtcaacaacgaagaaaagataccagtatgattttgttttttgtttgtttgaattgtaaacatgttttccaggcgtaa

SEQ ID NO: 3905 - DNA, 1512 bp, Candida albicans
cttttacttttacttttttttttgtcaatgagtaaatttcttattttgtcagggccaaaagctttatctgattttagaatcaataatttgattcaagaaattgaaaaaaaaattggtcaatcagatataattgataaagttgttggttcatttactcattatatttcattacaacaagagcaaggtgatttaactgataaacaattggaattattaaaaattttattaacttatgataaccctcttgaaactgataatgatgaaaattcatctttaaataaaattttaattaaaaattctactgttattgatggtgaatctattgaattacccccaaatacttatttgatccaaatattaccaagaccaggaacaatttctccttggtcttctaaagctactgatattgctcaaatttgtggattaaaagatcaaattgaaagaattgaacgaggattatcattattaattaaaactaaaactggattcaaattagatcaaaacgacaatgacgataataatgatagtggttctaattctaattctattcctattgaaactctgttaacttcagttttcgatagaatgacgcaactgatctattttggtaataatgttcctcaatataatgatttatttgatcatcattcaccaaaacctttagtcacaattgatattatttctgatctggaaaatttaattaaagctaataaagaattaggtttagctttagatcaaggtgaaattgattatttaattaatgcatttaaagaaatcattggtcgtaatccaactgatgttgaattgtttatgtttgctcaagttaattctgaacattgtcgtcataaaatttttaatgctgattggactattgatggcaccactaaagaattatcattatttaaaatgattaaaaatactcatgaaaaaactcctcaatatactatttcggcttattctgataatgcagcagttttcgaaggtcatgaaggttatgtttggactccagattttaagacaaaacaatggaaatccattaaagaaaaagttcaaactttagttaaagtagaaactcataatcatccaaccgcagtatcgccatttgctggtgctgccactggttcaggtggagaaattagagatgaaggtgctgttggtagaggttctaaatctaaagcaggattatcgggattttctgttgctgatttaaatattccaactttgcctcaaccttgggaaagaaatgttggtaaaccaaatcatattgcttcatcattagatattatgttagaagcccccattggatccgctgcttttaataatgaatttggtagaccggccattaatggttattttagaactttaactactgaagtggaaaattctcatggtgaaacagaaattagaggtttccataaaccaattatgttggctggtggtatgggagcaattagacctgatttagctcttaaagatactaaaatcttcaccacggggctggaaggaaccgca

SEQ ID NO: 3906 - DNA, 618 bp, Candida albicans
gtgctggtgccggatgggctaaatcagttttattccatgataaagctcgtcaagaatttaaaaaatttttccaagatagaaatgatacatttgcctttggtgcatgtaatggatgtcaattttttaattagaatagctgatttaatccctggtactgaaaatttgcccacttttgaaaaccatttatcagaacaatatgaagctagatttgttatggttgaaattgaatcatccccacagaaaaataattcaatttttttgaaaaatatgaaaggttctaaattaccaattgctgtagctcatggtgaaggtagagctcaatttaaagctttacaagaacaaaaagatttccaattggatgtgattcattatgttgataattatggtaaaattacggaaaattatccttttaatccaaatggttcaccaaatggtattgctggtattactaattctaatggtagagtattagccatgatgcctcatccagaaagagtttgtagaaaggaatcaaattcttggtatccaattgaacaaggtaaagaatggggtcaatatggtccatggattgaattattcaaatctgctagagaatgggttggtgataataggaattag

SEQ ID NO: 3907 - DNA, 660 bp, Candida albicans
agaattagagcagttttccaaattaaatttaaagattataccaaattccaacaaattttcttggataatggaattgatgaaaatttcatccaaattattggtaaacctaaatttgattctaaacaattaatcgatatttcttttaatggtacaccaatatattcatctactcgtggtcatttacaacaattatggtctaatacatcttatcatattcaaaaattaagagataatccaattacttctacacaagaatatgatgccattaaagatgataatgatccaggtatttcatatcaattgacatatcaaccaaatgaattcaaaaaatattctctgcaacaacctaaagttgctattttaagagaacaaggggtcaattctcaacaagaaatggcttggtgtttccaacaagctggatttgatgtttatgacgttaccatgtcggatattttagaaggtataaccacattagatgattttgtcggaattgctgcatgtggaggattttcttatggtgatgttttaggtgctggtgccggatgggctaaatcagttttattccatgataaagctcgtcaagaatttaaaaaatttttccaagatagaaatgatacatttgcctttggtgcatgtaatggatgtcaattttttaattag

SEQ ID NO: 3908 - DNA, 1155 bp, Candida albicans
ttgggggctaaatttgaattaagatctatattatcgttagaaccaggtatgtcaccaatggaaatttggtgtaatgaatcccaagaaagatatgttttaggagtagcaccagaaaatttggatttatttgctaagatttgtcaacgtgaaagagctccatttgcagttgttggagttgctactgaagaacaacgtttagttttaactgattctttattaaattcaactccaattgatttagaaatgtcagtattatttggtaaaccaccaaaaatgtctcgtactgcaattacttcaaatttaaatttgactccatttgaaaccactaacaacaacctagatgttagtgaatctattgatagagtattacaattacctgcagttggatccaaaaatttccttattactattggtgatagatttattactggattagttgatcgtgatcaaatggtgggtccttggcaagtccccgttgctgatgttggagtcactgctacttctcttggtgatactattttatccactggtgaagctatggctatgggtgaaaaaccaacattagcattaatttctgctagtgcatcggccaaaatgtgtgttgccgaatcgttattaaatatttttgcagctgatatcccttcattagatcatgttaaattatcagctaattggatgtcagcagcatcccatgaaggtgaaggagctaaattatatgaagcagttcaagccattggtatggatttatgtccagatttgggtatttctatccctgtgggtaaagattccatgtcgatgaaaatgaaatgggatgataaagaagttactgctcctttagctttaactattacttcatttgccccagttgataatacttctaatacttggacccctcaattacaaaatttggatgaacaacaacaagaagaaactgtattagttttagttgatttggctgcatctaatgaagccggaaagtctttaggtgggtcagctttagctcaagtttataaacaagttggggattctgcaccaacagttcattctcataagattttgaaatcatttttagaaactcttattgttttacataaacaatttgatatattagcatatcatgatagatcagaaggtgggttaattactactgtttaa

SEQ ID NO: 3909 - DNA, 897 bp, Candida albicans
ttcaagtcggttgatcacaacaacatccaaggagatgaattacacgaagcatttggagccggaaaacttaaagtggtaggaattattgaccaccatgaggatgaaggacaatttgttgaatcgcaaccaagaattatacgtacttgtgggtcaaactccagtttagttttcaattatttttacaatgaattctttaaaagtaatacctcaaaattcttagaaactcaacttgaagctataaagttattgttgggaccgttgctcattgacacttccggtatgactcaaaaagtcgaagaaccagatacggaagccttttccatttaccaaaaagcattagaaggagatgaaaaatttatacagttgtttgcaaattctggagataaagatccatacaccaactactattctactttaaaggcagctaagaaagatgtctcaggattcaaatttgttgatcttttgcgtaaggactacaaacaatttacatttgatagtggtgacagagttgggttcagttcagtcactaaggcattcaaatggattgtggccaattactccaaggaagaaatcggaaaaacattgatcaaaacacttgaagagaacaatattgatttattgattattggaactcatttcactcggaaggacaatgacaagtacacaagagaattcggttactattacaaaaagctggaaaacgaaaaattcaacaatttgcacaatttggcagaaacaaaattgcaactcaataatgaagtttatggagccgacaagattgtatcaacagttgaaaccttaagcagccacggtaacttcaaagtatttaaccaaggaaatataagtgcgtcaagaaagcaagttgttccaattgtaaaggagattcttgaaaattga

SEQ ID NO: 3910 - DNA, 285 bp, Candida albicans
ctcattttgattgacacaacagaaatgaccaaaatcaaggtgctatcaggtgaagaggaagatttcgatagtgttaaaatacacaagctacttgaagaagtcagttttaatttgggagacctagacctagatcaaattgtggaaagtgtgcaacgcggattgccttcatctttaaccatagaagaattatacacatttattgccgaagtgatcgctagtagagtcatttatcatcccgattacgcgatattggctggaagaatagagacagaaagctttatttaa

SEQ ID NO: 3911 - DNA, 456 bp, Candida albicans
aaaaaaaaaacagaaggctcaaaaaaacaatcaacaaatcattgtacaagtaacaggtacatccaaccgtactacctttcaatccgaatattgcacaaatatagacagtacactatggaaatagatagtcatgaagggccatcggtcactattagggaagcggaaaaagaccatgtcaattttatattgaagaatgtcgacttggctgtggcaaactcaatgagaagaaccattatagccgaagtgccaacactagcaatagatttggttgaaatagatgttaacacgtcggtattggcggatgaattcttgtcccatagattaggattgattcctttagttattgaaggaaaccataacttgacttactcacgagattgtacgtgtgacaactactgttctaaatgttctgtgaactttacattaataccaattgtgctaccgaattcaccatga

SEQ ID NO: 3912 - DNA, 1074 bp, Candida albicans
aaaaaaaaaaaaacagaaggctcaaaaaaacaatcaacaaatcattgtacaagtaacaggtacatcccaccgtactacctttcaatccgaatattgcacaaatatagacagtacactatggaaatagatagtcatgaagggccatcggtcactattagggaagcggaaaaagaccatgtcaattttatattgaagaatgtcgacttggctgtggcaaactcaatgagaagaaccattatagccgaagtgccaacactagcaatagatttggttgaaatagatgttaacacgtcggtattggcggatgaattcttgtctcatagattaggattgattcctttagttagtgaaggaatcgataacttgacttactcacgagattgtacgtgtgacaactactgttctaaatgttctgtgacattacaattaatagcaaattgtgctaccgagtccaccatgaatgtttatgcttcagatttgcaaaagatgtctcataacggctcaaaattgggtgatccagtcatcagagatccccaagcaagaggtccattgatttgtaaattaagaaagcatcaagaattatcacttacgtgtattgctaagaaaggaatagccaaagagcacgccaaatggtctccgactgcggctatagggtttgaatatgatccttggaataaactaaaacataccgactattggtatgaagttgacgccgaggcagaatggccaaaatcgaaaaactgtgactgggaagaagcacctgatccagaggcaccttttgattataaagcaaaaccatcgacttactattttgatgtggaaactgttggtaacttgcctccaaatgaagtgattatcaagtctatagaaactttgcaaacaaaattggcagctatttcaattgaattaaataaggaagatgttgaagttaatgaagctgcagctggtgggttcactagttatggtagaactgagtatggcagaacagaatatggtggtgctgatggaggtcaaactcctggtggtagaacaccatatggtgacagtggtttcggtggtgctcaatggggttaa

SEQ ID NO: 3913 - DNA, 549 bp, Candida albicans
gtgggtcaaggacatcattgtggaaacaaaaatcgtttgagtcggaatcataatactaatgtgggtgatattaatggaggtaatggagatagtaatattgatggaaataatataagtaataataatgataaagacataaatggagatagacaaaataaaggtaacaacgacgacaatgatgacgacgacgacgacgatgacgatgacgatgatgaagatgatgaagatatgaaagaagatgaaatatcaaatatggaattagcaggaccaaattcaaatgaaattgttcataaaacattaaattttttaactaattttgctagatttaaaaatcgatcaagttgtgaaactgttgaaaaattattaaatgattttagtgaacattgtaatgaacctttacatccatttgaattggctcaattaggtacattagaatgtgaagatccagaagaagcaaaatctttaataccaagtttacaaaataaagtatcagatgtacaattacaaactttattaactgaattaagaaaatatcaaaccttgtcataa

SEQ ID NO: 3914 - DNA, 1236 bp, Candida albicans
gtttttaaaaccagtactttacgaacactaaaaaaagatataccattaacaatgtcaaaaaatacagataacaacaaaccatcacctaaaaaagtaactgagaaaagcactccaattgtaacgaaaccagagtcagataagactgtcgaaaaagcttccgacgacagcgaaatcgatcttcctgaggtgtataaaagacacagagagtttttagccaaacatgtggttaacagacacaagttaaaacaagaagagtccaacgagccattgcttacaccagacaagacgcgtcataccatatatccgataaagtatcccgagttatggcagttctataaaaagtcgttagcctcattctggactgctgaagagcttgacttgagtaaagatttggatgattggaataataagatgaacgaaaacgaaagattctttatctctcgagttttggcattctttgctgcatcggatggtattgttaatgagaacttggtggaaaatttctgtgcagaagtgcaaatacccgaggctaaactggtttacaagtttcagatcatgatggaaaacattcattcagagacttattcgttgttaatagaaacatatttcaaagaccccgaagaagcagactttttgtttaatgctattgacaatatcccatttataagaaaaaaagccgattgggcaatcagatggatccagagcgaggatgctttgtatgctgagagattggttgcatttgctgctgttgaaggtatatttttcagtggctcgtttgcagcaattttctggttaaagaaacggggtttgatgccggggttgacattttccaatgaattaatttgtcgagacgaagggattcacacagattatgcctgtttattattttcatatttaaaaaataaaccttcttcagaaataattgagaaaatcatcaccgaggctgttgatatcgagaaagaatatttcagcgatgcgcttccagtatccttattgggaatgaattgtgacttgatgtgccagtatgttgaatttgttgctgatagattactagtagcttttggaaataaaaagtactacaatgttaccaacccatttgattttatggaaaatatttccttggctggtaaaactaatttctttgaaaagagagtctctgattatcaaaaggctggtgtgatggaaaaagtggaaaataagaatgagaaaactggattgtttgatcaagatttctaa

SEQ ID NO: 3915 - DNA, 1083 bp, Candida albicans
agattaacacaacttaataacatccatctcataatgtccgtacaagaaactccaactaaaggtttaactggtaaaatttccgacttagacatgtcaaacatgaaaggtaaatccttgactgataaattagctgctgatgccaaattaaaagatgaagctcaaaccattcacgaagtcaaacaagccgttgcatccactgacaaagcaactgaagaaaaggatgacagtctcaaaaaacatcaagactttttggctaaacacaaagtccacagacacaaattgaagcaattagaagctgaagaaccattattggttgaaaacaaacgtcgttatgtgatgttcccaatcagataccatgaaatttggaacttttacaagaaggctgaagcttccttctggactgctgaagaaattgatttgagtaaagatttggatgactggaacaacaaattaaatgaaaatgaaagatattttatttctagagtattggcattttttgccgcttccgatggtattgttggtgaaaatttaattgaaaatttctcaactgaagttcaacttcctgaagccaaatcattctatggttttcaaatcatgatggaaaacattcattcagaaacctattctttattgattgaaacatatatcaaagatccccaagaggctgattacttgttcaatgccattgccaatattccatgtattcaaaagaaagctgactgggctatcaaatggattcaagatgatgaagccttatatggtgaaagattagtagcttttgctgctgttgaaggtatcttcttcagtggttcatttgcttctattttctggttgaaaaagagaggtttgatgccaggcttgactttctcaaatgaattgatttgtagagatgaaggtttacacaccgactttgcctgtttgttatttgctcatttgcagaatagaccatctccagagattgtcgaaagaattattactgaagctgttgatgttgaaaaagaatactttactgatgttcttccagtgtcattgttgggtttgaactgtaacttgatgtgtccatacattgaatttcttccctga

SEQ ID NO: 3916 - DNA, 1059 bp, Candida albicans
ccattaaatcaggaaagtagctcaaatacggagcaattgaaatcgtccactactcctaatattcctgctcgtccacaaacaagaccacagaaacaaacaacaacaacaacaacagtacctactgatcaagactcaactaccgagacatcattagaaaaaccattagataatcctcaagatgaactagacgaattggctcatgaaattgagaaagtcttaagtgatcctgtgattccacctcgtcctcaacatggatcgtcgacaaagtcaagtgaaacacaaacagaacataaagaacaagattttgagccagcgcatccagctattcctcaacgtcctacgaataaaaaagaaacgattcaatcagaggtgggtgaccacaaaaatggacttgaatcgaaatttgatttgaaggtaaatgaagaaaccccagctgatctggtatccactgacaaggataaagtacatatcaaaccttctattcgtaatataccatctcgtcctcaaagcagaaatttggactcttctgaagttgacaacacaaaaccatcaactactgcaagtattcctgctcgtcctcaaagacaaagtacatcaacacaagatgaatataagccacaagcttcaaatacacctgacattccaactcgtccccaaactaaaacggaaaagtcagttctgagcgaagaattagataaaccaggtgatgaacccctgtcaaaggaccaagacaatgaaagatacacagatgatagtaatgcctcgaaatcaattcttgaaactgaaaaagccgtagcacaggaagaaaagaaagctaagaagagtgacgttgacaataagccatcagaaccaaccaccagcacagattcatcaacagaaccaacagctccagcaagaggtttcagattacctttacatatgcagcaaggtagcggaccaatatctacaagtacaccagttgctggatctgaagccgaattgaattcattgaacaactcaaatacttttggtgatggagaagtcactccaggaaactctgataccaaagttaacatttaa

SEQ ID NO: 3917 - DNA, 2085 bp, Candida albicans
tcagagccaaaaattacggcattcccggcagaatttgttgaaaaggttccaaatattgaaaaattagtgcttgacaaaaatcatttagtgtctctccctaatgaactttgtcaattgtcaaaattagtatcattatctgtacatgccaataatttgcagtctttaccagcaaacattggagatttaagatttttgaaatatttggatttgcacagtaacaatttgaaatcattgcctgatcaaatttgggatctttgtcatttgacactgttaaatgttgcatccaataacttgacttcattccccaaggctccttattctgtcgtgaaaaggttatcttcgtctcttgttgatgtacatctcgaatcttcgcaaactttatctttagctgacagtttgttgattttaatattgtctgataatcgattaagtgacgattgctttgatgagatttcatttttgatagccttaaagtcgttgaatgtgtcatacaatgatttaatagagattccacaggggacattaagtcgtttgactaggctcaatgagttgtacttgtcaggaaatgaattgacaactttaccagctgatgacttggaagtgctaaagtcattaaaattgttatacatgaataataacaaacttgtttcactcccagcagagttgagccgaatcgccaatttgcaacatttggacgttagttctaatcaattgaaatataatatttccaattggccatacgattggagttggcactggaataaaaatttaaaatatttgaatttttccggtaataaacggtttgaaataaaacaaagtcatattaagaatcccgaaacaggagaggatttcgatagtttattggtattgaagcaattgagagtgttgggattgatcgacgttacgttgacgacaacaaacgtgccagaacaagctgttgacttgagattgagaactactgcttctgaatttgataattttgggtatggggtcagtgattctttaggtatgagggaccatgtttcagcacgtgatttatttgtccaaaagtttagaggtaaagaaaacgagatgttgctttgtgcatttgatggtaagcatggggcaaccaatcaaggtcacaggatctccttggttgcgaaaaacatgtttgtgagaaatttcacaaaagaattggatgaaataaagaatgatgatgaaatagaaaatgcccttagaaaagcttttttgaatttcaataaagaaatcaatggtattttgaccgctaaaaagaacaagtcatttacacctgtgcctaacatgtcaaaagaagctcttgaattgaatttggtagacgatggtaacgctggttgtaccgtgtctgtgatttatattaaagataagaaactttattctgcaaacattggtgacattgaggcgttactttgcaggaacaatggtgatcaatttttacttaccgaaaaacatgatccaaccaatcgtgaagagtttgaaagaattagagcttctggcggatatgtttcaggtgggggagagttagatgggcaattatcagtgtcacgaggggtaggatttttcaactttttgcatcatacacattgtgggcctactattcgccggtttaaaataactaatgacgatgatatgattattttgggaagtaaacagttgtgggatttcatttcttatgaatcagctgttgacattatccgtaaagataagaatgatcctatggtggccgcacaaaagttgcgagattttgctatatgttatggtgcaaccgataaaatttgcgtcattgtcttaacttttggtaataggcagaaacaagctgccaatatgtattcaaattatggtgttgatagaagacgtcgagataagcaacaagttgttggtggagactctaatctccgtaaattagaacaagagattgagccaccaataggaccattagctttggttttcactgatatcaaaaactcaactttattatgggattcgtacccggcacctatgagatcagcaatcaaaattcataatacaataatgcgtcgatgttcaccacgggctggaaaaaccgcgtcc

SEQ ID NO: 3918 - DNA, 705 bp, Candida albicans
  unsure (663): Identity of nucleotide sequences at the above locations are unknown.
gttcaagtcacattattcgagtattcaaagaagattacactttcacgacaatcttatgtcccttgggaaacaaccaccagtgagcttttaactattgtgcaaaagaaattctttcttgagtcaacaaccaatttccaactatcggtgtgtattgggaactgtgttaaggtattggaagattttgaaaagcctctcaagattcaaatggggttacttttactcagtggttatacagaagaggataagttgagaatgttgggaagagaagacttgtcatttgtgtgcaaatttgttgttgaaaacatatttttgaggagtttgactcatgatgaagaagttttattgtcacggaattacgtcgatgtcaatatatcttcactaaatttgaaaaatgtccctattatattccatcaacatacttatgagattgaaaaattaaatgtggccaataatccctccatatacttgccattggatttcattcagggatgtactagtttggcgtatgtggacttttcccacaatgggtgttctaaattccccaataatttattagaagcaccccaattgactcatttgaacttggaaatgaactttttggatgaaataccccaaagaataagttgtttgtcaaatttaactaacttgaaagtgcgttcgttnttcacctacgaagggccgactccgaaatatatgtgcagggaa

SEQ ID NO: 3919 - DNA, 1272 bp, Candida albicans
acatttcctaaagggttttaccttttgaaaaatatcaaatttgaagcatcaacaattgttaattttaattttgaaaaatttattcatttaacatctttaagtttactgaatattgattttgctcaatcaagaaaattggaattccccttggggttaaaaaaattggaatttattgattgttctatttcatctcatatactggcattcccggattctttaagagtattggtgattacacgaggtaaatggagcaccaaaagaaatgccaatatttctcgattgcaaaaattaatagtatatgaagttcaaattaaagatttaactgaaaaaataaacagttgttttggattatttcatcttgaagtgatcaattgcaatttaaataatgttgagacattaaagttgtccaaaaatttagtatatttgaaatttattaatgttagtctagttggcgttaagttcccaatgttcccacaatcattagaagtgattaatattgaacggaacggaattctgcaatgtgaattgaattgcaattgcaattgcaatagcaatagcaatagcaaattgaaaacattaagaattgctcataatgatttaactgatgagtttgatattagtagtcaaccggttcatgatgttaatttagaaggtaataacaatttaactttagtgctactacatgataaaaccaaaatattaaatgtgtcgaatacaaatattcaacatattattggcaatggtcttactaaacttgtattaaatggatgcaacaacaacaacaacaacaacaacaaaattgattggaaatcatttaaattatcacaatttgttacccaattaagtcttcaaaattgtcaacttgaaacttttgaatttgaatctaatcaagaaggaattgaattaaaacatcttaaagtattggatttatcgaaaaataaattacacctgataaatttggttgaatatgagaatttagaagatgttgaattatcaaataatgaattgaaaaaactttccaatgacaatttcccattgaatatcaaatcaattaatgcagagaaaaaccagattcaacaagttgatttacaagaattatataacttgatatggttacaaatttctgaaaataaattgaatggaattgaacaaattcaaattcctaatagtttagacacattaattttaaatggtaatattttcaatgaaattaatgatgcaaattttaaattatcggaaaatttacgacatttggaattgaataaatgttaa

SEQ ID NO: 3920 - DNA, 1902 bp, Candida albicans
tcgtcagttatgagtagatctcaaatagttgcgttattgaaggagcaacttgataccattaaacagaagaaatcaatcaaactaaactccttaccatctaccaccaaaccgtcagaattgatagatacaatatatgagtttttaactagttttgatccgtctttggagttagagaaattggcaatacaaaacagccaactcattgaactaccatcaaacttccacaaaattgcatcgtctataaagtatttggatttacaccagaattcaatttcgtatattcctcaagattttttttatgggtttgatagtttggagatcttggatttagcatccaatgacttggagttcttgcctgactcgttgtcttctgttaccacgttgaaggtaatttctatcaaagataacagtttcaagtacatatcgccacagcttggagaattaccaaatttgaacttaatcgaagtgtcagggaatccatcactacttccttcgaacgacataattcgagcattccagcaacaaaaacctgatctagattgggtgggagagttgaagaattatttggtcgccaatagaatgctcattaatctgaaaattcaagaggccatggaaaagtcgtcgcaaaaacgacaacaagtaccaaaagattcgacaccagaaacgtctcaaaccacgagtgatccagtaatagcgagaagtaaatccggatctatatcgacctcgttttcatcaaaggcatcacggagaatggggttgattatcaagaaatcagacgaaaacagtgacggatcctccaaagaagatgccaataatagtttaatctctggggctgtaccggatcatgtaaccacagaaggcattcctcatgttgactcaccaacagacatctccttccagttgccaaagtcgccacctacatctacaccaggaacaaccacaccgtcaacacaaactgcacctgctacgacatctactaataagaaccttggcgtgacactgacatcatcggcacgaggacgttcaaacacttttaaagagatcgatcggatgcttgaaaaaagcgaaagtgtcgatactgaacgtaaatccaatgcttatttcaaacgtttgtccaccttgcaagaacttcctggtgatgagttatcggagtattctcaacccaaaaaacccgcagcagagggcaaacaagcttctggaaatgtgtcaaaatctaataacaccgctgccagcgaaaattccccagccaaacctcaacagcaaagtaaattgcacaccaatccagtcattattagagtatctcgtaaaatccttttttcatttagtgaactacattcatccattcgtagattcacttcgttttgctcagataaaaaagtcacgatgaaaatggtgtcatacctttatagcacaaaatctaacattgattctttagtggagaatcttgaaatcatggaagaatccggcgacaattcagaacaaatagtgcaagctttacacaattgcataggctcgttcaaatcgattatgaagcttctccatgagaatatccagtcttttgttggaaatatagaggtttgctttataagaatggtctatttatctgtgtttggatcgttgaatgaactacaaaatgcttacttgttgttgtgtcctaaagcaagtgcaaagtcttcttcaactgaaatgaaacagaagctttccatcaatactactacggatgcagatgaaaagttgtacagtacaattgaacgggctactaacaacaccccgaacatattttccgagttgattaaagacaaccataaaggtggaacactaattgcccaaggagggctatttcaccccaccgtcgcttccccgataaaagaaataagccccggtgtgtgcaacacccgctaa

SEQ ID NO: 3921 - DNA, 777 bp, Candida albicans
tatatgtatcatttaccaaataaccttgtacagttgcacttggcttcctgggaacagggaaagatgggagttttcacccaaatggttaaatggccattgatgttgactaatatcatatttcataatttcaatattaataatcacacattggagtttttgaattttaaggaatccagacttgaggaaattaatattcgtggaggtaacgtcaacaagttagatgccgatttatttcccactagtgttaaatacctaactttaagagaaatgaaaatccaggaattgtcagattcatttgaaaatttggaaaatttacgcaggttgtctctagcaagaaatcaattgaagatggtaaaccctgtgaaattgccggtgtcaacattgcagactttagatctaaaacaatgtaacgttcgtttcatatcgccatttttggtgtcaatgctcgaggaaaagaataaaaatcctaaactacatgtatacgccacggaaaattcaaatattagtgtaattgacataagaacagcattgaaattggttaaggggctagtgctatttctcaatgattttgataaatctttgacggaaatatccagacgttcttcccgtttgatctgtataggagagagtcgagatcctcattttgagaattatgaaatttctgcaacagaagaggtggtccctgactatgatccagatgatctttacgatggaagtgatgctagcctggatgaagaagataccggtgatgatactaaaagaaggagagaaatgtag

SEQ ID NO: 3922 - DNA, 609 bp, Candida albicans
tcaatcgcggatccgtccagccccgtggtgaaaactttgattgatgcctatcagggcaatgaaaatgccggaatgacaattgaacgagaattgaatgcattggaggatcttgggtgtaactattttaaaattggtgagcgtaaattgaaggggttggaaacaccagaacctatcactttggtgtttaccaatagattgaaattgagatatgatatatttcaaaagagacttgatgcaaatcatagtactcgagtggctggaacattaccagtggagatcatatatggcttaagaacagtatcgttaaggttggagaatctctgttcttcgatcaataatggtggtaattattgcagtgaaggatttgaatcttcatcaggggttatttcacaaaagatgaattcatcgttcaaagatctggatttgatctcattgctcaatcacgttacaactagaattgaaagttgtaccacaacattgtttttgcgtcaacaattaagtcaaattaaaggaaatggcgggttgatagagactaacaattctccatcattggatgttattatggatgaagtagcagacatcatgaaaacagttaatgaacttaaatag

SEQ ID NO: 3923 - DNA, 381 bp, Candida albicans
ccactaaacatgtcggtagttggatctttaatattttgtaactattgtggtaatttactagattctcacagctcatcatctgaaataaaatgtacagtctgttcagcagcttatcccaaatcaagatttgctaacttaaaggtcgtgacaaaatcatcagacgatgccttcccatcgaaattaaaactggctagatccgtagtgaagacttcgttaaacaaggatgaactagacgaaggtgcaacaattaaagaaaaatgtcctaaatgtgggaatgaagaaatgcaatatcatactttacaattaagatctgcagatgaaggtgctacagtgttttatacatgcaccaactgtgggtaccgtttcagaactaacaattag

SEQ ID NO: 3924 - DNA, 1098 bp, Candida albicans
aaaatgaatcgtttactattacttcaacaacaacaaatattgaaaacttttgtttctcattacttcaaacgtaactttactacatcaattatgtcatcttataaattagtttgcttaggtaacccattattggatttacaagccaaagttgaaaaagattatttacaaaaatatgatttaacagataatgatgccatcttagctgatccaaaacatatgccaattttcgaagaattgattaaacgtgatgatttagttttggttgctggtggtgctgctcaaaacactgctagaggtgcccaatatattttaccaccaaattcagtcgtttattttggatcagttggaaaagatatctatgctgaaagattaaatcaagctaatgaagagtatggtttaactacaaaatatcaaattcaagacgatattgctactggtaaatgtgctgcattgattcataatcatgatagatcattagtcactgatttggccgctgctaatcatttcactcctgatcatttacaaaaaccagaaaattgggaaattgttgaaaaagctggattttactatattggtgggttccatttaactgtttctccaccagctatcaaattattaggtgaacatgctagtaaaaccaacaaaccattagttttgaacttttctgctcctttcattgcccaattcttcaaacaacaattggatgaagttttaccatacgttgattacgtcattgccaacgaaagtgaagctgctgcttatgcagaaagtcatgatttgaaaactactgatgttgttgaaattgctaaagaagttgctaaattacctaaagaaaataaacaaattcctagaactgttattttcactcaaggtttagaaccaactattactgtcacttatgatgccactaaggattcatttgatgttcaacaatatccagtcaaagaattggctaaagaaaaagttgttgacactaatggtgctggtgatgcctttgctgctgggtttgttgcttcattggttgaaggtaaagatttaccaaaatctgttgatgttggtcaatgggattttcaccatgggcagaggaacagagagtga

SEQ ID NO: 3925 - DNA, 519 bp, Candida albicans
  unsure (482): Identity of nucleotide sequences at the above locations are unknown.
ttctactttgttatgtttatattatcagaaatatcagatttaatacgtataccacctagtgcattcaatgttcccatacaacattctatctcagatgaattgaacaaaaaatatgccaataaaataattgccaatctcggtttggtaataaccatatgggatatactcgacatcaaagatggattattgaaaccaggagatggtggatcatatgtcgaagtgagatttcgaagtatagtttggaaaccattccgaggagagattttaactggatgggtaactgaatgtacagcaaagggaattaaagttcgtatggagtttttcgatgagatttggattccaaaagattttctatttgaaaattgtaaatattcagaactggaacaagcttggatttatttattggatgaaaatgaattgtttattgatgttaatgaaaaaattagattcagagtggaagaagaaaatttccataacttatnttcacctcggccatcgcacgatccaatttttatttgt

SEQ ID NO: 3926 - DNA, 462 bp, Candida albicans
ttaataatgtccgacgaaagaacttttattgctatcaaaccagacggtgttcaaagaggtttaatctcatctatcttgggtagatttgaacaaagaggtttcaaattagttggtattaaattggttcaaccaactgaatctttattgagaactcattatgaagatttacaatctaaaccatttttcccatctttattatcttatatgttatccggtccagtcttagctactgtttgggaaggtaaagatgttgttaaacaaggtagagccattttgggtgctactaacccattacaatctgctccaggtaccatcagaggtgattttgccattgatatgggtagaaacgtttgtcatggttctgattctgttgaatctgctaacaaagaaattgacttgtggttcaagaaagaagaattggttgaatacaaaccagctttgttcggttggatctacgaataa

SEQ ID NO: 3927 - DNA, 516 bp, Candida albicans
caattattgtataatatagaaaatggtaaagttggcggtaaattagttggtattatcacttctcgtgatattcaattccatgaagataacaaatcaccagtttctgaagttatgaccaaagatttagttgttggtaagaaaggaatttctttaaccgatggtaatgaattgttaagatcttctaaaaaaggtaaattaccaattgttgatgctgaaggtaatttggtgtctttgatttctcgtaccgatttacaaaagaatcaggattatccaaatgcttcgaaatcattccattctaaacaattattatgtggtgctgccattggtaccattgatgctgatagagaaagattggacaaattagtagaagctggattagatgttgttgtattagattcatctaatggttcatcagttttccaattgaacatgatcaaatggatcaaagaaaaatacccagaattacaagttattgctggtaatgttgtcactagagaacaagcagcattatcgatt

SEQ ID NO: 3928 - DNA, 195 bp, Candida albicans
ggtggtattggtatcattcatcataactgtacttctgaagaacaagcagaaatggttagaaaagtcaaaaaatacgaaaatggtttcattaatgatccagttgtcatttctcctgaagtcactgttggggaagttaaaaaaatgggtgaagttttaggtttcacttctttcccagtcactggtatgtttctttaa

SEQ ID NO: 3929 - DNA, 348 bp, Candida albicans
ttcttattatctacaaatcctttctatttctacccccttctacccattcccatttctcccaaaaaaaaaacaacaacaatggtgtttgaaacttcaaaagctacttcttatttgaaagattacccaaagaaagatggtttatcggtcaaagaattgattgattctactaattttggtgggttaacttataatgatttcttaattttaccagatgtaatcaatttccctagttcagctgtttcattagaaactaaattgactaaaaaaatcactttgaaatcaccatttgtttcatcacctatggatactgttactgaagaaaatatggctattcatatggcattatag

SEQ ID NO: 3930 - DNA, 600 bp, Candida albicans
aactacttccaaactagttatattacacaaataatgtctgatagagtattagaaatcaatgccttggccaaagaattgaaggctaacttgaaacaattccctaacttcccaaaagaaggaattttatttgaagatttcttaccaattttcactaagccagacttgtttaataaattagtcaaagctttcaaattacacgttggcgaacaaaaaatcgattatgtcattgggttagaaagtagaggatttttatttggtccaactttagctttggctttgaatgctgggtttgttccagttagaaaaccaggtaaattaccaggtcctaccttcaaagtcgaattccaaaaagaatacggttctgatgaattcgaaatccaacaggacgttatccctaagggtgcaaaagttttgattgtcgatgatattttagctactggtggaagtgcttttggtgctggtgaattggctaagaaaacaggagcagaaattgttgaatacttgtttgtcatggaattggatttcttaaaaggtagagataagttagatgctccagtgtatactttgtttggtggacaagaagaaaagtttactgagtaa

SEQ ID NO: 3931 - DNA, 252 bp, Candida albicans
acaaatttaaatatgtccgacaaacaacacaccaaaactgcaattttatcagtatatgacaaaacaggtttattagatcttgccaaaggtttggttgccgctaatgtgcgcatcttagcttctggtggtaccgcaaaattgatccgtgaagctggattcccagtcgaagatgtctcatcaattacccatgctccagagatgttaggcggtagagttaagactttacatccagctgttcatggtggtattttg

SEQ ID NO: 3932 - DNA, 1314 bp, Candida albicans
tgggagatggactttcacggcgtttgcaatatcactgccgaggctagaaacagattggcattgaaagcatttgagcatactgcagactatgacgttgctatttccgatttcttcagaaagcaatatgccgaaaacatctctcaattgcctttaagatacggtgctaacccacaccaaaagccagcacaagcttttgtgtctgaaggtgaattgccattcaaagtgttaaatggttcaccaggatacatcaacttattggatgctttaaattcatggcctttagttaaagagttatccgcttctttgaatttgccagctgctgcctcattcaagcacgtgtcgccagctggtgccgctgtcggtttacctttgacagacattgaaaagaagatttattttgtcgaagatattgaaaacttgtctcctttagcaaacgcttatgctagagccagaggagctgatagaatgtcctcttttggtgatttcattgctctctccaacattgtcgataaaccaactgcacaaatcatttctaaagaagtctcagatggtgttattgccccagggtattcggaagaagctttagagcttttaaagaaaaaaaagaatggtaaatactgtatcttacaaattgatccaaactataacccagaaaacttggaaagcagacaagtctacggtattactttgcaacaaaaaagaaacgacgctattttcaaaggttcttcattcaaagaaattgtgtccaaaaacaaggatttgactgaacaaggtgctgttgatttgactatcgccactattgccttgaaatacacccaatccaactcagtttgttacgctaagaacggtatggttattggcttaggagctggtcaacaatctcgtattcactgtaccagattagctggtgacaaagccgacaattggtggttaagacaacatccaaaggttttgggtttcaaatgggctaaaggtaccaaaagaccagaaaaatcaaatgcaattgacttatatgttaccaaccaaatcccaactgaggaaccagaaaaatctgaatacgaatctaaatttgccgaaataccagaaccattaacagctgaagaaagaaaagaatggttgagtaaattatctaatgttgcattatcctcagatgcatttttcccattcccagataatgtttacagagctgctagatcaggtgtgaaatttattgctgctccatcaggatctgttatggacaaagctgtctttgctgctgcagatgctaacgatattgtgtacgtggaaaacccaatccgtttgttccatcattag

SEQ ID NO: 3933 - DNA, 633 bp, Candida albicans
agaagaagctgcctaagattaagccccgttgacggttcagaattggatatctttaacaaggtatttgtattcccgatgttattgaatcgatctcattcaaagggaccatctcaaactatcaagacccatcacaatgtcggtggtttattagaagatatgaaattgaagttaatcgagccattgagagaattgttcaaagatgaagtccgtcatttgggtgaattattgggtgttccagaagatttggtctggagacatcctttcccaggtccaggtttggccatcagagttttgggagaagttaccaaagaacaagttaaaattgctcgtgaagccgatgctatctttattgaagaaatcaagaaagctggcttatacagacaaatctcacaagcttttgctgcattgttaccggtcaaatctgttggtgttatgggtgatcaaagaacttatgaacaagttattgcattgagagcaattgaaaccctcgactttatgactgctgactggtttatttttgaagctgcatttttgaaaaaagttgcttccagaattgttaatgaggttgatggtgttgctcgtgtcacttatgatatcacctccaaacctcctgatacagttgaatgggaatag

SEQ ID NO: 3934 - DNA, 987 bp, Candida albicans
tttacaataatgagtgccaatattgacgatgttcctattgaagtttccaaagtatttgataccattttggtattagattttggttctcaatattcccatttaattacccgtcgtttgagagaattcaatgtttacgctgaaatgttgccatgcactcaaaagattgcagaattatcttggaaaccaaagggtataattttatctggtggtccatactcagtttatgctgaagatgcccctcatgtcgatcatgatattttcaaattgggtgttccaattttgggtatttgttatggtatgcaagaattggcttggatcaatggtaagggtgttgctacaggtgaccaaagagaatatggtccacctactttgattgttgaagatccagaatgtgctttgttcaagggagttgatcactctcaagtttggatgtcccatggtgataaattacatgccttgccaactggtttcaaagttgtcgccacttcagacaactcaccattctgtggtatctccaatgaaagtgaacatatttacggtattcaattccacccggaagtcacccatacagttcaaggtaagaaattgttgaagaactttgctgttgacatttgtcaagccaaaaccaactggagtatggaaaactttattgacactgaaattgctagaattaagaaattggtcggaccaactgctgaagtcattggtgctgtttctggtggtgttgattctactgttggtgccaaaattatgaaagaagccattggtgatcgtttccatgccatctacgttgacaatggtgttatgagaaagaatgaaaccgaaagtgtcaagaaaactttaaatgaaggtttacgtatcaacttaactgttgttgatgccggtgatttatccttgggtagattgaaaggtgtctctgacccagaaaagaaaagacagataattggtaatacatttatccatgtctttgaagaagaagctgcctaa

SEQ ID NO: 3935 - DNA, 1629 bp, Candida albicans
catctcttttataaaatgtgtggaatattaggtattgtattagcagaacaaaatttaaatgttgcccctgaattatttgaaggagcaatgtttttacaacatcgaggacaagatgcagctgggattgccacttgtggatccaaaggtcgattttatcaatgtaaaggtaatggaatggcccgagatgttttcactcaacaaagaatgaataatttagttggtaattatgggatttgtcatttacgttatcctactgctggatcaagtgctggaagtgaagcgcaaccattttatgttaattcaccttatgggataagtttgagtcataatgggaatttagttaattctattgaattaagacaacatttagatgaagttgttcatcgtcatattaatactgattctgattctgaattattattaaatatttttgctgctgaattagataaatttaataaactgagagttaataatggtgatttattttctgctttaacgggtacgatgaataaaattagaggtgcttatgcatgtgttgccatgttggctgggtatggtataattggattccgtgatcctaatggaattagaccattattatttggtgaaagaattaatgctaatgatggttcaaaaagttatatgttagcttcggaatcagtagttttaaaagctcatggatttaataattttaaagatgttaaacctggtgaagcagtaattattactaaaactggtgaatatgaatttaaacaagttgttgaaccaaaaatttttgctccggatatttttgaatacgtttattttgctagacctgatagtgtattagatggagtttcaatttatcgatcaagaattgatatgggagaaaaattggctcataaaattaaatccatcatgttggataaccaagaaagtgaaggaaatgaaggaaatgagattgatgtggttattcctgttcctgatactgctagaactagtgcatttcaatgtgcagtttcacttaataaaccattccgtgaagggtttgttaaaaatagatatattggaagaacatttattatgcctaatcaacaagaaagaagatcatcagtaagaagaaaattaaatgctatggattcagaatttaatgggaaaaatgttttattagttgatgattcaattgttagaggtactacatctaaagaaattgttgccatggctagagaagccggagctaaaaaagtattttttgcatcatgtgctccaccaattagatttaatcatatttatgggattgatttagctgacaccaaggcattagttggatttaatcgtgatgaaaatgaaattgctcaagttattggtgctgataaagttatttatcaagatttacaagatttaatagattgttgtaaatcagatattattaaaaattttgaagttggagtatttactggtgaatatattactggagttgaagataattatttacaagaattggaaaaaattagagctcaaaatcaaagattacaacaaaatataatgaaaggtttatcagtagatgcttgtattgattcaagtgatttagttgatgttaaagctgaagttgatattagtatttataatcgtggtgattatactgaataa

SEQ ID NO: 3936 - DNA, 576 bp, Candida albicans
acccgaaccaacaagatgtcactgcgaccaaatgctttcaaagggtcgaattccgcccgttttgtcaagaatcagatgacgaccaattacagaaataccaatgattaccgccagcaaaataatagaaacaggcaacagcaacagccagaagatccttatgtggccaataatcctatgcttaatgattcaatacaaaaaaaagaattggttgaacgaatagaccatattgactcgattatgggatttgatcgtttagaacatggagagaatgacgggaataaaccccgaaaaggttggttaatcaacatgcacgccacaactatccccactgatgattatttagcaggatattccggagtggattattatttcttggatgaagaaggaggaagttttaaagctacactacaatttgatccatatttttttgtcgatgtgttaccaggagatcatgaactggaagttgaggaatggatgagaaaatatttagaaactgcaaatgttaaaagttatagtcgagtcataaaagaagatttaaaattgcctaatccatttgtcttccacctacgggactga

SEQ ID NO: 3937 - DNA, 1839 bp, Candida albicans
acgcggatctccacccgtggtgaagatgatggtacaaacttatacaagcttacaatggcacaatctgttttccaagaacaaatgagtgatgttgatagtttgttacaggactcaaatattatgggactctatgaaagtaatattgatcctgtgtctcgagctataatagatttgggtaacactgttaaatttgatgatacaagagtgggtgctttagggaaggggttgaagactgggttcaatactagagaattgataaaagctagttccgaagcttacttgagaaagtttgacatggacattgtttacttgttgcatattgtcactaacagttatgagttttttgctctttttaatacttgggaaaatgactgccaaatgtttgttttgaaaccttctgctaatgcccaggaattaccaaataatattcacaagatttatcgtgaaatctttgaatccaagagggagaaattggataaggttctgaatgtggtgaattaccctgcagaaatgtcatttgatgtgaaatattaccacgaaagtgccaaattgttcaaaaaactcaaccaagtcattggaaaaatccatgaaagcagaagcaacaaagcatttttggcaatacaatccccttattccagtagaattttgaatgttttgaatacaacggatgatttcccaactataaagatgaatattagtgaattgtcgttaccagcagttggatggcaatctttgatttcgaaacgtgtaattaatcattattttgttttagggtcttggataaagaatttggttgcgtttgccaaatatgctaatgtaccgctttgtaacttgcaaattgaaaacattggatttttggtagatattgaatatgcaagaagattaagtgagaacaatattgtgttgtggtggtcacctaatccattaccagaccttggtgggtttgagatggatagaatggtagactttgatagtttggctttccctaccattaacaatccagagatttatgaaactgcatgtttggaagttgaaattggtacattaactataaataccatacttactagtgcacttatcaacgaagccgagggaacagatttggcagatgaaaatatgcattttgataacaacaatggtgcttccacttttgctgaagattccttttcgagccctgcattatcaatactcagatcaatggtgaaagattggtgggatgatgccttgagtaacaatatcaatgctgattctataatgaacactttggtcacatgggttcaacgtaatgattcgatgttatatgatccttcattacattatcatgtccataatttaacttcaaaggcacttttgcaattaattagtgagttcaagcgaatgggagcacaagtgatttttgccaacaggaataaaatgttgattcagacttcaaagatttctgtggaaaattcatatgcatatggtcaatatattttgaaagcagcgagatctaagcctttgttcaactttttggatttaagaatagtaaagtattgggatattttgatatggatggatgaatttaattatggaggtagaagttgtacagagattgtgaatgaagaaatgcaaaatttggttccagagaatcattggcacttgcaaaaatttttaccaataatttttcaaaacgaatttgaagattggcttgtgatattcttggatgcattgacaaagtataaaaatgagaatttacttgggaaaggagctcaagcaaatacacctagagttactcaaattgttcacatattggaaaggtcagaaaaaattacaagctcaagaagtcgaagaagaggatga

SEQ ID NO: 3938 - DNA, 699 bp, Candida albicans
agacgccgtttgaaattcccagatgccaaaattgatcaaattatgatgatatcgtatatgatagatggtgaaggttttttgatcaccaacagagagataatttcagaagacattgatgatttcgagtacacaccaaaacccgagtacccaggtttgtttacgatttttaatgaacccgatgaaaagcatgtgttgaagagatttttcgaacacatccgtgatgtgaaaccaactgttattgcaacattcaatggtgattttttcgattggccatttgtggagaatagaacaagatttcatgatatggacatgtttgaagaaatagggtttgctaaagataacgaaggcgaatataaatcaaaatattgtgttcatatggattgtttcagatgggttaaaagagactcttatttaccacaggggtctcaaggtttgaaagcagtcactaccgccaaattagggtataatccaacagaattagatcccgaattgatgaccccatatgcttacgataaacctcaattgctttcagaatattctgtttctgatgctgttgcaacatactacttgtactataaatatgttcacccgttcattttttccttgtgtactatcattccattgaatccagatgaggttttaagaaaaggtactggtactttatgtgaaatgttgctttcagtgcaagcatacgagtga

SEQ ID NO: 3939 - DNA, 459 bp, Candida albicans
gacattttattgcctaacaaacattctgatccaattgaaaggttttatgaaggacatttgttagagtcggaaacttatgtgggagggcatgttgagtcattggaggctggtgtctttagaagtgatatacctacacatttcaagattgatccaactgctatcgatgaattgttagggaatttacataactccataaaattctgtattgaagttgagaatggcaagaaaatggaagatgttgagaattttgatgaaatttatacccagattgagtcaagtttgttggagttgaaaaataacccgtatagacaggagaaaccattgatttaccacgttgatgtggcgtcaatgtatcctaatattatgacatccaaccgtttgcaaccggattcaatgaaatcggacgaagattgtgcttcttgtgtaactgccccaccacgggataggaagtgcggcggt

SEQ ID NO: 3940 - DNA, 525 bp, Candida albicans
  unsure (86),(511): Identity of nucleotide sequences at the above locations are unknown.
acaatcattcaaatggctagagctttggttgaaagaattggtagaccattagaattagacaccgatggtatttggtgtatccttcntaaatcgttccctgagaattttaatctcaaatgtaaagatggcaagaaaatttttttggagtacccgtgttctatgttgaattatttggttcatgaaagatttaccaatcaccaatatcaagatttagttgaccctgagactttcaaatataaaactcgttctgataattctattttcttcgaagttgatggtccttataaggcgatgattttaccaacatcaaaagaagaaggtaaagggttgaagaaaaggtatgcagttttcaatgaagatggatcgttggcagaattaaaaggatttgagttgaaaagaagaggggaattacaattgattaaaaatttccaatctgatatattcaagttatttttagaaggtgatacgttggatacctgttctcaagcgtgtcaacctaccgagatatcgnatacgcgctatatc

SEQ ID NO: 3941 - DNA, 522 bp, Candida albicans
tggaattattattatgaaagattagcgtcagttgtacaaaagattatcacaattccagcagctcttcaagatgttaagaaccctgttcctagagtgccacatccggattggttacagagaaaagtgaaaaatagtgaagatgttatgcaacagaaatcaatttcgaattttttcaagaaaaccacgaaggaagacatcaaactcaaagacatagaagattttggtgaagttgatgcttctgtgccaaagggtaaagtagttaaagttacttcaagaaagagaaagtctggcaaggcaaatatggttgaggatgccgaagaagatgaaaagaatcaagcaattttaaatgggccatgtccttctatgacagaggattatcaaggatttttacagtaccaaaaggcaaaatggaaggtccagcaagctggccgagaaagaagaagaagattatttggagcaaattcagagagttcacaaagatctactgtgggtcttcacacaagccgccgaaggaccaatatc

SEQ ID NO: 3942 - DNA, 1197 bp, Candida albicans
tatctgctcagtgtcatgtcttctagtatcaaagtcaactctgtgacagagaaaccagtggccactgtgggttccttttttaatggtttaagagtatctcctgaagtagaatttgacttgtataaacataagaagagagatgactatgttttacatggagaaactgataccttagattacaacggtacatctaataacgaaaatgaatacgttgttgctgtttttgatccaaacagcaaatccgttgaattatacaaaaccccatatatatccaccaaagttactgcaaagaaaaatagagtttataaaggtccaaaagtcaagagtgcaggtataagaaacgtaacacaacgtaatgcattaggtgaagcctttggtactaaaaaagccaaatctgctattactaatttggaaaagaatagaattgattctgaaaaattgcaggacattgaaatggatattgttgatactgttaaagagagcactcgtgatttgccagctcaagaagatggtgttgacagaccagcaccattggcaaatgttgatgccacaaacgtagaagacatttatccactagaaaatattattcctgaaaaagattggcaatatcttcgtgttagttccattcttactgcagaaaatccattggaaaaattgccatttaccaaatcagaattcattgccaaacaattgcctattttgattctgcaaaaaaacacagaaaagttgcaaatgcttttttacgcatcccttttattgggtgtttatgagaatagaagagtcaaagataaacagagtcttatgaccagattacaaaatataccttctgaaatcttggttgatggtattttggatcgatttgctatttctcgtgccactaaatttggtaaatcaaaggacaagtcatttactattgatccatatcacgaagataaattgttgacatacttgttcatattgcttttacatataaataacttcacagttgaattggtaccactttcaaaagatttgaagttgaaaaatacaagattggttggtttattcagagctttgggtgctattatcaaaagtgcaactgttggtgaagccgaagctctcggtattccaaagagtgctgtcggtacctacaagatagccacattgaaagtaccattcaagttaccagaattgactagaagaggaaagcgtcgttag

SEQ ID NO: 3943 - DNA, 1302 bp, Candida albicans
acaaattcaagaatcatgtgtgacgtcgtattaggatctcaatggggggatgaaggtaaaggtaaattagtcgatttattatgtgatgatatcgatgtttgtgccagatgtcaaggtggtaacaatgctggccacacgattgttgttggtaaagtcaagtatgacttccacatgttaccttctggtttggtcaatcctaaatgtcaaaacttagttggatctggtgttgttatccacgttccttccttctttgctgaattggaaaacttggaagcaaaagggttagattgtcgtgatagattgtttgtttcatctagagctcatttggtctttgacttccatcaacgtactgataaattgaaagaagctgaattatcaaccaataagaaatcaataggtactaccggtaaaggtattggtccaacttactcaaccaaggcaagtagatcaggtatcagagtccaccatttagtcaaccctgatccagaagcttgggaagaattcaaaactagatatttgagattagtcgagagtagacaaaaaagatacggtgaatttgaatatgatcctaaggaagaattggcaagatttgaaaaataccgtgaaaccttgagaccattcgtcgtcgactccgtcaacttcatgcacgaagctattgctgccaataaaaaaatcttggttgaaggtgctaatgcgttaatgttggatattgatttcggtacttatccatacgtcacttcttcatcaactggtattggtggtgttttgactgggttgggtattcctccaagaaccatcagaaatgtctatggtgttgttaaagcctacaccactagagttggtgagggtccattcccaacagaacaattgaacaaggtaggtgaaactttgcaagatgttggtgccgaatatggtgttactactggaagaaaaagaagatgtggttggttggatttggttgtgttgaaatattccaacctgatcaacggatacacttctttgaacatcaccaaattggatgttttggataaattcaaggaaattgaagttggtgttgcttataaattgaatggaaaagagttgccaagtttccctgaagatttgattgatttagctaaagtcgaggttgtgtataagaaattcccaggttgggaacaagatatcaccggtatcaagaaatatgaagacttgccagaaaacgctaagaactatcttaaattcattgaagattacttgcaagttccaatccaatgggtaggtaccggtccagctagagattctatgttagaaaagaagatttag

SEQ ID NO: 3944 - DNA, 1074 bp, Candida albicans
aacatggctcaatacgaatgctcagaacatatggaaaatttccttagagaattacctaaatgtgaacatcacgttcatttggaaggtactttggaaccatcactattattcaaactagcaaaaagaaataatataactttgcctgagactttccctaaaaaggttgaagaatgtaatgatagatacaacagatttgcagatttacaagatttcttagatcattattatattggaatgggtgttttgattactgaaaatgatttttacgatttagctatggattattttaccaaagctcattctgatggatgtcttcattcggaagttttcttcgatccacaaggtcatgttgaaagaaacatagatatcgatgttgttgttcaaggttttaatcgtgcatgtaaagatgctaataccaaatacggtaccaccaacaaattgatcatgtgtttattaagacatttacctgcggaaaatggattacaaactattcattcagcttctaaatattaccaagacggtattatccatggattaggattagattccagtgaaaaaccattcccaccaaatttattcactgaatgctatgcccatatcaaagataatttccctgaagttgggttaactgctcatgctggtgaagaaggagatcacacttttgtcagtgatgcattgaatttgttgaaagtttctagaattgatcatggtgtcaattctcaccaaagtgaagagttaatgcagagattagctgaacaaaaaactttactttcattgtgtccattatcaaatgttaaattgcaagtggttaaagatgttaaggagttaccaattgacaagtttttccaaatgaacgtaccattttcaatcaactctgatgatccagcctattttggtggatatattttagacaattataaagctgttcacacaagatttggattcaccaaagaccaatggaaaataattgctttaaatggtattaaaggttcatggtgtgacgatcaaagaaaaaatgaattaattagcttggttgaagaagtttataaaaaatacaatattgaaggttgctga

SEQ ID NO: 3945 - DNA, 195 bp, Candida albicans
caattcatatttaaattttccataatgtcagcagaagatatacaaatggaagatgccagtaataatagtgaacaagaacaaattcaagaacaagaatatgatataaataaaatcaaaattttaccaggaagttcagaagatggtacttcagcatcatttcaaatcatcgatgaggatcatacattaggtaatgcc

SEQ ID NO: 3946 - DNA, 711 bp, Candida albicans
agacaaaaagtattgcttaatgctcttgctgctaaaataaagtctttggatccagacgtctttattggccatagattggaaaatatatctttagatgtgcttgtgcatcgtatgaatgataataatgttgttacgtggtctgctcttggacggagaaacagaaggcaatggccatatatgataaacaaaagtaattcaagttacaacaatagtcttctcattcgtgatgtttttcaaggacggttgttgtgtgatattgccaatgaaatgggacaatccttaacaatgaaatgtcagtcatgggatttgcatgaaatgtatgatgtcgtttgtcacaaaaagcattctccagtagaaattaactatcaaaacttaaagtatgctgaagatgcacatttatttttgatggcattgaaggaaaacgaactcaacgtcaagcaaactgcagaaattgcatttgctacccagatcctttcgctttctaagcaattgactaatattgctggtaacgcatggtctcatactttgagcggaacaagatctggtataaacgaatacattttgttacatgaattcaagagaaacaattacattgtacctgataaggaggataaaacgcacaagaatacgtcttatcaacaagaagcaatagtggataatgccgatgaatatgcgacaactgccacatcgaacaagaaacccaagtattca

SEQ ID NO: 3947 - DNA, 417 bp, Candida albicans
actatgctgtccagatcagccagacgtaagactctacaacaattgaaagaagccagaaagacaggtagaaacgttaatgttgttgaatctgatactgatgattacaatgagatttatgatgaggtggacgaagacacttacagacaacacaagagaaatcagctaatgaatgacgattttattgttgacgataatggagaaggttatgttgataatggagctgacgactgggacgatgcttctagaccaaactattattcagatgaagaaaacgagtctatgggatccagaaaacgtagaaaaaaggaggacaagacaactaaagtagctaaaacatcacaaattagaaattttttcaagccaatgagtgggtctcagattcttcttcaccacgggcctggcagcaccgcacttacg

SEQ ID NO: 3948 - DNA, 1956 bp, Candida albicans
  unsure (1882): Identity of nucleotide sequences at the above locations are unknown.
gttgtccttccagccggccgtggtgaagacactgccacatcgaacaagaaacccaagtatcaaggtggtttggtgtttgaacctgaaaaggggttgcataaaaattatgttttggttatggatttcaactcattgtacccaagtattattcaagaattcaacatatgtttcacaactgtgaacagagacagatttaacgttactcatgacgaaaacaaggacatgccaattcttccagaaagagataccgaatccggtgttttgccacgattgtcaaacactttggtttctcgtcgtcgagaagttaagaagctactcaaagatcctaagaatactccatttcaaaaagctcaatatgatatcaaacaacaggctttgaagttgactgcaaactcaatgtacggttgtttaggttatgtgaactctagattttatgctaaaccattggcaatgctagtgacaaataaggggagagaaattttgatggatacaagacaattggcagaatcatctagtttaagagttgtttacggtgatacagattcggttatgattgatactggtgccagcagctaccaggaagctattaagattggagagcaattcaaagtacaagttaacgagcgttataggttgttagagattgatatcgataacgttttcaagagattgttgttacatgccaagaagaagtacgcagctatgaatgcctcaataaataaagctactaacgaagaaacagctactttggaagtcaaaggtttggatatgcgaagacgtgaatactgtcaactttctaaagatatttcgacctttgtattgacaaaaatattgtcggacctggaccctgaaactgcacttcttgaagtgtacgactatttggatgacatgaaaggtaaaatacaaaacaatgaaataccgattgacaaatataagataaataccaaactttctaaggacccaaaaagttatccaaatggtaagtctatgccacaggttcaggttgctttgaggcttagagaagaaggaaaagtaatcaaagctggtagtgttatcacatatgtcattactgcggctaaagatgatggcgataattccacggtggcagagagggctagggctattcaagaattactttcaaaaaaagaccccgatttgaaaccagacgccaattactatttggagaaacaaatatttgctccagttgaaagattgttagaaagaattgagggaattgatatggtcagagtggcaacatcgttaggcattgatacaaaacgttacattttaagagtaaagaacagtgacgcaaacggagaaatacttccaattgaatcaaacatttctgacaaagagagatttagagctacaagttatttggtgttgcactgtaaatgtggaagttcattccgatttgggggaatcatggcagcagaaacatacaaagtcacattcaatggtgtttgttgcacaaagtgcaactatacatttccagctattaaattgacctcacaattggagtcaatgataaggaagcacattgcgttgtattatgctggatggttggtttgtgatgaccctgcctgtggaattacgacaaggcagatttctgtttatggtaaaagatgtattggtaattcaggtagagctatggattgcaaaggggttatgagatatcgctacaatgacaagcaactttataatcaattgctttatttccagtctatctttgatgttgataaaacaaaacgtggtgagctcaggcccttggtggatgctttggaggaatctaaagacaaacagttgcctaaattgccatcaggacaagtagaggcattggctgaacaaaatagggaactttttggcatttgtcaggaagtantacagaagtatttgggtgaatgcggtcgtcgttatgtgaatatgggatctatttttgactttataaggaactaa

SEQ ID NO: 3949 - DNA, 759 bp, Candida albicans
gggactatgatcttccaggggcggggtgagaccgactatactatggacattgataattttgaagatcaaccttcatcaccatttaagcttaaaagcgaggtgactccagaagcagaaactgaaaaggagaatattgatccagaaccgacaaaaaacgtttttgaaaacccatctgaatcattgaaaaatcaagaaaaagtcaatgacaacgatgacgaagacgattcagatgacgatattgtttattcgagaaaacccagagcagcagtggttaagaaaaaccaggtggatacggtttcagctgtcaaggccaaccaattaccttcatctccaatttccaaaccagtttataccaaattttctaatcacaccgaaaaggtatctaaagacaatattaaagacacatctgattcattcaaaatgttctggtttgattacgcagaggccgagaactctcttttgctatttggtaagatcatgaccaaggaaagcaaattagtatctggagtggtcaaagtcgacggaatttgccgtgaattgtcttttctaccaagagagtatcgtattgtggatgacgaagaagataaaagcaagaagctcacagccattgacgtattagaggaaatacagccgcttttgttagctaattacaacttagaagaattgcgtgctaaacctgaggtcaacaaatatgctttcgagttagccgatatacctaaagaagccgagtattttaaggtgttggctcccattcaataa

SEQ ID NO: 3950 - DNA, 756 bp, Candida albicans
ttgaacgtcgttagtagtccagcaacggaatcacggactttcggtaagcttggtgcacaggatgtgatcgaaggagacggaagtttgcggatgttttggctcgactatacggaagtcaacggcagtttgtgcttatttggcaaggtgaagaacaagcacaccggttctcatgtcagcgctttcgtcaaaattgacaatatcctccgaaagctttttttctttcctcgggagtacagatataaacatggccgagtgaccgatgaggaggtggatatgaaagatgtttatgaagaggttgatgagataatgtccaggctcaaagtcgggatgcataagatcaagccgtgcacacgcaagtatgcgtttgaattgcccgatattcccaaggaagcagagtacttgaaattgctctacccgtacgacaagccggcattaccgatggaaaccaagggcgaaacgttctctcatgtcttcggaaccaacacctctctcttcgagcaatttgtgctttggagaaacgtcatgggtccatgttggctcaagattgaggatgcggattttacagctgtcagcaacgcgtcatggtgcaagttcgagtgtcaggttgcaagacctgcttgcattacacctgtgcttgacaccgggaatctggagccgccgccccttacactcatgagtcttgctttcaggactcaactcaatgtaaaggagaataagccagaagtcttcactacgaacgtgcgggctccgcgtata

SEQ ID NO: 3951 - DNA, 1080 bp, Candida albicans
agatcatctttaaaaaaaataaaacacccaatacatctaacaagttcaaccacgtcttcgaatacccaactttttcaaccaataatcatgagtgagatgttagtatcagataaagcacgtcatctttatacaaagatgagggagtatccaacttccaaactttttgatcaagatgaattacaaacactatttgatattaaaaagggatcagaattaatggaatatttacaagaattagtcaatggtaaatatgttaaaattagtaaaatgggagatcaattaaaatttcaaactgttgctgaagaagaagccaaaaaagtatcgtcaatgtctgatgatgaagcaatgatttattcttatattgaagcttcaggtcgtgaagggatttggactaaaaccattaaagctaaaactaatttacatcaacatattgttcaaaaatgtttaaaaaatttagaaaataatcgatacattaaaagtattaaatcagtgaaacatccaacaagaaaaatttatatgttgtataatttacaacctagtattgatgttactggtggtccttggtttactgattcagaattagatactgaatttatagaaactttattggaagtgtgttggagatttattgttgggaaaaccatgtatataaaggatgaagaagctgataatgcagatataaatccacttcacacgacatatcacaatcatcatccaggggtgaatttggatcaacttgttgaatttataaacaatagtaatatcaccagtgttgagttgggtattaatgatattagatcattatgtgatgtgctaatctatgacgatagaatagaagaagttggtgggaatcaagaaaatagtgggatttttaaagctacttggcaaagtataatagataaaggtaacactattttgcaaaataattatcaggatttgaaaaatgttgtttctgaagattgttttaattatttacaacaaaatcaatcagattttagtgtttttcaatataaatctactattcaagatcttcaagatgaatcggatctagtgtatttagatagctggatgaatgaataa

SEQ ID NO: 3952 - DNA, 324 bp, Candida albicans
agaataaaaataataccggatacaaaagtaccaaatgcagcaatagttaagattgaaagagaagatcatacattggccaatttattgagggctcaattgttaaaagatgatagagttttatttgctgcctataaagttgagcatcctttatttgcaaactttgtgttaagaattcaaactgaagacgattattcaccacgagaagctttgcaaaatgcatgttccggtttgatcagtgaattagatgtgataaaaagtaaattcaatgatgaatgggcacttaaggcacttttgaataatactgaagatgatttcgagtattag

SEQ ID NO: 3953 - DNA, 531 bp, Candida albicans
ccaccacgagctatgaaagaagtagttgttgatatagctcctaaatgtattaaaggtttggagtttggggctttatctgcaaaagatatagtagctcagtccgaagttgagattcaaaccagagatttgtatgatttggaaaaagggagagtacccaaagagcacggggcccttgatactaaaatgggaatatcatcaaatgcacaagaatgttctacttgtcatggtaacttggcctcttgtcatgggcattttggtcacattagattagcattaccagtgtttcatgtgggttatttcaagagtatcatttctgttttgcagtgcatttgtaaaagctgtgctgcagttttattagatgaacaaagtaaacgacaatatttgaatgatttgcggaaaccacatatagacaatttaagaagaatgaaaattatcaagaaaattattgaacagtgcaaaaagcaaagaagatgtctcaaatgtaatcacatcaacggtgttgtcaagaaagcagctagtggtgctggtcct

SEQ ID NO: 3954 - DNA, 3771 bp, Candida albicans
agaaaagacatttgggacgaggatttggatcaagttttcattagaaatcctgagttggaaaagtttgccaaaagaatccatgatgatttgaatccattgaaaacgttgaatttatttaaacagattactcctcaagattgtgaattatttggattagatcctgccaaaggtggtagaccagaaatgtatatttggagatatttacctgcaccccctgtttgtattagaccgtctgttatgatggattcccaatccaatgaagatgatttaactgtcaagttgacagaaatagtgtggacatcatctatgatcagagcaggtatagttaaggggatttctattaataatttgatggaacagtgggactatttgcagttgtcggttgctatgtatatcaactcagactctgccaaccctgcgttgctgactggtggtggtggtgcaaaatcatcgaaaccaattcgtgctttctgtcaaagattgaaaggtaagcaaggtcgttttagaggtaacttgtcggggaagagagtggatttttctgggagaacagtcatttctccagatcctaatttgaaaattgatgaggttgctgttcctgatagagtggccaaggtattgacgtatcctgaaaaatgcaccagatacaacaagaaaaagttgcaaaaattggttgttaacgggccagatattcatccgggggcaaactatgttatgaaacaaaacgaaccaggtaaaagaaatttgagattcggtgatagggtaaagttagcgaaaacattacaaatcggagacgttgttgagcgtcatatagaagatggagatgttgttttgttcaacagacagccttcgttgcatagattgtcgattttgtcgcattatgccaagatcaggccatggagaactttccgtttgaatgagtgtgtttgtaccccatataatgctgattttgatggtgacgaaatgaatttacatgtaccgcaaacagaagaggcaagggcagaggctatcaatttgatgggtgtgaagaacaacttgttgactccaaaatccggtgaaccaattattgccgccacccaagatttcattactgggtcatatttgatttcccacaaggactcatttttcgaccgtgctacattagtacaactcttgagtatgatgtctgatgcagacattcagtttgatattccgccaccaacaatttttaagccagtaatgttgtggactgggaagcaagtcttttctttgttgatcaaaccaaacaaaaaatcaaatgttgttatcaacttggatgctaaaaacaaaacattccatcctccaaagaaaggtttaccaaatgaaatgtcgccaaatgatgggtttgttgttattcgagggtctaaaatattgagtggtttgatggacaagtccactttaggtgatggtaaaaagcattcagtgttctacacaatccttcgagactatggtccccaagaagctgctgcagcaatgaacagaatggccaaattgtgtgcgaggtttttagggaatcgggggttctctattggtatcaatgatgttacccctgccgatgaattgaagcaaaagaaagagttgatggttgaacaagcttatttgaaatgtgaccaattgattgatttgtacaatcgcgggaaattggaaacacagccaggttgtaatgaagaacaaacattggaggcaaagattggggggttgttgtctaaagtcagagaagaggtcggggatgtttgtatcagggagttggactccttaaatgctccattgattatggcaacctgtggttctaaaggttctacattaaatgtgtcgcaaatggtggctgttgtgggtcaacagattatttcggggcatcgtgttcctgatgggttccaagatagatcattgcctcatttcacaaagaactcaaagacaccacaatcaaagggttttgtgcgaaactctttcttcagtgggttgactccaccagaatttttgttccatgctatttctggtagagaaggtttagttgatactgccgtcaagactgctgaaactggttacatgtcaagaagattaatgaagtcattagaagatttgtcttcacagtatgacaacacagtacggaactcgtctaatggtatcgttcaattcacttatggtggagatggtttagacccatatgatatggaaggtgacgccaaaccagtcaattttaatagacaatgggatcatgcttataacttgacgtacaatgtcgacgatgccagcttgttgccttatcaaatagaagagttggtggattccgttttggcaccattggagaataagttgataagatatgataatttgggtaatgctttgaatgacaaagaaaaggaacaaaaaatagaatacattgaccaaaatgatggtgaaagagacttttacaaatcaattcgtgatttcctcacaaagaagtcgatcaggttggctctacttagggaagaaagaggtttgaaggcatactttactgcccccaccgaagacgaaattgttatggatgaagatgcagttaaagtcaaagcaattgatcagttgctgaagatttctctgaaggcggtcaaaacatttttggaacaatgtctttacaaatactcccgtgccagagttgaaccaggaactgctgttggggctattggtgcccaatctattggtgaaccaggtacgcaaatgaccttgaaaactttccattttgctggtgtggcatctatgaatgttacgttgggggttcctcgtatcaaagaaattatcaatgcatccaaagttatatcaactccaattatcaatgcagttctagttaacgatgatgacgaaattgcggctcgtgttgccaaaggaagaattgaaaagacacttttagaagacgttgcattttatattgaagatgtttacaaggacaatcttgcatacttgtcgatcaagattgatttggaaacaatcgataagcttcagttagagcttaatctagaaaacattgccgttgccattgctaatgctcctaaattaaagattgctcagagtgatgtttcagtgactggtaaggacagaatcaatgttttagttaacatcaaagagaccaagacagagagtttgagaaacactgttgaccctaagaacgcattgtttttcagaatgcagtacttgaagagggccctacctggtgtttgtattaaagggttgcctaatatcttccgtgcggttatcaacataaaagacgatggtaaaaaggagttgttagtagaaggttatggattgaaggatgttatgaataccgaaggtatagttggaaccaagaccactacaaatcatgttttggaagtgaatcaaatattaggaattgaggctgccagaggatctattatcaaggaaattgattatacaatgagtaatcacggtatgagtgttgatcctcgtcatattcaattgttgggcgacgttatgacatataaaggtgaagttttgggtattacgagatttggtttgagtaaaatgagagattctgttttgcaattggcttcgtttgagaaaactactgatcatttatttgatgctgcattctttatgaagaatgataaaattgaaggggtttcagaatgtatcattttgggacaaacaatgctgattggaacaggttcgtttaaattggttaaatctagtaattgcgaaaagaaggcgttgaagaagaaaccaactttatttgaatcatgttgtgaagtagcagccagtgcttga

SEQ ID NO: 3955 - DNA, 1680 bp, Candida albicans
ggaggtggccaattaggtcgtatgattgttgaagcagcacatagattgaatatcaagaccgtaattttggacgcagccaaatcaccagctaaacagatcaatgctctagacgatcacgttgatggatcgttcacaaactatgattcgattgtgaaattagctgaaaaggcagacgtattaactgttgaaatcgaacatgttgatgttgatgctttaatcaaagttcaagagaaattccctaaagttgaaatatatccattacctgaaaccataagattgattcaagataaatatttacagaaaaatcatttaatcaaacacgatgttgcagttacagaatctgttgcagttgaaaccaacacagtcgatgacttgttacacattggggaaaagtttggatacccttatatgttaaaatcgagaactttggcgtatgatggtagaggtaactttgttgtcaaagacaagtcatactgtgagaaagctttagaatttttaaaagaccgtccattatatgctgaaaaatggtgtcctttcaccaaagaattggctgtgatggttgtcagatcattagaaggggaagtctttgcttacccaactgttgaaactattcatgaaaacaatatttgtcatttagtgtatgctcctgccaggatcccagatactttggccaaaaaggcatctatattagccaaaaatgcagttaagtcattcctcgggtgtggtattttcggtgttgaaatgttcttgttggaaaacaacgaattattgatcaatgaaattgcaccaagacctcacaactctggtcattataccattgatgcatgtgtcacttcacaatttgaagctcatgttcgtgctgtcacaggattacctatgccaaaggggttcactgaattctccacttccatcaccaatgctattatgttgaatgttttgggtgataaggcaactccaaataaagaattggagatttgtcgccgtgctttggaaactccacatgcgtcagtgtatctttatggtaaaactactagaccagagcgaaagatgggtcatatcaatgttgtcacatcttccatgcaagatgccgagagtagattaagttatatattgggtgataccactgaaattcctaaatctttagctaccgacaaggaatctccattggtgggaataataatgggttccgattcggatctaccagttatggcagttggtgctcgtattttgaaacaatttggtgtgccatttgaactcacaatcgtaagtgcacacagaactcctcatagaatgtctgagtatgctattgaagcaccaaagcgtggcttgaaatgtatcattgctggtgcaggtggtgctgctcatttgccaggtatggtggcggccatgaccccattgcctgtcattggtgttccagttaagggatctacattagatggggttgattcgttacactctatagtacagatgccaagaggtattcctgttgcaactgttgctattaacaatagtactaatgctgcattgttggcaatcagaatattaggcgcctatgactcaaaatggttgactgagatgaaccaatatatgttgaacatggaaactgaagtattaggtaaagcagaaactttagaagaaattggatatgaagactatttaactgataaattgaaaaaatag

SEQ ID NO: 3956 - DNA, 1230 bp, Candida albicans
aactcaagatacacttggtattctttagttgccgatggtattgttgaatatgtggatgctgaggaagaagaaacgataatgattgctatgacaccagatgatgtaaaggcttccaagaatagtgtatcagagtctgaacaacaaaagatacaattggaagaacaggaactcgacccaggtaagagaattaagccaaccaccagtggcaatactcatacatacacacattgtgaaattcatccgtctatgatattgggtgttgccgcctcaattattccgttcccagatcataaccaatcgccacgtaacacttatcaatctgcgatgggtaagcaagctatgggagtgtttttaaccaattattctgtaagaatggataccatggcaaacatcttgtattatccacagaaaccattgggtaccacgagatcaatggaatatttgaagttccgtgaacttccagctggtcaaaatgccattgttgctattgcatgttattccggttataatcaagaagattccatgattatgaatcaatcatccattgatagaggattgttcagatcattgtttttcagatcttatatggatatacaaaagagacaaggtatgaaggcacttgaaacttttgaaaaacctactagatctgatactttgagattaaaacacggtacatatgagaaattagatgaagatgggttgatcgcccctggggtcagagttagtggtgaagatattattattggtaaaacaactcctatacctgcagatgcggaagaattgggtcaaagaacacaatatcacaccaagagagatgcttcaacaccattaagaagtacagaatccggtattgttgaccaagttttgttgactaccaatggtgatgggtctaaatttgtgaaagtgagaatgagaacaactaaagttccacaaattggggataaatttgcttcgagacacggtcaaaaaggtactattggtgttacctatagacacgaagatatgccttttacagcagaaggtattgttccagacttaatcattaaccctcatgctattccatctcgtatgacggttgcacatttaatcgaatgtttattatcaaaagtgtcgtcattgtcagggtttgaaggggatgcttcaccatttactgatgttacaacagaacaaatttccacattgttaggacatcatgggtaccatccaagaggatttgaaattcctgtataa

SEQ ID NO: 3957 - DNA, 993 bp, Candida albicans
gaagattctcatttaattttagatcacccagctcgacatacttttgaaaaggatcatgaaaataaacgttatgaaattacgtttgggaaaatttatatttggaaaccatcacaaactgaaggtgatggttcaacgcatgctgttttccctcaggaagccagatttcgtaacttgacatattcttcacctttatatgttgatatgactagtaaagttttcaaatcagatgataacaaacggaaagataatgaattagaatggattcaagaagaacccgataaagatactgaaactaaagttttcttggggaaagtccccatcatgttaagatcgaaattttgtatgttgagagatttggctgaacatgaattttatgaattgaaagaatgtccttatgatatgggtggatatttcgttattaacgggtcagaaaaagttttgattgctcaagaaagaagtgccgccaatattgtccaagtgtttaaaaaagcagctccatcacctatatctcatgttgctgaaatcagatcagctattgaaaaggggtctagattgatttcttcaatgcaaatcaaattatacggtagagatgaaaagggggtttctggaagaactattaaagcaaccttgccatacattaaagaagatattcctatcgtcattgtattcagagctttaggggttgtccctgatggggatattttggaacatatatgttatgatgccaatgattggcaaatgttggaaatgttgaagccatgtgttgaagaagggtttgttattcaagaacgtgaagttgcccttgatttcattggtagaagaggggtattgggtattagaagagaaaaacgtattcaatacgccaaggatattcttcaaaaggaattattaccaaatatcacccaagaagaagggtttgaaactagaaaggcattctttttaggccatctggtgaatatttttcacacacggcggctggaaggaacctatctc

SEQ ID NO: 3958 - DNA, 198 bp, Candida albicans
gatcctgtaacatccaccactttttcaatcattaatggaaaaatgcctcctaaaagaagacgtacattactgacaggggctcatgatgctgcctttaacgagttattaaaaccagagtataagggtaaaaaattgacagatgagatcaatactgccaaagacaaatgggaatttacttcctgcatttttaagagttaa

SEQ ID NO: 3959 - DNA, 3183 bp, Candida albicans
gttcacaaatctacatcgaaaccaggtgtgaaagaagttattttgcctcctcatgaatgtagattgagagatttaacttattcagcacctatctacgttgatgtcgaatacactagaggtcgtaaaattattagacacaatgatttggaaatagggagaatgcccgttatgttaagatcaaacaagtgtatgttggaaggtatgtccgaagcaaccatggcccaagtagaagagtgtcccttggatccaggtggttactttgtggttaatggtaccgaaaaggttatcttagttcaagaacaattgtccaaaaatagaattattgtcgaagcagacgagaaaaagggtatagtccaagcatctgttacgtcatcgactcacgaacgtaaatcaaagacttatgttattaccaaaaatgataagatttatttgaaacacaattctattagtgaagatatccctattgtcattattttaaaagcagctgggatagtttccgatttagaaattttacaattagtttgtggatccgactcaaactatcaagatttgtttgttgtaaactttgaggaagcagctcggttggaagttttcactcaacagcaagcattgtactatgttggtaaacgtgtgaagacgattagacgtgccggagctcccaagttatcacaactccaagaaggtattgaagccattgccaccacaattattgctcatttaactgtttctgatttacaatttagagaaaaagctctttatatcgccaccatggccagaagagtggtcatggccatgcacaacccaaagatggttgatgatagggattatgtcgggaataaaagattggaattagctggtcaattgatgtcattattgtttgaagatttgttcaaaaaattcaattcagattttaaagccaatatcgacaaagtattgaaaaaaccaagcagaacttctgagtttgatgcattattatcaatcaacattcattcaaataatattaccatgggattgaaccgtgccatttctactggtaattggtcattgaaacgtttcaaaatggagagagcaggtgtcacacatgttttatcacgattgtcatatatatcggctttgggtatgatgactcgtatttcctctcaatttgaaaagtcaagaaaagtctctggacctagagctttgcaaccttctcagtttggtatgttgtgtactgcagatacaccggaaggggaggcctgtgggttagttaaaaatttagcattgatgacacacatcaccaccgatgatgaagaagctcctgtgaagaaattgtgtatagctttaggttgtgagcctatctttgcattagactcggccactttgcacgtggatgggaactttggtgtctatcttaatggtactttgataggtaccacaagattcccagtgaaatttgttcatgatttccgtcacttgagaagagttggaaaagtatctgcatttatttcgatttatacaaacacccaccaccaggccgtgcatatagccaccgatgggggaagaatttgtcgacctttgataattgtggaaaatgggaaatccaaagttacagcagaacatttggcaaagttaatcaatcaagaatggtcttttgatgatttcttaacacacggtttagtggaataccttgatgtcaatgaagaaaacgactctttgattgcattgtatgaggatgatatcactgctaatccaggagcaatagtcactcatttagaaattgaaccattcactgttttgggtgctgtcgcagggttgattccatacccacatcacaaccaatctccaagaaacacttatcaatgtgcgatgggtaagcaagctattggtgctatagcatataatcaatttagaagaatagacacattattgtattttatggtgtatccacaacaaccaatggtgaaaaccaaaacaatcgagttaattgaatatgacaagttgcctgctggtcaaaatgctactgttgcagttatgtcatattccggttatgatattgaagatgctttggttttgaataaggcatcactagatagaggatttggtcgttgtcaagtggttcgtaaaaacacggtgcaattgaaaaaatatcctaatcatactcaagatattcttgccggtatgagagtggacgagaacaataaacctattttccagcatcaagcattaggtccagatggacttggggaagttggaagtagaatctttaatggtcaagtttttgccaacaaatgtgttcctacaaactctggtgattcaacattaggtgctcaacaagaacaaagggctgcagaaagccaccgtgaagcaccagcattttacaagggtcctgaaccatcatatatagatcaagtgatgatgtctgttagtgataatgaccaagcattaatcaaggtgttgttaagacaaaccagaagaccagaattgggagataaattttcctctagacatggacaaaagggggtttgtggtattattgttcaacaagaagacttaccattcaatgattctggtatttctcctgacattattatgaatccacatgggttcccctctcgtatgacggttggtaagatgattgaattgatctcgggtaaagctggggttttgaatggttcacttgagtatggtacttgttttggaggatcaaaattggaggatatgtccaaaatattgatcgaaaaagggttttcgtattcaggaaaggatatgttgtattctggtataactggtgagtgtttgcaagcatatattttctttggtcctatttattatcaaaaattgaaacatatggttttggataagatgcatgcaagagcaagaggtccaagagcagtattgacaagacagcctaccgaaggtagatcaagagatggtgggttgagattgggtgagatggaaagagactgtgttattgcttatggtgcttcgcaattgttgttagaaagattaatgatttcatcagatgcttttgaagttgatgtttgtaataaatgtgggttaatggggtacaatagttggtgtacaacttgtaaaagctccgagaatgttatcaagatgacgataccttacgctgccaagttgttgttccaggagttgttatcaatgaatattgctccaagattaagattaggtgacgtgttttaa

SEQ ID NO: 3960 - DNA, 375 bp, Candida albicans
acacatctactactactactaccacctttctcctttccctcccaattacacaactatagattaacaatgtcaggaatattatttgaagatatgtttattgtggattcaacagatccaggaagatacaataaagtatgcagaataacaggacattcatcaacatcaaaagatattaccatcacattagatataaataaagaattattcccggttcaaaaccatgattcattaactattacattagcatcttcattaggtaatgaatcatcaatgattacttcaaatggatcatggagaccacctaaacctgatgaaagatcattagctgatgattatgattatgttatgtatggtactgtttataaatttgaagaa

SEQ ID NO: 3961 - DNA, 942 bp, Candida albicans
ttgaatataaacaaaaaaaaaaagaattcaaattcatttgacatgtcagtggaagttagaaaaagaccagcagataacttcagtctggcgtcgaaaagaagggcaaccgtgcaatccactaatcctaaagacggcaatggcttgtctgaatgtttcaaaacagtttccacatcattatatgtatcattggcaccagtgcatttacaaaacccaataaatggtattaaacaacagcatttagatccgttaataatgacgtattttaccaaggctaaagggattgtcgtagcatattcaaatatcaaatttttggagaataactatgacaatgaagattcagcttatagtcttgccaagatagaaggaagttcgccttttacatttttgtggatttcagtggactttttatgctggtgtccagaagttggtgacgttttggaaggtgacatatatatgcaaaccccatcccatattggtcttttaatatgcgatacatttaatgctagtataaagaaatacaatattcccaacacatggtcttttgttcccaatcaaattgatgaggtgtctggtgatgacagaaaaacatttggacactgggtggatgaatctgaaaccaaagttgaaggaaaattacagttcactattaaagccattcatactactggtagaatcgtttccgttgaaggtacattaattagacctggtgaagaaagaaatgctcaacctgtttataaagaaagactggaaacaaaatcgactggtaaacatatgaaatttgccgatgatgaagtgatcaccaccactgaaattgcggaaccggatgaaaatgacgagttaccagcttatatcaaggattcagatgacgaagattcgggaagtgatgataacaaagttgttaataactccgattcagatgaagataaaattgaatcagattag

SEQ ID NO: 3962 - DNA, 1389 bp, Candida albicans
  unsure (18),(151): Identity of nucleotide sequences at the above locations are unknown.
agagttcccgttaatgtnttctgtacgacattaccatcttttaaaccatttgaaactgatgctagagctggtggttatattaaacaacgtttctattctggtattagaccacaagatatttatttccattgtatggctggtagagaaggtntaattgatacagctgtcaagacttctagatcgggttatttacaacgttgtttgacaaaacaattggaaggtgttcatgtcagttatgataattctgtaagagatgctgatggaacgttgattcaattcctttatggtggagatgccgttgacactactaaacaatcacatatgaatcaattcaaattctgtgttgacaattatgatgccttgttgaccaaatataatcctggagatatgacagaaaacattgatactgatttggcattatcatattccaagaaagtacgtaaatcgttgaagaaacaaaaagatgtaccacattatgatcaagttattaaatatgatccagttttgaatgtttataatccagctaaatatttgggatcagtatcagagaaattccaagaaaaattggatacttatgtttctaagaatccaaccatatttgctcaatcaaaagaagaaactaaatctactggtaagatcactgaaaagaaatttagagctttgatgcaattaaaatatatgagatcattaattaatcctggtgaagccgttggtattattgcttctcaatccattggtgaaccatcaacacaaatgacgttgaatactttccattttgctggtcatggtgctgcaaatgttactttgggtattccacgtatgagagaaatcattatgactgcctctgctagtattaagactccccaaatgacattacctattttagctgatgttaatgatgaacaagccgatgcattttgtaaatcggttgctagagttgttatgtcggaatttgttgataaagttgttgttactgaaactacatctcaagatgttgatggatctaatagtagatcatatgtcattgggttgaaattctatactaaagaagaatatgaaactgaatatgatatttctcaagaacaattggaagatgtcattactagtaaattcttacatgcattagaaggacaaattgttaaagaagtcaagaaacaaaagaaacctgattatatgccaactgttggtaaatcagctggtaagaccgatatggaaactgtatctgggaagataaaagaaatagacaatgacgatgatgatgaagataatgaagttgatgaagatcacgatgaagaacaagctaaacaaaatgtcaaacaacaagtctcatatgaaggaccagatgatgatgaaattgaaaccatgaaaaaaattttaataaatccttga

SEQ ID NO: 3963 - DNA, 2337 bp, Candida albicans
agatgtgggacagatgaaaaattctgtcctggtcatttgggacatattgaattacctgttcctgtttataatccaatgtttttcaaccaattatatattttcttgagaagtgcttgtttgtattgtcacaaattcaaacttaatcaattagaagtgcacaactttgaatgtaaattacatttgattcaatatggattgttattggaatgtgttgagttagataatattatggctaaatcctctaaatccagtagtgtaattgatgttgatggcgaagacaatgatgatgaagaaggaggaggatcagtagatgaaaaatctaaaaaagaccttatgaaacgtcgtgaattatttgttaaaaatgctattgaaagtgccttgaaagacggtagaactaatcataagggagttgtcactgcttctgtttctgaagaaagaaaagcaactattcatgaattttataaaagattattgagtagaccaaaatgtaccaactgtggtatgtattcaccaggtttcagaaaagatgggtttaccaagatttttgaaaactcattaactgataaacaaataacaaataatcgtgtaaaaggtttgcaacgtccagatatgatcaagaaaaatgccggcaatggtaatggtaattctagtagtactggagcagcaagtgatcttccaaatataaaacacaagggaggatccaaatatgtgttatcaactgaagttagaaatattttgagatcattattccacaaggaacaagcaattttacaaaaagttttccattcgagaccttaccaacacgacccaattagtggagacctttttttcaaacaatcagttttagttcctcctactagatttagattgccatctaaattaggagatgaaatacatgagaatgctcaaaatgaattgttatcaaacattattaaaacatctgttctcataagagatttgaacgaaagaattaccaacatgtacaaagagaaaatcagtggtgaagacaagaaaatcattttcaatagattgatgaatgcatttgtgactttacaaaatgatgtcaatgcctttatcgactccacaaaaaaccagaatgctccagcagggaaaataccaaatccaggtattaaacaagccttggaaaagaaagaagggttatttagaaaacatatgatgggtaaaagagtcaattatgctgctcgttcagtcatttcccctgatcctaatttagaaactaatgaaattggtgttccaccggttttcgccaaaaaattgacttatcctgaacccgttacctcttataatgcttctgaattgagacaagcagtcataaatggtccagatacctggcctggggccatccaagtgcaaaatgaagatgggtctttgatttcattgattggtatgacattagaacaacgtaaagccattgccaatcaattattgactcctaatggaggtaattcagttgttggtaaaaaagtttatagacatatcaaaaacaatgatgtggttattatgaatcgtcaaccaacattgcataaggcttctatgatgggtcataaagtgagagtattaccaggagagaaaactttaagattacattatgccaatactggtgcatataatgctgattttgatggggatgaaatgaacatgcatttcccccaaaatgaaaatgctagagctgaagctttaaatttagcaaatactgataatcaatatcttactccaacttcaggttctccattgagagggttaattcaagatcatatttctgctggggtttggttaaccaataaagatacatttttcaatagagaaacttatcaacaattgatatatggttgtattagacctgaagatggccatacttcgaaaaatagaattgtaacggttccaccagcaatttataagccagaaatgttatggacgggtaaacaagtgattactaccgtattacttaatattaaaccagataatgttcctggggttaatttgatatctaaaaacaaaattaaaagtgattattggagtgaatcaagtactgaaaatgaagttatttttaagaatggtgaattattatcgggtattttagataaatcacaatatggtgcttctcaatttggtattgtccattcattacatgaagtttatggtccaactgttgctggtaaggcattgagtgttttaggtagattatttaccaattatatcatgatgacggcattcacttgtggtatggatgatttaagattgactgatgaacggaacacttggagaaaagatatattgaaacaatcgggtgaaattggaaaaatttgcaactactga

SEQ ID NO: 3964 - DNA, 477 bp, Candida albicans
aataagcgcagatccggcgactcggcaggtgaagaaataggaactagtgaaggggttaatttccgtgccatgtgggatcaagatgattttattaatgtcaatggtatcacttcaaatgatgtttatgccgtcttgaaaacttatggtgttgaagctgccaaaaataccattgttcatgaaatctatagagtgttcgatacttatggtatcaatgtttcttcccgtcatttggatttaattgctgatatgatgactagagaaggtacttatttggcattcaatagacaaggtattgatagtagtacatcggcatttatgaagatgtcttatgaaacaacttgtcaatttttgactaaagcagtgttggatggtgatcgtgaagaattggaatctccttctgctaaaattgttatgggtaaattatcaaatgttggtactggttcatttgatgtatttgctcaaatgccaagattatga

SEQ ID NO: 3965 - DNA, 963 bp, Candida albicans
agattgaatgaattattggcatttatatttattgttagagatacctataagaatgggaatccgttccataatttccgccacgctgtggatgttctacaagcttgtttccattttcttattagattgggtagtttacccaaattcaagcaatttgtcgaggacccgaaattggattacaccgaagttcatgacaaacatactgtattgattgccttacaaaacaattcctccgaggaaaaagcttctcttaatccaatacaaacattaggattattggttgcagcattgggccatgatgtgggccacccaggtacgacaaatgatttcatgattaaattcagtgcaccaacggcactactttacaatgacagatctgttcttgaatcttatcatgcatctttatttatcaataaagtgttaagaatatgttggccagatttattaacttgtacaattgaggaaaaatcagagttaaccattataagtttgataatttcttcgatattggccaccgatatgggtgaacataatgaatatgttaatcggttgaaatctttcaagacccataatgaaattttaaaccatgataacactgttaaattgatttctgccttgttaatcaaatgtgctgatatttctaacgtgacgagaccgttgagagtatctgcacaatgggcaatggttttatcaagagaatttgcagaagttgagttgctcaaatcggtaatcaaaaaagatattgatcttgactttaccaaatatttaacttatgatgatgttccacatgaattacgcgaaatacttgaaatactacccgatatacataaaggacagatatttttcatcaatttattcgctgagaatttatttaatagtgttagtgatttattacctcaattgcagtatacttgtgatattatcatggaaaacaaactattttggttggaaagagcaaagaaataa

SEQ ID NO: 3966 - DNA, 825 bp, Candida albicans
  unsure (756),(776): Identity of nucleotide sequences at the above locations are unknown.
aaccggaaaacattgatcagactttcccagctggcagggttgctaaaggtgaattattcagatccattctatgacaatcaaaatgatgtacctgcaaaacctttggtatttgccaatcagaaaattgtggtgccattgaaaaatgagctgctgattcctagtcttgagatgtctcaattaattaaacaaaatacacacataactaaacccatatcccaaatattcagtacttggcagtatgtacctgaacccccgtctaagcgtgaagtcagtaagtggttaaaacatgatgaagcgtacacccttaaaaagaataccaaataccaattccagatagaaccaggagtgactcaatcttatgattacaagtattcatacaattctatgaaaatttcgagaagacctgacgagtttaattgtttgacgaattttcacatggaactacatgcgaatcctcccaatagtaaacttacagttgaccctttaagagatcccatttcattgattttttattctttcgatgatgctaataatatgtttagacatttaaatttcgcgtcgggtattttgatctttaataatacaaatattgatatgaatttgatacagagattatcacatacattgaataaacatattgaaatatttgacgatgaattgaaaatgattacaaaattagtcacactagttgagctctttgatccggatattttatcgggatatgaagtcaattcaatgtcgtggggttacattgtngagagactaagagatgtatntggtataaatataatgctggatttgagtcggggaaagttcaagaagtaa

SEQ ID NO: 3967 - DNA, 1380 bp, Candida albicans
gcgactacgtctgcggcggctgctagaaaatgtattagcacgtacttggaagaaattttaagtatcagaatcaaaatcaaacaagttatgaaattgtttaaagaggatgccgaattgacaaaactatacaattctagacaacttgccctaaagttaatagctaatgttacatacggttacacttcagctacatttagtggtagaatgcccaattctgatatagcggacgctatcgtgtccaccggaagagaaattttaaacaaatcaattgaattaatagaagccgggaattatggtgccaaagttgtttatggtgacacggattctttgtttgtttacttccctggtaaacctaaaactgaagcgttcaagcttggtaaacaaattgccaaaacgattactaattatttccccgatcctgtgaaacttaagtttgaaaaagtgtaccacccgtgtgttctattggcgaagaagagatatgttgggttttcctatgaatacgaggatcaaaaaactcctaaatttgatgccaaaggtattgaaacagtacgaagagatggaattcctgcacaactgaaaatgaccgaaaagacattaagaattttatttgaaacgaaaaacctttccaaagtgaaacaatatacgattgatcagttttacaaaatcatcttcaataaagtgcccattagagatttttgttttgctaaagaagtgcgatatggtacttacaaaaatgaaaaatatttacccccaggggctataattgctaaaaatatggcagaggaagacccaagaaaggagcctcaatatcgagagcgtgtgccttacgttgttattagagattcttcaaaacccaggattaaagaccgctgtgtcacacccgaagattttatcaaatcatatgaaactaatctgccggtctctttggattatgaatactatatcactagggtattaattcctcctttggaaaggattttcaatttaattggtattgacattaccggttggtatagacaaatgcctatagtaatgcgtggttcgcatgtcgcatacgctgaaggttgtctagtgtgtgggaatcggttggatgatagtgctaatatttgtctgaaatgtcttgcaaatgaacaagaggtgattgccgatataattctgacttctagagacactgaaaagaaacttgttgaagttgaacgtgtgtgtcaaaagtgtgtggataataacacctctctgtcaatggggagattcatcgatcaatgcactgatgattgtgtcaatggagattgtatcgtctattataataaatttaagctcaattatgaatcgaaacaaattttcaccaaaaaagacaaaatccttcaagagttggattggtaa

SEQ ID NO: 3968 - DNA, 2013 bp, Candida albicans
gtcttccatccggtcggtgaaaacgaagctaaggaagagactgacgagttaggtggatattttattgttaatggtattgaaaaattgatccgtatgttgattgtgcaaagacgtaatcatcccatggccattatccgtccttcatttggaaaccgtggtgcttcttacacaaaattcggtatccaaataagatcagtaagaccagatcagacatcacaaacaaatgtattacattatttaaatgatggtaatgttacttttacattttcatggagaaagaatgaatttttggttcctgttgtgatgatcttgaaagcattaattgaaaccaacgaccgtgaaattttcgatggtatcgtaggaaatgatactgaaaactcgtttttaactgatcgtttggaattgttgttaagaacttacaaaacatacaatttgtactcccaacaagaaactttagcttatttgggtgacaagttcagagttgtttttggtgcatcaccagatatgtcagatattgaagtcggtaaagaagttttgaaaagaattgtcttggttcatttgcctaataatgctgacaagtttagaatgttattgtttatgattagaaaattgtattcattggtcgctggagactgtgctcctgataacccagatgcaacccaacatcaagaagttttgttgggaggtttcctttatggtatgattatcaaagagaaaattgaagagtacttgcaaaacattaaattgcaaattcaatctgatattaatcgtggtgttggtataaactttgacgatagaaaatatatgaccagggtattcctgagaatcaatgagaacattggtcaaaaattgcaatattttttaagtactggtaacttggtgtcccagtctggtttagatttgcaacaagtttctggttataccgttgttgctgaaaaaattaacttttatcgtttcatttctcatttcagaatggtccaccgtggttccttctttgctgaattaaaaactactactgttagaaaattattgcctgaatcttgggggttcctttgtcctgtccataccccggatggttctccttgtggtttattaaatcacttgtcgcataaatgtaaaattgccactgaggcatccgacgtgtcacaagttccaaaggctttaacccaattgggtgttttaccggccgactcatttgcagctggcccaaacttgtgctgtgttcaattggatggtaaaattgttggttggacgacacatgaacaaggtagaattgtcgctgatacattgagatactggaaagtcaatggtggtcacggattgcctttagatttagaaattggttatgttccaccttcaaataaaggtcagtatcctggtttgtacatttttggtggccactctagaatgatgagaccagtgaagtatttacccttggataaagaggatatcgttggtccatttgaacaagtctacatgaatgtagctgtaactccagaagaaattgagaataacattcacagtcatgttgaatttaccccaactaacatattatccattttggctaatttaacacccttttctgatttcaatcaatcaccaagaaatatgtatcaatgtcaaatgggtaagcaaacaatgggtactcctggtactgcattggtccatagatcagacaacaagttgtaccgtttacaaactggtcaaacaccaattgttaaagccaacttgtatgatgactacggaatggacaatttccctaatggtatgaatgctattgtcgctgttatttcatacactggttacgatatggatgatgcgatgataataaacaaatctgcagatgaaagaggttttggttatggtactgtttataaaactgagaaagtcgatttgtcacaatcaagaagaagaggtgatccaataacacaacattttggttttggtagtgatgaatggccagaagcatggaaggaaaaattagacgctgatggtttgccattgattggtgtt

SEQ ID NO: 3969 - DNA, 1029 bp, Candida albicans
cggcgtggcggaacaggtgatccaatagtggcatattatgatgatactttgggtaaaactaaagttaagacttaccattcatcggaaccagcatacattgaagaagtcaagttattaggtgacgacagcaatgaacaagagggtcaacaaataactatcaaatacagaatcacaagacaaccattaattggagacaaattctcttctagacatggtcagaaaggtgtttgttctagaaaatggccacaaattgacatgccatttactgagtcaggtatgcaacccgatgtcatcattaacccacatgcgttcccatctcgtatgacaattggtatgtctgttgaatctcttgctggtaaggctggtgccttacacggtattgcccaggattctaccccttggaaattcaatgaacaagatacaccagcagactactttggtgagcaattgctcaaagctggttataactaccatggtaatgagccaatgtactctggtgccactggggaagagttgcgttgtgacatttacattggatgtgtttactatcaaagattgagacatatggtcaacgataagttccaagttagatctactggacctgttaattcattgacaatgcaacctgtgaaaggtagaaagagatccggtggtattcgtgtaggtgagatggaaagagatgctttgattggtcatggtacttctttcttgttgcaagatagattgttaaattgttcagattacacacagacaccagtctgtcgctcatgtggatccatcttgactacacaaacgtcagttccaagaattggaagcatggcaagtatcagatgtagaagatgtgcagtcggcttggacaaatatgaaggatatgcagctgattcagatatatgggaagatggacatggcaagaaatttgtgggtggtgacgataccacaactgtggcaataccttttgtattgaaatatttggatagtgagttgtcggcaatgggtataaagatgcgttataatgttgaaccaaaataa

SEQ ID NO: 3970 - DNA, 291 bp, Candida albicans
agaacgggggaattggctaaaaaattccaaaaatgtttcccaccaggagttattggtatcgatgctaatggtaaagcatacgttaaagatgccagaaaagatactgtttctcgtgaagtattaagacatccagaatttgatggtaaagtccaattaggtagacaaagagatcatttcatattcaatgttgaaagtaccggggctatgcctccagcagagattttcttcaaatcagtaagattattgaaaaataaagctgaatatttgagaaattgtccaattggtcaataa

SEQ ID NO: 3971 - DNA, 780 bp, Candida albicans
aaaaacatttgtatgtattacattaccagtcgtcatcgatactctcttctgtttttttcaagtattagacatatcatcgataaaataccaataaaaaaaggcaatagtataatgtcagataataacattgttgggatagaatataatagagtgacacacactacttcaactgatttcgcaggtcatcaacaaaatggagattattcatgggacattgaaaaatttaaaaacaagtttgaaatcaaaatcacaaatttgagtgaaaggacggggacttttgatttgatacatattgatacatcaatagctaatgcatttcgtcgtattatgattgccgaagttccttcagttgctgctgaaactgtatatatgtttatgaacacttcagttattcaagatgaagtattggcacaaagaattgggttaatcccatggaaaatcgaccccgataagttgacttgggtagatgaaactgttgatatcaatgatcgtttcacagaagataatacaattgtgttatcattagatgttgcatgttcgaaaaaccctcatgcacctaaaaattctactgatcctagagaattatataaaaattctcatgtttatgctaaagatttcaaatttgaacctcatgggaatcaagaagaaaaatttaaagatactccagtggtgccttgtgatcccgatattttattggctaaattaagaccaggtcaagaaatttcattaagagctcattgtgtattgggtattggatctgatcatgctaaatcttcacca

SEQ ID NO: 3972 - DNA, 2196 bp, Candida albicans
aaacaagacgcgttgttttaccttctttcaacatcttttagcaacaccacccattcaataaccttcaatatggaagtcacttctttgccaattaaacttcagccatcaaacattagacccatagcatttcgaatattgtctaaaaaacatggattaaatattaatacagatgctttagcaattttaacagagaccatcggctacaaatttggaactgattggaaaagtgtgagatcacaacaatttcttgaagaggttgccaaagtttggaaaatcgaagatcggggactatttattgatggcgatgggttaaaacaagttttgaaggatatgaattccaaaagcagcaatgatacaaaaagagctcatcgaactgacaccctagttgatatcactaatgatggtaaccaaaatcatactcatagccaccaggataagcaaataagttttgaagataaaaatatggaacatgaagaaagagatgatgtaccaatcaactggcaagattatttcaaagttgtatctcccaataaccaacctactagtatattcgacaaaacaagaaaacaatttgacatagtatttaaaaataatgatgacaaggataagaaagccgagcgtggcgggaaacttgagtcaattgtggcagagttagtaaaaaatttgcctgcatctattgaatcattcaataatcgatactatctcttaagtgatcgattatcgagaaacgaaaattttcaaaaaaaatcattaatcagtctatcagcgttaaattctttcaaagaaggaaaaacagatagtataactggtcatgaaattagtttaatcaaaaatatgttgggtcgagatggtcaaaaatttttgatattcggtttgctcagtaaaaatgcaaacgatgaatacacattggaagatgaaacagaccacattgaattaaacttatctcaagcttttaaatctcaaggattgttttattgtcccggaatgtttctattagtggaaggtatttattctgcaagtgggggtaattccaaccaggatcatggttatatcggaggatgtttttatgttagtaatatcgggcacccaccaagtgaacgaagagagacaagcttagatgtttatgggaatttggattttttagggatgcatagacaaattgcacctgtgacaggtgaaaaaatcaccaaaatatctaaaaagtttaagaagagattggttctaatcgaaaagaccttgtataatcataaacttatttttgtgggtaccgatttatacttggatgatttcaaagttttggatgggttgcgaaattttttccaaaaattagaaaattcaattattgaatcaatcgaagacgaagaagggcaaatggccgaaggaaccaatataccacttgctttagttttcacagggtcatttgtgtcaaaacctttatcagttacaaattcatcagtgaccaacatcaccaattcagaatcatacaagagcaattttgataatttcacaacaatcgtgagcaaatacccaaacattgtatctcgctgcaaaataatattgattccaggtaaaaatgatccttggcaatctacttattcattgggatcatctagcttaaactattttcctcagtcgtctattccaaaagtgtttatcaatcgattggaaaaattattgcccaagggaaatttagtagtttcatggaatcccacaagaataaattacttgtcacaagagttggtagtattcaaagacgaattgatgaccaaattgaaacgaaatgacattattttccctcgtgatattcaagaacaagaagagttgattgcacaagatgaccaaagaactaacgaggagagaatcaataatttaatccagaataaaaatactcatttgccttcaaaaatcaaacaggcaagaaaactagtgaaaaccattttggatcaaggaaatttacaaccattcttgaagaacctaaaattaatcaacttggcttatgattatagtttaagaattgaaccattgcccagtgtaattattttgaacgattcaagtttcgacaattttgaagtgacttataatggttgcaaagtggttaacattacttcagttgtcagcttgaataatagaaaattcaattatgttgaatattatccaggaactaaaagatttgaatttaaggatttgtatttctaa

SEQ ID NO: 3973 - DNA, 744 bp, Candida albicans
  unsure (711): Identity of nucleotide sequences at the above locations are unknown.
agacagggcaacatgagtggaggaagggtagtcgctgcgaaacccagtgcaataagagaaggaccgatagatgtgaatgcccccaattgtgatgccaggcgactgaacccgcacttgtctccagacccagcaatcaacaatgaggaacttgatgatttggacttatcattacacccaagaaattggataaagattgttgaggcattcgacatgccccgcttgacttacaacgtcgacaagaagtacttcgaattaacaaagtcaaaggctacattgttcccgcaggcttcacacaaaactagcatgtttagagaccgttataacatcattcaccagcgtctactccggaatgaaacatttcaatcatcgttgagttatctcacaggccactccatgaagaggtcgtcatcctcattcgctcccactcaatgttataggttgacaccgatcgcaaacttgcttggaagaagtggcacgtcacacctgcttctaggattactctctatatcacccgcaggtgatctatccttggtcgatttgacaggtagcgttgcgctagatctgagtcatgcccggacgataccagacgatggtgcttggtttgctcccggaatggtaatcctcgtcgatggagtctatgaagaagaaggaagcgtgagaggatcggtcttaggcggaaacagcggattcggtggcgccgttgaggggtcnatttgtgggtgtatcaatttgcggaactccgtg

SEQ ID NO: 3974 - DNA, 414 bp, Candida albicans
tttcaatacaaaacttacataatgtctgattacgaagataatgcttttaatgaagtagctgaaaattttgaagattttgatgctccagaccatttttctgataatgaatatgacgatccatcagcaaatggtggtgatgccgctttaaaaaccactgatggaagaacaattataaatggtggatttggacctgatgatgctcaagcagctggtcaaccaagaaagaaaaccactaaagaattggctattccaaaggaaaagagaactaccactccgtatatgaccaaatacgaaagagcaagaatattgggaactagagctttacaaatttcattgaatgctccagtattggttgatattgaaggtgaaactgatccactttttcacatccgcatggccatccaatttaattaa

SEQ ID NO: 3975 - DNA, 435 bp, Candida albicans
gcgcgggatccttgtcagcttttcgtggatgaagacgtatgtgatggagcattattaaaagaaaaaaccgttagaagtgaactttatcatttaattaaagctaatataattgaaattcaagaagttcctcgtagtgctgatagagcagcttcaaaaactttttatttatttcgacataaatcaaatagtaatttcaattatttgaaaaattgtttaatttatgatatggcagaaattttaaatcgaattcaagattttaaattggaacataaaattttattagaaaaatataaattggtggaaggtcaagaagatcaatatttacttgatcgtgaattaaaattattaaatgatttacaacttcgagaaattaaaaatttggttaaatttcaaagaattaaaagtttatacagtctttatagtttagttgattaa

SEQ ID NO: 3976 - DNA, 501 bp, Candida albicans
ctgctatcagaaattagtaatcgtacgaaaatccctaccaaaaatatcaaatcggctatagtatcattaattcaattgaattgtatatattattggcaagaagaaaaagatcggaaattttattattcattgaaagaaactggattattattatatgtatatagtggagatattattaatcatattaaaagacaatatggagaagatgaagcagaaatcattcaaaatatattgattcatggacatgttaaaattgaagattatttaacgcaatttaatcatgataaatcaatgaaaattgatcaagaaaataaatttttgaaattatttaatgataattggttaattaaattacaagattatcatttccattcattagatgatatatggcataaaatttttgaagaatgtctgaaagatacaccaagatcatcagttacttctgaaattaaacgagttgctgaagctcaagctaaagcaaaagtaaaattaaatacatga

SEQ ID NO: 3977 - DNA, 528 bp, Candida albicans
ttctacgggggaggttatttaccatcccagcggtcaatagatacaaaaacgttccgaactaatgcatttgtcaatatggttagatcaaaaattggtgtattgacagctattgtttatgatgccgctttaaggtatattgaaaataagagtccacccatggattatccattattggatattccgggactaattaatgatcctaaagatgttaaagaatatattctttctattgaaaataaattggttaatgagaaaaaaatcaccttttcagcaagagacattcaaagacttttacctaaagatatagattttaaaaattctgtcattactccaacttttgccaaaccgaaaagaccacttgaaaatggatcatcgccaactttgaaaaaaatcaaacttgaagatggtattgcttcgtctacttccacttccacttctacttccagctcaacgtcatcaaatggtacttcgattgatttaaacactttggaacaacatttgaaattattacttaatggtaccaatacg

SEQ ID NO: 3978 - DNA, 807 bp, Candida albicans
aactcccaatcagatgagcatcacatcacatcattcatcaccatcaaaatggcatcaaatactgtgaatagatcaattatagttttattgggtgggggtcatgcatctggtaagaaaaccactgcattgtctctaaaagaagagcttctggccatagttcccgagtgtcacgttgacgtacagattatcgatatgaatgattatactgttgatggcaagtcgtcgattgattctagccaatttgttagcaataagtctgcagcaatctcaattaataaaagtaacgataaattaccacgtctcaaaccttcgagatttcaatttgataagttgaaaaccttccttttaaataacttggatacaccaagtaacgagcctcaaaaaatattactcgtgcatggtttgtatgctttgtatgataaagaaattagacacatagcacatattaaagcgtttatcgatagtgattcagatacaagattaatcagatggattagaagagacgttttacaaaaccaaacagactcattggaaggtgttatcaatgcttatttattaggagccagatcagaaatgagtgatttcattttccccacaaaggaatttgcagatgtaatcttacctcgtggtgctgaacctaatgcagttagattaatcatagatggtattatgttatatctcaatgacaagcatttgacaaacgacacaacacaattcccggagaatattttgcgtccaaacgaaattgggaacttccaaaaggaacgatttgatgttcaaaagaacaaattttacgaattaaactaa

SEQ ID NO: 3979 - DNA, 738 bp, Candida albicans
agaccttcaagagccaacattgccgcattgaagagattgggagttaaagccatcattgccttttctgccgttggttcattgcaacaagaaatcaaaccaagagattttgttttacctactcaaatcattgacagaacaaaaggtattaggccatctactttttttgaaaaaggatttgttgcacatgctatgtttggagaaccttttgatttgaagttgaataaattgattagtgatgccattccaagtaaagggtttttggaaggattcgacactgatggtactcctgtattgcacactaaggaaaacaccaataatggagaagatttaaccatcatctgtatggagggcccgcagttttcaaccagagctgaatctagattatacagaagctggggaggttctgtcattaatatgtcagtattgccagaagccaaattagctcgtgaagcagaaattgcttaccaaatgatttgcatgtcgaccgattatgattcgtggaatgaaagcgaagaacctgttactgtagaaactgtggttggcaacttgaaggctaactcggctaatgcttgtaaattagctgctaaattgattgatgaatttgctgctaagggtggtgaaattggtaaagacttacaaggaagcatgaaatatgcagtcagcactagtccacatggtgttaagaaggaattgttagagaaaatgcattttttgtttcctggttactgggaagtatag

SEQ ID NO: 3980 - DNA, 600 bp, Candida albicans
actacttttcccgttagagtggcccaattgttaggaatttctagtgttgttgtcaccaatgctgctggtggcattaacccaaagtttaaacccggtgatttgatggttattgaagatcacattaatttcccagggttggctggataccatccattgagaggaccaaatttgagtgaattcggacctagattccagcctctttctgatgcgtatgactatgaattgcggaaattatttttaactaccgccagagataaattgggtattactagaaacatttatgagggtacatatttctttgctgctggacccacttttgaaagtagagctgaagtgagaatgattaaaacaatgggtggagatgcagtgggaatgtcaactgttccagaagtaattgttgcccgccattcagggttaagggtgcttgcattatcactaatcacgaatgctggtgtaggagacaaaccgccaagtgctttcgatgaaaatcctccggctttagatgaaggtatggctagccatgctgaggttttggaggctgcagatgaagcttcaaaagacgttcaaagaatcatagaggaagtaattaatcaattataa

SEQ ID NO: 3981 - DNA, 1200 bp, Candida albicans
tgtcatgggcccacgttcatgttttcggtgaaaacttgtcctctggctgctgggattattcatttgggtgctacttcatgttttgtcactgataatgctgatttaattttccttagagatgcttatgatgttttaattcctaaattggtcaacgtcattgatagattatcgaagtttgctttggaatataaagacttaccagtattaggttggactcatttccaaccagcacaattgaccacagttggtaaaagagccactttatggttacaagaattgttatgggatttaaggaatatggttagagccagaaatgatattggattaagaggggttaaaggtactactggtactcaagcttctttcttatcattattccatggtgatcatgataaagtagaagaattggataaaagagttgttgaattattaggatttgatattgtttatccagttactggtcaaacttattcaagaaaaattgatattgacgttttatcaccattggcttcatttggtgctactgctcacaaatttgctactgatattagattattggccaatttaaaagaaattgaagaaccatttgaaaaatcccaaattggatcatctgctatggcttataagagaaatccaatgagatgtgaacgtgtatgttcattggctagacatttgggtggattgttcaatgatgctgtgcaaactgcttctgtgcaatggtttgaaagaactttggatgattctgctattagaagaatcagtttaccatcagctttcttgaccgttgatattttattatccactatgcttaatattaccagtggattggttgtttatccaaaagttattgaaagaagaatcaattctgaattaccattcatggctactgaaaacattattatggccatggtcgaaaaaggtggttctagacaagattgtcatgaagaaattagagttttatctcatcaagccagtgctgttgttaaacaagaaggtggcgataatgatttgattgaaagaatcaaatcaactgaatatttcaaacctatttggaatgatttggatactttgttggatcctaagacttttgttggtagagctcctcaacaaactgaaaaatttgtcaagaatgatgttgccaatgctttgaaaccatttgaaaaatacatcaccactgaaaatgttgccttgaaggtgtaa

SEQ ID NO: 3982 - DNA, 297 bp, Candida albicans
cataccacgatcatcatgtctgaatacgataaatactcaactccattatcttcaagatatgcttctgaagaaatgtccaagattttctctttgagaaacagattttctacttggagaaaattatggttgaatttagccatggctgaaaaagaagttggactttctgtcattactgatgaagcaattgaacaaatgaaacaacatttggaaatcaccgataaagaaattcaagatgctgctgttgaagaagctaaagttagacatgatgtcatgggcccacgttcatgttttcggtga

SEQ ID NO: 3983 - DNA, 1419 bp, Candida albicans
aagcaaaaaaaaaaaaaattatattcatctcatccccatagaacaaatagtacaacacatacaacaaagcaaactaatatgagggacttgattgtattggggggttcatctcatcataatttgactaaatcaatatgtcgaagcttgacactagaacaaggtcttgtggattctcgtaaattttccaatggtgaaatatcaattgaagttaagaatagtgttcgagaaaaagatgtctttattattcaaagtggatgtgggcatgttaatgataattttttggagctcttgatcactatagctgcatgtaaaactgcaagtgccaaaagagtgactgcggttttaccattgtttccttattcaagacaaccagatataccttatcttgctaatgcaactggtgcaccaagcattagtaccaaaaaggaggaatacacttttgaaagtgcgcctgcaactccaaatccattatcaaaatcaagtagtgaaaaatcgtttctttccctggcatcgtcgtcgatagtatcggaaaacaaagcagcaaccacaggtgtaaacaacattagtagtggcaacagaattaaactgccagttccaaagaaatacactccaaaattaattcacacaaatgcctcagcaacaaattttttaccgcaagtggacgcttatggtaaaaccgagagtggttataaacaatggatctctccaaatggaactttgatagccaatttgttgactactgctggcgctgatagagttatcactatggatttgcatgatccacaatttcaaggattcttcaatatccccgtggacaatttatattcaaaacctattttgaaacattacatattgaatttcattcctaactataaagattgtgtcattgtcagtcctgattcaggtggtgccaaaagagcaactgctattgctgattccttaggttgtccatttgcattgattcacaaggagagaagagccaagttgccaaagaatccacctctgacttccatgagtaatagtcatagtcataatcattataattctcaacataagccgacaatggttgcaactaccatgttggtgggtgatgttgctggtaaagtttgtgttttggtggatgacttggttgatacctcgtatactattactagggctgccaaattattgaaagatcaaggtgctgaatatgtgtatgcattggtcacacatggtatttttagtggtgatgccatcaacagaatacaacaaagtgctattgataaattagtcgttacaaattctacgccacaatccgagcatgtggagatactaggtgatagaatggaagtcttggatgttagtagagtgtttgctgaatctataagaagaatcaataacggtgaaagtgttagtatgttatttgatcatgggtggtag

SEQ ID NO: 3984 - DNA, 636 bp, Candida albicans
gacacagatgatgtgacgtaccgtgcatggtgggtcaaaaaagataaaaccaacgatgccatcaatttggacgagtctattgcaacaataaagaattacatacaaaaaggcgagatcatcgcagacaatgacttgaaagtagaagaggaaactgaagaagaaaagaagttgcctattgttggtatacttgggttctctcagggtgctgcatttggtggagtcgtagcacataaatgtcatgaattgtttgaaacagaccctttaaagtttgttgttttatattctggatttaaattggacacttcaaaaaaggcaggtaacgacaagtacgatgaatatgaccctcagacagaagaagaagtgaaaagtggtggtttcaaatatcttcacgtgttgggagagttggacactgtggtagcagaagatcgtggctattcgttgtatgaacatacgaagtcatctgccgatatggtgaagcatccaggaggtcactttgttccgaactccaaaatgtatgtcgacaatgtagcgaactggattgaagcccatcaaaatggatctcagctgaagtctgaagcgccagaagacgatatcgattcgttgttggacatgatggataatttcgggaaagcgtga

SEQ ID NO: 3985 - DNA, 822 bp, Candida albicans
acaaaattttctcatagctatgtcacctcaaattcatcagtcatgtctaaaaaaattttgtgcttgccagggtatttgcaaaatggtagtacttttgcagcaaaatcatcgggtataagaaagattttgaccaagaaattagattgtcaacttgactatgtggatccgtatcattcgattgaatcgtggcgtgaattctcatttccaattgcggccaatgaggaggaatcagataaaacctgggcatcaattgttgaaaaggggaataatgttcgctggtttgaacacaaagcaccaggcgtcaatcttggtttggatgagtcggtgaactatcttgttgattatatcaagcagaacgggccatatgatggaattattgggttttcacagggggcagccatggcggagataatgacaaatacaataagaaaattattaccatcacatcctgatttcaaaattagtttgtttatttcagggtttttcttaacagaacctattagtgatgatcattcggaagggaatagacaaagaatcaatgacattactgacttggaagagtataagagtcaagtacaaatctcccctgatatggctaaatactttactcctccacaggacttgaatactcaggttttaatggtttatggagatgatgataatattgtagctccagtgagatctaaatacgcatcaacattttacaagtcggtccacatgtttccccatgagggagctcattatgttcctaacaaaaaagactttcttgaaccaattgtaaagttatttgacaaaacgttgaatgaaaagccaatgttatag

SEQ ID NO: 3986 - DNA, 1200 bp, Candida albicans
agattgttaaatacagaagtagctcttctgtcgaggtccacggatttgttcagaagaaattcaactttgacaaagtttttatcattttacgcacaaactaacggggttgattatttgaatgaggttttgttacctgttatcaaagaacttgttgataatgatgtgcaatttgaagttgaaaagcaagacaattcagataccgcagatctcttcatattatatttatcaagaataatcgatctgattgtgaattcgactgacaaattgccgcatgcattcaaactggtaagtaaggcaatttacgattctgtgtcgaataaatttcctgaagctgcactcacggccgttagttcttttgtatttttgagattcttgtgtcccgcaataatcagtcctgaacaacatttcaaacttccaattaacaaccccaaagttaaaagatcattaatgcaattggtaaaagtattgcaaaatatggccaatggaactttgacgtctattaaatggcctgcaattgccggaaaaactgaagaattgaatttctacaatcaaaaaattgatggatttttgaaaattatttccacagatgtaacaacggagaatcaaagcgctgaattatacaaacccgagaaaccattaacttcgttgagatacttgcacaagttcatttaccattactttgcaaaaataagatataactttcttttccaacactcatggagatgtaattacctgttgcatgataaagcagtgaaatttaaaaaatttgattatctagtaatgcaaatgggtcaaccaaatcctggtgttaaattacagatgtccagtaagttgaagcttttagatactaataacctagatgaggaagaaattaaacttaatgattttatgacaaaaatgtcaatcaaattttctgacacaccaccggatgcaattgatgttattcatagttcaattttcaaagatggtacaccagcagtagtggttaatttgaaaaaattgagtggccgaccacatgattttgaatacttggcttacaaattaatagaaactgcatctcaagtgtgggataacaagttttatttggtatatgattttacagaatattactattatattgaaacagttacgattgaatatgctaatttgattgcaaacaggggcaccaaactattgttcaataattgtccaaagatttaa

SEQ ID NO: 3987 - DNA, 2235 bp, Candida albicans
atcatggatggaggatttaaattcgaaaagcgggatgtttggttgggtaatttgttcaacatacttttgaaattgatttgggaattcgtgagaacccatgcaagtaatgttccattcccagctgatgctactaattttgttgttactgtttcagcacatttagcgaaaacattccctcaaatgacatatcgttttttcaaagcattttttgataatttcgatcgtatagatagggagaccaggtttacatctattttgtatttatcaccttggattcaaaacatatatgagtacgtgtttctgaatgatgagaatggtgctgataagactgcggatttgcttcgattgttttgtcgtcttacatcaatttataaagaccgcattccatttattaatgattatatatggtccaaattatttcaagaggcaagattggtatcgactttagtggaagaggtagtagcatttgctattgatagtaagaatgataatccagactggacatttattattgcagtgatttgtccatcaatagaagtttgtggtgaagttacatcgagattattacaaagaatcaataaagttgtgacaactgattcatctattgccttacaatcgaaattgtttgaaatatcggttttaattaagatttgctcatcattgtttttcaattcatataatcttgccaagacttatttggccgagttgattttctttgttactttgtttattgataatcctgttttggatgttggagaagatttacaaaaattgcttatgacggcaattcagtctttcttacacaagccaaatttgactgaagcacaacgagctgaaatagataaagctattgcgtatttttcaactccaagagctaagatgattttcggtaccagtagagacgtaacgaaaagaaatgatgctgcacaagctttcaataaaatcacaaatatcgaacagtttgctgattacttgaatgttttcatcaaggcatttgcgttacacggagatagaactaactggcgagctagatggtcgtctaatactattgatgtcgcctttaacaactactcggtatttcaagatcgagcatttttgatggtggggattctttctaaagaaggtattagtgattcaaatgcatgccgaacaataaagttagtttctaacggcgagttaaatagtatcgatataactatttgtgttgctgttgctgttgccagaatcttagatggtttacctgatagttccattttaccaccaattttgatttggccacaattatgtttcacattattgaatcatgctgtactctatccttctgggttagaaaatgttattgcttcaatcacaaaaataatgagacttggaccaaattatttggacattatatttgaacaacaacaatatttagaacccgatttatctaaattccaggaaaggcatggttatataataactaaagagaattttggtgttcacatatttttcatattgggtcaaggattaagaatttctcaatatagacacttagcaattgcgtgtattaagagatattttaagcaaagatatttaatgagagaagggaaaacaatggatgggaaatttataacaaataacacatatgcctatattttctatctttatttgtgttgtgatgccaaggaggttgaagattatttgaaggagcttgaaatcgatcgttcgtttatatctttagatgataatcaaaaaattcctaaattattaattgacttgttgtttgacaatactgaagtatccaaaatattaatgatacatgttggatttttgttctgtgacattcaaggggtcgatatcagttttaaagcaagatttattcaaatctatctttatatgctcaagaataacagagaattggcattacttgtgtatcatatcatcaaaccaacattgatgcatgatttgttgaatacagtttcagtggaagttgttaaaaatatttctgaaatagtggagattgtttcccaatgtactgattatgatccagagtatcacaaaaatgttgttgatgatatattaatactgaaaaaaatcacaattcttaaaactttgagacatttgaaaccacttagtgaaaccatagatgaaaaccaaatattcaaacctgaatttgattctgatattaaaccaatccaatcgatgctttatagagctgcatgtagttacatcagtgggtcgaaattggaggattaa

SEQ ID NO: 3988 - DNA, 3849 bp, Candida albicans
gagttgttaattccacaaatgagtgattccataatgaaagatgaccattttatatttattcaggcgttggcgaaaagaatcgagtcattgttaccaaatcacaccggtcgtagcatagaagaagtcgaacttgaccaacagttctccattacgagaaaattattattagagaacaatagtaaagaccccagaacagtaacgtatattttggtaacttttgcttccattttaaagaccattaatactgaattcactaacaacaaactcaaatatcgtgatgataaatcaagaaactcaattttattaatttgcaaattacttgctgacgttttgaaagtgagttgggatcgagagtctactattgtggatgacaaagattttttaagcaattactcaaagttctattattatgatactccaaacagaatagaatcgtcggtagtttctgatttggttgatacatttgtcaacatgatttcatctagtgttgttaggaaagtggtgtcactagtgcgtaatgaacaaacattaacaaccctaattgtggccaaagaagagtctgagattttgcgtgaagaccaactaatgacaaaagaggaagaaacagaattggtgataggtaaaattgatttttatttggatacaataattcgatatattgctaccgccaatcctgaagactattatgatgttttaaaggcaaaaattttcaggtattctcaaagagacgcaacaattcccttacccgttttgcagacatatttaccattgcttaaattcattttttttgcaaaagttaattcagtcaccattgtggacgatactttgaaagccttaccatgtataaggtcaaatacttggaaacaagtatacttgcattttctagctagcagcatcaaagctcaatctttttcacgtactttagattacaatgtgttagtggatttaaatgatacccatcaaactcaagtggcgcgaagcttgtttgacatatcatttagcctattttctgatgagtcctccacaaatctgtttaactcgccatttgttttgatttggtttttcgttatttgtctcgaagatgttattgaagttagcagcgataagccattaaacaaattaaagctaacattcaacaaaaggctaaaattcataatgtcacagttgaaagagagcagtaatgcttctagtttgggaagttttgattcatttatccatctatttcatttaggtgcccgtttacaagcatataaccaattatggcatccaatttataagtttagcatgaaatttctcgatgaaatccaccaaaatttgataaagtttggcgaagttcgcaaggacgaccttctagttgatgatgatttgcttttcagatacgatttacttacagttaatttctacttggcagccattttgataaattcagataaatacattagaattgtcatcaataattataagcaaaaccaggaggatcttcggttcaacaaaatttttgtcaagataattaaagggttatcagaaattcagacagccaaaaagtcgttttttgcaacaatgaaacaagtgacacccactttgagattaatggtttatggtgcttccaaaatcttgtatcaatatgaaattcgacgtagtatcaatcaaataagtcaaggtagcattaatggttcttcagatgcttctacagcttcatatatcgacaatgaacaaaacagtgacgaggtaacagctgccactcaggaagcttttagtcgaatcaaaacaagtctagatcattatacagcggacttatttgacactgacttgaaaaaactaaatagtagtaaaaattttactacctcatcatcttcagtattatcaacttcaacttatagattccgagttgtcaatggagcagaagagttattgtcggacatttttcgaatatttgcagcagcaccagaattctatttcaatgatgaaaaattaatgagtaaaaaagtatacgaaaccaaaccattatcagaatcacttccacctataataagattttgtcatgacgcgattatcccaataagattagcattcaagtcaaaatggataattcaaggagacacacgattattggactctacaaaagagctatcattgaaaatggtggagccaaccactagtttgattgacattcgtactgacttatcggtttttgcaaattttcaaatttgttgttgtattatttacgtcacctgtgaagcatgtttatccatttcattacttaacccaaagtttaaatcctgctttttgtttttaaactcgtttttgcaaaaaagaacctactttaataaatttgtgattgagaatcctatcttgaccaacccagatactcgagtgtatttgggattttgtggagatattatacattctgtggaaaaagttttgttactttcgttatgtacccatgacatactgttttataattatgcattgcaagggattgattggtatcttgatgaagtggaaactaacaaacctttttatccatctgaggatgttcgtgatactttagttgacacatttcaaaaaatcctggaagataaagctgttttcactggatttgtcagccttcacaagcgccatagaaatattttgcgtaattccaaaccgacaaagtcattatatcaaacatgggtgaccatttatcatcgatgggtcagaatccttgatacaaagtcgagcttaggaaatgacaaaacactcattttgagacatttcactggattccttgtctctacttctggttgtttcttatcaggcagtctagtctctgaagagcttgcagcaaatacctggccaacagctcctatttccgagtttttcgataagtgtatcgagttgttaacttcacctgacatggtgattcaaatgattattaaggaagctttagcaagtgaatcgcaagcagaggtatattgcttgactgctcgaaagttaatggaaacagcaacacactattttgagaataataaatcagatgaaattgcagttttcctagatcgtgcaataatagttatgacgtccatgataaatgtgaaaagcgagggagcactttatctttcaaccttgttaccagaaatttgccaggattttattaaatttatcaacgcaatagatgatccatgtgaaagattcaagttgcaattaaggttttgcaaacttggatgtgctttagaatcagatcgtacaaatgccggtttaaatggggcttacaaattgagaaatctatactccagagcaagtttggaatggttagaaccagctgtattttatgatagtgcacttgaggaaaacataaaagctgatgatagctcgagtgtgaaaaccaataaagaagttgagcttctgcatttagcattggattttgcagttgaatgttctattcttttacgaggacaagtagaaaacttattattggaagtcccagatggcatcaaagaagatgaaatcaataaatacaaagatttgtcctttagtgtttatttctcattattttacaaagtgattcaaaaatatactaaagcaacaccaactaatcgtgaaaaacataagcatcatataattattgataacattcttcaatctatcacaaatattttacaatatgactctcagattggaatgagatttattttaccaatgggatatcatgaaagcaagaaaatcagatcaatctttttgaatgtcttttcaaaaatgttagttcatcaaagcaaaatttccaacagggaagagtacccagataagttgattaatgagttgacggatcaatttgaaattttgtattcgaccgccgctggaaatcagccg

SEQ ID NO: 3989 - DNA, 1236 bp, Candida albicans
ttttattttagaatcgaatatactccattagtcgatgaaaatggtcaaccaatcccaaaagcaccaagaaagccaaaacgtaaagttgccgttatgttaggatattgtggtactggatataatgggatgcaagtacaaaatgatcctaatgttaaaaccattgaaaaagatatttatgatgctatggccactgccggagccatatcggctgaaaatgctgttgatttaaaaaaatcgggatttcaaagagcagcaagaactgataaaggagtacatgctgcaggtaatgtaatttcattaaaaatgataattgaagatccagaaattattaataaaattaatgatttattacctaaacaaattagaatttggggaattcaaagaaccacaaaggggtttgattgtagaaaatgttgttcttcaagaatttatgaatatttattaccgacatttagtttattaccaccaaaaccaaaatcagtattaagtgaattagttaaagaaaaaaaattagaaaatcccgatttatttgaagatgatcaagaaggtattgattggtgggaaaatgttaaatcaaaaattttagcttccggtattactcaagaacaaattgattcaattactagttcatacgatgaacaacaacaacaacgacaacaacagcagcaacaacaagctgacgaagaagaaagagatgtttctgaattatcatttactaaattgattaaacaaattaaaaccattgaaaatcaaagtagaagatcatatagaatttcatcatcacgtttacaacatttccgtgaagttatgaaacaatatgaaggaactcataatttccataatttcaccgtgggtaaaccttttaaagatactagtgccaatagatttatgattaaaaccattgtatcagatccatttgttattgaaggaactgaatggatatcgattaaaattcatggtcaatcatttatgttacatcaaattagaaaaatgattgctatggcagcattagtagttcgattaagtttaccttgtggaataattaataattttttccaatcaacaaaaattaatattcctaaagctcccgctttgggtttacttttagaaaatccagtatttgatggatataatattaaattaactaaatcagattatgaaccaattgatttcactaaatttgataaagaaatgaatgaatttaaaatgaaatttatttttgataggaccggggcg

SEQ ID NO: 3990 - DNA, 519 bp, Candida albicans
aaatctcacttcaattcaagttctctttcaattgacattatagtatttcccaattcaattatggcttctcatgcttcctgtatattctgtaaaattatcaaaggtgaaattccttctttcaagttaattgaaactgcaaagacttattccttcttggacattcaaccaattgctgaagcccactttttaattatccataaacaccatggggcaaagttgcacaacattccagacgactaccttagtgacattttaccagttgtcaaaaaattgacaaaagtcttgaaattggacgaaaataatactccagaaggtgaaggttataacgttttacagaacaacggaagaattgctcatcaagttgttgatcacgttcacttccatttgattcctaaaaaggatgaggctacaggtttaggtgttggttggcctgctgaagccactgattttgataaattaggaaaattgcatgagaaattaaaggaagaattggctaaggtagataatgaaaaattataa

SEQ ID NO: 3991 - DNA, 654 bp, Candida albicans
agctgcgtttcatgccgatacaaatgcacttcgatattcttctctcccaagtattttcaatgttattattttttttttcgctctcttatctcttcaacaaacaaagccacaatgacatctcaagagatttacttttaccggttcctagtgagcaagcaggtattctacaagtcaaggtatacgtatgcgctagtgaatctcaagccgttggtgccaggtcatgtgttggtggttcctttgcgtaccaatgtgttacggttcggcgacttgtcgcctgaagagtctgtcgattatatgcataccttgcagttgatccacaagtttatacaaaaggtttacaaggctgactccttaaacttagcaatacaagatgggcccgagtctggccaatcggtgccacatttgcatacccacatcatacccagacacaaaggtgacggctatggtgacctgattcacaccatgttggagagcaaggatcttgaacgcgaataccaggagttcttccagagaaagtcacagtatcagattgaccagatgaccaaaaagaacgaattctccaaaggtgacgaggaaagggtagcaagaagtgagtctgttatgagtgaggaagctgtgtggttggcccgtgagttggaaaaatttacagtgtaa

SEQ ID NO: 3992 - DNA, 981 bp, Candida albicans
caagtaatcatgaaatacgtcgttgtctcaggtggtgttatttccggtattggtaaaggtgttttagcttcttcaactgggttgttattcaaaactttagggttgagagttacttcaatcaaaattgacccttatatgaacatcgatgctggtaccatgtctccattagaacatggggaatgttttgttttagatgatggtggtgaaattgatttggatttgggtaattatgaacgttatttatacataccgttgaccagaaaccacgacattaccactggtaaaatctattcgcatgttattgaaaaggaaagaaatggtgattacttgggtaaaaccgttcaagtagtccctcatatcaccaatgcaattcaagattggattgaaagagtggcacgtatccctgttgatgatactggattggaaccagaagtttgtattgttgaacttggtggtaccgtcggtgacattgaaagtgctccttttgttgaagcattgagacaattccaattcagagtaggtaacgaaaattttgcattaatccatgtttctttggttcctgtcattcatggtgaacaaaagacaaaaccaacacaagcagcaatcaaagatttgagatcattggggttgactccagatatgattgcttgtagatgtcaagaagaattggaacatgctacaatcgagaagataggtatgttctgtcatgttggtccagaacaagttattgccgttcatgatgtcaactcaacttatcatgtcccattattattgaaacaacaaaaagtcatgaattacttaactaagagattagcaattggtgaaattgacaaacaatctttggctaagggtgaggcattgttgagcaaatggagacatttaacaagtagccatgacaaatcttttgaaactgtcactattgcattagttggaaagtatatcatttacacgattcatacttatcagttatcaagtcgttag

SEQ ID NO: 3993 - DNA, 822 bp, Candida albicans
aactgtcactattgcattagttggaaagtatatcatttacacgattcatacttatcagttatcaagtcgttagaacacgcttccatgagatgtaacagaagattgaaaatcgaatgggtcgaatcttccgacttggaagaagacaccaaaaaggaaaacttatccaagtaccacaaggcatggcactttgtttgtcaagcagatggtattttagtacctggtggatttggttcaagaggtattgaaggtatggttgctgctgccaaatacgcaagagaaaacaatgttccttatttgggtgtttgtttaggtttacaaattgccgttattgagtttgtcagaagtgttttaggtgtttcccattctacttccatggaatttgatagcaatattgaagaaaaagatgcttccgtagtctacatgccagatgttgaccaagtcaaattaggaggaactatgagattgggaatccatcaaaccaaattcgtccaagactcagaatggtccaacttgagaaaattatatggtggcgctgatgcagtttacgaaagacacagacatagatacgaagtgaaccctctattgattgatgatattgaaaaacgaggcttaaaattcattggtaaagatgaaactgggaagagaatggagatgatcgaattaaaagatcataaattttttgttgggactcaatatcacccagaatgcttgtcgaaagtattggatccatcacgaccattccttggtttggttgccgctgctgccggtatattagaagatgtcttgtctagagacgacttgaacttcgaaggggaattttag

SEQ ID NO: 3994 - DNA, 267 bp, Candida albicans
caaacaaaagatatgacagtcaacactaagacctatagtgagagagcagaaactcatgcctcaccagtagcacaacgattatttcgattaatggaactgaagaaaaccaatttatgtgcatcaattgatgttgataccactaaggaattccttgaattaattgataaattgggtccttatgtatgcttaatcaagaatcatattgatataatcaatgatttttcctatgaatcccctattgaaccattattaaaactttcacgttaa

SEQ ID NO: 3995 - DNA, 243 bp, Candida albicans
aatatgggtgaacaagaagaaggatttgattggcttattataacacctggagttggattagatgataaaggtgatggattaggacaacaatatagaactgttgatgaagttgttagcactggaactgatattatcattgttggtagaggattgtttggtaaaggaagagatccagatattgaaggtaaaaggtatagagatgctggttggaatgcttatttgaaaaaaactggccaattataa

SEQ ID NO: 3996 - DNA, 657 bp, Candida albicans
atgtctgttgccaaagctgtgagcaaaaacgttattttattaccgcaaaccaaccaattaattggtttatactcaatcattcgtgatcaacgtactaaacgtggagattttgtattttattcagatagaatcattcgtttattagttgaagaaggtttgaaccaattaccagttgaagaagcaattataaaatgccatggtggatatgaatacaagggagccaaatttttaggtaaaatttgtggtgtatctattgttcgagctggggaatcaatggaaatgggattaagggattgttgtcgttctgtaagaattgggaaaatcttgattcaaagagatgaagaaactgcattaccaaaattgttttatgaaaaattacctgaagatatcagtgaacgttatgtatttttattagatccaatgttggccacaggaggatcagcaatgatggctgttgaagttttattggcaagaggagtgaaaatggacagaattttatttttgaatttattagcagcaccagaaggtattaaagcattccaggataaatacccagatgtcaaaataatcactggtggaattgacgaaaaattagatgaaaataaatacattgttccaggtctaggtgatttcggtgatagatattactgtatttaa

SEQ ID NO: 3997 - DNA, 1074 bp, Candida albicans
aatcggaaagatgaaaaaaaaaattgtcgaacacgcgtttctaccaatacttacccaacgatgttgattggtatatctggtaccttaagctcaggaaagactgaagtcgctagatacttgactttccaagggttcaagctaatttcatttaaacaggaaggccatgaatcagatgccaccacgccagaggaggatgaagtgtctcaccaaattacggatttgacagtcgatgcagactacaaaatggaagtttttaaacatttcgatgatttgagtgctttagataattatgtcacggttaattggcaagataattttgtgatttcccatatacaagatatgaatatgttgaaagcattgcagaaaagaccatttttccttcatatatctatcgatgccccggtctatttgagatatcaaagatcaaaactgaaaaataatttcacgttggaacagtttgtggataaaaacgatcaattgttattcaatgttgctaatccattgattgagattaataaccaggcacaggtgaaaattataaatacatcgacttcgatcaaagacttgtttatcaagttgtcggaacttaatcttttaaacggttctcgattgagacctacttgggactcgtactttatgcgattagcagatttggcagcgttaagatcaaactgtatgaagcgtagagtcggatgtgttattgttcgcgagaaccgagtggttgctactgggtataatggaactcctcgtcatttaaccaactgtaatgaaggaggttgttcccgatgcaataaaggccaaggaagtggggcactgttggccacatgtctttgcttgcatgctgaagaaaatgcgttgttagaagccggcagagatagaattcgcggtgagagtgtattatattgcaacacatgtccgtgcttgacatgctcgataaaaattgtccaaagtgggattagagaagttgtttatgcccagagttattccatggacttacaaagccataaagtgatgagcgaggctaatattatattaagacaattccaccctccaaaagatggaatatttatatag

SEQ ID NO: 3998 - DNA, 1587 bp, Candida albicans
acgcggttcttccatttcgtggcgaatagccacattacttcctttgctacttcatttgatgattttgaacaaaccaccaaagaatcattagctgctgggttcacttttaacgccttcttgcctcatactcaagctggtgcttcagttactgattacagaagtcttattgacgccattgatgctgttggtgctagtgcatacaccgattattccgtttccattgctgcttctgaaaccaattctcaaagtgtcagtgatgctgccgacaatgcaggatctttgttcttaccattcaatgattttgccaattctaaagtttcagccttgactgctcaattttcatcttggccaaacaacaagccaatcattactgatgccaaaactactgatttagcttcagttttattgttggcctcattgtacaacaggtccattcacattactggtgtttcttctaaagaagatttggatttgattaagatggctaaagaaaaaactttacaagttacttgtgatgttgctgtccattcattgttcttatctaaagatgaattggattatccattcttaccaaacaaacaagatcaagaatatttgtgggaaaacttgaaagatgttgattgtttctccattggtgttttgccatatttgattgctaaggcatctggtactgagattgctccgggtatgggaatcaaagaagctgttccattgttattaactgctgttaaagccggtaaacttactatcggtgacattgttagtaaattccacgataatccagccaaaatcttcaacttgccaaaacaagatgctcaagttggtcttgatttggatagatttgctactgttgaaccagtgtatcttgaattttctaaattgagattgagaggtgccgttgaaagagtttccttccataatgaaactgttgtattggatggttctgttttgtctcaaattgccttgggtaagaatgaagttgtaccaagaagtagatttggatccactgcaggtattccagaatcaccaagactcggtaacaagagagtctcattcagtagtgatatgcgtcgtccatcattggcaccagaaactccagaaccacaaccagcaattttcgaaaaattgggttctgaattagtttctcaaccaattgctggatcattaggtgaaattgctgccttgagtgattacatcagacacaacaatactttcttaagaaacaacattatttctgttaaagacattaccagatcagatttgcattcattattcactgttgctcaagaaatgagattggcagttgaaagacaaggggttttggatctcttacaaggtagagtgttggccaccatgttttatgaaccatctacaagaacttccacttcatttgatgctgctatgcaaagattgggtggtagagttgttgctgttgatcatggttcatcttcagttaaaaagggagaaactttacaagataccattagaactttgtcatgttattccgacgctattgtattaagacatccatcagaagagtcagctgacattgctgctaaatattcaccagttccaattattaatgct

SEQ ID NO: 3999 - DNA, 1026 bp, Candida albicans
ctcccctacttatttgatataacaatggctcaattatctgttccaattactccaccaatggaatctactggtgatgtattgatgactttggaaacccaagatggtattgctcttcaagggtattcctttggggctgcaaaaccagctgctggtgaagttgttttccaaactggtatggttggctaccctgaatccatcactgatccttcttatgagggccaaatcttggttatcacctacccattagtaggtaattatggtgttccagatcgtgaattactcgatgaggattatgaaccagcattacctaaatattttgaatccaataaaatccatattgctgggttagtggttgctcattatactgaagaatactctcattggttagctaaatcttctttaggtaaatggttacaagaacaaggtattcctgctatttatggagttgataccagatctttaactaaaagattaagagaaaaagggtcaactttaggtagattggccattcaaaactctgattacaaatcagaagaaatcatttctcaatctaaatcaaatcctcaaaattggaaaaaatttttcaatgtcccggaatttgatgatccaaatgtgaaaaatttggttgcaaaagtatctactgataaaccaattttatatacccctaaaaaaaccaatgaaaatattaaattgggtaaaaatggtaaaccaattagaatccttgctgttgatgttgggatgaaatataatcaaattagatgttttgttagaagaggagttgaattattggttgttccttgggattatgatttcaccactgaagaatacgatgggttgtttatttctaatggtcctggtgatccagccgttatggataaaaccgtggaaagattacaaaaaatccttaaagaaggtaaaaccccagttttcggtatttgtttaggtcatcaattattagcaagagctactggtgcttccactttgaaattgaaatttggtaattgtggtcggaacccaaccgattgg

SEQ ID NO: 4000 - DNA, 4215 bp, Candida albicans
accaagttgaattccccaggtggtaaattggccgaaaacagagctgctcatcttaaagtggacgttaagaaagttttggttttgggatctggtgggttatctattggtcaagctggtgaattcgattattctggttctcaagccattaaagctttgaaagaagaaggtatttacacagttttaatcaatccaaatattgccactattcaaacttcaaaaggtttagccgataaagtttatttcttaccggttaccccagaatttgttagaaaagttattaaacatgaaagacctgatggtatttactgtacttttggtggtcaaactgctttgagtgttggtattgccttgaaagatgaatttgaaggtttgggtgtcaaagttcttggtactcaaattgatactgttattaccactgaagatagagaattatttgcctccgccatggccgaaatcaatgaaaaatgtgccagatctgaagcttgtaacaccgtcaaggaagccgttgacgctgccaatgctattggttacccattgattgttagagctgcttatgctttaggtgggttaggttcaggttttgctgacaacgaagaagaattggtggccttgtgtaacaaagcatttgccacttctccacaagttcttgttgaaagatccatgaaaggttggaaagaagttgaatatgaagttgttcgtgatgcctttgacaattgtattactgtttgtaatatggaaaattttgatccattgggtattcacactggtgattccattgttgttgctccttcacaaaccttgtcagatgaagattacaatatgttgagaactactgccgttaatgtcattagacatttgggtgttgttggtgaatgtaacattcaatatgccttgaacccattctccaaggaatactgtattatcgaagtcaatgccagattgtctcgttcttcagctttagcttctaaagccactggttatccattagcttataccgctgccaaattgggtcttaacattccattgaatgaaatcaaaaactctgttaccaaatcaaccagtgcttgttttgaaccatcattggattactgtgtggttaaaattccaagatgggatttgaaaaaattcactcgtgtctcagcccttttgtcttcatcaatgaaatctgttggtgaagttatggccattggtagaactttcgaagaagccattcaaaaagccatcagatctactgattaccacaacttgggtttcaacaaaactgctgcattaatgtcaattgatattgatcaagaattacaaacaccatcagatcaacgtttgtttgccattgccaatgccttgtcagatggttattctgttgataaagtttggaaattaaccaatatcgataaatggttcttgaacaaattggacggtttaatcaaatttggtaacaagattgcctcatatggtgccaaggaagatgttccaatgtcaatcttaagacaagccaaacaattgggattcgaagatagacaaattgctaaattcttaggttctaacgaagttgccattagaagattaagaaaagatgctggtatcattccatttgttaaacaaatcgatactgttgctgctgaattcccagctttcaccaattatttgtatgtcacctacaatgccgattcttccgacgttaaattcgacgataatggtgttattgttcttggttctggtgtttacagaattggttcttctgttgaattcgattggtgtgccgttagagccattagaactttgcgtgaaaacaatgtcaaaacagtcatgatcaattataacccagaaactgtttccaccgattatgatgaagccgacagattgtatttcgaaccaatcaacttggaaagagttttggatatttatgacttggaacaatcttccggggttattatttctatgggtggtcaaacttcaaacaatattgccttaccattgtacagacaaaatgtcaagattttgggtacatctccagaaatgattgactctgctgaaaacagatataaattctcaagaatgttggatagaattggtgttgatcaaccagcttggaaagaattgacttctgttgatgaagctgaagattttgccgaaaaagtcggttacccagttttggttcgtccttcatacgttttgtctggtgctgctatgaacactgtttattctaaagatgatttagcttcatacttgggtcaagccgttgacgtttcaccagattatccagttgtcattaccaaatatattgaaaatgctaaagaaattgaaatggatgctgttgccaaagatggtaagatgatcatgcatgttgtttctgaacacgttgaaaatgctggtgtccattctggtgacgctactttgattgttccaccacaagatttggatccagaaaccgttagaagaatcgtcgaagctactgccaagattggtaaagctttggatatcactggtccttacaatattcaattcattgccaaagacaatgatatcaaagtcattgaatgtaacgtcagagcatcaagatcattcccatttgtttctaaagttgttggtgttgatttgattgaaatggctactaaagctatgttggacttgccaattgttccatatccaagtgaaagattacctgaggattactgtgctgtcaaagtgccacaattttcattctcaagattagctggtgctgatcctgttttaggagttgaaatggcttccactggtgaagttgctacttttggtaagaacaaatacgaagcttatttgaaatcattaatttccactggattcaaattaccaaagaaaaacattttgttttctattgggtcattcaaagaaaagcaagaattattaccaagtattgccaaattacatgaattgggttacaaaatctttgccactgctggtactgccgatttcattaaggaacatggtattccagttcattatttggaagtcttgagtaaagatgaagatcaaaaatccgaatataatttgagtcaacatttagctaacaacttaattgacttgtatgtcaacttgccatctgcgaacagattccgtcgtccagcttcttatatgtctaaaggttatgaatctcgtcgtatggctgttgattatgctgttccattggttaccaatgttaaaaacgccaaattattagttgaagctattgctagaaacatttctttggaagtttccaacagagatgctcaaacttctcatggtactgctattttacctggattgatcaacattacttcctttgctacttcatttgatgattttgaacaaaccaccaaagaatcattagctgctgggttcacttttaacgccttcttgcctcatactcaagctggtgcttcagttactgattacagaagtcttattgacgccattgatgctgttggtgctagtgcatacaccgattattccgtttccattgctgcttctgaaaccaattctcaaagtgtcagtgatgctgctgataatgccggatccttgtttttgccattcaatgattttgccaactctaaagtttcagctttgactgctcaattttcatcttggccaaacaacaagccaatcattactgatgccaaaactactgatttagcttcagttttattgttggcctcattgtacaacagatccattcacattactggtgtttcttccaaagaagatttggatttgattaagatggctaaagaaaaaactttacaagttacttgtgatgttgctgtccattcattgttcttatctaaagatgaattggattatccattcttaccaaacaaacaagatcaagaatatttgtgggaaaacttgaaagatgttgattgtttctccattggtgttttgccatatttgattgctaaggcatctggtactgagattgttccgggtatgggaatcaaagaagctgttccattgttattaactgctgttaaagccggtaaacttactatcggtgacattgttagtaaattccacgataatccagccaaaatcttcaacttgccaaaacaagatgctcaagttgttcttgatttggatagatttgctactgttgaaccagtgtatcctgaattttctaaattgagattgagaggtgccgttgaaagagtttccttccataatgaatcttcaccacggggctggacggaaacgcgctgcgaa

SEQ ID NO: 4001 - DNA, 183 bp, Candida albicans
gttgacaataagattttgagtaatgctaaacaacacatgtgtgttatgcatccattaccaagaactaatgaaattagagaagaagttgatttcgatcaaagagctgcatattttagacaaatgagacacggtttatttattagaatggccttattggcaatggttattggtgttgatttttaa

SEQ ID NO: 4002 - DNA, 756 bp, Candida albicans
attttattttgtttctctttttccaactcatatctaattgtttatcctacatcattacttcttcttggtggtgttgataaaatggcaagaggtcaattaattctaattgaaggtcttgatagatcggggaaatccacacaagcatcaatactatctacaaaattatctccttccaaattaatcaaatttcctgaccgttcaacacccattgggaaattaatcaatgaatatttaaccaacaaatcatttacattgagtgatcaagcagctcatttgttatttctggcaaatagatgggaattgagtcaacaaatacaagatctattaaatcaaggatatttcatcatattggaccgttatatatattctggtattgcttatacattggcgaaaaatgatttccatgatgaaaccatatcccaaggtaaaaataaacaacaattgaataatattgattggttattatctccagataaaggattacctaaacctgatttgacattgtttcttacgttagatttagaagagataagtaaacgaaaaggatggggtgatgaacgttatgaattacaacaatttcaagctaaagttaaacaatgttttttagaaatattagataccaataaggatccaactatacgtattgttgatgttggtgggaaaaccattgatcaagtaactacacaactatgggaaatcattgaaacaaataaaaaccatgaattaattaatgattctatacaatttattacgtaa

SEQ ID NO: 4003 - DNA, 1098 bp, Candida albicans
cttaacccaaccattccaacaatgtctgatattgaattaggtataactgccgatatgcacgtccatcttcgtgatggtagcatgtgtgaactaattactcctactgttagaacaggaggtattgccatctcttatgttatgccaaatttggttcctccaattacaactaaacaacaagttgttaattatcatactaaactttccaaattagccccacaaaccacatttttaatgtcattttatcttagtaaagatttaactcctgaattaattgaagaatgtgctgatttaatacatggtgttaaatgctacccagcaggagttaccacaaattccaaatacggtgttgacccaaatgatttttcctcattttatccattatttgaagctatgcaaaagcacggaatagttttaaacattcatggtgaaaaaccaggtactagtgaagaagatgaaatcaatgttattaacgctgaaccaaaatttttaccagctttaaagaaattacatgctgatttcccacgtttaaaaatcattttagaacattgtactactagtgatgccgttgaaactgttcgtgaattaaattccaattataaaccaggagatgaattatttgttggtgctacaatcactgctcatcatttatatttgatcattgataattgggccggaaatccaattaatttttgtaaaccagttgccaagtttcaaaaagacagaaaagcacttgttgatgctgcaactagtggagaaccatggtttttctttggttctgatagtgcgccacatccgattcatgcaaagcaaactcacgttggtgtgtgtgctggtgtttacactcaaagccatgctattgcttatgttgccgagattttcgataaagccaacaaattggacaatttgaagaaatttgtcagtgacaatggtattaagttttatggattatcagatgagattttaaagaaacataagaatgaatcagtttggttggttaaaagagataatcaagtcccagaaattattggtaacggtgatgttgaagttgttcctttcaaagctggggaaactttaaagtatgccatcgaatggagatga

SEQ ID NO: 4004 - DNA, 636 bp, Candida albicans
ctcccacactattatggcggatttgttcagttccgaagtgaagattcttgttcctttttgctccccttcttctcttctcatgtagaacagcactgttacaaacacaaacaaacaaccatggcatcttataaatcatcatttttacaattggctcttgattctcaagcattaaaatttggtaaattcactcttaaatcaggacgtgaatcaccatattttttcaatttgggattgttcaacactggtaaactcttatctaatttagccacttcttatgctgaagcaatcattgcatcgggattaaaatttgatattttatttggtcctgcttataaggggatccccttggcagctataactgtggctaaattagctgaattagacccaataaattatggtgatattggttattcatttaacagaaaagaaaagaaagatcatggggaaggtggatcaattgttggatgtaatttgaaagataaaaaaatcttgatcattgatgatgtgatcactgctggaactgctatcaatgaagcatttgaaatcattggtaacgaacaaagtcaagttgttggttgtatcattgctttggatacacaacaaactactgctaatgattcaaccaaatctgcttaa

SEQ ID NO: 4005 - DNA, 1734 bp, Candida albicans
atcctttcccatcttgaagaattagacagctttcccctaacaaaagcaaatattatctttttgctcaacagttttacatatacaagtgtgtctaatatgccactacatccgaaatcaagaagaagatcaagtagaatatccccacttcctgacgaggattcattgtcatttataaactcatcagtagaaaaccttgatcaatcaccatttgaaagtatcgatgatttagttgaagatgtcaacaaatatgacttgaaaagtcccagtgatgagcaacgacaacaactgcaacaagagctgcaaactcaaaatttgaaacacaaaccatcgttcacttctacaccgaaagcatcatatatcccaccatggaccgaaccatatatcattggtattgctggtaattcagggtcagggaaaacctcaatttcccaaaaaatcattcaggatatcaatcagccatggacggtattattatcatttgataatttctatcaaccattgaccctggaacaaagtaaacttgcatttgccaataattatgattttgattgtcctgattcattagattttgatttattagtagagaccattggtaatttgaaaaaaggaggtaaaactactatcccagtttattcattcacttcacataatcgtacttcaaaaactaataccatttatggcgccaatgttattattgtggaaggtttatatgctttacatgatcaacaattattggatatgatggatttgaaaatatatgtcgatacagatttggatatttgtttagcaagaagattaactcgagatatattgtatcgtggtcgagatttaggtggagctatgcaacaatgggagaaatttgttaagccaaatgcggttaaattcattaatccaacggtacaaaatgctgatttggtgattcctcgaggattatataattcaattgccataaatttaatgattaaacatatcaagaatcaattagcattaaaatcaagaaatcatttacaacgattgaagaaattaggggtcaatataaaatttgatattgataaattcaatattaaattattacaaaacactaatcaagtcaagggaatcaattcgattttatttgatacgtcaacttcacgtaatgatttcatattttattttaatcgtatgtgtggattattaattgaattagcacaagagtttatgaccaattataccaatgtcgatatcgatactggtaaagggatttatcatggtaaaaaattattacaaaatcaatataatgcagtcaatataattcgtagtggagattgcttcatggcatcaattaaaaaatcattcccagaaatttctattggtaaattattaattcaaagtgattcaactacgggggaacctcaattacattttgaaagattgcctcataaattatctgataaaattatgttatttgattcacaaattattagtggagccggagccattatggcaattcaagtattattagatcatcatgttaaagaacaagatattattttaattacgtatttatctacagaaattggtataagaagaattgttaatgtgttccctaaagtgaaaattgttgttgggaaattatcaagtatggaagattcaaattcgaataacaaagtttggtataataatgaaggatttttggatagtcattggcatttcagaaatagatttatagatagtttatatttcggcacagaataa

SEQ ID NO: 4006 - DNA, 870 bp, Candida albicans
ttctctttcatagttgaaaacaaattcaaatcactacaaatgactgtatcacctaacactgcagagcaagcatatcttgatttatgtaaaaggattatagatgaaggtgaacatcgtcctgatagaactggtacaggcacaaaatcgctctttgcaccaccacaattaagatttgatttatcaaatgatacttttcctttattaaccactaaaaaagtattttcaaaagggatcatacatgaattattatggtttgttgctggctctactgatgctaaaatattaagtgaaaagggagtgaagatttgggaaggcaatggatctcgtgaatttttggacaaattagggttgactcatcgtcgtgaaggagatttgggaccagtttacgggttccaatggagacattttggagcagaatataaagattgtgattccgattataccggtcaaggatttgatcaattacaagacgttattaaaaaattgaaaacaaatccatatgatagaagaattatcatgtctgcttggaatccgccagattttgctaaaatggccttgcctccatgtcacgttttctgtcaattttatgtgaatttccctacatctctgccggacccaaataatcctaaacaagctaaaacggccaaaccaaaattatcttgtctattgtatcaaaggtcttgtgatatggggttaggtgtaccatttaatattgcatcctacgctttattaaccaagatgattgcacatgtggtggatatggactgtggtgaattccatcatactttaggtgatgcacatgtctattttggacatataaatgccttaaaagaacaatttgaaagaatcctaaacaatttcccaaattag

SEQ ID NO: 4007 - DNA, 1044 bp, Candida albicans
tcaatcaatcaagaggattacaaaatgtctactaacaaaatcacatttttattgaattgggaagctgctccatatcatattccagtgtatttggctaacatcaaaggttatttcaaagatgagaatcttgatattgctatcttggagccctccaatccatctgatgttactgaattggtgggatccggtaaagttgacatgggtttgaaggcaatggttcacacattggccgccaaagctagaggactcccagtaacatcaattggatctttattagacgaaccattcaccggtatatgttatttggagggatctggtatcacttctgatttccaatccttgaaaggtaaaagaattggttatgttggtgagtttggtaaaattcaagttgatgaattgactaaacattatggtatgacacctgatgattatgttgccgttcgatgtggtatgaatgtggcaaagtatattttagaaggaactatcgattgtggtattggaattgaatgtattcaacaagtggaattagaagaagctttgaaagaacaagggaaagattcaaacgacgctaagatgttaagaatcgataaattggcagaattgggttgttgctgcttttgtacaatcttatacattgccaacgataaattcattgctgaaaactcacaagcagttaaaaagtttttgaaagcaattaagagagccactgattatatgttggcccacccacgtgaggcttgggctgaatatggtaatttcaaaccaactatgcaaacagacttgaacaccaagaagttccaaagatgttacgcctacttttctgagtccttgtacaacgttcatcgtgattggagaaaggttaacaattatggtaagagattggatattttacctgaaaattacgttccaaattacacgaatgaatatctttcatggccagaacctaaagaagttgatgatcctgaaaaagcacaagatttgatgcttaaacaccaagaagaatgtaaaacatgtggtggttataaaagattggttcttgcctaa

SEQ ID NO: 4008 - DNA, 198 bp, Candida albicans
aaagaggtaaaacaagtggaagagctgacgataacattgaaagttttcaaaaagagatttagaacattcatcgaaacctccatgccagttgttgattactttgacaaacaagggaaagttgttaaggttagatgtgatcaaccaatagatgttgttgctaaccaagtcaaagacgcgttgaagacaagaggtatttag

SEQ ID NO: 4009 - DNA, 558 bp, Candida albicans
gcaatgttttcgagacaagttttagcaggtaaacaaattgttagcacttttgctaaacaaaaagccgtatcacaatgtatcaaaagattcaattcaagcaaaaccaattcaacccctccacctaaatactccaaaggtaagcttcttgccgtgttgggaactttggctattggttctaccattgctgcctctttctataacaaggagacacctaaatctgcatttgaacccaatgaatctggtgataaaccagagtttgctgaaggcaaagtttcagtcatttttgtgttgggtggaccaggatctggaaagggtacccaatccgataaattagtcaaggaaaaaggatttgttcatttgtctgctggggatttgttaagagccgaacagaataggccaggctccaagtatggtgagcttatcgctaaatacatcagagaaggtgaaattgttcctcaagaagtcactgttgctttattgaaacaagcaatcaaagaaaattatgaacagggtaaaacaaagttcttggttgatggtctccctcagaaagatggatta

SEQ ID NO: 4010 - DNA, 414 bp, Candida albicans
cacacttgctgtccaggttactcagaaggtgggatacctattggttcatgtattatttcatccgatggcacagtattaggccaaggtcacaacgaaagaatccaaaaacattcagctattttacatggagaaatgtcagcattagaaaacgcaggaagattaccaggaaagacttataaggattgtaccatctatactactttatcaccatgtagtatgtgtactggggccattttattatatggattcaaaagagttgtgatgggagaaaatgtcaatttcttgggtaatgaaaagttattgattgaaaatggtgtcgaagttgtgaatttaaatgatcaagaatgtattgatttgatggccaaattcattaaagagaaaccacaagattggaatgaagatattggagaataa

SEQ ID NO: 4011 - DNA, 183 bp, Candida albicans
agatacattcttgaattagacgaagttgacgacggtgctgaaatccaagaagcattattggaaatcactggtcaaagaaccgttccaaatgtctttattggtggtcaacatattggtggcaattccgatgtgcaagctttgaattctattgacaatttaaataacaaattcaaacctgcttaa

SEQ ID NO: 4012 - DNA, 582 bp, Candida albicans
tcacataccatcaaaaagatattgctcagtatcaaagtaaaagatgcaatacttacagattcaacaaatactatactcatatccattcaacttctaaaagaaaacccacacatggactatttccaaacagaaaagacaacagaaacaagacaacaacgacaacaaaaaaaaagacccgtgagaaactcaatcatttgtactctttctttatcttatcaaccaaattttgtcatgagcctgcttattggatggttatcatcgtggttccaaaatgaaccaatcaccccagaattgaagaaagagatagaatccaacattaattcacacaaggtacttgtttattccaaatcttattgtccttattgtacttcaacaaaaacattattgcaaagcttaaaccaagattacaaagttattgaattagatcaaattccgaaaggttctgcaattcaaaatggattacaagaattaactggtcaacgtaccgttcctaatgttttcattaatgggaaacatattggcggtaattccgatattcaagctttacattcccaaggcaaattaaaaccactttttggatag

SEQ ID NO: 4013 - DNA, 1485 bp, Candida albicans
acttcgtgcatagctaaaatcagtatggaaaaattgcagatattgacggaacgacagcaaactgaattgaaccatgcaataatacagtatttacagccattgtgtcaacaagacaatcatgttttacttgaccaactctccaaattactcaacatagaccaatcaacacaggaatcaaacaatgttgaaaaagtggataattacttggagaaaagatggtccacagttttacgacttcaaaagaaaattatcgatcttgaaaatgaaattagtaatttgaacaacattatcaattccactaactccgataataatggtattatattaagtaaagacaaaattaactggatacctaagggtgctgtcaaacaaagttatcaatgtgaaaatattgttaccacagtgaaattacatccaaatttacctttggtgctcaatgggtgcaacgatggaaatctttatatatggaatatatccaatgatgacaacacaataccagagaaaatgattaaagcacatacacgggcaatcaataagatatgtttcacttataaaaagccatactatttggctacctgctcctctgatttaactataaaaatctgggatgagaaattcaaccatattcgtacgttgaatgggcatgaacacacagtttcatcaatacagttttctccagttgataacagcattttgtattctgtatcacgagacaagaatattcgagtttgggacatttttcaaggcataagtctaaaaagttttgtgggtcatagtgaatggtgtcgagatttagatattatactgctggatacttacggggattttgtgctaacctgttcaaatgaccagctggcaaggttgtcacatgcaaatagtggggctggtgtagcaatgattgtcggacacagccatgttgtggaaacggtcaaatttctaccttctttgcaagccaacaagatactcgatgaatacataaccaaaaacactgaacaatttcctacaattcctttggagctactaaaagataagacgtataatcagttgggcttcaaatactgtataactgccagtagagacaacacgatcaagttatggttaatcccacctccaacaattgctccccataggccaccacttccatcaaagtacaacaattcccaaagttggctaattgcagaactcaagggacatctgtcttgggttaaaagtttatgtgttcatccaaatgggaaatttattattagtggcagcgacgacaagacaatcaagttttgggatttgtcaggtttgttggaaactgggtatgtcaatgttgttaaaacgattataggtcacgatggattcataaacgatattgattttgcccgattgaaggaagcaagtgacgtgagtgaagaggatttattgaaacaagttgaaaaacgaatgagatgtctatttattagcggaagtgccgataattcaatcaaactatggaactaa

SEQ ID NO: 4014 - DNA, 591 bp, Candida albicans
aaaatcttcttcttggtattaacaataatattttatttaattgttcacaacccaaggctaaatatgttagaaaattcgttattatcaacatcaagatttatcaacaagtcatcatcatcattatcacctggtttattattgaataatttccgtggcaatttccaacaatcacgatttatatccactgaattaaaagatgcattagataaagctgttactacatcccccgtagttttatttatgaaaggtacaccagaattcccacaatgtggattttctcgagccactattcaaattttaggtcaacaaggagttgatccggaaaaatttgctgcttataatgtattagaagattctgaattacgtgaaggaataaaagaatatagttcatggccaacaattcctcaattatatgttaatggagaatttattggtggttgtgatattatcactagtatggcccaaaatggagaattggcagaattattagaagaactgaatgcattaattcctgaagaaaatgaaccaacaacatctgaagaaaatcaagagacggttcaatcagccaatattaaaccaaatagaaattaa

SEQ ID NO: 4015 - DNA, 462 bp, Candida albicans
cgaatgcgcggtctttctgcgctttggggaagtataaatcccagttcaccatctattcttgataatgaagaatttgataaatctgataaattggaattagctcaagaattagaatcagaattgaaagaaaatttggattctgcggaggcaagttggtcaacaataaattattggattttaagatttttcccttatttatctcataaatatagtattatgcccaaatggttcaacaacaaaaccagtactgaagccaataatgatgaaaaagtgacggttttatgttgtaatcgggttggagttgaagaagatgtggtttatgctgggagtagttgtattttacaatttaataatcatggtaaatacaatgatgctactgatttaactaatgaaagtgttgagttgattggtaatttggatcaaattaatgaaagtattttgattaaagaaattgatttataa

SEQ ID NO: 4016 - DNA, 3015 bp, Candida albicans
aaattaaagaagttatttccggaaaaatttcaatcttggaaaaatgattattatcaatcaaaattacatttctccattattaccgaagaaggtaagagtgacctaattgaaatgaccaaacattatattgaaggtttacaatgggttttgtattattattatcgtggttgtccatcatggaattggtattatagatatcattatgctcctagaatttctgatatttcattaggattagaagaattgatcaatgaaaaaactgatttaaaatttgaattatctcatccttttaaaccttttgaacaattaatggctgttttacctgctcgatccaaaaaattgatgccagtggtttatcgtcctttaatgaccgatgaaaaatcaccaattataaatttctatcctcatgaagttgacattgatatgaatggtaaaactgcttcttgggaagcagtagtattattagattttgttgatgagaaaaaattgattgaagcattaaaacccattgaatctaaattaacccctgaggagaaacaaagaaattcttatggtcatgctatcaaattcattcataatccacaaattgatcatgttttttcatcaccgttaccagggtttttccatgatattgaacatgatcaatgttatgaagaagaattcaaattacctaaaattgaaaatttgaaaattggatttattaaaggagctaaaactggtaaagatttattagctggattcccaacattatcaaccattccatttacttctgaattagcattgaatgaagttaaaatttttaatttcccttcaagatcagaatcaatgattttgaatgttgaagatgtttggtctgatttgaccgtggcacaatttgctcaaagttttgttaataaattagtttattccaaatggccatttttaagagaatgtcgagtggttaaagttgtaagtgaagaaaataaatttgaatcaattaaaactaacacgggattgaaaaaagttgttactaatgagttgagtgttgaagataaaaaatcattccgttccgaagtttctaatcttaaagttacttgggataaatttaagggggtcaaattaggtgaaataaatgcattagtttatgttaaaccggtaaatggattaattaggaatcataagggggcttatgtgaagacatattctaaagatgtggacgtctatcctttacaattgattgtcagagaagttactaataaagatcaaagatatttgactagaccaccattaccaattgatcaagtattccctattgattctcaagttgtattcttgggagatatggcttatggatcaccagcaaagattgttggatataatgaagataaaactaaattgggggtgaaaatttttaagattcaactgacagcagaaccaaacattggtaaaaagagattaactattgagaaaaatgaaatcaaatattatccttcatttgaagttgctaaaactttaagacttaatccattattgttatctaaaattactagtcaattcatggttcaagattcttccaaaggtaaagtaaatattggattagaattaaaatttgaaagtaaacgtcaaaaagttttaggttatactagaaaactgagtaatgggaaattttgggaattttctccattggctattaatttaattaatacttataaaacaaaattccctgggttatttaaaaaattagttaataacgttagtggatccaattttcctactgtggatgaaattctgagtcttgaagaattaaaagaaattagatcatggttaaaagaagtgaaaagtgaattaatccctgtttcattagaaagtgaatcatttaccaaatttagttatcaagccattgaacaatatatggataattatttatcaatgaatcaaatcccaactataaataaagatattaaaggtgttcctcgtgaagccattttgaatgctaatgaatcgtatcaattattaagtgatcaaaggtttgaattaggtgatagaataatttatgttcaagattttggtaaggtacctattttatctaaaggtactgtggcttcaattttaaccgttggatccaaaacttcattaggggtgattttcgatcaacctttattgagtggtaataatatgaatgggaaattgaattctaatcgaggattaattattgattcttcattggtgttgaatttaactaataaacaatttgtttatcattctcatgcatcaaaaaatagaaagaaattgactgatgaagaaaaaattgcgaaattgaaagcaatagaagctaaaaagaatcagaagcaacaacagcaacaaaaagaacaacaaactaagcaaaagcaagttgaacaacaaaaacaaaaaggtgctaatgaattgttgtctttgttgaagaaaaaactggatatgaatagtactaccactacttccactactgatggagattgtaagaaaacagaagaaaaagatgatgacaaaaataatggtaatgaagatgaaagagttgatcctaatgcaattaaacaaatttatggccatatttattctaatgttatgaatcaaggtaatgttcgtcctccaccaccgccaccaacaggtccaggtcatccacaacaatttccttatggtatgcctattcctccaccaggtgcaccaatgcatcctggttatattcctgtagttccaggaaatccattacctcctagtttctaccaacaatatccaccaaatggacaacagtttgtcaattcacaaccaccgccaccaccaccaccaccgccatcacaacaacaacaacctcaagtagctgagtcaacctctgacgagaaatcaaaaaatgataacaagcacaatgtaaatggtagaggaagaggtggttctagaggaagaggcggatatagaggaagaggcggagttagaggtgggcgaggtggaaataaatcatctcatcaaaatcaacctaaagataaggtaaaacaagaatcataa

SEQ ID NO: 4017 - DNA, 1206 bp, Candida albicans
catataaaaattacaggtattccaaagtttttccgattcatctctgagagatggccattgatttcccaattaattgatgaaaatcaaatccccgaatttgataatttgtatcttgatatgaattctatattgcatacttgtactcattctaatgataataccattaccagacttctggatgatcaaatgtatgctgccatattcaattatatcgaacatttattccaaatcattaaacctcaaaaaactttctatatggctattgatggggttgctcctcgagctaaaatgaatcaacaacgtgccagaagatttagaactgcttatgaagcagaaataaatttaaagaaagccattgaaaatggagaagaaatacctaaagaagatccatttgattcaaattctattactccaggtacagagtttatggctaacttgacaaataatttgaaatatttcattcataaaaaaatcactgaagattcaagttgggccaatattgaaatcattttgagtggtcatgaagtccccggtgaaggtgaacataaaattatggaatatattcgttcaataagatctcaagatgattataatccaaatttaagacattgtatctatgggttagatgctgatttgatcatgttaggattggtcacacatgatcctcattttgcattattgagagaagaagtcacttttggcccacaacgtaaagttggtcctaaagatttacatgatcagaaattttatcttttacatttatcattattaagagaatatttaagtttagaattccaagaaattgaaaatcaattgaattttgaatatgattttgatagaattttagatgattttattttaattatgtatgtcattggtaatgattttttgccaaatttacatgatttgtttatcaataagggagcattcccattgttaattgctgctttcaaacaaacattgttagaaagtgacggttatatcaatgaaaatgggaaaattaatttagtcagattaaacatttatatcaaaattttatctaaatttgaatttgaaaattttgaaaaacatgaagttgatgttgaatggtttaataaaaaattagatgatatttcaatttctggtgaaaagaaacgtcaaagaattgggaaattattaattttacaagagcatcttctccccaagggcacaaatccgcctatacgg

SEQ ID NO: 4018 - DNA, 378 bp, Candida albicans
aagatggaattatattcacctgagggacttagaatagacggaagaagatggaacgaattgcgtagatttgaatgccgtatcaacactcatccaaactcatcggatggctcctcatatgtcgaacaaggtaataccaaagtgatgtgcacagtacaaggaccaatagaaccagcattaagatctcaacaacattcagaacgagcaaatatagaagtgaatttgaatattgctactttttccacttttgaaaggaaaaaacgaagtagaaatgaaagaagattagttgaacttaaaactactttagaaaaaacatttgaagaaagtgttatgataaatttatctcgcgatccttcacctcgggatagcagagccgcataa

SEQ ID NO: 4019 - DNA, 1203 bp, Candida albicans
atcaagcgcggatcctgccagccccgtagggtgaagacaaacagtaaaaaaatacaaagatcaaaaagaagagggaaaagaatagaggaaatcatcattgacaacactttactatccacagaaaatatgacaattgagttggataagagaagaaacgagctacatgtattgaatgtaaaggcttgggaaggagacttcacatatgaaactgtctcaaaactagattcctcattgaagaagaattctacattcataaaaaaagtaaaatcaatcagcaatgagtcatcactgtcaatactaaaagatattcaaacattatctattgagaaatatttaagtgaagtactaacttcgttgactgaagctttgtcaaaagtttccaagagtgatgacatcttagccgccatggaaattgtttctgctttgcatcaaagatttacttcccagttttctccaatgcttttggtaaatataatgacagcaatgtctaacccaggtcccacccaagtgatggacgaaaaagaggaaacagcccgtatctcgagacaaaaaaatctctcgaaattaactatggagttttatttaatcggaatcttcaccaatttgaaaatgtgcagtaaagacactatacctgatgaaatattggtaaagtatggaaaatcagcatcagagcccattatacttgttgtgctaaaggatttgttgaactacaaaattaaactgggaaacactttagtaatagttcagtcttttttaaaaaggtttcaccacataatctatgattctaataatgaactattacagtttgaggtgagaaatgtgcttcaactaattttcacaatttatactagggcaatttttgaaacgctggttgagttgaaaaagagagtacaccaagtgactgagaaaagtaaaaaggcgtcaatcagaactggtcgcatattggaggaaaagcagatcgagttagaaaatgtcaccaaactatttgaaaagttcaagtctacttctgagtttgtatcgtctattcttgatattcccttaccatacgagcttcaacaacatgaccaagataaagaggaagaagagccgacaaataccgtagtggaagttgttaaatccaaatctatgaacgaagacgatcttaatggtgtctgggaagatgtcaaggaaaagaatttctacactgtaatccctctggtatga

SEQ ID NO: 4020 - DNA, 879 bp, Candida albicans
tggttgaataatttgaaatctatttttattgataccgatattccttccaaaaagaaagcacaaaaccgtgctgttgaattgaagaagaggaatgacataaataaagatttattgggcgtttttataacctttttgcaatattacttgttttgcaaggaaaaaccattacccgttgagctagattttaaattaaatgatttatttgccaaatacaagagtatacccaccgttaagcgttatgacactttacaagagatagggaagagacttcaggaactgattcagagaaagagagaagcagagtcttatttagacaacagtgatgaagcattggtggttgatgacgatgatgacgatgaagacgttgctgaagattatgacaatactgatgacattgacttagatgaagatgaaggtgacgaggaagatgaagatgacgaagatgacgagagcgaagaagataatgatgaggagagtgaacgtgaagatgacactagtgacattgaaaacaatggagtttctgaagaagacagaatgcgtttagaagctgaaaaaaagtttatggacgaccttgataaggaataccaaaagattttgatcgattcttatgataaatcttcatcccagacttcttccaatagaaagaagttattaatgccaacaccgcggaaaatatttgttgaaaaaaaccaagtaactccttcaactgacaaaagcaaagtttccttcggattgctcactagaaaaggcaaaactacagatatcaagcagcttcaactaccaagtgacactaagtttgccgagtcggtattaaaggaaaaagaacatcagcgacaagatcgtgaacgaattatgaaattggtttccaatatggaatag

SEQ ID NO: 4021 - DNA, 756 bp, Candida albicans
  unsure (58): Identity of nucleotide sequences at the above locations are unknown.
attttggcatttgatttattgtttgctgagaatgaatcgttattattggatgatgatntgggccagttttcgtattttttaaatttggttgtcaaagtcatcactgcggatgttaaactgtttcgggattgctttaacaatgaacttgctgttatggacagtaagacgaaaataactttggtgaaggataacaattggaacatctcaacttataaatctttattgttgtcggttattcaaaaattttttaaattgaatttagccaccgaagcttttgacgatagagaacaaatgcagaattactattcctcaattgacaattgtttacagattttgcacttgttagtgacggggaatgagaatgattttggagatttgttgatgtttttgattcagatttctttgaaactttccaaaactgacacagtatctccgattatcgaggctgttcagtcaaagtttttgcagtgtattttttactatttggagcgtgcaaccgagttgaggttgaatttaaatttgctacacgttgaagaacaaaacaaaaatccattgttaattaattttatatgtctcggaattctgaaaagcgagtcccctatattgttggaaaagtggatgtcacttcttattaaatcattatacttatttggggaatctgtgttcagtgtcttgcttgtcttgaatgacactttaattaagaaaatcgacaatctgtttgaccaattttctacttggtcttcaccacggggatag

SEQ ID NO: 4022 - DNA, 909 bp, Candida albicans
ctggcttgtttgaagaaatttttaatttatggtaaagaagatttgaaaaacaattcagaattgagttcattattttttaaaatatttcaaattgtcactgctggtgccagtgaagatatgggttatactgatttggtggaatcatttgaatatgctcaaacatttattttgagtttggaagaagtttcaaatggatatatcccatcattcctcgaatgtgttttatcaaattatccatctggtgataaaaaattggttaaaagtacatttgttgtcaatagtaataatgttatcattgcatctttgatttatgatacaaacaacactatggcattattgcaacaatcacaaatgttgatgccatttttgcaaaaatggtttgaaatcatacctcatttggaaagggtttatgatttgaaattatcagtattggcttgtatgagtttgataagattagatttggatcaacaaactttggccagtatttccaataatttagcttccatgttgaaaaaattacctgatgctatacaaacattagaaaagaagagaaagaattttggagaattatcaggatcaaattatcaactagaaggtgagtggccagaagatgaatttgaagatgaagaatacgatgaagatgatgaaggagaaggagaagaatattcaaatattgtcaattctgaagatttgaatttacacaagactggtgggtttttcgatataaaagaagatgaagtttatgaagatccattaagtaccactccattggatgcagttaatatatttgccgttgttaaacaatttattcaagaattgcaaatgaataataatcaaaaatttaattccacttttggacaaatgaatgaagatgatcaaaaaatcattcttgatattatgaatgtttaa

SEQ ID NO: 4023 - DNA, 1212 bp, Candida albicans
  unsure (591): Identity of nucleotide sequences at the above locations are unknown.
gacaagttttcccccgtagcaggtcaagttgataatttacttttcacatttgtatatccagagttgctgcaagattgtgcttccaagactccgtggttgacagctagagcatgtgacacaattgctatgtttcatgaccatcagtatactgatatgaaaattttgcaagatattttccaaagtgttgttacatgtttctccaacgatgcacagttcccgatacaattgactgctgcagatgcgttgtctacgttagttaaagaagattcggtttcccaattagttgccgatcaagcgccacaattgatgggaatacttttagaaaaatcaaagcaatatgaaagtgacatattgaccaatgttatggacatttttgtggaaaagtttgcgaagaatttggaaccatacgcagtagaattgggatccaaattagttgaacaatttatcaaaatcgcaagcgagatattggagacaaatggtagtgggcacacagacaaagaaatccaagccgctggtatattgaacaccttaacaaccttggttatatcgatgtcaaatgcccccaacgtggctttacaattggaatctgtnttgaaagatttaattaactttatattcgaaaatgctatgattgtctttttaacagaagtaatcgaaatcttagaatcgattttatttgtcagaccagaagtttcaccggttatctggaatattttcaaggttgctattgagtcgtttgagacctatgcatacgaatactttgactcattccaaccattttttgaaagtatcattaacaaaggatttgagcaacctgatattactatagcagatgaacgtgttcaagcattgatgaatgtatgtttcactatattgaaagacgaagatacggatcctgtttttgcacatctggcttttgagaatatcgagttgacagttttggctcttaaccagaggtttgcaagcttcttaccacaatttttaccagaaatctttgacattttcactaaattagagagccaagatgcctttgacggatacatgctacatcatttgtctattttgaaaatattgtctgcttgcatatatgttgatccagctgtcactgttcaatttattttgtcgaaaggattttggtggacttttacaagttgtggattaagtacagctccgactttcaaagtgtgtacggttgcaaattgcaagttttag

SEQ ID NO: 4024 - DNA, 1623 bp, Candida albicans
ttggggatgggattattggataaacgggtcaattattgcaactgggaaaacctggaagatcatctttatactggtatgctctgctttgcggagatcaccagaaagtataaatgggtcggtaatgaagatagacaaaataaattgtatccaataattgagcaagcattcccacatttgttgtctattggtggagttatacttaatactgaaatgaccgaattaagagcagagattttgaaattaattttaaaactgtacaagtttgttacatattatgatttgcctgaacctttacgtagtaaagatgcagtcatcagttggggagaattccatggttcagtgataaatatgactcctccatcgtatgttttaggaacaaatatcctggaacaagagaaactgtttttgcagatttccaaatgttataaatgggctattgccaacatttatcgattatttattcgttatgcaagtactaagaacttgactaaaaaatatgattacaaatcattccatcaattatttttgaatgatttcattcctcattttattacccaatttttatcgattattgaagaatattgtcaaggtaaaagatggttaagtactactgcattatatcaattattggaatgtttgagtcattgtattgttgaaaaatccacttggtcattaattaaaccttactttgaaaccttggttacccatttggtatatccaataatttgtcccgatgatcaaattttggaaatttatgaagaagatccacaagaatatattaatttaagttttgatcaaactagtgaatacgatagtcctgagaatgctgcattgggatttatagcaactgcattatacaaaaaaccaaagacaactttgccatgtatttctacatttatttatcaacaattgactgaattacaacaacaacctgaagaaacattagaaattgccaagaaaaaagagggggctttgagaattttgggaagcatttctggcaatttacctaaagatgccactattgaaccaatgttggcatcattggtggtaccatgttttgcttcaaaatttgagtttttacaagctagaactattgaagttgtaagtcaattttgtgatgttccctttagtaatcaagaaactttaagtgcaattattcatggtattttgagaaattttgataattcagaggcaagtttaccagtactttttgaaagtgcattatcgattcaagcatttatggttaaagatgaatttaaacaagttttatcaaacattgtcttacccacaatgtcgaaattgttagatttatctaatgaaattgataatgatgccatttcagttgttatgcaagattgtgtggagaacttttctgaacaattgcaaccatttggagttgatttaatgggtaaattggtgcaacaatttttgaaattagctcatgaaatcaatgaggcttcacaagctgatgttgatgattttgatgggaattatgatgatcaaggagacaatgcaatggcagcattaagatttatcaataccatgattactgtgttgttatcatttgagaattctcctgaaatttgtatcaagttgggaaaaactcttttctcaagcgattaa

SEQ ID NO: 4025 - DNA, 522 bp, Candida albicans
ctttcaatcatggatagtaatttgatcttggaatgttttgctggaactttacaagctgatcccaacttaagaaaccaagcggaatcaaaattgaaagaattatcggtttctcctggatttctaggtgcatgtttagatgtcatagatttatcatcatcaccagtacaagctaaaaaggcagctgcagtttattttaaaaatagatttatcagatattgggaagctaaagatagtcaatacaaaattgatcaagatgaaaaaccaattgtcaaagagagaattttgcccgttattatcaatgctgattacaacatcaaacaacaattaattcctgccttgaagttattggttgccttagattttgataattggggatgggattattggataaacgggtcaattattgcaactgggaaaacctggaagatcatctttatactggtatgctctgctttgcggagatcaccagaaagtataaatgggtcggtaatgaagatagacaaaataaattgtatccaataa

SEQ ID NO: 4026 - DNA, 1335 bp, Candida albicans
aaaatggataaacaaacattattagctgcccttacaggtacattggcttcagaccaacaaatcaggaagcatagtgaacaacaattacatgcattcgaacaacaaccagggtttaccgcatatttattagatttgattactgatgcaacagaaaaccagccaggggtgaaaacagctgctgctattttcttcaaaaaccgagtcgtcaattactgggttgttcctgaaaacaaacaacacactgcattctacctttcagagactgaaaaatccagcataaaagaaaagttggtgtccacattgtttgcaacatataaaattcaacagatcagattacaattatctactgcattgaacactatcttgagttatgataaatgggacgagttaaccaatattatccagaaactattgtctgatgaatccaacatcgatcatgtttttacaggattgatctgtctttacgaatacaccaaaaattacagatgggccggttttgagctgaacaattttgttaatcctatattggaggaaattactcagaaattgttcccacaattggaaaatttggccaacaagtcgatcgaaagcgacaacaaggttgctgatgaaatgctctacttgattatcaagattttcaaattcacttcatactcttcattgccaacatattttcaagactccaacaacttgggaaaatggtgtcaaattcatgtgttgataatcagcaaacctttgcccaaggacgttttggaagaagatcacattgaaagcagaaattctcacccaagagtgaaaactgttaaatggtgttttgctaatatgaatagacttttaagtagacacgggggtgggtacttgaccaaatccaaagaaacaaatcaattcgcacaaatgttcatttctaactttgttcctgaattgttgaacgcttattggaagattatagagtcatggtcaaataaaacagcttggctcagtgagatttctttatatcatatgatatcattcttagagcaaattattgagactccagcttggtctttgatcagcgataaattggatgcaattatcagacatgtaattttacctactttagtggcaacccctgagactgtggaattatatgaagacgacgccgacgagtacattagacgtttctttgatatcaatcgtgaacaaagcacctcagatgctgcgtcaataaattttatttatcgtttgttcaacaaaaaattcaagctgaacaataggatggttgtccaattattaatgaaaattttactgaacagaacaatcattcccaagtcttctgaacaccgccctgaaaattga

SEQ ID NO: 4027 - DNA, 1458 bp, Candida albicans
gaaaccaaaataatatgtatgagaaacacaatatataaacattcatctattgttacagcaatgtcaaataccttgaagattgccattgaaggatgttgtcatggagaattgaatgatatttataattcaatacctgacatcgagagtttagacctacttctaatatgtggtgatttccagtccctacgcaataaatgtgatttacagagtttgaatgtccccctcaaatatcaacgaatggcagatttccatgaatattatagtggtaaacgtaaagcacctgtattaactatttttattggtggtaaccatgaatgttcatcatacttgcaagaattaaaatatggaggatgggtggcacccaatatttattatctaggtgaatttggaagtatatggtataagggactacaaataacgggatggagtgggattttcaattatcatactttcatcgctaacaatatcgagatggaaaaattaccatttgattctagaacaataagaagtgtttatcatcaaaaattggcgaattttttgaaaatgtatatgatgaatcatgatatggatattgttttgagtcatgattggcctgtgggcattgaaaaatatggaaatgtgaagaggctactaaaattgaaaccatttttcagagatgatattcaacgaggacaattaggtagtccactaaataaatttttgatccattatttgagacctaggtattggttttcaggtcatttgcatgtcaaattcgaagcaagaattgttgatttggtaaggagcacggataaaaagaaatcagccacgactgtagatttaattactgaatcaaataaagaagaaatatctctagatatggatgatgaggaggaagaagaggggggaaatgttagggaagttagttttgaggagaaattttatttcaaacaacacctgaatccagcaaaaagaccaaaaaatgatttaactcctgaaagggatgtatgtgaacatgcaacagagtttttggctttagataaatgcggtaagcgtagacagttcctagatatcaaaactattgaagtccataacacttctcatccgtcatttatcaatgcagggaaattatattatagtaagcgatcaatcgccataaacaaagttgttgaaaagtatttgaatgacaatagacaagattttacagaattaaataccaaacaaatattgagtaaccctcaacaattcccattagtcaatgaattaatgcccattattgaaaatgacttcaaatcaatgcagaaaaatataacagatgaagattttttcatggtgccagagaattttcagactattgcacctacagacgacgaacacactgagtcaaagttaaagtactatccgaacaatcaaacactggaatattgtgaaaagtttggtattccaaaactagttttatctaaagagtcggaccaatag

SEQ ID NO: 4028 - DNA, 1242 bp, Candida albicans
caaccacacacaattgacagacacatttctaattacattcttaatatgtcacttgagttaagctcaaatgagagtgaagacaattttagggatgaattagtggacatttctggccaagtttccaaaaagcccattaatatagactctcgtcaggtaagattaatcttggatcacacagcctttgttagagggattggtaatattaaaagatggttcaatgaagagtatatcaattccaataccaccagatctaatgaaattattaatttgaatatttatattccaacgtatactttgcatgaatttgattttgttaaaaagggcacatctataagtgccaccaatgctcgtgaggcaattagattcattgataattatttagagaatgaagtcgagatgaattcagataagatccaatataatcttattttggaatcacctcaagacaatgttccatcttggaataagtgtaatcattataaagtgcattctccaaagatcaaagaattccccaattataaaactaaatttgattcatctttaattggacaaatccccaacgttaatgaggattcggaatttaatgaaaattttgataatgctttaactttcaatcaacgcaataaattgaatgatatacaatatgaaaattctgcatcgtatcaaaatgctattgccaattctgataacttggcggaaatgcctgttcgtttaagatatttgattagaagttgtatttataaaagattcattgaaacaaagaaacccaaaatcaaaaatgaaattgaggattggaaattggttacagaagaccccatcacgaaaatttgggctaaatcatatggaattgattgtctcaatgttaatgaagccgaattattaattttccagaattatgatgtcaatctgtttagattatataatccatatgttaatgatggagataattttgatccaagtacaaacattttgcaaaataccattgataccactttgtattcatattcaagcgttcaagatgagccagtaacttcaaattaccgaggtaaaaacaaccgaggaagaaataatagaggaagacgtggcaataaaagaagagaaagagaaagatggcctttatcaactgatgctgttgttagtgaggaaagaaatgaatctggaactggtttcattaagaaggagaaatttggagcaattaattatgcaccaagaggacaaggggaattatggagaccaggataa

SEQ ID NO: 4029 - DNA, 1155 bp, Candida albicans
cttttccataattttgataagagtaacgacgacattgaagatttcaattcaactgcgtccaacattatctccacccgtgataatggattaatcaacgatgggaatggttcagaaactgatactattaatcaatacaatgaacaagaattgttgaatcaatcacaagatgagcaatatacttctgatcatcctattgaacaggcagtacattcatatgctacccacgacaccgatgaagactcagaacaacattatgaacatgcatgtgcttactgtggaatccataatcctaattctgtgattaaatgtaacacatgtaataaatggttttgtaatgcgaaaacaaattcttcaagttctcatattgtcactcatctaatcatgtctcgtcataatcaagtgagtcttcatgaagaatctgaattgggagatacaactttagaatgttacaattgtggtaacaagaatgttttcattctaggatttgttagtgctaaacaagaatcagttgttgtgatattgtgtcgtttaccatgtgctcgttctaaagatgtcaattgggacactagtgaatggcaggcattaattgaagatagacaatttttgtcgtggttggcacctcctccaactgaagatgatttaattgaagcaagattgattacaccacaacaaatctccaaattagaagctcaatggagattaaatcgtgctgcaacaattaatgacattgacaacaataaggaagcagaacaagaagttttgccaattttgatgagatataacgatgctttccaatatcaaagatcatttggaccattagttaaattagaaggtgattatgataagaatttaaaagaatcacaagcattagaacacattcaagttaaatgggcattaggattaaataatagacatttagcttcctttacattgtcaacttttgaaactagtgatttaaaagtagcagtaggtgatgaaatcattttgagatatagtgggaatcaaggtgaaccatgggaaggtcatggatatattttgagattaccaaacgcatatcaagaagaattcacattagaattaaatccatcgaaaatcattccaccaactcaattaaccacgtcttctaccataggggacgggccgatccgcatttaa

SEQ ID NO: 4030 - DNA, 537 bp, Candida albicans
gtgattttaggtaatcctcgatccttgtgtcgtaatagattatggaatcatttattgattcatttccgtgaaaaagggtgtcttgttgatggtccattagataatttacaattatcaatggtacaattgaatacaaataatatgagaccaaccacttcagcattttcaaacaataatggcaataattattctaatggtcgtcaacggagaggtaaatttggtgttgcttcgacaatcaattcagtgacagattttgatagtgctagtattttatcctatgacaatagtgctattgttcataaaagcggtcacaatgggaataataataataataatataaaagaagaaatgtggcctgctttgaatggtagacaacaagttttcgacggtgataatagtttgagtgccaatttctataataaattaaataagattgataaaaattatggtggtggaagatatactaatgatggtaataatattgaagatgatattaaaagtatcactagtacatttgctgctggattgaatttttaa

SEQ ID NO: 4031 - DNA, 321 bp, Candida albicans
gctgcggatgccggattaaaacaatcattatttgaaagattggtgtttttaggacatgttcatattagattggaagtgcaatatagaatgcatccatgtttatctgaattcccaagtaatatgttttatgaaggatcattacaatatggggtcactagtgatgatagattaattgaagaatctacatttactttggaccagtatattgataccccaatgatgttttgggccaattatggtcgtgaagaattgagtgctagtggtaattcatatttgaatcgagttgaagccatgtatgttgaagtcttcaccaggcgctag

SEQ ID NO: 4032 - DNA, 594 bp, Candida albicans
actaatgctgttagaacggttttacaaagaccattatcattaattcaaggtccaccagggacaggtaacacagttacttcagcaacaattatttatcatttatcaaaattaaacaaacaaaaaattttggtatgtgctccttctaatgttgctgttgatcatttagcggcaaaattagacttgttgggattaaatgtagttcgattaaccgccaaatcacgtgaagatgttgaaagttccgtgagtcatttagcattacataatttggtcaatagtaatgctaaaggtgaattgaaaaaattgattaaattgaaaaatcaagttggtgaattatctgtggctgataccaataattatttaaaactttctcgatcctcagaaatgaaagttttaaataaagctgaagttgtttgttgtacgagtgttggtgctgctgatagaagattatcacaatttagatttaaaacagttttaattgatgaaagtactcaagattctgaaccagaagttttaatccctattgttaagggagctaagcaagttatattggtgggtgatcatcgactattgggaccagttatattagataaataa

SEQ ID NO: 4033 - DNA, 288 bp, Candida albicans
ttagtttggaccataatgccttattacgctgttgctaggggacgcgaagtgggtatttattcgagttggagagaatgtcggccacaagtatattgttgtaaaggagctcgttataggaaatttgagaacttgattgaagcaaaagaatattgtgaaaacgacggacgatactacatttatccagtatacgtcgatggagcatgcagaaataatggacgtgaaaacgccaagggtggatatggagtttactatgggcatgaattttcaacagccgtgcaaatcatactc

SEQ ID NO: 4034 - DNA, 723 bp, Candida albicans
attttgaatatatactcaatcatgccatattacgcagttgttaatggtcgtgaagaaggggttttctctagctggcaagattgtcgaccacacgtctttgcttataaaggtgcccattttcgtaaatttgaaaatagaaatgaggcagaagaatattatcaaaatgacggagattatttcatctatccaatatatgttgatggtgcttgtagatataatggttgcccacatgcagaagctggatatggggtttattatggagatggtgattcaagaaacgtgtcagtaccattggatgacgttgatcctgatggaattattccaactaatcaacgagctgaactttgggcaatgaaccatgccttgagaaacatttggaatgaactacaggaagatactgaagatggtaaggctgttatttatagtgattcgatttatgccatcaaatgtcttacaaagtggcctaacaaatggacacaaaatggttggttaaatgttcatggtcaaacaatttccaattatgatttggttactaaaaactatgagttatatgagtggattaatgatgaatatgatgataggggttggggagaattggatttaattcatgttaaaggacattcaggaaacgatggaaatgaagaagcagataatctagcaaacttggctgctgatagatatggctatcagtccagttcatcgtcatctggttcttattactga

SEQ ID NO: 4035 - DNA, 960 bp, Candida albicans
tttttcaacttccttctttaccctttccttcacccttctttctttaggttaattcaatttttcaagattagtagacgattattcaaatcaattcaaacagatatgccatattacgctgttgctaaaggatcaaaaactggtgtatacagtaattggggtgattgtaaagaacaagtccacggttatagtggcgcatcttataagaaattcagtactgctgctgaagccaatgcattcgtgcaaagtgggggcaaatcaggatcaagttcatcttatagttccggaggtagatcatcaggtggaatttctggttctagtcgctcatcaggtggttattctggtggttattctggtggttattccggtggttattccggtggctactctggtggtagctcaaagcgttcttcttcctcttcaacatcttcttcttctactactactaatcgtgtttatgttgatggtgcttcaagaggaaatggacaaaccagcaaggctccatcaggatatggtgtttattatggtcctaatgattcaagaaatgctgctgttcccttggatagagtagataaaaacacttcatataaacctacaaatcaacgtgctgaattacatggtgtgaaacatgcattgaaaaatatccacaatgatttacaactgggcaaagctacggggaaaaccgaaattcatagtgattcgaaatatgctattcaaagtgttaatgaatggtccagtaattgggcaaagaatggttggaagaattctaaaggggaaactgttgctaataaagatttgattcacgaaactgttgcattaaaaaatagtattaacaaaacttatcaagataaaaattggggaaatttggaatttgttcatgttaaaggtcatgctggtgatcctggtaatgaagctgctgatagattggcaaatcaaggagctgatcaatatggcaagaagtag

SEQ ID NO: 4036 - DNA, 759 bp, Candida albicans
cagatgagtagttcttgtgttgtgctggtttacgcgtcagtttgtgtccttgcgtgtcgcgtggaattcaaaagttggttcgcgtcacaatacccgccacaaactcttttcaatcgtcatcgttcgtggcgaagaacaaaatataaacaaaacaaaacaaagcgtgtctcctttccttctcatcacaacatcaacatcaacaaaagtaaactttttttttccactaacaacaacaacaagaattacctccattacccagtattaccacttcattttacaatgggggttaatggattattacaaatattgagagaaatccaagatccttgttcattagaacgatatcgaggtcaaacattggctattgatacttatggttggttacatcgagctttagtttcatgtgctgaagaattatgtttaggcaaaccaacaagaaattatattacggcaatattaaataagatccaaatgttaaatcattttggtataactccatattttgtatttgatggagcttcgttacctaccaaacaagaaactaatcgagaacgtcaattgaaacgacaagaagctaaagaattagccgaaaaatatattgctgctaataatcgaaaattggcttataaacaatttatgaaagcagcttatgttacttcacaaatggcaaaatcagtaatgtgtgaattagataatctttccattccaaatatattcgtggctccgtcttcaccacgggctggacggatccgcgattga

SEQ ID NO: 4037 - DNA, 822 bp, Candida albicans
tttcattttttgcaaccctctaatatttcaccaatcacgatgctttctattttgtctatcgctgctctccttattgctactgttcaggctgcggacttttcttcgtcatgtccaattgattcacctatttcttgttccagtaatggtgatacttcaaacagttgttgttatgagaaccccggcggtattattttgttcacccagttttgggactataatccagcatcgggtccagctgactcattcaccattcactctatttggaatgactattgttctggtggttacccacaattttgtgatacctctttggaaatcgacagtactggtagtactattgagtcgattgttgttgaccagtttggagatcaaactttgtatgacaatatgaataaatactggaccgatatcaacggaaacaacaaaaaattttgggctcacgaatttaacaaacacggaacatgtttgaacactttgaacccatcttgttactccaattacaagcaaaatgaaaatgtctatgactactatagtcttgtttatcaattattccaaaaattaccaacctatcaatggttagttagtgctggaattaaaccttccacaactgctacttataccttgtcccaaatccaaagtgctttgaagagtaaatttggtgctgaagtttacattgcttgtgactccaataatgcgatcaatgaagtttggtatttctacaacattaagggttccatcttgcaacaaaattatcttccaatagacactgtttcaaagaccaactgtccaagctctggtattaaattccctccaaaaaggtaa

SEQ ID NO: 4038 - DNA, 1047 bp, Candida albicans
cacagttttgggactataatccagcaactggggccagacaatttgtttactcaacatggattatggggtaacatgtgctcctatggatatccacaattttgtgatccttcgttggaaattaaccccaatggtgaaattatacgatcaattatagtcgatcagtttggtgacgaagaattatacaataatatgagttattcttggaaagattaccatggtaaagatagttccttttgggctcatgaatataataaacatggtacttgtttcagtacaattaagccatcatgttatttatcgaacactcctaaaaaccaaaatttatatgattttttcagaattgccattggtttgtttaacaaattgcctacttatgattggttggctgaagctggaattgtgccaaccaattcgaaaacatatagtttatcagagattcagtctgcattaaatgataaatttggagctaatgtctttatcaaatgcgattataatcatgcaatcaatgagatttggtattatcatcatgtcaagggatctttattgcaacataatttcctccccatcgattcagtggctcacactaattgtccatcaactggaattaagtacccgccaaagggtaaaatagctcatccaacattaaccacgaaaacaacaacaggtacttctactaccatacataaccccacgggtattcctgcaagatcttatgttcatttgtcagggaaatctgggtgtcttatcagcaatggtaaatggtacacttcaggaacttgtgccacctatcatttcaagaaaacaatcgatgactcaaatattgaaattagatcttctaaaggaatttgtggtatcaatggcaatgaggaatttacttgtagtcgtgctgtcagtggtggcacagatttccaaatcaaagatgggaaaatcggatatcaagataaatttgattggtgttttggaagcaccactggatctggttcaacagctcaaactagtgttaaattggcagacggatcttgtgattctttccaattgttaatctag

SEQ ID NO: 4039 - DNA, 291 bp, Candida albicans
aaaataaacataatggtaatcaaaatgaagtatagtattttggcaattctagcacatttgctcaccaatatcaaagctactcaagaagtattcactttatctgaccttccacccgactcgtgccccattgattcaccaatctcatgttcaaaaaatgcacaagaattagaaaatgtcaatagttgttgttatgaatccccagcaggagttattttgttaacacagttttgggactataatccagcaactggggccagacaatttgtttactcaacatggattatggggtaa

SEQ ID NO: 4040 - DNA, 999 bp, Candida albicans
gtgacgaactacaatcataatatgctttctcaatcctttttgatagctcttgctgttattcctgttactttggcctcaccttactacaatccttactttgggaaatatttccatggtcaaagaacttcaggtgattcttcgtcgtcaggtaacttttatccagttaaagattgttctaccttcattgaccaaaacccagaaacttcttggtcttgtcataacaagtcaccagtatctgctgcaaactcttgttgttttgaagaaaatgggatcattttgctgactcaattttgggattataatactactttgttggaaattgcggttaatggatctaccagtgacattgttgaagctgaattgaaaagtaagcttgacactgtttacaatgatttgagtagaactttcaccattcatggaacttgggatgatttctgtaatggatcttacccacaatactgtaacaaaagtttagaagtaagcgatgaaaaagataatcttacccatattttggttgatcaatttaaagaagttgaattatataatatcatgtccaaatattggattgacaccattgctagtaatgtggacagcagcgcctctacagccttatgggaacatgaatataataaacatggtacttgtatgaccacattgagtccatcctgtttcaccagccaaaactatactcgttttgaaaatgttgtcaatttttataagaaaactgttgaaatttggtcacaattggatacttttgagtttttagctgctgcaggaatttaccctactgtttcaagaaagtacaagttgagtcaagttcaagaagctttacaaaaagctcatggtgctgaagtgtatgttggatgtttgaataattccatctcagaaatctggtatttctacaacttgcaaggaagtattttgacaggtacttataagccaattgataccacaaccaatactaagtgtaaagatgaagtgtggtacatccctaaataa

SEQ ID NO: 4041 - DNA, 660 bp, Candida albicans
cgcggaaataccagggccgtggtcgactactcttcaaattacttccaaaccaggtacgacttggctgttaaaatgatcaaggatggtaatgcttattgtgatgacactccagttgatactatgagagaacaaagaatggtgggtgatgcatcagcaagaagagaaaggtctgttgaagaaaacttgagaattttcactgaagaaatgaagaatggaactgaagaagggttaaagaactgtttaagagccaagattgattacaaagctccaaacaaagccttgagagacccagttatttacagatgtaacttgacaccacatcacagaactggtactgaatggaaaatgtatccaatctatgatttctgtgttcctgttgttgactcaattgaaggtgttactcatgctttgagaaccaatgaatacagagaccgtaatccacaatatgaatggatgcaaaaaactttaggtttgcgtccagttgccatttgggatttcggaagagttaactttgttagaaccttgttgtccaagagaaaattgcaatggtttgttgacaaaaactacgtttccaactgggatgatccaagattcccaactgttaaaggggttagaagaagaggtatgacagttgaaaggttgagaaatttcattatttct

SEQ ID NO: 4042 - DNA, 633 bp, Candida albicans
cgacaagacatcgacccagttgcaccaagatttactgctgttgatgctaagaatgttgtttcagttaaattgttgaacggaccaaaagagccatacactgaatcaaaaccaaaacacaaaaagaacccagaggttggtaacaaagatgtcatttttgctgatcaagttttgattgaccaagaagatgctgatttgactgaaggtgaagaagtcactttcatggactggggtaacattattgtttcaaaagtcaacaaagaaggtgatattgttaaatccgttgaagctaatttgcatttggaaggtgatttccgtaagacttccaaaaagattacatggttggcttacactaaggataaagttgaaattgacatggttgattttgatcatttgattactaaagacaaattagatgaaaatgataactttgaagacttcattactccagaaaccgaattccacactaaaggctttgctgatttgaatgtcggtaaattgaaagctggtgatatcattcaatttgaaagaaagggttactttagagttgataagccttctgaagaaggtaagcctgctgttttatatactatcccagatggtaaagcagtttctagatatggtgccaaaaaataa

SEQ ID NO: 4043 - DNA, 666 bp, Candida albicans
agctatacttccccttttctgtcgttttacttatattacaattatctgactaaacttgaaccaaagatgtcattcaaattgtctgttgccggaaaggctcaaaatgtcccttatcctgtattaattgcagttaactttatcaactctagtgatgttgatgtgtcaatcccaattgaatttgttgatgacaaaaccgttgactctaaagattcaatcaaattagttactccaggtggtgaaacttttattgatcaattagatgctttggattatttgtcacaaactttacctgaattgttaccagaaagaagcaaatcccaagaatggatcaaatttgccttgaccaaattgtacgtcaagaactttaaagaattggctgttgatttggaaaaacttgatcaacacttgaacttccgttcattcattgttggttaccaatactctttagctgacattgccatttggggtgttttgagagccaatgcattgatgggctctgttatcaagaatggtgtttatgccaacatttccagatggtacaatttgttagctgatgacaaaagattcgaaggttctgttgaattgatgactaaatcattggcagaagtgagaaaagctgctaaatctgccaagactcttcaccacgcggctggaaggacacacgct

SEQ ID NO: 4044 - DNA, 894 bp, Candida albicans
tctcctggaataacgcgttcctgcactccgtcgttaagaccggcggccccaatgtttaaaggatttttagttgatcaagatgttagatggaatgttgttagtggtgcggttgatgatcgtacatttattgaaaagggacaagaaccttattctggttatcatttatttggaggattagatattgatgctcaagataaattgagaattaataatcatcaaataaatcaacaaggagatttattggatttatatactaaagatggtaaaccaattcaaagagttcctaaatcaagatatgattcaattgataattatttaaatgataattattatgatacaaaatatttccaagatgaatataatgatcttaatgcaccaataaatgaacaagtttatcaacgattaattgatgaaggtaaactcgacaagtatatggccaatcattttgctcatttatttattcgtgatccattagtcattttcagtgaaagaataaatcaagataataatttagaaaatgatcattttgaaaatattcaaagtacaaattggcaaactttacgatttaaacctccagcattatatactaaagatactgatttgactactaaaccaggttggagagttgaatttagacccatggaaattcaattgacggattttgaaaatgcggcttattcatcatttataactttattatctaaagcaattttgaaatttcaaccaaatttttatatcccattactgaaagtagaaattaatatgaaattggctcataaagttgattcaactttaaaagataaattttggtttagatcatttgaattatggaatattgatccacaagaatttgatgattatggatttgaatggtttgacggaaattttttttaa

SEQ ID NO: 4045 - DNA, 609 bp, Candida albicans
atggtaaccaacaaccaaaatggccacgtgaacaataacaataacaatgacaagaaaaccaaaaatgatccaataattgttaatgtttctactactactactaatggtacaaatagtggcagtggtataacggaaacaaatggtacaatgttacctaaaggatgtgaaggtaagacagtggaagagattaatgatgttgatgataatggtattgatcaaaggtatactatttgtcaattgattaatggtagtgggaaattccctggttttattaaattagtgattaaattgattgccactgatttagtaccacaagcattaaacaattcaactacatctaaggaacaattgattgaagaattgataaggttaagatcttatttatatttacttgcaacaagagccaatggggaaataccaaccacggcacattgggtaagaaataaagtattacaacatcaagattataaacaagattcaaaagtatcagaaaaaataacatttgatttgattgacgattcaataaaaatcaccgaattaaaagatagacaattgatagaaggatttttgggtgctgacattactgagtatttaatgggatcaaaataa

SEQ ID NO: 4046 - DNA, 528 bp, Candida albicans
ttcaaaaagaggaaccactgtattatcatgggtcttttatctattggtacacctttaagttgggatgaatcgaaaaagtataataatcatgttagaaccaatgggataactcaattgattaacattttcaaacaacatggacatcgtgaaaatgatgtatttttatggggtgatgaagttgaatatatgttagttgattttgataagaccaacaaaactgctagattatcaattgataaagattatattattaatgatttaaatgaccctgataaattattaccaatagctgaaaaacaagatgttagttatcatccagaatatggtagatttatggtagaagcaaccccggcaaaaccatataatgggaatttattactggattatttatatattgaaaaaaatatgataattcgacgtcaattatgtgaagataatttaccttctcatatcaaattattaacattgactacattcccaagaatgggatgcaatatttttacttcaccaccatcaaaacctaatgtg

SEQ ID NO: 4047 - DNA, 498 bp, Candida albicans
ggcgtgtgtgaaaaaaatttccatttacctaaaccaggtcaaggtttattatttggtggtgatttaactaatgataaattgggtaaagttgctgctaatttgactggattgggatataaattctatactgctagtgaaccagtggctcaatatttaaaacaaaacaattttgttaatgaaccagtagaaatcattgaattcccaaaaactgataaacgggcattaagagaaattttccaagataaagaaattggtgctgttttcaatttggctaaagctagagctgaagatttattggatgaagattacgtgatgagaagaaatgcaattgattttgctattccattatttaatgaacctaatacttcattattattttctcaatgtttgaaagaaaaaatcggtcataaagtttcatttgatgaaatacctcataaagttgaaatccctgacgaagttaaaagatggagtgaatttattggtggtaaaccggtgtaa

SEQ ID NO: 4048 - DNA, 1263 bp, Candida albicans
  unsure (111): Identity of nucleotide sequences at the above locations are unknown.
tttgttgtttttcgtatcatcttcttagaaatgatgactgtaaaagctgctataactcagcagtttaaaatcactaaaaaaagtatactgtttgtccacaaacattcattntcatcatcatcccttttaaaacagaaggaacaattacgttatgctggtgcagatttgttgaaaaattttaccgatgaacatgcacacaaattggttgatgtttccaaagtgcttgttattggttctggtgggttatccattggtcaagctggtgagtttgattattctggatcacaagccattaaggctttaaaagaagctaataaacaatccattttaatcaatccaaacatcgctacaaatcaaacctctcatgctttggctgacgaaatctattatttgccagtgacaccagaatatatcacgtatatcattgaaagagaaagaccggatggtatattattgacatttggtggtcaaactgggttaaatgttggtgttaaattggataaaatgggtgttttcgaaagatacggtgtcaaagtgttgggtactccaattaaaactttggaaacttctgaagatcgtgatttatttgctcaagctttaaaagaaattgatattcccattgctgaatctattgctgttgaaactgtcgatgatgccttaaatgctgctaaagaagtcggataccctatcattgttagatctgcttattctcttggtggattaggttccggttttgctgctaatgaaaaagaattaagaaatttggcagctcaatcactttctttagctcctcaaatcttggtagaaaaatctttgaaaggttggaaagaagttgaatatgaagttgtccgtgatcgtgttggcaattgtataactgtttgtaatatggaaaattttgatccattgggtattcacactggtgattccattgttgttgctccttcacaaacattatctgatgaagaataccatatgttgagaactgccgctattaagattatcagacatttaagagttgtgggtgaatgtaatgtgcaatacgctttacaaccagatggattggatttcagagttattgaagttaacgctcgtttatcccgttcttcggctttagcttctaaagctactggttacccattggcttatactgctgctaaaattgctcttggtcatactttaccagaattaccaaatccagtgactaaaactactactgctaattttgaaccatcattaggattatttggttacaaaaattcctag

SEQ ID NO: 4049 - DNA, 915 bp, Candida albicans
gattatttggttacaaaaattcctagatgggatttatcaaaatttcaacatgttaaacgtgatattggttcggctatgaaatctgttggtgaagttatggcaattggtagaaatttcgaagaatctttccaaaaggccattagacaaattgatccatcatacattggattccaaggtgatcattttgataatttggatgaagcattggctaatccaaccgatagaagatggttagccgttggacaagctttattgtatgaaaactataccgttgatcaagttcatgaattgaccaaaattgatagatggttcttacataaattgatgaatattgttaacatgtatcgtgaattagaagcaaatggacatttgtcaattattaaccatgatttaatgagtcgtgctaagaaattgggattttcagataaacaaattggtctttgtgttggagctgatgaattagaagttagaagagttagaaaagaattgggaattattccatttgtgaaaaaaattgatactttggcagctgaatttcctgccaatacaaattatttatacaccacttataatgccactagttctgacattgatttcaatgataaaggtaccatggtgttgggatctggagtttatagaattgggtcttcagttgaattcgattggtgtgctgtttccactgctcgtgctttaagagcaaatggacacaagactattatgattaactataatccagaaactgtttctactgattttgatgaagttgatagattatattttgaagaattatcattggaaagagtattggacatttatgaattagaacatgctcaaggtgtggtggtttccgttggtggtcaactaccacaaaatattgctctttctttacaaaaccaaggttgtaatgttttatga

SEQ ID NO: 4050 - DNA, 567 bp, Candida albicans
actaaccctgaagatattgataaagctgaagatcgtcacaaattttctcaaatcttagattctattggtgttgatcagccagcttggaaagagttgacttcagtgaaagaagctgaagaatttgctaatgaagttgggttcccagtattggttcgtccatcttatgttttatctggtgctgccatgtcggttattaacaataaaagtgaattggacgcaaaattgtctaatgctgccaaagtttctcgtgattaccctgtggttatttctaaattcattcaaggagcccaagaaattgatgttgatggtgttgccaatgatggtgaagttttagttcatgctatttccgaacacgttgaaaatgctggtgttcattccggtgatgccactttagttttaccaccacaaggattatcaccaatattattagatcgtttgaaagtaattgctgataaagttgctgctgcttggaaaatcactggtccattcaatatgcaaatcattaagaatgatcaaaatggtactttaaatgatgaaacttgtgaattgaaaatcattgaatgttaa

SEQ ID NO: 4051 - DNA, 1056 bp, Candida albicans
aaagaaaaaaaaaattcatcttgcaaaaaaaaaattgttgatggtattactaatatccaacaacttgttattaacaaaaagatgtcaacaaaaactgatatttctactgaagaattggtttccttattcagtaaagctggatttgaagaaaaaaagtctgcagagatagtcaagaataaaaaagttgcctccgctttatataatattttaggctccaacttccccaaaactgatgataaaaaattatctttgttacatcaattggctatacatgaaagtaaaaatggaaaagtaccaaatcatgactttatcattgatggaattcaaaaaggggacttgaaaactgctttgcaagtaactgaaggtatcaagtatttacaaaacaatgcaacagttgataaggaaaaatttgatgaagccagtggtgtaggtattgagattactcctgaagaagccaaggtagaaatttcaaagtaccttgactctattaaaactgatttggagagtaaaagatattcaatcttacctaaagttctaggtgaagtgaaaacccagccatctttgaaatgggcaccacttaacttattcaaaccaattttagatgaagagtttttggccagattgggtccaaaagatgaaagagatgttaaaaagaaggaaaaaaaagccaagacaccagctaatgcagctgccaccaaaaagcaagatactggttctgaacctgaacgttctatgttttttgaagggttccttggggatttgcataaaccaggtgaagaacctcaaatgtaccctgaattgttagaagagcataaaaagtttatttgtgataaagtctacacccgtttcccacctgaaccaaatggatttttgcacattggtcactctaaggccattatggttaattttgggtacgctcaattcaacaagggtaattgttacttgaggtttgacgatacaaaccctgaagctgaagaggaagtttatttcgatccccgtcttcaccatggggatgcgctatcgatgcacgatccgcgattgatgtcccgtgggata

SEQ ID NO: 4052 - DNA, 1104 bp, Candida albicans
atcgcctccgctggtgaaaactatgattttacgcactgtttggttgattcttttgaaaacattacccattcattgtgtaccaccgaatttgtcttgtctagagaatcgtatgagtggttgtgtgatgcattacatgtttatagaccagcacaacgtgaatacggtagattgaacttaactggtaccatcatgtccaagagaaagattgctaaattggtcaatgaaggttatgtcagaggatgggatgacccaagattatacacattagaaggtatcaaaagaagaggtgtccctccaggtgccattttgtctttcataaacaccttgggagttacaacctcgacaacaaatatccaaacggtgagatttgaaagtgccgtgcgtaactaccttgatcaaacaactccaagattgatgatggttttgcacccaattgaggttgttattgataatttggatgaaagctttagtttggacgttgaaataccatacaagccaggtaaagatgaaaagtctatgggataccgtaaacttacattttccaaacatatttacattgatgaaaatgatgttagagctgaacctgccgataaagagttttatagattggctccgggccaaccagttggtttgatgagagttcctttcaatatcagtttcaaatcaattgaagaaaaagatggaaagaaaatcgtccatgttaactatgacgaaagtgtaaaagctaaaccaaaaacctacatccaatggattcctaaagacactgctgttcatattaaagaagttagaatctacaatcaattgttcaaaagtgaaaacccttctgcacatcctgaaagttatttgaaggacattaatcctgatagtgaagaagttttgcgtaatgcagttgttgaagaaattcttaaagacattgtggcaaaatctccaatgaacattgaaattccaggaagtgcattccacattaaaggaaacaaaggtaataatactgtcagattccaagcattaagagaaggttacttttgcttggacaaagattccaaagaagatggtttgattcttaatagaattgtcagcttgaaagaagatgctgctaaaaaatga

SEQ ID NO: 4053 - DNA, 417 bp, Candida albicans
agctttccttttccaatgctttctgctactaagagatatttagcaactgctgctgctgctgctgctactaataccaccaccactagcaaagcgtttacaaatactacttcacaattaggtagagcaacattaactataaaagatggacctgttttcaatggttattcatttggtgccaatagaaatgtcagtggtgaagctgttttcaccacttcattagtaggatatcctgaaagtatgactgatccatcatatcgtggacaaattttatgttttactcaaccattaattggtaattatggtgttccttcaagcactgctaaagatcaatttaatttattgaaatatatggaatcaccaaaagttcaatgtattggtatacttgttgctgatgccgcattaaaatatagtcattgg

SEQ ID NO: 4054 - DNA, 726 bp, Candida albicans
gatgaagacacaaggaacttggtgagttatttaagagataaaggttcatcattggggagaattacgattggtgaagaatatgatgctgatgaagatgcggcatttgaagaccctggtgccattaatttagttcataaagtaaccaccaaggcaccatttcatattgcttgtccacctcaatattctaaagggattcatattgctgttttagattgtggagcaaaagaaaatattttgcgttgtcttgttgaaagaggtgcttcattaacagttttcccttatgattatcctattgataaaattgctaataaattcgatgggatatttatatctaatggtcctggtgatccaactcattgttctactacagtaaacaatttaaagaaaattataacaaatcatcaagatttaccaattttcggaatttgtttaggtcatcaattattggcattagctagtggtgctaaaactataaaattaaaatatggtaatagagctcataatatcccagctatagatttgatcacggggaattgtcatattacatcacaaaatcatggttatgccgttgatgctaatacattatcggaaaattggcaaccttatttcactaatttgaatgatttaagtaatgaaagtatgattcataaatatcaaccaattttttcaactcaatttcatccagaagctaaaggtggtccattagattactcatttttaatttga

SEQ ID NO: 4055 - DNA, 1452 bp, Candida albicans
tacgacgcggatctgccagccctcgtggctgaatacggatctggtggtgttgcctctgcaaaaacaactgccaaatatggtgccaaagtattattaattgaatcgaatttcaaaaagtttggtgggacttgtgttaatgttggatgtgtccctaagaaagtcatgtggtatactgctgatttggctcataaaaagcatgatttatatgcttatggattagataaagagccagactcaattaaatatggagatttcgattgggctaaacttaaacataaaagagatgcttatgtcactagattgaatggaatttatgagaataatttgaaacgtgaaaaagtcgattacgcatatggatttgctaaatttattaattctgaaggtgaagttgaagtcacattactgggtgatcaagaattgccattcttggacgaagggaaaacttataaaaaaggtgagaaattggtgttttccgctgacaagactttgatcgccactggtggtacagcaattgttcctccttcagtccctggtgctgaattaggtactacatctgatgggttctttgccttggaaaaacaacctaaaaaagttgccattgtcggtgctggttacattggggttgaattatcaggggttttcagtagtcttggttcagaaacccatttctttatcagaggagacactgttttaagaagttttgatgaagtgatccaaaacactgttactgactactatattgacaatttaggaatcaatattcataaacaatctaccattactaaaattgaaggtagcaaagatggcaaaaaagttgttcatttgaaagatggtacctccgtagaagtagatgaattgatttggactgttggtagaaaatcattgattgatattggattagacaaagttgatgtaaagataaatgataaacaacaaattgttgctgatgaataccaagtcaccaacaatccaaagatattttctcttggtgatgttgttggtaaagttgaattaaccccagttgccattgctgcaggtagaagattatcaaatagattatttggtggaccagaatttgccaaagataaattggattataacaatattccatcagtgattttctcacatccagaagctggttctattggtttatcaactaaggaagccattgaaaaatacggtgaagaaaacttgaaaatatatcaatctaaatttactgccatgtattatgctatgatggatgatcaaaaagataaatcacctactgtctacaagatcatttgtgctggaccagaagaaaaagttgttggtttacacattgtaggtgattcaagtgctgagattttacaaggttttggtgttgccattaaaatgggtgcaactaagaaagattttgataattgtgttgctattcatcctacatcagctgaagaattggtcacaatgacttag

SEQ ID NO: 4056 - DNA, 897 bp, Candida albicans
  unsure (826): Identity of nucleotide sequences at the above locations are unknown.
ccgcaaatgcgttccttccacggcggggtgaaaacggtgcataacgatgacccagacgatgtgactgaatcttcattcaaaaggtttctatgcgacacgccgttccctgacgacgaagttgatggagacaaggaccaatttgaaggacttgaactcaaaaattggggagaatcaacaaaaccacgaattggtcctacccacgaactatatttcttggatgggaaattaattgccatctccattcttgacttcctaccatcgggcgtttcttccatatattttatttgggaccccggctatgcacatttgagtttgggcactttatctggactaaaagagatgcaaatgtgtgacaagctaaattactcgtggtactatttgggatactatattgaggattgcgtcaaaatgaagtataaactgaaatttggtggtgaattattggatttgtgcaatgaagtatatttcccattagagattgttgatccgtatataaagaacggtagactatttgtcattggtgaaaaggacgacgagtacgattcagagcttgagattgagagtttaggagctccgttagactataaagatagtgatttttatgagaaaaagctagtcaacattgctgaggacatttacggggacgaaaaggtcgaggcagatgctaaaaaggccaagcaaatcttaaaagtcaaatatcaaattgatctgaaagactctcaaaaaagattgcctaatgtcgtaccgggaatgattcctcatttggcaaattctccgaatggtttgatatgggttacattgatgaagatttcgttgttgaaatatntatggggcgaaaaaatgtttgaatattctcttgaacaacttaatggtgaaagggaaaacaaccgtggttga

SEQ ID NO: 4057 - DNA, 729 bp, Candida albicans
  unsure (16),(19): Identity of nucleotide sequences at the above locations are unknown.
cccccccccttggtcngcngacagactcttttcctacccgtctggttgaagagtgatgctgataaggcccatgtgaacaccaagcaaagagtcacagaagttgtgatgcacgaattggcccatcaatggttcggtgacttggttactatggaattctgggatggtttgtggttgaatgaagggtttgcaacctggatgtcctggtacgcttgtaactccttgtacccagactggaaagtttgggaatcatatgtctccgattccttgcaacatgctttgacattggatgccttgagagcttctcacccaattgaggttcctgttaaaagagctgatgaaattaaccaaattttcgatgccatttcttactcaaaaggttcctcattgttaagaatgatttccaaatggttaggtgaagatgtgtttgtcaaaggtgtatctaactatttgaaaaaacacaagtggggcaataccaaaacatctgatttatgggaagctttgagtgaagcttccggtgaagatgtcgttaaggttatggatatctggactaagaacattgggttcccaattgtcaaagtaaaagacattggcaatggtgacatccaagtaactcaaaatccgttcttggctaccggtgatgtcaaagaaagccaaaataaaaccttgttccccgttattttggggattgaaaaccattttacggtgttgaagaatctctgggtgttttaa

SEQ ID NO: 4058 - DNA, 573 bp, Candida albicans
aacacgattccacttgaagaagcttggctttgtgacattgatgaaactgtcattgaagtttccaaaaaatacttgccaaacatggctaaatcttacgatgatccaagaactagagttcatattggtgatggtttcaaattcttggaagaatacaaaaatcaattcgatgttattatcaccgattcttctgatccagaaggtccagctgaatcacttttccaaaaaccatatttccaattattgaaagatgctttaactgaaaaaggtgttatcactactcaagcagaaaacatgtggattcatatggatatcatttctaaattgaagaaagattgtaacgaaatcttcccagttgctgaatacgcttacactatgatcccaacttatccatctggttcaattgggttcatggtttgttctaaagatccaaatgctaatgtatcaaaaccaatcagatttgattggagtgatgaatttgtggccaagaacttgaagtactacaacaaaaagatccatgaagctgcatttgttttaccaacctgggccgatcaagttttgaacaaaaaggactaa

SEQ ID NO: 4059 - DNA, 453 bp, Candida albicans
  unsure (441): Identity of nucleotide sequences at the above locations are unknown.
gttgaaaaaagttctttatatattttctcttcttatcttaataactttttttttttgaatatttatcaatttacaatggctcaagaattaactcatcctgcaatcaaagatggttggtttgctgaaatctccgataccatgtggccaggtcaagccatgtctttaaaagttgaaaaggttcttcacgttgaaaaatccaaataccaagatgttttggttttcaaatctaccacttatggtaatgttttagttttggataattgtattcaagtcactgaacgtgatgaattctcttatcaagaaatgattactcatttggccttgaactctcacccaaacccaaagaaagctcttgtcattggtggtggtgatggtggtgttttaagagaaatcttgaaacccgaatcaattcaagaagatttgcctcacaaccgacatggncggaccatttct

SEQ ID NO: 4060 - DNA, 1044 bp, Candida albicans
tttaacaatatgtcaccatccacccaacaacaagtccatgaactgaaccaatcccaatcaaatgattcttcctccatcgggttgaggttgaacgacaataatattcaaccgattgagattgaattgtcaagttttaaacatgattcaataactttccataaacaagattcttcttattggttttatgaaaaactgaaacaatcatttcctggtcaatcatttggattacaagtggaaaaaatcttgtatcataccaaatcatcattccaagatattttaatatttaaaagtacaaatttcggtaatgttttagtcttaaatgggattatacaatgtacagaaaaggatgaatttgcttatcaagaattaatcactcatttaccaattatgtcgcatccatcacctaaaaaagtcttagttattggtggtggtgattgtggcgtcattagagaattaatcaaacatgtaaatgatcaaacgatacaagaaatcaccatggtggaaatcgatgatatggtgattaaattactgacgaaatttttaccagaaatggctaaatatcataatcatcctaaagttaatttaattattggtgatggatttgaatttttgaaaaatagtagtaaagagaagaaatatgatgttattatcactgattcttctgatcctgatgatggtcccgccgaagaattttttcaaatcaattatttcaaattattattgaatgcattgaatgaaaaaggtattgttattatgcaatcactggaaaatatatggttaaatttaccttatttgaaagaattgaaatcaaaagccgccacagtgttttctaatgtcaaatattgtcaatgttatatgccaagttatacttctggtcaattaggtttgataattgctactatggatactggaaaagatttggttaatccattacggaaatttgatcatgataaagaattgaaattgtttaaatattacaatcaacacattcataccaattcatttgttttacctacatgggcagatgattatttgaataattga

SEQ ID NO: 4061 - DNA, 996 bp, Candida albicans
ttgttgtcgctgatacctaactttaatggaaatcctgcacattttttttttttgttgttcgcctcgctttgttttgcctctgttagatctaatcagtataaattctccacgaaatttttcattctttttttgtcgaagttgtttttttcaaccagagataaatcattaatcatgaaagactacacgattacagtattaggatgcggtgttatgggcacagctgtaacatcagctattttgaaatccaagtttgacccatacccaaagaaaatcatagcatgtaccattccaagccaagaacaaagcttgaaagaaacctttgctgatcagccattagttcatgtttctgccggagttgaaaacaacaacaaggcagttactgaggcagatgttattattttaggatgtaagccatatatgtatgaaggcatttatgaagaagtcaaggaatcattaactggaaaacaattattaatttcattattggcaggaaccactataaaggaattgtctattttcactccatatgttgccaaagtcatgaccaacactccagctagatttggttgtggaactgcggcaattgcatttgctccagaagttagtgaagaaagccaagagttggtaatgaaattgattgatactgttggtatgactgtaaagattccagagaagaacatggacattgcaacttcattgattgggtccggaccagctttttgtttattgatgatggagtccatgatcgatggtgcagtaagaatgggtatgccatacgatgtagcatctgttgctgcagccaaggtgatggaaggtactgcccgtatggtcttggaaaccggcgaacatccagctgcgttaaagagcaaagtgtgtactcctggtggtactacaattggtggcttgttgaccatggaagatcgtggattaagaagtgctattgctagaggtgttgaagaggctgctaacatatctgcttcatttgccaaaaagtaa

SEQ ID NO: 4062 - DNA, 546 bp, Candida albicans
tcgaaaatgggattattaattcaaaataagataagtcaaataattagacaaagaatggatgaaatacaatttgaagaagtcagtttatcattgattagtcataaagaattatggaaattgactaatcgatgggatcaagaagaaatttttaaacttgtaggtgatgaatatttattagtccctactgctgaagaagaaatcacaaattatgttaaaaaacaatttttggaaagttataagaatttcccattggcattatatcaaattaatcccaaatttagaaatgaaaaaagaccaagaggtggtttgttacgagggaaagagtttttaatgaaagatgcctattcttttgatttaaatgaatcagaagcaatgaaaacttatgagaaagtagttggtgcatatcacaagatattccaagatttaggtattccttatgttaaagctgaagccgactcaggtgatattggtggtagtttaagtcatgaatggcattatttgaattcttcaggagaagatacagggcctgaatgtgacgtttcatag

SEQ ID NO: 4063 - DNA, 1503 bp, Candida albicans
caaggcaaaaaaaaaaaaattttatctttgaaaaatttttcttccttttcttcttctgttctttacataacagctatcaagaataatcaattaataatgtcacaacaacaagataaacaacctagtgaaaataaattatggggtggtcgtttcaccggtgccactgatccattgatggatttatataatgcttcattaccttatgataaagttatgtatgatgctgatttaactggtactaaagtatacacacaaggattaaacaaattaggattaattaccactgaagaattgcatttgattcatcaaggattagaacaaatcagacaagaatggcatgataataaattcattattaaggcaggtgatgaggatattcatactgctaatgaacgtcgattaggagaaatcattgggaaaaacatttctggtaaagttcacactggtagatcaagaaatgatcaagttgctaccgatatgagaattttcgttcgtgaatcattacttaatttaagtaaaattttacatcaattcatcacggcaattcttgaacgggcacataaagaaatcgatgtattaatgcctggttatactcatttacaaaaagctcaacctattagatgggcacattggttaagttcatatgcaacttatttcaccgaagattataaacgtttacaagaaattataactcgtgttaaccaatctccattaggatctggtgctttagcaggtcatccttatggtattgatcgtgaatttttagctaaaggattaggatttgatggtgtcattgggaattctttaactgcagtttcagatcgtgattttgttgttgaaagtttattttggagtacattatttatgaatcatatttctcgattctcagaagatctaattatttattctagtggtgaatttgggttcataaaattagctgatgcttattctactggttcttcattgatgccacaaaagaaaaaccctgactcattagaattattacgtgggaaaagtggtagagtatttggtcaattatctggatttttaatgtcgatcaaatctattccatctacttataataaagatatgcaagaggataaagaaccattatttgatgcattgactacagtggaacattcaattttaattgctactggtgtgatttctactttactgattgataaacaaaatatggaaaaagctttaactatggatatgttggctactgatttagctgattatttagttagaaaaggagttccatttagagaaactcatcatatatctggtgaatgtgttagaaaagctgaagaagaaaaattatctggaattgatcaattatcttttgaacaatttcaacaaattgattctcgttttgaaaaagacgttatggaaacttttgattttgaagctagtgtggaaagaagagatgctattggtggtactgctaaaagtgccgttttaaaacaattagaaaatttaaaatcaattttaagttaa

SEQ ID NO: 4064 - DNA, 2082 bp, Candida albicans
tacggaatggcattagaacaatcattggcccaattatccttggctactgtcgcatcaccagaaaatggaaaggctttaccaaccaaatctttgattttcaaaccaaagactgccaaaacagctacaccaattcccctctttgtttttgcattacaagataccactactccatcaaatttgatagccaaatcagcaggtgttaaagaaccaagattggccaaagatgatttagtcgaagaatttttcaaaaccaccacaaaagaagtttccattgccaatttgtccaaagaattagctggtaaaattaagattgtcattgatgataatgttttgaaagctgccaaaaatgaagaattgttgaaattatccactcaaagttcagcagctgttttatctgctaaaactgtagtagaatttttacaatctactggtattgagattattgaagttgatttttcagctgaaccaactcaagctccagcttcagcatctccaggtggtagtggtgctgctgcttcctctaaaaaggaaaagaaagatgatgctaaattagaagatgctaaattgattggtatcactgttgacaaggaaaaagatttctcttcatggtatacccaagttgtcactaaaggtgaaatgcttgattattatgatgtttccggttgttacattcttagaccaaattcatactttgtttgggaaaccattcaagattggttcaatgccagaattaagaaattgggtgtacaaaacacttatttcccaatgtttgtttctcagagagttttggaaaaggaaaaagaccatattgaaggttttgctcctgaagttgcttgggtcactagagctggtaattcagaattagatgaacacattgctattagaccaacttctgaaactgtcatgtacccatactatgccaaatggattagatcacatcgtgatttaccattgaaattgaaccaatggaactcggtcgttcgttgggaatttaaacaccctcagccatttttaagaaccagagaatttttgtggcaagagggtcatactgctcatttgaccaaagatgctgctgctaacgaagttttacaaatcttggattattatgctggtgtttatgaagaattattagccgttccagttgttaaaggtaaaaaaactgaaaatgaaaaattcgctggtggtgattacactaccactgtcgaaggttttattgctgctactggtagaggtattcaaggtggtacttctcatcatttgggaaccaatttctcgaaaatgttcaatatttctgtcgagaaccctgaaggttcagaaaaaccaagaattttcgcttatcaaaactcttgggggttgtcaaccagagtcattggtgttatgattatgacccattctgacaacaaaggtttagtgttaccaccaagaattgcccaatatcaggcggttgttatcccagttggtcttacatccaaatccactgatgcacaaagaaaagaaatcaatgaaggggcagaaaagattgaacaatctttaagagccaatggtataagggttactggtgattatagagaaatttataatccaggttggaaatttgctgattgggaattaaaaggggtcccattacgttttgaatttggtcctaaagatttggctggtaatcaagttactattgttagaagaaatgatgggaagaaatacacggttaaattagacgagttagataccgaagttccaaaattattggaccaaatgcatgatgatttattgactaaagctaaacaagaatttgatgaacatcgtgttaaagttgatgaatggaaagattttgttccaacattgaacaaaaagaatgttattttgtctccttggtgtggtgatgccgattgtgaagatgatattaaggactcttctgctaagaaagatgatggtgaagaagaagaagttgatgaaaaggctccatcaatgggtggtaaatcggtaagtattccatttgagcaaccagaattgaaagaaggtcaaaaatgtgttaaatgggatagaaaagcagttacttactgtatgtttggtagatcttattag

SEQ ID NO: 4065 - DNA, 1062 bp, Candida albicans
gttttatatattacttttcatattatgatgtcttccgttagaactattactacaactagattattatccactactccaatcaaagcaactgcgtcttcacaaacaccacgtcatttgatcaatatagctcaattaaccaatgatgaattttcttcattgataaataaagcttatcaatttaaacaattggtcaaatcagataaaccatcaattgaaaatcatcaaaaattgttaggtaaattagtggctttattattcacaaaaagatctactagaactagaataagtactgaaggagcggcatcattttttggagctcagccaatgtttttaggtaaagatgatattcaattaggtgttaatgaatcaatgtatgatacgacaaaagtgattagttcaatgacgtcgtgtatttttgctcgtgttaacaaacatcaagatattttagatttatgtcaacatagttctgttcctattgtcaattcattatgtgataaatatcatccattacaagccattgctgatttattaaccataaaggaacaatttggtgataatttaaaggggttaaaattaacatggattggtgatgctaataatgttattaatgatttatcgattgcttgtttgaaattaggtataaatgtatctatttcaatacctaaagatattacatttgatcaagatgtagttgaaatagctgaaaaattagctaaagaacaaaatttgacatttgaaattgttaatgatccaataattgctttaaataatgctaatattgttgtcactgatacttggatttctatgggtgaagaagaacaaaaattggctaaattgaaacaatttcaaggttatcaaattactcaagaaatgtgtaaattgggtaaagtcaattcaaattggaaatttatgcattgtttaccaagacaccaagaagaagttgctgatgatgtgttttatagtgataattcagtggtttttgaagaagctgaaaatagattatatgctgctatggctgtgattgatggatttgtcatcaataaaggtgacctcttgaaataa

SEQ ID NO: 4066 - DNA, 1275 bp, Candida albicans
ataactatcccaatttccaatcaagagtgtttttatgtcagaccctctgctacgaaaccaatttcaacaattacaacaacaacaacagcaaaaacaactaggatacaacaccaaagttacctgacaatggttgcaccagctttaatttattccaatcatgaactttctacggcaattgattcaactcatgcttttgaaggtccagaaaaattacttgaaatctggttctatgaatccaaagaattatcaccaatcaatttaagagatattaaatttgatacttggatcgaaattttgaatttagttcattgtgaagtcctttctaaagtttcttcaaatttatgtgatgcatttttattaagtgaatcatcattatttgttttccctcataaaatcattttgaaaacttgtggtactactactacgttagcttgtttagatttattatttgaaactgtgaacaaagaattattacaaaacgaggggttgaaggcaactttccaaagtaaaaatatttatcaaattttttattctcgtcgttcattcatgttcccagatcgtcaaatccatgttcatgggaattggcaagaagaagtcaaattattgaatcaatatttcaataatggtaaaagttatattgtgggtaataataccaattggcatctttacgttggaggtaatggtaagactaagaaccccgttgcctctacaacaacaacaacaacaactccagtggtcaatgattgtactttagaaatcattatgactcaattatctttagaagctagtcaacaattttatactactagaaagcctggtgatactgccattgattcaaatcacgatttaggtcatgatttgggccaagaaatacttaaacaaactggattaaatgaattattcaaattcaaaaagcaaccaactatgcccggtttaagttcatctccaattaaagaaattcacgatggatttgctttcactccatgtggattttctagtaattcaattaatgaatcaaattattatacgattcatgtcactccagaaccaggttggagttatgcatcatttgaaactaatatgattggtgattataaggctattgttgataaatgtattaatgttttccaacctggtcaattcatggtgacttttttaactaatactgatatggaaaaatttgaatgttgtttagatgattataaagttaatcatcgtgaagaattagatgttgaagattataaattgtattttgttgaaattgttcgtcaataa

SEQ ID NO: 4067 - DNA, 1017 bp, Candida albicans
  unsure (4): Identity of nucleotide sequences at the above locations are unknown.
ctangaagaattattgcatgtcttgatgttagaactaatgatgatggtgatttagtggtcactaaaggtgatcaatataatgttcgagaacaattatcatcatcatcaactaacgaatctgccgaggaggattcttcacaggttcgtaatttaggtaaaccagttgaattagcaacaaaatattataatcaaggagctgatgaaattacatttttaaatatcacatctttccgtaattctcctttaaaagatttacccatgttacaagtattgaaaaaagctgctgaaactatatttgttccattgactgttggtggaggtattaaagatttatatgatccagaaactgggaaaactgttcctgctgttgatgtggctcatttatatttccaatcaggtgctgataaaattagtattggatctgatgccgttaccattgccgaaaattattatgccaataatggggaaattaccggtctttcatcaattgaaaccatttcttccaaatttggtaatcaagcagttgttatatcagttgatcctaaaagaaaatatatcaaagatccaacaactgaaactactactatgcaaacaataaaaatcactgatccttcacaatatggtccaaatggtgaacaatattgttattatcaagtaacttctcaaggtggaaggaaaattcatgaattaggtgcattagaattatgtttagcttgtgaaaaattgggagctggagaaattttattaaattcaatcgatcatgatggttccaataaaggatttaatttacaattattacaacaaattaaatctcaagtttcaatccccgtgattgctagtagtggtgctggtaatcctcaacatttccaacaagtatttgaaatggattgtggaattgatgctgctttaggtgctggtttgtttcatcgtggtgaatataccgttaatcaagtaaagaaatatttacaacaagaagcaaaaatggatgttagattagatgaagatttggagttgtaa

SEQ ID NO: 4068 - DNA, 645 bp, Candida albicans
  unsure (41): Identity of nucleotide sequences at the above locations are unknown.
caaaatgacacccaagcattgtgctcgattgatatgcctgntggaccgtttgaagttttggtgattgctgactccaacgccgatgctgattttgttgctagtgatttgctatcacaagcagaacatggtgttgattctcaggtcattcttattggggttggtttgagcgatgaaaagttgaatgagttccaagctgcagtggagagacaagctaaagtgttgccaagaaaggatattgttgctaaatgcttggctcattcgtatattttattggctaaaacctacaaggaagcatttgatttgtcaaaccagtatgcacctgaacatttgattttacaaatcgatgatgcaccatcgtatgttcctgatctgattgagaatgccggttcagtatttgttggtgcattgtctcctgaatcgtgtggtgattactcaagtgggacgaaccatactttgccaacttatggttatgccagacaatattctggagtcaatactgctactttccagaagtttattacttcccaagaggttactgaaaaaggtcttcagaatatcggtaaagcagtcatggagttggcaagagttgaagggttagaagctcatagaagagcagtagatgattcgaatggagaccatggctga

SEQ ID NO: 4069 - DNA, 549 bp, Candida albicans
  unsure (505): Identity of nucleotide sequences at the above locations are unknown.
gatcgatttccttccggctgtcaatacaagattttgggtccaggcaatcaatttgttactgctgccaagatgtatgttcaaaatgacacccaagcattgtgctctattgatatgcctgctggtccgtctgaagttttggtgattgctgactctaacgccgatgctgattttgttgctagtgatttgctttcacaagctgaacatggtgttgattctcaggtcattcttattggggttggtttgagcgatgaaaagttgaatgagttccaagctgcagtggagagacaagctaaagtgttgccaagaaaggatattgttgctaaatgcttggctcattcgtatattttattggctaaaacctacaaggaagcatttgatttgtcaaaccagtatgcacctgaacatttgattttacaaatcgatgatgcaccatcgtatgttcctgatctgattgagaatgccggttcagtatttgttggtgcattgtctcctgaaaaattcccgnttgggtttttgggggtgattactcaagtgggacgaaccatactt

SEQ ID NO: 4070 - DNA, 603 bp, Candida albicans
agacaaaactacgttccagtgattccaagcacaaaattgactgtcaaacgtcaagaagagaacaagatatcaatttctgcagtgtttgttagtactttgactaccgacagaccagatgggttgtacactacattaatcacaaccccttcaccttcctatacagctttgggtatagtatattcgtccaaggactcgataattgctgcaattgaagaaaaagttggggtttaccaatcacgtaaacgcagagacgaattgtggtacaagggcaagaccagtggtgcaacacaaaagttggtaaagttatccaaggattgtgactctgatgtgattcagtttatggtggagccacgaactgggtatgggttctgtcaccgtgaaaccaaattcacatgttttggtgacgatattgccgactctccagctagaggattgccgaaattagatagtactttgcaagacagattggaaaatgcacctgaagggtcctacactaaacgtttatttgatgacgagaaactattgattgccaagttgaaggaagagttggatgaattgattgaggctaaatcaaaggaagaaattgcctgggcagtgtgctga

SEQ ID NO: 4071 - DNA, 486 bp, Candida albicans
  unsure (456): Identity of nucleotide sequences at the above locations are unknown.
ttgaggctaaatcaaaggaagaaattgcctgggcagtgtgctgatttggtttattttgccatggtttggtgtatcaaacacggggtgagattggctgatattgagaagaatttggatgtaaagtccttgaaggtttcaagaagaaaaggcgatgccaagccccaataccaagaagctcctgtaaatagcagttacaagctagagattgttagtgttgacgatgctgctgctgttgagcgtgcaatgacaagacctgtacaaaagactgcagacattatgaaactcgtgcttcctattattgaaaaagtcaagtctgatggagacaaagcacttattgagttgacttccaagtttgatggtgtaaaacttgatgctcctgttttacaagctccgttcccggctgatttgatggatatttcagaagatatgaaggctgccattgacttgtccatgcanaatatccaaaagttccatgctgcacaattt

SEQ ID NO: 4072 - DNA, 396 bp, Candida albicans
gaattgactcattttgattattacgcaaccattgaaattttttatttttttttggtgaagatttttcccacacaacttcttcttttacttaaccaccaactaccgataatggatttagtcaatcatttaccagaccgtttgttatttgctgttcctaaaaagggcagattatacgaaaaatgctgtaacttattgagtggtgccgatatacagtttagaagatctaatagattagatatagcactttctacaaacttgccaattgcattaatcttcttgcctgcagctgatatcccagttttcgttggagaaggtaattgtgacttgggtataactgggttagaacaaatcaaaaaaactgaacaattcgacaacatcgaagactggttggatttg

SEQ ID NO: 4073 - DNA, 471 bp, Candida albicans
gtggtggaagatagatatgtcggtggttccgttgaggcttcttgtgccttgggtgttgctgatgctattgtcgatttggttgaaagtggtgaaactatgaaagcagctgggttaaaggccatagaaaccatattggagacttcggctcatttgatttcgtcaaaaaaaagtaaattcccagaaatggtcaatataatcgtccaaagacttcaaggtgttttagctgcccaggaatatgtcttgtgtaactacaatgccccaaaatccatccaagcaaaatgtttaaccattactccaggcagaagggccgctactgtctctactttggacaaacacagcgacgacgaagaggactgggttgccatctcatccatggttaatagaaaggaaatcggtaatgtaatggacgaattgaagaaagctggtgcaaccgatatattggtactcgagatatcaaattgtagagtttaa

SEQ ID NO: 4074 - DNA, 957 bp, Candida albicans
atgcacacacatcattcacacagtggtgactatgtatctcatgcagtggacactttaaatgatatggtagaactctactataaaaagggatttcaaataatatgtttaactgaacatatgccacgattagacaacaaatatttgtatcctgaagaaattgacaaatcctacactatagacaatttgaatggtgactttacaagatacttaaatcatgcccgtgatttacaattgaaatatgccactaaagataagagtagtagtgggaatatgaaaataattattgggtttgaagttgaaggaataaacatagatcatataaattattcacaagagttattgaataaagtgcagatgagtgttggatcagttcattttgttaatgaaatccccattgatttcaataaggaattatggcttaaggcaagagaatccactaaaagtaagacaactcgtgaattgtataatgattattttgaattacaatataaagttataacacaattgaaacctaccgttgtgggacattttgatttgattcgattattacaaccagaagatgatatcgatccaactactggtaaactaactaaagatgtcaatttagaaattgattggcctgatatttggcaattggttattagaaatatcaaatttgttaaactgtatggtgggttgtttgaacttaattcttctgccttgaggaaaggttgggatacaccatatccaaaacgagatattgccaatgctatcattgaatatggtgattccaggttttgtttatccgatgatgcccattcattatcacaagtaggtatattttattcaaaagcttgggaatatgttgaatcattgggtatggaaaatatctatcatttggatctagatgataatggagaagtggtaataagttctaaaaaaatacaagagctcaacaattctctattttggaaatag

SEQ ID NO: 4075 - DNA, 474 bp, Candida albicans
ctcaaatttcatagacacttttcttttcttttttggttagccctaacaattctttcattattgacaatgtttgacattagtgctattattcgtccaaatattttaaccttggaaccatatcgctgtgctagagatgattttaagaccgggattttgctagatgcaaatgaaaatactcatggaccagctcttccttccccagatgcaaatgaagctgcattggaattgaatagatatccagatcctcaccaacatgaattaaagcaacagatcattcagtttagagaacaacacccaaacaagtatgcaacagaaaaactatcaattgaaaacttgtgccttggtgttggatctgacgaaagtatagacatgttattgcgttgtgtctgtgttccaggaaaagacaaaatgttgatttgccctccaacatatggaatgtatttcttcgaccacgggctggaaaatcccgcgcta

SEQ ID NO: 4076 - DNA, 324 bp, Candida albicans
tggataattatgtttccaaaattgttgaacatgagagaattagtattagaaaaattattgagtttaaagtacgttgggagaaatattggcggattggattcaaatttcatattgattgaaattttggataaagacggtaaaccatcaaatgatgttgctaaaaaattatacaacaccttggctacagacaactcggtagtggttagatatagaggatctgaattgaattgtgttggtggtttaagaatttccattggaactgcagaagaaaacaaacagttgttgaccaaatttgaatctgttttaaatgaaattaataagtag

SEQ ID NO: 4077 - DNA, 432 bp, Candida albicans
gagatcttcaaacttggcgaaactggaatttcgattgggaaattggagggagatgccaaatttagtcaggttaatacaaatatcattttatttcatgaagaatataccattactgatatacctaaagacagacaaattttacagtactcgatttctagcaacaaaaagggctcaaataagttcagagagatattgcccaaaatcaaaatagacttgccgtgtaccattttatgtgatacaggacgtgatctaagtgttggtatggctttggtgctattgtgtttaaattttgatttgaactggtgtccgactacaacccctccaacagtgacgaaaactctaatcaagcaacatttgagtaagatttcgcaaatatgcaaagtcaatcccagtagaagcactcttcaaagtgtaaacacctttttattttag

SEQ ID NO: 4078 - DNA, 216 bp, Candida albicans
gagtgtagctgcggtccttccagccgcgtggtgaagaatgttccgttaaacgatagattagacacatgtgatttcaagtcaacagatgggcataccaatgtgtggtctttttctttgcgtagattgaacttgcatcttttgcctattatttcagagcatggtggtgtcgtgatacttgattctacaagaagggggaaactaatgcccgatgcgtag

SEQ ID NO: 4079 - DNA, 408 bp, Candida albicans
ctgaaaacaattcccatttggtgtgctgtgtcgaattctgtcatttatggaaccggcgattggctaagaaccccgtctagtatggtctcaaaaagtgaacataactcgatcgacaaattgattccatcgtttgtggcatcagtaatacagattaagttgcttgaagggttcaaactatacaagcccctaattccctcttggtactatcccggggctagcttgaatagcaatttggtcgaatcggcgtacaatatctgttgcatctctgcatccagaaaacttgatgtgcacaatcgaattgacatcacaactggtactggtactatttcgtgtgattgcatccaaggctcggctgatgatcatgagttattggtgccttcatcattgtgcaatgggaagtatggagct

SEQ ID NO: 4080 - DNA, 1545 bp, Candida albicans
aaaaaaaaatctttgcaaaaaaattttcatcacatctccatgatcaaacgactactcatgactgccaccaagcccaaaaaaggaaaagctcaagactttgtattgaaaacaccaaagggtaccaaagactgggcagacaaagatatggtcctcagagaggccatcttcgggacattatcgactctattcaaaaagcacggtggtgtaaccatcgacacacccgttttcgaattgagagaaatattgactggaaaatacggtgaagactcgaaattgatctacaacttagaagaccaaggtggagaactcacttccttgagatacgacttgactgttccgttcgccagattcgtcgcatgcaacaatatcgccagcatcaagagataccacattgccaaagtctacagaagagaccagccagccatgaccaaagggagaatgagagagttttaccaatgcgatttcgatattgccggaaactacgacacaatggtccccgactcagaaatcttggcattattgtgtgatgggttaaatggattgggaatccaagactttaaagtgaaactcaaccatagaaaaattttagatggtatcttccaagcatgtggggttaaagaagaagatgtgagaaagatttcctctgcagtcgacaaactcgacaaatcgccatgggaagtggtcaaaaaagaaatggtcgtcgaaaaaggtcaaccagaagaagtcgccgacaagatcggtgagtttgtcaaacacaacgggtcaattcgtgaggtgttggagtacttgcaatcgagtgaaatcctcaagtccaacgactcagcacaaaaaggaatcgaggaaatgcaaatcttggccgactacgttgacgcattcgatatcacccaatacttgtcgttcgacttgtcattggctagagggttggactactatactggtttaatctacgaagctgttactgccgcctcagcaccaccagaaaacgctaccgaattaaaagctaaatccaaagacgacgacgcatcggcatatgtcggtgtcgggtccatcgctgctggtggccgttacgacaatttagtgggtatgttctccaacggtaaatccatcccttgtgttggtgtatcgtttggtgttgagagattattctccatcatcaagaaccgtgccaatctcaacaacatctccgccaaccacactgacgtgtttgttatggcatttggcggcggcgaaggctggaacgggttcttaaaagaaagaatggaaatcaccaacaagttatggaaagctgggatcaacgccgagtacttgtacaaatccaaagccaacattcgtaaacaattcgatgccgccgaaaaggccggcgccaaattagctgtcattcttggtaaagaagagtacccacaaggccaattacgaatcaaagtgttgggccagggagaggaaaacgaaggtgagttggtcaccaaagatgaactacttgctgctgtccaggccaagctcagctctgacatcgacgacatttctcgcataatcaagggtctttag

SEQ ID NO: 4081 - DNA, 1074 bp, Candida albicans
cgcggacatagctcccgcgtggtgtcacataaacgaattatcattgatgtagactttagaatacgagtcagaagagaccatattgtgcaagactcgttgcagtacattaaaacaaactcagataacttgaagaaaagtctacgggttcaatttgccaatgagcccggtgtggatgctggtggtttaaaaaaggagtggtttttgctattgacaaaagagattttccatccccagtcaggaatgtttcataatgttgatgactcgaattttctatggttcaacatcataccggttgagaacccagatatgtattatctttttggtgcaatattgggattggccatatataactcgaccatactagatttgcaatttccgatcgctttgtacaaaattttgctcaaaaggggattggatagagatgactacagaaaattgtaccccgtgtcttataagaatttaataaacttgaaatctatgtccaacaaggagatattagacttggatttgacatttgaagtcagctatagcgatatgtttgggaagaatcacacaacagaattggtcaccaacggagcaaatatacaagtcaccaaatcaaacttggaagagtatattgacaagtatactgggtttttcatgaaagatggaattgcaaaacaggttgatgcatttattacaggtttcaataatgtcattggacgtaatgctttgtcgttgtttctgccagaagagattcagttactattgtgtggtaacgatgatcatagaatagatgtcgatgttctaaaatctgtcacaaagtatattgggtggagatccagtgaaaaagccgtggactccaagattataacctggttctgggatcattttgaacaaatgagcaataacgaaagaaaaaaactattgattttcataactgggtccaaaccaattcccgcacccggtttacagaaaccaccattccaaaatagtttacctaataatgggcccgaaagtcctagaattaccattggccatacatgtttcacagaatttggctttaaccacctacgcccgaaagaaaaaccttgg

SEQ ID NO: 4082 - DNA, 702 bp, Candida albicans
attatggctcctaatatatctacatcaaggagcaacaacaatactaccaccatcaacgttaaagttgttgctgctgaatcattatataaacgagatgtattccgtcaaccagatccatttgccgtgttgacagttgatggatcacaaactaaaactaccattactgctaaaaaaacattaaatccttattggaatgaaactttcaatttccaagctaaagaagattctatattagttatacaagtatttgatcaaaaaaaatttaaaaagaaagatcaaggatttcttggtgttattaatgttagaattggtgatgttattgatttgtctttaaatagttcggaagaaactataactagagatttgaaaaaatctaatgaaaatttagcggtatcggggaaaatcattgttgtgatatctcataatagaaattccaatggaggaggggtaaccacagccactactagaggtactggtgcttcatcatccaataatattgctacaattactagcggtgttaataatctacgcataggttcagctactagtagtgcaaactccacagcacatgcatcttctgatgcaactgttggtgctaatggatcaggtccaacatgttcattgcatccaataggacaaggacacccagaaattgcggccaccccatggaggagcagctggtgcagctggagcagcatttag

SEQ ID NO: 4083 - DNA, 267 bp, Candida albicans
gacaaggacacccagaaattgcggccaccccatggaggagcagctggtgcagctggagcagcatttagacaatattcatcttttgaagatcaatatggtagattaccacctggttgggaacgtagaactgataattttggtagaacttattatgttgatcacaattctagaactacaacttggcaacgtccagctttacatcaatcagaaactgaaagaggccaacaaagacaatcagaagttcaccacggccatggaagatccgca

SEQ ID NO: 4084 - DNA, 1395 bp, Candida albicans
  unsure (68),(73): Identity of nucleotide sequences at the above locations are unknown.
ggacgtccgtattttgtgaatcataatattggaacaacaacttgggtgatcccaggacgaccacattnttttnggacatttggtcctaataccagtattcaacaacaaccagtgagtcaattgggtccgttactttcaggttgggaaatgagattaaccaatactgctcgagtatattttgttgatcataataccaagaccactacatgggatgatccaagattaccatcatcattggatcaaaatgtcccacaatataaacgtgatttcagaagaaaagtcatttatttccgttcacaaccagcattaagaatattaccgggacaatgtcatattaaagtaagaagagatcatatatttgaagattcatatcaagaaattatgagacaaacccctgaagatttgaagaagagattaatgattaaatttgatggtgaagaagggttagattatggtggtgtttctcgtgaattctttttcttattatctcatgatatgtttaatccgttttattgtttatttgaatattcatctcatgataattatacattacaaatcaatcctaattccggtattaatcctgaacatttaaattatttcaaatttattggtcgtgttgttggattaggggtattccatagaagattcttggatgctttctttgttggagcattatataaaatgatgttacataaaaaagttgtgctacaagatatggaaggggttgatgctgaattctatcgatcattaaaatggattttagataatgatataactggtatattagattcgacgtttagtgctgaagaagaaagttttggagaaattgttgaagttgatttaaaacctggtggtagagatattgaagtgactgaagaaaataaacatgaatatgttgaattaataactgaatggagaataagtaaacgagtggaagaacaattcaaagcatttattgatgggttcaatgaattaatacctcaagaattggttaatgtatttgatgaacgtgaattagaattattaattggtggattagcggaaattgattgtgaagattggaaaaaacatactgattatcgtggttatcaagaaaatgatcaagttattcaatggttttggaaatgtattaatgaatgggattcagaacaaaaggcaagattattacaatttacaacggggacttcccgtataccagttaatggtttcaaagatttacaaggtagtgatggaccaagaagatttactattgaaaaagctggtgaagctaatcaattgcccaaatctcatacatgtttcaatagagttgatttaccaccttatactgattatgaaagtttgaaacaaaaattaacattggcagttgaagaaacagttggatttggacaagaatag

SEQ ID NO: 4085 - DNA, 333 bp, Candida albicans
ataatcgacttgattcctaatggtagaaatattcctgttactgaagagaataaaaacgagtacgttaagaaagttgttgaatatagattgcaaacatctgttgaagaacaaatggagaattttttgattgggttccatgaaattatccccaaggacttggttgccatttttgatgaaaaggaattacaactattgatttctggggttgcccgaatattgatgtttccgaatgggcaaaatcctactttcctacaacaattaatctcctccgttcgctccaaatacaaatggtcctggagaaccgtccaatccattggaacaggaagatataac

SEQ ID NO: 4086 - DNA, 465 bp, Candida albicans
agagaattccatgatggatctttcagtttaaaattgggttcaataggaacaaaatcccaattttttgtccagcttaaaccggatggtttaattggggaaatgttattctttcatacttttaaagcatctccacaacaattaagattagatatagtggctgatataagaaacatcaactcaatgtctatgcctgcatctaaagctggtatgattattttgggaggtggattgatcacacatcatatttgtaatgcctgtttgatgagaaatggtgctgattatgctgtttatatcaacactggacaagaatttgatggatctgatgctggtgctagaccagatgaagctatttcatgggggaaaataaaggctgaagcaaaatcagtgaaagtttatgccgatgtaagtttagtatttcctttaatagtcgctgctacttttgctagtgaaaagccacagaattga

SEQ ID NO: 4087 - DNA, 630 bp, Candida albicans
ccaaagatggttgaaaaaaaaaattttcaatttctcactatcaatagttggcatttgtaccataactccacatttcaactaataatgagtggttcaggaaaattaccaggtttggcctctgatgccgtattaaaacaatctattccagtcccagaagatttccaagaagttaaggggattgactattctcaagacaatgcctataatatgagagcaaaagatttaatcaaatctatgtcaaccatgggatttcaagcatcatcattatcacaagcttgtgatattattgataatatgagatcttggagaggtaaacataaggatacattagaagaacatgaacaaactggtgaatttgatgatgaaggttatcaaaaaaccacgatattcatgggttatacatccaatttgatttcatcgggattaagagatactttacgttatttggtacaacataaaatggtgagtgctattgttgctagtgcaggaggggtagaagaagatttacttaaagttttagcaccaacttatatgggagattttactttacctggtaaaggattacgtgatcaaggaatgaatagaattggcaatttgctagttcgtattcgaccacggggcttgaaaagt

SEQ ID NO: 4088 - DNA, 1527 bp, Candida albicans
tcggagaaaaagaaatgttcagatctgaatgaatattctgaagttggaatctactgttctgtcttttttttccacttgcctcgttttttttttcacgccaagtttcctatttattattcattctttttttatccatttttctacatttttcctttgattttgttattatcaacaagcctagttaataaacaagttacacatatagctatggcggaaactgaattaaagaatttacaagaatgcaagaccattggtataattggtcttggggatatgggttacttgtacgccaaacgctttagcgatgctgggtggaaagttgttgggtgtgatagggaagacttgtatgaaaccactaaagcaaagtttgccgatgaaaagtttgaaatattgagaaatgggcattttgtatcgagaatttcagattacattatttacagtgttgaagcagaaaatattgaaaaaattgtgtcaatctatggtccctcaaccaaatttggggcaatagtgggtggacaaacatcatgtaaggcaccagagatagcagcatttgaaaaacatttgcctgaagataatgaaattatttcccttcattcactacatggacccaaagtgaacactacgggacaacccttagtgttgataaagcatcgtgccactgacaaatcgtttgaatttgtggaagctttagtttcgtgtttgaactcgaaacaagtgtacttgacggctaaagaacatgatagaataacagcagatacccaagcagtgacacatgctgcgtttttatccatgggagtcgcgtggaaactggtgaatcaatatccatgggagacaccgagatggatagggggtattgagaacgcaaagataaatatctcattaagaatattttcaaataaatggcacgtttacgctggcttagcaataactaacccttcagcacatgatcaggtgttacagtattccaagtcaaccacagaactatttaccttaatgatacaaggaaaaaagaaagagttaacagagagattaacaaaagcaaaacaatttgtcttcaaatatattaccaaccatcatgatttgttattggatgacaatatcttgcaaaagttttctttgagcaaaactccaccagaggggaaacaaccaaattcccatttatcgttattggctattgttgatagttggtacaatttaggaattgtcccgtacgaccatataatttgctcgacaccattatttagaatttttttgggggtcactgagtatgtgttttgcactcctgggtatttggaagaaagtatagatgtggctgttaatgatacttcgttcagacaggacgatttaaatttcactattgcagcacaaacttggtccaatatcatcagctttggaaatttcgaattgtacaaacgtgaatttgaagatacccagaattttttccagcctatgttccaagaggcaaatgctatcggtaatgaaatgatcaaaaccatattagaaagagtgaaagaaagagaatgctga

SEQ ID NO: 4089 - DNA, 1113 bp, Candida albicans
atgagtaaaactcctgttcctaccgaatacgacgacacaagaatattgggttacgatcctttagttccaccagccttattacaacacgaaataaaggcatctgccgaatcattggatgttgttataaaaggccgttacgattctgctcaaatccttaagggtaatgatgacagatgtattgtaattgttggtccatgttcaattcacgatcctccacaagccttagaatacggtaaacgtttgaagaaattggctgatgaattaaaagatgacttggtgattatcatgagagcttatttggaaaaaccaagaactaccgttggttggaaaggtttgatcaatgatcctgacgttgacaattcttttgatatcaaccgtgggttgaagatatctcgtcaattatattccgatttgactagtgttgttggattaccaattggatcagaaatgttagacaccatttctccacaatacttttccgatttcttgagttttggggccattggagctagaaccaccgaatcacaattacacagagaattagcttctggtttaagcttcccaattggatttaaaaatggtaccgatggtggtttagccgttgccttggatgccgtgcaagcttcttcaaaaggacatcatttcatgggtgtcaccaaaaacggtatggctgccattaccactactaaaggtaacgattgttgtttcattatattaagaggtggtaaaaaaatcaccaattacgatgttgaatcagttaaagctgctaaagaagccattgccaaatgtaccgatccaagtatcaagttgatggttgattgctctcacgacaactcaagaaaagactacagaaaccaacctcaagtattagacagtgttgccgaacaaataagtaatggtgaagactccattattggggttatgattgaatccaatattcatgaaggtaaacaaccaatgcccccagcaggtagtggtaaagaagcattgaaatacggtgtgtctatcaccgatggatgtgtttcttgggaaaccactgttgaaatgttgaccaaattgagtcaagcagtccaaactagaagaagtttaaagaaacaaaaagtttccaattaa

SEQ ID NO: 4090 - DNA, 537 bp, Candida albicans
caacaatcatttattttactagtccgtggttacgatccattaactcctccagatcttttacaacatgaatacccattaactcctgaatcacagaatattatcgttgaaggtagaaatgctgcttgtgatattttgaacggcaaagacgatagattgattattgttattggaccttgttcgattcatgatcctcaagctgccttggattactgtgaaagattatatcaagcttctgaaaaacacaagggtgaattattgattgttatgaaagcatacttggaaaaaccaagaacctcagttggttggaaaggtttaattaacgacccagatatcgatggtaccttccatataaataaggggttgagaattgccagaaagttgtttgttcaattaacttcaaaattaccaattgctggtgaaatgttggatacaatctcacctcaatttttatctgatatattctcagtgggggctattggtgcaagaaccaccgaatcgcagttgcacagagagttggcatctggattatcattccca

SEQ ID NO: 4091 - DNA, 435 bp, Candida albicans
gggggggacccaaagtgggtccccatttgggcacgggacacccggggggttttttcaattccaaaggtgtacccgaaagaagcctggttcaggaataaggtggatggttttccgggcactttaaaaaagattcagaggaatcccccgaaagtgccccaaattgttgtagcacaagtgcccggcggtgaaaaatccaaacggggattaatgatggagggtaaaaataaaggagggaagacaagatgttccacccaaggaacaaggggtaaagatgcttggaaataccgtgtttctattactgaagcttgtattggttgggaaaccacaggagaagttttggaggttttaagccaatgctgtcaaaaccagaagatctttatagttgattatgtaatcatatttttattaatttcaacaaacaatgatattaaataa

SEQ ID NO: 4092 - DNA, 828 bp, Candida albicans
tcttcctgccggctggctcgaaaacgaattgaaatacgtggtattgatattgaagatttgaaaacaccagaaatttctaaaagaggtgtttcctcctatgatgatcatagagtggctatgtcattttcattattggcaggtttgtgtaaagaacccgttttgattttggaaagatcaaccactggtaagacttggccaggttggtgggatatcttacattccaaatttaagattgagcttgatggttatgaaccaccattcaatactgataaacatgtggataaatctagtgataaaagtatcattgtcattggtatgagaggcactggaaaatctactttatctgaatggttggcttcctttttggggttcaagatgttagatatggacaaatatcttgaagagaaattgggcactggtatcaaatcattgattaaagccaaaggttgggaatatttccgtcaagaagaagcaattgttgctaaagaatgtttcaccaagttttccaaggggtatgtactttccactggtggaggaattgttgaaggtgaagatgccagacagcaattgaaatcttatgctgataatggagggattgttttgcacttgcatcgtgatttagatgaaactgtcactttcttggctgctgatacaaccagacctgcttatagcagtgaagttcaagaagtatggttaagaagagaaaaatggtaccatgaatgttctaactaccacttctattccagtcactgtagtactgaggatgaattcaaccatttgaaaagatcctttgttaactactttaaacttatcatggtgctgaaagac

SEQ ID NO: 4093 - DNA, 801 bp, Candida albicans
acgtctagcgcggatcctggcagtcccgtggtgaagacgcagaatactttaaaaccattgattgctttcaatttaggttctcaaggtaagttgtcacaagtattaaatggaacattcacccctatttcccacaaattacttccaaatgatgaagagttcttaacaatcggcgaattaaatcaaacttattttgatattggaggtttcactgctaaaaaattttgggtcattggttcacccattgaacattcaagatcgccaaatttgcacaatgcagggtataaagcattgaatttgccttaccaatttggcagatttgaagctacagatgttgatgttgtttatgataacttgatcaataaaccagactttggtggtttagccatcactatgccattgaaattggatatcatgaagtttgccactaaactatctgatgcagcagagaccattggagccgtcaacacattgattccaattgaaggcggatattttggtgataacactgattgggtgggtattagtaattctttcataagagcaggtgttccacctaagctgagctcgaatgggttagttgttggtgcaggcggcacttctagagctgccatttatgccttacatcaaatgggatgtgcaaagatttacttggtgaatcgtactgctgctaaattggaggaacttgtcaagtcattccctaaagactataatcttgagattgtcgaaaccgaacaacaagccgataaagcaagtaaagtcctgttggcagtgtcttgtattcctgctgataaaccattagat

SEQ ID NO: 4094 - DNA, 1266 bp, Candida albicans
  unsure (116): Identity of nucleotide sequences at the above locations are unknown.
gttgcatacggtttacctgtgtctattgacgataaagaattcttgaaaaaagtgggaccaaaacgtcattatgttgaaatcgatattttgttgaaaaaaatggccattgacaaganaaatgatggtagtaagattagatgtgtcttgttagagaaaattggtaaatgttaccaattgaaagcacatcaagtatccaaacaagatttaagttttgtgttgactgatgaagtgttggttcacccattcaccaatccacctaaagaaaacataattgttccacctggttccaaatctatctccaatagagcattgattttagctgctttgggtaatggtactgttcgtgtgaaaaatttgttacattcagacgatactaagcatatgttagatgctgttgcttctttaaagggagctgaaatatccactgaagataatggtgaaaccattgtagttaaaggaaatggtggcaacttggtcacatctggcgaagaattgtacttgggtaatgctggtactgcttccagatttttgactactgtagcttcattagtgggcaaatcacaagctagtgatgatgttattttaactggtaacgcaagaatgcaagaaagacctattggaccattagtggatgccttgggatctaatggttctgagattgagtatttgaataagcagggttcattgccattgaaaatcagtgctggcaatggattgaaaggtggaagaatagaattggctgcaacaatctcttcgcagtatgtttcttcaattttaatgtgtgcaccatatgctaaggagccagttactttggctttagtcggaggtaaaccaatttctcaattatacatagatatgacatgtgcaatgatgaaatcatttggtattgaagttaccaaatcaactactgaggaatacacctatcatattccaaaggggacatacaagaatccatctgaatatgtcattgaatcagatgcgtcatctgcaacttatccattagcatttgctgctatgactggaacatcctgtactattccgaacataggttcttcctcattacaaggagatgccaaatttgctgttgatgtgtcgaaaccaatggggtgtaaagttgaacaaaccacaacttcaacaactgtaactggtccgccgagaagtcacttgaaaccattacctcatgttgatatggagccaatgactgatgcatttttgactgcttctgttgttgctgctgttgctaaaggggggtcttctacttcctaa

SEQ ID NO: 4095 - DNA, 1140 bp, Candida albicans
  unsure (34): Identity of nucleotide sequences at the above locations are unknown.
ttaagcgcgtatccgtccagcccggtaggtgaanacaataagagaatacctttagttttgagaaatatgacaacttcgtccaagaatgcattaacaccatatttgaaaaaattggtagtagagccgcctactttagagcctaaagatttgtcagaggcacttgaacttattttcagtgatattccatcagatattcaaactgcagcatttttaagctgtttgaggttgagagggctagatcaggaagctgattatatcgctgctgcagtcacaacagtattgcattttgccaaaaccattcctcctgagttggtggattctaaaggatacatagatattgttgggactggtggtgatggccaaaatacgttcaatgtttctacatcatctgccattgtggctgcgggaatgggtttaccagtatgcaaacatggtgggaaggcctccacttcgtcttcgggatccggtgatttgttaaagtcgttgggtgtggacttgtcgcatgtaaacgaagtcaccacgccggaaatcgttaaaaaatcaaagttttgtttcatatttgcaccttcctttcacccggggatgggcttggttgctcacattagatcacaattgggtgtgcttactattttcaatattttgggaccattaatcaatccaataccgcttagagctagagtcttgggggtgtacagcgaaaagttgggtgaatcttatgcacaagcagcatcgatcttggcaaagaaaaatgaaacacatgaaaagacaatggttgtgtttggagaagttgtccttgatgaaatttcaccaattggatacacaaagacatggacaattgataaaagcggtaaaatcgaacgtaatagaatatcacctaaagattttgggttaccagaacatgatttatccacagtgaaatcaggaacaccgcaacaaaatgccgaaatcttatcacatattttgaatcaagataatgatgaatttaaagtgaagcaagatagcaataaccacccattggttgactatatcttaatgaatagtgcagcagtggctgtagtatcggggatagctgataactgggtagatggtgcgccgtgtcttcacctacgggagatgcccgaccgcgattatgttggggag

SEQ ID NO: 4096 - DNA, 906 bp, Candida albicans
agaaattgctccaaaaaacaagggccaattaagttgggacagaatttcatttctaacattggtcaagaaggttacgaaaaacatgtcaccattttggaagaacatattttagaaggggacattattcaggcagtgctttcacaaagaattgctcgtccaacatcattacatccatttaatatatgtagacatttgagaacagtcaatccatcaccttacttgttttacattgatttattagatttccagatcattggtgcctcaccagaattattggttcaatctgacactaaggggagaattgttactcatcctattgctggtacaatgcctcgtggtaaaaccaacgaagaagacgaagaaaatgctgagattttgagagcaagtttgaaagatagagctgaacatattatgcttgttgatttggcaagaaatgatgtcaatagagtgtgtcaacccaccacaaacaaagttgacaaattattgactattcagagattttctcatgtcatgcatttggtgtctgaagtcagtgggactctacgtgaagatcaaacaagatttgatgcatttagatctatattcccagcagggactgttagtggtgctcctaaagttaaggctatggaattgattgcagaattggaaaaggaaaaaagaggtgtttatgctggtgctgttggccattggggatacgatgggaaaactatggacacttgtatcgcattgcgtaccatggtgtataaagatggtgttgcctatttacaagctggaggtggtattgtctttgatagtgatgaatatgatgaatacattgaaacaatgaataaaatgaaagctaacaacaacaccattgtcgaagcagaaaagatttgggctaacaaagttggtcaattagaggggtaa

SEQ ID NO: 4097 - DNA, 651 bp, Candida albicans
aagtcaaaaactaacagaatcacaatgcagtcacaacttgtgcaaccaacaatcgaaacattgaagaagactattgatgccaatagttctttgaaagaaagtccaaatgtatatccagtatataaatatgtgccatataatgatataactattcatcaagcatatttgaaattagccaacttgaatgattcaaatagaacagaatcatttctttttgaatcctcggttaaaggtgacactgttgatagatattcatttattgggatacaacctaccaaaatcatcaagacaggtgacgatcctaagcaatttgctgatgaattttgtaatgtggatcccataactgttttggaaaaggaattgtctaagtataaacaagcaccattgcctggtttgcctaaattcaatggaggtgccactggatatatatcttatgattgtatcaagtattttgaaccaaaaaccaaacgaccaatgaaagatgttttgggattaccagaagcggttttaatgttttgtgatttggttgtggcttttgaccatgtttaccaaagattccaaatcatttacaacatcaaaatagacgacaatagaggcacaataaatgaagatattgaagattcggcaccacgcgcaaagtatccgcattga

SEQ ID NO: 4098 - DNA, 942 bp, Candida albicans
  unsure (841),(842),(850),(851),(859),(860),(880),(900),(901),(925),(927),(931),(936),(939),(940): Identity of nucleotide sequences at the above locations are unknown.
cgagtaattggaaaaagagaatttcataaatataacaagccgaattttaaatttttcttttggcccaaaggaaagaatggtttttttccaaaatttgaaatgattagatgggtattaaccaaagaagccgaacaatattttcaaaagtggtgccaaccccagaattttaaagttttcgatgaagttttgaaagctttagaaggattgacgatttctcaattgaaagaaaaattaggtccaatgggagctgttggtcaaggtaaggcattcaaatacaaatggttgagtaaagatggtgacaaattgattgcacaagttgaaaaattacctgaagatgttgtattaaacgagttgaaaactattagtgaaaccggaacccttaatgacaagaaggaattaactgaattgaaaaaaagaaaattggtcactttgaccaaaatcgttggttacaaaattgaaaaaggtccaaaatttgctcttgaaattgtgaatttggaaactgatattacatctgatatggtgttgaaccacacttggaaggatgcccaattcaaaccatataatttcaattctgaaggggtttatccaaactctggtgccttacatccattagacaaagttagagaagaatttagacaaatttttttctcaatgggattcaccgaaatgccatcaaaccaatacgtggaaacagggttttggaattttgatactttattcgtccctcaacaacatcctgctagagatttacaagatactttctacttgaaagatcccaaaaaagctggcgaaccagaagataaacaatattgggaaaacattaaacaagtacaccaagaanntaaatatnnttctattnnttacagatacccttcgaaancagaagaatcattgagaatnnttttgagaacacacacaacttttntntctnaaggncannaa

SEQ ID NO: 4099 - DNA, 1080 bp, Candida albicans
  unsure (36): Identity of nucleotide sequences at the above locations are unknown.
cacgccgcttttctttcccctggtggcagagtccgnatgtcattaactgaagcggatattcaaccacaattgactcgtatacgtccaggtcaaagtaaattatctaccccaagagatgaaaaagatttagttgaaatacaaagtggaactgagaatggattaactttgggttcacctattggaatgattgtgagaaataaagatcatcgtcctggtgattatagtgagaccgatttgtatccaagaccaagtcatgccgactggacctatatacagaaatacggaaccaaatctagttctggtggtggtagatcatctgctagagaaactattggtagagttgccgcaggagccattgcagaaaagattttggccaaagtgaataatgttgaaattgttgcctttgtaagtgctattggtgaaatatctatgaataaatctcctcaagatgcaaaattccaagaacttttaaacactatcactagagaacaagtcgatggtgtaggtccaataagatgtccagatgcaaatgtccgtgaagaaatggttaaagtgattgaaaaatatcgtgatgctaaagattccattggtggtgttgtcacttgtgttatcagaaactgtccaattggattaggtgaaccatgtttcgataaattggaagctaaattggctcatgccatgttatcattacccgctaccaaagggtttgaatttggttctggatttgaaggtatcaagatccctggttcaaaacataacgatgcattctattatgatgaaaatttcggaagattaagaactgaaacaaacaatagtggtggtatccaaggaggaatttcaaacggtgaaaacatttatttctcagttgccttcaaatcggctgctactatcagtcaagaacaagaaactgctacttacgatggtaaaagtggtgttttggctgctagaggtagacacgatccaagtgtcaccccaagagcagttccaattgttgaagccatgactgcattagtattatgtgacgaatatatgattcaacaagctagaacttcaactagattattggtgcaagacaattaa

SEQ ID NO: 4100 - DNA, 288 bp, Candida albicans
tatggtgacaaaattttggttgagtcatttccgtttttttttctcattatgagcacactctttgcagttgaaaaaaaaaaaattttgaaaaatttatttttgaacatatcaacatcagttatcaaagataaatcaataacaacaagcaacaacatgtcgtcttttggaacattatttaaagttactacatatggggaatcacactgtaaatcagttgggtgtattgttgatgggtgttcaccaggggtccatcatttcgtcgatgactgcacgaagattatggcggag

SEQ ID NO: 4101 - DNA, 1644 bp, Candida albicans
agacctgccacttgtaatgatagattaaaaattttgggagaaatcgccgattcatttatttatgttgtttctaaaatgggtactactggtgcttcaactaaagtttccacggggatccaagaattatgtgatcgagtaagaaaatatgctggacccgatactccattagccgttggatttggggtttctactagagaacattttttgaccgttggtgaagttgccgatggtgtagttattggatcaaaaattatcactttgattggtgattctaaaccaggtgaaagaggtaaagttgcttatgattacgtccaatctattttaggtaatgacttcaaacctaattatcctaaaacttttgaaagaaataacaataaccaagctaaagaaactaaaccagttttggaagaaaaccacaaatataatccaagattcggtgatttcggtggtcaatatgtccctgaagcattacacacctgtttggctgaattagaaaaaggatttgaagatgccgttgctgatcctgaattttggaaagaatttagagatttatattcatacattggaagaccttcttctttacacaaggcagaaagattatctgaacatgctgggggagcacaaatctggttgaaaagagaagatttgaaccatactggttcccataaaatcaataatgctttggctcaagtgttaattgccaagagattaggtaaaaagaaaatcattgctgaaactggtgctggtcaacatggtgtcgccactgctactgcttgtgccaagtttggattggaatgtactgtattcatgggagctgaagatactagacgtcaagcattgaatgttttcagaatgaaaattttaggtgctaatgttgtcccagttaaaaatgggactcaaactttaagagatgccacttctgaagcttttagattttgggtatctaatttagaaactactcattatgttgttggatcagcaattggtcctcacccatatcctactttggttagaactttccaaagtgtcattggccaagaaaccaaagaacaattcaaagctttaaacaatggtaaattgcccaatgcagttgttgcttgtgttggtggtggttccaactccactggtatgttttccccatttgaaaacgataaagaagttaaattattaggggttgaagccggtggtgatggcttagatactgaacgtcattctgccactttaacagctggtattcctggtgttttccatggggttaagacttatgttttgcaagataatgatggtcaagtccatgatactcattcagtatctgctggtttggattatccaggtgttggtccagaattggcttattggaagagtattggtagagccgagtttgttgctgctactgatgcacaagctttggaagggttcagattattatcacaattggaaggtatcattcctgctttggaaagttctcatgctatttatggtgctgttgaattggctaaaacaatgtctaaagaccaacatattgtcatcaatgtatctggtagaggtgataaagatgttcaatcagttgccgaagtattgcctaaattgggtgaacaaattggctgggacttgagatttgaagaagatccttcaaaagtatag

SEQ ID NO: 4102 - DNA, 1038 bp, Candida albicans
atcatcacaaattattcaacacacgatcagaaaagaatcttgttctttattattaattcttttttcaacttgttttgtttgatatatctcatcagtatgacagtcataacggatccagttgaacaatataatttaattaccaagggtttacaagaaactctcaatgggcaaatcattaaagatgttctagaaaaagaaaatagaccagttaaaatctattggggaacagcaccaactggtaaaccacattgtggttatttcgtgccaatgatcaaattggcccatttcttaaaagctggttgtgaagtcacagtattgttggctgatttgcatgcctttttagataatatgaaggcaccattggaagttgtcaaatatcgtgccaaatactatgaatttgttgttaaagcgattttgaaatcaattaacgtcccaattgaaagattaaagtttgttgttggttcctcataccaaaaaggtggtgattatgtgatggatttatttaaattgtcaaacattgtatcccaaaatgacgccaaaagagctggtgctgatgttgttaaacaagttgccaatccattattgtcggggttgatttatccattgatgcaagctatagacgaagaacatttgggtgttgatgctcagtttggtggtgtagaccaaagaaagatttttgttttagccgaagaaaatttgccaagtattggttataaaaagagggctcatttgatgaatcctatggttcctggtttgggccaaggtggtaagatgagtgcctcggatccaaactccaaaattgatattattgaagaacctaaagttgttaaaaagaaggtcaatagtgcctactgtgcccctggtgagttgaaggataatgggttgattgcatttattgaatacgttatacaaccaattgctgaattgaagactggtgttgaaggagcattcaaattggatatagacagaccagaaaagtatggtggacctttgtcttatgactccatcgaacaattaaaggctgactttgtggatgga

SEQ ID NO: 4103 - DNA, 324 bp, Candida albicans
cgcgtgaatttccagcccgggcgggcatactatggaaaattggctcctccggagttgaaactgggtgttgctgacaagattaatgaattgttggcaccaattagggctgaattcgaatctagtgaagagtttcaagtggcacaaaagaatggttacccagtcgaaaaaccaaaacaagaaaagaaaaagaaagttaagaagataggtactagatatccaggtactgtttctggtggtgattctgctgacactccagcaaactctaatgatggtgaaaaagctgaagaaaagaaatctgcagaagaaaagccaactactgaataa

SEQ ID NO: 4104 - DNA, 1050 bp, Candida albicans
  unsure (1035): Identity of nucleotide sequences at the above locations are unknown.
aaaaaaaattttttagctcaatatattcaagacccgaccaaattcattcatctaggaaatacccaagccatgactactgacagatcatcgaaacgacatgtattaatgattgataattatgattcatttacttggaatttatatcaatatttacatcaatctcctaaatgtggtaaagttgatgtttatagaaatgataaaatcaccatttctcaaatagaaaatgaaattaaacccgatataatttttatttctccaggtccaggacatccattaactgattctggtatatctagagatataatcaaatatttcctgggtaaaatccctatttttggtgtttgtatgggacaagaatgtatatttgatgtatttggtggtgatgtatcatatgctggagaaattgttcatgggaaaacaactactattaagcatgatggtaaaggtatgtttgaaaacgtaccacaatcagtagctgtcacgagatatcattcattagctggtagttctaaatcattacctgatgtattagaagttactgccgttaccgaaactcaaccagaagtgattatgggggttagacataaaaaatatactattgaaggggttcaattccatcctgaatctattttaactgaaagtggacaattaatgattgataatttattaggagtttatggtggtacttgggaagaaaatgatgccattaagactggtaaatcaattaaaattaataataaaaacggaggagaaaatatattacaaaaaatctataaacaaagagaaatagattataaattaattgaaaaattaccaggtaaatcatttgaaaatttacaaattgaattagatttagatcttgctccaccattaataaatttttatgatcgtcttaaatatactcaatctaacttgaaggaaacaattatattatcagaatttaaacgtgcaagtccttcaaaaggggatattaatataaatgcccatcccgctaatcaagcattgacatattctactaatggttgctccactatntctgttttaacttga

SEQ ID NO: 4105 - DNA, 285 bp, Candida albicans
gggggacaactgaggatcccattaattattggagttaacaatcgtaacttgactacttttgatgttgatttaaataccacaagtaatttagtgaaacaagctaaaactagtgatagaaaaggtgatgtattggttcttgcattatcagggataagttcagttgatgatgtgaagaaatacaagtatgaagataatgttgatggatttttaattggagaaagtttaatgagagctgaagaaaaaggtgaagcaggtaaatttttgcatgatttatgtacttgttaa

SEQ ID NO: 4106 - DNA, 723 bp, Candida albicans
cgcggtacttccagccccggggtgaatacaatcatttctgaacacaataatgaaactcgtgtatgtccaaatatcactccaagaacagctaaggctgagatttcatacatcaattcctgtgtaggattggattactcaggtgaagaaatctcaaagttgttgaaaaaaatgtcattagatgctaccccatctactgaagagagagacatactcgatgtgaaaatcccaataacaagatctgatatcttgcaccaatgtgatattatggaggatgtcgctattgggtacgggtacgataatttgaagaagaccaaacctaaggctgaaagtttagttgctgccccattacctgtaaataaagttgctgatattttaaggttggcaagttctcaagctggttatttagaagtcatgcctttgactttatcttctcacgatgagaattttgcttggttgaaacagaaggatgatggtaccaaagctgttaaattggaaaatccaaagacaattgaataccaagttgttagaactactttattacctggtattttaaaaaccgttaaagaaaacagaaaacactcgttaccaatcaaagtatttgaatgtggtgatattgttttgaagaatccagaattagaaagaggtgcttttaaccaacgtaattgggctgccttgtacgtaagtaagacttctggtttcgaaatggtccaacgtttattatga

SEQ ID NO: 4107 - DNA, 258 bp, Candida albicans
aagatcatgcaaaccatgagaactccttggttagaaaatccttctaaggatcaaagaagacgttactggatagaagaagaccaagattaccccactttcttcccaggaagaggagccaagatttatttcagaaatgccgataatgctgaagccaaagctattggaagcattggtgttttgcatccagaagtaatgaataactttgacattccttatgcagcatcgtctgttgaaataaacgctgaagtatttttgtaa

SEQ ID NO: 4108 - DNA, 807 bp, Candida albicans
ctttacacttctacaatgccaactattcctgtagacaaagaagaccttttcaagttattgggtagatcatatactacagaagaattcgacgagttatgtttccaatttggtattgagttagatgaggatactactgaagatgtcaaaggcacagacgaaagaccacaattgaaaattgaagttcctgccaacagatacgatatgttatgtattgagggtattgctcaagctttaaatgaatttttaggtaacacatcagcaccaaattacaaattgagtcctagcaaaccagagatttctttgactattaaagaatcaacctacccaattcgtcaatatgctgccagtgcgattttgagaaacgtgaaccttgatgaaagagcctatgactcttttattgccttacaagataaattacatgcaaatttatgtcgtaacagaactttagtggctattggtactcatgatttagatactttgacaccaccatttacctatgaagccttggcacctaaagatattgttttcaaaccattaaatcaaactaaagaaatcaatggtgaagaattaatggagttctatgaaaaagataagaatattggtaagttcttgcatattattaaggattcgccagtttatcctgtcatgcttgatgccaacagaacagttgcttcgctcccaccaatcatcaatagtgatcactccaaaatcactttaaacaccaagaatgtttggattgatgtcaccggtactgatagaaccaaaactgaaattgttataaaccaattagtggccatgttttcacgt

SEQ ID NO: 4109 - DNA, 801 bp, Candida albicans
atgaaacaaaaagtggattatgctgtagtaccatttgaaaattttactattggacaagttgtttcaacttatgatttattacgtgattggtattttcaaacttcaacaccaccaaaatttagaataattgctgaacaatttgtatctattcatcataatttattaactaatgcttccaaaattgaagacataaaaactatttattctcatcctcaagtatggactcaagttaataaatttttacaaagtttacctcaacaaataacgaaaattgatgttggatcaacttcaaaagcagcagaaatcgtcagtcaagataccatcaccaccagtggtagtagtagtgctgctatttcatcgtatatgagttcagaattgtataaattgccaatattaaaagaaggaattgaagataatcaatccaatactacgaggtttttgatactagggtatgattctccaatatcaccaccaccaccaccagcatctaataatgatgacgataatagcaaaagaaacactaccatagtatcatcaataatgtttactttaaatcatgacgatcctggtgcattatgtgatgttttggttaaatttaaagaatatggtataacattaacatcaattaattctcgaccagcaaatttgaaaccttggcaatatgtatttttcgttgaaatgattggtgatattcatcaagaaggactcgtagaaaaaattaaagagccttgtttagaacttgtgatactaggtgtttttcaaagaagttggaggtataacaacaacagtaatgatcaatag

SEQ ID NO: 4110 - DNA, 948 bp, Candida albicans
acagaccaagcaaaaaaaatttactattatttttgttgtcgtccaaaaatttcttcgattttttttttttttaattctccaattttatggaatattctccacaataaagctattacaattccaacagaaacaacaccagccatggattttatgaaaccagaaactgtgcttgatcttgccaacatccgtcaagcattggtaaggatggaagatactattgtgtttgatttaatcgaaagatctcaatttttcagttccccatcagtttatgaaaagaataaatataatatccccaattttgatggaacttttttggaatgggctttgttacaattggaagttgctcattctcaaatcagacgttatgaagcaccagacgaaactccattttttccagatcaattgaaaactccaattttaccgccaatcaattatcctaaaatattggccaaatattctgatgaaattaatgttaattctgaaataatgaagttttatgttgatgaaatcgtgccgcaagtgagttgtggacaaggagatcaaaaggaaaatttgggttcagcatcaacttgtgatattgaatgtttgcaggctatttccagaagaattcattttggtaaatttgttgctgaagcaaaatatcaaagtgataaaccattatatatcaagttgattttggataaagatgttaaaggaattgaaaattcaattactaatagtgcagttgaacaaaaaattttggaaagattaattgtcaaggctgaaagttatggggtagatccatccttaaaatttggacaaaacgtacaaagcaaagttaagccagaagtaattgcaaaattatataaagattggattattccattgaccaaaaaagttgaaattgattatttgttaagaagattggaagatgaagatgtggagttggttgagaagtataagaagtaa

SEQ ID NO: 4111 - DNA, 1281 bp, Candida albicans
gtttcaccaatgacaaagcaattcaccatagtcattaaacttgggacctcatcccttgtagatgaggttaccagagaaccaagaatagccaacatgtcgcttatagtcgaaacgatggttagactacgccgccagggccacaaaatcgtcattgtctcgtctggggcaattgcatgtggaatgaaacaagttggattagaagaaaaacctgcaaatttatcagcagtgcaggctttggcttctatcggacaagtgcgacttattagaacctttgatgatttattccggcaattagaacaaccgatagcccagattttactcacaagaaacgacataatggacttcactcaatacaagaacgctcaaaatacattgaatgagttgatggatatggggatcattcctatagtcaatgaaaacgatacattatcagtttctgaaatcaagtttggtgataacgatagtttgtcggccatcacagccgggatcattcatgccgattatttgtttctcatgaccgacgtcgagtgtttgtataccgacaacccaagaaccaacccagacgcacaacctatattggtagtcgacaagattgatgatttgcatgtgaagactgataccgagtctggtgctggatctaaagtcgggactggtgggatgaccacgaaattgattgctgccgatttagcaaccaatgctggtgtgaccacgatcataacattatcgagtcaaccatattacattattgatattgttgcccatatacaggctcatgcagatacattatcggttgaaaaccagcgtcttgcgttacaaaaggatatccaacagggtaaaattccattgcatacaagatttttgagcaagccccaagatacattaatcaaatctgatcgcagattctggttattacatggattaaaaactaagggagcattagtcatcgaccaagggtgtttccaagcattgacaagacgtaatcgtgcaggattattaccggttggtatacttcatgttgtggggaattttcaccaaagtgaatgtgtatcgatcaaagttgtccctgataagaatggtgctattgatgatgcagttgaagtgggccattgcagagtaaattacctggccccagaaatcaccctaattaaaggtcataaaagtagtgaaattgaagcaattctaggttatgctgatagtgaatatgtggcacatagagataatttagcattcccaccagtcatgccaccttcaacagattcgttgatctcggatagtttatag

SEQ ID NO: 4112 - DNA, 849 bp, Candida albicans
gtgaaattattaatcaaactttacaaattgaaactgatgttccttcgtgatgctatacaattgattccaagtagagaagatgtggctgatttattgaatcaagataaatatatcgatttagttattcctcgtgggtctaatgaattagttcgaaatattaaatcaaatactaaaatccctgtattgggtcatgctgatgggatttgttcaatttatgttgatgaaaaatttgatattattaaagctaaaaaaattattgttgattcaaaaacaaattatcccgctggttgtaatgctgttgaacaattattaataaattctcatattcctcaacaacaaattattgaaatcttacaaatattaattgctgctaaagttaccattcatgtcactccagaaatcaaacaaatcatttcaagtggtgataatatcaatatcaatatcaagggagacgactatattaaagatgttgaagcggattcatttgataaagaatatctttcatttgatatttcggtgaaattagttgataatgttgatgaagccatcaaacatattaatgaacattcatcaaaacatactgaatgtattattactgaagataaagctattgctgaaaagtttttgaaaagtattgattctgctggtatttattggaatgcatcaacaagatttgctgatggattccggtatggatttggtactgaagtaggtattagtaccaataagatccatgctagaggtcctgtaggattagaaggattaatgagttatcaatatcaattgaaaggtgatggtcgttttcatccacggaggagccgccgatcctccacaataactgtggggggg

SEQ ID NO: 4113 - DNA, 327 bp, Candida albicans
ttagtcaatcactctaccccccctcccctccattcttcctattcaccacaaatcatccccaatatgacagcagaaactatagctaaagctgccaactctgcttttgcctcattgaaaactttaaccaatgatcaaagatcattagctttacaaaaaatccatgatgctttattaaccaacaaggataaaattcttgaatccaataaattagatatggaaaatgcccaatcccaaaatttatcttcatcattaattaaacgattagatttatccaacccggggaaatatgatcttcaccacggggctggaaggtccgacgattgcgtt

SEQ ID NO: 4114 - DNA, 963 bp, Candida albicans
gaagctaagggtacacaagaaaaaccatatgctactccagcttttgcattgtatactcatcctgatgccaaagtatttgtttacaaacaatctgaagaggatgctgaaaaattcgaatacgttgaaatctccgcttctgccttaaagaaagctaaaaaaggtgttgaaggattgaaaaagaaagctgaaaagcaagccaaattagaagaacaaaagaagcaacaacaagccactgccaaattagccgaattagatttatcatcaattgaagaagacaaatcgttaccatcagcccaaaaaattaaaatcagacaattgaaagatcatttggatacaagagtacttgtgcaaggttgggttcatcgtttgagagttcaaaaaggtttagcttttattactttaagagatggcactggttatctccaatgtgttttaactggtgacttggccaaagctaaacaaactcaagaattaactattgaatccactgttgccattaaaggtgttatttccaaattaccagaaggtaaaactgctccgggtggagttgaattgaaagctgaccattatcaaatcattgctttagctccaggtggtgatgaatctttcaccaataaagttcaagaaaacgccgatccaaacttgttattggaccaacgtcatttggccttaagaggtgaatcattgtctgctgtcatgaaagtcagagctgcttacctggctgctattagaagattctttaccgaagaaggtttaactgaagtcactccaccatgtatggtgcaaaaccaagttgaaggtggatccactttattcaaattagactactatggtgaagaagcttacttgacccaatcatctcaattgtacttggaaacctgtttagcatctttgggtgatgtttactgtatccaagaatcattgagcgctgataaatcccacactagaaaaacatttaagtga

SEQ ID NO: 4115 - DNA, 654 bp, Candida albicans
gtgactatactcatattggaagctgaatgggtgttcataacatttgaagacttattgacccatttggaaaaattactttccaagaccattcaatatgttttggaagacccagttgctggaccaattgtcaaacaattgaacccagattttaaagcaccaaaagcgccattcaaaagaatggaatatattgaagccttggattggttgaacgaacacggtattccaaacgaagatggtgaaaaattcaaattcggtgatgacattgctgaagccgctgaaagaaaaatgactgataccattaacgaaccaattttattgactcgtttcccagcagaaatcaaatctttctatatgcaaagatgtaaagatgatccaagagtcactgaatctgtggatgtattgatgccaaatgttggtgaaattactggtggttcaatgagaattgataactatgatgaattaatggctgctcttaagagagaaaacttgaacttggatagttactattggttcactgatgtgcgtaaatacggtagtgctcctcatggtggttacggtattgggttagaaagacaacttgcttacatgttgaacagatacactgtacgtgattgttcattgtacccacgtttcactggaagatgtaagccataa

SEQ ID NO: 4116 - DNA, 564 bp, Candida albicans
agaccagtttttctagagagttgcccgtgtaggaaaacattccccgtgggagaattcaagattccaaaagatggcaaaatggtcaaattacactttaaagaaggtattgccatgttgagagaagctggtaaagaagttgatgatttcgaagatttgtctactgaaaatgaaaaattattgggtaaattggttcgtgaaaaatacgacaccgactttaacattttggacaaattcccacttgccgttagaccattatacaccatgccagattctgaagatccaagatactccaactattatgatttctttatgagaggtgaagaaattttatctggtgctcaacgtattcatgatcctaaattgttaactcaaagaatgaaagaacatgaagttgatccaaatgttccaggtttgaacgattacgttgaggccttcacttacggttgtcctcctcatgctggtggtggtatcggtttagaaagagttgtcatgttattattagacttgaagaatattcgtcgtgcttccttattcccaagagatccaaaacgtttaagaccatag

SEQ ID NO: 4117 - DNA, 1221 bp, Candida albicans
aagaatagtcatttagtaatcaaatatacaccatgcatagaagtattcaatctttctgttagtcatattcttgatttcaaatccctattattcatctttataactctacatatttttttttttgctctagtcattgttaagtcactccataatataactgtgagcaaacacacacactcatatttttttcgtcttgaaatttttttcttcctttataatttttcattccgaaaactcttaatcttttattatagatttcaattaccaacacaaatgtccgttgaaaagaaagtagaggaattatccattggtgaaaatccagctgcttccattgccaatgaatcagctccagctacgactgccaccaacagcaataatgttgaaggtgaagaagtagttttgggtgaagatggtcaaccattgtccaaaaaagccttgaagaaattattgaaagaaaaagaaaaggctgccaaaaaggctgaaagagaagctcaattggccaaagaaaaagcagctagagaagctgaagcagctaatgatccagctaaagagaattacgggaaattaccacttataaactcatcgactagaaatgctgacgaaaaacgtattcttttcaaagacttgtctgttgccaatgatggggaaactgtaaccttcagagccagagtacacaaaaccagacaacaaggtgccactatggtattcttaacattaagacaacaatctgaattgatccaagctttgttgaagactaacaaagatactgatgcaactgcagtctccaaacaaatggttaaatggactggctctatcaatttggaatctattgttttagtcgaaggtaaagtagctaaagttgaagaaaaaatcaaatctgccactgttcaagatgttgaaatccttattagcaagatttatactatccaagaaacgccagaacaattaccattgttgattgaagatgcttcaagaagcgaaaaagaatctgaagaattgggattaccaggtgtcaatttagatactagattagatgcaagagttattgacttgagaactccaacaaaccaagccattttcaagattcaatctggtgtttgtcaattgtttagagaattcttgataaagaaggggtttacagaaatccataccccaaagatcattggtgctgcttctgaaggtggttctcatgtcttcgaaattatctacagacggccctga

SEQ ID NO: 4118 - DNA, 372 bp, Candida albicans
aaaactttagatgtggttaataattggttgaatgataaagaaaatgcttcatcatttttggttgctcacgttccaattactgctaatgccaagacaatcactgaagccattaatttgattataaagcaagataaaaccaaatcaatttatttattgactggtgaaaccgataaagttgctcatggatgttatgttagtgatgaagccattgccaagggtattaatgataatgagttggctaaagctgtatcagaatatataggtggtaaagctggtggtaaaggtaacattgttcaaggtatgggtgataaaccacaaggtattaacactgctattgaagaagtaactaaattattcaaagagaaattgtag

SEQ ID NO: 4119 - DNA, 300 bp, Candida albicans
  unsure (16),(136): Identity of nucleotide sequences at the above locations are unknown.
agatctagtgattatnggaagaatcaggtattgttaaaagtattagaggaattgttgctgtttactggacatgatgctcataatgttcaaaaatttgatatggaatttgaacaagatatcgacaatgcttcaagtntaccatttggtgttgctaaagaatctaaatctaaagaattgggagttgcattgaaaaaattatcaatttccgtgttggataaacagagattgactgaaaaattcaataaattggataaatccatcagagataatttgaaggctaaacaaaaagaagaaacctaa

SEQ ID NO: 4120 - DNA, 1452 bp, Candida albicans
atgtcgcatgagtcgcgtcatttgagagacattttttttttttcaagaatttttttttattctctgtcttttttttttttctttcccacattacactcaagaagttactcatcatatttaacacccactttaattttacttattaggtatatgataaagacattgctccgaagaatgtcaagtaataccactataccaaccccaaatggctccaatcattggactgcctcaaaagttagatctacatttttagactatttcaagaaacagcaacacacttatgtcccatcttcatcagttgttcctcacaatgacccaactttattgtttgccaatgctggtatgaatcaatataaaccaatttttttgggaacagttgatccagctagtgattttgctagtttaaaaagagctgccaattctcaaaaatgtattagagctggtggtaaacataacgatttagaagatgttggtagagactcttatcatcatacattttttgaaatgcttggtaattggtcatttggagattatttcaaaaaagaggccattgactattcatgggaattgttgaccaaagtttatggattacaagaagatagattgtatgtcacttattttggtggtgatgaaaaacaaggattagaaccagatttagaagccaaaaatttttggttaaaggttggtgtaccagaggatcatattttaccaggttcagttgaagataatttttgggaaatgggtgatcaaggtccatgtggtccatgtagtgaaatccattatgatagaattgggggtagaaatgcttctgctttagtcaatatggatgaccctaatgtgcttgaagtttggaatgttgttttcattcaatataatcgtgaagctgatgggaacttgcgtacattaccaaacaaacacattgatactggtatgggttttgaaagattggtgtcaattttacaaaacaaatattcaaattatgatactgatgtgtttttaccaattttcgacaaaattagagaaattactggtgttagaccatatacaggaaagtttggtaatgaagataaagatggtatagatactgcttatagagttattgcagatcatgttagaactttgacatttgctatttgtgatggtggtgttcctaacaatgaaggtagaggttatgttttgagaagaattttgagaagaggttctcgttatgttcgtaaatatatgaattatccaattggaggatttttccaacaattggtcgatgttgttattgaacaaaacaaggaaattttcccagaaatttctagtggtgcccaagatttgaaagaaattttgaatgaagaagaattatcatttgccaaaacattagatcgtggtgaaaaattatttgaacaatatgatattcttgcttccaagatcttcacaacgagcatggacggatccgacgaatgc

SEQ ID NO: 4121 - DNA, 531 bp, Candida albicans
  unsure (500),(506),(508): Identity of nucleotide sequences at the above locations are unknown.
gatgctattcctaaaaccaatgacgaatttaaatatggtcttgaaaatgtcaaggctaaagttgttggtatttatgatggttccaagtttgttgattctattgaagatccaagtattcaatatggcatattgttggataaaaccccattctatgctgaacaaggtggtcaagaatatgatactggtaaattagtaattgatggtaaactggaattcaatgttgctaacgttcaagtttatgctggttacgtgttacacactggtaatattgttgatgggaagttaaatgttggtgatgaaattattgctacttatgatgaattaagaagatggccaattagaaataatcacactggtactcatattttgaattttgccttgagagaagtccttggagatggcgttgatcaaaaaggttcattggtagctccagaaaaattgagatttgatttcagtcataaacaagctgttaccgctaaagaattggaacaaattggagncatttntnaatctgtcccacagggctcataa

SEQ ID NO: 4122 - DNA, 444 bp, Candida albicans
atcgtagagtatggaagcaactttttcatcaagaaacaaaaagttaaaaaattttgttcctcactgaaaaatcaaagagtcatctttcaagtgttgtattattctgacgtttccacaatacagtttattagatattttcatagaagtgtttctagagtgatgtccgcaagtagaacaaatattcccttttctagagactccttagaacaaactttaaagagaagatttttctttgccccatcattcgagatttatggtggtgttgcaggattgttcgactttggtcccccaggttgtgcctttcaaaacaatgtcattgatgcttggagaaaacatttcatcttagaagaagacatgttggaagttgaagcaacaatgttgactcctcacgatgttttgaaaacttcaggacacgtcgacagattttcggactggatgtgttaa

SEQ ID NO: 4123 - DNA, 1386 bp, Candida albicans
aggtttgtccttctagccgcctgttggacactttccgtgctgagccatttggttgaagaagttttggaatctagattgaaaggtgataaattggctcgaggtgttaaaattgtcgaagaagaggatgaagacaaaaagaaaagaaagaagaaagtcaaggaaattaagaatgtcaaattagaagacgaagttgttaaagaatatgaatcaattttggctcaaattgatgggttttcaggacctcaattaggtgaattgattgttaagtacgacatcactaacccttctactgggggtaaattagaaccacctgtggaattcaatttgatgtttgacactgccattggaccatcgggaaatttgaagggatacttaagaccagaaaccgctcaaggtcaattcttaaattttaacaaattattggagtttaataatgacaaaatgccatttgcctctgcctccatcggtaaatcattcagaaacgaaattgcaccaagagctggtttgttgagggttcgtgaattcttgatggccgaaattgaacattatgttgaccctgaaagtaaatcacatccaaaattcgaagatgttaaggacatcaaattgaaatttttgccaaaaaatgtccaagaatcgggatcaacagaattaatcgaggaatctattggcaaagctgtatcatctggcatggttgataacgagacattgggttactttattgccagaatctatttgtttttagtcaagattggtgttgacactaatagattgagatttagacaacatatgtctaatgaaatggcacactatgcctctgactgttgggatgctgaactagaaacttcttacggttggattgaatgtgtcggttgtgctgatagatctgcttatgatttgtctgttcattctgccagaactggtgaaaaattggtggccagacaaactttagctgaacctcgtactgttgaaaattttgaaatcgagattgctaaaaagaagtttggacccaaatttagaaaagatgctggtaccgtcgaaaaatggttaacctctagaacccaatgtgaattagaagaattgggtaaagaattaagtgaaaagggtaaaattgttgtccaaattaaaggcgtggaaggcgatgttgaattagatggtgatttaattaagattgacaaagtaaagagaactgaacacgttagagaatttgtacccaacgtcattgaaccttcatttggtatcggacgtatcttatattccatctttgaacaccaattttggtgtagaccagatgatgctgatagaggtgtattgtcacttccaccacttgtggcccctagttttcacacaggcgactgccaggtccaacgcttaagtttacccaacgcc

SEQ ID NO: 4124 - DNA, 1122 bp, Candida albicans
atcaaactgagtagtgcttttgttcctaaaaaacccatcgtggtggtaacgtcaggagaccgcgacatcaaatggaattcacacaatcagtctccgaatttattacccttgaaacttaacttaatgaaagagccttccatcactactacctttgttgaggttacagacaaacttcctacaaagcctccgtgcagggtgtttttcaagaatgagtatgagcagccctccggcagtttcaaattaagaggcatgggacacttggttggccagtctatagatgtggccagaaaacttggcaaatcgaacgtagcagttttttcgtcatctggtggtaatgcaggattagcagctgcttatgccagccagttttttggagtatcgtgcactgtggtgttgcctgaaagttcgaagccaactgttatagaaaagttgaaatccttgggtgcagatgtcattattcatgggaaacattggggagaggccgataactatttaactgattttgttattaaaaatcttgacaaaacagtctatccggtctattgtcacccttttgatgacccattgttgtgggagggtcatagtaagatcatcacggaaatcatcgatcaaaagcaattacccaactttgataaagttaagggggtcatttgttcggtaggagggggtggcttatacaacggaatagttgaaggtttggaaaatcataaggagataccagtgttggcaattgaaactaaacaagcggccacgtttcacgaggcggtcaaagaaggtaaagttgttcatttacaaaaagtgcaaactttggccacttctttggcttcgccgtacctttcttccaaggcattagcaaactatattgagcgtcctacagttcttgctgaaattgatgacttggacgctgttaaaggtgttgttgatgtatacgaccatttcggatatatggttgagcctgcatgtggtgcatccgttgcatcagtgatgcacaggcaagatttattgaataaatttggtacattaagtccagatgatattatcattgttgtcatatgtggtggatcggctatcaacaagtatattatagacgaatatagaagtttattagaaaaagactcttga

SEQ ID NO: 4125 - DNA, 1164 bp, Candida albicans
tttgttttaattaattgggtacttcttcaatacagtttcttttttgtattatcattcattcaacagtttcacctcaacgtttgctacaatttggacttcaacatgtcgacttcaatggatttgcagccatacacaaaattgtcacagccatatattcaaacttcattgactgaagtaacaaacatattacctacaaaaccaccgtgtcgtatttttttcaaaaatgaattggaacaaccatcggggagttttaaattaagaggaattggtcatttagtacataaatcaatagaaaatgcccttaaaaaccatctgaacaaaactattcatgtgtttgcttctagtggtggtaatgctggcttagcagctgcttatctggctcaattttataaagttaaatgtacagttgtattaccaataatttcaaagccagtggtgcaagaaaaattaaaatcttatggtgccagaattgttttgtttgggaatactattaacgaagctgatcaacatttgaaaaatttaatgagttcgattgatttagattcaatttatccagtttattgtcatccttttaataatccattgatttggaatggtcattcctcgttagtcgatgaagtgagtcaacaattggattctaaagatagaaaattgttaaagggaatggtttgttcctttggtggtggcggattatataatggtatctatcaaggtatggttaaaaatcaaattagaggggatattttacttattgaaacacttcaggcaccaacattgactcaatctttagaggctgatgaagtcatcactttgaaatctgtcaattcacttgcaacttcattggcttgttcatacaccactgaacaatcattgaaatactataaagatcaaagtttggttaaatctcaagtggaactcatcgacgatatatattcattaagagcatgtgttgcttttgaaaaatgttttggtaaagttgttgagccagcttgtggagcagcaatggcagttgtttataacaaaattgacttgttgtacaagaattttaaatatttgcaaccagaagatattgttgttattgttgtatgtggcggttcatgtactacagggtctgatcttaaagggtttgaaaaaatgatacagaaatcagaaattaaattatag

SEQ ID NO: 4126 - DNA, 531 bp, Candida albicans
ctagacatgccttcctcatcacaagtttatagatctactagatctagccaaccagaagaattatcctttgaagatgttgttatgactgggttagctcccgatggtggattgtatttaccatcagctatccctcaattacctaaggactttttaagtaaatggactgacttatcatttaatgaattggcatttgagatattaagattatatatcaatgagaatgaaatccctaatgccgatttgaaagatttgattaccagatcatactcaacattcagatcatcagaagtgacaccattgaaaaaacttgatgacaatttatacattttggaattatttcatggtcctacttatgcattcaaagatgttgctttacaatttgtcggtaatctttttgaatatttcttaactagaagaaatgcacaaaaggatttgactaaacaaccaagagatatcattaccgttgttggtgccacctcaggtgatactggatcagctgccatttatgggtcacgtggtaagaaagacgtc

SEQ ID NO: 4127 - DNA, 303 bp, Candida albicans
  unsure (299): Identity of nucleotide sequences at the above locations are unknown.
ctagacatgccttcctcatcacaagtttatagatctactagatctagccaaccagaagaattatcctttgaagatgttgttatgactgggttggcccccgatggaggattgtatttaccatcagctatccctcaattacctaaggactttttaagtaaatgggctgacttatcatttaatgaattggcatttgagatattaagattatatatcaatgagaatgaaatccctaatgccgatttgaaagatttgattaccagatcatactcaacattcagattttccgaaggatcccattnttaa

SEQ ID NO: 4128 - DNA, 1071 bp, Candida albicans
aattcggcgtgggtagcgcggtcattttcagcatcgttggccaattgtggaaagaaagacgtatctgtacttatattatatcctaccggaagaatcagtccaatacaggaagaacaaatgaccactgttgaagatgaaaatgtccatactttatcagtcaatggtacctttgatgattgtcaagatattgtcaaactggtatttggagacaaagaatttaatgataaatatcatgttggggctgtcaactctatcaattgggccagaattttggcacaacaaacatattatttctattcttatttccaattacagaagcaagctaaaactactaataaagtcagatttgttgttccttcaggtaatttcggagatattttggctggttattatgcttacagaatgggattaccagttgacaaattgattattgccactaacgaaaacgacatcttggacagatttataaagtcaggtgaatacgccaaggaacaagaagttggtgtcaaggcaacttattctccagcaatggatattttgatctcatcgaattttgaaagattgttatggtacttaatcagagacaacgctcctgaagttaacaagagtgacgaaaaagccggtcaattattgaatgattggatgaaacagttgaaagaacaaggcaaattcaaagtcccagctgaggtcattgatgctgcaagacaagtttttgattcacaaagagttgataatgacactaccgtacaaaccatcaaacaagtgtatgacaagtctgctgataaatatgtcattgatcctcacactgctgttggtgtcactacttcttattcatttattgctaaagatacagaaccaactcaatacatttctctttccactgctcatccagccaaattctccgaggttgtcaataaggctcttgattcatttgatggctactcatttgacaaagatgtcttgcctgcagaattgaaagccttgagcagtaaagagaagagaattaaattgattgatgaagctagtgttgagaaagtcaaacaagccattaaagatgaattgaaattttag

SEQ ID NO: 4129 - DNA, 1077 bp, Candida albicans
aaaaatttttttgttccacgtaataatcaccatacaaatttaaaccaaacccaccaccacaaccccctaagttacattctagataccatgttagacattaatgcatttctcgttgaaaagggaggtgacccagaaattattaaagcatcccaaaagaaaagaggtgactccgtcgaattagttgatgaaatcatcgccgaatataaagaatgggttaaattaagattcgatttagatgaacacaacaagaaattgaattcagtacaaaaagaaattggtaaaagattcaaagctaaagaagatgctaaagatttaattgctgaaaaggaaaaattgagtaatgaaaaaaaggaaattattgaaaaagaagctgaagccgataagaatttacgtagtaaaatcaatcaagttggtaacatcgttcatgaatcagttgttgattctcaagatgaagaaaacaatgaattggttagaacttggactccagaaaattacaaaaaaccagaacaaattgctgcagctactggtgcaccagccaaattatctcatcatgaagtattgttaagattagatggttacgatccagaaagaggggttagaattgttggtcatcgtggttatttcttaagaaactatggggtatttttgaaccaagctttgatcaactacggtttactgtttttgagtagcaaaggatacgttccattgcaagcaccagttatgatgaataaagaagtcatggctaaaaccgcacaattgtctcaatttgacgaagaattgtataaagtcattgatggtgaagatgaaaaatatttaattgccacttcagaacaaccaattagtgcttaccatgccggtgaatggtttgaatcaccagcagaacaattgccagttcgttatgctggttattcatcatgtttcagaagagaaactggatcacacggtaaagatgcttggggtattttccgtgtccatgcttttgaaaagattgaacaatttgtcttgactgaaccagaaaaatcatgggaagaatttgatagaatgattggatgttcagaagaatttatcattcattag

SEQ ID NO: 4130 - DNA, 774 bp, Candida albicans
atttcggaaaggttgataatttttcagtctaaaagaaacactctgttccttgttttactattttttttttctttaaacaaaagacaatatcaatttatcacgatgtcagtaaagaaagctggagttttgggagctacaggttccgtgggtcaaagatttatattattgttatccaaacacccagaatttgaaatacatgctttgggtgcatcatcaagatctgctggtaagaagtataaagatgcagctagttggaaacaaactgaaacattaccagagacagagcaagacattgttgtacaagaatgtaaaccagaaggtaactttttagaatgtgatgtcgttttttcaggattggatgctgatgttgcaggtgatattgaaaaatcatttgttgaagcaggtttggctgttgtttcaaacgcaaaaaactacagaagagaaaaagacgttccattggtcgtacctattgttaacccagagcatattgatgttgttgaaaataaagtgaaacaagctgtttccaaaggtggcaaaaaaccaggtttcatcatttgtatctccaactgttccactgctggtttagttgcacctttgaaacctttagttgaaaaatttggtcctattgacgcattaacaactaccacattacaggccatttctggtgccgggttttctactggtgtttctggaatggatattttacataacattgttccatacattactggtgaagaagataaattagaatgggaaacccacaaaatattgggg

SEQ ID NO: 4131 - DNA, 324 bp, Candida albicans
  unsure (169): Identity of nucleotide sequences at the above locations are unknown.
attatttcattaagatttgctaatagaccagctccatctgttgaagacgtgaaacaatgtttgagagaatatgaatgtgctgccagtaaattaggctgtcattctgcaccaaagcaaaccatccatgtgttggatcaaccagatagaccacaacctagattagacaggnacagagacagtgggtatggtgtatccgttggtagaattagagaagattcgttgttagactttaaaatggttgttttatcgcacaataccattattggtgctgctggtgctggtattttgattgctgaaattttgaaagcaaagaatattatctag

SEQ ID NO: 4132 - DNA, 1647 bp, Candida albicans
aattatttatcaatgtcacaatccccaactaacgttccaagatcctataattcagttttagaccttaaactcgcctcaccgacaaattctgcttctggtgccactggtggttggattgtccaaaaatttggtggtacttcagtaggtaaattccccgagaatatcgttgataacattgtcaaagtatattctcaaaccaatcgtgttgctgttgtatgttctgctagatcttcacaaacgaaaagtgaaggtaccactagtagattattacgcagtgctgatttggcagaaaacgataaggattatcaaccacttttaaatgccattgaagaagatcatgttaccaatgcagaacgtattcaactggaagaaattaaacaagagttgattaaagatactaaacaagaaattgaacacgttagagaattattacatgcatgtcaaatcattggtgaaattagtcctcgttcattggattcaattatggccgttggagaaaaattgtcttgtttgttcatgactgccttgatgaaagaccatggattgaatgctgtatatataaatttacaagatgtcattcctttgagttatgatttccaaaaagggtttgatgattcattttatcaatttttatcccaagaaattggtaaaagggttttacaatgtgataaagaaagagaagaagaagaagatgttattccagttttaactggttattttggtgttgtacccggtggactattaaatggtgttggtagaggttatactgacttatgtgctgctttagctgctgttgccttacaagctgatgaattacaaatttggaaagaagttgatggtattttcactgctgatcctcgtaaagtccctaatgcaagattattagatagtgttaccccagaggaagctgctgaattgacatattatggttctgaagtgattcacccatttactatggaacaagtcattagagccaaaattcctatcagaataaaaaatgtggaaaatccaactggtaagggaacaattatataccctgataatattggtagaagaagtgaagccactccacctcatcctccagctgcatttgaacaattggccatgagtagtttattacaaagaaaacgttcagccactgccatcactgctaaacaagacattgtggttataaatatccattccaacaaaaaaacattatcacatggatttttagctcatgttttcactacattggataaatataaacttgtggttgatttaatctcaacttcagaagttcatgtatcaatggcattactgatacaactggatcaagaatcacaattgaaacatgcattagttgatttacgtaaaatgggtactgttgatgttactaagaaaatgaccattgtttccttagtaggtaaacaaatggtgaatttcattggtattgctggtaatatgtttaaagtgctagctgatgaaaaaatcaatattgaaatgatatctcaaggagctaatgaaatcaatatttctgctgtcattaatgaaaaagataccattagagcattaaaatccattcatgctaaattattagaaggtggttcagcaattggcgattccctggctgtggatacacgtttggaagcattaaaactactgtag

SEQ ID NO: 4133 - DNA, 633 bp, Candida albicans
cactatacaacaatgtcatctcctcaacaaattgtcaactcattccaacaagccttgaatttatcaggatctccaaatgctgtttttacatcaccaactcaatcattcttgagtcaatatgttccaagcaagccagctaaagctttgaaacctttcaaaactggtgatatcaaaattttattattggaaaatgttaaccaaactgccataaatattttcaaaaaccaaggttaccaagttgaattttataaatcatcattacccgaagatgaattattagagaaaatcaaagatgttcatgccattggtattagatcaaagactaaattaacagaaaaaatccttaaagctgctaaaaacttggtggttattggttgtttctgtattggtaccaatcaagttgatttggaatttgctgccaaatcaggtatcgctgttttcaactctccattttcaaattctagatcagttgctgaattagtcattgctgaaatcattactttggctagacaattgggtgatcgttcaatcgaattgcacactggtacttggaataaagtcagtgccaaatgttgggaaatcagaggtaaaactttgggtattgtaggttatggtcacattggttcccaatta

SEQ ID NO: 4134 - DNA, 183 bp, Candida albicans
agacgaaaactgtcggccatatcttatccaatcataacattgaagaaacaattctccgattctcaaggtgatattgcttacttaatggccgatatttctgatgttgatatcagcgatatacagtcattatatgaacaattagaacaaactccatataaaattgctactcgtttgttgtattaa

SEQ ID NO: 4135 - DNA, 1557 bp, Candida albicans
gaaaaaaaaaagaaacccaataaaaccaccacatctctatatctttcgttaaacaatagacagccaatgacatatacaaacaaaccaccagccttaaaagaagatattttagaacttattggtaatactccattagtcaaattgaacaaaattccacaatcgttgggaattaaagccaaggtctatgccaaagttgaattattcaatgccggaggatcaattaaagatagaattgccaaaaatatggtattggaagccgaaaaacaaggtaaaatcaaaccaggctatactttgattgaaccaacctcaggtaatactggtattggtttggctttggttggtgccgttcgtggatacagaaccatcattaccttaccagaaaaaatgtcaaacgaaaaagtttctgttttgaaagccttaggtgctgaaatcattagaactccaactgaagctgcatgggactctccagaatctcatattggtgttgctaaaaaattggaaaaagaaataccaaactctattattttggaccaatatggtaacccagccaacccagatgctcattattatggtactggttatgaaatttgggaacaaactgaaggtaaaattactcacttggttgctggtgctggtactggtggtaccatcactggtatttccaaatacttgaaagaaaaaaattctaagattcatgttactggtgctgacccaaaaggttctattttagctgaaccagaatctttaaataattccaccgaaggttacttggttgaaggtattggttatgattttattccagatgtgttgaacagaaaatatgttgatgattggatcaaaacagatgatgctgaatcttttaaattggctagaagaattattagagaagaaggtattttggttggtggttcttctggttctgccttacaagctgctttacaagtagctaaagacttgactgaagacgatactgtcgttgttgttttcccagattccatcagatcttacttgtctaaatttgccgatgacgaatggttaatctccaatggattcgaagttgaagattcaccgggtgctaacaaggctgacgaattcttgaatggtaagactatcaaggatttggttgctggcaaagctccagttgtcactgtcactttatctgatacagttgccaagacttttgatttattgcaatccaatgggtttgatcaattgccagttttgaataactctggaagattagttggtttgatcaccttatccaagatattgaaatctttatccactaaaaagattcaaacgaccaattcaatcagttcgatcatcattgatttcagaaagttggctgattttgaaaaatctttcaccatcactaaaaaatcaggattcactaagagaagttatgaaccaatcaagttggacaccccattagctgctttgaataaattctttgaaaccaattcaaatgctataatcacagatgatgaattgaaaccagttcaaattgttactaaggtcgatttgctttcgtatttgactaaaaacgctagtttttaa

SEQ ID NO: 4136 - DNA, 603 bp, Candida albicans
ttgcaagttatgccgacattgaagacaaggtcgcggcaaattaccactcgtgcgatgaatggagaattagattttaatcaatcattagctgaaagagtattgctattaaagggaattgatgcatcatcaatctgggacgagttgaaattgaagatacaagtaacaaatggagtgcctgaattgtgcaaagcattgaaaaaattaaatataataatgggagtttgttcaggagggttcattccgttggctgaatttttaaaggagaaattgggcttagactatgcttttgccaacaccttgggaattgacgattccaatcgtttaaacggtacaaccgttggccctatagtgaatggagaaaaaaaagctgagttattgttagacatagccaagaaacacaaaattgatccactggatgccgttgcagttggagatggtgctaatgatttgaaaatgatgtttgtagctggatttggtattgcttggaatgctaaacctaaagtacagaaacaagctccagcctgcttgaacacaaagagcttatcagacattttgtacattatgggctacaatgataaagaaataaaagagttgatagattag

SEQ ID NO: 4137 - DNA, 738 bp, Candida albicans
  unsure (1),(718): Identity of nucleotide sequences at the above locations are unknown.
nttggggctccccgcgggtctctaaaacagtcgctctctaatctccatgtcaatcccatcagccccgatcccgaaaaggtcactgaaagcggcattgttcacaccattttcaatcatcagacaaatccccttccgactggaactccaaaactggtagcaactatcatttacaagtccgccaatcccgtccatcctcatctccatcccgactcttccccaaatgcgaataggctcccatcccccatggttcctgtaggatccgctccgacggatgatattgagaagctcccacgggagcatccagctccggagccggagccactcgatcatctgtatggtccgttcgtctcccagcagtgtttgaccaacttcctccagattatggaatccctctcgacgccttaccagcgcatgaatacctctcatcgctgtttggatcaagatgatcagccgcgcgtcgtcgaggttactctctctcctccgccgaatcctgagtacctttctttcgaagatcttcgcaaacacgagagcatatggcgcttcgagcgcgaatggaatgtcgaggtggtccttcagaaggaaagcgtcttccgtcgccacaagcgtctggttgtattcgatatggatagcactttgatccagaatgaggtgatcgatgaaattgccaaattcgttggcgttgagaaggaagtttcggttcgtcttcaccacgcgaggntggcaggatcagcgctaacg

SEQ ID NO: 4138 - DNA, 288 bp, Candida albicans
aaaaatatgacatcgaagcgtggatgccaggaagaggttcctgggggagagctcacaagctgttctaattgtggcgattaccaatctcgaagattaggtatacgttataatgatgatcaagaaggtcgtctcaaacacgtgtcaacacttaacggtacatgtatggccgtccctagagtaattgttgcattaattgaacaaaactttaacgcagaaaagaatgaaatttcaataccagaagttttgcagccattcatggatggcaaagataaaatcgttcctaattaa

SEQ ID NO: 4139 - DNA, 1296 bp, Candida albicans
ccatcgtgtgatgggaatgtttctatgttgtgtacaggaaacagaataattcttgttcaattctctactgtgagtgcacgaaagaaaatgacctacaccttacattattctaccaatcgaagtaacatcaaggctaggttatcaagcatgcttaacactatacgtagatacattagcactggcaaaaactcatcaacgttattaagagcacaaatcgacattaatgatattttgagtcgtccaaaagagtatgaatcttcaattcaccgaagacaactaccacaagagttgattgaaaacatcaatttcatcacatcaaatcgaccattacaagcacaattgttttctcaaatcaatgacatgaaaaaagaaagaactatcctagcagagcgtttaaagtcacacgtgggtgatctacaacaattcaaagaaagattgaagcaactcaaatgtgaactaaaaccgttggaaaaacaagtgaaaaccatccaagaaaaaatatacgccaaagccgaatctttgcccaatgttatagacgtaacagtccctacggatcctttgatagaagaagttgtccaatttataaattgccagtctgaagaagatgctaaagtttcaaattcgtcagcagttcatgatcacaaggaaataggagtcaactttaatattttggatttcagtgtggcatctagagtatctggaccgtcttggtactatttaattggagatggtgctttgcttgaacaagcgttaattcaatatgcgctctcaaaagctcgcaggcgtgggtatttgatgcttactccaccttcgattgttaagtcagaaattgttggagcctgtggattcaaaccaaatgatcaaaataatgaaaagcaaatctatgaacttaaaggcgaacacaagtccttgacaggtacagcagagataccattggctgcattccattcttctactgtattcccgagtggcactcaattccccataaaatatgttggtgtatcaagagcataccgcgctgaagcaggggccagtggaaaagatactaagggattgtatagagtgcatgagtttactaaagtcgagttattccattttacaacaaaagagaaggccgcacaagaattagaagatctaaaggatatgcaagtggaaattgtcacggaattgggtctatccgctaaattgttaaatatgccatcatccgatttaggtgcaccagcaatgaaaaaatatgacatcgaagcgtggatgccaggaagaggttcctgggggagagctcacaagctgttctaa

SEQ ID NO: 4140 - DNA, 1194 bp, Candida albicans
tggtttttgtccactggttatttacgtggtttgtttaaacagaaacaaaaaatttttcaatctgcttttttctttcaacaacaacaacagccaacagaattactacccaaccttgttcatatgagcgttacttcatttaaaataaaggttccagcatcatctgctaatataggaccaggattcgacgttttaggtataggcttacaactttatttaaccattactgtcactattgatcctagtattgatacttcatcagatcctcaccatgccttattaagttatgaaggtgatgggaaagttccatttgaatctaatgaaaatttaattactcaaacggcattatatgtaatgagatgtaatggtattaaagatttcccccgaggaactcatattcatgttaataatccaattccattaggtcgaggattaggatcactggcaagtgctattgttgctggagtatatttacgtaatgaaatgggcaatttgaaattacataaatatcgattattagattatcgtcttatgattgaaagacatccagataatattgctgcagctatgcttggaggattcattggatcttatcttaatgagttatcttcagaagattcacaattaacaactgtcccattagactacattttaccaaaagttaaaaatggtgaattgattacgccgcaagataaaatcgtttcacaacaaccaccaaataatattggtcaatatgttgaatataaatggaataaaaaaattaaatgtcttacgataatccctaattttgaattatcaactgatctttctcgttcagtattaccgaaaaattatcaattaccagatattgtttataatttacaaagaattgccattttaactaccgcattaactcaagatcctccaaatcataaagttatttaccaatcaatgaaagataaattacatcaaccttatagatttgggttaattccaggattaaatacagtgttacagaaaataactcccgaaagttatccaggattatgtgggatttgtttatctggtgctggacccacaattttgtgtcttgctactgatggttttgaaaaaattgctaatgatgtgattgaaatatttaaacaagaaggtattgaatgtgattctaaattattagatttagcttatgatggtgcaactgttgaatatggaagttag

SEQ ID NO: 4141 - DNA, 312 bp, Candida albicans
ctatcaacaatgtctgaagttgcagataaagtcaaggacttgtcgttgaaagacaagaaaaagaaacccaccaacccattatacttggaccctcaaccagaattcattgaagaaagaatcaagttgtttgacgaattgaaagctcaatatggcgaggaaattagtaagaaggagaaattgccaatcaaaattacgttaagagatggcacaatcaaagaaggtactgcttacgagacctctcctatggatattgccaactccattggtaaatcgtttgccgaaagaacaagttattgccaaagtcgacggtaa

SEQ ID NO: 4142 - DNA, 813 bp, Candida albicans
actgtccaggccactgtattttgtttaaatcgagagaaagatcatatcgtgaattgccatggcgtgttgccgattttggggttatccacagaaacgagttttcgcggcgcgttatctgggttgacgagagtcagtcgtttccaacaggacgatgcccatattttctgtaccactgatcaaattgggactgagattgctggtgttttcgactttttaaagaaaatgtatggtatttttgggtttgagttcaagatggagttatccaccagaccagaaaagtatgttggtgacttggatacttggaactctgctgaaaagaaattagagcaagccttaaacgatttcttgggtgaaggcaaatgggagttgaaccctggtgacggtgcgttctacggtccaaagatcgatattatgatcagtgatgcgttaaagagatggttccagtgtgccactatccaattggatttccaattgccacagcgttttgagttggagtacaagtccgacaagggtccaaacacgcgtccagtgatgatccacagagccattttggggtcagttgagagaatgactgctattttgaccgagcactacaaaggtaaatggccattctggttgtctccaagacaaattttgattgttccggttggtcctaaatactatgactatgcccaaaaacttcaaaagaagttgaatgacgattactttttctactgtgatgttgatgttagtggtaacaccttgccgaagaagattagaactggtcaaatgtacaactacaattttattttcattgtgaagtcgccaccaccg

SEQ ID NO: 4143 - DNA, 1068 bp, Candida albicans
cccaaaagtgggacggtaagtaggtgggatatgcccacgtcccatagaaaggagatgtacagttgggaattttggaattttgagcatccagaaggtaaggccgtattgtggcactcgtcggcccatatattgggtgaggcttgtgcatgccattatggtgtcaacttgtcgcatggtccaccaaccgaagatgggtttttctacgatatgtcgatcaacaatggtgaaacgtttgttacccaagcagattttggtaatttagaacaagtggccaccaaagccattaaggaaaaacagaaattcgagagattggaaatgaccaaggaacaattgttaaagatgttccactacaacaagtacaaggtcaagtttatcagcgacaagatccccgacggtacttccactactgtgtatagatgtggtccgttgattgatttgtgtgttggtccccacattcctcattcaggaagaatcaaggcatttaaggtgttgaagaattcttcgtcctactttttgggcgatgccaccaatgactcattgcagagagtttatggtatttctttcccagataagaagttgatgactgagcatttgaagtttttagctgaagctgctgaaagagaccacagaaagattggtagagaacaagaattgtttattttcaatgaaatgtcgcccggctcggccatgtggttaccacatggtgcaagaatttacaacaccttggttgatacgttgagaacagagtacagaaagaggggctatgaagaggttattacccccaacatgtactcgaccaagctttgggaaacttctggtcactggcaaaactataaggaaaacatgttttcgtttgaagttgaaaaggaaacgttcgggttgaaaccaatgaactgtccaggccactgtattttgtttaaatcgagagaaagatcatatcgtgaattgccatggcgtgttgccgattttggggttatccacagaaacgagttttcgcggcgcgttatctgggttgacgagagtcagtcgtttccaacaggacgatgcccatattttctgtaccactga

SEQ ID NO: 4144 - DNA, 1083 bp, Candida albicans
aatatgtcaaagtcagttaatgttgcaattattggatccggtgttgttggttcatcatatcttagtcaattgaataacttgaaaagtaacatagctttcaatgtaatttatttggctaaaacttctgaagaagcattatacagtaaagactactcaccagttgatttgtcaacttatgaaacagctccaactcaacctacattgagcttagatgatttggttaaattcataaaaggtgcaaagaaaccaactgtgttagtcgataatacttcgagtcctgctattgcaaattattaccctactttcattaaggaaagtatctccattgctaccccaaacaaaaaggctttctcatctgacttaaaggaatggaaagaaattttacaaacagctgaattgccaggtgctggtttagtttaccatgagtgtactgttggtgctgcattgccaattatctccccattgaaagatttgatcgctactggtgataaagttgataaaattgaaggtattttttctggtactttgtcctatattttcaatgaattttctaaaactgaaaaatcagacgttaaattttctgatgttgttaaaaaggctaaagaattgggttacactgaacctgatccaagagatgatttgaatggtttggatgttgccagaaaagtcactattttggccagaatttccggtttagaggttgaaggtccaacttctttcccagttgaatctttaattccaaaagaattagaatgtgtcgagagtgttgctgaatttatggaaaaattaccaaattacgatgctgatattcaaaaagtcaaagatgaagcttttgctgaaaacaaggttttgagatttgttggtaaagttgatcttaacaccaacaaagtatcagttgaaataggtaaatatggttttgatcatccattcgcttctttgaaaggtagtgacaatgttgtttctatcaaaaccggaagatatccaaatccattgattgttcaaggtgctggtgctggtgctgaaatcactgcacatggtgttttggcagacactatcaaaattgctgaaagaattgccaattga

SEQ ID NO: 4145 - DNA, 1197 bp, Candida albicans
taccaacatagaagtaacatgtcagaacaaagaacattggaccgtgaagaaccaaattattttggtgctggcccatccttattacctacttcagttttacagcaagctgcttatgatttaatctcatatgagggtgataacattggaattggggaaatctcacatcgttctaaacctgcaattaaagttatcgatgacactaaggaaaatttaactaaattgttgaatattccagacactcatgaagttttttttatgcaaggaggacgcactactggattctcatcaattgcttacaatttaattgctaactatgccaagataactgggaagaaagggaaagctgcttatgcagtcaccggatcatggtccaagaaagcttccgaagaggctcaaagattaggtttcgatgtaaatattgttgtcaacacaaaaggtgaaaatttcggaaccattcccccatattctgaatggaaaccaattggagaagatgtttcttatttgtatgtgtgcgataatgaaaccgtgcatggagtcgaattcaccaatattccgggcactgattatttacctgaaggtgtcgaattggttgctgacatgtcttcaaacattttatctaaggaaattgatgtcagtaaatatggtttgattatggctggtgcacaaaaaaatattggattggctgggttgactatttacattatcaaaaaaagtttgttagaccaggcttctgacgatgaattgagaagtttgaatattccattatctcctattgctttccattatccaaccgtcgtcaaaaacaattctgcttacaatacaattccaattttcacttgtcatattttgaaacttgtcactgataaattgattgcggatggaggcattaagaacacggaacaaatcaacaaaaagaaagccactattttatacgaagccttggaatcttatccagacttttacaagttgcctgtgttcaattctcaagtgagatcaaatatgaatgttgtttttagattacctaacgaagacttggaagccaagttcatcgctgaagctgctaaaagaaatttggcaggtttaaagggtcacagatcagttggtggtatgagagcttctatatataacgctgtcaccttgaaaagtgtccaatctctagttgacttggtaaatgattttgccaaagccaatgcctaa

SEQ ID NO: 4146 - DNA, 582 bp, Candida albicans
attaatttattacttctttctttaaaaccacacccagcattgtcaatcatgattagaacattattaagaccaacttcattgagacttgttacaccaacttttagatctttctccacattttcaaccagatttcaattgatagataaagattcacacgcctacaaatatttatatgaaaaaacccccgttgttacaaaattcactgaagatcatgaatgggttcatttatatgatgatgattctgcttttgttggtattactcaatacgctgctcaagctttaggcgatgtcacatttgttgacttgccagaagttggtgatcatttggaattgaatgagactttgggttctgttgaatcagttaaatcatcagctgatgtttactctccagttgatggtgaagttgttggggttaatctcaaattagaaagtgaaccaggtattttaaaccacgatccaacgaaaggtggatggattgttcacattaaattggatgacccaactcaagtcactaaatctgaaactttaatgagtgaagaacaatataagaagtttttagaagaagaagaagaaggccattaa

SEQ ID NO: 4147 - DNA, 1284 bp, Candida albicans
  unsure (1244),(1248),(1279),(1280): Identity of nucleotide sequences at the above locations are unknown.
aacctaagcgctgtcctgccgcctcgtggtgaagatattgagtcttccaaaaaagtattaggaacactttcgaaccctaatcttgtgaaaactgaagcatatatcaatggcaaatgggtccccagttcatccggggaaacctttactgtgaccaacccagcattgtatccaaatcctgaaagtgaattggcaaccatgcaatctatgtcagaagaagattttaactctgctatagaatcagcagatattgcgtttaacaaattcaaaaagactacaggtaggtatcggtctgaactacttttaaaattatacaatttgatgatttccaacaaagacgatttggccaaattggtggttttagaaaatgggaaaccttatgctgatgccttgggtgaagtcaattacgcagcatcatttttccaatggttctctgaagaagctccccgtatttatggtgatattatcccctctgctaatgggactaatagaatcttgacctttaaacaaccaattggagtttgtggtattttgactccttggaatttcccattggcgatgattacacgtaaattaggtgcagcaattgctactggttgtactgcagttatcaagccagcttcagaaacaccattgtcggctactgccttggcatttttagctgaggaggccggatttccaccaggagttattaatgtattaccatctgctgatgcttctggtctgggtaaatacttaactgaacatcctttgattaaaaaagtatcatttaccggatcaacaccagtaggtaagattttgatgaatcaatcagcatcaacattaaagaagctttcatttgaattgggtggtaatgctccatttattgcctttgatgatgttgatgttgacaaagctgtcaatggggcaattgcttcgaaattcagatctagtggtcagacatgtgtttgtgctaatacaatttttgttcatgagaaaatctatgatgaatttgataagaaatttgttgataaattgagaaatgaaactgttttggggaatccgcttgcttatggtgtaactcatgggccagttattcatgacagatcaatgaaaaaagtcagacaacacattgaagatgcagttgataaaggtgcaaccattttacttggaggttccaagcgtcctgatttgggtgagaatgtccacgatttgactgttttgggtgatgtcactactgaaatgttgattacacgacagaacacgtntttncctagagacgacagtcgaccccaaatatctnngaga

SEQ ID NO: 4148 - DNA, 1464 bp, Candida albicans
gtggtgaagacaaatttatttcaaaataaaccatttattaatggtcaatggtacgactccaaatcaacctccacttttaaagtctatgaccctgccactcaagaattaatcattgaattacctgaccaaaccccacaagaaattgatgaagccattgctattactcataaggcattccaaacttatcaacgtactccagtttatgagcgtgctaaatggttaagaaaaatgtatgaattgatgacagaaaatttacaagatttggctactttgattacttgggaaaatgggaaatgtttggctgatgccttaggggaaatcaaatatgctgctagttattttgaatggttttcagaagaatgtaaacgtaattatggtcataccatacaaccactgaatcaaaataataaagtcattacttataaacaaccagtgggtcccgtcggattattatgtccttttaatttcccaagtgctatgggagctagaaaagccgctccagcattagctgctggttgtacatgtattttgaaaccggatggtcaaactccattgagttcattggctttagcttatttagctcaacaagctggattccctgatggttgtttcaatgttgtattgacttcagtcaccaatactccaatgtgtggattgaaattttgtcaatcaccaaaattgaaaaaaatcagtttcactggatcaactaatgttggtaaattattaatgcaacaatcatcttcaactttgaaaaaattatcaatggaattaggtggtaatgctccgattattgttttcaatgattgtaatttagatcttgctgttgatcaaagtattacttctaaattcagatccttagggcaaacttgtgtttgtgccaatcgtatttatgttgaaaagggggtttatgatgaattttgtaataaatttgttgagaaagtaaatcaattcaaaattggtaatggatttgaaccaggtgtaactcatggttgtttgataaacactaaagccattgaaaaagttgaagatcatgttcaagatgccgttgaaaaaggagcaaaattgattgttgaaggaggtagattgccccaattgggagaaaatttctattccccttcagtagttaaggatgtgactcaagatatgaaggttgttaaagaagaaacttttggtcccttggcagctattatcccatttgattctaaagaacaagttttgcaatggtgtaatgatactccttatgggttggcatcatatatcttttcggaaaatttgaatactgtatggtatatgtcagaatttttggaaaatggtatggtttccgttaatactggattattcaccgatgctgcattgccatttggtggggttaaagaatcaggttttggtagagaaggttcactttatggaatggatgactataccgttattaaatcaattactttaggtaatgtctataactaa

SEQ ID NO: 4149 - DNA, 807 bp, Candida albicans
atgtatttaagatcaatttttaaatcaacaattcgaaaaatgcatattgaatcaattcctatgagatggggccatggtgacaactatgcctacttggtggttgatacacctacaaaacaggcatggttgatcgactctgcccaacctgatgaagttcttgagtactttaagaaacataaaactgatttcaatttgaaagcaattgttaatacacatcatcattatgatcattcggatgggaatccatttttccacaaaaagtatccggatttgccaattattgctggtaaggattcgccattagttacatatacaccttctgataaggaaacacttgaattaggagaggacctcacgattactgccttgcacactccttgccatacacaagattcaatctgttactttgtgcaagataagaaaactaacgagaaagctgtctttactggtgatactctctttataagtggctgtggtagatttttcgagggtacaggtaaagaaatgaactactcgctcaatcaagtgttggctaaattgcccaaggaaactaaggtttatccgggccatgaatacaccaagtcaaatgtgaaattttcacaaacagtattgagtaatgaagcaataaaagaattggctgaatattgcaagtcccatgaacatactactggtaaatttactattggtgatgaattgcagtttaacccgtttatgaaacttactgatccccaggtgattaacagcactggattaactctgcctgacgaaataatggataaattacgtaccatgaagaataatatgtaa

SEQ ID NO: 4150 - DNA, 579 bp, Candida albicans
tataatatggcaagtgatgggacgggtggaatgtatggttctccaactttggctggttctaggccaggtgctcttgtagttggatgctgggctacattaatcaatattgggaaacaaggatacaccaagttttgttacgatattgtgctggcgtcaatgaaagttaaacgagcaattgaaactgacccgatactatccaaacatttacaaattattggtgatccaattgggtcggtaatttcgtttcaacttgcacctcagcaatcgggaaatttaagtatttacgagattagtgatttgttgaccaaaaaaggttggcattttgcaactttacaaaacccatcagcattacattttgcatttacaagattgactgtcccggtggtcgatgaattgattgcagatttggttgaagctacaaaagaagcggtggcaattgccgaggaacacaaaaagaatggagtgaccaaagctccaggtgatactgctgcgttatatggtatagctggcagtgtacatacagcagggttggctgatagattaattgttgcatttttagataccttatacaaaatttga

SEQ ID NO: 4151 - DNA, 1263 bp, Candida albicans
aatattattatgcttgaattgaattcaattacgattcctcggaatttcactgaattccaactcacagcattaaagatctactatcaacttaagattttatttcttgccacatactgtactcaaggatcacttggcttgaacggttcagtctgtttagcaagagatatttttgttggctatgttgtatatactcaattattaaagctttatcgagtattaagagggtacggtattatagactctattcgaaggttatacctatatgttagttctattgtgtcatctcaaatcttttcactaccatttattaaatccaaaattgacaaggaattgcaagcgactattggcaaagtggaagaagagattatgaaaaacgatccacagttattacagtttcccgaattgccagaacagggtattgacgctgacaatgtttccttggagttggataaattacaaaacttgaaacattctgactggatcaatggaagagtcagtggagcagtttatcatggaggtgagaatctattgtcattacaagttgaagcttacaagaaatactcggtggccaatcaattgcatcccgatgttttcccaggtgtgcgtaagatggaggccgaagtagttcatatggttttggatatctttaatgctccgagtgacgggtgtggatcgacaacttcgggaggtactgagtcgttattgttagccgggttgtcagctagagaatatgggaagaaatatcgtggaataactgagcctgaagtcattgcccccgtgacaatacatgcgggaattgaaaaagcctgtttttattttggaatgaaattacataaagttgacttagatccggttacctttcaagttgacgttaagaaagtagaaagattgatcaatagtaatacagttttaatctgtggatcagccccaaattatcctcatggaataattgatgatatagagtccttatccaagttggcagtcaagtataatatcccgttgcacgttgatgcatgtttggggtcatttattgtttcgtttttagaaaaatcaaaagtacatggcgataggaaattgcccatatttgattttcgattaccaggtgtcacgtcaatctcatgtgatactcacaaatatgggtttgctcccaaggggtcatcaataattatgtaccgttcgccaaaattacgtgagtgtcaatactatattgcaagtgattggacgggtggatcttcaccacggggctggaaggtcgcgcgattg

SEQ ID NO: 4152 - DNA, 1173 bp, Candida albicans
aatttccattcaatcatgactacttccaaggaaactttccttttcacttcagaatccgttggtgaaggtcacccagataagatttgtgaccaagtctccgatgccattttagatgcttgtttagctgttgatccattgtcaaaagttgcttgtgaaactgctgccaaaaccggtatgattatggtttttggtgaaattaccactaaagctcaattggattatcaaaaaatcattagagacaccattaaacacattggttacgacgattctgaaaaaggttttgattacaagacttgtaacgtcttggttgcaattgaacaacaatctccagatattgctcaaggtttacattacgaaaaagctttggaagagttgggtgctggtgatcaaggtattatgtttggttatgccaccgatgaaaccgatgaaaaattgccattgaccattttattggcccacaaattgaatgctgccttggcttctgccagaagatcaggttccttgccatggttgagaccagataccaaaacccaagtcaccatcgagtatgaaaaagatggtggtgcagttatcccaaaaagagtcgacacaattgttatttccactcaacatgccgaagaaatcaccaccgaaaatttgagaaaagaaattattgaacatatcatcaagcaagtcatcccagaacatttattagacgacaaaactatctaccacattcagccatcaggcagattcgtcattggtggtccccaaggtgatgctggtttgactggtagaaagatcattgttgacacctatggtggttggggcgcacatggtggtggtgccttctcaggcaaggatttctccaaagttgataggtctgctgcttatgccgctcggtgggttgccaagtcgttggtgaccgccggattggccaaaagggccttggtgcagttctcctatgctattggggttgctgaacccaccagcatttatatagacacctatgggacatctaaattgagcaccgaagcccttgtagaaattatcaagaataattttgacttacgccctggcgtaattgtaaaagaattagatttggctcgccctatttattttaaaaccgcttcttatgggcattttactaaccaagaaaattcttgggaacaaccaaaaaaattaaaattttag

SEQ ID NO: 4153 - DNA, 267 bp, Candida albicans
gagttttttggaagatcctttggaaaagtgaaagttgcccgtgcacgaacagggccctttaaacaaggaatttttgttggcaacctgggtcaatggatcaaagcagagggcccagtcatatcatccttcaaaagaatttgccaagctaaccatcaacacaaaacccacatatttttcagaggtacttacgctgcagttccattggaccagttggttgtaggtttagaaaagtttggtaaagctgtcagagccgagtttggattgtaa

SEQ ID NO: 4154 - DNA, 1200 bp, Candida albicans
tttttatttttgtttgaattctttttctatatatttatttcacattctactgccataatgactagtgatacaaagccacaggctaaagatttgacacatttgttatcaaatgaatccaaagcaagacagacctcgccattgaaaggtattttcaaatactacaaacaacctggtattacatttttaggaggtggtttgccgttgtcggattatttcccgtttgaaaaagtaactgctgatattccaacaccgtcgttcagtggtggaattggtgcccctattgaaggtgagaataaaaccacaattgaagtgttcaaaaaagctgccgataacgttccagaccaaattgaattggccagaagtttacagtatggtagcacatttggtctgccagagtttcttcagtttatcaaagagcataccgacatggtccacaaagttccttatgagaattgggatgtgattgtttcggtggggaacaccgaagcttgggatagcacattgagaacattttgtagcaaaggggacaccatcttggttgaagagtacactttctcatcggcccttgagtcagccaacggacaaggtgtcaatactgttccagttaccatggatgaattcggtataatccctgaaaaattagaagaattaatgagtcgctgggttggcaacaaaccaaaattcttgtataccatctgtactggacaaaaccctactggatcctcattaagtgccgaaagaagaaaacaaatttatgacattgcctgtaaatacgatttcttgatcatcgaagacgagccttactactttttgcaaatggaaacgtacactaaggacaaggcagcaagagaaggtaaggctgttcacgatcacgatgagtttttaaaagcattggttccttcttttatttcccttgatgtcgaaggtagagttgtgagattggattcgttctcaaaagttcttgcacctgggttgagattgggctggattgtgggtcaaaaggacttgttggagagatacgttcgtttgcatgaggtgtctgtgcaaaatccatctgggctttcagaagctttagccaatgcgttgttgcgcaaatggggccattcgggttatttggattggcttattggtttaagagcagagtatacccaccaacgtgacgttgttttcacacacgccggccggcaggaacctagctcc

SEQ ID NO: 4155 - DNA, 1524 bp, Candida albicans
agactttgttacaccaaagatatgtctgatcctactcatttaatttctaagcgagctgctggaagaacttcggtgcattttacaaatgctccatctgataagcctccggcaaatttcaagcctcatgaaaaaccgttggcattgtcttatggtatgccgaatcacgggtttttcccaattgattccatagatgtcaatctagttgattacccatttcaaaaaattaccacaccttctactacttcgtctactgcagaagaagaacctccttcttcttctttgaatggttccgagaacggtcatcaaaccaaaactccgccttccagtatacacacaccacagtcaactgttcatatcagcagacatactactgatccaaaattaattgatttggctagaggattacaatatgctgctgttgaaggtcatgcaccattattacaatttgcaagagatttcatcattcgtacacataaaccaaattatgacgattggaatgttttcattactactggtgccagtgatggattaaataaagctgctgatgtatttttagatgatggtgatgttatcttagttgaggaatttacatttagtccatttttaagatttctggataatgctggtgctaaggctgttccagtgaaaatcaattttgataatgattccgatggaattgatttgactcaatttgttgatttattggagaattgggagaaacattatccaaacttacctaaaccaaaggcattatatactattgccacaggacaaaatccaactggatttactcaatctttagaatttagaaagaaaatttatgatttggctgtcaaatatgattttgccattattgaagatgatccttatggttatttgacattaccaaaatatgaaaaacctaatataggtggtagtggtagtggcaataatgaattgaaaaacgatcttgaaattgatgattatttgaagaatcatttgactccatcttaccttgaattggacactactggtacagttcttagagttgagaccttttccaaattatttgctccaggtttgagattaggatttattgttggtcataaaaaagtcattgacgcagttaagaattatagtgacgttgttaatcgaggtgctctgggtttaacacaaactattgttaataatgttattcaagaaaactttaaaggtgttgatggatggctagaatggattttaaaaatgagattgaattattcttatagaaaagatttgttattatattcaatttttgaatcacaagcttataaaaaaggttatgttgatgttattgaccctaaagctggtatgtttgttacttttaaaattaatttgccaaaagatgttgatgttttacaaaaaatgaaattattattatggaaattgatttcttatggaattttggttgttccaggatataatatgacggttgatttagagtttagtaaagatagaagcaatttctttagattatgttatgctcttgctaataatgatgaataa

SEQ ID NO: 4156 - DNA, 624 bp, Candida albicans
tccgtggtgaagaattgtagtgtcggggagattgctgaagatgctattgaaactgccaaatacatttgcgaagaatattatgggttattcgaagccccagaaatacagttgattgcacctcaacaagatataaatttcatgtatgttcctggacacttgattcatatgctttttgaaactttgaaaaactcattgagagcaactatcgagttccatacaccaaagttgaaacaaaagttgatagatgaagatccaaatttgaaattcgacgagattgatataaatgatttgaaatttcctcctataaaagtaattattctggaaggtacagaagacattgccataaaaatttccgacgagggaggcggtatacctaggtcatcattaccattgatttggacgtacttgtacacaaccgtgaatgaaactccaaaattagagcctgaatatgatcaaacttcatttaaagcaccaatggctggttttggttacggtttaccaatcagtagattatatgcacaatactttggtggtgatttgaagttgatttccatggaaggctacggaactgatgtttacttgcatttgaacagattaagcagttctaatgaaccgcttccatga

SEQ ID NO: 4157 - DNA, 414 bp, Candida albicans
  unsure (22),(24),(27): Identity of nucleotide sequences at the above locations are unknown.
ttgttggtggacctaacgaaancnggnaaaagaagtgattatcatataaatcaaaccccagaatatttctaccaattcaaaggcacaatgtgtttgaaagtggttgacgatggagaattcaaggatatttttataaatgaaggggactcatttcttttacctcccaacgtgccacacaacccatgtcgttatgaaaacaccattggaatagtggtagaacaggatagacccgcaggtgttaatgataaagtcagatggtattgtcaaaaatgtcagacagtcattcatgaagttgaattttatttgacagatttaggaactcaaattaaggaagcaattgttaaatttgatgctgatttagacgcaagaacttgcaagaattgtggaacagtaaattcatcgagaagagattaa

SEQ ID NO: 4158 - DNA, 1470 bp, Candida albicans
aatctatgcaaaggacgaaccaaagttttttcacgacttttcctccgctttcgcaaagctattagagttagggataaaacgggaaacgttataaaaatttcttttttgttgcaccactttcttttttatattttttttttttcaccaatgactatcccaaatattgaagaattcgatgtgttccccaactcagggttccttccttcgaaacttcctttagaacgactcccacaagagtactaccagccatgggaaaatatagtaaacaaccttccttcattaatactcacaaaacgtattagagcaatcatagataaactcccagtattagaaaccactcaccttacctccgacgaagaataccgcagagcttaccaaatattagggttccttgctcatgcttatatttggggaaccgacacaccaaccgataaattaccttcccagatcgccacaccatggataaaagtttccgaccatctcggattaccgccaatagcaacctacgctagtctttgtctttggaattttaaacaaattatgcctagcgatgatatatgggatttggacaatttgacaactataaacacattcactggttcaattgacgagagttggttctatttggtgagtgtatattttgaacacaagggtgcgttggctattactactggtttagatgctattaaatgtgcttacgacaataacaccaaaggattggttgaaaacttgcaacagcttgcagaagctattgatagtcttgggtctgtgcttatgaaaatggaagaaatgtgtgatcctcatgtattttatttcagaatcagaccatacttggctggatggaaaaacatgaccgaggtggggcttaaaggtgtttactatggagaggagaaaactgtcagaaactatgctggtggttccaacgctcaaagttcattaattcagttcttggacattttacttggtgtaaagcattattcaactggggaaaggccattgccattcaaagccagtactggtgttggtgctgaaaatgggtttatgaacgaaatgagagaatatatgccaggcaaccaccaaaaattcttgtcaaaaatccaggaaatcaccaacataaaccagtatgttttggaccacaaagattctcatccagaattggtattgtcatacgacgcatgtcttgccatgttgaaactgtttagagataaacatatacagattgttactcgttatgtcgttttgcaagcaaagaaaactgaaaagatgggttcttcctccacattaagatctggtcttgcacgtaaaaagaaagaagaaagaggtacaggtggtacatctttacttccattcctcaaacagtgcagagacgaaactggtgatccagctgcaggtaattggggtcaaagaattcttagtgacggtgtgatgagattgaaattctccaaaccaaacggaatcaacgaggactga

SEQ ID NO: 4159 - DNA, 666 bp, Candida albicans
catgattggcgagaagattttgctgcctgggtttcccacaaaaatttaaattcgggacctggagccatggtgggaatttttgtgcatgaaaaatacaccttagagaacaaggcaagcagtttcgtacctagactagctggttggtggggcaataactcccaagaacgattcaaaatgttagaagagtttgatccaataaactcggctctttcttacagacagtcaaatccttctgttcttgatgttgttgctgtgaagtcgtcattggaagtgtatgctaaagtgggtggagtatctaaacttcgtgaaaaaagtgttgctttgactcaatttttacaggatctattgacgaattccaagtattacataccacaatccagtacatcaaactccaaatttgggtttaaaattttaactcctttgaatccagctgaaagaggatgtcaattgtccattatgtttcaaccgcatttcgatgaaaaggacaagaacgtcatggaacgagttaatgcgtacttgcatgatcatgctataatctgtgacgaaagaagaccagatgtaatcagattagccccattgccgttatacaatacttttgaagagacttttattgctgtccagagattatttgaagccctagataatatctctaaagaatatatgtaa

SEQ ID NO: 4160 - DNA, 894 bp, Candida albicans
tttctcgattgtaaagctcttcagctgacagaattgttgttgaggcccaatggcgtcttttttttttccaccattcgcaattatctcccacataatactgggtatcaactttttttgttgtttccgatttttttcttcaattctatctctccggttataccaccaactactccaaccccattttattatcagatgtcattagccgaggcaaagaaattggacaaaaatttcccaacttttaaaaatgagtttgccataccaacttttggatcattaggtatcaaaaataataaatatgagtcatcaactgagtctatttatttatgtggaaactctcttgggttgatgcctaagaatacaaagaaagctatcaatgatgaattaaatgcatgggttgaacgaggggttgagtctcatttcaatcatcctgacaaactgttaacaccgtgggtagacatcgatttacccttattaccattaatagcccccattgttggtgcaaaggaaaacgaagttgcagttatgggttctttaacagcaaacttgaatgcattgttgatccatttttacaaacctgaggggaaaagaaccaaaattttatttgaaaaacaagcatttccttctgactactatgcatttttgaacattgttaaattgttcggatacgacgagaaacatttgattcaattggaagttcaacctggtgaaacttatattaaaacagaaagaataatcaaggctatagatgagaacctggatgaattggctctagtgtgttttcctggtatccaatactacactggtcaatttttcaagatagaggaaataactaaatacgctaaggaaaagagcccacacattttttcaccactaggaccgaccccgcctatatat

SEQ ID NO: 4161 - DNA, 1548 bp, Candida albicans
agtgcgtgtctgcgatggcgaaaaaaaagatttctcaacaaatctgtgcaaaaatttccagtcttaaacaaatctcgatttaaattctctccctctcactccttaaattttttttcttctcagtttgtgcattttctactcctgtattcttatatcgataataatatactcaatttatctatattaacaacaatcatgtcctccgctccagccactaactataaagttgccgatatttcattagctgcctttggtagaaaagatattgaattatctgaaaatgaaatgcctggtttaatgtacattagaaaaaagtacggtccatcccaaccattgaaaggtgctagaattgctggttgtttgcacatgaccattcaaactgctgttttgattgaaactttggttgctttgggtgctgaagttacttggtcttcttgtaacattttctccactcaagaccatgctgctgctgccattgctgctgctggtgttccagttttcgcttggaaaggtgaaaccgaagaagaataccaatggtgtattgaacaacaattgtttgctttcaaagatggtaaaaaattgaacttgatcttggatgatggtggtgatttgacctctttggttcacgaaaaatacccagaaatgttggaagactgttacggtttatcagaagaaaccactactggtgttcaccatttatacaaatctttgagagatggtaaattgaaagtcccagctatcaatgttaacgattccgttaccaaatccaaattcgacaacttgtatggttgtagagaatctttagtcgatggtatcaagagagccaccgatgttatgattgctggtaaagtagccattgttgccggtttcggtgatgttggtaaaggttgtgccatggctttgcacggtatgggtgccagagttattgttactgaaattgatccaatcaatgctttacaagctgctgtttctggttaccaagttgctccaatggacgaagttgcctctattggtcaaatctttgttaccaccactggttgtcgtgatatcatcactggtaaacatttcgaacaaatgccagaacatgccattgtttgtaacattggtcatttcgatattgaaatcgatgttgcttggttgatagccaatgctgagtctgttgtcaacatcaaaccacaagtggacagatacttgatgaagaacggtcgtcacgttatcttgttggccgacggtagattggttaacttgggttgtgccactggtcactcttcattcgttatgtcatgttctttctccaaccaagttttggctcaaattgccttgttcaatgctgacaacaaagaattcagagaaaaattcccagaatttgccaagactggtcctttcgatgttggtgtacacttgttaccaaaggttttggatgaaactgttgccagatgtcacttggaccacttgggtgctaaattgactactttgactgaaactcaagctgaatacttgggtatcccagaagaaagtccatacaaggctgacatctacagatactaa

SEQ ID NO: 4162 - DNA, 2310 bp, Candida albicans
ccaaaaatggttcaatcttccgtcttaggtttcccacgtattggtggtcaaagagaattaaaaaaaatcactgaggcctactggtccggtaaagctactgttgaagaattgttagctaaaggtaaagaattgagagagcacaattggaaattacaacaaaaagctggtgttgatatcattccatctaatgatttctcctactatgatcaagttttagatctttctttgttgttcaatgctatcccagaaagatacaccaaatttgatttggctccaattgatgttttgtttgccatgggtagaggtttacaaaagaaagccactgaaactcaagctgctgttgatgttactgctttggaaatggttaaatggtttgattctaactaccattatgtcagaccaaccttttctcactctactgaattcaaattgaacactgctgctggtatcaaaccagttgatgaattcaacgaagctaaagctttgggtgttcaaaccagaccagtcatcttgggtccagtttcttacttgtatttaggtaaagctgacaaagattcccttgatttggaaccaatttccttgttaccaaagatcttgccagtttacaaggaattgttgcaaaaattgaaggaagctggtgctgaacaagttcaaattgatgaaccagttttggttttggacttgccagaagctgttcaatccaaattcaaagaagcttacgacgctttggttggtgctgatgtcccagaattgatcttgactacctactttggtgatgtcagaccaaacttgaaagccattgaaaacttgccagttgctggtttccactttgatttcgtcagagttccagaacaattggacgaagttgcttctatcttgaaagatggtcaaactttgtctgctggtgttgtcgatggtagaaacatttggaagactgatttcgccaaggcttccgctgttgtccaaaaagctattgaacaagttggtaaagataaggttgttgttgctacttcatcttcattgttgcacactccagttgatttggaatctgaaaccaaattagacgctgttatcaaggactggttttcctttgctactcaaaaattggatgaagttgttgtcattgccaagaatgtttctggtgaagatgtttctaaacaattagaagccaatgctgcttccatcaaagctagatccgaatcttctatcaccaacgatccaaaggttcaagaaagattaactaccattaacgaagctttggctactagaaaagccgctttcccagaaagattaactgaacaaaaggctaaatacaacttgccattgttcccaaccaccaccatcggttctttcccacaaaccaaagacattagaatcaacagaaacaaatttgctaaaggccaaattactgctgaagaatacgaagcttttatcaataaagaaattgaaactgttgttagattccaagaagaaattggtttggatgttttagtccatggtgaaccagaaagaaacgatatggttcaatactttggtgaacaattgaatggttttgctttcaccactaacggttgggtccaatcttatggttctagatatgtcagaccaccaattattgttggtgatgtttccagaccaaaagctatgactgttaaagaatctgtctatgctcaatctattacttctaaaccaatgaagggtatgttgactggtccagtcaccattttgagatggtcattcccaagagatgatgtttctggtaaaatccaagctttgcaattgggtttggctttaagagatgaagttaacgacttggaaggtgctggtattactgttatccaagttgatgaaccagctatcagagaaggtttgccattgagagccggtaaagaaagatccgattacttgaactgggctgctcaatcatttagagttgccacttctggtgttgaaaactctactcaaatccactcccacttctgttactccgatttggatccaaaccatattaaagctttggatgctgatgttgtttccattgaattctccaagaaggatgatccaaactatattcaagaattctctgaatatcctaatcacattggtttaggtttattcgatatccactctccaagaattccatctaaacaagaatttgtttccagaattgaagaaatcttgaaggtttacccagcttctaaattctgggtcaacccagattgtggtttgaaaactagaggctggccagaagttaaggaatcattgaccaatatggttgaagctgccaaagaattcagagctaaatactaa

SEQ ID NO: 4163 - DNA, 957 bp, Candida albicans
aaggatacgacaacaaggttttatatgtatggtttgaatgcccctattggttatgtgtccataactgctaattatttcaaagattcaaacaccgatgattatctcaaatggtggaaaaacccagaaaacgttgatttgtaccaatttatgggtaaagataatgttccattccacactgttgttttcccagcttctcaaattggtactggtgataaatggaccaagttacaccatttaagcactactgagtacttgcaatatgaaaacggtaagttttctaagagtagaggtgttggtgttttcggtaacaatgctaaggaaactggtgtctcaccttctgtttggagatattatttggcctcaaatagacctgaaactcaagatgcccatttctcttgggacgaatttgttgctaagaacaattccgaattattggccaatttgggtaactttgttaacagaattgttaaatttgttattgcaaaatataatggtgtgattccaaaattcgatactaagaacataccagattacgacaagtttgaaaatgacatcaactctttgttggcaagttacattgacaacatggaaaatgtgaatttgagaaaaggtttagaacttgccatggctatatcttccagaggcaaccagtttttgcaagataacaagttagataactcgttgtatgctaaccagccagcaaaatctgatgctgttgttgctgttgccattaatttggtttatttggttagtgctattatttacccttttatgccagaaacaacagttaaaattgatcaaattttgaatgctcctgcattatcaattacaaacaaatttgaattggtgttgttgccaggtcactgtattggtaaagcacaatatttgttcacaagaattgatgacaagaagattgatgaatggagaaagttgtatggtgggcaacaaaagaagtaa

SEQ ID NO: 4164 - DNA, 813 bp, Candida albicans
tctgatgaaagaaatattttaattacttctgccttaccttatgttaacaatgttcctcatttgggtaacattattgggtcggttttgtctgctgatatttacagtcgttatgctaagaatagaaactacaatactttgtttatttgtggtactgatgaatatggtactgccactgagactaaagccttggaagaaaaagtcactccacaacaattatgtgacaaataccatgctattcataaagaagtctatgattggtttgatattggatttgactatttcggaagaaccacaacctccttgcaaactgaaattgctcaagatatatttttgaaattgcacaacaaaggatatttggaagaaaaaactactgaacaattgtattgtgaacaccataaatctttccttgctgatagatttgttgaaggtacttgtccaaaatgtgattatgaagatgccagaggggatcaatgtgataaatgtggtaacttattggacccattggaattgattaatccacgttgtaaagttgatggcaatacccctgttgtcaaagagtctactcatatttaccttaaattgaatgacttagaagagccattgaaggaatgggttcttgattcatcggcaaaaggtgcttggtcaagaaactctaagaacattaccgactcttggattaaaataggtttagagccaagatgtattaccagagacttaatctggggttacacagttccattaaaaggatacgacaacaaggttttatatgtatggtttgaatgcccctattggttatgtgtccataactgctaa

SEQ ID NO: 4165 - DNA, 528 bp, Candida albicans
acaacaacccaccaaacaacaataatgtccttggaggtatatggagctaaaggcaacacattattagcgttaactaataacttaaagttatctattgcattagcagcttttgaaccaaaagtggaattaactttgaatgaagttgaatcaaatttgtctttgaaagataagaaatctggttttgaattgattgaaccaaatgccatcgttaaatacttggcgaaagactttaccaccactgaggccattaaatttgaagaacaagttttatattcagcaattaaatccaacaaaaaagatgaacttgccaaaattacggatttgccaaagtttgctaaagaagagttgaccccatctcaaattattgtatttgctagtttataccctgctttcaaagatactaaagaaaatgagtggtttagtaagttttcacaattaccagaagttgcaactggtatcaaaaacgctttggcaatcactccagtggaaagagaaaaggaaaccaacactgggcaagcaaaatgttga

SEQ ID NO: 4166 - DNA, 468 bp, Candida albicans
gtcaaaactgaaacgtttactcttttaattcagaaacacaccataaacacagaactagaacactctatattaagttcccagttcgcctcaacttctttctctctttttttttatccttatatgaacttgaggtttttcttgccaaaaaggataatcagaatgtcatcaacaacaacaaccagtgctgcaaagaaaccaaccgttaaacaaccacaatggtatcaaccagaaaacaagaataattctaagcctacacttaagatctacaattcattgacacgttccaagaatgagttttatccaaataaaccaggccacattacgtggtatagttgtggtccaaccgtttacgatcattctcatatggggcatgctagaaactatgtttcaacagatatctgtagaagaattttgcaagattactttggctacaacattaaatttgtacaaaacgtcactgatattgat

SEQ ID NO: 4167 - DNA, 225 bp, Candida albicans
tgcaaagaaaggaagctgaaaagttggcccaaaatgaatatcaatcattcggatttgtttaaagatacatctttatattctgaatgggacgaacaaggattacttactaaagatgctaaaggtgaagaaataagtaagagcatgaaaaagaaattgactatacaataccaacaacaggagaagttatacaaagagtatttgaagactgttgaagaagccaaataa

SEQ ID NO: 4168 - DNA, 1152 bp, Candida albicans
caaccatggagtaaaggagatatgaatttgattaacgatggtgaagggtcattgagtgtcagtaataccaaacgtaacgcttcagattttgctttgtggaaagcatccaaaccaggtgaacctgcttgggactcaaaatggggtaaaggtagaccaggatggcatattgaatgttcagtaatggcttctgatattactggagaaaatatggatatccactccggaggtattgacttatgtttccttcatcacgataacgtattggctcaatccgaagcttactttgataataaacaatgggttaactatttcatgcataatggacatttacatattcagggccaaaaaatgtccaagtcattaaagaactttatcactatagacgaagcattgaatgatttttcagcaagacagttgagattggtgtttcccttgaatgcttgggaaaaaccattggatttcaaagattctcttattagtgaagtgaaatctattgagtccacattttccaaatttttcacaaatgttcgtgcattaaactcggattataaacacaaaacagaaaatggtggatatgtatcaagaaaaattacagatattgaaaaacaattgttcaatgatttggaacaggctcaagatgaagttgatgctgctttcaatgataacttatcaagtggtcaagcaattagagttttgcaagatttgatttctaaatctaataattatattcaattgacttctactggacaaacagaattaagaattgaagttttgattcaagtcacaaactggattgttaaaatattagagattttgggtttcgaagccagatcagatagattaggctggatagatgaatcagaacaaacaagcactaacggttctagtacagaggatgttgccttaccatatgtcaaagcattagctcaatttagagattctgtgcgtagtttagcaatcaacaaggctgaattgaatgaattcttaaaagcttccgatgccattagatcgctgttgattgggttaggagtttcattagacgatagaccagatggcacttctttggtcaagtttttgaatgctcaagaaaaacaaaatttgttagatcaacaagaagccaaattgagattagttgccgagaaagagaaatag

SEQ ID NO: 4169 - DNA, 348 bp, Candida albicans
gtgaagcgcggttccttgcagcccagtggtgaagacgttagagaattcttagatagcatcaaggatgttgctatgcctcatttagacaaagagtttggtgccactgtcactgatccacaagtttgcagaaagttaccttcgtattgggaaaaaagatataacgaagatatggctagattgaatgtgttgccaccatcagtcactaccagagtttccgaatatatgcctgatatcattgaatttgttgacaagatagttactaatggatacgcttacaagactgatgatgggtctgtgtatttcgatactgtgaaatatgaacactcgcagcatgattatgctacatga

SEQ ID NO: 4170 - DNA, 1194 bp, Candida albicans
caaaatctaaccatgatattgaaaactagctcactacttagatctgccgtacaaccaagacaatggttaagatacacttcaactgttgcaccgttagaggcttctaaattaattgttgaaaaaactagtaatcccaaaccaaagttgccaaaggacaagttagtctttggcaaaacctttaccgatcatatgttggaaattgaatggaccaaagaaaaaggttggcacacccctaaaatttcaccatatcacaatctttcgttagatccatcaactattgtgttccattatgcatttgaattatttgaaggaatgaaagcatataaagacacaaatggcaacatcagaaccttccgtggagataaaaatatgattagaatgaacaaatctgctgaaagaattgcattgcctacttttgatggtgaagaattacaaaaattgattgacaaattattacttttagataaagattttgtacctgaaggtaaaggatattctttatatcttagaccaacactcattggtaccactgcctcattgggcgtgggtacaccagatagggctcttttgtttgttattgcctctcctgttggtccttactactcgtctgggttcaaaccagttagcttagaagcaactgattatgcagtcagagcttggccaggcggtgttggtgacaagaaattgggtgccaactacgcaccatgtgtgaaaccacaacttgaagctgctcaaagaggattccatcaaaacttgtggttgtttggtgaggaagggtatgtcaccgaagtggggaccatgaattgttttgtagctttcgaaaatgatgatggtactaaagaattggtcacggctccattggatggtactattttggaaggagtaactcgtgattccattttagaattggctagagaaaggttaccaagtgatgaatggactgtatcagaacgtaaatacacaatttatgaaatcgaagaaaaagctaacaaaggacaattgattgaggcttttggtgctggtactgctgctgttgtttctcctataaacaatattggattcagaggtaaaaatattaaagttcccgttgccttgggtaactctggtgaattgacagccactgttgctgaatggattagaaagattcagtatggtgaagaagagttcaagaattggtcaagggttgcaaaataa

SEQ ID NO: 4171 - DNA, 648 bp, Candida albicans
gtgtcagtgcaccaactaaagcattatatattcttattgcttcacgtgttgtccatatttcagtggtgtttcaaaccagtgtctttggaagccacagattacgccgtaagagcttggccaaaagttgttggttcttataaattgggtgcaaactatgtgtcttgtattgaaccacaaatggaagctgccaagagaggtcattcccaaaatttgtggttatttggtgaagaaggttatattactgaagtgggtgctatgaatgttttttttgcattcaagaatgccgatggcactaaagaattggtgactccgccattggatggtatgatcttgccaggtgtcactcgtgattctactttagaattggctaaaagcaaattaccaagtgattggactgtcaatgaaagaaaattgactattcatgaagttaaagaaagagctgctaaaggtgaattagttgaagctttcggtactggtaccgctgctattgtttcaccaattgacaacattgaattccaaggcgaacaaattaaggttccagtttctgctggtagttccggagaaatagctttgaagatcaatgattggataaaggctattcaatatggtgatgaaagttttaaaaactggtctagagtagcccaatag

SEQ ID NO: 4172 - DNA, 1008 bp, Candida albicans
gcgcgggattttccagccactgtggtggaagaaagttgccaccaatcattgttgatgattcatgggagaatggaatccaatgttcctgaaattgccggaatgtactttaaggatgccgacaatgttattatcaagaaattactggaagaaggtatactcttggtcaacacccaagtaaagcactcgtacccattctgttggagatcagatactccattgatgtacagaaccgtccctgcatggtttgttagaattggcgaagtcattcctgaaatgttggataatgttgaaaagacaaactgggttccttccaacattaaagataagagattttccaactggattgccaatgccagagactggaacatttccagaaatagatactggggtacaccaattccattatgggtttctgacgattttgaagaaatggtgtgtgttggttctatccaagaattaagggagttatctggtcgtgatgatattactgatattcaccgtgagagcatcgattctattaccatcccatccaaaaagggtaagggccaattgaagagaattgaagaagtttttgattgttggtttgaatctggttctatgccatatgcatccaaacattatccatttgaaaatgaaaagaagtttttggatgcctttccggcaaatttcatttccgaaggtttagatcaaactagaggttggttctacacattgactgtattgggtacccatttgttcaaaaccgcaccatatcagaatgttattgtcactggtattgtgttggctgctgatggtaaaaagatgtcgaaacgtttgaagaactacccagacccaaccttggtgttggagaaatatggtgccgatgcgttgagattgtacttgatcaattccccagtgttgagagccgaaacattaaagtttaaggaagaaggggtcaaggaaattgtttcccaatgtgttgttgccatggtacaactcccaacaatttttttaagggaagtcgcttaa

SEQ ID NO: 4173 - DNA, 624 bp, Candida albicans
aaaaaaaaaagacttcaaaatttttttcttctcttccgtctattagtcatctatacatcaacaagttggtactttacagatatgtcgttacaagaaagcaacaacaatatccctcaaggtgcttttagttttcctaaggaagaagaagcagttatcaaacattgggatgatgtcaatgcttttcaaagaactttagagttgactgaagatttaccgccatttgcgttttttgacggaccaccatttgccactggtactcctcattacgggcacattttggcctctacagtcaaagatattatcccacgttatgccaccatgaacgggtatcatgtggagagaagattcggttgggatacccacggtttgccagtagaacatgaaattgacaaaaagttgaacattacctcgaaagaagatgtttatgccatgggtattgacaagtacaatgctgaatgtcgtgcaattgtgatgagatacgctgatgaatggcgtagaacaatcaagagattggggagatggattgatatggacaacgattacaaaaccttgtaccctgaatttatggaatctgtgtggtgggctttcaaggagtgtcttcaccacgggtcgaaatccgcgtca

SEQ ID NO: 4174 - DNA, 1137 bp, Candida albicans
aaccaatatccaaaaaacatgtctgttaaaaccaaaaccattactgtcttgcctggtgaccatgtcggtaccgaaattgtcaatgaagcaatcaaagtcttgaaagcaattgaagctgccactccctaccaaaaaatccaatttgatttcaaacaccacttgattggtggtgctgccattgatgccactggcgtcccgcttccagatgatgctcttgaaagtgctaaatcatccgatgcagttttgttgggtgctgttggtggacccaaatggggtactggcactgttcgtcctgaacaaggattattgaaaatccgtaaagaattgaacctttatgccaacattagaccatgtaattttgccagtgactcgttattagaattgtctccattaaaagctgaagtggtcaaaggaaccaatttaattattgttcgtgaattagttggtggtatatattttggtgaacgtcaagaacaagaagaaagtgaagacaaaaaaacagcttgggatacagaaaagtatactgttgacgaagttactcgtatcactcgtatggcagcatttatggctttgcagcacaatccaccattgccaatatggtctttggacaaagctaatgttttggcatcgtcgagattgtggagaaagaccgttgataaagtgatttctgaagaatttccagctttgtctgtgcagcatcaattgattgattcggctgcaatgattttgatccaaaacccaaccaaattgaacggtatcatcattacatctaacatgtttggtgatatcatctcagatgaggcatccgttatcccaggatctttgggtttattgccatctgcttcattggcttcattgccagataccaacactgcttttggtctttatgagccttgccatgggtctgctccagatttaccagccaacaaagtgaatccaattgctacaatcttgtctgccgcttccatgttgagattatccttggattgtgttaaggaagctgaagcattggaagaagctgtcaaacaggttttggatagcggtatcagaacagcagatttaagaggtactagctctactacagaagtcggtgacgcaatagccgaaacagtcactaaaattttaaaacaaaataca

SEQ ID NO: 4175 - DNA, 879 bp, Candida albicans
ttattactttacattaaatacccctaccccataaataaggacaattactttactatggctcctaaaacattatacgacaaggtctttgaagaccatatagttcataaagacgattctggttcatatttattatacattgatagacatttagtccatgaggttacttccccacaagcatttgaagggttaaagaatgctggtcgttcagtcagaagaaccgattgtacattagccacagttgatcataatatcccaactatttcaagagcaaatttcaagaatgtcgattcattcatagagcaagatgattctagattgcaagttaagactttagaacaaaacgtcaaggattttgatgttacttattttggtatgacagacgacagacaaggtattgtccatgttgttggtccagaacaaggtttcactttaccaggtaccactgttgtttgtggtgactcccatacttctactcatggtgcctttggttcattggcttttggtattggtacttctgaagtggaacatgttttagctacgcaaactattattcaagccaaatcgaaaaacatgagaattactattgatggtgatttgtctgaaggtatcacttcgaaagatttggttttgcatgtcattggtgttattggtactgctggtggtactggttgtgttattgaatttgctggtaaagccattgagaatttgtcaatggaagcaagaatgtcgatatgtaatatggccattgaagccggtgccagagctggtatgatcaaaccagatgatactacattcaattacatcaaaggtagaccattggctccaaagggacaagaatgggaaaaggccatgaaatattggaaaactttacatactgat

SEQ ID NO: 4176 - DNA, 1086 bp, Candida albicans
agaatgtgtcttggtatgaacccagatattttggatcctgaagaaagatgtgcttctacttccaacagaaatttcgaaggtcgtcaaggtgctctttcaagaacccatttgatgtcaccagccatggctgctgctgctgctattaaaggtcatttcactgatattagagaatttgactatgccacacaagatgaacctcaaatacaaattgctcatgaaattgaagacaaagaattacaagaagctgtttatgagcacgaaaaggaatacattgaagataccccagaaactcaagcagaaagacttgaagacattccaaaagatgaaccagaatttaaaagggccagaaccgagatcgacaactctgctgctggtactcctagtattgataacagtttcaaagttttaactggtattactgctccattatacaaagccaatgttgatactgatgccattattccaaaacaatttttgaaaacaatcaagagaaccggattaaaagatggtttgttttatgaattgagatttgttaaaggtgaaaatggtaaagatgtggaaactgattttgtattgaatactgaaccatatagaaaggcagaaattttattggtgacaggagacaattttggttgtggatcaagtcgtgagcatgctccttgggctttgaaagattttggtatcaaaagtataattgccccatcatttggtgatatcttttataataattcttttaaaaatttccttttgccaatcagaataccgcaagaaatcattgaatctaaattggttcccgttgttacatcaggtcatagattgacgatagatttgccaaaccagcaaatcagagacggtgaaaccgacgaagtcttgattgaacatttcgatgtggaagagtttagaaaacattgtttggtcaatggattagatgatattggtttgactttacaaaaagaagaatatattaaagaatatgaagctaaaagaagaatcaagttttctttcttggaaggaggttctaaattaatcaaacctataaaaggtactaaaaagagtatttacggtaacagagcacaagaatggtaa

SEQ ID NO: 4177 - DNA, 705 bp, Candida albicans
aaaaaatacagagagggagagagtttgtgtgagagagagaaaaagaaaatttttcacttcttgagtcattcttgtaaccataatccacttttgtttccaacgaactataaaatcatgagtggtcctgttacttttgaaaagacatttcgtagagatgccttaatcgatatagaaaagaaatatcaaaaggtatgggcagaagagaaagtttttgaagttgatgccccaacttttgaagaatgtcctattgaagatgttgaacaagttcaagaagcacatccaaaattctttgccactatggcttatccttacatgaatggtgttttgcacgccggtcatgcctttacattgtctaaagttgaatttgcaactgggttccaaagaatgaatggtaagagagcattattcccattgggtttccattgtacgggtatgccaattaaagcagctgccgataaaatcaaaagagaagttgaattgtttggatctgatttgtctaaagctcctgctgatgacgaagatgcagaagaaagccaacaaccagctaaaaccgaaactaaaagagaagatgtcactaaattctcttccaaaaaatctaaggctgctgccaaacaaggtagagccaagttccaatatgagatcatgatgcaattgggaatcccaagagaagtattcaccacgaggctgccaaaatccgcgcttaac

SEQ ID NO: 4178 - DNA, 2703 bp, Candida albicans
gagtttttcccaccattgtgtcaaaaagatgtaactgcttttggggctagagttgattggagacgttctatgatcacaaccgatgctaatccttattatgatgcatttgttagatggcaaattaatagattgagagatgttggtaaaattaagtttggtgaaagatataccatttattctgaaaaggatggccaagcatgtttggatcacgatagacaatctggtgaaggtgttggtccacaagaatatgttggtataaaaatcagattaactgatgtagcaccacaagcacaagaacttttcaagaaagagaatctcgatgtgaaggagaacaaagtttacttggttgctgcaactttaagaccagaaactatgtatggtcaaacttgttgttttgtgagcccaaaaattgattatggtgtttttgatgctggtaatggtgactatttcattaccactgaacgtgctttcaaaaatatgtctttccaaaacttgactccgaaaagaggatattataaaccacttttcactatcaatggtaagacattgattggatctcgaattgatgctccatatgctgtcaacaaaaacttgagagttttgcctatggaaacagttcttgcaaccaaaggtactggtgtggtcacttgtgttccatcagattctccagatgattttgttaccacaagagacttggccaataaaccagagtactatggaattgaaaaagactgggtacaaacagatattgttcctattgtccataccgaaaaatacggtgataagtgtgctgacttattggttaatgatttgaagatactgtcaccaaaagattctgtgcagttggccaacgccaaggaattggcttataaagaaggtttttacaatggtactatgcttattggtaaatacaaaggtgataaagttgaagacgccaagcctaaagtcaaacaagacttaattgatgaaggtcttgcttttgtttacaatgaaccagaatcccaagttatttctagatctggtgatgattgttgtgtatcattggaagatcaatggtatattgattatggtgaagaagtttggttgggtgaagccttagaatgtcttaagaacatggaaacatactccaaggaaaccagacatggcttcgaaggtgttttagcctggatgaagaactgggctgtcaccagaaaatttggtttgggtactaaattgccttgggatcctcaatatttggtcgaatctttgtcagattctactgtctatatggcttattatactattgatcgtttcttgcattcagattattacggtaagaaggcaggtaagttcgacattaagccagagcaaatgactgatgaagtatttgattacatctttactcgtcgtgatgacgttgaaactgacattccaaaggaacaattgaaggaaatgagaagagagtttgaatatttttacccattagacgtcagagtttcaggaaaagatttaatcccaaatcatttgacattcttcatctatacccatgtcgccttgttcccaaaaagattttggccaagaggtgttagagccaacggacatttgttgttgaacaatgctaagatgtccaaatcaactggtaactttatgactttagaacaaatcattgaaaaattcggagctgatgcctctagaattgctatggccgatgcaggtgacactgttgaagatgccaactttgacgaagccaatgctaatgctgcaatcttgagattgacaactttgaaagattggtgtgaagaagaagtgaaaaaccaagataagttaagaattggtgactacgattccttctttgatgctgcttttgaaaatgaaatgaatgatttgattgaaaagacttaccaacaatacactttgagtaattacaaacaagcattgaaatcgggattgtttgatttccaaatcgccagagatatttatagagaaagtgtaaacacaacagggattggtatgcacaaggatcttgttttgaaatacattgaataccaagcattgatgttagctccaattgctcctcattttgccgaatacctttacagagaagttttaggtaaaaatggaagtgttcaaactagcaagttcccaagagcctcaaagcctgtttccaaagctattcttgatgctctggaatatgtcagaagccttaccagatctatccgtgaagcagaaggtcaagctttgaaaaagaagaaaggaaagtctgatgttgatgggtcaaaaccaatcagcttgacagttttggtttccaacactttcccagaatggcaagataactatattgaacttgtcagagaattgtttgaacaaaacaagttggacgacaataatgttataagacaaaaggttggcaaggacatgaaacgtggtatgccatacatccaccaaattaaaactagattggcaactgaagatgctgacactgttttcaacagaaaattgacttttgatgaaatcgatacattgaaaaatgttgttgaaattgtcaagaatgccccatactctcttaaagttgaaaaattggagattcttagtttcaataacggtgagactaaggggaagaatattattagtggtgaagacaatattgagctcaatttcaagggtaaaataatggaaaatgctgtacctggtgagcctggtatctttattaaaaatgtcgaataa

SEQ ID NO: 4179 - DNA, 462 bp, Candida albicans
ttaattgttggtcatgtgaccggtcatcctagaattcaattcaacgactttttgggatgtttacaagcatatggatatgagatatacccagtcgaatatccagtatggaccagtgcattggagagatttgttactgaagaaagtaaagaatctgccttattcccacttttacattttgtgttggataatttgccacaagacacaaaggctcccgagttagacgactctaatgcagccaaatcattaaaacaagattccaaatatacgggagaagattttagtgctggtaaaggtgtggatttggatcaaactggtgtttacattagttatttgatcaagattggattcttacctaaaccaactggtacaggcgagaagaaattgcctgaagttgagattagtgatgaaagcttgaaattgattagtggaggtgctggtgcacgtggatcagctgccaaataa

SEQ ID NO: 4180 - DNA, 1524 bp, Candida albicans
ttgaaaacattcaaagctgatgttgatgattccatagaagaagccaatgatccaattgtcaagggattagtcgcttacagagaattgattaaagacatcaaaggatacttgaaaaagaagttggcatcctacgctattccaacaatcattgtaccattagtgaaattacctttgaatcctaatggtaaagtggacaaaccgaaattaccatttccagatactgctcagttagcagcagtcgccaaattaagtgtttctagtcacgatgcccaagctgctgaagaagaaaacttgaccaaattggaagagcaaattagagatttgtggttagatgtgttaccaaaccgtccagcaacaatttccaaagatgattcattcttcgatttaggaggtcactctattttgggtaccagaatgatttttgagttaagaaagaaattaaatgtggaaatcccattgggtgtcattttcaaaaatccaacagttgaacaatttgccaaagaagtcgaaaaggtgatcaaaggaggccaagatttccaattggctgatgaaggtaaaactattcaagaagagaataaagatgtcgctgattctcaaagcgaaaacctaaactatgctgaagatgcaaaagaattatcaaaatcagcacttttggaatcatattcatctttgaaacagcttccatctggatcaattaacgtttttgttactggtgctacagggttctcgggttcttttatagttcgtgacttgttgactgcacgtaacaaaaacttggatatcaaagtgtatgctcatgtaagagcatcttccaaggaagctgggttacaaagattacgtcaaaccgggatcacttatggtatttgggatgaaaattgggccgaaaagattgaaattgtgttaggtgatttatcaaaagaaaaatttggattggataattctcaatggttagatttgactaataacattgatgtgattattcacaatggtgcctttgtgcactgggtatatccatactctcagttacgtgatgctaatgttattggtactatcaatgttttgaacatggcaggtgaaggtaaagctaagttcttttcatttgtttcttcaacatccgctttagatactgattactttgttaatttatcggatgaattattagcccaaggtaaaaatggtatttccgaagctgacgatttacaaggatcggctaaagggctaggaaacggatatggacaatccaaatgggctgctgagtacattataagacgtgctggtgaacgtggattaaaaggatgtatcaccagacctggttatgttactgggttttccaaaactggtgcttccaatactgatgatttcttattgagaatgttgaaaggatctgctgaattggggttatatcctgatatcactaataatgtcaatatggtccctgttgatcatgttgccagagttgttactgctactgcattaaacccaccaagtaccgaagaattaactgtgtccacacacgcccgctag

SEQ ID NO: 4181 - DNA, 270 bp, Candida albicans
aaacctgggagagaacatggctggttaaagccaatagacagaatgtatagatctggtgatttgggtcgttatttacctgatggtaatgtagaatgtcgtggtagagcagatgaccaagtcaagattagaggtttcagaattgaattgggtgaaattgatactcatttgtctcaacatcctctagtcagagaaaatgtcaccttggtgagaagagacaaaaatgaggaaccaacattgatttcttacattgttccaaaagattctccataa

SEQ ID NO: 4182 - DNA, 2040 bp, Candida albicans
caaccttcaattaattccacaacaatgactgacttttggttgaattatttggataatcctacattatctgtgttaccccatgattttttaaaacctgctaacaataaatccgtggaaggtacttacacattcaacattgataatggtagtactgatttcaaatttggcttggctgtatttgctgcattggtttacagattaaccggtgatgaagatatagtaattgccactgacgaatcggccaatactccagaatttattgtcaggttaaacttgacaccagaattaactttccaagagctcgtcagtaaaataaccaaagagtacgaaaacagcatttctcaaataaactacaaagcattatctgaggtttcacatagaattaaagaggctaaagggttagatgaaaaccctggattgttcagattgtcctatcaacatgctcactctaatcaacaattgaataccacagtcgagggatctattcgtgatttagcgatctacaccgatggaacaaaattcaccatttactacaatgccttattatattcacacgaaagaattgtgatatttggagaacaatttgcacagtatttaacaactgtatcgaacgataccaatactgttataactaaagtgaatttgattaccgacttccaaaaaaagaatttgcctgatccgacaatagatttagattggtcaggttacagaggtgctattcaagatatctttatggataatgcaaataaacatcctgatagaacatgtgttgttgaaaccgaatcattcttggattcaaactcaaaaactcgtagctttacctaccagcaaattaatcaagcttctaatgttgttggtaactacttgaaagaaacaggaatcaaaaaaggtgatattgttatgatctacgcttaccgtggggtagatttaatgattgctgttatgggtgttttaaaagccggagcaacattttccgtcattgaccctgcttaccctccagcaagacagaatatttatctttctgtggcaaaaccaaaagggttaattgggttagaaaaagccggtactttggatcaattagttgttgattatattggtagcgaattagatgttatttctacgatcccacaattgaaagttcaagatgatggtacattagtaggtggtaaacttgaaggtgcagataacgattgccttaacgattatcaaaaattcaaagatcaaccaaccggggtgattgttggtcctgattctaatccaactttatcattcacttctggatcagaaggtattccaaaaggggtattgggtcgtcattattcattagcctattatttcccatggatggctaaaagatttggattatccgaaaaagacaaattcaccatgttgtcgggtattgcccatgaccctattcaaagagacatgtttactccgttgtttttgggagctcaattattagtgccaactgctgatgacattggtactcctgggaaattggctgactggatggccaagtatggagcaacagtgacacacttaacaccagctatgggtcaattgttgagtgcccaagccaccactgcaattccaagcttacatcatgccttctttgttggtgacattttaacaaaaagagattgtttaagattacaaagtttagctgaaaatgtgtttattgttaacatgtatggtactactgaaacacagagatcagtgtcatactttgaaatcaaaagtcgtaaagcagatcctacatacttaaaaaacttgaaagatgtgatgcctgcagggaccggtatgcacaacgttcaattgttagtcgttaatagaaatgaccgctcgcaaacctgtggtgttggggaagttggtgaaatctatgttagggcagctggtttagccgaaggataccgtggattgcctgatttaaatgctgctaagtttattaccaattggtatgtcaacccagacaaatggatcgaacaagatgaagctaacaaaaattccagtgaaaacctgggagagaacatggctggttaa

SEQ ID NO: 4183 - DNA, 1824 bp, Candida albicans
gactccttctccatctatcgcccaacacccacaatcattatgtctgaagaagttgataaagttgccgaacaagttcaaaaaacctatttggacgatgtcaccggtgaacaagtttccaaaaccgaattaaaaaaaagacaaaaacaaagagcaattgaagctaagaaagctgctaaagctgctgccactccagccaaaactaccactaaaaagaaagatgaattggctgatttgaatccaaatcaatttttcgaaatcagatctcgtcaaatttctgaattaagagagaaaaacaatgctgatccatcagctttcaacccataccctcacaaattcaatgttaccaccaaaattccagaatttgttgaaaaatacgcccatttgcaaagaggggaaactttgaaagatgtcactgtttccgttagtggtagaataatgaccaaaagagaatcaggatccaaattgaaattctacgttttaaaaggtgatggtgttgaagttcaaattatggcccaagctcaagatgctccaagtgttgaagctttcgaatcaatgcacgaaattttgagaagaggtgacattatcggtgttactggttatccaggtaaaactgctccagccaaaggtggtgaaggtgaattgtccgttttcgctaccaaagtccaattattgactccatgtttgcacatgttgccaactgaacattatgggttcaaagatcaagaagctagatacagaaaacgttacttggatttgattatgaacgattccagtagagaacgtttcagagttagatccaaaatcattcagtacatcagaaaattcttggacaacagagatttcgttgaagttgaaacaccaattttgaatgttattgccggtggggccactgccaaaccattcactactcaccataatgacttgaatatggaaatgttcatgagaattgctcctgaattgtttttgaaagaattggttgttggtggtatggacagagtttacgaaattggtcgtcaatttagaaacgaaggtatcgatatgacccataaccctgaattcaccacttgtgagttctatcaagcttatgctgatgtttacgacttaatggacatgaccgaattgatgttttccgaaatggttaaagaaatcactggtgattacgttatcaaataccacccagaaggtccatcaggtaaagaaatgactttggatttctccagaccatggaagagagtcaacatgattgaagaattggaaaaagtatacaatgttaaattcccagctggtgatcaattgcacactgctgaaactggggaattcttgaaaaaagtcttgaaagacaacaacttagaatgttctccaccattgaccaacgctagaatgttggataaattagttggtgaattagaagatgcatctatcaacccaacttttattttcggtcatccacaaatgatgtcgccattagccaagaaagatagaaacattcctggtttgtgtgaaagattcgaagtttttgtcgccactaaagaaatctgtaatgcttacacagaattgaatgatccatttgatcaaagagctagatttgaagaacaagccagacaaaaagcccaaggtgatgatgaagctcaaatggttgatgaaactttctgtaacgctttagaatatggtttaccaccaactgccggttggggttgtggtattgatagattggcaatgtttttgaccgactctaacaccattagagaagtattattgttcccaactttgaaaccagatgctttggtcttgaaaggtgaagaaccattaaaagatgaaaactaa

SEQ ID NO: 4184 - DNA, 1167 bp, Candida albicans
ctaactcatatactaattatgtctaaatcaccagttattcttcatttaagagcagaaactaaaccattagaagctagagctgctttaactccttctactactaaacaattactcgatgctggatttgaaatttatgttgaagaatcttctcaatctacttttgatattaaagaatatgaagctgttggtgctaaaatagtacctgaaggttcatggaaaactgctcctaaagagagaattatttttggtttaaaagaattacctgaaaatgaaactttcccattaattcatgaacatattcaatttgctcattgttataaagatcaagctggttggcaagatgttttaaaaagattcccacaaggtaatggtatattatatgatttagaatttttagaaaatgatcaaggtagaagagttgctgcctttggattttatgctggatttgctggggctgccattggggtattagattggagttttaaacaattgaatggtaatactaaaggtactaaaagtgaacgtgaacgtggtgaattacctggggtgactccatatcctaatgaaaatgaattaattaaagatgttaaaattgaattagaaaaagctttaactaaaaatgggggtcaatatcctaaatgtcttgttattggtgccttgggtagatgtggatctggtgccattgatttatttaaaaaaattggtatccctgatgataatattgctaaatgggatatggctgaaactgctaaaggtggtccattccaagaaattgttgatctggatattttcattaattgtatttatttatctaaaccaatcccaccatttattaataaagaaattttgaataatgaaaatagaaaattgactactattgttgatgtttctgctgatactactaatcctcataatccaatcccagtatatgaaattgctacagttttcaatgaaccaaccgttgaagttaaacttgataaaggtcctaaattatcagtatgttcaattgatcatttaccttctttattacctagagaagcttcagaattttttgctaaagatttaatgccatcattattggaattaccaaatagagatacttctccagtatgggttagagctaaacaattatttgataaacacgttgccagacttgataaagagtag

SEQ ID NO: 4185 - DNA, 1362 bp, Candida albicans
ccaattcaattcaatcaaatactaaaaatggttaagaaagttcttttgttaggatctggttttgttgctaaaccaaccgttgatattttatctgaacaaccagacattgaagtcactgttgcttgcagaaccttatctaaagctaaagaattagctggtgataaagcacaggccatttctcttgatgtcactgatgctgctcaattagatgaacaagtagctaaacatgatttggtcatttcattaattccatacactttccatgtcaatgtggttaaatcagctattaagaacaaaaagaatgttgtcacaacttcgtatattaaccctcaattgaaagcattggaaaaagaaattgaagaagctggtatcactgttatgaacgaaattggtttagatccaggtattgatcatttgtatgctgttaaaactattgaagaagttcataaagctggcggtaaaatcgtatcattcttatcatattgtggtggattaccagccccagaaaattccgataatccattaggttataaattttcttggagttcaagaggggttttattagctttaagaaaccaagccaaatattggctcgatggtaaagtcattgatatttctagtgaagatttgatggctagtgctaaaccatatttcatttatccaggttatgctttggtttgttatccaaacagagattctactacttataaagaattgtacaatattccagaagctcaaaccgttattagaggtactttgagattccaaggtttcccagaattcattaaagtgtttgttgaccttggatttttgaaagatgaaccaatggaaattttctctaaaccaggtccatggaacaaagctttagctgaattggttggagctaaatcaagctctgaacaagatataattgataaaattaaccaattgactaaattcaaatctccagaagaccaagaaaggattttggctggtttcagatggttaggattattttctgaaaatcaaattactccaagaggtaatccattagatactttatgtgccactttggaagaattgatgcaatatgaaaaaggtgaacgtgatttagtcattttacaacataaattcggtattgaatgggctaatggtaccaaagaaactagaacttctactttggtcgattatggtgatccaaatggttattcttcaatggctaaattggttggtgttccttgtgctgttgccactaaacaaatcttgagtggtgaattatccaaaaaaggtttgttggctccaatgagttccgacattaacgattctattatgaaagaattgaaagataaatacgatatttatttggttgaaaaaactatttaa

SEQ ID NO: 4186 - DNA, 1380 bp, Candida albicans
ttcttttttttttctattataattattcttatgaagtcacgaattgcattaaccttaagacgatttatatccactaggccacggcttttcaccacctataccaccggacaaccaacatatgaaacaagacctcatattatcacccaaccaggtgatttaactccagggatttctgcaatggaatactatcaacgtcgattgaaattatcaacacatcttccatccaaatcattggccataataattgggaataccactcaattcagttctgggagcgtattttatgattttcaacaggataacgatctttattatttaactggatggctagaacctgattctatagtggccattgagaagaagggtgacaatggtgaggatgacgtggtgttgcatatgttagttcctccaaaggaccccaaaaaggagttatgggaaggtccgaaaagtggattggaaggtgcatataacatttttaacgccgatttggttgaagatataagtcaggccccatcgtacttgaagcaattaattaaacagaatgattacatatattgggacaaaaaatttaatctgaaacaaaatgaaggattgagacagtttttcaatttttcaacaaatcatcgccatcatcaaggtataaatgaaattatcgaaaattcaaaaaaaagtgtacagaaactatccccaatagtagcaaaattacgtgttattaaatctgacgcagaagtaagtgttatgaaacgagcttgtgaaatttcaagtgtagcaattaatcgagcaatggctacagtgggatcagatgatcctatcaattctgaaaacacgttggcacgatacttggagtatcagtttgtgaaaggtggatgcgaaaagaatgcctatatcccagtggttgccagtggatctaacgcattatgtttgcactacaccagaaatgatgatttgatcaagaaaaatgaacttattttcattgatgctggtgggaaattaggcggatattgtgctgatatttctcgagcatggccaaattcaacagacggctttactgatgctcaaagagatatatatgaagtcgtcttagctactaataaaaagtgcattactttgtgtagcgaatcgttaggctactcattccatgatatccatgaagtttcagtgaacacattaaagcatgaattgaaaaatcttcctgggtttggtgatgtcaccttcagcgacatctctagaatttactacccacattatgtgggtcacaacgtggggctagatttgcatgacataccatccgtatccaaccgtttgccccttaaaacaaaaccaagtcattaccatagagccaggatggtatataccacaggacggaccaaaacattatag

SEQ ID NO: 4187 - DNA, 234 bp, Candida albicans
atttgcatgacataccatccgtatccaaccgtttgccccttaaaacaaaaccaagtcattaccatagagccaggatggtatataccacaggacggaccaaaacattatagaggcataggcttacgtattgaagataacgttgttgttgggaaaacccatagggatataattaatttgacaagtggttgcaagaaagaggtttctgatatcgaggcattagttaggggtggttaa

SEQ ID NO: 4188 - DNA, 495 bp, Candida albicans
gatatccacttacaggcccacaatgtgttgattcaggggtttttagagctaggaattttcaattccaaatactcggcaaaaaagttgtttgctgctaaagctactgctagattcttccctcacgggttgggccacgttcttggtatggatacgcacgatgtgggtggccgcgccaactactccgaccctgacccgttattgtgctacttgcgaattagaccaaaattggaaccaaatatggtcgtcaccaacgagccagggtgttacttctcccccttcttattagaagaggtcctcaacaaccccgaacaagccaagttcatcaacacggacgtattggacaagtactggtacgttggcggtgtgcgtatcgaagacgacgtcttgatcacccccaccgggtacgagatttttacaaaaatcacaaaagacccagcagaaatcagcaaaatcgtaaaggctgggctcgccaaaaaattccacaacatagtttaa

SEQ ID NO: 4189 - DNA, 534 bp, Candida albicans
accaccctaaacctccccggacatccccttattatgaatattcgtcaacaaatcactcaatttttatcacttgcatatgttttttcatcagcatttatgttatggaaaactttatcggtgatagccaattctcattcccccatagttgttgtattatcaggatcaatggaaccagctttccaaagaggtgatatattatttttatggaatagagatcatcaacaaaaagttggtgatatagttgtttatgaaattgatgggaaatctattccgattgttcatcgagttttaagagaacatcataatctggaaaaacaattattattaaccaagggggataataatgctgttgatgatttatcattatatgctaaaaagcaacaatatttaaatcaaaaacaagatttggtgggtaccgtgaaaggatatttaccatttattggatatgtgaccattttaattagtgaaaatgtatattttaaatatggtatgttaggattattaggattatcatcattattttccaatgaatag

SEQ ID NO: 4190 - DNA, 951 bp, Candida albicans
atgacagtatccaatactatcaaaatattaagaacagtacaacaagttcgtcaatggagagcacaatgttttttacgaaatgaatcagtaggatttgtccccactatgggagcattacacgctggtcattgttcattaattaatcaatcgattaaagaaaatgataaaaccgtcgtttcaatatttgttaatccttcacaatttgctcctcatgaagatcttgataattatcctcgaactttagatcatgatttgcaaatcttacaaactaacaacaacaacaacaacaacaacaaaatcgtggatgcagtatttgttccaaaagtttcagaaatgtatccttcagggatctcattagatattgataaacaacgaggagcatttgtaacggttcatggatcatctgaacaattagaaggtatcactagaccacaatttttccgtggtgtagctaccgtggtgacaaaattattaaatattgttcaaccaacaaatatttattttggtcaaaaagatgctcaacaatgtgttgttatacaaaatttagtcaaagatttaataataaatactaatgttagaatcatgcctacattaagagaatcaaatggattagctatgtcttcaagaaatcaatatttatctcaagaaatgaaagataaaagttcattaatttatcaaggtttaaaaactggtgaaaattattatctcaatcatagtaaagatagcggtgataaagtttcagctaatgaaattttacaacagattaaacctattataagttctgatcctgatttcgatattgaatatatagctgttagtcatccagaaactttagaagatcttgattatgtggtgcctggtactggtgcaattgtttccactgctgttaaagtacctaaagaaaactctgatgaaaaggcaagattaattgacaatattatcttacattag

SEQ ID NO: 4191 - DNA, 540 bp, Candida albicans
acttacaattatcaacaatcatcaatgggcaacgagttattatcaaccgcaagaatatacacgttcaaaatacccgatgcatataataatgtgatagatttcgaccaattcaagaataaagtgatactaatagtcaatgtggcaagtttgtgtgggttcacacctcaatataaagaattgcaattgctttacgaaaaatatcatgaacgtggtctagaaatattaggatttccttgtaatcaatttggaaatcaagaaccacttcaggaagaagaaatagtcgaatcttgtagacgcaattttggtgtcagtttccccataatgaagaaaaccaaagttaatatagattgtgatggccatgagtcggaatcgaacaagtacttgaaatctggaaagcctggtgaagtgggttttaaaggtgtccgttggaattttgaaaagtttatagtgaacagaaaaggtgaagttgttgctagatttaactctctaataacaccactacaactcgaagggtttattgaacaacttttatcagaataa

SEQ ID NO: 4192 - DNA, 282 bp, Candida albicans
cctaccgagtttctatttcctccctcaatacttatagctatgtcggatttttatgaatttgctccaaatgatatcaagggaactccttactcattcaaaaaacttcaaggtaaagttgttcttattgtcaatgttgcttccaaatgtggattcactccacaatacaaaggtttaccagatttgaaaccaaaatttgctgatcaaccagtggaaatattaagaattccttgcaatcaatttggtcatcaagaacctggaactattgaaaaaattgaaaagtaa

SEQ ID NO: 4193 - DNA, 699 bp, Candida albicans
gctctaaatatggtgaaaagcaacgtcgagctggcatgggaaaccatggaagatacatttctggaaatccaaaacaaatttcaccaaatttacaaaccaatagacactggcaaacctgatgaagatgatgaaactactaaaaaagagagtcttgacattactgatgattcgacactctcagtatcaccaataacccaactactttatcttgcacgactgaagttttatgatttaactcccttagataacctgaaatcaccattcccattcaaaaatctacgaggtaaagtggttttaattgttaatgttgcctccagatgtgggttttctttccaatacaatggtctagaacaattgaataaacgatttgctaatgatgactttgtgttattgggtgttccctgtaatcaatttctatggcaagaaccaggcactaatgatcaaatagtaacgaaatgtaaaaagaaatatgatgtatcattccagatactagataaaatcaatgttaatggtgaacaagcagatccagtttataaatttctaaaagcacaaaaagaagggttatggggtactaatagagtgaaatggaattttgaaaagttcttgatagataaaaatggcagagtggtggaaaggtatagtacgtttactagacccgtggcaataacaccaaggattgaacagttgctagaaagctag

SEQ ID NO: 4194 - DNA, 579 bp, Candida albicans
attgtttttctttttccttctttttgcctcccttctctttctttgtattattacttcattacaaagtattcaattatcacatatctacataaaatgtctcaattttacgaattagctccaaaagacgccaaaggtgaaccatacccatttgaacaattgaaagggaaagttgtccttatcgtcaatgttgcttccaaatgtggattcactcctcaatacaagggtttagaagaattgaataagaaatttgctgatcaaccagtacaaatcttgggtttcccatgtaatcaatttggccaccaagaaccaggtagtaacgaagaaattggatcattctgttcattgaactacggtgttacattcccagtcttggataaaattgaagtcaatggtgacaataccgatccagtttataaatatttgaaatcacaaaagagtggtgttttgggattgaccagaattaaatggaattttgaaaaattcttgattgaccaaaatggtaaagttattgaaagattcagttcattgactagtccagaaagtatcggtaccaagattgaagaattgttgaaaaaataa

SEQ ID NO: 4195 - DNA, 474 bp, Candida albicans
acagttatatttggatcagaatgggcacaagtggaaataatcaatcgattattaaatcaaggtgataaaattgataatgatgatggtaatggtgacaacaatgataataatgataaagttgattattcaaatttcattattagaataacttgtttatttgctattactagtttaataccagttattgattataaagttttaattgataaagtattaccatttattaatggattaattaatgattcggttccaaacattcggtttaatgtggctaaatcatatttaatattagtcgaatcattaattaataagaaaaaatcgggtcaactatcagaaacaaatgatcaagaattgaaaaaattcattgattcacaagttttatcaaatttacaaaaattggaaaatgatgatgatgttgatgttagattttattcaattaaaagtattaaaggtattaatgaaattttaacttga

SEQ ID NO: 4196 - DNA, 1104 bp, Candida albicans
gtgatgaagaaattaatgggattttctctgacattaatacaaaatttgagtcaaggtaattggttcctgaaaaaaattgctgcttgtggattatatcaatcagttattattagagttgatgctactactagacaaaatttattgaaattatatttcaaattagttactgatgattatcctatggttagaagagctagtgccaccaatttacctcgattaattgatttattgactgaatttactgaacataatcctaatgatgttaataaaattactaatgaagattgggaaataatttcgaaaatgtttcaacatttaattactgatgatcaagacctggttaaatttttgagtgttgacgttttaatttctattttagaatttttcgggaaaattcatgaatacagttttaatgctgatttcttatctagtgcattaaaattaattcaagatgaaagttggagagttagatatactgccgctgataggtttagtaaaattgctcgtaacttcaccaataatgaactggatttattccaattgattgatccatttatttcattaatgaaagatcatgaaggtgaagttagaaaagctattgctaaacaattgccagttttctgtcaattattagtgaaattccctctgactaaagccactgttttaaataaaattgtccctgtggccaatgaattgagtcaagatcctcaagaaaatgttcgtgcttcattagcttccactataactgaactttcaccaattttagaaaaacaagccactattgataaattattaccagtgtttttaatcatgttaaaagatgaattccctgatgttagattaaatattatttccaacttatctgttgttaatgaaaccattggtattaatttattatccactaatttgttaccagcaatcactgaattggctcaagatcataaatggagagttagattagctattattgaatacattcctaaattagccaaacaattgggtgaatcatttttcaatgaagaattattatcattgtgtatgtcatggttatgggatccagtttatgccatcagagaagctgctgttaataatttaaaagaatag

SEQ ID NO: 4197 - DNA, 447 bp, Candida albicans
aacaagagaaacttcaaaagtaacactggcattatgaataattttagtgatgatttatacccattagctttgttaatggatgaattgaaacatgatgacgtttctaatagagtagaggcgatgcaaaaattggacaccattgctattgccttgggaccagaacgaacaagaaaagaattattaccatttcttaacgatgttgctcaagatgatgaagaagaagtttttgccgttttggcaaataaattgggtgaatttatcccattaattggtggtcatcaatattctgaaccattgatttctattttaactatattggcctcaatggaagaaccattagttagagataaagccattgattcattaaataaaatcagtttggaattgagtgatgaagaaattaatgggattttctctgacattaatacaaaatttgagtcaaggtaa

SEQ ID NO: 4198 - DNA, 753 bp, Candida albicans
  unsure (509),(512): Identity of nucleotide sequences at the above locations are unknown.
cttggatccgacatggcttttccaggctgtgtgaagattgattatagatcagatgaatttgttgttttggcttgtgatggtatttgggattgtttaacttcacaaaaatgtgttgaatgtgtcagaagaggtatttatgaaagaaaactgttatcaattatttgtgaagaaattatggatttatgttgtgctccaacttcagatggatcgggtattggatgtgataatatgtcaattgccattgttgcattattagattatactaaaaacgaaactttagatcaatggtatgaaaaaatcatatccagagttgaacaacagcaacaacagaaaaacgatccaaatagtttgaacaaatatggtccaatttctcaaccttataatgaattatacaaagaaatgtatggtgaatattatgatattggtcaacaaggtcaaggtggaaatggtagatcaaatattggcagtggtaatggtagtggtcgtggtagtggtgcaagtggtagtantantggtggtggcgctagtattaatggtaattctatatttggaagaagtggatacgatgatgaagatgatgatgatgatgaagaaaaaaatattgaaaggagaagaagagatcaagatgaatcccatttaaatggaggagctatttctttacagaaattattggcttctaatgctataacaaatgaaaatggtgtaatatatttagatacttcatcagctcaatctcttttagctcattttggt

SEQ ID NO: 4199 - DNA, 297 bp, Candida albicans
ccattatcaattgtttcaatgggtcaactattatcacatccgattgaagagaaagaattggattataaatcctataccaatttgacgtactgtatagggtccatgcaaggttatcgaatgactatggaagatgctcatgatgttaaaataaacgaacatgaaaatttggcagtatttggtatttttgatggtcatggtggtaaaaattgttcccaatatttagctgaacatttgcctaaacttgtatttaccaaattgaataatcttcaccacgcagtggacgatccgacttgcatt

SEQ ID NO: 4200 - DNA, 504 bp, Candida albicans
  unsure (15),(26): Identity of nucleotide sequences at the above locations are unknown.
cgtgacgcgactccntccatcccggncgggatgatagatctcaaggatgtgtttgatatcttgaagaactcatttttcaaaattgataaggatttatctcatcatgcaaatatggtcaattgtgggtccacagccactgtagtgacgataattgcaaactatattgttgttgctaatacaggtgattcacgatgtattgtttcaagaaatggtcatgccaaacccttgtcatttgatcacaaacctagtaatatgggggaaagagtcagaatagagaatagtaatggatatatactaaataatagaatcaatgaagttctagcattgtcacgagcatttggtgatttcaagttcaaactaccatatttatcaagctccagaaataaatatattaaagaaaaccaaaagttattgggtgataaactaatcacattaccaccagaattattccaagtgacagtcgaaccagatataatgttatatgatatgcaaaagttggattcg

SEQ ID NO: 4201 - DNA, 807 bp, Candida albicans
ttaaacaataaagtatgtgttggtaatatacttgatttccatcaaatacaagaaaaaaatgataatcaattcaaattggtcatatattgtgaagattatcaaaacgaagaatgttatgatgaattcccaactttacaagatttacaatatatttggcaagattatatgctggggaatcatattcaccatacttatatgataaagatcccatcattaggttttagaaataataaatcaattgatgaatatgaactaataatgattttgaatcttttgaaattgattgaacgcatcagtcgagttaataaagtatttattggttgttatgatggattcactcattctacaaatttattagtattagtaatgcaattattgggtaaagttattattgaagaatcgattttccaattgacagaaactgaaaatgtcaaattatttttttcaaatccgggtattgttggtggtgatttacaatttttaagagaattagaaccatttgttgattatttgaataaacatttgattcaagaattcccgacaattattgatatgaataacttggatttggattcaattcatcggtattattgtatcaatcctattgctaaacctccactttatcaagatgattggtttgttgtcaagactaataattccaaacatgatataaatttaccatcaagaattttagcaaatgtgtatttgggaagttcaatgcatggtgggtcattaactattctacaaacttataaattcacccatttgatttctattgatgaattaccaattggtgggactcattga

SEQ ID NO: 4202 - DNA, 2202 bp, Candida albicans
ggatttcataaatataatttagctaaacgttcattttttgtacatcaacgacaacaattacaacaaaaattggataacagtagtactaatactagtaataccaatttccaagattatatgaatcataatgaattgtttactgattatcatttatctcgaccagatgatattcgatttttaatgtgtattaatgatgaaagtttaccagttaatttacataatacggtgaaattgacagaaatattgacaaaaatcgatgtttcaaaatcggaaattaaagaaatcattaaaaagatctggttaaatgataaaaatggaattgaaactgaaactgaaactgagactgagactgattcaagttttattgaattattggtgactgattgtataaaattaaatgttttaccgatatttttaaatttagatcctgaaagagggatttcattaagaaattttcaaattcaagtggcaaaattatcaagttgttccgattttataatttatggaattgatgaattgaaaattcaatcaataacaagaattctttggttagctcaaaggtatgaacgtcaacaacgagaaattgaaattaaagaatcacgtaaaggtaatcaacaacaacaaacatataatatatttgttttaaaaaatgatttaactcaatgttatgaaaaattacctccttctactacaattatgaatactatacaatcatttgctaaatatctgaaaattgatacttcagggttattttataaaccaataaatcaatatcttttaaatgattataatttaccattatatgaaaaaattgaaactgcgaaaatgtcttctgctacaaaaatttatcaaaatgtttggataggtaatttttgggattatcaaagtatgttaaattatttatctgagaataaaccagtggaaacatcaaaggaaaacttgagagattattattgtcaaccatcaaactcaataactactagtactactactactactactaccaccaccaccaccaatagtcaattatcattacctcagccaaaagctaattggaaattatttattcgatgtcatagtgaagcttcctttcctgatttacaagatttaaatcaattattatttaaatatactatatcatcgcatgaacaatcagatgaaattcatcatttggaattcccaccactgggttcaattggaattggtgattgtaaaaaagaaaatttacaactgataattaatacttgtaaattgatttatttatactcgtcaaccacaaccaaaaatccttcatctgggttaaattcattgatttattgtactgatggatatactgaactgtcattattagtattttgttatttaatgtattcattaaatatatcattagatgaagctatattagaattacatttaacttatggtagaccattttatatttttcctagtgatgtaattattttaaaaaaattacaaccattattaagaaagtttagtcccaccaccaagagtagcaacaataacaattcaatgaatcgacaaattgattgggcaaatttagaaattctttcatcacaagaaattaatgaattattattaggttcaccaaaagaatcctcacaacaaaataccagattaggatttatttccccaaacgaggacgaggacgaggacgaggacgatgaagatgaagatgaacaagatattgataatgattcaagttcaggatcctcggattattcttttaatgaaattgattgggttaatgaagttgaaggatcaattccatcaaaaatattacctcatatatatttaggttcattaaaacatgccctgtgtttatcaattttaaataaattgggtattcaaaaaatcatatcagtgggggaatcattaccttggttaaatggatatattttccaacgtcataatgatataactataaaccaatccaccgatggtaatattgaaacttataccatcacccccaaaaagaaaaccaacttggttgcccattctcaccatattacttccgtggatacagtattaaaagttaataatttagaagatgatggaattgatgaattaagtcaaagattaccccaaattttaaaatttataaatgatcaatatgaaattaatcaaggtcaagtgaaaattttaattcattgtcgagttggtgtaagtagaagtgctaccgtt

SEQ ID NO: 4203 - DNA, 597 bp, Candida albicans
aaattaaaaatttatgaatttgaattcaatctgaaaaatttgaaatcaatacctcaagaattattaaataaatggtcttcttcatcttcttcatcaatggggttaccacataaaaatttcaaatcattgatttatatccatgattttaaagatgacggtagagattcattaatggaattattaattgatgctccaccagcaatccaagataaaatattattaggatcaacaaccaatatcaataatcctactaacaattatactaacgccaacaataataataataaaactttgattcattgtaaaattggtgttagtagatcagcaacattggtaattgctcacttaatgaaaacttatagacttggatttttacaatcatattttcttgttagagttcaacgatttaatataattatccaaccaaatttaaaattattttatgaattatatttatttgatcaatggttaggattaaaagatttttatattaatcatcaatttaaacattataattgggaaactatttgtcatttaattaatcaattgaatcaaatttatatcaacccaaaatctataacactttcatcgtcatag

SEQ ID NO: 4204 - DNA, 1122 bp, Candida albicans
tctcgtgtaacaatgtttcagtttattccttttccaatatcattcacgaagatgaacatatccaagaaaccaataacagcagtgacaactgggctaacggctattacgtccaatgaatcccgcaaagaaaactcagactcctcctcctccaagaaaagcacacctgcagttcttacaatctcctcacacaagcaaagggaagatttcaatgaattgaacgagattgaatcgcaccgtatagtggaggggttgaacaatgccgccacttccatctggtcgatcagtgctgggatatcccgtgttaaccgcaagagaaataggtacaccaacgttacaccatgggatcgaacaagagtgaaacttcccgttgtggatggatccttttcggattatattaacgcatcacacattcacttgaaaaccacagcaagcaaaatatctaacagatacattgcatgtcagggcccattggaacatacaactcaccacttttgggcaatgtgtttcaacgaactggaaaaacaaaaaaatgacgtggttgttgttgtaatggtgacccctttggtcgaaaacggaatggtaaagtgcgacaggtattggccggaattgcatgaaacgtgggatttcacctccaagaatgcagaggatggtatcaagtatgaaaaattaactctcacaaacattggcgagaatcacaaggaactggaagattacttgataaccgaattggagttgaaatcgcccaccaagagcaaaaaagtttatcactactactattataaatgggcagatgccaaagtgcctccatctatcgaaccgttaattgccttgtcgcgcagtgtttataagatcaatcagccattgatcgaatctggcaaaccgcttgtgccaatagtacattgctctgccggagttggtagatctggaacatttatggcttttgatcatttgtttagagatgcagacaagtttcgaaacctagtgcacgaagacagaatagccagtaaggatttagtataccaatctgtctgtcagctacgtaaccaacgtatgatgacggtgcagactgtgtaccagtattgctttttatatgaagctgctagaactatatataagagatag

SEQ ID NO: 4205 - DNA, 324 bp, Candida albicans
gcgccgatttggcagctccgtggtgaagatccaaggagagctggttttacttttggtcaagacatttccgagcaattcaaccatactaatgatttaagtcttattgctagagcccatcaattggtgatggaagggttcagttggtctcatcatgaaaatgttgtcacgatattttcagctccaaactattgttatagatgtggtaatcaagctgcaatcatggaagttgatgaacaacataatagacaatttttacaatatgacccaagcgttagaccaggagaacctacagtaacaaggaagactcctgattatttcttatga

SEQ ID NO: 4206 - DNA, 816 bp, Candida albicans
  unsure (800): Identity of nucleotide sequences at the above locations are unknown.
acaataatggatttagatacagacgtgccaatggaagacgttgaggaacagcaacagcaacaagaacaatctctttcgaaacaatcggctacaaaatcattgaccaatcctcaaggcactggtgccactgcaacttcatcagcacaacaacaaagaaaagatctagacggatcatcaatcaatcaattagatgtgtggattgaaaaattgtcaaagtgtgagccactttccgaaaccgacgtcaagaaattatgtgatatggcagttgaagtgttacaatttgaagaaaatgttcaaccagtacaagtgccagtgacaatatgtggtgatgttcatggtcaatttcatgatttgatggagttgttcaaaatcggtggaccttgtccggacaccaactatttgtttatgggagattacgttgatcgtggatattattcagttgaaactgtatcatacttggtttgtatgaaagtaagattccctaacagaatcactattttgagagggaaccacgaatctagacagatcacacaagtttacgggttttacgacgaatgtttaagaaaatacggatcagccactgtttggaagttgtttactgatctatttgattacttcccaataactgcattagttgataataaagtgttttgttggcatggcgggttatccccaatgattgaaactattgatcaagtgagagaattgaacagaattcaagaattccccccgaaaggccaatgtgttaattgttggtggtctgaatcaaatgataaacgtggctggtggtattctccaanaaagaacgggttttaa

SEQ ID NO: 4207 - DNA, 957 bp, Candida albicans
atacagcaaatcatgggagaaagaggtccagatcagtggttggaacagataaaaaattgcatttcattatcagaatctgatatgaaacagttatgtgaattggtcaaagaattactaatggaagaatccaatattcaacctgtacagtcccctgtgacggtttgtggtgacatacatggacaattccacgatttattggaattattcagaactgcaggaggtttaccttcagatgacaatcaaaccaactttattttcttgggagactatgtcgatcgtggttatttttccttggaaacattcactttattaatggttttaaaagtaaaatatcctcacagaattactttggtaagaggaaatcacgaatcgagacaaatcacacaagtatatgggttttatgaagaatgtttaacaaaatacggctcaaccactgtttggaaatattgttgtcaagtttttgatttcttaactttagcagcaataatagatggcaaaattttatgtgtacatggtgggttatctccagaaatcagaatgttggaccagattagagtgttgtctagagctcaagaagttcctcacgaaggtggtttctgtgacttggtgtggtcagacccagataacattgacacttgggcagtatcgcctagaggggctggatggttgtttggctcaaaagtgtcgcgagaattcaatcacatcaacaatttgcaattaattgccagagcacaccagttggtaatggaagggtttcgttaccattttaaggaaaaagatgttgtcacagtatggtctgctccaaattactgttatagatgtgggaatgttgccagtgttatgcaagtcgatgaagatttagaacctaatttcaagatattcagtgccgttcaagatggtgacttatcagtcaagaacaatgccaacaaacaacaaagaagtgattattttttgtaa

SEQ ID NO: 4208 - DNA, 558 bp, Candida albicans
ttaactggcaagtatcaagtagcacctattctaatggcatcaacagatacagacaactcaaaaacagtgtcctcctcaacgtcgtcgcctagcactccgacaaaaacagcaactaccaagaccactgccaccccaccaatacaatcttctttggaggtaccatccttggctaataatagtaacggcagttccagtacatcaacttcctctacaaatgcatctctgacaggtgctaatgactccaactatgatccatttgctggcctttcttttagggttggggttgcagaaaataaaaacaccacattccgtaacaaaatggaagatgtccacacatatattgccaattttgctgaacgagtggattggggatattttgctatatttgatggccatgctgggaaggatacagcacggtggtgtgggaataacttacatacactattggaagaagaaatcgatcgcaattccgatgagggtagtccacctccgactcccataaggggtaaagatgatttgcggggaagatatgtaccagtgttttgttcaagccgatga

SEQ ID NO: 4209 - DNA, 1161 bp, Candida albicans
ttaactggcaagcatcaagtagcacctattgtaatggcatcaacagatacaaacaactcaaaaacagtgtcctcctcaacatcgtcgcctagcactccgacaaaaacagcaactacaaagaccactgccaccccaccaatacaatcttctttggaggtaccatccttggctaataatagtaacggcagttccagtacatcaacttcttctacaaatgcatctctgacaggtgctaatgactccaactatgatccatttgctggcctttcttttagggttggggttgcagaaaataaaaacaccacattccgtaacaaaatggaagatgtccacacatacattgccaattttgctgaacgagtggattggggatattttgctatatttgatggccatgctgggaaggatacagcacggtggtgtgggaataacttacatacactattggaagaagaaattgatcgcaattccgatgagggtagtccacctccgactcctataacgggtaaagatgatttgcgggaagatttgtacaagtgttttgtcaaagcagatgaattgatagaaaaaagtggacaaggtaaatctggatgtactgctgcagtggctgttctcagatgggaaagtgataatgaagaaccagtatcgcacaccaagagccaagatggtggtaaatttgatttcaagccaaccaagaatcacaagcgattgttatatacttctaatgttggagatctgcgaatagttctttgtcgtgctggacaggcataccgattgtcgtatgatcataaagctacagacacacatgagattaatagaatagaagataatggcgggttggtattgaagaatcgggtaaatggtgtgttagcggtgactcgatcacttggtgacacatatatgaaactgttggtcataggagttccgtttactacggcgacagaaattactgcggatgatgaatttattattattgcctgtgacggactttgggatgtagtctccgataaacacgcttgcaaattggcagctgaatcatttaaacaaggttattcaccgctgcaagttgctaagaagttgtgtcaatttgcaatagaattgtctacaacagataatgttactgttatggttgtacagcttgacaatgacgtgttcagttag

SEQ ID NO: 4210 - DNA, 552 bp, Candida albicans
agaacgattgaaaatatcaaacaatgtaaacatatacctgaaggtgacgttgaagagttgtgtaccaaagtaatagaattattgattgaagaagcaaacattcaacatatagatacaccagtgaccatatgtggcgatatacacggacagttacatgatttaatcacactttttaaaacagggggagaattaccggacacccagtatttatttcttggagactttgttgatcgggggttttattcatttgaaagtttcttattattgataagtttgaaattacgatatcctgatcgaataacattgattagaggaaatcatgaaagtcgacaaataaccactgtttatgggttctacgatgagtgtttgcgtaaatacgggtcaataaatgtgtggcgatattgttgtgaagtgtttgattatttatcattaggagcaattgttggtggatcacaaggagtattttgtattcatggagggttgagtccagaaatcgatacagttgatcaaatacgggtattggatcgaaagaaagaagtaccacatgaagga

SEQ ID NO: 4211 - DNA, 1257 bp, Candida albicans
ctcatcccaattcatcttttaattactgattctgctgttgctggtaatccattagccaatggtcacaaaaccatcaatggtcaaatctcagttgatgtcaataagaaaccagtgggtgctattggtgaagctcttaaattgttgggttacaccgttggacttgttgtcattacttcagttggtgatgttactccatgtgtttgggtcagtcacgctgaatcaagatccgaccaagatcttattgttgaacaaatggttggtcaaactcacccaatgggtccagtcgctgatttgattattggtggtggtagagactggtttattggtcttgaccaaggtggtaaaagaagagataatagaagtttgattgaagaagtccaaaagaatggtacttggacatatgttggtgacagagctggttttgacagtttggacaagggtaagaatgtttctttaccattattgggtttatttgccaaagacaactatccatacagaattgaccgtaaagattctgaatatcctaacttggttgaacaaactcaggtagctttgaatgctttaactgaacacaccaaggataatgataaaggtttctttttgatggttgaaagttccagaattgatcattctggtcatgaaaattgtgttcaagcccatgctcaagaagcacttgaatacgatcaagttattaacttggttcacaactataccaagaatgccgatgttgataccgttgttgttgccacagctgatcacgagactggtggtcttgttcttaaccaaaaaacaccaaatgatttcaaagttgtttttaatgctactcattctggtgagtacttagctaaacaaatcttgacttataaagaacaagacaaattagctgattttgtcaaagaaactgttattgaacaaggtttgggattgaccaactacactgacgaagaagttactagactcgttaatattgctcaaaagaactctactactactgccaccactcttggtgttgctattgccaacttgacttcatcaagagccaaagcttactggggatctcttgaccacacttcagttgacgttgatttgtacgctttttccaatgctgattatcttcaacaaaaagttactaatgttagggaaggattggctggtttccacgaaaacactgatttcagtgtctttatcaagtcaattgaagatattgatttagacaaagctactgaattagttgccaatgtcagaactaaatattaa

SEQ ID NO: 4212 - DNA, 750 bp, Candida albicans
gacaacctttttattgctacatattccatcatgggtttatcaaatgatcaaagtcctttacttggaggcgatagcttaacatgttggaacaagaaacaatcaggcattaaaagaaatttgtcttatttgctcaatattataaccattggtatcattgcatatttgtgcatatttgccaaacactctgataacgatgataataccgggcctttattgaatccccagaagaaaaagaacattgtcatgatggttactgatggtatgggtccagctagtttatctgcagctagatcatttagacaatttagagataaattggccattaatgatattttgactcttgataaatatcttattgggtcctctcgtacaagatcttcgagcagtttggttacagactcggctgctggggccactgcattttcttgtgctttgaaatcgtataacggtgcaattggtgtaaccccagacaagactccatgtggtactgttttagaagcattaaaattacaaggttactacactggtttagtggtcactactagaataaccgatgccactcctgctgcatttagttctcatgttgattacagatttcaggaagatttgattgcccaacatcaattaggtgaatacccttttggaagagcagtagaccttattttaggtggaggaagatgccactttttaccaacttctgaaggtggctgtcgtgctgacaatagaaatttgattagagtacagcgataa

SEQ ID NO: 4213 - DNA, 951 bp, Candida albicans
ttagagtacagcgataaatggcaatatgtcggtgatagagtgctgttcgatcaattacagggagggaaaaacgtatcgttgccattattgggattgttagctaacacagacatcccatatgacattgaacgtaaggattcagaatacccttcattagctgaacaagttcaagttgcattaacagctttatcagaggctaccagggactctgaacaagggttctttttgttgattgaaggttctagaattgaccacgcttcacaccacaatgatcctgccgcacatgtgagagaagttttagcttacgatagagcatttgaggaagtgatcaagtttatcgacaatagtgaaattgaaaccgttgcaatttccaccagtgaccatgaaactggtggtttagttgttgccagacaagtttctgagctgtatcctgattatttgtggtatcctgaagtattattgaacagcactcattccggggactacttgtcacacaaggtggtacactataaggagaaagacaataccaagaaattcacaaactttatcaagcatgaaatattagagaaagatttgggtattagtgattacactgcgaaagacgttgatttgatcatcgaaaaggcaaacaatgctggggagttgctttacgtgttaaataatattgtttcaattagagctcaaattggatggaccactcacggtcactctgctgtagatgttaacatttatgctcacaccaattctcctgctattaagtcgaaattgctctcacacaaagcttacgatggattatctggaaatcacgaaaatattgaaataggagcatttattgagtatatcactggatcagatttgaatcaagtaacccaattgataaagaaaacagaacattctccagacaacaataaagccaaggtggatgacattttccatgcaaacgtattataa

SEQ ID NO: 4214 - DNA, 1800 bp, Candida albicans
atgataaaccctaggaatttacgattgattatagcagtcattggacttgttggtatatttgcattttttgccagttcacaacattccttagttgaccgtactgctttacaagttaacaaaccggcagcagactcaccacatgttcctcctcctgctgctgctgctgcaccagtgtcaccaccaccaccttctcaacaacaaaagcaacaagaaggaagccaaaaacaattaaatgacgaaaacagtgatgaaaaaaatacgttacaaggaacttcttattctggtactaagccaccatacgaaaaggttgatggtaaatcaaacaaaatcttggccgataagttagatactactaaaaactctaaaccaaatcaacaacaacaacagaacacccagaaaggtgcatcagaagaaaaatcggcccaaaacaaaatcactactccagaagaagtgtccatggacaatgggaaatgtaatgatattgattatgttgtgatgattgatgctggttcaactggatcaagagttcatgtttatgaatttaatacatgtgttaaaccaccacaattgttgagcgaggaattcgagatgttgaaaccaggtttgagttcttttgataccgacacagttggtgctgctaaatcattagatccattattagaagttgctttaaagaaagttcctaaaaataaacaatcctgtacacctgtagcagtcaaagcaactgctggattaagattattaggagaaaccaaatctaaggctattttggatgaagttagatctcatttagaaaaagattatccatttgctgttgtttctgaagatggtatttctattatggatggtaaagatgaaggtgtttacgcttgggtcactgccaattatttattaggaaacattggtggtaaagaaaaattaccaactgctgctgtgtttgatttaggaggtggatctactcaaattgtgtttgaaccagattacaaagttgatgaagttccagttgatggtgagaccaagtatcatttcacatttggtgacaatcaatacaccttataccaattcagtcatttgggttatggattaatgcaaggtagaaataaggttaatcaattggttttgaaaaacaagttgtcagagttgaatttacaaaagtataccaaaaaggaagttaaaggagccaaagccactgttgatgtcagtaatccatgtattccacctggtgtcgttgccaaagatgttcaagttgaattaggagaagatgagttttatgtggttaacatgaaaggtccatcttcaaaagattctacagtagccggtggttctcaatgtagatatcttgcagaaaaggtattgaacaaagacgctgaatgtacttcaaaaccatgttcttttaatggggtacaccaaccatcattaacacgtactttcaacaagaattctgatatgtatgttttctcatacttttacgaccgtaccaatccaattggtatgccatcatctttcagtgttgaagaattgaaagatttaagtaaattagtgtgtcaaggagaaacattttggaaagatattttattggatgatcacgttaagaatttaaatgaagaaccacaatggtgtcttgatttatctttgataactgccatgttacacactggttatgatattcctttacacagggaattaaagactgctaataccattgataacaaccaattgggttggtgtttgggtgcttctttaccattgttggacaagaataatgcaaaatggacatgtaggatagataaaactgattaa

SEQ ID NO: 4215 - DNA, 1623 bp, Candida albicans
attgtgcgtaattcactgatggttaaaaaattaaatgtattaatatatgatcataattctaattatgattttatatcatttaatttatatcatacaatattaaaatttaatcaatttattaatcatttcaatatcagttatttagaaggtggattttatccattgaaaaatgatattgaaaaatatcatcacctaatagatgattctgatatttccaacaacaacaacaatattggcaacttctcaacaatgaataattcaaaattacaacataggaaagccaaaagtttatctggtttaacattaccaatgataaccaaaaccactccaaataataataataacaccaccagcaccaccaccatcactaataacaataacattaatcaattatcttcatcaattaataatagttttttacaatcaattcataaaaaatcaaatggtaatgatgaaccaatactggaagaattacgtaattatcaattaaaaatacctcaaagtttacaaaatattcccaattggttacataatgttcatttatatgaaaattttgaaaaattagaaaatttcgaaaaaaccagcatcaataatattttcaatagtagtagtagtactactactaccaccaccaccaccaccaccaccacatcgaaactgggttctcctattggtaagtttggtaataataataatagcaacaatgatgatgataatgataatgatattatatcaccttgttgtatgtcatgtcaaaaaattgaattcaatgtacctagaggtatagaatatggttataaaaatcgttataaaaatatttggccttatgatcattcaagagttaaactaacagcttctacaaacaacaacaacaataacaacaacaacaaccataaccctccctcctcaccctcctcttgttcttcttcatcatttattgatgattattttaatgggaatttcattaatactaattccatcataccaaataatcaattcacttatattgccacacaaaaacctctaagttcaacaatatcggatttttggaatattataaatcatgaaaacatccaaattataatcaatttagattatgaaccaatcaattatttcaattataaagaatttataaaactgattaaaccaataccagaaaaaacagataataccaaaaaagtttatttgattaatgaaaaaatttattatatacaatatttatcatggcctgattttagtataccacaagattatcaaagttttttaaatttaataaatttgaaaaatgaaataacggcaaaatatgatttgaataaaaaaattttggttcattgttctgctggttgtggtcgtactggagttttcattactttagattcattaattcaaggtataataaataaggacaatgacaaggacaaggataagccagaagttgatggagaagttgatggagaagttgatggagttgtttttgatgtttataaaagttcaaaagatttgatttataaattgattcaacatcaaagaaaacaaagaatttcaatggtacaaaattataatcaatttattgcttgttatgaaatttgtcttcagccacaggggctggaaggaaccgcgcta

SEQ ID NO: 4216 - DNA, 291 bp, Candida albicans
gctttttcattagatagagccaactcacaacaaaaacaagaaggtaatagttggaatcaaggtgatggtaacaaggaaaatgcttcaccaacaaatgtggatattaatgagggtgaaattattcctaagattagttgtggtattgaatttggtcataagaatagatatatggatatatatttatatgatcattctagagttgaattaggtcatgtcaataaggccaatgataatgatcaagtgcctgtgtttgaaaactacatcaatgccagtttaattgaaccaccataa

SEQ ID NO: 4217 - DNA, 390 bp, Candida albicans
aaatatagcaataataataacaatcaaattaagaatcggtatattgctacacaaggtccattagatgaaacaatgggtgatttatggaagatggtggtacaatttaaaatccctcttattgtttcattgactgattcgattgaaaatggggttacgaaatgtgcaccattttggcaaagcgggatctataaatcttataaagatgctattaaagtatcattgattgaagagaataaattagatgagagcttgattttacgtaaattcaatgttgattgtaattcggcaagttcatcatcatcaaatccaggtgaatatgattgtgaatcccaatttgacaattctccaagggttttcttcacccaccggcgctggaaggagccgcacttg

SEQ ID NO: 4218 - DNA, 519 bp, Candida albicans
tctcggccgcgtggtgaagacccattatgtaatgaacataaagctttcccatttccggcaactacaagtacaccaggtacaccagctgcaccagcattaccgtcatcgacaccacctcaaaaaccatctacaaatcaaccatcgcctcatttggagaaacaaaaaacttcatctttagatgaatctttgaaggctatccaacagcaacaaaaaaagagaataaactctattcccctgctgaattacagacctaaaattgaaggcttgtccgatagatttaaatatcctcggcggattgaaatgggtgctcaagcggctctgtccaaaaatattgttcttgatattagaccatctgctcaatattccaaagcacatatcaaagacagtattaacctttgtttaccttcaacattattgaaacgagccaccttttcattcgagagatcagtcgatgcattaggtgagcggcagagagatagatttgctgatttttttaatcgcatatcagaaacaagcagc

SEQ ID NO: 4219 - DNA, 906 bp, Candida albicans
tttgaaagatttgaaaaggttagaagaagaagaagaaaaaaaaaacacctttgggtaaataataccaataataatagtaataataatagattcaattcagtttcagtttcaatttcaatttcaatttcaatttcaattatgggtcaaatcctttcacaaccagtagttgaaaaacactcggatgaacataaagataaatatttagcttatggtatatcatgtatgcaaggatggagaattaatatggaagatgctcatgctactattttgaatttgtatgatttgccattgaagaaatcattatcatcaaattcagaacaagatgaagatgaagaagatgaggaagaggaggcggattcacaagattctactaccaccaacaccacaaaatcacatcaacaacaaaaccaaaaagaagaccttcaacaaaataatgataaacagaatctgcaacaagatataaaagatggtgataatgatactcaaatgagtgatagtgatgaaaaccatcaccatgctgcaccacaacaacaacatattgcatttttcggagtttatgatggtcatggtggtgaaaaagctgctattttcactggcgaaaaattacatcatttgattaaagaaactaaagaatttaaacaaaaggattatattaatgctttaaaacaaggatttttaaattgtgatcaagaaattttaaaagatttttatatgagagatgatgatagtggatgtgctgccacttcagcaattataactcctgatttaattgtttgcggtaatgctggagattctagaactatcatgtcaaccaatggatttgctaaagcgttatcatttgatcataaaccaagtaatgaaggtgaaaaagctcgtagtcttcaccacggggctagaagacccgcg

SEQ ID NO: 4220 - DNA, 960 bp, Candida albicans
  unsure (48): Identity of nucleotide sequences at the above locations are unknown.
ccgccccaccgcatgtcctttccattcccctggtggaacagacacccnggaaaacgagttacattaaccgaaaatgagattagattcctttgtactaaggcccgtgaaattttcatccaacaacctattcttttggagttagaggcaccaatcaagatttgtggtgatatccatggacaatattacgatctactccgtttattcgaatatggtggcttcccccctgaagccaactacttatttttaggggactacgttgatcgtggtaaacaatcattagaaacaatttgccttttacttgcctacaagatcaaatatccagaaaattttttcattcttcgtggtaaccacgaatgtgccagtatcaaccgtatctatggattctacgatgaatgtaaaagaagattcaatataaaattatggaagacttttacagattgtttcaattgtcttccaatcgctgccataattgacgagaaaatcttcaccatgcatggaggtttgtctccagatttgaattctatggaacagatcagaagagtaatgagaccaaccgatatcccagatgtcgggttgttgtgtgatttattatggtcagatcccgataaggacatcactggatggtcggagaatgaccgtggtgtgtcgtttacttttggacctgatgttgtgtctcgatttttacaaaaacatgatatggacttgatctgtcgtgcccatcaagttgttgaagacggatacgagtttttcagcaaacgacaattggtaacattgttttcagcaccaaactattgtggtgaattcgataatgctggtgccatgatgtcagttgatgaaagtttgttatgttcgttccaaattttgaaaccagcagacaaaaaaccaagatatgccccagcaaatgtggctaacaatcgaccaggagccaatcaaagaaaaccaaagaaggctgtgaaataa

SEQ ID NO: 4221 - DNA, 1302 bp, Candida albicans
cattatatactaacaattccatttacagatagaatataccttggcgcttatgatcatcacaaaagggatacagaagatttggcatatttcacagttgaagacgcattaccatataatgcattttacatggatttcggacctttgaacattgggcatttatatcgttttgcagttcttttacacaagaaattaaacgaagactcaacccaagggaagggactcgtgatatatagttcgacatcccctaaggaaagagccaatttagcatgtttactatgctgttacatgatattgctccagaattgggctcctcatcaagttttgcaacctattgctcaaatcacgccacctttacaagctttcagagacgcaggatatagcagtgcggattatgaaataactattcaggatgtcgtgtatgccatgtggagagctaaagagagaggtatgattgacttggccaaatttgatttagacgagtatgaacagtacgaaagagtcgaccaaggagattttaacgttatatccaaagatttcattgcatttgcatctcctcaacaaagcaagcgaggaggattaaacgaaccatttcaaaaagttttggagtacttcgtggaaaacaacgtccagcttgtggtgagattaaactctcacttatacgacgcaaaagagtttacaaagagaaatatcaagcacattgatatgattttcgatgatggaacttgtcctactttggaatacgttcaaaaatttattggtgctgcagagtgtattatcaataaaggtggaaaaattgcagtacattgtaaagcagggttaggaagaaccggttgtttgattggagcccatctcatatacactcatggatttacagccaacgaatgtatcgcgtacatgagaatgatcagaccaggaatggttgttggtcctcaacaacattggctttacttgcaccacgatgattttagaagctggagacatacaatgatagtagacaatagacccgatcctttaattggcaacttgttcccattgtgctcttatgaagactataaacaaagactaaaagaggcaaaaagaaaagaaagattgcaattgcaacaacaattgacatctccacttgctgattcttctgtaataaataccccgattagaagacgtaaggtgagtggtgctttggcatctaaaatccaaactgtggtacctatcgagtctcctggacaaccaagaaaatattttgaggactctgaagatattgacgaggtagaaatggtgaacaattctgacgatgaaaacaattag

SEQ ID NO: 4222 - DNA, 396 bp, Candida albicans
tcctggccatcttgccgtggtcgaagaacagtcgatcgcaaagccggtctgggtcgtaccggttgcttgattggtgcctatcttatctaccggtacggattcacagccaacgaaattatcgccttcatgagattcatgcgtcccggcatggtggttggtccacagcaacattggctgcacctgaaccagggctcattccgcgaatggtggtttgaggatagcatgaaagagaagctagcccagatgcaaccagcaccgattacacccggaagaggatctaccatgcaacgtgccaacaacggcccaattgcgactccacccaacaatagtcactcgaagcgttccgcgcttggagagattgaccacaatgagggtgctggaacgcaaagtgaatag

SEQ ID NO: 4223 - DNA, 1080 bp, Candida albicans
actataaagttatggaaaatacaagagagacaaatcaaactagtttcggaaaacaatttaaacgggctgacccatttgcctagtactgacattggtatctcatcgttgaaattgcctcaattacagttacacgacaaattgatctcagctcaacctaaaaagatttatgccaatgctcatgcttatcatatcaactcaatatctgtcaattcagatctagagacgtatcttattgctgatgatttgagaatcaatttatggaatttgggcattgctgatcaatctttcaacattgtcgatatcaaacctgcgaatatggaggaattgaccgaagttatcactagtgctgaattccatccatcacaatgtaatttgttcatgtactcatcttcgaaagggacaataaaattgtcggacatgcgatcaaactcactttgtgatagccacgctaagatatttgaggagtatttggatccgctgtcacataatttctttactgaaatcacaagttctatttccgatgtcaaattcagtcacgatgggagatacattgcatcccgtgattatatgacagtgaaaatatgggatttagctatggaaaacaaaccgctaaagactattgatgttcatgaacatttgagagagcgattatgtgatacatatgaaaatgatgccatatttgataagtttgaagttcaatttggtggagacaataaatccgtgatgacaggttcatacaacaatcagtttgtgatttatccaaatgcagtaaacaaaggcggaaatgataaaccaaagtctgtgttcaaaaataatacaaataagagaaaaaagaatggctatcgaggacgtgatgatgatgacgacgaagataacaataatgacgacgatgacgacgatgatgatgacgatgacgatgaagacaaccagtttgacaaggaggtgccagtgagtaaaaattctccaagttctcaattagattactatgatgatgacgatgaaccggaaaaaatcactttacaagcagacaagtctgctttcacatcatcttcactacggactgccggatccgaattaagt

SEQ ID NO: 4224 - DNA, 1335 bp, Candida albicans
  unsure (658),(715): Identity of nucleotide sequences at the above locations are unknown.
gatatcaattttttaaaagcctattatcgtaaaggtgtatcattaatggctatattaaatcataaacaagcattagaaaattttaaatttatattgaaaaaattacctaatgataaattaacattagaaaattataaacaatgtactaattatttaaaaagacaagcatttgaaaaagctattgctggaaatgatgataatgaatcgatttttaataaaattgattatcaaagtatacaaattgaaaaatcttggtctggaccagaattgaatattacaacaaccacaacaacaaatacaaccacaacaaatacaacaactacaacaaccgttggagataataataagaataaaaaatcagatgtgattgtgaatattgaaggattagatcatgattatttgaaatatatgattaaattatttaaaaatggtgggaaattacctaaacgacatgtttttgccataattgcaaaagtttatgaaattttgaaacaagaaaacaccatgacggaaatttcattattacattctcaaattgatttcaacaatgataatgatgatactattaataatcctcatggtaaaggtaaaggtaaaagtgatcaaatcattggtgggaaaaaattaactgttgttggtgatactcatggtcaatttnttgatttattgaatttatttgataaattcggtcatgtaacacaagatcatatatatntatttaatggagatgttgttgatcgaggatcatggtcatgtgaagtggcattatatttatatgttttaaaaattctttatcctaaatcaatttttattaatcgtggtaatcatgaaactaatgatatgaataaaacttatggttttaatgatgaatgtgaatttaaatattctaaaaaaattttcgaagctttcaatcaatcatttggtgcattacctttagcttgtttaattaatcaaacttatttatgtatgcatggaggattattttgtaatgataaagttacccttaaagatattaaatcaattaatcgattccatagtaatggatcttctcaacctccaaaagaaggattagctatggaattattatggactgatcctcaagaaataaatggtagttctccttctaaaagaggtattggtatgcaatttggtcctgatataaccgaaagattttgtttatcaaataaaattagaaaaattattcgttctcatgaagttagaatgaatggtattgaaaatgaacaaaatggtcgattaatgacagttttcagtgctcccaattattgtgattataactgggaattgtattacaccagcggggctggaaggatcccg

SEQ ID NO: 4225 - DNA, 525 bp, Candida albicans
attgataattatcttaatagacaaacattccagattattattattatttttataaactttaaggtgacaatgtccaaaatttattctttatctgatttgaaatttattaaacccaaaacattaaaatcatggttcacaaatggttcatctccccatggtaaattttgtgttgttgatgtacgagattctgattttgttggaggtcatataaaaggctgttatcattatcctgcagccaatttccactacacattgaatgaattatatcaaaaaatatatcagaataaaatacaagatattgttttccattgtgctttatctcaagtaagaggtccttcaagtacattaaaattcttgcgtggaattgatgatataaccgattccaaagtaaagagttatttcaatgatgacaatattcgagtatatgtgttacacgggggcttcacaaaatggcaagaagaatatgggaacgataaagaagtgacagaggcttatgaccaagaaatatgggagtttggctcctag

SEQ ID NO: 4226 - DNA, 807 bp, Candida albicans
aactgccaccaccgtctccttctccctccaacccacatcactaacattattaaaacttgctattccactatctatcctacaaacaaaccattacaaacaatgatagaaggatcaactaaaggagaaagtgatataccactctatttattcacttataattgcaacaaacgagttatagatgcaaatgtatttaaatccaaagtatcacaatcattaccaccaaaagataatccttcccatttatacgtttttgctctccaagagttttgtactattcttgatggttcattcaaggcatcagcaaaccaacaattaatcgcttataatgaattactccaagttatgttatttgaagagtatggaacagatcattttcaaactattgctattaatcatacaggtgcagttggattaatcattataaccccctacccactgaaattccaaaatgtgagattagcaaacacttcttgcgggtatggatatagctcaatgaaaggtggagttggtgttaggttgagatattacccagaagggaagtatggagataattcagtagaattgagttttgcaggaattcacttaaatgcatatgaaggagagtattattatttacaaagaaatgccaatttattgagaattgttagaagtcttgattttggagatggatatggattaatcaaaccaaacaatcatgttttcattttaggggatttaaactatagaacaaccaaagagtacaagaaaacttcagttgtggcacagaatttgttatttcttcaccacgagcgtgcaaggaccgcatag

SEQ ID NO: 4227 - DNA, 1053 bp, Candida albicans
atactgatttccgaaataagacccaatgggaaagaaagattttgggtgtgttgcaaaaaacggaacaaatacatggtgatgtggagtggtcaattaggaggggttgccttgtatttttttgtgaaagagtcacaagtcaaatatgtttccaatgttgaatgttctttcaaaaaaaccggtcttggtggagtatcagctaataaaggtgggatagctgtgagtttcaagttttccgataccactatttgttttgtgtctgctcatcttgcggcggggctaagcaacattgaggaaagacaccaaaactataaagcactaattaaggggatccagttttcgaaaaatcgacgcattcaaaaccatgacgctgttatttggttgggtgatttcaattacagaattgatttgactaatgatcaagtaaaaccaatgattttacaaaaattatacgccaagatctttgaatgtgatcaattgaataagcaaatggctaatggggaaagtttcccatttttttcagaacaagaaattaacttcccaccaacttataaatttgataaaggtaccaaagtttacgatactagtgaaaagcagagaatcccggcatggacagatcgtatattatttctttcacgacaaaatcttatagaaccattgctgtacaattcttgccaaaacttgactttttctgatcatcgacccgtttatgctacattcaagattacagttaaaataataaaccacacaattaaaaagaatctatctgacgaaatatataaaaactacaaagacagtcataatggtatatttgatattttagtaaaatcatttgataataaagaattaaatgaaggaaaggacgccagtttgcctccacccagttcagataaacaaaaatggtggttagaagggggtaaagctgcaaaaattataatcccaggtcttgaagatgataatatggttatgaatccatggcgaccaataaatccatttgagaaaagtaacgagcctgagtttgtttctaaaaatgatttggaagctattcaaaattga

SEQ ID NO: 4228 - DNA, 1080 bp, Candida albicans
attatctgcaaattatggttttgtgctctcatcgaaagtagagaaaaaaaaaagttaaacctgaaaaatagaaacaatacagctttcgatgacctacaacacaagcttctaatgctggtaaaaagaattttaggaggactatatttgtcatcaattgatcctattttcaaggagatagatttgaaatccgaatatggtattactcatatattatctgttgttcctggaaccatgaaggaatcctatttttctgattatgaatggaaacagattgaaataacggatgaagaaactacaaatgtgattcagtattttccagagagctatgcttttattgaatctgcccttttccaaaattccaacgataaaaagcatcaaagttgtgtactagtgcactgttcccaaggtgtctctagatcagcaacatttataatagcctatttgatgcaaaaatatcatttgagcatagaccaggctttgcacgctgtaaaaagaaagtgtcctggtgctgaaccaaatcctgggttcatgaatcagttgaaactatacaacgaaatggggtttaagatagatgaaagtaaccagaagtacaatgaaatattgaagagcaactctttgaaaactgatccaacaggacgaagcttaagagacatgataatggaaaaaagtggctcacctaaggaagtaaaagaagagctgctatacgaacttcgttgtaaaagatgtcgtcaaatactagctagtagtgtgcatatcgaaaatcatgatatccctgagtcagactcccgtcaatcaagttttatcaagacagctcctaattcgagaagaataatatctgttgaacgggctagtctgatttgctctcattattttttcaaagagccagtgaaatggatgaaacaagaattagataaagctgaaatggaagggaagttcctgtgccctaaatgctcctctaaggttgggggctacagttggagaggttctagatgttcgtgtggaaagtggatggttccagctattcatttacaggaagcaaaagtagattatataaagagagaaagcactcttcgtaattag

SEQ ID NO: 4229 - DNA, 615 bp, Candida albicans
tgcgctggtatgtcgattcataattacacgactccaaatcgtatactttactacaactaccagtacattcgacttcaacaactactgacaaaaatgggggctaatgcaagtattcttgatggtttcatcgaagataccaattttagtattgaagagattgatagattgcgcaagaggtttatgaaattagataaagatgggtcagggcaaattgataagcaagaatttttatccatacctggtattagttcgaatccattagccaccagattgatggatgtgtttgataaagatggagatggatcgattgattttgaagagtttattactggattatctgcattttctgggaaatcagataatttaaacaaattaagatttgcatttaatatatacgatattgatcgtgatgggtacattggaaatggtgagttatttattgtgatgaaaatgatggttggtaaaaatttgaaggacgaggaactacaacaaatagtggataagactttaatggaagctgatttggacggtgatggcaagttgaattttgaagaatttaaaaatgcagtcaacaccgatacaattgccaacactttgacattaaatatgttctga

SEQ ID NO: 4230 - DNA, 888 bp, Candida albicans
ctatcttcatcaaccatggattcgttcgatgctgctaaccaattgctacaaatgctccgtagcttgtcgccacaactacaacatttaagtaaagcagtgtattttgcattaaaaaattccgacaaagaagattacttattgccaacaatattagatgtgataaacgacaaacaattgcctacaagcattaaagcaaatatactacaatttgttgacttgttaataaatgaatcacttagcctggataagtataaacaagcatatgtacagggcttgaaagataatttgcccttgattataactcaagtaagcgacaacaaatccaatttatacagcacttatttgagtttatttaatatatctcaacactttaaaatggattgtcatgggtgtgtttcccaatttgactccaatatgttaacggataaagatattgatttgataaagaggaatgaagagtttaccaaatccgacattaacgacgacgagccgttggtgcgagcatggaaaatactcttgcaatgcaaacatgaatgtcaatttgaaagagctaaactattagagcattcagaatacatcgatgatattgttgatgaagatctgttgttcagtattcgagagaaatcaaacccttcaacgactttgttgtccaaacgtcagattcttgtccgcatggaggatgatagagaagcacacaaacggtcgaaagagaatttctgggtagtcaatcgagacaaagaaaagggcaaccacatcaccgaagacgagtttgttaatcattactggaacaagttccagccgttaaacgaccaagaaaacaaagaatttctcaactcgttgcaagaattgaatgtgattgtggaaaatagctataaagacaagtactaa

SEQ ID NO: 4231 - DNA, 801 bp, Candida albicans
cgattgatgaccttccagcccgctggtgaagacacttcagaaaatcctatattaattagacgtaatactaatgagacattacaaacccccaatttttccgacacactatcgccacatctgcatctgcagcaacaacaacaacagccaggttcaccgttgtcaacatcaatgaacggcaatactatttctcgtacatctactaatcattcaatcatttcaacaacatctcacaagtcatcactgcaacaatcgaatttacctcttaaaaaggaaacaacaacttcatcactaagtacaaattctaatactatagatatagattcattaattgataaattattaaatgctggatttagtggtaaacgaacgaaaaatgtttgtttgaaaaatactgaaattgaattaatctgtgcctcagctagagaaatttttttatcacaaccttcactattagaattggccccaccggttaaagttgttggagatgttcatggtcaatatcatgatttaattcgaattttttctaaatgtggattcccaccaaagacaaattatttatttcttggtgattatgttgatagaggtaaacaatctttagaaacaatattattattattatgttataaaattaaatacccggaaaatttctttttattacgagggaatcatgaatgtgccaatgtcactcgagtatatggattttatgatgaatgtaaaagaagatgtaatataaagacttggaaattatttattgatacatttaatgtgttcaaccacgggagctggacggatccgcgctta

SEQ ID NO: 4232 - DNA, 357 bp, Candida albicans
aatgatttattatggtctgatccggcggataatataaatgaatgggaagataatgaaagaggagtatcatatgttttttataaagtggcgataaataaatttttaagtaaatttaattttgatcttgtatgtcgagctcatatggtggttgaagatggttatgaatttttcaatgatagaactttagtaacagtattttctgcccctaattattgtggagaatttgataattggggagcagttatgggagtactggaagatttattatgttcatttgaattattagatcctttagatagtgctgctttaaaacaagttatgaaaaaagaaaaacaagaaagaaagaaatctacataa

SEQ ID NO: 4233 - DNA, 585 bp, Candida albicans
agcaacaagactcgtttgccagtggaaaccaatgaacttaaatatgttttggccaaaagtagacaaatttttttggatcagccaactttattaagattatcaccaccagtgaagattgttggtgatattcatggacaatttcatgatttaatccgtattttcaattgttgtggatatccaccacattcaaattatttatttttaggtgattatgttgatcgaggtgaaaaatctttggaaaccattttgttattactttgttacaagatcaagtacccggaaaatttcttcatgttgagaggtaatcatgaatcagccaacattacaaaaatttatggattttatgatgaatgtaaaagaagattaccaaatcataaattatggaagaatttcattgatgtattcaatgccttacatattgctgccgtgattaatgaaaagattttctgtgttcatggtggactttctcctgatttgaataattttgaccaaattgaaaatattaaacgtcatactgatgttcctgataaaggattattagctgatttattatggtcccatcctgatgctccgtttaaatcttga

SEQ ID NO: 4234 - DNA, 1107 bp, Candida albicans
agacagtgtgatagaatgtgcaactacgacaattatcctctattaacataccccgatattgcaattttggaaggaggctataagaatttctatgaaaattacccccaatggtgtgatcctcaaggatatgtcgagatgaagaatttacgacacaaaaaattatgtgaatccaacttggataaagttagaaaagataataaactaactagagcaaagtcttatcaatttggtattcaacaccgccgtggtggttccactggtggacttttcggcaactataattactacgttatgaactcatcagatcaacaattttggagtagcagtacttccaacactgctcaccacagaagtagtagcagtagcgggttcattaataatatgcatagtggtgcttcgtcatatcaccataggtcacaatcgtttgtaactatcaataatgagaaaattatcaagcgacaaagatcgactcccaaagtcagcaactcaccaaccaagcccacgtcatcaactgtatctcctgataaacccattccgttggctaatattcatagattaactcgtgccaacactatttcatcagaccaaacattgtttagcaataagctggtatcttccccaatgatatctccacttgcagctagttttgaacaatcgtcgattggaatgagctcttctgaattatcagtcaatactcaagattttcaaccaccgactacgtcctttaggaattctactcataatttcaacaacatgaatcgtcgccgcaaatcactttcatcgaatttttcctcgtgttcaatcaattccattacatcatcagtagcagactctgattacgcaggttcagttgattctgcgttgaccgaaccatatacatcttcgtcgccaatacttgattcagcggattattttgataatggtgcaaaaagacaaaacttaattgccatgccaatttcaaaaggtcagccatcattattgacttcgtcatcatcatcatcatcaattcatagaaaacatgcatcaaaactgggtagtaatatccaagcatctttggcaaaccctccatcattgccaccaccgccaccaccaacaacaacaactgat

SEQ ID NO: 4235 - DNA, 516 bp, Candida albicans
agcgtggttccttccagccgcgtggtgaagaataagaaaatggtggatagaataatcttgattggtgatattcatggtcattatattgaatttagaaaattattgacgaaaataaattataataaacataaagatcatttaattgttttaggtgattttataagtaaaggtcccgattcatttaaaacattagattatttgattaataataatattgattgtgtattgggtaaccatgaatattatattttacaaaattatgccacattccatggattagaccaaccaaatttctcatcatctgagagtcagccaatagccgttaaagattcatttaatgatgacccggaattcttattggctaaaaaactcgaaccccatcatgttaaatatatcaataattgctcgataattaaaaaattgggatatgtgccaaatcctaaaggaaagaaaaagaataaagttggtgatggcgccgattatagtcaaggaattgccgttcatgctggtattaga

SEQ ID NO: 4236 - DNA, 474 bp, Candida albicans
cccccttgtgatcatatgttatttattaaatcattaattcgttcaattattgcatcaccgaaaaatcaatattatgattcatcaacaaatttaaaacttgatttatcttatattactccacaattaatagtaacatcagcacctgtaacaaattatattgaatcatggtatcgttatcctttaaatgatttattacaatttttaaattctaattatggatcaaattggcatattttcaattttcgaggtgaatctcctggatatgatgattcattagtatatcgaaaagttagtcattatccatttcccgatcattatccacccactatgaatattataattaattgtattgatgaaattgataatttattacaagttttcggcgataagactaatgttgttgctgtgttacattgtaaagcaggcaaaggtagatcaggaactttatgttgtgcatatttgatctatcaaaaa

SEQ ID NO: 4237 - DNA, 1056 bp, Candida albicans
  unsure (768),(781): Identity of nucleotide sequences at the above locations are unknown.
gcaatgagactatatttgatagaaaaacctagaacgtttgttatcactacgaatacacatgcattaattattcgacatccttcgccgacatataaacattctggtataaagggtttagtaagtgggcacagcaaagataaagatcaaaacaaggatacaaaagtgttggtcgagtttgttttaaaagaatatctagacttgagcttatatagagacatcaccccgaaacatggtggattactagggttattgggactactaaatgtcaaagggaaaacattcattggctttataactcgagacgaatggactgcatcggcaacggttactgataggatttacaagatcacagatacagagttctactgtattaacaatgatgaatacgattacttgcttgataaggaatatgaaaacatgagtcaccaagaacgtgaacgattgcgatatcctgcagcgtcggtgcaacgattgttgtcgagtggggcattttactattccaagcagtttgatatgacttcaaatattcaagagcgtggatttgtcagcagtgattataaattaattgctgactcttccttttttaaatcgtttatgtggaatggatttatgacggaagaattgatagaaaccaggaaaagaatgtctcctgctgaacaaaagattatcgacaaatcgggacttctcattattgtcatcagaagctatgctaaaactgtcaacactactgttggtgggtgtgaagccttgatgaccttgatatcgaancagagttgtgcanaagaaagaacccttttcggggattggggcagtgatggtgaatgctatgtttctaactacttggaatccgaaatcattatctatactgaaaaattctgtttgtcttatgttaacgttccagggaatgtgccgatgtattgggaatttggaaaaccatttttcaaccaaaaactatacttgcagcccaatggggaagcaaattgctttccctccttccttttgaaaccttcccacggaacacctgttccaacctttccaataagcttccccctccat

SEQ ID NO: 4238 - DNA, 414 bp, Candida albicans
cccgccgcatattcaatgaagttactatataaggaacaccctcgaacattagtactatattcagatactttcagtttatcatttcgaatcaaatcgtccaaagaactcgattccaagaaaccaacagttaatgttgatttaatcccaaacacaaacatcaccaaagaacaaggttatagaacattaattcgaagagacgtttttggatgtttaggattaatctatgtggaagatcaaatatatcttgcaattattacaggggcattaactaatgttgctcgtcccattgaaaatgaaacagttgataaaatttattcggtggattttgtatctttaaataatgatgattgggattttgttgaattagatagttcaggatatcctattgttgttaatgaagaacaagatgacgat

SEQ ID NO: 4239 - DNA, 2457 bp, Candida albicans
tattctaatgattttgatttaacgtcattattacaaaatagaggagttagtagtcctgacactagaataaattctattgatcattataaaccagaatatatgtggaattcatttttaatggatgaattgattcatttccgatctaatttagatacttataatcaattaattttggatgataatcggtttttaactactgtgattagagggtttgcgaaaacaaccccgattggcagtaatggtgattccttgacgattatttctaaacaatcttggaaacgtgctgggacaagatataatactcgaggtattgacgataatgggaatgttgccaattttgttgaaacggaatatatctattataatccatcgaaatcatcaattttcactttcacacaaatcagaggatcggtacctacattttgggaacaagattcaagtttgatgaatcctaaaattactttaacaagatccacccaagcaacacaaccagtttttaataaacattttggtgatattcttcaaagttatggagtgtgtcatattgttgatttactttcgaaaactaaatcatcagaagtacaaatatcacaaagataccaacaactttataatcattgtgacaagaaagaagaaatcgactatacggcatttgatttccatcatgaaacaaaaattgctggaggttttgctggggcaacaaaaattttaccctatttacaagattcattaaatctgtttggttggtttacttatgatatgaatcgtcaagaagttattactcgacaagatgggattttccgtgtaaattgtttagattgtcttgatcgtactaatttaatcgaacaagttatttgtcgatccgttttggaaaatattttaactaatcaagggatttataataatcgtatggcatttgaaggaatgattcaaaaacacaatacattatgggctgataatggtgatgccatatcacaaatttatacggggaccaatgccttgaaatcatcattttcaagatcaggtaaaatgaactttgctggggcattatcagatgttactaaatcagtttcaagaatgtatcaaaatacatttgtcgatgggaaaaaacaactgacaatagatatattggttggagttgatggaagaaattcttgtaaagtgaaagtttataatcctgccagtgaatacattaaaagtaaattaaaagaacaagaaaattcatttacaagttttgaaaatgttaaaatttttacagggacttataatgtcaatgcatttaacccgttgatgacgaaaaatatcgatttaacttcttggttgttcccttctagtgtacaaaatggtgatggatcattaccggatatgtatgccattggattacaagaattgattgaattaaatgcaagttcgatattaaatgctgatggtagtagagcattacaatggtcacaattattaaatgaacaattgaattcttttcaaatggatgaagaatatgtcttgttaagaacagaatcaattgctacaatggcattatttttatatgttaaaaaatccaaagtatcatatgtaacaagagttgctgggtcatccaaaaagactggtttaggaggtatggcagccaataaaggtgcttgtggaattagatgtttatttggtaccacgtcatttgcttttgttacatgtcatttagctgatgggacattggccgtcacagaaagatataatgattattcaacaataatgcaaggattagttttcccccgtaattattatattaaagatcatgatcacgtaatatggtttggtgatttaaattatcgaattgatattcccaatttagaatgtcgtcaattggtggctaatggtgcttacaaggaattattagaaaatgatcaattaactcgtgaaagaagagatcgaggagcttttaatgaatttaaagaaggtttagtgaaatttcctccaacttataaattcgataaatatactaatgattatgatactagtgaaaaacaaagaactccatcatggacagatcgtgttttatttttaagtgataagaaattaactactactaatccattgaaattattaaagtatgattctgctattgatgtcttgtattctgatcataaagccgtttatgcaagttttgaaaccacagctaagattattaatgaacaaatcaagaaaaataaattgaatgaaattattctgtctttatcatttaagaaaataacaccatcaccatcgccatcacctgccccattaacaacatcatcaacaacaacaacaacaacaacaatgtctcgtacatcaagtttaacaaggtcttcaacttcaattttgacaccaactccagtatcagctggaggaaccactgatttaatacatggattaggtcaaacaacaacaaccactttgtcactggcagtggtcaccacgcgctga

SEQ ID NO: 4240 - DNA, 921 bp, Candida albicans
ggtgaagacgatatcggatataaagttttatatactcgtattcctattgcatcatctagaattaaaaaaattggctattcaggacagaatccatacgacatagtatcactactttcgaattcaattatcgactttggtgccttattttacgacagcaaaccaaactcttttattggtaagcaattgggagtatttcgaatcaattctttcgatagtctcaacaaggctaattttctaagtaaaataatcagtcaggaagttatagatttggcattcagagatattggtttggaattggatagagagttatacgtaaagcatgctcagctatgggaagaaaatgatttgtggatatccaaattaacattaaattttgcctcaacaagtgacaagctacacacgtcccacaattcaattaaatcttcctttgttaagtcacatataacgaaaaagtattttggaggtgtagttgaatcgaaaccgaatgaaattgctatgcttaagcttttggggcgattgcaagaccaatctcctgtaaccatgttcaatccaattcataattatgttaacaaagagttgaataagcgtgccaaggattttacctcaaaattggatttatcagtttatgcatcaacatttaatgtaaatggttcagtttatgaaggcgatattgacaaatggatatacccagaggaaaatgattatgacttgatttttattggactacaagaaattgtcgtgcttaacgcaggacaaatggtgaatactgatttccgaaataagacccaatgggaaagaaagattttgggtgtgttgcaaaaaacggaacaaatacatggtgatgtggagtggtcaattaggaggggttgccttgtatttttttgtgaaagagtcacaagtcaaatatgtttccaatgttga

SEQ ID NO: 4241 - DNA, 783 bp, Candida albicans
atgacggtgccgttcaaaataccaatttccgatttagattattgtctagagcaattattagatcataaaccaccgaaaatccttcctccagagaccattcaacaattatgtcatactttaaaaacagaattattacagactccaaatataatatcgctacaatcaccaatatcggtagttggtgatattcatggacaatatcatgatttattagaaatattccaaattggaggatcaccgcctcaaactaattatttattcttgggtgattacgttgatcgtggttattattcagtggaaactatatcattgttattagttttaaaattgagatatccagaaagagtgtttttaatacgaggtaatcatgaatcaagaacaatcactactaattatggattttatactgaagtcttaaacaaatatcaagggtcagccgatgtatggacattcattactgatttgtttgattatttaccattaggggctactatagatggcaagatatttgcatgtcacggtgggttatcccccagttgtcaacaattggatcaaatacgagcagtcgatagatttagagaaatccctcacgatgggattatggcagatttagtgtggagtgatcctgacgttgccatactggattttaaattgagtcctcgtggtgctggttatttatttggtaatgatgtcattgataagttctgtcaggataataatttggtgcaaatgattagagctcatcattcttcacctcggagtagacggcccgcgcttatataa

SEQ ID NO: 4242 - DNA, 330 bp, Candida albicans
gcaataaagcgtgcatcaatgctcagtaaacaattaagtgattccattgtgcagactgccaagtcaggcacattaaccaaagatgataagtcaccagtcacaattggtgactttgccctgcaagcgattatcaaccatgccattaaattgaatttccctaatgatgaaattgttggtgaggaagattcgcaggagttacaggaaaacaacagtttagctgaccaagtattaagcctaatcatcaagatacaaaaagaaaccagtggatataaggacattggatcttccaccttgagtatgggacagtaccggactaatatctcggcatat

SEQ ID NO: 4243 - DNA, 876 bp, Candida albicans
atgaagacattattcatctcaacactcttcatattgcttgtatcattacttttcacatataaaccactcaccaccagactaaatttattcactcgtttcatcagcatgtcccattctactcacccataccaaaaggaacttgaagttgcaactttagcagtaaagcgtgcctcattgctcactaaacaattaagtgattccattgtgcagactgccaagtcaggcacactcactaaagatgacaagtcacccgtgactattggagattttgctctgcaggctattatcaaccatgccattaaattgaatttcccaaatgacgagattgtgggtgaagaagattcacgggaattacaggaaaacactggcttggctgaccaaatgttacaactaatcaccaagatccaaaaggaaaccagcggatataacgacattgttggaacattgactgacaagaacgaggtgtatcagagtattgattttggaaactcacaaggcggtctgaaggggagattctgggcattggacccaattgatgggaccaaaggattcctcagaggtgaccaatttgcagtgtgtttggcattgattgaagatgggaaagtggtattaggtgttattggatgtccaaacttactggaagacattgtatcgaacgaagaacattcaggggttgttggtgggttgtactctgctgtcaaaggagttggctcattctacagtgatttgttcaaagaaggtgctgagccattgtcacagcaaaaacgaatcaaaatgcaaaaccatacaaaccctagccaattgaaggttgttcgaggtgttgaaaaagtcattcttcgcattctgtctcaccatgccgcaggacgaccgcaatga

SEQ ID NO: 4244 - DNA, 1200 bp, Candida albicans
atgaagacattattcatttcaacactctccatattgcttgtatcattacttttcacatataaaccactcaccaccaaactaaatctattcactcgtttcatttccatgtctcacactactcacccatatcagaaggaacttgaagttgcaactttggctgtgaagcgtgcctcgttgctcactaaacaattgagtgattccattgtgcagactgccaggtctggtacactaaccaaggatgataaatcgcctgtgactattggagattttgccctgcaagcgatcatcaaccacgctattaaattgaatttccctagcgacgagattgttggtgaagaggattcacaggaattacaggaaaatagcagtttagctgaccaagtattaagtctaatcatcaagatccaacaggaaactagtgtgtacaatgatgttgttggaacattgacagacaagaacaaagtgttccagagcatcgattatggtaactcgcaaggtggactgaaggggagattctgggcattggacccaattgatgggaccaaaggattcctcagaggtgaccaatttgcagtgtgtttggcattgattgaacatgggaaagtggtattaggtgttattggatgtccaaacttactggaaaacattgtatcgaacgaagaacattcaggggttgttggtgggttgtactctgctgtcaaaagagttggctcattctacagtgagttgttcaaagaaggtgctgagccattgtcacaacaaaaaccaataaaaatgcaaaaccacactaaccctagccagttgaaagttgttgaaggtgttgaaaaaggtcattcttcgcattcaacccaagctgaaatcaaagctaaattgggctttgacctggcaactgttgcaaaacaaactgttaacctcgactcacaagtcaaatactgtgtgttggcaagtggacaagcagacatatatctcagattgccagtaagcgatacataccgtgagaatatctgggaccatgcagccggttacattttaatatacgtaagtggtggtcaagtagttgatgttactggtgcaccattgaattatggtaatggcagaacattagattctaaaggtgtgattgccgcaaataaagaaatatttgatatggttattgatgcagttactgaaataagaaagtcaagcactcctagagtttga

SEQ ID NO: 4245 - DNA, 693 bp, Candida albicans
cgtcggcgtgtaagacaggggagattcgggccattagacccaattgatgggacaaaagggtttctcagaggtgaccaatttgccgtgtgcttggcattgattgaagacggaaaagttgtattgggtgtaattggatgcccaaacttactggaaaacattgtgtcgaatgacgaacactcaggggtagttggtgggttatattctgctgtcaaaggagttgggtcattctacagtgagttgttcaaagaaggtgcagaaccattgtcacagcaaaaacgaatcaaaatgcaaaaccaaacggatcctagccagttaaaagttgttgaaggcgtagagaaaggtcattcttctcactccacccaaactgaaatcaaagccaagttaggatttgatccaaccactgttgctaagcaaactatcaatctcgactcacaggtcaaatactgtgtgttggcaagtggacaagcagacatatatctcagattaccagtaaacgaaacataccgtgagaaaatctgggaccatgcagctggtaatattttgatttacgagagcggtggtcaagtcggagatgtcactggtgcaccattgaatttcgggaatggtaaaacattagactctaaaggtgtgattgccgcaaaccaagggatatttgataacgttatagatgcagttactgaagtgagaaagtga

SEQ ID NO: 4246 - DNA, 339 bp, Candida albicans
catttaccaatattgatttatagattctttggtgttatctggtcgtgcaatttgctcaatatcagaatagaaaaacatctgaaaaattctatttattttacggaagctacaaccataaccccattagacatggcatcagcagaagaactaaaagaccaaggtaataaagcatttgcactgaaggaatataaaaaggcagctaaaatatatagagatgctatacaaatagacacatacaatccaatattatattcaaaccgagcacaatgttttcttcatttacaagattatgatcgtgcttacaaagatggtgtgagtggtataaatttgaatcactag

SEQ ID NO: 4247 - DNA, 1167 bp, Candida albicans
  unsure (443),(490): Identity of nucleotide sequences at the above locations are unknown.
cgaacaagagttcaccgtcaaaaaagaataaaaaacaaattaatggcaatagaacaatttatcacgaagggtgacgatgcccttaaatcgaaagactatttaggtgcaatttcctactattctcaggcaattaaggaaaatcctcaagcgttctccccttatttgaagagatcaaccgcgtatcaaaaattaaagaacaatgacaaagcaaaggcagacatatccagtgcattttccattgccaccgaaaaaggcaaaagagtagatattggcttatgttattttaagcttggattggtttattatcaggaaaagaaagtcaagttaagtttgacccaatttgaaaaggcagtcgaatacgactgtaaggaaccaactttatttatgtggaaggccaaggccgagtatgatttgaagaaccaccctgaatggaatgttgaggncgataaagaagaagacgatgatatagatttagttcttggtgttgaanacgagtacacccaatcaatggctaataccgagaaggacaaatctcatgaaccaaaaattgtggaattggatgccaacgaagaatcaagtgaaaagaaatccaaccaagagtctacatcatctgctcctgctgctcaagctactactcaagctccaaagtctactaacgttgatgtgattaacaagatcgcaccactaaacgttaaattcagagatgactggtatcaatccaacgaggaagttattatcactatctatgccaaaaaagtcaatgaagaaaagttgaaggtcgaatttgatacaaactcggtttgtatttcctttccaagcgcagccgcctctgaatacaagtattacttggatccattatttgcagaaattgttccatcggaatcaaaatataaagtgtactccacaaaattggaaatcactttgaaaaagaaggacgcaaacaagtggcccgaattagaaaagcaagcagtagaaggtgtgactgacaaccaggacaaggataagaaagttgatccatccgaattagtctatcctacatcatctaaaaagaagatcaactggaataactttaaaattgatgatgatgatataacgaagaaggcaatgaaaatgactttttccggaaaatattcaaagatgttgacgaagattctagaagagcgatga

SEQ ID NO: 4248 - DNA, 1212 bp, Candida albicans
gaagaagaaaaagcgatctttatttcgtacgtttctagtagtttttttttttgccaacagaaaggtgacaaaagaggcgaacaaaaaaaatctagctttcgtaattcaattttccaaatccatagacaacacgtttccaaaacacttttccccacatcaactaacccatatttcctgatgtcttcaaccattactaacaaggatattgctttatccattattgactttttgaaacaatctgttgctaaaaaagaagttgctgaagattatgctgaatcaatggatgttgccattgattgtattgccgatgcatttgaagtcaataaggaagatgattccaaaaccttaaaagacgtttttcacggaaagtcgttgtcagaattgcttaaatcctctgtttcattcagctctacatctgagaaatcggaatctgttccagcggcaaaggaagttgacgctgacaccaaggctaaagctgatgaattgaaagtacaaggtaatagagctatggcattgaaggattatccagaagctattgctaaatactccgaagccattggtttggatccaagtaatgttgtttatctttccaacagagctgctgctcattcttcttcccaaaaacacgacaaagcagtagaagatgctgaaaaggctattaaattggacccaaacttttgtaaagcttactctagattgggtttagcaaaatatgccttaggagatgcaaagggtgccatggaagcatacaagaaaggtttagaagttgaaggagaaactaaatcagatgcgatgagaaaaggatacgaaactgcaaagaagagagttgaagaagaattggaaaattccatttccactaccgataaatcaggtgaaagctctggctctagtgaatctgcaactggtgctggtgcgggtgcaggtgcaggcgcaggtggtttacctgacatgagtagcttcttgggtggaggtggtggtatgccaaatcttgctgagatgatgaataaccctcaaatcatgcaagctgctcaagaaatgatgtccaatcctgctgctatgcaaaatttgtttagcaacccagctgtgaaacaaatggcacaacaaatggggttgggtggcgaaaatggtcctgacttgtctaatattatgaacaatccaatgttcaatcagtttatgggaggaagagaaaaccaaggtgataagccagaatga

SEQ ID NO: 4249 - DNA, 999 bp, Candida albicans
aaaagaccttccttgactgaagatgtgattatgggtttacttaggtattggcctaaagttaatagtcctaaagaggttatgtttttgaatgaaatcgaagacatatttgaagtgatggaaccaaatgaatttattaaaatccaaattcctctatttgctcaattatccaaatgtataagctcgcctcatttccaggtgagtgaaaaagtgttatgttattggtcaaatgaatatttcttgactttgattaccgaaaatgccgaagtcgtgttgccgataatatttgcctcgttgtatgaattgactaatgcaactcaagcaggtatcgaaaatggtataatgaaccaaaaattggctcaattccctaatgctactactgatgccaatggcaatctaattgataatggattagtgttacaagatttacaacaaggaattgctccaagtatgaataatccttctcatcctcattataatattttccaagttcatgcttcaataaacaacaacaataacaacaatggtaacaacaataacaacaatgatggcagtataaacaatccagatagtatgaatattcacaccgattctaatggcaatgagatgtctgatgaagaatattatgatctgtttactggaatgggaggaggaaatggaggaccaggaggagcaaatcctaataatccattaggtgatgattttggtggtgcgtttgatgatggtacagggggtttattacaacataattcagctacatcaaattggaacagaagtattcattcgttagcttatggagcattaaaagtgtttatggatcataatccaatcttatatgatcattgtacggtgctttatcatcaatcattagcagaacaaaaacaacgtgaagcaaatagaaaagaaggatggaaacgagttgaagaattagttcgacaaatcaagaataaaaaaaatttggaactgcaacaaccacaacatccagctagtggagtcatttaa

SEQ ID NO: 4250 - DNA, 1104 bp, Candida albicans
  unsure (1),(47),(53),(184): Identity of nucleotide sequences at the above locations are unknown.
nggtatctttcccaaccaaatgacaataatccatcaactttttgtgnctttantacaacaggaacaggcacaggagcagcatttgcgttatcaccaggatcttcaactcccttgaatgcgagtgccaatgcacatacaagcaatgtgccttcgattctggtttctgttccggcaccatcattcnatttgaatcatccaattaccccgacaccaacgtctccaaattcatcgttgggatttcataatcaatttgaaggtaaagcaactcatagtcaacattctgctcagcctcattattcccaattaactcccaatatcgcttcaccagggaaagaaaacatcgacattgacttgattgtcactcccaaaagacactcatcttcccgatttgaaccaacatcttcagatagatatcaagagattgttaaattgccaaattttgatgaagtgttacctgaagaacaaattcaattgtttatacaaaaaattgatcaatgtaataccatgtttgatttcagtgatccaacatttgacattagaggtaaagaaattaaaaggataactttacaagaattgattggatttatatccaataatcggttcacatacactgatgaaatgtacaaacatgttgtcaccatgtttaaaaagaatcttttccgaccaattccacctccagttaatccaattggtgatatatatgatcctgatgaagatgaaccagtaagtgagttggcttggccgcatatgcaagccatatatgaattcttcttgcggtttattgaactgccggatttccaacatcaagttgccaaacaatatatcgatcatgaattcattttgaggatattggagttgtttgatagtgaagaccctcgagaacgtgattgtttgaaaaccacgttacatcgtatttatggtaaatttttaagtttgagaagttttattagaaaatcgataaataatgttttcctacaatttgtttatgaaacagaaagattcaatggtattggtgaattattagaaatattgggatcaattattaatgggtttgcattaccattgaaagaagtcttcaccacggggctggacggtcccgcgctt

SEQ ID NO: 4251 - DNA, 1293 bp, Candida albicans
gtcaaagatatgtcatttgtacttgcagctaaaccaaggtttgtgtaccttaccaacaaacagttgcaaactattggtaaacggttacttacacaatcagcaaaatcgtcattcaagtcgtcacaatgtttgttaagtgaacccaacactatgattaagacagcatctcctaaaaagaaccaacaacagtataggaagtcagttgctttagtgtctggagttataatcgtgggatcttacatcgtattcaatcaatctaattattttaacttggacacattaccactgaacttaccaccgccgcaacaatcaaaaaaattgttacaagacaatcaaaagaaatacttcagtacctcaacatcgtcattgcatcaaaaagacagtataagccatcaacaacacaaggaggggatctttttgttgaatgaagaacaagtaagcaccaagttacgtcaattcgaggagagttatactgtaaacagaggcaaaggagtgactagatacgacatttgtcagttaccctctaattctcccattgaggatgacagagcagaggaaatagtgcaggtaccgatattacaagataacaacatcaaaacgtcaactgattggatgttttttggtgtgtttgatggacacggtggttggaccacgtcgtctaagttgagggatcaactaattggttatgttattaacgaattgggtactatctacaagcctgtacagggagaagagaacttgcgatacgttcccaacagcgccactattgatcaggccatgaaaaatgggtttttgaaattggaccacgaactagtaaataagaatattgagaaattattaaccgatggtaataaagctaaggcggctgaattattaatgcctgcattatcgggatcttgtgcattattgagtttttatgacaccaattcgcaaatgcttaaagtggcagtcacaggtgactcaagagcaatcttgggctcatttaaagataatcattggactgtacgtcaattgagtattgaccaaaccggggctaacccatcagaagtagctcgtattatcagtgaacatccaaacgaaccaaaagtaataaggaatggtcgtgtcttgggtagtctagagccaacaagggcattcggtgactgtcgctacaagttaccagctgtaattcaagagaggatatacaaacagttttttggaagaccattgcctaatcaattaaagtcgccaccgtacgtcacagccgaaccgtcttcactcacgggagctggcacgaccgcgcttagattaagg

SEQ ID NO: 4252 - DNA, 1458 bp, Candida albicans
  unsure (1265),(1449): Identity of nucleotide sequences at the above locations are unknown.
acttcatttatattattagcatatcaatcaatcaatcaatcaatcaatcgatcaatgtctgccacaataacggaaaaagaaaccgctgtttctacaactaccgccacaccaaaatctattagacctttgtcatacacaaacttgttagctaatagttccaactatttgaaacatggatcatcttctgagtcactcgattctcaagtatcaaatgcttctaccatcaaattcacagcatcatctgtgtcgccaactatttcaccatctccacaaacaccacaagtgcaaccacaatcacaagtgcaatcacaagtgcgtaagaaaattcaaataccaaactattatgtgccacccaaagtgaacattgctccatctattagtattactgaaagtaatgatgcaaccaataccacagaaaccattgccagaccaagtctaattcgtaaaaagtctggtgagattgtcaaatcatccttgaaattgtcaagtctattgcaacgttcattatctacaccacaattatccacaatggggaataaaggtagtacgagaaaatcggttcgttttgcatcaagattagctaatgtcaagacatttgatggttgtgactctccaagtacggtgtcattagctaattctccttgcacatcacctccatgtgaatttgaatctgggtttgaagatgttgatgttgatgatgatgtatatacatttttgaaaaataaaccaaatcgtcgtcttcgtctgggattcgaatggaattgggataaactgattaattcatcctcgtcatcttcagatgatgatgaaaatgaagatgattactggtcaactccaaaacagtttagcaagcccaataaatttttaccaaattcaggatttgtttctggtactactgcaaagactattactacaacagggtttaattccaattcattgaatagttctacttctgctccttcaaaggaatatagattgacgtcacataatattccaaaaatgatcaactctagagaatccattgtttggttaccttcagcatatgtgttaaagacagatggtaaaacttttctttatggattagttaatgttcaaaatttagcatttgaaaagaaggttttccttaaattgactttaaacaattggaaaactagtgttatatttggaggacaatcggtgattaattatttcaaatcaattgataataaaattgatcaatttaagtttaaaatcagtttggatgatttgatttcttcacatggtanaaatgttcaattacaaatgtgtattaaatatcaagttaatgacactgaatattgggaatataattttggtaagaattatccattccaattgactcgtattgatagaaaagttctccaacacatcaattcaagttattccgttggtgacagcaagaacgtatccactacaacttacactgcccanaaaatatga

SEQ ID NO: 4253 - DNA, 1299 bp, Candida albicans
tccatcacctacaagtttgattatttttatttagatggtgtatttagtaatactaaaaatgatactccgccagttttttcacctgaggaaatgtcggactacaaattggttcgcaaaaaatcaggtgaacttgtcaaaccatctttgaaaagtcccctttattatcacaaaaagcgatcactatcattaccatccactccaacctataaacaagtacattttggtggctccactgatgtgcgttatttccataaaaaggataggccggcagcaatttcggcttcaaattcacccaaactaagcccagccgatgatgatgatggctacgattattctgacgacgatgatggctatgataacgactcttgtgattctgaccctgaaagtatcgatctcaacaataaaatttttggattcgatgaagggcaacgtcaacgacaacgacaacaaggtcttcattcgaaaaccgacacaaaataccctaagaaattggaagggttgattgattggcaattaagactcaccaatttcccacccttatcgtatttgaaaaaaattgaaacaggagttccagtctttttagaaaaaatattcatatctggtgatagaaaatacttattgggtcatgttgctgttcgaaatcttgcttttgaaaaacatataaccattcgttactcattggataattggatgactgtgattgagcttcctactaattatatcgaagagagaccagaagttttgaaattaaatgattacgatcgatttggatttaagattcctttgaatagcttgtttcatagtttaaagttttccacaaattcgtcgacagattctttggatgccagtagcaatgaggatgacggcactagtacccatgaacgaacatatcaattgtgtataaaatacgaaactaacaatcaagagttttgggataataatgcatccaagaattatgaagttaaattggttaggtcattcaaacaaatgcctgatgtcacgaaaccatttataagaaagaatattggtgttgttggtactaagattcaagaccatgctagaaaaccaagatattcaaactcctatcttaaacgagttgcatctgactcggcaatagctactaccatgaattcaaaatctactgctgaaccaactgcaactgaacttgccacttatggtttagattcaccttcagaatcatcaattgcggattccaatagtggactgagtaatttttccgaaattagtgattttgtcaaaaataattattatttatcgtcgcctttattgtcatcgtaa

SEQ ID NO: 4254 - DNA, 372 bp, Candida albicans
cccgagggtcgaagaatattggatattcataataaagtattttcatggacaaaagtaagacaagggttaataaaaatgtatatggttgaagtatttaataaattccccgtattacaacatttttggtgtggtgaagttttatacccttggaaagatcatcaagggaatgatttacctgtcaatgaaaaagaggaaacggagttagataagccgcccgaaactactttgaattccacaactacaactacaactacaacaaaagtatcaagttcaacatcaaaaataccatttactccagctccatgggcaaatactactaccactcatgcagtaccccgtaatacccgtaatactcgtaatccccggagctaa

SEQ ID NO: 4255 - DNA, 1128 bp, Candida albicans
acctggaaaaaagaactcccagtgtttttccttgtaacaactatttgcaatatgtcatacatcacacctactaaaagaattttcactccggaagatttgtccaaatgggttggctcgcctacttataataccgtattggatttcattgtggagttgcagtcatccgtcactggcaaatccaatgattcatcatacgagaccagtctgataattgacaaactttccaaactcctttcgaaagttgacaacctcattactttacatcctgctcatgattcagtatctcgatttggaaagattgaatttagagatttttatagtgatttgtccagcaaagctgaagaatacatttctgagattactgcgacggcaattcaagaaacctctgcatatttcattgaatcgtgggggaacagcacaagaattgattatggttctggtcatgaattgaattttatatgttttttattgtgcttgaaggagttgggtcagattacctctgctgattacgagggtttggttctcaaagtcttcactcagtatatgtcgattatgcgaaaactacagaaggaatactggttggagcctgcaggatcccatggggtttgggggttggatgattatcactttttgccctttttgtttggagctgcacaattatctactcacccacatatgaaaccaaaactgattcataatgatgagttggtggagatgtattccaccaagtatatgtattttgaatgcatcaacttcataaataaaataaaaaccattcctaaccatcaaggtaaattgagtttgcgctggcatctgccaatgttagatgatatatctgcagctaaaaactgggataagatcagagaaggaatggtgaaaatgtacaaggtcgaagttttggggaaactaccaatcatgcagcattttatgtttggtagtcttttaaaatgtccagagggaatccctgaacatactgatgaaaatggacacggagagaatcctgaagatcattgtggccatgctcacgttaatacttggggagattgttgtggtattaagattcctagtggtatagctgctagtgaaagtctaaaacatgagaggaagggcaacattccgtttgattag

SEQ ID NO: 4256 - DNA, 510 bp, Candida albicans
agcatagatctgccagccgcctgttcgataacaataccattacgaccgttaatagaacctaccactaccactaccacaagagaaaacaaaattggcccatcacatgggaatgttgaaatattgattgaattattccaatatcttaataaactaatagatgaaactccacctttaaaaggaccaactagatttgggaattttgcttgtagagattggcatgataaaattgatataattcccatacttaaaaaattcaaattcccgcaagaattaagtagtagtaataatagtagcagcaaatctaatattgatggatttttattagaatcaagttattatttactaaattcatttggttcaaaaataagattagattatggtactggacatgaattatcatttcttgcctttattggatcattaatagaatttaaaatattaaatcatcccactacaacagaagaaatcaatggtaaagaaattcttattatatttgccaattattatgat

SEQ ID NO: 4257 - DNA, 537 bp, Candida albicans
  unsure (502),(506): Identity of nucleotide sequences at the above locations are unknown.
agtccattgatgactctatattacctccaggaagatacattatcagaagctatgtataataatgtaaagctagatcactacttcaacaaactaccaaagagctcggaagaaaataatatcaacgaccagacaaatcagcttatagtatcagctgcacccgaactggaagattcccctgctgcagaatggaaattattaagaacattagcaggtgcacaccaagggtggataagagcgattgcattagatgaaataaccaataaatggtatgtcacagggctggccgactctacaataaaaatatgggattttgaaaataattcactcaaagcagtgttgactggacatgtgctaggtatacgttcattgtgcatttctaaacgtcatccatatttattttcagggggtgaagataaatctttgcgatgctgggatttggaaagaagtaattctgacgcggggtgtcaaatacggtcatatcacggacacttgggaggtgttntttntaattttctattggcttgcaccctgagctag

SEQ ID NO: 4258 - DNA, 636 bp, Candida albicans
ttttctattggcttgcaccctgagctagatgtgttattcagcggtgggaaagactgtgtcgtaagagtttgggacattagaagcagggtagaagccatgactttattgggtcacactaatgatataacatctattgagactgattataacgatccacaggttatcaccagctccatggatggaactatacgattatgggacttgagaaaactgaaaaccgagcttttgataactaatcattcgaaaagtatacgaagcatgaaatcgcatcctaaagaagcgacatttgtatctggtgattcaaacggcgaaataaagcaatggcttttaccaaagggtgaattgttaaatgaatttggaaccagccaactactgccaaaccaaagagataatagcagaattattaacactttagcgattaatccagttacaaacactttgttttcgggatatgacgatggtaaacttgaattctacaattacactaccggtaacttgcaacaatctggacaatctccctctttggctggccctgaacaatcggcaatttatgcctcaacttttgacatgtctggtttaagattattgacatgccatggcgataaaagtattagaatatggggaacatcctattaa

SEQ ID NO: 4259 - DNA, 531 bp, Candida albicans
ttaaaagtaaaacagggtacggggttgtttgatctttcgtcaacgataaacaaagttactaacttgattattttttttttgaaaattagatgtcgttcaccaatggcagaagcaatttttaagcatcaagtggaaatccaaggatactccccatttttcaaaagaatagattcatttggtaccagtggatggcacattggagaaactcctgattctcgatcaagcaaaacatgcaaaaagcataatgtccctgtttctcaccatgctcaacaaatcaatagttctgattttaaagattttgattatgttataggtatggacgaatccaatgtggccaatttgagacatttgaaacctagagactcaaaaactgtggttgaactatttggacattggaaaacatcagacgagtttaaaacaattgtcgatgatccatattatggaggcattgatggatttgaatataattataaacaaatttgccatttcacagatgaatttttgaaacaagaaataggtagtttagattag

SEQ ID NO: 4260 - DNA, 267 bp, Candida albicans
ggaaacatcaaaagtaccaccacccaaatcgaaaatcaaaacattcttttcggcttcagattttttgtccaaaccgtaagcaatggcagcagcggttggttcgttaatgattctcataacgttcaaaccagcaatggtaccagcatctttggtagcttgtctttgggaatcattgaagtaagctgggacagtgacaacagcatctttaacagtggtacccaagaaaccttcagcggtttccttcattttacccaagatcatagatga

SEQ ID NO: 4261 - DNA, 195 bp, Candida albicans
tccataggcaatagcggcagcagtaggttcattgacaattctcaaaacgttcaaaccagcaatagtaccggcatctttagtagcttgtctttgagcatcgttgaaataagctggaacagtgacaacggcatgagtaacttttttgccaaggtaatcttcagcaatactcttcattttacccaaaaccatagatga

SEQ ID NO: 4262 - DNA, 1113 bp, Candida albicans
ctcaaggatttctctattttggataaacaaagtccggctcataatgattttgtagtggatacattcactactcccacaacatcaatgattcaatcattagctcaaaccacattaggcgatgctgtatataatgaagatttaaaaaccattgaattagaacaaaaagtagctgaattaactggtaaagaagcaggattatattgtgttagtggaacattatctaatcaaattgccattagaactaatctttatcaaccaccttttagtgttttatgtgattatcgagcacacgtttatgttcatgaagccggtggattatcgacattatctcaagctatggcacaaccaattaatcctaaaaatgggattcatttaactttagaagacgatattctaccaaattttataattgatgatggggaaattcatggtgctcctaccaaattaatatgtttagaaaatacattacatggaatgatattcccaattgaagaaattaaaaaaatttcgaaattttgtcaacaaaataatgttaaattacatttagatggtgcaagaatttggaatgcaagtgctgaaactggaatttcattaaaagaatattgttcatatttcgatagtgtatcactttgtttatcgaaaactttaggtgctcctataggtacagttttagtaagtgataaaaaatttattcttaaagctaatcatttcaaaaaacaaaatgggggtggcattagacaaagtggattattggcaagtatggcaattatcgccattgatgaaaatttctcaaaattgaaacaaactcatatttgggctaaagaattgggtaaattatgtgatgaaaatggaattattttggaacatccagtacaaacaaattttgtatttattgatattgctgctaataaaattaatccagaaaaattgataaaaatttctgataaatataatgttaaaatttattctggtagaatagctttccattatcaaatatctcaagaatcatttgaaaatgctaaaaaagttgttttagaagtaattcaatatgctaaagatcatccttatgaagagaaaactaattttaagttctatactagtgaaaataaatag

SEQ ID NO: 4263 - DNA, 1236 bp, Candida albicans
gcttttggtttgctattttggtttaatagattaataactttttttcctttttcctttccttttcccttttttttgcatctatacgacacatattactcagcacaccacattaatatgacagcagacgaagaagaaacttttaccacctttaatgagttcagaagcgatacattcactgttccaactagggccatggttgaagatggatttatgaatgccacatttggtgattccgtataccaagaagacgaaaccacattacgtttggaaagtaaaatgtgtgagataactgggaaaccagcagctttattttgtgttagtggaaccatgtcaaatcaaattggattaagagctaatcttgttcaacctccatatagtatattatgtgactaccgtgctcatgtgtttttacatgaagctggtggattggctacattgagtcaagctatggtacatccagttcgaccatcaaatggaaattacttgacctttgaagatgttttggcaaatgtaacttatgatgatggagatattcatgctgctccaaccaaagtaatctcgttggaaaataccttacacggaatcataattccaatagaagaaatacgtaaaatcagtgaattttgtcgtgaaaatgatatcagattgcatttagacggggccagattatggaatgctagtgtggcaaccggaattagtattaaagaatactgttcatattttgacagtgtttcattatgtttatccaagtcattgggagcaccaattggttcagtattggttggagatgaaaaattcattcgtaaagctaaccatttcaaaaaacaaagtggtggaggaataaggcaggccggtataatgtctgctatggccatacatgctattgattataatctttcaaaacttgaattatcacacaattatgctaaacaaattggcgacttttgccaagaacacggaatcaaattggaatcaccagtggataccagtcttgtgtttctcgatttgaaggccaataaaatggatccgaatagattagttgaattgggaagaacaaagtataacgtcaagcttatgggacaaagaatagcatgtcatttccaattgagtcaagaaagtgttgataatgtgaagaaatgtattttagagtgttttgaatatcatcaaaaacatcctcataaagatgatggtaggaataataagaagatgtatagttttgacgccattaaaaaataa

SEQ ID NO: 4264 - DNA, 780 bp, Candida albicans
gcggttccttccagccccgtggtgaagattttagatattgaaggaacagtatgtcccataacttttgttaaagatacgttatttccttatttcattgaaaaattaccacgaattttagataaatttcaatatccattatcaaacaccagtgctagttctgatgatcaagttttgaatatattgaaacaattaccagataatatcactaaatcaagcgaatctatttataaacattttaaaaatttagttgatcaagatattaaagatcctattttaaaatcattacaaggattaatttggaaacaaggttatgaaaaaaatgaattacaagcaccaatttatcaagattcaattgaatttattgaatcattccctacaaaaagtagtactaataacaaaatttatatttattcatctggttcaataaaggcccaaattttattattcggtcacgtaaaatcaacaacaacaacaataactaatgaagttattgatttaaatcctaaattgaatggatattttgatattactacagcaggatttaaaaatcaatcaaattcatataaaaaaattttacaagaaataaataaatcatcgacacctaaatcggtgttatttttaagtgataatattaatgaagttaatgctgctattgaagcagggatgaaaagctatattgttatacgtcctggaaatccgcctattgatgatgatgatgatggtaatgatgataaaatcaaccataaaattatttattcattagatgaattggatttataa

SEQ ID NO: 4265 - DNA, 1233 bp, Candida albicans
caaattaacaacaatataatgtcacctaaaaagtcttatagtcttgaaacagagttggtacttaacaagtccggcgaccaatacaatgcatctgttccacctttgtatcaatccgcgactttcaagcaaccatctttatctaatatgggggaatacgattacacgagatcgggtaacccaacaagaactcatttgcaaaaccatattgccaaaattatgaaggccgaacatgcatttgccgtctcatccggaatggggtgtcttgatgttattacaagattattaaagcctggcgatgaagtaattgctggtgatgatttgtacggtggcactcacagattattgacttacttgagcaagaaaggtgatattgttgctcatcactatgatactactaataccgaattaataaaatcaaaaataaataacaagaccaagatgattttcttggagtcgcctaccaaccctttaatcaaagtggtcgatgtcaaatcgattgctgaccatgcccacaaggctaatcgcgacattgttgttgttttcgacaacactatgatgtctccagtgttgatgactccattggatttgggggttgatatccaatatgaatcggcaactaagtacctcaatggacaccacgatatcatggctggggtgatcgccaccagatcatcttctttagctgaacaattatattacattataaactctacaggatgcgggttatccccatttgactgctggttgttaagcaggggtttgaaaacattagcaatccgtgtggaaaaacagcaacaaaactgtattagaattgccaaatttttagaaaatataggctttaaggttagatacccgggattgaagtctcatccacaatacgagttacatagctctatgtgttcaggctatggtgctgtattatcttttgaaactgggagtgtcagattactggagaaaattgtggagaataccgatatttttggtatagcagtttcttttggttgtgttaattcgttgatatccatgccatgcaaaatgtctcatgcatccatcgatgcaaaaaccagagaagaaagagaatttcctgaagatttaataagattgtgcattggtattgaaaactgtgatgacttgatagacgatctaaccaaggcattattgagaagtggtgctgtgaaagtgaatgatagagatgagttatacaatgcggtaggcatacaaccaaaattgtaa

SEQ ID NO: 4266 - DNA, 549 bp, Candida albicans
acttgtggatctttaatgaatataaaactatttagacatttacctaaatcaataacaagatcaataataatgtctaaattttcaccaccaatcaaccgtaatatggttgaattagatcgttcatttttctataaagaagtaccattattagctgcttatttccctaatcccaaatttttaggtcaatttgttaaatcttgtcaaaatgatattctttatgttcaaaccgtaaaacatattatttccatggatgattctaaagccatattattacgtgatgatgtgaaactgatatctgatttaaacccggaaactcaattgaaaattaatgaatttggaataatattaaaaccttatactttaaaacttgattattcattttggaaaagtgaagaaattttgaaaagtatattaccagaaaatttaatagatgatgtacctagtggatttagtcaagcaggtcatttagctcatattaatttaagagatgaatataaaccatttgggaaattaattggtcaagtgattttagataaaaatcctctggtt

SEQ ID NO: 4267 - DNA, 246 bp, Candida albicans
agattggtttctgaagataaagcaaaaagattaccttctaaattgaaattgtttcatcatgctactagtttgggtggtactgaaagtttgattgaatggagagctatgagtgatgatcatattagtaagaaattattgcgagtttcaattgggttagaagacccaagagatttattggcagattttgttcatggattaggtggtgatgatgatttagtcaaacagattgaaaatttggaaatttaa

SEQ ID NO: 4268 - DNA, 621 bp, Candida albicans
acccttttccttttctcttttttcctttatctcttttccctttatctcttttcccttttccctttttctttccccactgtaaccctttcaataatgactcgcttggcaactgactctatccatggtggtgatcatcttaaacgtgtgattgatgtaatcaacccaattcatatctcaacaacatacagttattctaacaatcctgatgaattagtacctggtggattaactgatcctaacactttggtttattcacgtgaaaaccatcctaatgccgctcaaatagaagccattattgaaaaaattactggatatccagcagtcatttataattctggattgggtgcgtttaatggattaatcacttatgttaatcctaagactatggcatttggccaaatttatcatggtgttcatggaattgccgatatttggacaagaaattttggattaaaacaaattggtatcgatgataattttgatggagtattacaaaagggagatttggttcatttagaaaccccagttaacccttatggtaccaatttggatattctgaaatatgctgaaagagctcatgctcaagtctcaccaccggactggccggatacgcgcttatgt

SEQ ID NO: 4269 - DNA, 423 bp, Candida albicans
atatgggggatggaatacaaagagcagattgtcgattccagggtttatggtatgttcagagaaccagagatcttggatgttgttgttgctccaaacttgtacggtgatattttgagtgatggtgctgctgctttagtcgtttctttgggggttgttccatctgccaatgtcggagacaattttgctattggtgaaccttgtcatggttctgctcctgatattgaaggcaaaggtatttctaacccggttgccactatcagatctactgcgttgatgttggaattcatgggttacccagaagctgctgctactatttatcaagctgttgatgccaacttggcagaagacaagatcaagaccccagatttgggtggtaattctactacccaagaggttatagatgatatcattagaagattctaa

SEQ ID NO: 4270 - DNA, 372 bp, Candida albicans
aggaataacagccgactgaaaaaaaaatttattaaccaaaaacttcaacaattctttaattctcttcttttattatttgttgtttcactcaattgtcattattatttacaaatgttagctgctagatcttcaattcgtcgttgtttctcaacttcttctactactttaaagtccttgaaaattggtttaattcctggggacgggattggtcgtgaggttatacctgctggtaaggctgttttagaaaacttaccagccaaacacgatttgcaattcgaatttgtcaacttggatgccggtttcgaattgttcaagaaaacaggcacagctttacctgatgaaactgttgatgttttgaaaaaggaatgtgat

SEQ ID NO: 4271 - DNA, 1776 bp, Candida albicans
cacactcaaacattcataccaaccccaaccagtatgagtaaattgaaaacattaaatagacaattcatatccaatctagagactcataaggtgaccacagatgccaaaagaaatttgatcttatcaattttaaaatcaactactacaaaacgtgaagccaagaattacttaactaaataccaaaatcaatttgatttcaatgatgatttagattttaataaaagtattaaaatcaaaaatgaacaactgtcattaactaatagagattcacaacgagaattatttataaatagatttcttaatcaactgaatccatttataaatgtttatgataaagaagatgtaaaattacaaaaagtacctcttcgattggccattttcaaaatcaaattcacaaaaataactattaaacaatggaaaggtatagctgaaacttttaaaagattgataactttgggtatttcaccaattataatgttagattacgatcatttacctctggattcttataaaaataatgaactttacatgattaatcaaggtaacaaaatgctcaattatttgggacatcctgaagaagaaagcgatttgaaagtgacacttttacggtcattatttacgtcacataaaggggtaccaacattggatagtttagaactgatacttattccattgtatcaggggattatccccataattcaaccaattgtctataatgcagatctttcaaaacaagaatttcttgcctcagataaattattgttaggtttaagttcagcattgattgaaaaaagaactactgatttgttatccattgagaaaatagttatgatagatcccattggaggaataccttctatagaaagacaccaaactagtcatgttttcataaacttgtcacaagaatattctgatattctttccgaattatttattggacatattgaacccaaatatcgtgacactcatgtcgataatttgaatactatgaacaatgttttatcatatataaatgaaaaatcaggtaatgatgaaactacaggcattattaccaccccggaaatcatgtcaataaatatcgatcaattgaatcctataatttacaatgtccttactgatagagccattatatcgtcttctttaccaagcaccaccaatagaactccacatttgtccactactattatcaagaaaggtgttgaagtacaaatatttgacgttgacaattatgacaaagacttgaccatgcaaaacttgtttgatgataaattggtgaacaaagagaaattgattgatttattaaatgattcgtttggaaagagtttagatgtaggtccctatttggaccgtataaacaagaacatagcgacagtggtaattgttggtgattacgatggagccgcaataattacttgggaatatagtaaaggtgaaaagattgcctatcttgataagtttgccatcgccaaaaagaatcaaggtttacctggcttagctgatgttatattcaaaatcatcttacaatctcatccatttgaattgatctggagatctcggaaaaacaatccagtaaacaaatggtattttgaaagatgttgtggatgtatgagtgcccctgattctcaatggaaaattttctatacgggtgaagtgtttgataagaagattgatcggtttaaacggaaactacgccaccaaaatggtgtagtcgatattgatagaaaattacaacaatattccgaaatttgtgaaggaataacaccatcatttaaatag

SEQ ID NO: 4272 - DNA, 2406 bp, Candida albicans
ggtcaatttgctgtttctttagcaaagaacttgggcatttctcatgttgccattcacaagtactcatctttgttatctgctcatggtatccagttggctgacattgttattgaaaagcaatcaccggcatcttttacgtactctctggagaatttcgctgccattgacaacaaaataaaatacttgatcacgtctgcacaaaaggattgtgaagaacaaaatttgcttggcttcaaaacgaggttggagattttgttaaatatgagatatgtcggatcagatactcatttacttatccctgttactaaaggtgaatatgatgcggataaaaaatttatcactcgacacaagaatgaatttggattcaatttagacagaaaagtgttagttgatgatgttcaagttttgttgcatgttgaatcagacgataaagagaaatataatccgtatcaagaatttgccaaattggaaaacaagaattcatacctagctccttcaaaaattcaaaagaacatttattttgaaaccgaaggttggttagaatcatctgtttattttttgcctgatttacaaaaggggctggtaatcaagggcccctctattataattgataatacacaaacaattttagttgagccacgttctaaggcggcaattctaactgatcatatattaattgaagtagaacaagagaaaaagccagaactttcaaggacaacaattgatcctattcaattgtccgtatttggacacaggtttatgtcggtggcagagcaaatgggtaggacattgcagcagactgcaatatctacaaacattaaagaaaggttggatttttcatgtgctatatttgatagtaatggtgatttaattgccaatgctccacatattccaattcatttgggatccatgtcgtatgcagttaaagctcagattgaattgtggaaaggaaaattgcaacatggtgatgtattggtttcaaatcatcccaaagctggtgggtcgcatttgccggatattaccgttatcacaccagttttggatgaatccaacaaccctcttttctggactgcttcaaggggacatcacgctgatattggttctatagcggcgggatcaatgccgccaaattctaaaactatttatgacgaaggtgctgctattattactcataaattatgcgacaaaggtgtatttgatgaagaaggggtcatcaagattttggttgaagagccagccaaatatcccggtgggtcaggaactagaactttgagcgacaacatttcagatttgaaagcacaagttgcggcaaattataaaggcattactttattgaacagaatggtagatgaatttacatttgaagttattgacttgtatatgacaggaattcaatctacggctgaggtctcagttcgaagtttattgaaattggcatataagaaatttggaggtaataaattaaaaggtgttgactatttggatgatggtactgcaattgctttgactgttgacatcgatccagaaacagggtcagcgttgtttgattttagtgaatcaggcgatgaagtatacggtaacttgaatgcgccaagagcaatattgtattcagctgtgctttatgtattgagatgtttaatcagtactgatatccctcttaataatggctgtttaagaccaatagaatttagcaccagagaagggtcgattgttaatccgtcctatgatgcagcagttgttggtgggaacgttgaaactactcaaagaattgttgatgtcatgctaaagactttccaagctgctgcaggatcccaaggaacttgtaataattttacttttgggaccaatgactccaccaagggtatatcgtttggatattacgaaacaatctgcggtggttctggtgctggccctacatgggatggtcaatcagtggtccaatgtcatactacaaacacaagaatgaccgatacagagttatttgagaaaaggtatcctgtgttggttcatgaatattcagttcgtcaaaattctggaggtagcgggttccataaaggtggagatggtgttgtacgagatattgaatttttgtaccccttagaagtttcatgtttgatggaaagaagatccttagccccgtatggattgttgggtggtggagaaggtgctcgtggtatcaattattggtatcaaaaattggatgatggaggatatcgaaaaaaatcattgggtggtaaatgtactgttaaagtggggacgggtgacaggatagtgattaaaactcctggtgggggtggatttggcgagctgttgtcaggagagttgaatttccccgtggagagttcgcatccaagtgtcttgacggggtcagtgggggttagagcaatcacccaacaaacgaattaa

SEQ ID NO: 4273 - DNA, 1212 bp, Candida albicans
aatgggtactacagtagccacaaacgcattattggaacggaaaggtgccaaagtgttacttgtgactacaaaagggttcaaggatgtattgtttattgcaatcaaacaagacttcatatttttgatttgacagcgaaaaatttaggacacttgtactatcaagttttggaaattgatgaaagagtcacattcgccgggttttcagaaggaggcggtgagaatttgaaagttaatgtcgagtctgattctgagttgagagaaagtgttactggagatatcgtcagagtgataaaagaaccagattatacaaaagttactgctgatttgcaagaaatataccgtcaaggagaaattaaaacaatagcattatcgttactccatgcatatgcctatccacaacatgaggccaaggtagcagaaattgcaaaaaaaattggatttgaagtttccgtatctcatgagcttcaacctatgcttggatttgtcaatagaacttcttcaactgttgcagatgcatatctttctccggtaatcaatgagtatgtcagaaactttggggcgggttttgaaggggggttagacgcatttggtaacaagttattatttatgcaatcaaatggtggattgtgtccgtggtataaatttactgggttgaaggcaattttatctggtcccgccggtggtatggtaggttttggtgtgacctgttacgacgacatttcaaaaaaggcaaccattggttttgacgctggaggtacttcaacagatgtttcaagatatgctggtaatttggaacacatttatgagacagtcgtcagcgaaataaacttacaaacaccacaattagatatttccactgttgcggctggtggtggctctatgttgttttggaaaaatggaatgtttgttactggtcctgaatccgctggctctgatccgggccccgcttgttacagaaagggtggacctttaacagttaccgatgccaatttgtttttgaataggttattacctgattttttccccaacatttttggtccaactcaagaccaacctttagattacgaattaacggcagaaaaatttagagctctaaccgatgaaattaaccaagatgaagcagaagaaaggattattttgaacactgaaagattcgcaagttgggttttaaaagttaccattgagtcattggcagaacgatcaggatcttga

SEQ ID NO: 4274 - DNA, 423 bp, Candida albicans
cataaacattgttggaaaacaaaaagcaaaacaaaccccagaaaaccaatccgttcagccatgtctcaaactaaaaagggaattcaaatcgcaattgatagagggggcacattttgtgatgttatagccaaaattcctggccaaccagactatgtattcaaattgttatccgttgacccacagaattacaaggatgcacccgtggaagggattcgtcgagttttagaaaaagcaacgaacaaaaagatacctaaagggaaaaagcttagtttggagttaatacaaagtattagaatgggtactacagtagccacaaacgcattattggaacggaaaggtgccaaagtgttacttgtgactacaaaagggttcaaggatgtattgtttattgcaatcaaacaagacttcatatttttgatttga

SEQ ID NO: 4275 - DNA, 258 bp, Candida albicans
acattgttggaaaacataagcaaaacaaaccccagaaaaccaatccgttcagccatgtctcaaactaaaaagggaattcaaatcgcaattgatagagggggcacattttgtgatgttatagccaaaattcctggccaaccagactatgtattcaaattgttatccgttgacccacagaattacaaggatgcacccgtggaagggattcgtcgagttttcgaaaaagcaagtcgccaccaggcggtaaaaggacaacgt

SEQ ID NO: 4276 - DNA, 1674 bp, Candida albicans
cggcgcatcgcatcgccagataatggaaaaaaaaaatacccgaaagctcaaaaaatctccattaaatcatcttctgcaaccactatgacttcagaaactgtgatagcaccatcattgtctactgcacagaatgacggcacatttacctatgacaaagtcaaatccaccgccaaagagagaaaacacttgaatttgaaaaacccactggatgcaaacgagatcaaatccaaaatatggaactactattcgttgtcagaattgattcaatatctaggacaaaaggaaaacgacgatttcaagtacaaacgaattactttacagtttccagataatttaatatgcgactctgctaccatagtgcatgaacttcaacgagaattgaacattgtcccgcaagccaatcaagacacaggtgaatccaataccgctcaaagagtctggatactagcagacacctcctattctgcctgctgtgtggatgaagtggcagccgagcatgtcagaagcgatttagtggtgcattttggggatgcatgtctaaatgagattgataaactacaagcagtgtttgtgttgggcaaacctacactcgatgttgatgcaatagtgaaacagataaaaacggcttacagtacggagcagaaagtagttctcatgtctgatgctcctcacacgtatttgctacccgagatagcgaagcaattgccagattacgacattctaattgccgacttgccaaaaacttcgagagccaaaataataggatacacgccaccaccaacagggcacaaaaaattcaaccgagttttcaacactgatacggttgagtttggggaatacgaattgtttcacataacaagtccggagtcgccacgattgctacagttgaccacaaactttgcgtctgtcaccacctacgacccgatcagtggcactgtttctactgggccattccctaatctaatgaggagatacaagtatgtccaccaagccagaatggcaggaacagtaggtattctagtcaacacgttatcgcttgcaaataccaaaatcttgttgaacacaatcaaagagaaaatcaaagaggcaggcaagaaacattatatatttgttgtggggaagcccaatgttgccaagttggcaaattttgagagtgttgatatctggtgtattttaggctgtgaccaccagggaattataatcgaccaaataaacgaatactataaaccaattgtcacaccctatgagttattgcttgggttgagcgacgagctatcgtggacaggaaaatgggtggttgactacaaaagtgtgttggaagagtatggcaacgaggttatccaacagaatgaagatcctgacaccgacgaagacttgccgccagtgtttgaccctgtgactgggagatacgtcagtacttcgaaaccattgagacagataaaccatcttatggtgacgtctagtgagcaaggcggtgtagatgatcatgacaatcaattggtaaagaggttttcaaatgcagtggccattaaaggaatggtcagcacgtctgctattcacttgcaaaatagacactggacagggttaggaagcgattacactgaggacgagaatgcagctggagcattggttgaagacgggagaaaaggtatagccagaggatatgatatttag

SEQ ID NO: 4277 - DNA, 249 bp, Candida albicans
aaatgtgtatacggaagaaaaaaaattgttttggaaaaattatttaacctctcttctcaattatcattcacaaaacaaacaatgttgtacctcattgggttagggttgtcatacgaatcggacatcacagttaggggattggagacagttaagaaatgtaagagggtgtacctcgaggcatacacctcaattttgatggcagccaaccaggagtcattggaaaagttctacggcagagaaatcatattg

SEQ ID NO: 4278 - DNA, 987 bp, Candida albicans
gctgaaaatgtgtatagggaagaaaaaaaaattgttttggaaaaattatttaacctctcttctcaattatcattcacaaaacaaacaatgttgtacctcattgggttagggttgtcatacgaatcggacatcacagttaggggattggagacagttaagaaatgtaagagggtgtacctcgaggcatacacctcaattttgatggcagccaaccaggagtcattggaaaagttctacggcagagaaatcatattggctgaccgtgagcttgtggagacagggtcagacgatattttgaaagatgccgacaaggaggatgtggcatttttggttgtgggagacccatttggggccacaacacacacagacttggtcattcgtgcacgtgaattggggatcaaagtcgagaccatccacaatgcgtcggtgatgaacgccgtgggagcatgtgggttgcagttgtaccagtttggacagactgtgtcgttagtgtttttcaccgactcatggaagccagactctttctatgggaagatcatggagaacagaaagattgggttgcacactttattgttgctcgatatcaaggtgaaggagcagagcatcgagaacatggctagaggcaggttgatctatgaaccacctagatatatggacattgccactgcagcacaacaattgttagagattgagtcgatcagacaggaacaggcatacacacccaacacaccgtgcgtggccatttcgcgattggggtcaccaacacagacatttaaagccggaacattgcaggagttgagcgagtacgattctggtgagccattgcactcgttggtgatgcttgggagacaggtgcacgagttggagttggagtacttgtaccagtttgttgacgacaaggagaagttcaagaaatttgttgaacaagatcaagagtttttcaaaccagctccgtatgttccaccggaggatgtggatagtgaatag

SEQ ID NO: 4279 - DNA, 2046 bp, Candida albicans
cattattccatgtgtggaattttacttaaagtatcaaataaaccattggatataccatcatgtattccacaaccattaagacaaactgataatgatcaaaaaaccaactgtaatcaacatcaacaacaacatcaacaatgggaaaccttagataaagccattattgaatcatttttaaataaaggatcggaattaaaaccattaactaatcaacaaatttataaattaaataatttatctcatttaagagaattaaataatcaattatcgaaacttaaaaataacgtgaaaagattatcatcagatttagaatatcaacgacaagaacaaattaaacaattacaaacagaaattgatttgatctctaaagatgatgatgatgatgataatgatgggttagaaattgatagacaaaaaggagaaggagaagatgatttggatcaattgatttataatatatctaatagaggtccagattatttgaatttcagtcaattcaataccactaccaataatggagatgaatttcatttccaaacatttctggcgatattatccttacgacaaccatttacaagacaaccgattttcaaagatcaatttgttttacaattcaatggggaattatataatcaagaatgtttacaaattaatgatacccaatttataattgataaattacatgaacatttacaagtgaatgataatagaaataatgcaattttatcaactttaaaatctctcaatggagaatttgccataattttaattgatttattggaaaataaaatttattttggtcgtgattctattggtaaacgttcattatgttataaattgagtggtggtgtcaaaaataaacaacttattattagttctgtatcaaataaaggatttattgattgtgaaaatataatttatgaatataatttgggttataatacattagcgaaacataagttacatgaattaccaagtcatgccaatatagaaagtggtgctataaaagatgaagaacaattagtgaaaaacctctatgatgaattgaagaaatctatatggaaacgacaagattctattcatcctttaatagaagacaacaatcaagaaagtaaattagccgttttatttagtggtggattagattgtactataattgccaacataatatgtcaattattcatggaacagaataccaccactaaaacaccaattgatttattgacagtcggatttgataatcctcgtactaatcaaaaaagtaatgaaagtcctgataggaaattagccattaaatcatggtttcatttaaataaacaattcccattattgaatttacaattgattgaaattaatgttgattataaatcttggttattacataaaagtcgagtgaaaaaattgatgtatccatataatacagaaatggatctttctatagcaattgcattttattttgcttctagttgtttaaaaagtattacttcgaaaactatattaagggataaacaaattgattgggatacattcattcaatcaccaaataaatatattaccaagattgaaaattatgaatctaaagcaaaagtgttattcagtggattaggagccgatgaattatttgctggatattctcgtcatgaagccattttcaacaagaaagaaaatatcactaacgataatactaatctactttatgaagaattacaagaatcattaaattatgatatatcaattattcatcaacgtaatttaagtagagatgatcgagtcattagttgttggggtaaagaattacgttatccatatttagatgaaaatttcattgattgggttattcaaaatattccaccacaattaaaattcaaatacaagtatgaatattctactactactactactactactcctcctactactactactcctacggtttctaccaaaaagtctaataaaaataaattaactttcatatcaacaaggaaatatattttaagacaattagctaattgtcttcaccagcacgggctggaaggacatcgctca

SEQ ID NO: 4280 - DNA, 1323 bp, Candida albicans
aaaatgcacaaggtaacaaaatttgcaattcgccatttgtcagataaagcaagtcgatttgttccaaaagccggtgtttatccaaaaggttatgctgtgggtggaattcattgtggggtcaaaaaagatgggaaatcgttagacttggccattttgcaaaatacatttggaaagaacgcatctgctgctggagtgtttacagtcaataaattcaaggcagctccagtacaagtttcaaagaaaatattaaaagaaaaactgggttcgggtattaactcatttgttattaatagtggaaatgcaaatgcagttactggtgctcaaggtatgaaagatgccgaagacatggttcttgtgactgattccgttttagagaatcctacaaattctagtttggtcatgtccacgggtgtcattgggaacaatttgccaatcgataaaatcttaggtggcattccgaaattggcatctcagcatctaggtaacacccatcaacattggattgactgtgcaacagcaatttgcacaaccgatactttcccaaaattagtaactaaacgcttttctattggtgatgacacttatacattagctggtttgtgtaaaggggctggtatgatctgtccaaatatggccacattgttgggattctttgttactgatgcgccagtaaccccttcagctttgcagcagattttaaagtatgcagttgatagatcattcaacagcataactgtagatggtgacatgtctaccaatgatactatagtggcaatggctaatggtgctgctggcggtgaggtgattgataacacttcttcttgtgcagaaagatattctcgtttacaagccgaaattgttgattttgctcaacagttggctcaattggttgtcagagatggtgaaggtgccaccaagtttattactatcagagttaaagatgcattatcatacaaagacgccaagtccattgcatcaagtattgcaaactcatccctttttaaaactgccatgtatggtaaagatgcaaactggggacgtatattatgtgccattggttacgcagatgtcacctctgccaattctgtgattccagaaaaaactagtgtcaagtttgttcctgttgacggaagtgagcatttgaatttattggttaatggggagcccgaacaagttgacgaggaaagagcatctgaaatattgcaaaatgaagatttgattgttgaaatcaacttaggaacaaacggtggccaaagtgctgacttttggacatgtgatttgtcccacgaatacgttactattaatggtgactacagatcttag

SEQ ID NO: 4281 - DNA, 561 bp, Candida albicans
attttatacaaaatggttttaagtaaacacattgatgctttaagattggaatcacaaattttgaaaaaaactccgcaagctcaattgcgtaaagaagcattcatcgatgcctatgattctcacaagaacattcctcaatttgaaatccctcaaaactcctcaaatgaacaattgatttataaatatctttctcaagaattggcccttgatggaatcccaactttgaatttggcatcctttgtcaacacttacgttgatgatacatctgcaagattgattcaggacaacttgaccaaaaacttggcagacaatgatgaatacccaagtttaattgatattcaaaccagatgtatttcaatattaagtaatttatggcacgctcctggtaaagttgataaggtcactggtaacagagtaactaattctattggtaccgcaaccaccggttcttctgaggcaattatgttagctgggttagctttgaagaaaagatggcaattgaaaagaaaagctgaaggcaaatctactgacaatcccaacattttcatggccacatgtgct

SEQ ID NO: 4282 - DNA, 1170 bp, Candida albicans
ccccccccttcttacgcggatgccgtccctcatggtgaagattttgatgttgaaaatagattgattcctgtcactgaagaatcgggtcatttgattgatgtttccaagattaaggaaaatattgatgaaaacaccattggtatttttgttatcatgggatcaactttcactggtgcctttgaaccagttgaggaaatctccaaattgttggatgaagttgaaaaagaacgtggattggatattagaattcatgttgatggtgcatcaggtgggtttgtagctccatttattttcccacatttgaaatgggattttgctgttcctagagttgattcaattaatacttctggtcacaagtttgggttgacatctgttggtttaggttgggtgatttggaaagatgctgatttgttgcctaaggaattgcgtttcagtttggattatcttggtggtgttgaagaaacatttggtttgaatttttccagaccaggtttccctgttattacccaatattacaactttttatctttaggaagacaaggatatgccaagatttttgatgggtgtatgaccaatgctagattgttgtcaagatttttagaagaaagcaagtactttgatgttgtttctgttatccaccacaaattgagtgattcggaaaagaaagctcaattcactagagaagttgacgataaaaaattggattctaaactttatactatcaatgaagaattcaagcctggtttgcctgttgttgccttcagattttccaaagaggttagagacaagtatcctgaattgccccaagaattgttgtcaacattattgagaaagaggggttacattattccaaactatcatttgcccccatctgagaatgataaggagattttgagagttgttgttcgtaattcattgtcgttgaatttgttggagagattgattcaagacattactgacgctacagaacttttgatcaaagctgctgattccattgctgattatgtttcaacaagtggtgaacatactgatgttgaaaatagagaaagaatccacaaattattggcagctattgcttctggtggtgttgctgaagtgaaagaagaaaaacacaaaaaggataatcaccaaggcagcaaaaataaaaagtcctatcgtggtacttgttag

SEQ ID NO: 4283 - DNA, 540 bp, Candida albicans
gagccattaccaacagaagaagagaagtcagctaatccagtagttaaattagtggcccacaattacaaagatgttttggaacaaaccgataaagatgttttcgtcaaatactatgctccttggtgtggtcattgtaagaaattggctccaacttgggaagaattggctgaaatctttggttctaataaagatgatgctaaagttgttgttgctgatattgaccatactaataatgatgttgatgttccatataacattgaaggttacccaactttattgatgttcccagctaatggtaaagtcgatgaaaaaaccggaattagagaaccaattgttttcgaaggtccaagagaattagatactttgatcgaatttattaaagaaaaaggggcattgaatgttgatggtgctgaattgaaagctaaattggatgaacaaaaagctactaaagaagatgaagaagtggaagaagaaaaggaagaagaagaagaagaagctccagttgaagacaaagaaaatgttgaacacgatgaattgtag

SEQ ID NO: 4284 - DNA, 765 bp, Candida albicans
tcaatcccattgattcttcaacattcaaatatgaaattttggacttactcaactaaagtgttagctactttattagctgttgtctctattactcacgccagtggtccaaccgatggtgacgccgttgccgatccaaacagtgctgtcgttaaattgacttcagaaaactttgcctccttcattgaagaaaatccattgattttggccgaattctttgccccatggtgtggttactgtaaaatgttgggaccagaatattctaaagctgctgattccttgaatgaatcccatccaaagattaaattggcccaaattgactgtactgaagatgaagccttgtgtatggaacatggaatcagaggttacccaactttgaaaatcattagagatggtgatagcaaaactgctgaagactatcaaggtccaagagaagctgctggtattgccgattacatgattaaacagtctttaccagctgttcaattccctgaaacttttgaagaattggatactttaatcgattctcaaactaaaccatttgttttacaaatcaatcctactgaagatggtaacgcaactttcaataaagttgttaatcaaaagagaaaagattacgtctttattaatgttgaagataaacaaattatcaaagatttaaataaaaaattcaagaatgttgacatcaccggtaagaaaccaagctatttggtggtccaaccaaaacaattgttttcaccacgggctggaaaatccgcgattcccgct

SEQ ID NO: 4285 - DNA, 678 bp, Candida albicans
aaaaaacatattatgaaactatctatcttatcattgcttggattcttgacaacagcagcagtaggggtagtgggctctgagataaacccacttgaacctcaaataattgcagatcaagtgacaaatggggaacacaaacgtcaatctgatgatgaatcaaactctcaacttaaatcccaatcaaagatggatgtccctcctacattatcaatgaaagaatttgacaaactcactcgagaaaaacttgtacttgttgaatttttttcgccatattgccatcattgtaaagaatttgcaccaacatggaaggaaacctatataaaatttgtcactgaataccctgatttgaatattgaaatgaaacaggtcaattgtattgaaagtggtgatttatgtgagcgtgagcatatagatttttatcctaacatattgttgtatgcccctgccgttgataaagatggcaagaaaactgggaaactgaaaaacattgattcatttccaagaaatctcgatagaaatgttgagaatatcatcaaatatttacgagaagccacggccgaattcgattcaggtgcaattaatttacccagttcttcacagttgttagatgttgacactatgtctaagctcattttcttcactacgcagtgccggatccacgcttatgttacccacaaa

SEQ ID NO: 4286 - DNA, 1305 bp, Candida albicans
cacgcttcatcgacgattgtggctcctgccgggacggttgaagacaaagtattccaaaattctcaatttgaagttgtttctgctcgtggtattaccgaagtcatggaatacaccagagtattgtcccatgaacctattgcccaattttatcctttgaaaagtaaaataaccgtagtgttttattatgatattgataaagtcactgaagaagatgaaaaaatattaccccatttactcaaaacaatccaagagtctccgtttaatatccaattacacaagggaaaacataaaaaaattgaagaaaatgtattgactatgggtcaaaatttaattgaatatataaattatgatgaaaacgataaatatgaatttgataaatcgatacaagtcttgactacattaacaacaaaaccaacaatacttgttttcaaagataactcattaattgccgacgtttatcaaagtctatctcccgaagatatgaaaacctatgacaaagtagagagttttatcaatagtattcagtatcctttgtatggccaattaaccccacaattggctccttattatttcaaaaacaatgaaaagtatcaagaccataaagttgtggtattgtttactgatttactggacttgaagggaacagataatcaattgtacaaattatcgttagcagcacacgaataccaccatttaaagcaaaaatattatttcgatagatttaaacaaagtaatcaagtgagtgctgccaccgtggaaaaattacaagagcaaaatcaagaaattattgatgcattaaaagagctacaacatgtaataccagaattgtgggagaatgatcaattcttatttacatttattgatttgcctaatgcatataaacagtttcgtggggttaaaggatggagacttaatcctaataattatcaagttggcgatgtggtggtcttgtctaaagataaccgctactattggaacaaagatacccaggggaacaaattaacaaatgaaccaaaagaattgaaaaaggttttgatgtcattattagctaaggatgacaaattgaaagcagcaatagtgggtagtccctatggaggtgttctagggtttatggattatgtacatgattatggtgtttggggatacattggctttttcttgtcaatttacactactggttttcttgttcttcgtctaggaagaagaagcagtagaagatggttattcaaaaggccgtcatcatcaacacctagcagtggcggtggtggtattattggtaataattttacgcctaagaaggattaa

SEQ ID NO: 4287 - DNA, 1239 bp, Candida albicans
gtcaaaaaaaatggtggaatagaattaaaatattgccatcaattctttcgtaaattaatttgttgttcaaccccgaagttaacacgttcttttacaattatttcacaactgttaaaaagaaacatgtctgaaaatactccagattcccaattgattgctgaatttgtatctataacaaattcttctacataccttgctgaacagtatttactgagaaacagcaatgatttagtggaagcagttgaggatttctatgccaacaatgaaccatctcaaaaatcagaaaccaaaaaatcttcttcttctaatgctaaaggctctggtgttagaacatttagagacttgaacgatgaagatgatgatgaagaggatgacaagaccaataccaatttctttactggaggagagaaatcaggattgcaagttgaagatcccaataaagataaggataatgacagatcaataattgatcaaattttccaaaaagccagagaacaaatgcaacaaccagatgatagaccaagtgcttctcaaaatgatcaaccatcaccaattaaattttcaggcaaagggttcaaattgggtgacgggaatgaaccaagtcaagtagtggaggatcctaatgccagtgctaaaaaattcagacctagtaaagtgactagagaaattacattttggaaacaaggtttcacagtaggtgatggacctttgcatagatacgatgatccaagaaacgccagtgttttgcaagaattgaaccaaggaagagttccaatgtcaattttagatgttgaatttggccaagatgttgatgtttctgtatacaagaaaaccgacgaagattggacacctccgaaaagaaaaattggtggttatcacggtgcaggtcatagactaggctcaccagtacctggggaagtacttgtaaataatgaagcatcatctcaacctgatatcaaaaccgaaactgaaatttctaaaccaaaagacggaggcgaaggtgactccacagttcaaataagatttgccaatggtaaaagaacatcacacaaattcaattcctcggattctattctcaaggtttatgaatttgttaaaaatcatgaatataattctgaacctactagaccattcactttaagtcatgcattcccagtcaaaccaatagaagaaagtagtgacattacaatttctgatgctaaattgaaaaatgcagtgattgttcaaagatggaaatag

SEQ ID NO: 4288 - DNA, 189 bp, Candida albicans
gtacttctggtttcactaaggaagaacagaagaaaaaagttgaagaattctttgcacaagaaagacaataaaggttatgaccaaagtttggctcaatcattggacatcattactgctaagagtaaatggactgatcgtgacgccaaatcaatctatgaatggcttgaagcaaacgaatacactaaataa

SEQ ID NO: 4289 - DNA, 927 bp, Candida albicans
ctcaacataaacatcaagtgtttacgatcacttgcaaccatatcatttttaaagaatcccaaacttaaattacgagacatagtaatatttctattgttgatatccagtatgacaaggcagtccttattaacacccacaaaaactgattattcagatgcccatggaaattcagaaggtgctcaacaatataaggaaaagtggataaaaatcaagcatcaaagagatgagaatggaaatttaaagtatccttgggattttgaagttgtccatggttttttcgtccagagcgatatgtccacagacgattttgggtttaatcatacttttcaaaacatgggtagaaaaaaatcttgggaagacataaaagccgaattgatacaactaaataatgaagctccagataatgttcagtataagctaatttttttagcacgacacgggcattctacacaaacacagattgttgagttggaagggttgcatttatggcatgaaaagaattgtaaactcactggtaatgatcagtttacctgggcaccagattcggaattaaccgagattggattggaacaggccaaggaaaacagagaattttggaaatcagagctattgttaggagcccccattcctagtaaattccatacttcgccattacaaagagcgtgcagcacattagttataacttggcatgatctaaaaccagtagagacgaagccaatagtgtgtgaaaaattgagagagaaaattgggaaaaacctaagtgacaaacgttctacgagatctgaaattcacgaaaagttcggtgacacttatgggtttataacagaacggtttcaaaaaggaagatttttttttactgaagacaagagaaaacttggcagaaacattctctttcggcttaaccggatatttatcagatttgtttga

SEQ ID NO: 4290 - DNA, 975 bp, Candida albicans
ttttctttcgttttgcttctttcattctttttcaatttttggatttcaatttatcaactactacacctaacaacaatgtcgaaaaatattccaaatcaagctgacgtagttgatgctaaaatttccgatactgatagacaacaatatgaggaactttttttgaaatattatggaggaaataataccaaaccacattgggaattttttattgtccctgggattttcaaacaatcattaccagaaactgatgctactaaatttgatacaattaaagaacattttggggtaatttgcggttgggatgaagtcattgcccaattgaatgaattgaacagtcaagtagactctaatgaaattcaatataaattgctttttttggcaagacatggtcaaggattccataatgttaaacataatgaaaaccctcaactttgggatgattattggtctcatttaaatactgatggtaaaattgtttggggtcctgatcctgaattgactgaattaggaattgaacaagctaaagataacaatattgcttggactaaagaaattgaaaataatatcaataagaataagaatttgatcattccaacaaaattcttcacatcaccatttagaagatcggttgatactttgattaacacttgggataatataattgatttaaaagaaattaaacctttaattcaagaatattggcgtgaaacaattggtgatcacacttgtgataaacgttcaacaagatcaataattgccgaaaagtatgaatcattaggtttcataattgaacctggttttgaagaagaagataattattggaaaccagattggcgtgaatcagtagctgaacaggcaattagacaaaataaaggattacaacaacttttcaatgaaaatcataaggatcaaattgttcgtactactattcatagtggatcaattcttgccgcacggggctggaaattccgcgtc

SEQ ID NO: 4291 - DNA, 996 bp, Candida albicans
tttggaaaaactatggttcaaacaaatttagcgatgttggttcctttcttgattgctactactttggcattcccgcaagtcattcttgcctcttcatcatatgaactcccaaaattcacttcttcgtccaaatattttggtcagtctgatacagatatcgatgtttccaaagtaaatgtcagtgataattttggattgataaacaagtattcttggaaagacgttattgatagtttatctgataatgaaaaattattttatattcaaagacacggtgaaggatggcataatattgctccacaaaacttttctagtgccgattgggattgttattggcaattacaacctggtcgtgatggtgttgtttgggaagatgctgaattgactcctaatggtgtacaacaaattgaaaaattgtctcatcagatccaaaccaccaaaaatttgccttggccagtaaaatattttactagtccattaagaagaactttacaaacttgggaactaacttggaaggatttgaaacatgaaactcctcttatcaaagagttggctagagaaacttatggtattcaaaccgaaagtaaacgtcacaataaaacttacattcacactaattggccaatttttgaatttgaaaaagggttcaccgaagacgatgaactatggaaacctaataaacgtgaaactggtcaacatcgtaagtatagggcagcagctttattaacaggaatctttgaccaaacttcaaccgatgataaagtgattagtttggtttctcattcggggttgattgggtctattttggaagttgttggtcatcgtgattatcctattgccactggtagtttaatcccagtgattattcataaaaagaaaaagaagactataacttatgatttggataaaccagataaaacttatgctgatatttgtcctagtccaccagccctgatttcaggtgcccctagtcactacagtactattgctgaataa

SEQ ID NO: 4292 - DNA, 1038 bp, Candida albicans
tttactataagtagaggtgaatttcaccttaacaaaaagccaatcttatttgtagcttatagacccggcaagaactataacatcacaaatatgcaacagtttttaactttgggtgcactttggactttgttcaatgtcgctaccacaatttcgcttccaaaatactcctcttcacaaacttattttgctcaatctgatcctaacattcctgtttctcaagtagatgacacgaacaatttcggtttgaaaagtcaatattcttgggatgacgttgttagcaatttagcatcaaatgaaaaattgttcttcttgcaaagacatggtcaaggatggcataatgtggcaccaagcaatttttctcgtgttgactggaactgttattgggccgagcaatcaggccgtgatggagttgtgtgggaagacgctgagttaactcctaaaggtgttcaacaaattcaaaaccttcatcaaagaattaaagatactccggattttcctcaaccagagaaattttttgttagtccattaagaagaactttacaaacctggaatattacttggaatggattgccccataaaactcctttgattaaagagtttgcacgtgaaatttatggaattgattctgaaagtaaacgtcataataaaacttttattcataactatgttcctagttttgaatttgaatccggtttcactgaacaagatgagaattggtcaccagataaatcagaaagtgatcaacattgtgactaccgtgctgccgttttattacaagatatttttaatgattcacctgatgaaaaagttattagtgttgtgttacactcaggtatcatctattgtttgttagatgttgtcggtcatcggtactttcccatggctactggtggtgctattccggtagtaattgcaattgaaaactacaacactgattatccgttgaatgatgcttgggatactttcaaagattggtgtcccaacccaccagctctgatttctggaactgccacatctactgctacagggtcagcttag

SEQ ID NO: 4293 - DNA, 945 bp, Candida albicans
aaaacattatttaacaaaaaaatgtcattacttatcccaacaccaagagatcgtcacgatgcacatggcgatttggaagaagacaacgcctactataatttgctaatcaaggagcaaaactcaacgaacaataggtacatttggaagttcaaaccagtaaaaggatttttcaagcaaactgacgaacaaacggatgatatggcatttagatacactgaacaaaaacttgggaggctagatgattgggaaaaaatagtggctgaccttcaacagttgaatcgtgactctccagataatgagatttataaattgattttcttagctcgacacgggcaagcgaagagtaatgtggcatctcagaaatattcaaaggaggaatggatgcgtaaatggagatttttgggaactgatggtgaattaacttggggaccagatgctgatttgactgagttgggacttaaacaagcagcagaaaaccatcaatgctggaaacaacaactacttgaaggtgctccttatcctaaacgtttctatgtttccccgttacagagactgatcaaaacccacaatattacttggccaaacactaagccaattgtacttgaaaacttacgtgagactattggtttacacttgtgtcataaaaggtcaaacaagtcatccttaaaagagaaattccccaaccttgtgtttgaagatgggttcactgaagaagatttattgtttgataagtatctcccaagaaaagagcatttacatgagcagttcttgcgaataaatggagttttgcaagatatttttaatagtgatgaggaggatatcttatgtataacatcacatgcgggtactattagagcattcattactgtgttaggtcatcgaaagttcaccataccaacaggaggaatgataccggtagtaatcaaggcaactagaactagctaa

SEQ ID NO: 4294 - DNA, 3726 bp, Candida albicans
atttcatcaattacaccaatgaatcaacatcaggatcaatcatcaatgcctaatggcaaacaacagcatgaggtgacggaactgtcatctccaccggaaatacctcatataaccgccaatatgattccattatcaaatataattaaatactatacacaagaagcatacaaacaattaactaccgccattgagaatttatcaatgaatgtgaatgaagaatcagatatcaaacgtaaaaagtatttcttgaatgttattattaatttacgacaagatttcattaaagtttacacattgattaaatgggcaagtatatctaaagatgtttccaaatttattgatttattaaattggttcagaatccaagaatttcattttgaaaatttaatttttcaattaaatgctttaactgggtataatgcagcaaaattacccaatagtgatatcataacggcattagaagtgttatatcacggcagaccaaaattgccatcttacaactatatcaaatcggataatttgagtccacagaaaattttagaaacgttaaatgatttgaatttggtattaatgacaagatttgctcttatggataatatacctaaacgatttgattacgaaattaaagatggacgtgcgtatattcgagttagcaatgaatttgaagtaagtatcaccgttggtaatgatttgattattgacaatcccgaagaatattataaatcgccgttttatttcattgattttaagtttttatttggcgctaatccagaatctgggttaatcacttttaatgatgataaaatttcaactaaattaccaacgagtctgcataagaaattggaaaaactagtgaatcaaacattattgacgcgtggattacaaggattatacgaattattacataaatattccaattcatttaaaatttatcttcttgccaaacaatttcaaactttattaattaattctcgatggagaggtaatttccaaattaattatcaaactaataaatcattgatagtcataaattattggtctcaacattacttatcgagaaattggaaatcatttattgaattaggtattgattctcattctaatttgaattatcgttggtttaaaaatggtcagtattgttttggtgatcaaggaaataatgaattggataaaattttccatcttcaaagaagaaatagcaacaatggtgtgacaacatcttcgaacaccatttcgactagcgccatgattgccggaattagaagatcaacagaattatccaatgaaacagctatagtggatgacaatgacaatgataataatgatactaacaataccggtgaaactgaaaatgaggatttaaatgttgatttgattttgaatgttgttgttaaccaacatgccaaatccataatgtcagaaatttattcacaattattgactcgattttccgaaactgatgtatcgatggtcagtcctcatcaattgttattgcaaatatctcctaagaaatctacagtttttgcaataaaccctttaactggatttttctattttattgatccaactccaattcaaacgtatatcactaagaagatcaattcaccaccaccaccaacactatcacaagttagcattaaacaatcatttataccggagagtgatatgattagctatgtgattgatcaaattattcaattgagattagaagttttcaataaggaagtcaatactaaattggctacgactgcatggatcaataatggtattatcaaattgagcgaccatgaattgagtaaattaactcaatttttaatccaaaacgaagaacaggaaggtgatgataatgaagaagatagtagtactaatacaagacttgactcagtactccagagtttcaaagtccaattttatcgtcgtaaaaactggccaagttcatggtttttaattaatatgattagtggggttaccactaaaagtttttggtgggtagcaagaattaaatcaattagtggagattggaagattcaatgggcacaaattattaagtttcatggagataatgccaagcaagaattgtcgccaaatgaaagcaaagtatttgacaaaccaaaaagaactgttgattgtagtattgaatctgaacaattgaattatgaatttttcaaaatattatccacattatcatcgaatttgattcttgaccacatgatattagaagagttacaagtgagaagtatcaaatttattaaacttgattgggaaactattgatgacaataagatattcctgaaattcaaacaaaaccatgatatatcgttgaaaaggaaaaattcccacaatatcaatattgatgttaatgttgatgttgcggataatactagtaccaccactaatactaaatatattcgagcacccaaattgaaatatgaatcaatgtttttgatttacaatgataaattgttaccaatttataattcagcgacgattttatttttaaaaattgaacttgttgaatcgaataagatgtatttaaaattatttggtaatttacgaaatttacagatcaaaaacacatcggaagatatacagaaattgcatttaaacattgatgaagctaatcaatattttgagattgataatacagttgatttatcgactgttattaatgaacccaaaacattattattgaatttgattttcaatacattgaataaattgaattccttaattaaaatattggatcaattgaacaagagcaatgttacagttttagataattctatggataacattactattaatattaaggacaaatataatgataataatgataaattaattattattaaattaccagaacaagctactgattcaattcaattgttgatgaagaatggctctactactactactgatgaaattgatttgagaaacaacaatattttggaatttgaattgattttgaaatttttgaatcaatatttacgagagagtaaactgaataatcataatcgtcaacaaatcagcatcatcaaaataatccaatatttgacagaaattaatccaattttacaatcaacaaaggctattaatcaacaattagcagaacttaaacggataaacagtaccaacaacaacaataatgctaaaagaaggagtattcttaaattatcaaatggattatataaattatatttcaatttaaacattattagtttgactcatttacaattggtttttttcatgaattcaaatactggatcaaatttgaaaaagattcaaagagataaaattatgatcaatttgagtttgattaaatttgatagattttctaaaccaaatggaaattttcaagatagtactaatggtcatttaattaaaatatcatttaaagatagtttgataaatgaaaatttaaaatttaaaaatttatttgaaattatctttaaaaatattaatgaattgttaatcaccaaatcaaaacaaattaaatcattaaaccaaactgagaatcaacaacaacaacaaccactaaagcaagaggataatagtgacagtgccataattaaaaaagaatcgcaatcaattgaagatgatttacttgattttggtgaatatgataatgatattaagcctcaacaacaagaaccacaacaaatgaaaaagaaaattcaaagactacatcaaaagaaaatgaaacagttagacctgatgatatattga

SEQ ID NO: 4295 - DNA, 1989 bp, Candida albicans
ttcattatggctgacgcaaaagttgaaactcacgaattcactgctgagatctctcagttgatgtctttgatcattaacacagtgtattcaaacaaggaaattttcttaagagaattgatctccaatgcttctgatgctttggacaaaatcagataccaagccttgtctgatccatcccaattggaatccgaaccagaattgttcattagaatcatccctcaaaaggaccaaaaagttttggaaattagagattctggtattggtatgaccaaagctgacttggtcaacaatttgggtactattgctaaatctggtaccaaatcctttatggaagctttaagtgctggtgctgacgtttctatgattggtcaatttggtgttggtttctactccttgttcttggttgctgatcacgtccaagttatctccaaacacaatgacgacgaacaatacgtttgggaatctaacgctggtggtaagttcactgttactttggatgaaactaacgaaagattgggtcgtggtaccatgttgagattgttcttgaaggaagatcaattggaatacttggaagaaaaaagaatcaaagaagttgtcaagaaacactctgaattcgttgcttatccaatccaattagttgtcaccaaagaagttgaaaaagaagttccagaaaccgaagaagaagacaaagctgctgaagaagacgacaagaaaccaaaattggaagaagtcaaggatgaagaagacgaaaagaaagaaaagaagaccaagactgtcaaagaagaggttactgaaactgaagagttgaacaagaccaaaccattatggaccagaaacccatctgatatcactcaagatgaatacaatgcattctacaagtctatttccaacgactgggaagacccattggctgtcaaacacttttctgttgaaggtcaattagaattcagagctatcttgtttgttccaaagagagctccatttgatgcctttgaatccaagaagaagaagaacaacatcaaattatacgtccgtagagtgtttatcactgatgatgctgaagagttgattccagaatggttaagtttcatcaagggggttgtcgattccgaagacttgccattgaacttgtccagagaaatgttgcaacaaaacaagattttgaaagttatcagaaagaacattgtcaaaaagatgattgaaactttcaatgaaatctctgaagaccaagagcaattcaaccaattctacactgctttctccaagaacatcaaattgggtattcatgaagatgctcaaaacagacaatctttggctaaattgttgagattctactctaccaaatcttctgaagaaatgacttccttgtctgactacgttactagaatgccagaacaccaaaagaatatctactacatcactggtgaatccatcaaagccgttgaaaaatcaccattcttggatgccttgaaagctaagaactttgaagtcttgttcatggtggatccaatcgatgaatatgccatgactcaattgaaggaatttgaagacaagaaattggttgatattaccaaagactttgaattggaagaaagtgacgaagaaaaagctgctagagtaaaggaaatcaaagaatacgaaccattgaccaaagctttgaaagatattcttggtgatcaagttgaaaaagttgttgtttcctacaaacttgttgatgctccagctgccattagaactggtcaatttggttggtctgccaatatggaaagaatcatgaaggctcaagctttgagagacaccaccatgtcttcttacatgtcctctaagaagacctttgaaatttctccatcttccccaattatcaaggaattgaagaagaaagttgaaaccgatggagctgaagacaagaccgttaaggacttgaccactttgttgtttgatactgcattgttgacttcttttttacaccacgggggctggaaggatccg

SEQ ID NO: 4296 - DNA, 999 bp, Candida albicans
ctaattattttttactatagatttcagcaacttgaaaaattgggtgaaggtacttatgccaccgtgtacaagggaagaaatagggccacaggtgctttggtggcattaaaagaaattagtctagattcagaagaaggtacaccatctactgctattagagaaatttcattaatgaaagaattggaccatgagaatattgtaactttgtatgatgtgatccacactgagaataagttgacattagtatttgaatatatggataaagatttgaagaaatatatggaagttcatggacaacaaagtgcattagacttgaaagttgtcaagtcttttatgtttcaattgttgaaaggaataatgttctgtcatgacaatcgagttttacatcgtgatttgaaaccacagaatttgttgattaacaacaaaggagaattgaaattgggcgattttgggttagctcgtgcttttggtattccgtttaacactttttcgaatgaggttgttactttgtggtatagagctccggacgtcttgttaggatccagagcttatacgacatctattgatatttggtctgctggatgtatctttgcagagatgtgcactggaaaacctttattccctggtactgctaatgaagatcagttgatcaaaattttcaggttgatgggtactccaaatgaaagaacttggccaggaataagtcagtacactaattacaaaaacaattggcaaatatttgttccacaggatttacgattaattgtccctaatcttgactctatgggtttgaatttattgcaaagcttattgcaaatgagaccagagtctagaataactgctagacaggcattgcaacatccttggtttcatgagataacaatgccaaatgcagtaccacaacatttaagtgacccttaccagcaacaacaacaacaacaacaacaacaacaactacaacaacatccacatcagcccataattgatcagcaatactag

SEQ ID NO: 4297 - DNA, 528 bp, Candida albicans
  unsure (13),(30): Identity of nucleotide sequences at the above locations are unknown.
aatgaatggatcngggtcgtcgttatgaanactattttggactgtcaaccaattgttgagatttacaataagattgaagatgttgttggtcctggagttgatgatgagaaaaagaaggatattgctgttgttaagaaagatgaacaggagaaaggacaaactacggaaaatcaacaagaactgtcacaacagcaactgcaacaacaagtacaacaacagctgcaacagctgcaacaacaagtacaacaacagctgcaacaacaattggatattcctgaaaagcaatcattattaaaatcattgacgaatttctgggctgatagagctgctacattgtgggaccctttgaattatccattggagagtcatgaacatacatttgcagattctgaagttattgttcgagaagatgaaccaagttcattagtggcattttgtctttcttcaaatgattacaaacaaaaaattaagaatgcatttgaaaagaataaaatgggtgatagtggaattttaaacctgaatttacac

SEQ ID NO: 4298 - DNA, 999 bp, Candida albicans
  unsure (976),(984): Identity of nucleotide sequences at the above locations are unknown.
caccaaaaagattcttttagttctaatgatgataaaccaagcaccaaatcacatcccagtagtgaatcaattttcaaacatattacaaaggaacaacaacaaaatcaaaatcaagcagatcaaggtgaagaaggtgatgaacaacatgaacatgattatataccggcaaattttgatttgaatcaaccattaagaagatatgcggtaccattacaattaaaagaatctcccgaggaacaattgttacataaatttgccgaaaataataaaatttacgaacgactgatgaactcacaacctgaatcagtatctgcctcagtatcaatatcaggtacaagtacagaatcagaaccggattcgggatcaaatatcgagtcaccaccacaaccaccacaaccacgacaattgagattgaaaaatcccactaattgttccaaatcaaaagaaactaattataataaacatttgaaaccattatatcaattgaaaaaaccacttttaactccagcagtattacgaccagcttatactaatgatcatgagaatttatctcctccaacaatcataccaccaccaacatcatcatataccattataatacccaattcagattatttccatagtaatggcgggggaggtctacccaattgtactaatgaaccggttcatgatcattggaaagataatggattaactagtaattgcatgtggtgtgttaagccatttcataatcctattgtttctatgatttgtgatggacctagaagacatcattgtcgattttgtggattgatattttgtgctgattgtttagttaataaaaccattttaattgatcatgaggcacgatttgtcattccaatactactgctgacaaatagtaatgagaccgaaaccaagaccaacaaattacaacaatttttttcaaattctaaagtgtgtaagaaatgtgggatgatatatgataatcttattngaagaacnttaaaccacaacaaa

SEQ ID NO: 4299 - DNA, 1362 bp, Candida albicans
gttctacgaattattcaggcacaacaatcagtatatatcacacacttggtgtcacgtttgttctctatggaaccagacattattgttgttggagattccgtttctggtttagcagaaaaattgtttgaagatgccggtatcactgtgatttcaaatgtcaaacctcaagttattgagagaatttcaaggtacactaaagcagatattttccaatcggtcaatgatttattctttaaaaagggtaagttgggtttatgtgaaaattttgcggtcaagagatataaataccaaaatcaaattaaaacgtttgtgttcttcactggttgtgatatccatctgggattcaccatatcaatacgtggtggaaataccaatttattgaataatgtgaagtatgcagccgaaacgttaatgccaggttatataaatgctagatttgaaaagagttttttggataatttgctgttgttttatgtgaagccgacggagaatcccaaaattgttgatattcaacaaaaattgcaggagatccgtgataatacaattgagggtgatgaaaatgggaaattgcatgacttgaaattagacccagcagaggtagtcaattatgttaaactgttcagtgaaagaaaacttagtttatcacctcctgtagagtattcattacccaatcccttggcaagaacaatttatacgtattatgcagtgcaccagtttgcccaacaaaatgctaaaatacaaaagttgtcatcagttgacgatatcaaagaagaatggctaacggaattaaagattgattataaattggaagaattacctggtaaggaagctaatttaataaatatccttaaatttgctagtgaggcccatttgaaattgttgattaatgaatatcaggctcgtgttagaatatggtcaaattgtatgaaatacccatcatatcaattgtatccaatatgtcatcgaaatattcatttattgcattcgaccgtttccattaaacatgcaacgccttgttctggaccagcaattattgttattgattattatacagacaatgataaatgttttgggttgtttcttgatcaagcattccatgaaagtctgaaagtttgtggtgaatgtggtgaaacgtacttggatcattataagagttatgttcatggtaaagccaaagtggatttaatcattgaaaaatatgatattcagtgtcttaacaatggtgaaatgcaaggtaaaaaccaaagagtcatgtggagttattgtaaggaatgtaattatgaaacaccaattattgccatgagtgatgaaacgtattatttatcgattggtaaattttgtgagttgaatttctatggtgaa

SEQ ID NO: 4300 - DNA, 2544 bp, Candida albicans
  unsure (2531): Identity of nucleotide sequences at the above locations are unknown.
cttggttttgttattatgattgggtcgccaccagatactcctaacgacatgagcaattcaaaacgcaagttaccactactagaaagaataccttctcacaccaacaatagtgatgacgaagacctgtacgataagggtgtcgtcgattatgtatcctttcctactattccagacccagaagttgagaacactaaatcgattacaggactattaactaaaacattgagaaaggtcacaacaaatgcatcaactcttgttcaaaactattcccagaattatacatcaccaaaacccaatgtgttagatacgtcaccatttaccaatcgtgttagtgaactaaaggcaactgccattggaagtgatgcatcgcctgttcctaaaaatgatgaaattgtagacacaccaatatccatggatttatctacaaaaactgacacgcggttacgggttaaggaagatactagcaaacgaatcacaagaagttcaagcccattagatttaaagggagatgcacagggaaacaaattagaaataatgaatccaattatcaaaagtgaaacaaatagaacaccaattgataaagtgtctattgtgacgaatgagacatcaacaggggcgacatttaagccacaacagtccaagcagcccccttccactagtacacccgctctttctttgcgacagaacttaattgatgaagtacatacaccaagagtcacgtcagacaacaagaccctacgaatatctaccatgcaattcccccgtatgcaatcgatggcgaatagcaccaccagctcggtggttaacgtcactgcactggcatcagttgatattgacaatgttactaatgacaagagtaatgtggagagtaaacccacacataaaaaggaatccagtatagatttgaagtctaaagataaagggttgcaaaacaagatttcgtcaatattcaacaatttgcccaatgatattgaattgtcagacgattctgcagatgaactggatagcactcataatgaaggttcagaaaactcagcaactccccaatcggatattgcttacatagagaatcggtcggattcaaacttgagttctatttctaaaatgaacaatcatctacaatttgaattaagtgcaagatacggtgactctgttgctaagtcggctcctatcaaggctgaaagcaaacacagcgctacttttactcctagttttggacaatctccgacagtatcgacatttcatgctatacaaaacaaagatgtttcggcgaataaacaaaaatcattgaataccccatcgacacttttggacaatgcaagaagtattatccatcaaaatattgaagccgtcgcatcatcagcatcatctattatagcttctaaacggagaaaaaagaagaagccaacaaaaacctcagaaaatcctttgaaaaatggtgggatcccaaagaaatattggatgaatgatgcatttgtatctgactgtttgaattgttttagaccatttactgcattcagaaggaaacaccattgtcgtttttgtggacaaatattttgttcagattgcacattgtttatttcatataaccaacatagagatgaaaggaataacaccaagaattctgccaaaaaaccgtataacgataaactccgagtttgcaagccatgttatagtgatgtgattatatatttaagtgatgactcgtcaagtgcaaatgattctgatggggaaaaagttatttcagctgaggaaatagaagtgccaaagaccaaggcggaagatttacttgtaccaaaccatcctttgtcaagaattcgatcaatgtcaatgggatctaatcgagacagttccagaaccgactctctatctcgaaagccactgttgaaagataataacaatttagaaaacagtttatcaactagtcattctagctcaccttcgaggagtaataataatcagtttatatatccagatgaatcaattaaagtgcatccaaggcaagctccacgtatggctattcctacaactcgtacaggagaagcagttgagattccgcttatgagacattccttgatgaattcaagcattttaaagacatcaggtgcaccatatagttctaatatgaactcattgccacaaacgtttcaccaatcgaatagtcaattttaccataatcatcatctgctgccggagcatccgcaatatggacagagacaaaatctggtacagcaacatcagccacagggcggacactttcataatcattatcacaatacttatagcaatctgcattcacagtacaataattcagctggtatttctgaatcaggaaatacaaacaagaccaggataaaaagccatttatcgcctacattatcgaatgctaatttaactagtcgtagtttggataatctcgggtctattaataacagttttatgactagaaccccgtcgtttaatatgagagttttatcagggtctagcagggatccttcacggtccagaagagttttctaccggccagcggnaatccacatactt

SEQ ID NO: 4301 - DNA, 966 bp, Candida albicans
ggtatcaatggaggaggaggaggaactaataatagtgtgaacaataataacaatgatgacaatatcaatccattggaatcgattttgacgagaaataaatctaatcatttgaaatatcaatttattgatgggaatacaaatttatcatgcaaaatcttctatagtgaacaatttgaagctttgagaaaagcatgtggtaatgatgataatttcattcaaagtcttagtcgatgtgttaaatggcaatctagtggaggtaaaagtggatcgagttttttgaaaacgttagataatcgatatattttaaaagaattatcgaaactggaattagaatcatttgtttcaattgctccgttttatttcaaatatattagtcaatcaatgtttaatactttaactacagccattgctaaaatatttggattttatcaagtacaaattaaaaacactactacggggaaaatattccgaatggatttcttaattatggagaatttattttataatcataaaaccacaagaattttcgatcttaaaggatcaatgaggaatcgtcatgttcaacaaacggggaaagaaaatgaggttttattggatgaaaatatgattgaatatatttatgaatcaccagtgtttgttggacaacaactgaagaaattattacgaggatgtttatttaatgatactagtttcttatctgccatggatgttatggattatagtttagtcattggtattgatgattcatcgaaaaaattgtatttggggattattgattggttaagaacatttacttgggataaaaaagtggaaaattgggtcaaaggtaataatttgattggtgggaataaacgaggtaaagatccaaccattgttacaccaaagcaatatcgtataagatttagagaagctatggaaagatatattttagaagctcctgatatttggtatgaagggtcaaaatag

SEQ ID NO: 4302 - DNA, 675 bp, Candida albicans
  unsure (19): Identity of nucleotide sequences at the above locations are unknown.
acgcggatcttcttgcccngtgggtcaagactgaaacgtaaatcaaaagttaaagctcaacctatttttgatagtaaaccaattgttgagatttacaataagattgaagatgttgttggtcctggagttgatgatgagaaaaagaaggatattgctgttgttaagaaagatgaacaggagaaaggacaaactaaggaaaatcaacaagaactgtcacaacagcaactgcaacaacaagtacaacaacagctgcaacaacaattggatattcctgaaaagcaatcattattaaaatcattgacgaatttctgggctgatagagctgctacattgtgggaccctttgaattatccattggagagtcatgaacatacatttgcagattctgaagttattgttcgagaagatgaaccaagttcattagtggcattttgtctttcttcaaatgattacaaacaaaaaattaagaatgcatttgaaaagaatagaatgggtgatagtggaattttaaacctgaatttacaagagaataagccccataatgataaaccaggtgttgaactggaagtgggtaatagtggtattactactgagagtgccagtattgtaactagtgttggggatactaaacttgaagagtcatcaataaacaacagtagtaatgcgaaagcgggt

SEQ ID NO: 4303 - DNA, 1887 bp, Candida albicans
gaaaaagttgccaacaagaatgttcaagtgacgattaattcgaacctggcagtttttgctaaagacaatttggatttttcaagagctcatatggatattatcaacaatttaactggattggctttacgtaaattggaatttttggacagaggagaaacttatattgtttactcaacttatgatcgtttgaaattgggttatttggccaagagccataacttacaaattttgagttgtggtatgtttactgataatttggatttgaaaacatcaagaaaattatttaaatcaagtattgaaataagagatgttatgttggatccagatttagggttgactgtttttgaatttggttctttattggtttataaggatgaatctattggtccatcattgaccagagcattcacttcagttattgccaatcctaaattagacccacattattgtttgaaagcttccaaagccgttggattaggtacgaaaaaattgcctcaagacaccgtggtaacaacgatttattcattaacaaatcttttatttgttactaatgaagggttattattaccttctaaaagtaccaaaagatttaataccggtttgagtggaggtgataatttatcaggaagagaagcatttgcatcacctatgtcatctagaagaacttcattcacttctttctctcaagcttttagtaaaggtgctaattctagtgaatttgatgaaaatgattaccgtaaagtttgtgaaaatgccgtcacgggtattattgaagtttgtgaaaaatgtaatgatgaaagtgttccagcattgacttgtactattttatcacaaaaggtcagcaaaatcgattcaccaattggaccattgattttgaaagggttaagttcatgtgccccatttttacctgaacgtgaatttgttattttgattagattattaaacaagatatcatttgatgcattagagaagaaaaatatggtgttgatgggctatttaacagaaagtaaagtgttacttgctgaaaaattaaaggtatcaaacccgttatttacggtttatcttcatgaattattacaagcaatcaacagtaaaggtgatgttcaacaattggaacatcatagatcccataatgaaattagtgaagttggtgatcaaattgctatttatttgaaaccattagctgcattgttgcctgatgttcatttaggtgagaaaccattagagattaaaagtactgtcactatcaacttgtttagaaacatttggttcaatatggttgttcatggatacaatatcaattcaaagaataccaaaactttccggaatgaattagaaagaattgcttataattcaccaccattggcttcagaattgtcatgggacagaaccgaaacttccattgaattaaacacagttttaagaagaggttcatccaatcataatatcaaagatcatcgtcattatttgggcaacatttttgaagtccatcgtagtttatcttatccgaaattgatgtttttatctgctgcagtgtttgttgaatctttaagagttagaaatggtaattgttccgattcattattgtatttcactgatccaacatttaagatttccggggttgacaaatatttgggacatatttcatttaaaattgtcaaagatttcattcaattaattaatactggtgccaataaacaatttagtgctgaccatattgcggaacaattgacgactatgttgatctattgttgttatccagttccagaaatgcaagatgctgccatgcaatgttgtgatttattaatcagtagagtgccatcgtcattgtgccacaagaagagtttattcgcgtcttcaccacggggctggcaggaccagccgtaa

SEQ ID NO: 4304 - DNA, 2136 bp, Candida albicans
agatcccaattatcatggagaagtagttttgttactgaaatcatgaataaattaccattgcgtaccgatgaagaaactgattttgccttccaagctattagagaaaaagtttattacattaaagccagattagttccaggagacaatggaggatttgattatcctaccaatgatgaaattatgaaattattgagtgaaattgctgggttaactttattgagtgatgttaacaatgctgaattgattagatatttagtggaaatcccattcacaatgtttgttccactgattatgattactgctagtggtgtttggtttgctgttatgaaagataaaccacaattatcagtacttttgttgagtgaaattgccaaaaaatgggaagaatctatacaattacgcaaaggggtcttttcacaagaatttgatcttgttcatcctgaatttgagaaaatggaatatgcaccaagtaatagagtattggttaataaggaagctgacattgctcaaaaaaatttcgctcctcacttagagattattagattatttgcatctaattttgaagctacattgaatcaactggatcatttattgaagattttcactagatttgttgaagttggcttggaaaatttgaaaattgccagttatcatccattatctcgtttagttcgttttgaattggttaaattttcttttgaattattacaatatcatatcaaattaggttccagaagcagcaaatatttaagtgaattaatcttggatggggcattgacttggtttagacaaagaagcacatatccatttggaggtaataaattaaaatttaagagtgaattaatacttttaaaagaagttgccaaatttgtcactggattaaataatttccaactggaattgattgatatgaaagctaaaattcttttatattttatggatgatgagatttgtaaatttactgtgtggttacattcaatgaatccttcagatactagtggtacttatgttaatcaacaaattggaggtcaacaccttaaatttgcttatgaaattgatccaattttggcagtgaatttggccatgagatacaaattaaagagtttagacgaattattacaacaattgataattaaagacccattacctgctatcagttaccctgatgccgtacaatttttcattggtatcaatgctggaactcatatgccatcgtatcatttattgttttgggctccattagctccaattgatagtatcacattatttttaccaccatttggatccaattcatacattttacagtacaccatgaggtcattagagagtcatgacgttaacttgacattcttttatgtgccacaaattgtccagtcattaagattcgattataaaggttatgttgaaagatttattgttgagacagctaaagtatcacaattgtttgctcatcaaattatttggaatatgttggctaatagttataaagatgaagatagtcaagaacccgatgatttgaaacctactttggatcgtatccaacaaacaatgttgaagagttttagtgctcatgatttgaaattttatgaaaaagaatttggatttttcaatgaagtcaccagtatttctgggaaattgaaaccttacattaagaaatctaaagctgaaaagaaggaaaaaattgatgaagaaatggcattgattaaagttgaaccaggtgtatatttgccatccaatcctgatggggttgttattgatattaatcgtaaactgggtacaccattacaatcacatgccaaggcaccatttatggcgacatttaaaatcaagaaggaattggttgattatgatgaacaaggtcataaacaatcatttgaaattgaaaaatggcaaagtgctattttcaaagttggtgatgattgtcgtcaagatgttttagccttacaattgatttccatgtttagaaccatttggagtaatgcaggattagatttatatgtgttcccatatagagttactgcaactgctcctgggtgtggtgttattgatgttttaccaaattcaacttcaagagatatgttgggaagagaagctgttaatggattatacgaatatttcattactaaatttggaccc

SEQ ID NO: 4305 - DNA, 1059 bp, Candida albicans
  unsure (1032): Identity of nucleotide sequences at the above locations are unknown.
cgcaagtgcggctccttccagccgccgtggttgaagacagatgccattacaccagttatttcagacgatgattctaaagtctcgaatagaatccaagagtctcaaagattaaaaacaaaatactcgaaaaagaaaatttcagcagcattacaattggacgattctgagaattacactactgatgaagaggaactaggttatgttcaaacgttgtcaaggccaaaaataagggaaatgaagtatactgaagtagaagagaatctcaagataaacacaataattagatccaaaaagaacaggtcaaagacaacagtgaatagtattagcttcttttctgacacagatcagtctgcactgatggaagagtataataggagtgcacaatcactaccggagttagtacgaaccagatccaggttggatttgtatagttctgaatccgaggctgccttgggaacatctcgcaactctgctgagttgattattagtaagaaaaaattcatgggatccgaagtaaaaacaagaccatacaaagaattattaaaaattcttcaggtaaactattccaaaaaagaaacgagttttataatgtcattgcaaaatatttctttgagattgtcactggttcctaaagtagcaaggttatctgcattaagagcagagttatctattataaatgagtctattcttccttcagaaatcgatatccctcaattattacctgttaccagtaataagaataaaaaattccacaaaatcttgaagttaaatataaatgaagcatgtgtattaaactccgccgaaagagtaccatatttgttactaattgaatacttgagcgacgaaattgattttaacccattcagtgatcaaaaccagaaaataatcaacgattgtattcgaaagcctgaagtcaaaccaaatgatcaaataagtggtgacgatgatacatcagttgtttctctgatacaagaagaaatgtttttagataataatgctagtgagaactataacgaagacggggatttggtnttcaccagaaggcgagatcaaatgtga

SEQ ID NO: 4306 - DNA, 522 bp, Candida albicans
  unsure (415): Identity of nucleotide sequences at the above locations are unknown.
actatgtctgcagatataactgaaaccccaaataaacaacttttggagcagattcggtctccactgtttagtttattcaattgcatttatgagttaaaaaaccatactgatagcattgggattcaacatgagcttgtcaaaaagttatattccttcccatatgaagatttgcaatttttcattccccaatttgttcaattattggttacatacgatagtgaatcaatggctcttgaagaattcataattacatatagttctaggtaccctcatttcagtttaattgtattttggaacttgcaggcttacatttttgaattgaaaaacgaaccagaatctcgatcattccaagccgttagaaacttaatcactaaaatccagaacattatgtctaatgcagatcaacagactgtanaggctccccaatttaaagaaaatttcttcctgctttggtcctatgcggtggtgttgcatcatcagtacttttgccgtcttttccaaatttattgtttacctatgaat

SEQ ID NO: 4307 - DNA, 852 bp, Candida albicans
gggcatcttgaaaattgggatctttgctcagtgattgttaaaaatggagatgatttaccacaagaggcatatgcttgtctattaattaatttaatttccaatatatggaaaaagcataaagtagacttctggactaaaagaatgaaaattttaataacgagtgcgaatgctggattagttgagaccatcacaaatgcaatgtccattcactccatcaaaaaatcattaaccgaattgtcaattgataacggagagaatgccaaaggacggatttttacattaaaggattattttcagaaactttacggactggttgactcactgaagtatgtcaaagctcaagaaaactttgcgataagtttggcatcatattccataatatgctatgtgttgcaaatcaaagatagacacaacggaaatataatgttagatcacgaagggcatataatccacattgattttggttttttgctttctaattctcccggaagtgtgggattcgaggctgctccttttaaattaacctctgaatatgtcgaggtattggggggactagaatcgaaggcttatttaaaatttgtagatacttgcaaaaattgctttaaggcattacgcaaagaatggggacaaatcgttagtattgttgagttaatgcaaaaggggtcaagtcttccttgctttaacaatggtgataataccagtgttttgcttcaacaaagattacagttacatttatcggatgaggaaattgattctttcattgaagtttatttgatagaaaagagtgtcgggagcatgtatactcgcttgtatgatcaatttcaaatgataacgcaaggaatttatagttag

SEQ ID NO: 4308 - DNA, 939 bp, Candida albicans
cttaacgttagcgcggatctgcattccgtggtgaagacagaagattggaacaccaagaaacaaaggatcaaaaagtctagtgcatatgggcatttgaagaattgggatttatgctcagtgatagcaaaaaacggagacgatttgccgcaagaagcttttgcttgtcaattgatttctatgatttcaaatatttggaaaaagaacaatatacctgtttggactaaaaggatgaaaattttaattactagtgccaacactggtttagttgaaactatcactaatgcaatgtctattcattcgattaaaaaatcgtttactgaacactcaatcaaaagtggtgaaaacagtaaaggaaaaatatttacgttacttgattattttcatagtgtttttgggctgccaaactctactagttttagaacggcccaacaaaactttgccaaaagtttagctgcctattctataatctgttacgttctacagataaaagatagacacaacggtaatataatggtagatggagatggtcatattattcatattgattttggatttttgctttctaattctccaggaagtgtaggctttgaggctgcaccattcaagctcacagttgagtatgtggaacttcttggtggtgttgatagtgaaatttattcgcagtttgtttatttatgtaaacaatgcttcaagtcgttaagagataatagtgaagagattattgaaattgttgaactaatgcaaaaagattcaactttgccttgttttaataatggagaaaacacaagtgttttattaaaacaaaggttacagttacagctcaatgatgaagacactgatcagtttgtagagaactttttgattggaaagagtcttggaagcatgtacactagattatacgatcagttccagatgataacacagggtatttatagttaa

SEQ ID NO: 4309 - DNA, 516 bp, Candida albicans
cgtacgtggatcttcggcccgccgtgtgtgaaaactaacgacaacatgggtgttcaccaccaattagtgcaaaaattgtactcttattcatatgacgaattggagttttttattccacagtttattcagcttctagttaattttgagacggattccatggccttagaggattttttgttgcattattgtaatcaatttccacattttagtttaatcgttttttggtatctacaggcgtttcttttcgagttgagaaacgagccaaaatcatactcatttcaaacagtgagaaagttcattaataaattacaaaatatattattcaatgttgaaacctcctttcacattagaggaccagaattccgagaaaatatgcaacctgctcttattttgtgcggatcggtcgccagtgcatttagtagtcccttggtaaatgagtatgcgttacctattgtacgttcacaagggaaacagcaaaagtcatttgtgtttaaattggccagttttcaaaaatct

SEQ ID NO: 4310 - DNA, 558 bp, Candida albicans
aacgttaacgaagctagtgttttaaattcggctgaacgagtaccatttctgcttttcattgaatacttgagtgatgaaatagatttcaatcctacaactgaatacaaccagagaataatcgccagaaaaaagatgaatggagctacaagtatgactgtaaagaaaatacactcattttctgaagttgcagatggtaatttcgaaaaggagaacaagattaaaagcagtacccctgagactgtttcaaatattatttataacgagaatactgaagaagcagacttaagtgaaatgcccttggatagaaaaactaccgtttcatcagatagtttttctccagaaatgctagttaccccttatattacggagcaactgaaactttcgaattttccatctttgaatacaaaagaagtgtccacaaaggttttagctgatcagatgagaatcgcagcagtgatgttgcagcaattggacagctttggtaaagcaaattcagaacaatcatttttgatcaaaaaccgtattgtcgaatcgatgattgcattacaagaccaatga

SEQ ID NO: 4311 - DNA, 1356 bp, Candida albicans
acaacaaaacaaacaaaaaagagagcacaaatttttctttcacaccacatctttttctttcccccagtgatgtcgattatcgatgaatatgaatctcttgaggttattgggaaaggatcgtttggtactgtacgacgagtgcgtcataaagatggccagatactagttcgaaaagaaattgagtatacttccatgacgagtcaggaaagaaaccacattatatctgaattgaggatccttagagagttggatcatccacatattgtcaaatactatcgacatgatcatataccagaaaagaaaatgatacacatatacatggagtattgcgaaggcggggacttggcaaaggttattaagaattttagggccagcaagagccggattcctgaagagtttgtgtggcaagtacttgtgcaggtgttgttggcgttgtatagatgtcattatggagttgatgcagagaaagtgaacttgtttaagactgcactggagccaaagtatgcgaatagtattatacatagagatatcaaaccagacaatatatttgttggctcgtgtatcaagttgggggattttgggttggcaaagatgcttagtgctaacgattttgccaagacgtatgtgggcacgccatattatatgtcgcccgaggtgttgttggatgatccgtattcgccagtgtgtgatatttggtcgttggggtgtgtgttgtatgagttgtgtacgttggagcctccattcaaggcgaagagtcatttacaattgcaggccaagattaagcgtggggtaattgaagaggtgccggatttttattccctgcagttgaggacccttattaggctgtgtataacggttgatccagaagagcggcctacatgttttgatttgattgattcgttggcagtaaggtttttaagaaaggaaatggaattgaaggaaatgaacgagaacttagaggagtataagaagcagttgttaaagagaagcaaggagttgaaggaaaccagtaaagaattggatgagtataaacaagagttggtacgcaagagcgaagagttgagtaagagggagaaatatttggatgaggagtttgagttgaggaaacaggcaatagaattggagtcgaaggagattcgaatggagtatcagagagagtttaatttggtggtggagcaagaagttaaaaggagattagagcagaggaaaccacatggaccgagaccacttgaagatgtgagtccaaggagtccattaaaggaaaggaatagaccaagggttactgatgcattggaaaggcttcatttagaaaagaggcatacgccggagtttgagtatataagtaagtaccgataa

SEQ ID NO: 4312 - DNA, 1206 bp, Candida albicans
cgaaatagaaggttcgaaaacttgaacgatttatcattttcaaaatactcaaaattttccaaagcatcgattatagttgggagtgaccccaaatctagaactacaacgctagactcaccatttgcgaagaaactaaaggaagatttaaatgttgaattcacgagcgataataccaagccatattatcccaccgtgtatccaatttatgaatttgataacaatgatgaaaacagtgattcacctttcctagattaccaaaacgaaaaaggaaatattcctcagaaacttagtggacagaaactccgcaagcaacaacagcaacagcaacagcaatcagaagctgaagaaaactttaaacagagcaatcaatatgccaggttgcaatctacacctaaacatcagcgaacttcttcagtcaaagtatcgttgactccagcacaaaagtttgaaaaaagaactagtacgcgtctgcacaatgcgttagataattttgagttgactacattagtggggaacggggcttttgcgagtgtctacagggcagtaaacctcaaaaccaatcaagtcatagcaatcaaacagattcgaatagagaaagatcaggatgtcggagttttaatgggagaaattgatttgttgaagatattgaagcaccgtaatatagtaaagtatcacggatttgtgaagacagcaacttctttgaatgttctacttgagtactgtgaaggagggtcattacgccagttgtataaaaagttgaagaaggggctacctgagtatcagataattaattatgttcgacagattttggagggactaaattacttgcatgaacaaggggtggtacaccgagatgtcaaagccgctaatgtgctactaacagataagggcgacgtgaaactagctgattttggagttgcaaccaaagttacatctcaacatctaactgttgtgggtacacccaattggatggctcctgaaactgttcttgggggagaaggtatttgtaccgcctctgacatttggtcattaggagcaactattattgagttgtttaccacaaatccaccgtatcacgacctcaatgctatggcaacattacatgctattggtaccgatgagcatccgccattaccaaaaaatatgtctactcttgcaaaagacttctattggaatgttttcaaaagcaagccaatcttagaataa

SEQ ID NO: 4313 - DNA, 576 bp, Candida albicans
ggcatattaagattggtgattatgggtttatgtaaagaggatatgtggcataaaagcaccacatcgacattttgtggtacgccagagtttatggcaccggaaatagtggcgggtaaagcatatgatagaagtgttgattggtgggcatttggtgtgttgttgttccaaatgcttttatgtcagtctccatttaaaggggatgatgaagatgatattttcaatgctattgagaacgatgaagttaaatatcctataaatttatctagacaaacagtattggtgctacaagcattattgacaaaggatccatcgcagcgtttaggtagtggaccaaaagatgctgaagaaattatggaacatccttatttccatgatgttaattttgatgatgtattgaattgtcgaattccggcaccatacataccagaagttcaatcagaacatgattattctaattttgataaagagtttacatctgaaacaccaagattgacaccagtggaaacagttcttacttctgaaatgcaagaacagtttagagggttctcgcatatatctgacaatgcaacgatttga

SEQ ID NO: 4314 - DNA, 1122 bp, Candida albicans
gaaatgaagaaatctactggccccactcaaactcgccaagtagtattcaacatatctcaaaactttaaagtgctcaagattttgggagagggtgcttatggcattgttgctttggcagtacatttacccacagagactaaggtggccatcaaaaaaatcgaaccatttgaaagaccattattctgtcttcgtacgttacgagaaatcaaattattaacaaaattcaagaaccacgacaatatagttcgattatacgatgtacaaaaaccaatgaattatgacagcttcaatgaagtttatcttattcaggaatacatgcctctggatttgcataatatcatacacacacatcttttgagcgatcaacacgttcagtattttatctatcagatcctcaaaggattaaagatgattcatagtgcaagagtaatacaccgtgatttgaaaccatccaacattttggtcaatgaaaaatgtgatttgaagatttgtgattttggcttagctcgcttagataccaaacattacaattttgatgaagcacctagaatttcaatgctaactgaatacgtcgctacaagatggtatcgagctccagaaatcatgttgagtgcatccaattattcgacggctatcgatctttggtcggtgggctgtatattggctgaacttttgacttacagggccttgttccctggatctgactacattaatcaattgaaattaatctttgaagtacttggaacaccaaccgatgaagacttgcagatcatcaaatcagaacgtgcacaaaagtttatcagatctctaccaacaaaggtcaagattgacttgagtgaattcattaataatcatccatatagaaatattaaacatcgtggtcgagaccaagtgaacccattagccatagatttattggaaaagttattggttttcgacccagctaaaagaatcaccgttcaagaggcattagaacacccttatttaaattcataccacgaacaacttgatgagcctgttacactgccaatacctatagaagagtttgattttgatatagataagaagaatttggacaccaatgacttgaaaaaacaaattttcgaaatagtcatgtcgtaa

SEQ ID NO: 4315 - DNA, 468 bp, Candida albicans
cctcgtcaagtttcattcaacgtatctgatcattatcaaatattagaaattgttggagaaggagcatatggaatagtttgttcagccattcataaaccatcacaacaaaaagttgccattaaaaaaattgaaccatttgaaagaagtatgttatgtttacgtacattacgagaattaaaattattaaaacattttaatcatgaaaatatcattagtatattagctatacaacgaccaattaattatgaatcatttaatgaaatttatttaattcaagaattgatggaaactgatttacatcgagtcattagaactcaaaatttatctgatgatcatatacaatatttcatttatcaaactttaagagctttaaaagctatgcattcagctaatgtattgcatcgagatttaaaaccactgaatttattattaaattcaaattgtggtctcaaaatttctgttttgtaa

SEQ ID NO: 4316 - DNA, 897 bp, Candida albicans
tatttattatcaaataatataataaaactaaccatgatagatatatttgatatggaagatgaagtttctacattaacttctcaacttcatactaaaatagttattagccctgccccatcatcttctacacaagaattaaattataaattaattgatgccatcgatgaagaaactatagctaatgaaaaagaaaaagaagaagaagaggatgatgattatgatgatgaagatgatgactatttaccacaagggtatcaaccacaaatatcttctagacctataaaaatcaataataacagtaatagacaacgaaggaaatcatcaatagtttcatcatacgaagtcaatattacaaattcttatgtttcttcatcattaataattgatagatcaccaggaattgtttctagtggaggaggagaaggaggaggaggagagagtatcaataatagcaaatttgtgtctagtgttatttccccacctagattatctgattttgaaccaattaaagtattagggaaaggatcatatgggaaagttttattagtgagacaagtatctactggtagattatttgctcaaaaacaattgaaaaaagcttcattgataatcaatcaacaagaacaagaaacagatgatgatgatgaggaggaggaggtggtggtggctggtgtcaaaatccatgaaaaaaattatcaacgaacattaaatgaaaaacaaatattagaattagttaatcatccaaatatagttaaattattttatgctttccaagataataataaattatatttaatattagaatatttacaaggtggagaattatttcatcatttagccatggaaaaattcatgagtgaaaaagatcaagttattatattgcacaaatgttattag

SEQ ID NO: 4317 - DNA, 870 bp, Candida albicans
aaaagatcaagttattatattgcacaaatgttattaggtataagatatcttcatttgaaattaaaagtgatttatcgagatttaaaaccagaaaattgtttattaaattcatttggtaatttagtattaactgattttggtttaagtaaaatagctgcagacaacgaagatggaaccaccaagaatcattctataacggggacagtacaatatatggcaccagaaattttacaaggtgatccatatgattttgccgttgattattggtcattaggttgtgttgcctttgatcttttaactggttcacctccatttacgggaactaatcctaaaaaaatattggaaaaaatgaaatcaattaaaaaaaatcttaaattcccattttatttaagtttagatgctaaagattttttaagaaaattattacaagtaaatccagagaaaagaattaatcttgatgatgaagaaatattccaaaaattcaaacaacatagatttttccgttatattgattggaatcatctagagaatttacaccaccaccaagaaagagaagaaggtgcagaagaattatcatttccaaaggcaacaaaaaatggtcaacaacaaaaaatgtatatgccaccaatattaccagttattactgatccaatattagcagaaaattttgattctgaattcacagaaatggatttcactcctccactaccaccaccaccacctcctcctcctcctccaataattatatcacaacttcaacaacaaacacgattatcttccagtggtaataatacttctgatattctaaatattcaaggattctcttatacaaatcctaaatttattgattattcattacataataaataa

SEQ ID NO: 4318 - DNA, 627 bp, Candida albicans
tttacattttctccagcaacgccaccactaccaccactaccaatgggtcatcttccaaaacttccagagggcacagttctccaggttggaaaacacaaggttactgttgtcaaatacctttccgaaggtgggtttgcccatatttacaaagttacaatagacccattagagaacgagtccgacattgcatgtttgaaacgagtgattgtgccagataagaatggattgaatgagttgcgcaaagaagttgatgttatgaagacattgcgccatagcagaaacattgtaaagtattatgactcacatgctgaacgattagaaaatggcacctatcaggtattggtgttgatggaattgtgccccaacggttcattactagactatatgaataaacatatcaaaacaaaactaacagagccacagatcctcaaaatcatgttggatatatgtcaagggatatatgaaatgcataaattgaaattagtgcaccgcgatatcaaaattgaaaatgtattgatcgactctaagaatcagtttcagttgtgtgatttcgggtccacagcgattccgaccatgcctgttttcacctacgggaagccgggccggaccccgcaacttagattaaag

SEQ ID NO: 4319 - DNA, 1608 bp, Candida albicans
gaacccgttatcccagaaatggggaatttataccggggaataccaatggacgagaaagcagatatttgggctttagggtgttttctctacaaattgtgctactacaccaccccatttgaagccaatggggatattgctatattacatgcctcgtttcagtttccgccataccccgagtattcaggagaccttaagaatttaattatcatcatgcttcaagaaaatccattatttcgtcccaacatcgtccaagttttgattttggtgtgtaaattgatgagtattgactttgcaaaactaaaactaaaagatttttacaatgctgggccttacaatttccaggcattgcacgaatatcaagtccataagcagaatgagttattgcgccaaaagcaattatattatcaacaacatgcacttgcaaactctgaagctggactcaccaaagagccaccagtggctgctggagattcccttccagcagatggaaaagagttagcctctacagaatctcaacctgaacaccatgccaaacccgcagccactccttctatagactcacaattatctccagaaatcaaatcaaccacgctaggtgtaccttcaaccctcacctccggatcatcgcgcgaatcattggcaggtttcagtctggaggatgacttggcagaaatagaaggcttagaagatgccgagcaaagatatccctcgttagaagagattgaggtccccatacaaaagagcacggaaccgctgcgactgaccagtatcaagacatctcattctgatgcggtctcaaccaagggaattgatgtacacgcagtagacgcggatcagttgcccaaacctagtaaagaagcagaaaaattggctgatgttattttttctaccaccgaaagtccagcaacggaaaaaggagataccgatgctgacttttatgatttgctgcaacgagtcgagcacttgcatgtcgatacagacccagttggaagtgccaagaacccatttccttatgccaagtcactggctgcagctaaagaggacggcaattatgagcaacctgaaacacacaaaaagaataatccttggggcaattataactcgacactggataattttgcatttagtctaccaccggctttgccggacataaaacaggtaccagtatcaaccgaacccgttttccttgaaaaccctaaattagcaaaacctgaatgtaacttgatagatttggaggttgggttggaatcctctagtgcatcaccatcgctcagatacctgaaatccaataacatctcagaagtgtctttaattgatatggatgattcccaattaaaaacaggtgaaaccaaagttgcggcaaattcagcatttaaaaaaagagttggctctagtacacacaatccatcacagtttagtttacaggaagaggttattgactttgcttcagatgatgaaaaccctgacaatggatcacatatgagcaggctcaagattagaagctcattaaaaaagcctagcaagggccgtaggtcaggagaacataagagaacagaaagtagtagtaccgactctaaaaagcggctatcgtttttcggtggtaattaa

SEQ ID NO: 4320 - DNA, 1146 bp, Candida albicans
tggtgcagttgccgtagttataccgtatttggctgctactgcggaaaaggttttggattatgtcaaaagcgttttaaaaataccaataatgctttgataattctagtgtcacctgaagatgcaagccaatcgtttagtaatttatcattaactaaagatcaattagatctgaaatttaaagagattaccattttattattaactgattcagaatcaccagtgaaaataagtctacttaataatatcttaccattgtgtcaatttttcggacaagacaagacaaatgatattattttaccacatttaatatcgtacttgaatgatactgatcaagaattgagattggcgtttttatcgtcagttttacaaatgggaccatttattggggtattatcatttgaacagtatattttaccgttattagtacaaacaattggtgatggagaacaatttgttgttttaaaagtgttggaaatttttaatatgtttgttaaagaacgactcatcaatccgagaaccgagtttaatgcattggatgtgtataaggagctattattaaacagtataaacttattgttacatccgaatgagtggattcgacaatcagtgataaacctcataatatctgtgagtgctaatttgactgatgctgacaagtattgttttttgtatccattgattaaacgatttttgagttatgatttgtctatcattgattggaacacattatatccatgtttaactaaaccattaaccaagcaaatttatgatttagccatcacttggtcattaaattcaacgtctaaatcattgttctggcaacaaaagaatttttcaatgttaacaactaagcagtcagggaacaacatcaccaaaaagatgaaaaaattgatttcttttaataaagatatgggtaaatctgtttatttaccacaaatgatgtcagaattaactttcgccaatggatcaaaccaaaaaagtaatctgacaattcctttatcgctggaagataaacaatggttattaaaattgaaatcaattggtttagatgataaatcactttggaaaattcttgcattaagggattatatttatcatgtgggtcgatctcctatgtcttcaccacggggctggaaggacccgcgc

SEQ ID NO: 4321 - DNA, 1377 bp, Candida albicans
atatcgatcagaaccggtatcgatatccaatggaactcgagaagaaagattcttggaagtaatgccgaggaaactgtatctataagaacttcttctcgtagaggttctaattcattaatattacctcaattagaaagagttacagcatcggttcaaaccgtcgaggcaaatgttatgggtgaaatggaaacgcataattcaggagtgaataaagatggttggtttaatgattcaaacacttcacataaagtgtttagtgttagtaattcgaaaattatcgtctcacatatcaaacatacgtatactggagagaatccgtatatattgaattttttaaagaatcctaaatttcaacctaatttgtcagattttgaagaatttgggaaaacaataattaaacatcaatacctgcaacagcaacagcaacaacaaaatcagaatcaacaacagctaaaaactattgacatgttaccacctatgaatgttttggtggcaagttttagatcttcagacaaagataatagattagaagagatcaatgcattagctgtttgtccaacatcagaattttttgttactggatcatcaacaggaagtttgaaagtttgggatagtttaaaaatggaaaaattagtcacagttaaaaatgccaatttatcaattgaattaaattcaagtgtctgttcaattacatttttacctaatagatttgttgttattgtgactactaatgatggaaccattcgattattcagaatagattttatgagaaatagtaagagtaaaaaaattgttcgatatttgaaaatgcatttgattcgaaaatatatacacggtaatgatcatgatgggagtgggaattgtaatggcaccaagaaatatcatcgtcttattgaacaaatcaaatttttacaagataattatattataggggttgatgttacagtacagaaaattatcatgttagatataatcaccatgacaatcctgtctgaattacaacatccattaatttatgggataattaatacatttattgtatataaagattattggttattagtggggaccgataaaggggtgttaactttatgggatttacgatttaaaatcattgttaaatcttggcatgtcataaataatgaaaataatgaaagacttggttctattaataatttagaattattatctaattcaattaaattatttgagacaaagaatgacggtgttagtagtggtggtagtagtagtgcttattttgcattgagtggtaatgatgatattagtatttgggaattaccaagtttagaatgtaaggcgattttaaaaacaagtaatgccgttatgaattcaagtaccattatgcatactcattga

SEQ ID NO: 4322 - DNA, 1056 bp, Candida albicans
atgggacagaaattatcactattggcaccatcagcaccaactgttgctgtgtcatcatatgtggatgcactacataattatcaatatgttgaagtgataaataactcacgatttttaaagacgataaaggcaattgataagacgacggggaatttagtaataataaaacttctaattaaaccagcatctcccaattactccattcaattacaacaagtgattgaattaatggtaaaacaatcatcccttttatatccattcaaaaatgcattaccgtggcacagattgattgagactgatcgtgctggttacgttgttcgacaaatgataaaaacaaacttgtatgatagactatcgatccgtccatttcttgaacccattgaaaaattatttataacctaccaaattttgaaaatcattaatgaaatacattccttaaacattcatcatggtgatttgaaattggagaattttttgataacgtcttggaattggttattattgagtgatttttccaatttgttgaaaccgacgtacataccagaagataatccaaatcaatactcattttattttgacacttcagggagacgattatgttatattgcaccagaaagattctataattctcaagatcatcctaaacatattctgaattttaatgacgatggtctgtttaccatgaaaaatagtgttactgatgcaatggatttgtttagtacaggatgtgtcattgcagaattgtataatgatggagaaccaacgttcacattgtctcaattgtttaaatttatgaaaaatgaatacactccagatctttcaggaatttataataaagatatcgttacgataattggaaaactaataaaactagatcctaatgaacgatcaagtgcacgagaaatattagatgaaaataaaggtacttgtttcccagaatttttttacagttttctttatgattttatggaaatgttaaataatcaagagaattttgtattaaatgccaataacgctaatattcttcactacgggagctggcaggagccgcgataa

SEQ ID NO: 4323 - DNA, 993 bp, Candida albicans
aacacacacatcccaagccaagaccaacacttattgcaaatggtagagttatctgattatcaacgtcaagaaaaagtcggagaaggtacttatggggttgtttataaagcattagataccaagcacaataatagagttgttgcattaaagaaaattcgattagaatcagaagatgaaggtgtacctagtaccgccattagagaaatctcgttattaaaagaaatgaaagatgataatatcgttcgattatatgatattattcattcagattctcataaattatatttagtatttgaatttttggatttagatttaaagaaatatatggaaagtattcctcaaggagttggactaggggctaatatgataaaaagatttatgaatcaattaattcgaggtattaaacattgtcattctcatcgagttttacatcgtgatttaaaaccacaaaatttattgattgataaagaagggaatttaaaattagcagattttggattagctcgagcatttggagttccattaagagcatatactcatgaagttgtcactttatggtatcgagctcccgaaatcttgttaggagggaaacaatattccactggggtagatatgtggtctgttggatgtatatttgctgaaatgtgtaataggaaaccattatttcctggtgattcagaaattgatgaaattttccgaattttccgaattttaggaacacctaatgaagaaatttggcctgatgttaattatttaccagattttaaatcaagtttccctcaatggaaaaagaaacctttgagtgaagcagttccaagtttggatgctaatggaattgatcttttggatcaaatgttggtgtatgatccaagtagaagaataagtgctaaacgagctttaattcatccttattttaatgataatgatgatcgtgatcataacaattataatgaagataatattgggattgacaaacaccaaaacatgcaataa

SEQ ID NO: 4324 - DNA, 1932 bp, Candida albicans
cacttactatttttccatcgattactaatcacatacattatgggtgttttgggtaagatattttcactgtcaagtaatttggcacaacttgaacaccaacagaagcaacaacaacaacagcaaccaccaccactgacgaaattactactgaagcaatcgccaccacaaccaccacctccagtcaaaacgaagccttccccttctaatggaactaccgtaccagatgaggacgatgagatactatctcaggttgaaaacgatattgtgacaccattacgacaaatcaaacaaccgcaaccacagcatccgacttctgtcaatacccctactgtaaacagtgtacgatcaaacaactcatcaccaagattaattaaaacaagatctgtatcaccttccaacgggttatcatcatccaccacttccccaatgctgttggaattattagaagataaattgaagaatcatcaaatagcatcccctacaggatcttcaacacaacctgtggcaatttcttcaaatgacaaaccatcgacaggtagaccttctccaacagtatcgcgtacatcatcttttagaacaccaccatctagagccacgtcagtcaaaactagatcaaatgcagtgtcatctacaaatgtatcaggatcttctactaacaccaaccctgtcaacaacttgcctagattcgttatgctagaaagtggcaaccacgatcatcatttacgatcagcaaaacgtcaagagaaactatcgaacatgttgaaagatttgctcggagctaaaaaatcacgtggcacaaccaaaagtgctgtaccagatatctttcaaggtgccatgcagtcttcaactagtcaattactgcaacagcaacaacaacagccgcagccagttaaacctcctacattatttgctggtttggtcaatagtgtcaagaatagcactagtccatatcatcaaccaggaaccactgatgtggtttgcagcactcccctttctgctgctaccggcacgtcagctaatggtatcgattgccgttcatttgcagaaaagtatggtagatgccaagaggttgtcgggcgtggatcctttggtgttgttcgtatatcacacaaaaagttggattcaacatcaactacagaaaaattatttgctgtcaaagaattcaaaagaaaaccaaatgaaagcgaaaagaagtataatcgtagattaacttcggaattttgtatttcgtcctcgttaaaacataacaatatcattgatactttggatttattaaaagatgctaaaggtgattattgtgaagttatggaattttgttctggaggtgatttgtatactttgattatagctgcagggaagctagaatatgctgaagctgattgttttttcaaacagttgatacgaggagtcaattatatgcatgatatgggtgttgcccatcgagatttgaagccagagaatttgttgttgactcaaaatggggtattgaaaatcaccgattttggcaatagtgaatgttttaaaatggcttgggaaaacgaaattcaatactctgatggtatatgtggttcatcaccttacattgctcctgaagaatataaccaagaatcatttgatccaagatgtgttgatatatggtcatgtggagtaatttacatggcaatgagaacaggaagacaattgtggaaattggccgaccctaagaaagatgaatttttcgaagaatatttagtgaaaagaaaagaatctagtgggtatgaaccaattgaaagtttgaaacgagcacgttgtcgaaatgtgatttattcaatattagatcctaaacctgaaagaagaatcactgggaaacaaattttaagtagtgaatggggtagagaaattaaagtttgtgaagctggtgaaggtcacttgaatgaattgggtaaacagtag

SEQ ID NO: 4325 - DNA, 1044 bp, Candida albicans
accacatcaatcatgtctactgcagcagttgcaacgaaaccatctgttacttcaaaaccagcaactaaacaagttctgaattacaccaaagaaaaaaaagtaggggaaggtacatatgctgttgtgtacttgggtaaacaaatctccaccaaacggcaaattgccatcaaagaaatcaaaacaggattattcaaagatggattggatatgtcagcattaagagaagttaaatatttgcaagaattgaaacatcccaatgttattgaactagtagatgtattttcagcaacaaataatttaaatttggtattagaatttttaccttgcgatttggaagtgttgattaaagataaatcgattgttttcaaatcagcagatatcaaatcatggcttctaatgacattacgtgggatacatcattgtcatcggaattttattttacatcgtgatttgaaaccaaataatttattattggcaccggatggacaattgaaaatagcggattttggtcttgcacgagctttggtaaatcctaatgaggatttatcatctaatgttgttactagatggtatagagcccctgaattattatttggtgctcgacattacactggagcagttgatatctggtcaataggtataatatttgctgaattaatgcttcgaataccttatttgccaggtaaagatgacgttgatcaattagatgttacatttagagcttatgggacaccaacagagcaaatatggccaaatgtttccagtttgccaatgtataacgcacttcatgtgtatccacctccttcaagacaagaattacgtaatagatttagtgctgctacggaaaaagcccttgatttgttgatatcgatgacccaattggatccaagtagaagatgtgattctacactagcattattacacgattattttactgaatcgcctcgtcctactgacccaaaaaagttgcctaaaaagtcttctccagaaaagagagagaatgaagatgaacagaataatggctctaaaagaaagcatgtgtag

SEQ ID NO: 4326 - DNA, 309 bp, Candida albicans
aggggattaaaggggaatttggaccttccaagtccaaaattggtgaatttccggattaacttaagtttattgggggaattgaaaatttaccaaccactttatgggggactcttgcttaatgggccaccggaaattcttaaacccaattgtcgaaagtatagtacaaaagtcgatctttggtcacggggggtattattatatgtatgtcttgtgggtttcccgccatttagtgatgaattggttccaccaaatatgaaggaacaaattttgactggtcaatatgcattttattctccttattggggatga

SEQ ID NO: 4327 - DNA, 1143 bp, Candida albicans
gcgacaacaacaccaggcagcaaaacatttgaagacttgcgtagtaaacggaaaagaaggttcggcaaactgttgggaccccccaaaagaggtactgactttgttcaagaaagcacaccaattggagacgaactatcacctaaaattgaaagcaagtttaacattacaccgcaacacaaactgttgagtgaaataataccaaaggccccgtcgttagaaagattctcccctcttttgaagaaaaaccattcatccatagatgctgaggataccattacaaaacgaatcgaagcaagacgacgagagcaaatggaacaagagtttgtgaaaaaagaaaaggaaaacgaattggccgaattgaaaataaaaaaacttgaacaaatagcagcactacagtctccttacgaagaacataaatctaaagagttccaagaacccaaacaaagtcgtatgccactccgtgaaatacctgtcaacagtgctgttgatgttttccgcaaaccaaaagcccctaaatctgctatatccccctcacctaatgtgcaaagcaattccatgatacccccggcacaaccagtatttagaaatacgttacaagactttccaaaacctccccaacaacctcaagccagtagccaaaatcagcaacaagtattgccctctgcacctataccacccaaagctcattacgatagaccccagcattctggaaataaacgagcattaataataaatgataaactgtacgagaagttggaacttataggaaaaggaggatcatctaaagtataccgagtgagatccctcaataacaattgtgtctatgctctcaaaaaagttgaacttggtcaattcgaagatgtgagtggattcaaaggggaaattgatttacttacaaagctaaagtcatgtgaaagagtagtgactttggttgattatgccaccactgaaagttcgctttatcttataatggaaaaaggtgatcttgatttagccgaggttcttcaatataaattgaaattggatgctccgttggatttgaactttgttaaatatcacacaattgaaatgtttaaatgcataaaagatgttcacgatgctggcattgtacatagtgatttgaaaccagcgaattttttgtat

SEQ ID NO: 4328 - DNA, 636 bp, Candida albicans
cccccgttcatggttcacgcctggcgaagacgtgatttgaaagcagcgaattttttgtttgttaggggcatgttgaaaatcatagactttggtattgctaatgctgtacctgaccacaccataaatgtttacagagagaaccagattggtacacccaattacatggcacccgaagccatttgcgaatcaaattatacctcagcaagaatttggaaggtaggcaagccttcggatatatggtcaatcgggtgtattttgtatcaattcatatacgggaaggcaccttttgctggatattctggcaatcaaaaattgatggctataactaatccgcatataaagatttccttccccagtagtggcattggaaataccccggtgcctgttagtgctatcgaattgatgaaaaactgtttacaccgtgacccaaacgatagatggacaattgaacaatgtctaacttgtgactttctactgccaaaaatagttagcgagaattttattcgggaagttgttcaccaatctataaactacggttataatagtaggatttcgggtgacggtatgacaagtgatagatatgatgctttggttgactctgtaatgaaacaaatacaaaacttaaactacagctag

SEQ ID NO: 4329 - DNA, 1380 bp, Candida albicans
atcgagaaaagatgctctacagcaaatttgttacggctacaacaatcgctttctaatagtacatttattcgaaattcaaatttgagtaaatcatacaaacataacgaaacaacagaagttgctaataataatttgcatgacactactttttcccaaacaacagaaacagaagagtttgtgaccccaaaccagttagatgaacaactagaggtggcaggacgaggaggaagaggagtagtagtagaagaagaacaacgagaggaagaagaagaggaggaagaagtcactttagaggtactagaaaacatgcaaaaattggaaaccaatttccccatattggctactgactatagattgattgataaaattggtgaaggtacattttccactgtatataaggcagaatctttaacgggtaaaatacgattaggatctgatatttggaaatcaccacctttaaagagaaacaaacgaaacattctaaatttccaacaatcaaggaaaaagaatcctatagttgctttaaaacaaatctatgtcacgtcttcccccaatagaatatttaatgaattacatttgctttatatgctttcagggaattctcgagttgctccattgttagatgttttacgttttcaagatcaaatagtcgccatattaccttactataaccattgtgatttccgtgagttttatcgtgacttacccgttaaaggaattaagaaatatttatgggaattatttcaagctttagattatattcatggtaaaggtgttattcatcgtgatttaaaaccaacgaattttttatatgatccgtttaggggaaaaggagtattagttgattttggactagctgaaagggaaaatatatcgaaaaataccaaacctgaaacttctactacgtcttcttcaggcacggccactacaactactacagccacaactacaaccactactactaccaccaccaccacaaattcttctactgcttcatcctcggcaatatccacagcatgtccttgtttgaacaaagatcagaaacttatcaaccgaacccatactaaacgtttaaatgtcaagggagcctatccaaaaaatgataatagaccaccaagaagagccaatagggctggaactagaggttttagagcaccagaagtattattcaaatgtactaatcaatcaaccaagattgatatttggtcagccggaatcattggtttctccattttacttagaaaatttcctatatttaattcaccaactgatactgatgccatattaaaattagcatggatatttgggtatgataaaatggctaaatgtgctgaacttcatggatgtggacttgaaatctccatgccgggaaattcataa

SEQ ID NO: 4330 - DNA, 501 bp, Candida albicans
aggaagctagccacccaaaaaatgagtatttcatcaactgctagtacatcaactactactttttatcctaccagtaataggacttcaatagatactactgctacttcaatcaataatgattatgtcaacactaataagcctactagactatcgacgacttcaagtttatttactatagattccgaattaaatgatttatatccagaattaccatcaaattttaaacttattgaattacttggtgaaggagcattttcatcagtttataaagctattgatatctcgaagaataatatgattgttgcgatcaaaatcattaataaaattaatcttaatctgaaacaattacaaaatattattaatgaaatcaatatattaaaacaaattaattatcatcatcatcctaatattattgaattattaggggttattgatggtattaatcaaacgtttttaattttggaatattgtgatggtggagaaattttgatcaaatattaa

SEQ ID NO: 4331 - DNA, 318 bp, Candida albicans
aatgaactgggtgaaaaatttgttaaaccggtttatactatacgtgaaggaatttctgatattgaaaaaatgaaaattaatgaagatttcacaaagagacatgatgattataaagatcataaatatttaatggaacttttatatggttgttttaaaatggatccatccaagagattaagtgctagagaaatattacaattaccatttttccatgaaattttacaaatcagtgaagatgacactcaagatgagtttatgcaacaaaatcaaactcaaactcaggaagaagaagaagaagatgaagtaattttatcttag

SEQ ID NO: 4332 - DNA, 1173 bp, Candida albicans
  unsure (109),(209): Identity of nucleotide sequences at the above locations are unknown.
aacaggaattgcttcacttttaacaagggttcgggaattggaacaatgaaaccaaaaatagcaagtgccctcataatgtacctgataaacataccagacaaccaccacnggaatcactcaaattcaaatattcaggttccaacagttgttcatgggaatcagcaaaaaggactgttgttgccaccaccatttattccgaatccaaacantatgagacctgcgccaacaccaactggagtcgaccaaccacctgcaaaacaaaaaccactgccagcacctaaacaaccacaaccacagcaacagcagcaacaacaacagcagcagcaatttcatagaaaatctattggtgattggaatttcgtaaagactatcggtgctgggtcaatgggtaaagtgaagttggcacaacataatgccacacatgaaatttgtgccgttaaaattattcctagggcagctaaactttatcaaagagcacatgccaacgaccctcctccgcaaaccacacaagaagcagctcagagacataaagagtttgaaaaagaagttgcgagagacagaagaactatacgtgaaggggcattggggagattattgtatcatcctttcatttgtcgtttgtatgagatggtacctatgacaaaccattattatatgttatttgagtatattgaaggaggacaaatgttagattatattgttgctcatggatcgttaaaagaacgacacgctaggaaatttgccaggggcattgcatcagctttagattattgtcatcgaaacaatgttgttcatcgtgatttgaaaattgaaaacattatgataaacgaaaaaggtgacataaagattattgattttgggttgtctaatttgtatgcacccaaaaacttgttaaaaacgtattgtggttcgttatattttgctgcaccagaactattgagcgccaagccgtatattgggccagaagttgatgtgtggtcttttggggttgtgctttacgttttggtgtgtggaaaagtaccttttgacgatcagtcggtttcggttttacatgaaaagattaaaaagggaaatgttgagtatcctgcttttctttccagagaatgtgtgtcattgctttcaagaatgttggttgttgaccccactaagagagcatctttggaccaagtttgt

SEQ ID NO: 4333 - DNA, 612 bp, Candida albicans
agacgtgtcgctgatgaattgacgagtattttaacgagtgttgaatatcaaatgagttgtgaaaactggtacaaaattactgaaacaggaagagagtatgcgtcttctcagaatgcacaaatattacctgatccaactggcgggttccatcctttggtatctatttactatttggttgacgaaatgagaaagaggaaaaaggcaaaggaagaggcattaaaggctcaaagacgtgctcaagttccgacaatcgctgttcctacaccaaaacaacaacaacaacaacagccacaaccagcacagccacaaccacaaccacaaccagaagtatctcagccattgccagaaccaaaacctgtaccccctgaggagataatcaaccctgcagtggcaacacaggcacaagctaacatgacagcaccaaaaattgtggaaacattttcagagacccctcaaagaacattggacccatccaagcaatcagtggatgaaaaaccaagtgcaccaggtccatctattgctgttccagaacaagcacacaccacatctgtcccatcatcgtttgttaaaacacagacatcgattgatgaagatcaactttccattcctgac

SEQ ID NO: 4334 - DNA, 1233 bp, Candida albicans
ttaagagaagtggttaaaatttggaaacaaatgaatattaaaacatcaatgattttcaatccattgggtaataataatagtaaatatagtatccatggaataatgtttcaagcagtttttaaacctgatagatccacacgttatactagagtagttactggtggacgatatgattcattaattgaatctttttcaaatgtcaccacaacaactaaacaaatcactcctcatggtgttggattttcattgagtactagtttacttttcattcttatgaaaacattaatttctcgagggaaatctaaattggatcttgtaaataaatggaagggcaatcgatgtaaagtacttataagttctactcaacaacaatttttaagtcaagtgggatatcaattagtttctaaattttggaataaaaacataagtgctgatataacatcagttgcagcaaagactcaagatgagatattccaaaatggtaattcagaaggggctatatggatagttataatacgactgttacctacaacaattgggaattcattctcatctttgaatggtggtagtggtggtagtagtagtagtactactactactagcactagcattagaagaagtaaaaaatctggatctggatttaaacctttgaaattgagaaatataattactggtaaagatattgatttagattatgatgaagtgatagattatttggtgactgaattattagaagattcagaacatgaagaaaatgatcaagataatggtacgatgacaaactcaacaacattacttacatcatcatcattatcttctaaaacaaatcaagaagaagaattattaaatggaccaattgattcagttgaaattgatcaaaaaatcattgttgttaaaaatgatgctcctcgtagtaggaaaaataaacgagataaatgggaatcagaaaatgatgctaaattagctggacaacaatgtataaaaaatttaagtggtggacctgttgttgttattgatgctagagatgaaatattagatatgattagtattacttcaattcatcaacaagatgaatggattagaaaagtggtttatacaactaataatttcccaaaaagttttgctatgaatatttataatactttgattaaagaatttaataaaggttcaatttggtgtattttggtgtcttcaagaactcaacatacaactattgttgatctacgtcgataa

SEQ ID NO: 4335 - DNA, 1053 bp, Candida albicans
ttctatttttatcatgccttcaggttcacaacgaattatgggagatacgctagagattttgaagaaattgggaaattggttcgtggtggatttggtgaagttgttaaagctagaagtagaatggaagggatattttatgctgtgaaaaaaattaaacatcgagctgataaattggattctttattaagtgaagttttatctttagctagattgaaccatcaatatattgttcgttattatggtacttgggttgaagaattagaagatacatctgcgattccatccaatagcacatctgctattgcgagcgatgacgaagaggaggaagaggaggaagatgacacagaaggcgactttggtgatgatgatcttgaactgacattttcaagtcgtgttggtcgttcatcatctgtgttacctagttatgataactcatttcaagtcgattacatttcaacatcttttgaccctaggatagaatttgatgaaagttcagaagaagatgaccaaaatgaagatgatgatccgtttgtgtttgccaattcaactgatgatatctcaaataatgaaacagaagatcgttccaaaagtgattcgaaagaagtttctgttaaaaaaccaaaagatgttgttaactcctctaaaaatgcatcaccgaaatcaatattatatatacaaatggagttttgtgaaaataatacccttctcaatcttattgaacaaggattacctaataaccctgatgaatattggagacttttccgacaattacttgaagcagtttcatatattcatcgtgaaggatttattcatcgtgatttaaaaccaatgaatattttcattgatagatccaataatattaaagttggggatttcggattagctaaaaattcacaattttcttcagttgttctgacgaataatcaagtggaagctaaagataatgaattatctaccgtggtgggaacattattttatactgccaatgaagtggccacgggtcaatacgatgaaaaagttgatatgtattcacttggaataattttcctttga

SEQ ID NO: 4336 - DNA, 792 bp, Candida albicans
tacattacaattatgccagaaacatcaattactctggatttagaacatagacaacaagatgaaattagtagtatatcatcaatttatggtgatatctttaaagatattactccaacgggtttagtttggaataaaaaacccagtccgcatttccaagtatttttatcatcgtcaaataatcctgatcgaccgactgtttccattacattagatatagaattcactcctacttatcctttatcacctccaaaagtaaaactactaaatgctcgtaatttattgaaaattaatattgctaaattagaaaagaaatgtaaagatttaatcaaagaatatcccgaacaagaagtttctttcacgataatttccgaattgattttcatgttagatgaaatacaaacaacaactgaaaaagtattatcattagaagaagaaagagaattaagattaagaaatgaaagaagggcattagaagaaaaagaggcgaaacagaagaaggatgaagaattggctcgaaagaaacaaaataaagaattgaatgaacaaattcaaaaaattcaaggtgaatttgatgatgattttactgatgatcaagatttagatatgtcaactactaatgataataataattcattaatcccacttgataaagatcaatttttcatttttgaaaatgccatggaagcaaccattcctaatacaagacggaaatttaagtttcgagcaatactgggattcataagatataatcaaaaggggtcttcaccacggggctggcaggatccgcgctta

SEQ ID NO: 4337 - DNA, 645 bp, Candida albicans
atcatgatcctaaaattcgtcctagtgcagcacaacttttacaaagtggttggttacccgttggacatcaagatcaagttatttcaagaagcattaaaatctttagctgatccagcatctcgttggcaacaacaagttcgtgaagcattgttcaatcaaccgtatctgcttgctaaagatttaatgtttgataaacaaaatgaacataattcccataataagcatgttgaattggatacttcgaatgattatttattatttgataaaatcatgaaagaattgaccaagattttcactaatcatggagccattgagaatttaaatacaaatttagttttaccaaaggcaccttcacaatcaagagaattagtttatgattttttggatagaagtggtgcagttttaactttaccttatgatttgactttaccaacagcaagatttttaagtaaaaccgatatgacaattcctaaaacttttcgacatgaatttgtctatcgacctaatgttcgaggtattggtatacctgatcgttatagtgccgttaattttgatatagccggtggactggaagttaacaaggcaacacttttcgctcatgatgctgaatgtttaaaagtgattgatgaaattgtcaatacttga

SEQ ID NO: 4338 - DNA, 1254 bp, Candida albicans
  unsure (50),(51),(52),(53),(54),(55),(59),(63),(65),(71): Identity of nucleotide sequences at the above locations are unknown.
tataaaaacatagagaaaaagaaatcagaacaaacccaaactcaggtttnnnnnnatcnacancnacaccnacataatcaccaccaccatcatcatcaccatcataatgaaaatcaatcgcaacagcaagttccgatcgaccccgctgcaaatccagcaaatagaatagggcggtatcaaattctcaagacattaggtgaagggtcatttggtaaagtgaaattggctcaacacttgggcacaggtcaaaaagttgctttgaaaatcattaatcgtaaaacattagccaagtctgacatgcagggtcgtgttgaaagagagatttcatatttaagattattgagacacccacatatcattaaattatacgatgtcataaaatccaaagatgaaatcattatggttattgaatttgccggtaaagaattgtttgattatattgttcaaagaggtaaaatgccagaagacgaagccagaagatttttccaacaaattattgctgctgtagagtattgccatcgtcacaaaattgtccatcgtgatttaaagccagaaaacttattgttagacgaccagttgaatgttaaaattgctgattttgggttatccaatatcatgaccgatggtaatttcttaaagacatcttgtggatctcctaattatgccgctccggaagttatttctggtaagttgtatgctggtccagaagttgatgtttggtcagcaggggttattttgtatgtcatgttgtgtggtagattaccattcgatgacgagttcatccccgccttatttaaaaagatcagtaatggtgtttacactttgcctaattatttgagtgctggagctaagcatttgttgacaagaatgcttgttgttaacccattgaacagaatcaccatccatgaaattatggaagatgaatggtttaaacaagatatgccagattatttgttaccgccagatttatccaaaaacaagaatagcaagattgacgttgacgaagatgttatccgtgcattatcggtgacgatgggatatgaccgtgatgaaatcgttaatgtaattgaaaaggcaaacaaacaagttgctgcaggaaactcatcgtctcagcaatcgaaatcaagtaatgagatattagatgcctatttattaatgaaagagaatcatgcattggtgaaagacttgaaaaagaatatatcagaaaacatcgaatcattcttatcccaatctccaccaccaagtccatcctct

SEQ ID NO: 4339 - DNA, 438 bp, Candida albicans
caagctcctcctgcacgtaagaaactgaaaacaagatggcattttggaatcagatcaagatcatatcctctagatgtaatgggagaaatttatcgtgccttaaagaatttgggcgcggaatgggccaagcctactgaagaagaattatggacaataagagtaagatggaaatatgacactagtgcacaatttgaatgtggtagtgcaccaaatttgatgaagatgcaaatccaattattccaattggaaccaaataactatttagttgatttcaaatttgatggttgggaactggcacatggaaatgcaggtaccgattctcctcaaagtcacagacaacaagacctagatgaagttgggtcattctctgcttatcctttcttacatttagctactagattaattatggaattagccgtaaatagtcaaagtggataa

SEQ ID NO: 4340 - DNA, 1293 bp, Candida albicans
  unsure (1275): Identity of nucleotide sequences at the above locations are unknown.
tatgaaatattattggcagtgaattattcacataatcaaggaaaaattcatcgagatttaaaaagtcaaaatattttaatatctaaaactggtgatatcaaattgacagattttggtgtgtcaacacaattatcctcaaatttttctaaaagaaatactactgtgggtactccatattggatggcacctgaagtaattgttaataataatggtggacatagttataaagctgatatctggtcattaggttgttgttgttatgaaatgttcacggggaaaccaccattacaatcaaaatatcctccaatgagagcacttcgattaatttctaaatgtcaaaagaatcaagattttattaaattaattgaattaaatgaattggacatatcttgggaatttaaagatttcttgcatcaatgctttattgaagatcctaaattaagagcaagtgctagtaaattgttgaaacataaatttattacgaaacatatacacgataaggataaaattaaacttcttaaaaaattaattacgaaaaagcaattgtggaatcaacaaaaccatatagttaaaactcaaaattattatgtcccaacagaaatctataataatcaactcaagtggaatatggatgaccagaatgggaatgagaaccaacaaacagaacttacaaaggaaagtggagatcagcacaccggtaataccataaaatttgatattagttcattaatgttgaataatgacttagaagatgatattgaagaagatgttgaagatgatgctcatgaagaacggaaatcttctccttcaagtgaacctaatgatgatataataggatttttcaagaatgatttcaataatattttaaccaaaatctttaataaaattgataatagaaatcaattatcaagactacaatatgatcaattggttgaaatgaataatttgatgggtcaattgattacaaatgataatggtggtactaataataatagaaagatattattatttcaatatttgaaatacttaataaaagaattattgaaagagaaaaattcacatatcaatcggttgatattaccatcaagtatactacataacactggtaccaatggtattaccactaacatttcaggaaataccctagtcaataacaataaccacgtgacaaatatgaccaattttaccaccaatgggatattatcatcaacaacgtcaacgacaacagtaaatcataacaggacaactagtcatacatggacaaagtttgatganttagaatccagtttataa

SEQ ID NO: 4341 - DNA, 1095 bp, Candida albicans
gggaaatttggggtgggatatctgttccggattgttcagagattcaaaaaaagttacgtggagaagttgttggttaattcaattcatagagtatggttggtttgccgtatttacaccaaggaacttaaggaacatggtgatttccaactggcggatttcttattgactgagttgggccaagttaaattagtgatttttggagtatcaaccgagattacaatgactaaaatgaaaaagaacacttttgttggaacacctttctggatggcaccagaggttatcactagagctaaattgattgagggtaacgttaagaattgtgtcaatagtaatggtaattacaatggtgggaatactggatacaatgaaaaggcagatatttgttcaacgggaattaccaccatagaattagtaactggttcacctccgttatcacaatatgacccattaaaaatattgtttgacatacccaaaaaaaggccaccactgttgtcagggattgattttagtgacaatatcaaaagttttgtaaagcattgtcttatcaaagaaccagacaaacgatcaagtgctacagcattattacaacataagtttttcaaagcatgtgtcactgaagatgtgcaagcaaggttgattaatctaatttcattgaaaattgccaatgatgaccatcgggcaggatacaaacctcgatttagaatatctggaaaattagacaatggcaaggagaatcttgaggcgccaattgaatgggagtttactaatactttgatacaacagcaaaaaacaacgccacgtctgccattactagaagaggtggacgagtttattgatgattccagtagcaattacccttcaaatgtacttgaacaaaacaatatgacatctttgaagttaataagtactaaacaacatgtaacaagtagaaaatgtgaactacttttcaattgcttacacatggttcaattaagaggtaaagatgaatatactaggtgtcaggtggagaaatttattgattcagtatgcgactttgaagagaaaaatcctggattttgtaatgctattgtggaagaactcgaaaaacatatttaa

SEQ ID NO: 4342 - DNA, 903 bp, Candida albicans
gagtacccgaaagtgataaatatagtggaaagggaaaaaagaaaagggccaggtaagttttttgatgatattgtaattcatttaaatatcaaccaccaccttccattactgaccaacccacaattaaaatcaccttccaaatcacacaataaaagaaatagtacaaatcctactgttggtgttaaagaaaatttactactgtcaccttcaaaattattaaaacggttatcaatgagattatcttcatcaaacttaaataaacggaattcagttattcctaatgatataaaagtaattatatctgaaccacaaccacaaccacaaccacagccacaacaattattgctgcctcgattaccattacaagaatatgaagaaaaatcagcaacgacaatacaatcacaactgataccctacttggaaacagtagcattaccaaatggtaaatcaattttaataccttcatcacaatcacaagatgaatatccatcaccaacattatcactcacaccaccatatctgacatcaccatcaaattcaaattcttcttcttgttatagtttacaacaacaaccatctaaatcttctacatctatgatagcatcaaatttaccacctttagagaatcaaaaattaaataaatcattgtcaaacagtactaatgatggaaagaaacccaccccaaatgaagtagttgaaattacgccaaagaaacaaagcagaagaagaagaaataaaagtcattctattagtgcatttatttcaccacgtaaattggccagtgaatatcataatcgagttaaatcaagttggagaaattctctgactccttcaactcattctcaattatcacaacctataccatatttacaatatcgtaactcgacccatgatgaagaatag

SEQ ID NO: 4343 - DNA, 912 bp, Candida albicans
attggagactattatttaggggagaattgtattaataacatcagcatgaagattaaacgtgagatttcaataatgaaacaatgcattcatcctaatattgttaaattgtaccaagtaattgatgatttaagatttgataaaatattatggattttagaatattgtcaatatggtgaaattgactggaaacgatataatcattaccgtgaaaaatatagaaagattgatactgaaagtacgcgagggaacactaactccataccacaaacacgtttgaccttaaacaagattctacgtgacatcattaacggattagaatatttgcatgattataaacatataatacatcgagatttgaagccatcaaacttactaataaaccaggataacactgtcaaaatatcagattttggggtgagtctattactagagaataatgctaatgacgccaaagaattggcaaaaatcatgggtacgccagcattttatgcacctgaactatgtcaatttgttaataatcggttttctatggttactaacgaagatcatgctggtaacaaaattaaaattagttataatattgacatttggtcattgggagtgactttgtattgtttactgtttaataatttaccctttaatggtaataatgaatttgaaatgtgtaagaacattgttaaaagtgaactacaattccctttaatcaagcattcatcaaaagttacagagaatgatatccaagaattgaaatgtttgaaagatttaatcaagaaaattttggtcaaagacccagatgaaagaatatcattgaaagagattaaagtgcatccatttactacatttgatttaagtgaattagagaagaagaagtttttcaagtttaatcaaaatatattcaaggcacaagatttc

SEQ ID NO: 4344 - DNA, 4278 bp, Candida albicans
tttaaagataattgtgaaagaaaaaaaaattatcacagacaatactcaattatgtctacatctctactgcaccaagagttgtcgactgaaaaggggcaatcatgtcctccaataccagatagcaatcctttaaatccaaagtcacctgcattaagaaccaccagcaattctacaattctaaatagtcccattgaaactatcaatgtaaatacatcatcaaaaagcaacatatccggcgaatcaaccattaatggctcagcatattcaaactccactacagtagttcagcctgaggtgttcggcgaagcgcacacgacaacttcaacccacaattccgcaagtaccagaacagagaggaacgaatttccgaatagccacctacaccaacaccaacaagagagtaggaacaatggtgaaagtaatactcctatgacttccccgaaacatttccccaccgatgatttgagacatagtcttttctacaaagcaggatctgcagctcaccataaatcggcaacttcttcgaaacagagttctacaacatctttgaaagatggtctcaataatgcaaacacttatcatttccagaatacatttttggataacaatgtcatgtcagatttggaagaatctcctgtccctaacgagagaaaccctattcaagacactggtcttggtcctcgttcccatgcaactaaatttggtgttcaatccacaacgtcattgcctactactatactgcagagtagattaccaaatagtaacaagtccagctttttccccttcaaatcttatacatcttcaccagtgaaggagaccaaacatgtatttttagagtacgacccaatcacccgcagaaaggtacttaacacatatgaaattttaagagaaattggcaaaggtgagcacgggaaagtaaaactagcgagagatttgatcaacaatgagttagttgctatcaaaatcgtcaatagaaaatcccggaaagaaagactttcgctacgaatgcgaaagaattcgagtgcacccgtcataaatgaatatgaattgaaagttaaaagagaaatagcaataatgaaaaagtgtcgtcacaagcatatagtggcgttgcgagaggttttggacgatttaaactcgttgaaaatatatcttgttttagagtatatggaaaagggtgaaataaaatggaaaaaactacaatcagatgttgctaaaccaacagctaacaaatgttacgatgccaacgataatgaaattccatgttgtggcaacggaagaatgcagcagcggcaacagagtctattaaccgatgaagatttgttgtcaaatgagttttccccaaatttgacgtttaaacagtcaagaaagatattcagagatgttttactaggactagagtatttgcacatgcaggggattgttcaccgtgatattaaacctgcaaacttgctagtttcagctgacaatattgtcaagattagcgactttggtgtttcctttgccacctctttagctgaaaatgacgaagggtatttggtgaacgaattggacttagctaagactgcggggacaccagcgttttttgctcctgaattatgtcaatttgacgatgaaacggctacagagaagttgtcgtcttccactgagtcgatggcacctcctaagattgactacaaaattgatatttgggcattaggtgtaacattgtactgtttgttatttggtaaagtgccgtttaatgctgatacagagtatgacctatttcaggttatcgtgaaagagcctctaaagttccccaattccattaaagcattcaatcctccagcaacagtgacagaggaagaatttgagttagcaaaggacctattatctaagatgttggacaagaacaaccgcaccaggattgaaatccaagatattaaagaacatcctttcactttgatggatttagataatgacgtggatggcttgcatgaattgtttcatctaaatggagacaacccagtcgaaccattgagctttgacttagacgaacacgacatagttctgaaagatgaagtcgataatgcagttattggggtaggagcaagaatcaaaagaagcttagtcagggcaatacgtgctggtgggttgaaggatggagaaataagaaacaagtttgcggctttgcaactagaacattcgaggagtgaaaatagcgaggaatcttctagtggttattctaactacagctctagcaccagattgttgggttatcaaaacggtcaaaactactcaatgatattgtcagaaggtttaccagtttcgtctgccactccccctcctgctttgttggcggcacaacagaaacgatcttcgttgttgctgccgaaaagtgggggaaattctgaacagaacaacccacatttcccatggtctttggcgcatcaaataccagacacatcatcccgttctacttggtcgtcttcaacgtcgatggcattccaaaaccatttttcctttgcaggcatgagagaaagtggcaaaagtctattgcatgatatgatcgagtccaatagtaataactctagcagaagaggtagttctgctggaataactgtttcggaggctcatcaaatagaaacacaaagaaatgttggaggggatttatatttgaagaaccagtctgttgtggagactttcaaagggatacaacttcaagatgacaagagaagacgatcaagtattttttcacttcattcgcaaattgggacaaattcaaacaagagttccttatctcatgaattaacaccaactcaaacagggctgggggcatccactcagcaacagcatcagcactattccacaaactattcaaatatagctgccccgattccagtaccagcacataggaaacaatcgacctcggataatgaacaagacatcaaggcaccattactccatcaagagaagaatgtcatgggtaagccatacttaaagattggccccattagcatcgccagagaagacgaaaagtctgccgatgatcatccggactcttccattatatccttaccattaagtgaaagttttgcatccttggatagcataaacgatgactatctaagtaggaagtacgaggaatacaccaacaatagaaaggagaattcaaaatctgagggcaatgtgccggttatactgctacggagaaagtcaagtctttcagaatcagatttaacgagacacgttcaattgaaagatccttttggtaaatttaaacccgatggaagtgagatagctgagaagttcaaggctttcaatcttggcaatttgatgaagactgggggcaaatttgctttagctgagcataactctagtgatagtcagcagataaaggggaacaattatcaaagcagcgatgatggcattgctcctaaagcaattgtacccgccatatcatactcgagctccgactcttactcttcgtgctcgtctagcagtttcgatgacgaagatgaatctgacgacgatgaagagaatttgacgttggcatttcaatctaaagttgcaccgatatctagagctaattttctatcgttgacaggacgggccaaatcacacgattcaaacttgccaacactccgacaaaatcgtgaaaaaggtagacaattgaatcctgaatttcaggggccaataatctttcacgatggtttaccagaatttgaagatgttccagatggtttaattaacagcaacccaattggaaataataatgttaatggtaacagtgcatttaattccggctacagctactatgacaatgttaaccctaccgttgtttctagcaatgtatctacagccactttaacaatgggcatggcaccaagcgagtcagtagagacaaatgtcgaagcaccagcacaggaaaatgctgtaaaggtttcatcgccattgaatccccacaaaaacaccctgtctcggagtgacattttgaaagatcttaaaaagaacacaagcatttcattcggagaaatccttttcaatgatcagttcaacaatcattacaaaaaagatccagtttactcaccatttccctctgctaaacatttagataatgatcaggaaacaatagtaaaggaatcagctagcaaatttcatgaacataggccaacttactacagatcaaactcggtaaccattgggttattgcatagaagcactcatagagaagacgatgatgatgtactgcaaacaggcaatgatctagagcaacttataactaaagagaaacaaggatga

SEQ ID NO: 4345 - DNA, 288 bp, Candida albicans
aagaaagagaatacatatacaacgacagtaccctggctaataatggatacaaataaattagcaattgtactagatcccaaatcgaaccggaaaataattaatcatagatataaaatcataaagaaaataggtcaagggcaatatgggaaagtattattgggagaagatgttacaactacggtaacttccactgaaaagaataagtcaaccacgatttcaacttacgttgccataaaaactattaatcgaatagataaatcgagactattattagtgaagaattgctag

SEQ ID NO: 4346 - DNA, 909 bp, Candida albicans
agtactggcggcattcgagatgatcaagtgattaaacctattagtaaaggggcatttggatcagtttttttaggtaaacggaaattgacaggtgattatgtggcgattaaatgtttgaaaaaaagagatatgattgctaaaaatcaagttttaaatgttaaatctgaacgagcagtaatgatgagacaatctgattcaccttatgttgctcaattatatagtagtttccaatcgcgagattatttatatttagtgatggaatatttaaatggaggagattgtgcaaatttgcttaaaacgttgggtgtcattggagtcgattggacaccaagatatattgctgaaataattgtgggtgttgatgatttacacaatagaggaattattcatcgagatttgaaaccagataatattttaattgataaaaatggacatttgaaattgactgattttggtttatctcgattaggtgttgttggaagacaacaaacacaacaacatcgtaaaagcagtaccaatgaacaaggtattgaattatttagaagtatgttactggaagaatcaaatcaaaagaaagttaatcctgggataggtactccattttcattatcaccaagtttagaacaatcaagagtgtcttttaatagtcagcaacaacaacaacaacaacaacaaatgggagtacctgctggtaatgccccatcagtgtcttcattagcagcaggtgaaaattttgttttatctagtacatctccaactttggcttatttagaaagttttaattcactttcatcagtatcaactcctacgggtgccacacaacaacaacaacaacagcaaccaccgccaaaaccttttgttaaatcatccaatggaagatctggttcaagtggatttgattcaccaata

SEQ ID NO: 4347 - DNA, 858 bp, Candida albicans
ttgataaccacatttacatctttatatcagtttttcccccccatcctatacattaatatgtcgaatactcccaataaatcaacacctgaacctgaaagtactgtctttcacggatcgatatttgaacatcctcatttgcatcatagtgtatcagagaggtcaatatcaccacgccacgtatcaaaagaaagtcaaaaccacaaccacaaccaccaacaacaacaacaagcatctaacagtctcaacttctcagatcaagtatcaggatatgattatccatcggcaactattgaagaacaaatagatttacgactcgcgtcgtctaataatcctactattgttatggaattagacttggatggaaatatccgttatttaagtaaaaattgggaatatattgttggaacaaatatcaagaaaattgttaatcgacacatttcgaaaattataattggtaataatgatgatgattctcaagtatttaacattgctatagatgccatgactcgagaagatattagttataaagtgaaatttataactgctacaaatcatactcaaagaaataaagatggtgaagaagtctataatgatttaaatgatttattattaagtcggtctcacgatgatgaacaatcagggattttaactcctcataattctatggaagatatggctaaaaacgataatatacctgtaaataattattttgaaaaacaacaacaacaacagcagcagcagcaacagcagcaacagcaacatttagaactgtcacaacaagaacctgaaaaaattgacacttctgatacttctagtacttttcttcacaatcgggcatggacggatccatgcgggagg

SEQ ID NO: 4348 - DNA, 1158 bp, Candida albicans
  unsure (47): Identity of nucleotide sequences at the above locations are unknown.
tgtttgaatttctttatggatatccgccatttcatgctgatactccnggtaaaagttttcaataatattttactggggaaaattgattggccagaattaacacctgaagaagatatgaaattttgtccacctgatgctaaagatttaattaataaattattagtaatgaatcctgaagaaagattaggatttaatggagctgatgaaattaaaaatcatccctattttaaaaatattcattgggatacattatttgaagaaccagctccatttacaccaatgttagatgatccagaactgactgattattttgattcaagaggagcaatgatgactcaatttcctaaagaagaggacctgcaactgctgctgctgctgcaactgctggatggtgaaaccaaaccagaagaaaatgaaaatgaaaaagatattgtcgtcaccacaaacacaagatcatcatctacgggacatattattcatcgacaaaaaagtcttgatcggaatagtagtattagtagtaatgattctggatcattatcattacctggatcttcaagtattaataatattactcctaccactacaaaaaaggaaagaagaagtagtaaattggctgatcctagtgaatttggttcattccatttccgaaatttggctgttttggaaagacaaaataaagatgttattaatcgattgaaaacagagcatttagaacatcgtggtagtttttctacttcttcatcatcagaatcaacaccaacaggaagactgagaggattttcatttggtaatgctggtaatagtggtagttccagtagtggtggaggtggaggtggaggtggagttgggacaagtggctcaccatttaaacgtccaatttctccaccatcgtttaatgccaatcaatcaagtggattaggactgccagttataactacatcatcaggagcaatgggaattatcaatacaacaaatccagtcaacattaccactactagtactaatcataatcatcataatacttttaatactgttggtggtctcggaattggtacagctacagctacaactgcggctgcaactacagctactacaacaacaggtagtattcgatcagcatcacctcatcgattatttgaaagtccgaatattccctaa

SEQ ID NO: 4349 - DNA, 732 bp, Candida albicans
catgaacgtataccatcagctacaagtgcatattctagtggtgatgaaataatgataagtccactgttaatgattcatcatgatgatagaaatcatcattcaaaaagtagtagtttgccatatctacaaactattactaaacaacccagtttcctgtatttgaatcataatcatataattcgagatttttcatcgccaaattcatcagatctggaagatactactaaatcaaatgcattattacgagttcaaagaagacgtgaaagttcacgtatgtcaacagagttattactgggcactaatactggtggtggtggtggtgccggtggtggaaccactagtagcaataatagcagtgtaattgttgctgatcttgatgtattatattgtgaacctatttctgtgattcgtcatagtgtggtgaaattattagaaaaagcgggatgtatagtggtctcggttacagatggagaagaattaattaaacgagcaacatcacaagttaaatttgatttgattttcactggattgaaaatatcaaaagttgatgctatagatgctgttaaattaattaaatttactagtgggaaaaatcgtaatacaccaataattgggattaccgagaataagaataaaattgatgatgatattactactagtagtacatttgattatattattgaacctaatcttgaagcaatttctaaagtttgtcggatattacgtagttaa

SEQ ID NO: 4350 - DNA, 570 bp, Candida albicans
tataaggggttaccattaccaaatatgtcagattatccatcaccaaaattggctaataaaatattgacgaaaaatttccaatcgaaaaacaaacatgcattaatgttttctaaaaaattcccgtttggaattttacaaagaatagtagaattatgtgatgaggcattattagtaaatcctccttcaacaaatgaagacaatattttagcattttctcctgggtccgaaaaggcattgaatgttgtcatgagttcaagctttttggaaacttctgatgtggcaattaaacaattaattgaagatactcaagaattgattaatgataaaatggaaactttatcgagattagtttcaattttacaatttctggagaaaatcaaacatgaagtagatactttggtgttatgtacagttcgagaaactgttgaaaaaatcaagaatcaaactattttggaatcaagagaatgtacaccaattaataatgatagtctgataagtattaatgaagaagtcgtgccgtcaacgttagaaacttggctttcacacaggccactggaaggacgaacgtcc

SEQ ID NO: 4351 - DNA, 1038 bp, Candida albicans
agcaacaactacaagttgatgaagttgtcagattattatatagacaaggaattaatttacaatagtgccatttctgatatatatacggctattgataagtttaataacttaccagtatgtcttaaaatagttgatgaagatttcagtcttccaccacattcaatccatcgagaagttcttatacttaaaactttgaaaccacatccaaacataattgaatattttaatgatcttaaaatttgtgacgatattatattagtcaccaaattgtatcgttatgatttgagtcaattgattgaaattacaaaatattgtaaacgaacaacacgatttatttatggtattaatggtaatcttgttagtaatcaatatacacttgctaatgaaattgaagaaaaagatatcaaattatggttaaaatcaatgagttcaggacttgaatttattcattcacaagggataattcatcgtgatataaaacccagtaatattttctttgcccgggatgatataacacaaccgattattggagattttgatatttgttatgatttaaaactgccacctaaagatgaaccccctatggcgaaatatattgatgtatctacaggtatttataaagcaccagaattgattcttggtataactaattatgaatatgaaattgatatttggtcattgggtataattttgactggtttatattcagaaaattttcaaagtgttttagtcaaagatgataaagaattgactaatgattctcatgttagtgatttatatttattaaatcaaatatttgaaaatttcggtacacccaatttaactgattttgaagatgaattattttgtgatgaatataataatgaaaacttgcattttaaaaaattcaatttacaaaaatatcctagaagagattgggatattattttacctcgatgcaatgatgatttcatgaaagatatttttaccaagatgattagatatgatcgaagttcaagaataacttctaaagaaatcttacaattaatgttggattga

SEQ ID NO: 4352 - DNA, 786 bp, Candida albicans
  unsure (764): Identity of nucleotide sequences at the above locations are unknown.
aatgaatttgatttagggagtgtttccaatttagacgaacaaatactagacaagctagagttaattgcacacattgctaatgctgtgaatttgtatgctgatgtcaaattcagtcagattattcccagtccgccatcttcagacgggatagaggatgacaccgagatgttgcctcctaagattattcatatgatcagtcaagagggaataggattatatattaagacgttgagtttgttgggaagagccatggatattgctggtcaatggtggtttgaaaaatatgatgctgttcatggcgaaagacctagctttgaaacgacagttagaattaatcaaatagtgcaatggatcagagaaaagtataatatttcccttgaaagattagagtttttgaaaagtaaaagtgattttactgctgaagaaacaatagaagataacgagcctaatggaacaacaagagtgcaacaggcaatttttgctgctgctcttggaatcgctagggaaactgcacttaaggaacttcttcgcaatagcacagatatagaatgctcatatgtcacaagtatatatatgcttttggcaatacttgaagatcttgaagaatctgatcgccaggaagtgaagaaaataattgaaaaaattaactcccgtttgaagaatttcatgggggaaatgatgatattattatcatgctttctcgcaagatatcacctttcacaagatacaaatatctcctcaaaaaaatacagtttctatgtatntaaatatatatatatatattag

SEQ ID NO: 4353 - DNA, 1233 bp, Candida albicans
atctcctgtctattcgacatgatacctcagtcgaaccctacagctcaaagacgttcaggtgatgcccaaaataccaataatgtggcacctaactcagtagccaccaccactgacactgctttgacagcttccacacaatctggaagcagcagcaatagtgcgaataaaaaattggagtatatatgtgtctacaagattggtccagaaattggtaaagggtcatttgccacggtttataaatgtatcgatacaaccaataataaagctgtggctatcaagtccgtgtatcggtccaaattaaaatcgaaaaaactactagaaaacttagaaattgaaatccagatattgaaatcaatgaaacatcctcacatagtgggtctattagattataagcaaacaacaagctacttccatctagtgatggattattgttccatgggcgatttgtcatatttcattagacgaaggaataatttggtgaagtcacatccagtaatctcaagtttgttgcatcgctatccgtcaccagaagggtctcacgggttaaatgaagttttggttctccattttttgagacagctctcgtctgcacttcaatttttaagagacaagagtttagtacatcgagacattaaaccacaaaacttgctcttgtgcccgccagttcattcaaagcaggaattcattgatggcgagtttgttggtatgtgggaattgccaatattgaaaatagctgattttggattcgctcgtttcttgccctcaacctcaatggcagagactttgtgtgggtctcccctttacatggctccagagattttgcgatatgaaaaatataacgccaaggcagatttgtggtcggttggtgctgtcctatacgaaatgacagtggggaaaccgcctttcaaggcaggaaaccacatagaattgttgaaaaacattgagaaggcaaacgataaaatcaaatttccttcggcagctcaggtacctgaacctttgaaacaattgattaggtcattgttgaaatacaacccaactgagcggatttctttcaacgagtttttcaatgactcattaataacctgtgacttggatgataatgatcagcctctcgaaacctctcaaatggatgagaatttgtttatcagtgaatatatcagtcccatagctcctgccgagcgaatcaagtttttcaaagagcaaaagaaaaatgattcagttgttaaaaaaccc

SEQ ID NO: 4354 - DNA, 792 bp, Candida albicans
  unsure (63): Identity of nucleotide sequences at the above locations are unknown.
gaaaatgtttctatttcaattaatgcaatgatggatatcaatactatttatcgttcatctaancctacttataacaatcctcaacaacaacaacaacaacaacaacaacaccaatcacaaaacaatttgtttaataaggaaaacattactcctttgaattcaccaacaaaatcaatattacataattctccacaacaagccaaatcatctacttcacctcaacatttatataataaattggtaaatgccaattataatggtaattctccacaacctgggatccaacaacaacaaaacaatcgagcattacaaaacaatattaatcaattacaaccaccattaaataaaagatataaattaactgaagcagaattttatgccaaagccaatagtgccagaactaaaagattaacatcgattgctcaattatattttttagattattattgtgatatgtttgattatgttattaatcgtcgagaacgaactgctatagttgaaaaaaatttattaactgatccaatgtataaaaatgatattactaaacaacaatttgaatggaaaaattatattggtagagaacgagcattattacgtaaacgaagattgaaacccaaacataaagattttgaaatgattactcaaatgggtcaaggtggttatggtcaagtatttttatcacggaaaagagatactacagaaatatgtgctcttaaaattttaaataaaacattattagttaaattagatgaaacaagaactgtcttaactgacaagagaaattttaactaa

SEQ ID NO: 4355 - DNA, 879 bp, Candida albicans
atgatttttaaaggtcatattaaatttaatgattttggattagctgctggaactgtttgtaatgatagaattgaatcaatgaaaattaaattacaaaatttacaaaatttaaatgattttaatgatgattctaataatgataatcaccattatcaagtactttcaagtttaatttatgaacgtcaaaaaatttttaaacaaagtcaacaacaacaacaacaacaaaattttaataatactactgccaattcaattgttggatctcctgattatatggcattagaagttttagaagggaaaaattataattataccattgattattggtcattaggttgtatgttatttgaagctttatgtggatatccgccattttctggttcaaaacaagatgacacttattataatttaacacattggaaaactgctttaagaagacctcaaactaaagatggtcgatatgttttcagtgatcgaacttggaatttaattattaaattaatcgcatcaccaaataatcgattacaaaattttaaacaagttcaacaacaaagttattttagtgatattaaagattgggggaatttaagacagaaaacccctccatttactccccaattggataatgaagaagatgccggttatttcgatgattttgaagatgatgaaatgatgatgaaatataaagatgtatttgctcgacaagaacaaaatgaacaattactagaaaagtcaaacaccaccactactactactactactactacaactaagaatggtaaacgatttagtcctgggtcgaaatttaatgataattttattggatttacatttaaacataaatcaaatccaaattatgcattcttccccacgaactga

SEQ ID NO: 4356 - DNA, 1443 bp, Candida albicans
  unsure (37),(40): Identity of nucleotide sequences at the above locations are unknown.
tctccatatactctgagctgccggctcttacgagaanaanaggttggcctgttagaattactcgcaatctctagaagatctgaaaggcaaaaacagcaaaaacagacactaataaaccatcccaccgtagtggatgaagataccagaacaattacattagcattgaacaactccagcaccattaaatcacgtgatatggacccaacaattacaatgaacggtaatttagcatataatgaattgcaaggaatatacaacgagttgggatatggctacaattttgatgatgaagatgagaaagtacaagaaccgacggttacaaattatgatggatatgttacagagacaattaatccaccaacgactaatgccaatctaattccaacacaagtcgattcgcctcaaatcgatcaagtggcaacacctcctactgacagagaagaagagttcgacgatcgtgtgctaagctcgccattcgttgagcagccagtagctaatactcaaccagttgatccatttgatattggtttacaagaaagttttttggataatttatcgatccccatgagcacatattcaggttactacgataaatcaactacaaaagttgaccgcatcagaaaatttagagaaatcactaacaaaaatcaaacaatcaacagaggatcactgctggccataatcgactattgtggtcaagagttatattgtttactacatgaattaggacaaggtggctatgggtttgtatatttgatagaagctggatcaactggaaaactaaaagcattgaaaattgaaactccttcaagtaggtgggaattctatattttgcatcaagttcatcgtcgattaattggtgaagccggttataaacaaagatatttcattcgtgcagaagcattatattacttccaggacgagagttttttaatattggattattgtagccaaagtacattgttggatgttgttaacaattacaagaataaaggctcgtctttagaggagtgtcttgttatatttttcactgtggagttgttaaaagctttagaagcattgcattctgttggtattttacatggggatttgaaagctgataattgcatggtccgttttgaacctataaacgaaagtgattggagtgagagatatgacagaagtggcaaatttggttggtcacataaaagtatcaccttgattgattttggtcgggcagtggatatgactttgttttcactgggtacaaggtttgttagcagttttaaagctgatgaacaagactgtccacaaatgaatgaagggaccccgtggtcttatgaagcggactattatggtctagcaactatcattcatacattgctatttggaagttatattaaaatcaaaaaagacggtagcgaactcaaagtcttcactacgggactgacaggtccgcattag

SEQ ID NO: 4357 - DNA, 807 bp, Candida albicans
gacttaagcgcgtgtccggccagtccggtggtgaagacgaaatgcacagacgtgctgcattacaaaaatgatccaagatatttgaaaatatggctagagtatactaactattcggactcaccgagggatatttatgtatacttggctaaaaaagagattggaaaccagctagcattgtattacgaagaatttgccagatacttggaagcacaaaagaaatatactgatgctaatcagatttatgagttaggaatacaatcaaatgcatttcccttgaaacgtttacaaaagtcttatgagaatttcaaggaaaggcttcaattggaaatgagctcggtttcaacaacttcagatcttgtgcgagaagctttgaaagtgaaaagagggtcaagtgttgagccaggtgcacacgttgatcacggccctatcgcaaaaaagcctagactagaagttttcaaagatgatgacgatcaaaatcaaagtgtgctacatttgatatttggcgcaagtttgaatgatgacataaaattaaactcaacaaaacagagaatcaaagagaatactatatcagcaacagcttggaaaggtcgggtcttgaaacaaaaagttcctactcctccaaattcttcaggtgggaaaatacaagtgtttcgtgatttcgagcctcttgctttccaggccaaaaaactgatttgttacgatgagaagggaagagcgtacactttgattgaaaatccgggaaagaaatccgagcgagtacttgtttatatggatttaatatatcccgatgagtctcaagaagtttag

SEQ ID NO: 4358 - DNA, 1233 bp, Candida albicans
gtgaagactgctcgtctgcaagcattagctgatgttactgccccaactaatatttatgaaattcaacaaactaaatatcaggaagcacaacagaaattacgtgagaagaaggctagagaacttgaagaaatacaaagactacgagagaagaatgaaagacaaaatagacaacaggagactgggcaaaataatgctgacacggctagcggtggtagtaatattgctccaccagtacctgtaccaaataaaaaaccgccttctggatctggtggtggccgtgatgccaaacaagcagctttgatagcccaaaagaaacgagaagaaaagaaacgtaaaaacttacaaattattgccaaattaaagacaatttgtaatcctggagatccaaatgaattatatgttgatttagttaaaattggtcaaggtgcctctggtggagttttccttgctcatgatgttcgtgataaatccaatattgttgccataaaacaaatgaatttagaacaacaacctaaaaaagaattaattattaatgaaattttggttatgaaaggtagtctgcatcctaatattgtcaattttattgattcatatcttttaaaaggtgatttatgggtgattatggaatatatggaaggtggatcccttaccgatatagtaactcatagtgttatgactgaaggtcaaattggagttgtatgtcgcgaaactttgaaaggtcttaagtttttacattctaaaggggttatccatcgtgatattaaatccgataatattttattaaatatggacggtaacatcaagatcactgattttgggttttgtgctcaaatcaatgaaatcaatctgaaacgtatcactatggtgggtacaccatattggatggcaccagaaattgtttcacgtaaagaatatggtccaaaagttgatgtttggtcattgggtattatgattatagaaatgttagaaggtgaaccaccatatttgaatgaaactccattgagggcattatatcttattgcaactaatggtacaccaaaattaaaagatcccgaatctttaagttatgatattagaaaatttttggcatggtgtttacaagttgactttaataaaagagctgatgctgatgaattattacatgataattttattactgaatgtgatgatgtatcgtcgttaagtccattagtgaaaattgctcgattgaaaaaaatgagtgaatctgattaa

SEQ ID NO: 4359 - DNA, 1623 bp, Candida albicans
aacccaaaaaaaaaaatttttttttgctcactactagttgtcctttttaaactttctcttgaacagcagttttataaagaaccaatttccataatggatcaacaagaagcacccatatattatggcagatccgtaaataaggtctacaaccaggaatttatcattgatagtcgattcaaaatagtcaaggagttgggccatggtgcctatggtattgtgtgttcagcaaaatacgataatgggtccaaaaaggttcctgattcaaacaacggtaatgcctcatcttcagctaatgcatcgtttgtggcaatcaaaaagatcactaatattttcagcaaaaacatcttatgtaaacgtgctttgcgtgaattgaagttgttgcagttcttcaggggccataaaaatataacatgtttatatgatttggacattatccccaatcccatgacaggcgagtttaatgaaatatatttatacgaagaattaatggaatgtgacatgcaccaaatcattagatctggacaaccattgtccgatcagcactaccagtcgtttatttatcaggtattgtgtggattgaacttcatccattcggctgatgtgttgcatcgtgatttgaaaccaggtaacttacttgtcaatgccgactgtgagcttaaaatttgtgactttggtttagcaagagggttttctgagaaccccgacgaaaatgctgggtttatgacagagtatgttgccaccagatggtacagggcaccagaaattatgttgagtttcaccaactacactaaggcaatcgacatctggtctgttggttgtatattggcagaacttttggggggcaagccacttttccgtggcaaagattacgtagatcaacttaatcagattttaatgatattaggtaccccaccagaatccacgttacaaagaatagggtcccacagagcccagaactatgtcagatctttgccgattacgagaaaagctagctacgaagaacttttccctgacgccaacccgttggcgttggatttattggaaagaatgttgactttagacccacgtgagagaattacagttcgagatgcattgaatcataagtacttagagctttggcatgatcctaaagaagaaattgagtgccaagtcaaatttgatttcaagtcgtttgagactgtagatgggttggacgaaatgaaacagttgatcatggatgaagttcagaagtttcgtgaatttgtgaggaagccaattgaggaacagcagcgaatacaaatgcagctacatatgcaaaaacgtgaagaacagcgacaagaggaggaagagaaagagctactagaacagcaaagacagtttccagctcaagagagtatggatatttctcagaccccttacaataacttggaaacgaatataggtactcctcaggttgaagatgattatcccagaccacaagagttggatgagtttactttttcaaatttggaatcttcaagctccatgaatttgttccaagacatggctaaaccatcaggagaagagtatataaagctagaggaagagcttgggtttggattagatggtgctatgtttaacaactactgtaacgaccaccagtag

SEQ ID NO: 4360 - DNA, 1161 bp, Candida albicans
acaatgcatttattctatttcatttcatatataatatcaatacttctagtgtcgattattgcttcgccccgactagagcggatcaccaccaaatatttatcacctcagcaacagcaacaacaacaacgacgggatcaagcatataatcctgctacacctactaacaatatatatacatctgcatcactacaacctctagctgaacgatcgttagacgattgggatttaaataatataatattactcagtgatattaatggctcattacattgtgttaatcgtgatgatggtaatttaatttggtcgctacctatagatgaaccgctcgtcaaaattcaatccaacatcaaagacaaatcagcagcacataatattctttggtttgttgaaccatatcaggatggtaccctatattatttcactcctaaatttggtttaaataaattgcccaccagtatcaaagatttagttatggaatcacctttcacattgagtggtgacgataaaatatacactggtactagaaaaacatcattatacaatatcaacattcacacgggtgaaataaagtcttcctttggtaatactgatgaatgcccaataccgagatcgacgttacctccagaaactgcgttcaatgctgatgatacaataatgattggtaagacaacttatgaattgtcgatccattccaaatctaatagtgatgttatgtggaatgtcacttattcacaatgggtgcctaacaatatcgataacgatttgattttacaaaaccaacaatcattagacaagatatatttcacaccattccatgatcgttcgttattggctataaataaagacattggtactcctatatggataagcaaattaccagggttacccgtcagtatttttgatgttttcagcaatagtgctaaaacaaatgattatttgttattgccccatcctttgaaagtgttgaatgatttgcaatcgaatgatattaaccaccaaagtatggtgtttgtgaataaaaccctgagtaccagttcaaatagtcaagatcatctcaatgatcaatgggtggctatgagtttcagaaactacccaacattaatcaaaagtgcgcccatttcaaaatatccagaagtcttcaccacgggagtagacgacccg

SEQ ID NO: 4361 - DNA, 804 bp, Candida albicans
agatcatcaatccattcaaatagtaatagcaatggcaatggcaatggcagtggcaatggtgctaccaatggtagtgtatctaattctgccacatctggtaaacgattgactaaagctatcgatatattttctttgggatgtgtattttattatattttaactggtggttatcatccatttggtgatagatatttacgtgaaggtaatattatcaagggagaatatgatttatcattattaatggagaaatgtcctaatgatcgatatgaatcaattgatttgatttcgaaaattattagtcatgatcctagtcaacgtcctaatacggggaaaattttaaagcatccattattttggtcattttcgaaaagattagaatttttattaaaagttagtgatcgatttgaaattgagaaaagagatccaccaagtccattattattaaaattggaagaacatgctaaagcggttcataatggtaattggcataaattattaaatgatgatgaatttatggataatttagggaaatatcggaaatatagtccggaaaaattgatggatttattacgagccatgagaaataaatatcatcattataacgatatgccagaaagtttacaattgaaaatggcaccattacctgatgggttttataaatattttaatgataaatttcctaaattattaatggaaatatattatgttgttgaaaaaaatttcagaaatgaacatgttttccaaaaaatattattagttgatataggcccggttgtttcaatttcatttcaattcaagttttaa

SEQ ID NO: 4362 - DNA, 528 bp, Candida albicans
aagcgttggtccttccagccgcgtggtgaagatcaagaagatcagcagcagaatgacgaatcagttgttgacgaagagattatccctactaagagtttaatcccacctagttcattacctgctattaaatcgagaaagaaacttcaaattgagaataatcttgttatatctgataaaattcttggttatggttcacatggtacagttgttttccaaggtacatttgagaatcgaccagtagcagttaaaagaatgttacttgatttttatgatatcgccaatcatgaagttcgattattacaagaatcagatgatcatcctaatgttgttcgttatttttgttcacaaagttctgaatcagagaagtttttatacattgcattagaattgtgtctttgtacattagaagacattatagaaaagcctcaaaatatgcctaatttatgtatccccaaaaggaatgatattttatatcaattgacaagtggattacattatttgcattcattaaaaattgtgcatcgtgat

SEQ ID NO: 4363 - DNA, 1914 bp, Candida albicans
tcttatgatgcttcgaaaattgatatttggtcagtgggagtcattttattaacattagttttccataagaacccatttcaagttgcaaattattctgataagagattcattcaatttgttaacaatatagaagcattatttgatattttttcaaccatgagtggtgatttattttcagtattgaggtttagtttaacaattgaccctgataatagagatttaaagggatttttggatgaattgatgctgttacggtactttactattgatgaagaatattgggctagtgaatatgatgatgatggcgacttagaagaagaaagagtgggaggcgaaggggaagaaaatgaagggtattacgatgatgacgatgatgatgaccacgatgaggaagaagatctggaagaatttggattttttgatgattatgaagataagttatcggtttcacctcaaaagttagtggaaatcaaggctacaccggtaacaccagtaacaccaatttccaatgaaccaatgactaatcaaaaactggagattaatccagctcctcaagtttatgtttataaatccagtttactgaaatcaccggttgatatgacaccgccaatccctcataatcgtagagctgatgcattgttatcaacaaatactgatttgaaacctataccaatacatggaactgctgggttcaagttccatcgtaatacaaggaaaccattgaatgttgcttcgtatactcaaaactcatatatgaacaatcgattcaacaatactggtagttctggtttcaatgccaattacaatagtaatagttataataataataacaactataacagcaaatttaaccgagaagattttttcactccaaaatcagttttcaatcattatttggacaaatatggagaacagaaatttggtaagcaatccgcatttgcagatggctataaaaagcattcaccacctcaacgatacaaaaagagaacttggaagaagaataataatcacaaacgtaaaacgggttatcagcaacaacaacatgtatacaacagccagtaccctcatcctaccaataacgattcacataatcatcatcgcgggaaaagaaagtctagactgtattctacgtctaaattgaaacgaaacgttatcaatggtaatacgaatggcaatatcaatggaaatggaggtggtggcaacaatttgacatcaaattacccttcattacatcatggaagtacaatgagccaaattgttaatggaagtgtcaatggtaatgttggatccaatatatctaattctgggaaatatattccgccttatttaagatctccagcttatcaaaaatcaccagccattgaaccattaactgaggatttggatcatttgaatttgaataatgattatgatgaagtgttccatttggaaggagatttcgatatggcaagaaatggcgataatgatgatcaatatgacagtcatatagatgatgttggtaatggtccacatgattatcatttgaatgttgcaggtgactttccgcacaagagaaatccaaagcctgatgtaggtttcatgcatcagcatcaccctactgctacaaccattacatcaggagtaaatggtcaagttcaagcccaaggtcaaactcatggtagaagaaactctacttctttttctacttcttggatgttgaatactaatagaagagccggggcaatttttggtaatgaattaccattggcttcaaataataccaattcattaccaaaccaaacaaattcagttaatggtggtggcattaatactaacagtaatggtaaatacgttccgccatttagaagaaactcggtttcatcatcacatggtactgcaaatggtactgtcttccccacgggtggaaatccgcgt

SEQ ID NO: 4364 - DNA, 315 bp, Candida albicans
ttattattattcctattataccaatttcacttagcaatggaacaatttgaacgatatgacaagggcgaactattgcgagatcgatatctaaaagttaatgatataagtgaaggttcttacggtttagtgtcagtcgccaaagatacgcgtaacaatgactgtttggttgctgttaagtttatctatccagttgattacaaaaaggaccatcaacttcttgaaactacatcaagaccatcctcaagtcctgcgaaaatgagaaataacgggcacaacaaatatgaatctgagtcttccccacgggtggagatcccg

SEQ ID NO: 4365 - DNA, 2061 bp, Candida albicans
acatatgtgtcttattgtgggttgatgcaaatgaatgcggggtcattatataaacgtacagaagttattggaagagggaaatttggtgttgtttataaagcccaaaataaacaaacaaagcaaatagttgccataaaagtacttaatcttgatactgaagaagatgaagttattgatgttcaacaagaaatccaatttttgagtgaattgaaaaatgtccctaatatcactcattattatggctgtattttaaatgataccaaattatggatcattatggattattgtgctggtggatcattacgaacattattaaaagctggggtattagaagaaagatatgttgctgtgattgtacgtgaattattaatgacattatcggcagttcataaattgggagttatccatcgtgatttaaaggctgccaatgtattaatttcaaaagaaggtaatgttcaattatgtgattttggtgttgctgccaaaataactgccaattccactaaacgtacaacaatggcaggaactccctattggatggctccagaagttatacgtactggagacacctataatagtaaagcagatatatggtcattagggatcactatttatgaaattgccacgggtaatccaccatattgtgataaagatgcatcatgggccatgcaattaatttctaaactgactccacctcgattggagggaagagagttttctcaggcattaaaagaatgtattgccttgtgtcttgatgaaaatcctgaggaaagaccttcagctgatgatttaatgaaatgtaaattggttaaaatttataaaaatcatcctacatcaatacttaaagaagttatatcaagatatttattatggagagatcgaaattcttcgcgtgattcagttttcattaatttagaaaatgaacaagaagattctgttgatgaaattgttaataaaaatcttgatggtggatatcataatcaacagcaacaacatcagcagcagcagcagcagaatgatcaccaagatcatgatggacataataaccaaatacaagtcaaatgggattttgattctttgagtagtcgagaatatattatggaaaatgatattgatttggataaagttaatcaacaatataacaacaattttgatactcaacaaggaaacacttattctactttaccaactttaaaagcacctaccaccaaaaataatacattggcagccacaaaccaaaattctatgacagcactgaaaaataatagcaagtctaccactgaagttcctaaatctctacaaatgttgtttgaagataattcaggggaacaagaagatttggctccaccaaaaagcaatgtcaatattatggaaagaatggaatcaccaacaattgaaatcccagacatggacagtctttcacaattaccctgtgcatcaacaacaaacacaaccaaccacccacaattaaacaaaccaccggcgttatatcattcacaatcggcttctggaaatttggaaagtcgatttttttcgttgaatacgtcaccaaaagataatggtggtagtactggcggtaataatggcataaatagaccaagaaagaaaaccatctctaatactggtgggactgctaatgctcagtttcaacaaacatcatcagctgtacctcatacaccaccttatactacacctgcttcagttcgaacaccatcacctaaaccaccatcttctgtcaatttgttaaatgccacaagtatgagcaagactggatcaccatcaaaaatgaaagcattacaatcaagttcaaacccattattacaaccaataaatatgaaactggaaaatatgaatgcaggaatcactggtggtaccggtagtcatcctcctatgcaagcacctccacaattgattacccaacaatctttacctgttcttccaacttcatcatcaacttctgcatcagtatcaacatctacaacaacaacaacaacagctacatcaacgacttctggaggaatggcagtcttcacctacgggggctggaaggatccgcgattg

SEQ ID NO: 4366 - DNA, 396 bp, Candida albicans
cttttcttgttttatagtagtactgaaatagttcaacctaacctcatcatactaatgaattatactagagtcaattcaagtgaagaattagaagtatatgaagaagttggtcggggtggatttggagtactttatcgaggtataatcaaatcaacaaatcaagaggtagccattaaacaaattgatttagaaaaagatctgacggacttgatagaaatcaataaagaaatccaaatcatatcagaatgtcattgtcaacaaatcaccagttatatgggatcatttgtgaaaaattataaattatgggtgattatggaatttattgatggtggatcaatatttgaactattaaaaccacgaccaatagatgacgaaaaaattgttggttttatctag

SEQ ID NO: 4367 - DNA, 570 bp, Candida albicans
gcgcggttccgtccagccccggtgggtgaagaaaataatgttaatcaatttggtataaaccctgctcaagcagctagtatgcctgtatcaatgacacctgtcactgaaaaggaccattcacaattatttccaaacattaataatgatgaatctttagaaaagactaataatggtagtggtaatagtagatctcatcaaaatagtttactgtcacaaaagaaatcgcttgctagttcatcaagtcataatttgtctagtttaggattttcaaatggtaataatagtgctccaactactgctgctgcttctactgctccaccgccaccgcctactatgtttgcaaatagagggagttcaaatagtgttctgcaactgcaagctaatttcagtcttaatggtggaggggcaactaataatggtaatccaacttttagtgtgttcccaaccatacctaatattaatggtgatatattttcagatacagtttccaaacagaaattggttaatgaattagatgtgatgattacacttttcaatcaaggattagaagttcttgaagagattttatag

SEQ ID NO: 4368 - DNA, 1833 bp, Candida albicans
tgggtgatcaacatgatatatattcccatattccatgtcaaaatcaacgttttcctggtcagcgtgaatcccaacagtactacgaacaacaacaacactcaacagcatcatgatagtgatctttttattgaagttggaaggaataattcttatgatgccagtagtagcactatcaataacacaagttatatcaaaattttccttttttcggaattgaaaaaggagcaggtgcttcagcgaccacaagaagatttagaattagttctcaattctgacattgaactagatgataacataataccagaaacaccaacaaagaaactgctactaccgaatcagcaccatcaacatcacttacccctttacacgcaatccaagagtccattgttgaagtttgacactgagaaagatggaagaaggaatttgtcaatagtcttagataaatcaaatgcaactaaacgagaaattagcgaaccaccttcaacaccaatcaatatgtcatttgcaaagaatagttttaagaaacctatgaataatgctgaaagaggtgatgaccctgatagtataattgctcaacgcatagatattatgccatcgttagatgaagctgactcggtgtctgtttatccttcaaagatagatgaacatttaattgaaaagtttggaatgaagaatatcaagtatattggatcgggagcattttccattgcttttgaatgtttatttaataacgaaaagtttgctatcaaaagaactaaaaaaccacttattggaaaattggagaaacaaactataaaacgagaaattgaagcattgagagtgttgacaagcattaaagaagatgaagcaactaatatgcaagaacaagaagaagggaaagagtatctagtttatttcattgaggcctgggattttaataattactactatataatgacagaattctgtgaaggtggtacattatttgatttcttagaggaaaataaacattacaaaattgatgaatttagaatttggaagatcctaattgaaattctaaatgggttaaaatttattcatctgaaaaattatttacatttggatttaaaaccagcaaacatttttatcacttttgaagggtcattgaaaattggtgatttcggattggctactaaattgcctatactagaaaaggactttgatcttgaaggagatcgtaattatattgccccggaattgattaatgacaaaatttatactccgtttgcagatattttcagtcttggattgattatattggagatcgctgctaatataattttaccagataatggaacgccatggcgtaaattgagaagtggagacttgagtgatgctggccgattatcaagtgataatatttcgatgtttttacaacacaatccaaataccaatagtaatatcagtggtagtggaagtagaagtggtagtggcagtacaggaggcaatggtagtgctggtgatggatccacgaattcgactaattttagttataatagtttgctgggcaattcattaactttaaacccaccagtcaaagcagtacatggtacaagtgacactaataacacattggctagtgaattaagtaaaaacatagaaggtttgattcctagttgggctccagattttttggtccatggggatctgatgaatttggataagttggtgaataaaatgttgagaccaaacccatttgatagaccaagtgcttgtaatatattagaaatgcctgaatgtttaattgttgaaaaccgcaggaaatgtggtgctactatttttgaaggagaatttggtagtccacctgatgaataa

SEQ ID NO: 4369 - DNA, 1791 bp, Candida albicans
atcatgaatcatgacaacatagcactatttgaaagtgaattttcacaaatacaccttaatcatcgtaacaatcttgacaaaaaaatctcaccaactcgaaggaaaaaagtgttatatccaccacatctatacccggcgagacttgacgctggtagacaaatatcaaaagagttatcacctgcttccgtggctaatttgaattcaaacaaatatgacatgtcgaggactccagttacgccaaagagaacaacaagtgcaactaatagcgacactcaaaacaaactaaccaacttgcagagctccaaaaatccattccggtcagacagaacagtgagttatccagttccagataaaatatctaaaaaatcagatggccagttttcatttatgagagagacatcatcatcattacaaaagaaacaagtattgactcctgttaacgaaaggcgtaccaccagtggtagatcgtcatccgttggtctgtcctcaacgaagaaacgcttagagtattctagacaattatcacaaagatccaagagacacatctccaacagtctaatcaataaatcaaaccacgactttagtgattttgagaattcacacacaggcaagtaccgactgagtctggaatcatcacccgaagaatattaccaactaaacactgatgatatcgtcattgatgagtcaccttccaaaccaagaagacgcatgacccaacctctaccaaagaccgataacgtatttgatagattgtatcctaaatcattaaagcatccgactgcaaaactgccaacaacaaaaccgaacaaagaaacacaaaccctgaaatctattcctcgactgaaaatagagtctatatcacagttgcaccaatctttatacataaaaaaccctcaactattccgtgacgatacattggaagaacaacttcaagcacctcacgatatccaggaatctgatttagatggtctcagtatgtacgaaaaaggtgaacttgcaaggaaaaaagagatttattacatatcaaaacggccacttcggcaaatagcagtgaattcacaggaaaacaattttggatttgatgataataaaggtaattatattatcattccagaagatcatatcaattatcgatacgaaattatatctgttcttggaacagggtcgtttgggaatgttgttatggcaaacgaccataaaacaaacagactagtagcagtcaaaataataaacaatcacataaattggtcattacaacaatctatcaacgaaatcaaactactcaaaaacttacaggacagacaaaagactttacagaattcaaacataatatctattttagataatttcaattttcgaagtcatatgtgtattattacagaactattatcaacgaacttgtattcaatgttggagttgacaaatttccaagggtttggttatgatttacttcggtatataacgaaacaaatacttacaggattgcaattcatacatgatgctaacattattcattgtgatattaagccagaaaatatcatgatcaaacttccaccatctcctaaccataattggtttcaaattaaaataatcgattttggatcttcgtgttttgtcaatgaaaccagtttcacgtatattcaatcaagatactatcgagcccctgaagtactacttggtacaagttacgaccaaaaaatagacatatggtcattaggatgtcttgtcgttgaattgtttactggtgtcaccgttattacgtcttcacaacgccggggcagatccaagtag

SEQ ID NO: 4370 - DNA, 1455 bp, Candida albicans
  unsure (1430): Identity of nucleotide sequences at the above locations are unknown.
ccctcccctttatatagcgcgggacccgtcagctccgtagtgaagactgctgctgctgctgctgcggcagcggcatattatcttccaccagctagattgggaagatcagctctgattgttcaatatcaacaatatcaacaagcattacaaaatcaaagaataactaaacataagaaccctgcacccaaggcaaggaaaatatataataaattggatttaacgcctaaattccatcaacaacctaaatatagacgatgttctataaattcaattcatatatcaccagtcaatgccttatcgatatatttaacagaatcatatagtttatgtcaaccaagaaaattccaatattcgaaatcaactaatcctaaacgagtattaactaaaccactggaacctaaatataataatgggtatgataatgaagatagtgattatattttatatgttaatgatgtattaggaagtgaagaagggaaaaaatatatggtattagatttattaggttcaggtacatttggacaagtagttaaatgtcaaaatcttaataatcaaactgtttgtgctgttaaagtgatcaaatcgaaaccagcatatatgaatcaatcattaactgaagttcgattattagaatttttaaatgctaatagtgatgggaaaaatttcattcgattattggatacatttatgcataaagaacatctttgtttagtatttgaaatcttggcatcgaatttatatgaattaattaaacaaaatcaatttcaaggtcttaatatgaaattagttaaattattaactaaacaattgttagattcaatggctcaattgaaaaatttccaaatgattcattgtgatttaaaaccagaaaatatcttattatgtcaacccgataaacccaatataaaagtcattgattttggtagtgcttgtttcacaagaaatactatatatacttatattcaatcaagattttatcgatcaccagaagtaatattaggtttaccttatactgaatcaattgatatgtggtcattaggttgtatcgtgggggaattatttttaggtttaccaatgtttcctggaacttcagaatataatcaaatttttaaaattgttgatatgttgggtcctccaccaagacatatgattgaagttgggaaaaattcattcaatttctttaaaaagaaagtcaacaccaccaccatcaacaacaatgataataataataataatacttcagaaacaaaaccaatttatgaacttaaatcatttgatgaatattgtcaatttttagaatataaacgacaaaaacaagaaggtgctacatctacaaccaacaacaatactaatagtagtagtagtagtaatcatcatcataataattataaaaaggaacaaccaaataaaaattatgtcttctaccacgngggccggacggttccgcgattgcgt

SEQ ID NO: 4371 - DNA, 996 bp, Candida albicans
aaacaaaaaccaacaggtttaaaaaaaaaacaaaagcaaaaaaaagaaaagaaaaggaaaatttttaaactttttttttttaagtattttaatttttatttagttttttatccttgctcttaccaattaagaatggttgaagataaagatatagacttgaatattaataatttgaaaattcacgatgcgccaacacgaacaccaccggtaagcctgccaccagctttaccaacaccaccaactccctcagggattctgctcaacactacaatgcaagctaaattgatggcctttcaacaacaaagatcgaaagcagcagcagcagcagcagcagcagcttcagtttcatcatcatcatcaggtacgcaggcgtcatcgtcatctatatcagcttcaacatcggaatcgagtgtatcaacaataccagcaaatattaaccgaactgtatcgggtaaaaagaaacccaaaccaaacttgaaattaagtgatttaccattgtcacgtaataatagtttacaccgttctaacactagtgctagtgattcaagtgtgactacgccagaagcagatacccctaccggtaagatttcaaatgaaccacaacctcaaggtttgtttgctaattattctgattatgttgatataaaatcaggtcaattaaattttgctggcaaagcatcattacattctaaagggattgattttctgtctgggtcttcatttagagtttcattagatgaatttgagtatttagaagaattgggccgtggaaattatgggtctgtactgaaagtcttacataaacccaccggtgtattgatggcaatgaaggaagttcgattggagttagatgagaataagttcacgcaaatactaatggagttagatattttacataaatgtgactcgccatatattgttgatttttatggggctttttttgttgaaggtgcagtttacatgtgtattgagtacatggatggaggttcgttggat

SEQ ID NO: 4372 - DNA, 1581 bp, Candida albicans
cagggttgggttcagttgttacggtcaactacaccaatgtcacgacaccattctttcccacttgattatgattccccacccaagcatctaactgtacattcgtatcactcgaagtatcaaactatcagtagtttgggtaatggaagttttgggactgttaatttggcaaaaatcaagttctttaaatttgacctattaaatctgcacaaaaataaactgggtactttattatgtccattggaagactccaaatgtaacacatcgaatctagttgccataaaaacaatgaaaaagaaattaccattattacaagaatactccaatgtaaaagaagtcaagttcattttatctgtaccatctcacccatgtttggtacaaatatatgaaatgtttattgacgacatccagtatcagctacatatttccatggaagcgttaaaccaaaacttgtaccaactaattagaagcagaagaaatataaagttttcaccggtgactttaaagagcattctaagtcaattgctttgtgctattagacatattcacaagtgcaactatttccatcgtgacgtaaaaccagaaaatatattggttatcccaacattgcatttttacggttctaaagctgcgattccaccataccgtaaaaatgacaattttataatcaagttgggcgactatgggttggcgcgccatgtttcaaatatcaaaccttacacggcctatgtgtcaactaggtggtaccggtcaccggaaatattacttagacagaaatggtattcacgtccgattgatatttgggcttttggagcggtagcagttgagaccgccaattttgttcctctatttcctggttctaatgaattagaccagatttggaaaatattgaaaattttaggaactccatttgttcccgaacctaaagcaattaatgctagctatgtagttcccttgggtggttattggactgaggcattatttttgacaaacaaattaggaataaagttacctgatgagtcaggaatgagtattgaagatattgttcagcaccccgattcattagctttaattgaagtcattcaaagctgcttgaaatgggatccactggctcgagcagatgccactgaaattgctaaaatgcaatactttaaggaatctataaccatgatggatacttatttcgaaactgatactgtttcaatgaatacagctttaaataagctagcaggaatccccaattcaccttcacgaaaactactcacaccatcgaaactacagaaaaacagtaatggcacatgtaacaccactggcagtgttccagttttccaagattcagatgatggatatgaaaactattttggagaatatattgctaaacagcctgaacgaaatagttctgggaatgaaagctacaagctttttgcacagccgtggttgctaaaagtaaacgaggttcttggtacaagagaatctgaaatggaacccagaagagccgggaatgaagcacacgatttgaagaaaaaactgagtaaagttgctggaactaaaagatcattcacaacattttctttagatagttga

SEQ ID NO: 4373 - DNA, 1860 bp, Candida albicans
cagataaaaatcatgtcgattattccttacaataataacaaggatgtactttatcacaaccctaatgatgggattgtggttgtgcatgatcctcgtgaaaacactataaagctactatccaccgttgcatccgaagcacggggagaatcaaatgggagtcaacgaacaaggagaccatcacaggcctttaacaatgatcaattcccccataccacaagcatgacaaaatgtcccaactgtgggtttacatggaacgaattcaataaatccgggcccagaagaagcagctcgcattcctcctctggcctcttcaatatatcattaccccaggaatacttatcacagtcatttattcataccgactatttcaaattgttaggtaaactaccttccaatgaggagcatgcgtgcaaactgacgcttaataactctttgcctgaaggggtattcaatcaaggatattttaaacggtttttcaagaaaatagacccgtatacgcttggttcaggagcacacgcacaggtttacaaagtcaatcatattttgaacaatatcgttttgggaacatacgcagttaaaagaattaacattggcgggcaacttgaatttttgcagcaggttttaaatgaagtgttgattttgtacgagttgtctactacaggagctaatgagaacaatttaattagatataatcatgtttggttggaaatgggggagctagacgatctgaattcaatttttttcccaacccccaaattggctgacaggagagatatgaaagtaccatatgtttttattttgcagcaatattgtgatggcgggcacttggaagatttaatcaaatgcaatttcacaattgaggaaaatcttacttggaaagaaaaggtcgaattagaacggaagaaaagacgtgctgtaaaggtaggagatgaaacgttaccaaaacggaaacagtggcttagtacctttgaaatatggaagttctttcatgatgtcgcaaacggagtcaattacttacatcagaatggtattttgcatagagatatgaaaccgtcaaactgtttgttagatgtaaagtatgttccacatgagatgaaactgacttttgagagccaagaagattttgaactgcatttatacaatttgccaagagttttggtttctgatttcggagaaggaaagtttatagaaaagcgtcaaaatgtcaatctagaaaacttatctgatagacagggtaatacaggtacattggagttcacggctccagaattgtggttgtattcacgtgatcctaaatttggaaaagatggtaagaaattttacaatgatttcacctatgaaagtgatatatattctttaggattgattttatgttatttgtgcattgggaaactaccattttctgatatgattagagatgagaatgatccacaagaggcaagaagcaaaatcatgaattggtataataatttgagctctgcaagttttagtgaatggtttgagtcgcaaattcacgatagagaaggggttatggatgagtgtatggaagatttccagaaattagcgttcaaaatgatcaagggagaagaagaagtagttgataatggtactacctctcgtattgggtccaaggatattttgttgtatttgaataatataaagtgggaaagatttataattaccggtcatacttttatcagtggtaattcttggagtatgagcaatgaattggcaattattgaaaaagatgatctggatctacattcgttcaacaaagatcgtgtaccatctttgcttcaaaacgaggtgtttagtgatgccgaagatgggactatagaatacgccgtcttcaccgcaagt

SEQ ID NO: 4374 - DNA, 561 bp, Candida albicans
  unsure (11): Identity of nucleotide sequences at the above locations are unknown.
gaatacttaangtctaggtgctgcgggtcgaatacaaccaatccaagccaacgcaatccaacccaacccaactcaacccaacccaacccaaccatcttatcaaaaagatactactacattgattgttcatatatatttatatctattatggcatcgagagaactaacacctattccaacaggagccactactggtactggtactgcagccactaatggttcaaacacatcaacaccattaatgccatcaatagttcaaatatcacgaccatttttcactcataaagaaatatcatatttacataatcaaaccattccagaaagtcttaaaccccattataccaatattaaaaataacgtatttcaatttttatttcaaattattaaacaattaaaattcccattacgagtattagccacagccatgaattattatcaacgatattatttatttaataaatttgaaaccaataacaatagtggtggtggtggtaatggtggggccacttttgattcttctgatgatcctcattctatctctcatttctcgttcaatttttag

SEQ ID NO: 4375 - DNA, 801 bp, Candida albicans
tttggaaaccagaggattttttacttaacgctcaacgggttggccaaattatgtgattttggtgtcagtgaatttggtcacgaagtaccggaggatttctcaagtcctgttaaattatcgacagcatatgttggttctcccccttatgcaccaccagaagtcatgttattgaaagaaaaatcaagtacagaaataaaagcttttgcctacgacccattcaaaatggattgttgggggttgggtatgttgttgttctgtttggtttatggtggtgtgccatttcaacaatcaagtcccaatgaccacgccttccgcgattacaagtttagtcacaagagattttgcaccgatcatcatacttttaaatctaatcaagggtatcctagaggtcctggtagtgaattcaaattggctgctaaatttgaaaataatggtgcttccagagttgcttggaaattatgtgacccttcagaaaacacccgttatacaatggatatgttgtttgacgacccttggttccaatcagtggaaatgtgtatttatgagagcccagatcaagaagtgaatccatttgtgttgcctgggactggtgaaaatattgatacacactcagtctcagggtattcatcagtcaacaattcacaagcgccatctagaagagggacattcacatctcgtcctgttggaagtggtgctgggagcggatacaatagtcatgatgaaagtagcaatggtctcagctcaagcttcagaagcatgctagatttgaaggatattccacagcaaaataacaaaaactga

SEQ ID NO: 4376 - DNA, 978 bp, Candida albicans
  unsure (5): Identity of nucleotide sequences at the above locations are unknown.
aaagnacgccgttcgttttcattgttgaaggggcggaaacacccagcccatccccaaacttgggcagttattctcaattatattattcacatttcttcggatttctcaaaaccattatggatcccaccactagtggtggccaaatccatttattcaacacctgtcaatagaagtagaagcaactctgataggttgggccacgttccaccaacaggaagaaaagtgctctcaaaagcagagacatttacccatttacaacaattgaacactagaaatgcagccaaaaatcaattgagaaaccaccgaattccatcaaatcatttaagctcaccgcttagtgcagccccacattcagataaaattgtatataatccatatggattaaataaaactgcaacccaagaacgtcctaaaaataccagtttctatttatctggggttaatgatggagaaagagtgttatcgaacccagtagccagtcctaatgactacttaccagcggagttgcaacaacaacatgtcaatttgttagaggattttgaaattgacgttggcaccaagaaattgggtgatggtggatcttctgatgttcgtatcataaactcatgtcatcataaaaaagatttgtatgcattgaaaaaattcactttgttgtcaaaagagacagatgaggatttctataaaagagtactggaggagtataagattcatagaaaagctgccatctcaagacacgtggttgatgcttttgccattttgagaattcaatcacaatctaatttaaccagaggttggggtatggtaatggagttttgtggtggtggtgacttgttttcagttattgttaaacccggttggaagtctactccccttgcagaaaaatattgtcttttcaaacaaatagcttatggtgttaaatttcttcatgaccacgatatagtgcatcgtgatttggaaaccagaggattttttacttaa

SEQ ID NO: 4377 - DNA, 1986 bp, Candida albicans
agaaatagcgatgtaggctataaagatgaaacgggatacgaagagtttataccgggattagatttttcgagtcttgtttccaaatggaacagcaattctaattctaatttggatttgacacgaaacactacaaatgtgagtttgtataccacacattcaaacacaccaagaagtcgagatgggtcataccttgatttaaatctattgcattccaaagtggccccacagcctatcaaaacttcaactgatcaacaaagaaatttatcttactctaaattgcatgaatttatgaaaactaaacaacaaaaaaatgcttacaatagtaataataacaacgacgaggacaatgatatagtactgttaacaaaagacaatttttctcgatcatcatcaggattaggttctagccctggttctgtcaagcgtgaaacttctgctagttctatggcagaaacttcaaaagcaagaaagaaacaaaaatcagcgatcgacccgatcactggcgaggtcaattacgaactaatcctaaatagtttgccgcccaatttcaatgatatgccatattctcaacgtaagaaattggtaaaatcattttccgaatcaattgattattcgcagttttcattgtttgctaagaactatcttggttcctcagtgggttctgctaagacattgaaatggagtagtagtggtactggtatagcatctgcaagtagtagtttatctcgtcgaaatcgtgtggggagtctcaatacacttgccggaagattgttggcaagaacttcgactactgatttcaagaaactccaacaagcaatgaaaccaaagtacaatgttgatgaaaaaggtgctattgttttgggtcacgaattgggtaaagtaataggtttcggtgcatgggggacaatcagagagtgtactgaccagcaagatggaaccatacgagctataaagattgtaaagtcaactcgtgactttgatggagggccaggaattgcgaaccattctagtggtaatttgaattccaaaactgatttaactggttccatgaagagcaaaaatcctcgagttttagaagttttcaaaaaagaaattcagatatggaaacaattgcaccatgataatatattgccactcatagactactatgaaactgaagatgcgattttttgtatcatgaacagaataaatgggggaactttatttgaagttgttgattcctggggacaattcaacgctagagttaatctcatttgtggaccgttagaatacctgtttgaagagcaacgtcatagacttttaaaagtgattgaatgtgctcgtcaaatagttcaagcattgctctatatgcacgaagaaaaggggatagtacatggagatcttaaattagagaatgttttagtggaaagagaaaaaggtaactgtaaaatgattttatgtgattttggaatgtcgagagtttatagttcaagaattagtcgcaaatcatcgaaaagacacattcactacaagggcaacaataaactatcgattgatggcgatcttgaagatacacttatgatgagaagcagatcttccaatattgaatttcggaaaccgtattttggcggtgattcaccaagttctcgcaaattagattttgatataagagatgattcacgggttggactagcaaattttttccgagctcatggcccttcaatgcaatcaattcatttgactccagttgtttcagaaaacggacattcgccatctgatggctattttgatatcacaaacaaaaatgataacggtggcaacaacgataaaccaatgttttcaagatatcaacaggtgtgtaatgacggtaaagaagaacatggcattgattcgggtttgcctcattctcatattggatcattaccttatgcatcaccggaaattttacaaccttctccgccacctttgggtcctagtgctgatgtatggagcattttggtgtattga

SEQ ID NO: 4378 - DNA, 1680 bp, Candida albicans
cgtcgagacaatcgtaatagagatagttacattccttctggcccaaaaaggctggcagagagggataactatcgacctgacaatgaccgataccaacaacaagagaatagacctgcatcatcaataccacatagagaatcaccatcatcgttatctggtgcaacggctctgcatccatcacccaaagggccaagagattcttatgcatctggaatgaaaagaccgttgccttcgggaccagcaagcttccggaaaagacgtgatttcaattctaactccaacagaataccaattccaaagggaccaagacagggatttaatgagatggatggtggaaatggaaatggcaatggcaacgttgataattatagaagggcaagacaaccagagaaacagaaattatcccttgaacaaatttattgtatcaagacgacaaatcgtcccaatatatatcaaagagttctgcaagttggtgaaggaacatatgggaaagtatataaagctcaacataaattaactggagaatatgtggccatgaaaaaattacgattacaatcagaaaaggaaggattccccattacggcaattcgagaaattaaattattacaatcatttgaccatgctaatattgttggattattacaaatgatggttgaatataatcaaatatatatggttttcgattatttggatcatgatttaaccgggttattaactcatccagatttacaattacaagaatgtcatcgaaaatttattttcaaacaattgatggaaggattaaattatttacataaaaaaagaataattcatcgtgatattaaaggatcaaatatattattagataatattggacgattgaaaattgctgattttggtcttgctcgtacaatgaaaatagtgggtgctaatgaaaaaccagattataccaatcgagtaatcactatatggtatcgaccaccagaattattattaggggccacagattatggacgagaagtagatgtatggggtgttggctgtttattgattgaattatattgtaaaatggcggcatttagaggtatggatgaagttagtcaattatgtcgaatttttaatattatggggactccaactttacaaacttggcctgaaattgatcaattaccatggtttgaaatgttgaaaccgaaaattaacgtcaaaagtaaatttgctcaaaaatatagtgaatcaatgtcagtaccagcattcaaattagctgaacaattattacaattaaatcctaaattaagacctacagctgaagaagcattaaatcatgaatatttccaacaagatcctcaaccaaaaccattatattttttgaaagatatacaaggagaatggcatgaatttgaaactaaaaaaagaatacgtgcagaaaggaaaagaataaaagaagaagaagatgctcaattggctgctagtaaaaaagctgctgctgctcctgctgttgcttctgctcctgctgaggcaagtgcagtaaattccataaaggaagaagtggattctgttgatgccataacgtattctgaaaaattagtgaatggagatgacaataagaataggtcaagtgaaattgatctgaaaattgttgatagtgttgaagagcataataaaatggaagagaaaagtcttgatactaaaacaacctag

SEQ ID NO: 4379 - DNA, 1413 bp, Candida albicans
tggagccacaacggagccacgtttaacccatatacttggattcaagttgtttcgtttgatgtctccaaaaattctcaacaggaaaatggacacctgacaatggggtctaattttttgaatcttaatttgttcattagattaccaaatatgttaatacccgagaacgagaaaaccagtaaaaaacacttgttcaccaatttccaacagggtcaaggaactggcagtgatggcggaaacaatatcggagacttgttgattggaaccattaaattacctttgaatcttaaatgccatactcagcaaatcagattgatgaatcatgaatacttgaagttttccaatttcaatgctggtttacaggatcttgtttctaatgatatgggtgaaatcatgctcacgatagagttcaagcctttaaccaagaaacgtctttctattgaggattttgatttattgaaacttcttggtagagggtcatttgggaaagtgatgcaagttgtgaaaaaagataccaaacagatttatgccttgaaaattattcgtaagcaacatattgtgtcaagactggaagtcacccataccttagctgaaagaactgttttggcaagaatcaataacccgtttattgtgccgttaaagttttcgttccagtctcccgaaaaattatatttggtattgtctttcatcaatggtggtgaattgttctggcacttgcaacgtgaaggtaagttctcgatggacagatcacggttctatattgcagaattattgacagcgttagagagtttacacgaattgaatgtgatttatcgtgacgtgaaaccagaaaatatcctattggattatcaaggtcatattgccctatgtgattttggattgtgtaaattaaacatgagtaacgacgataagactaacacattctgtggaactccagaatacttggcaccagagttgttactaaatcaaggttatacaagaagtgttgattggtggactttgggtactcttttgtatgaaatgcttacggggttgccaccgttctacgatgatgatgtgccttcaatgtataagaagattttgcaaaacccattgagattccctgctttcttagagggaactgatgctcaagacttgttaattaaattgttgcaaaaggatccaagtttgagattggacgaggcatcggaaataaagagccatcctttcttcaaagatattgactggaataagttattgaataagagctatttgccaccattcaaacctaatgtggaaaatttgttagatacgtccaattttgatcccgattttacaaatgaaaaacctcaggattcagttgtcgatgactttttgactgaaagtgttcaaaaacagtttggtgggtggacatacaatggtgacaatgttttataa

SEQ ID NO: 4380 - DNA, 1476 bp, Candida albicans
attgagaggactgaaaatagtagtattttatttgttactattataatgacaaccaaactgcgaaaccaaccattatcattaaatacaaaccaatcaggtactggcgctggcactagtactgattcaatacctgcaggttcacatatcactgacactaatcagtcctttttattaccaggcttagcatctccaccaactatttcaaacactgccatgtttcaaaatccagcaccacatactatcagaaaaatggatttaagtatagaagtaccaccacatcaacttgagaataatgaacaaaataccactcctatcgatatcaacatgaacatgctcaaacattatgaaatattacaactcccaacaccaattttcaacacggggtcatttgctaattataaccaaccattgtcatcattatcatctaactcttcaaatgcatcaatatcaatgtctccaccaacattcagactgatttcccgagtgtgtagtttaaagcaacccaagagatatgtttctgaaccaatacctatttccacttcgaccagtgaaaataaagtcaccacgtctccaattacaccatcatcatcacctccaacattacaacaagaagagattgcaaagaaagaaaaacaaaagatattttattcaaaacgtttagggttgtctttcaattttgttgaagaaattggtaaaggaaatttcagtcatgttgtattagcgaaaaccaatatttataatagtgataacaatggaaacagtgtcaacaataatactaacgataatcaagaagttgtcgacttggcagttgctgtgaaaattatatctgtgccgatggaatcaaaacaacaagttcacaatttcaagtcattcattcgtcgtgaattaaatatcttgtaccatatttcccaccatccttgtatcacttccttgattgattatgacatatccttagacattcctattgaacaaattgaatcagacgtgataattgatgacgatgaattataccagaaaaccccaccacagaatttgagcatgaatccacactccgacgttggtaaatcaagctctcctgatcagtttatatttatgaatcattgtaatggggggaacttgcttcatttcttgcaaaaaaacaatagcaaacatcattatcttcataaccatcaccatcatcatcatcatcacaaccatcaacaaggtcaccatgataccatccagtactggcaatttttgaaacgaatagtgtgtgaattgattgtgaccacagcgtttcttcataaaaacttggtaatccatcgtgatctaaaactagaaaatattcttttgttgcatgaatttgactctttggcatccttgacgtcttccataccgtttggaaaatttattaatgtccaatgctatttaccaattttgagtgaatttggattgtcgaaaaaattagcaactccagattcattgtttaagtactaa

SEQ ID NO: 4381 - DNA, 1320 bp, Candida albicans
aaactccttagcttaatcatggagtcatcgacaaattatccaatggtgtctatgaatacaccgataaaaaagatccgagatctaaccttaaattcaccatcatcgggacatcagctcgatcttcatttgcatgacacctccacatttaacagcaacagtatctacccaagtcttgatgatatacagacgtctccaacagcagcaacaatgttacaaaaaggttattcacaaaaaatcactaacaatgttttatcggaactaaattcacgagcccaacaattgttggggtcaccaccaccgatatcacgactgaataattatagcaatggagattccagctccaacaaagtcatgaatagaagaaacaaacgctatagtactattcatatgaataaattcacacaaatggattctataaatcagcattattcggttcatatgaaaaccccatcaccacagaaatctgaatcaccgtcatcaggggagatggaggaatcggcaaccaaaagaagaagaacattgaatggatctgatcagatagttgctgttccagtaatacaaaaggaaaccactgttgagaataacagtagtcccaatagaaaaatatcaccttcgaaaggttcaagggatttgaattcaatattacgacggataacaacagagactggatctccaaataaagaaaattttgttaaaccatatcctccaaccaacaaattaagacaaagctcgttggaaatggctggtgtcgtacacacatcatcaccttcacaacatcaacaacaacaacaacagaaacttgctgatcctccttgtttatacaagaaacgctctattcctcaattgcaaaagaagtcttcccatcctacattaaaccgaaaatcttcaatacccactttgaacaaaaagtcgtcaatcccttcattacaacggaaatcatctataccaagttttagtgggactccgtcaccaaatatgccgtctatgtattttgcacatctgcctgttaatgacatgccaccaccgccacctccacatgggtcacatttgcctgcgctcaataaaaaaccgtcatttacacaaactaataagaatacccctcgattgactagagtcagtccatcgaaatcaatacctcttagtgtatcctccagaagtgttgattctcgtgccttacaaaactcaactaatcttccgacaatgacgaaatcaaagtcagtaacgataccccaaccgttctcattatacgataaacctacagtttcatcgtccctcaaatcgcttaataagtttcaaaaattcaaagataagctttcgtga

SEQ ID NO: 4382 - DNA, 1164 bp, Candida albicans
  unsure (52): Identity of nucleotide sequences at the above locations are unknown.
aaccagaaaatttgttattggatttcaataaaaatatcaagattcccgattntggtattggctgcattagaagttaaagagaaattattggaaacttcttgtgtttctcctcattatgcttcaccagaaattgttgctggtaaaaactatcatggagctccttcggatatctggtcatgtggtatcatcttatttgccttattgactggccatttaccgtttgacgatgaaaacattagaaaattattattaaaagttcaaagcgggaaattcaatatgcctccagaattgagtttcgaagctaaagatttaatcaccaaaatgttaaaagtcaacccaagggaacgtataaccattgatgccatattgacacacccattattggccaaataccctgaaccaactgtttcctattcttcgactacgacattggatataaatagtatcaatatcaaacagattgaatcagttgataaaatcgacaaggaaatccttaagaatttatctgttttgtttcacaattgtgatgaaaaaaccataatctcaagattattatcaccaaatagatgtccagaaaaaatgttttattacttgttgatgaaatatagaaacgaacatttatcaaattcaaattcattcaacagcagtaatgatgtggactctgctagatctttaccaagatcaacctcatatgtaaagactacggtaacagatcatgccacgggtgaaaagcatactacggtgaaaaaaatccaacaatcatcttccatttactcaaaccggtcattattgaaaaaatccacctcagcaaagggtaatgtattatcaaatatcaccaatagacctaatactccaaaacaattcagtgcatccagctcatttaataaaaagaaagctcttcatagtaaaacgcaaatttatgcatcacggagtagaaatgcatcatctcgttctttaaaatcaaattcatcaactggaagaaatggtaataatgcttctgtcacttcagtaaacaagattcccgagattactggtgctacagttttgcaaccaattcctatgatggctatgaatagaggtgacgagcaacagaataagaccaagaaaaatttaactggtacttttggcaataaatcttatattgaactttcagttgatttgtga

SEQ ID NO: 4383 - DNA, 351 bp, Candida albicans
  unsure (274): Identity of nucleotide sequences at the above locations are unknown.
tcaatgtcaacagttgttaatagacggtcatcacatcagtttgactctccgagtaatcatttggatcattcatcttcgatgaatgtggataaggtggttcaatcagttacaaatgccactaagcgtctatcacaaatatctaccaacaccaataactccaataagaaaagaaaaacccaaaataaaattggaccttggaaattacgtagaactttgggtaaaggttctactggtagagtgaggttagccaaaaacactactacaggtcaattanccgctgtcaaaattgttcctaaatcaaatttcaagaaattaaaaaatccaaaatataaacgctctaaagaagatgct

SEQ ID NO: 4384 - DNA, 996 bp, Candida albicans
tacctccccattttccctcgcaccaagaaaccccaaatcacaatgattagtaatagaaagagaccaagagttttaagtactgatggacattcgagtgtttctaatgacacagctacaaattctacaaatctatcagatacacctccttttagtcaccatcaccatcatcatcacagtcaacaactgcaacaacaacaacaacaacaaatgccaattttatctgatacttcaactgattcaagtaattcaagtttcccattttataaaccattacttaaaagtagtaaaattgaatcaagtatgtttactaatccatttttatcaattcatgacaggaatgggatacaattgcctgaatatggtgatgacgacgataacgaagaagacgaggaggatgaaattagcgataatgtccttgacaatgatgacgatgataattatgcaatagaagatgatgatgaagaagtggatgaagatgaaatagttgatatcgaagacgatgatgacgatattgaagaaattgatgggtttgataatgatgatgacattatattcattgaacaacgtcagctacccaagagaaatagtgatagtttattatatgatacacaagcattggaagcttataataaattcaggtcgaataagaataataataacaagaaaaagctacctccagctcgtatcaaaaagcaacgaactaattcattaccacaattaccacaagccaaatgtatttataataaattacccaattatattttacaaggacctaaattgggtaatatacggaccaatgtgatacctcatcaattgaatttacctccatgtgtggatgaaagtgggcattatattgtcaaaccaaatacattatttgccaatagatttattattattaaattgttgggtcaaggaacatttggtaaagttgtacaatgctttgatacagttcagaatgaacatgttttattcgaccacgacgctggacgaaccgca

SEQ ID NO: 4385 - DNA, 621 bp, Candida albicans
ggcactggtcagatatgtattgttactgaggtactcaagatttcattatatgattttttggaaaataataaatatattggatttccagggagtcaaattcaatcaatagctaaacaattgatacgaacagtttgctttttacatgatttaggaatcattcataccgatttaaaaccagaaaatgttttacttaaagatgatagttatcataaattgaaaataactagtctgacaatgacttcagcttatttagccttgaaaaatgataaacgaccagtgaaatttctgaaaatcttgagtttaaccgatatttatgtgattgattttggtagttcaatatttgatagtgaatatcattcactggtggtttcaactcgacattatcgagccccagaaatcattttcaattgtggttggtcatttgctattgatttatggtctgtcgggtgtatattggtggaattaattattggtgaaccattatttaaaactcatcatgatcaagaacatttgcatatgattcaaaaaatatcgggtgaaactattgatcgaaaaatggttttaatgtgtaaaaaacaaggtcataaagttggagaatatttgatgataattgtcgattaa

SEQ ID NO: 4386 - DNA, 708 bp, Candida albicans
gtggtgaatacacatggtcgttcttcctccacttcaaacaaaatgcaaggattcattcctgttgagtatttgccaccattaccaaccattgataccaataccaacacgattgtttcagaggcgccggaacaacaaaatttgactgtgccttctacagcacgtcatatgcaccctacagccagagcaaaatctgttggtggtggtcatatgcgtaaagattcgtatggacgcgtatcacacggactgcagaatccgttgccaccgcttccaacgtctatggcaagccagaatagccaagaagttgttgggaaagatacaagcgaaggcttttttgatgacgttcaattggatgatgttggatatcaagaagttccacaactcactgaatcggagatcattgaacagtataatatttccaaacctaatagcatgccatcaattgagcattgtaagacattgtttttgaaaggttttttcagtgttcaaactacatcagccaagccgttgcctgttattaggtataatataattaacgtgttgagtaagttgggagttaaattccaggaagtgaaaggtggatttgtatgtatgcacacgccttcggtacagcctagtcacagtaacgaacttgatgaggagaataaattgtatggcgatgccttcaagtcaaaatcgagtgattcatttgaagcagctgaaccagaatga

SEQ ID NO: 4387 - DNA, 555 bp, Candida albicans
tcaaaaacacctagtcgacaaccttcacttcagttgccgtctcataccccaacaacgccatcgggtcctaaatcacacaaatcaagtaactctattggaaacattggtggaaatgtgcccagacgtaagttttccattggtaatgcgtttaatacttaccgtataaaaaatggatctcaagttatgatgccaccaaatgcagcacctacagctaaagtgattcatgggttgtatgacgacgacgataaggagagaaatggtgaagacgacgatgacgaagatgactatggatatgatgattctgctgattcgctcaatggatatggtggtggtagtgatatgttgatttcttcgcgtattgagcaacgtgccaaacatcaacgaactgtcagtagttcgagtcagaaagctagcaagtcgccattgaagtttgaaattcatattgtgaaagttccattagtgggattgtatggtgttcaattcaagaaaatattgggtaatacatggaattataagacactagctagtcagattttaaatgaaatgaatttatag

SEQ ID NO: 4388 - DNA, 240 bp, Candida albicans
aaagaaaatttttacaaagataaagcatataagaaaatgtctgcagatggagaatttacaagaacccagatatttgggactgtttttgaaatcaccaatagatacactgagctaaatcccgtgggaatgggagcatttggtttggtgtgctcaaccgttgatacattaactggtcaaaatgttgcattgaaaaaagtcatgaaaacttttctgaactcagtattgggaaaaagaactacc

SEQ ID NO: 4389 - DNA, 666 bp, Candida albicans
cggatccttccagcccccgtgggtgaagacagacttcaagatccacaaatgacgggttacgtgtcaaccagatattatcgagcaccagaaatcatgttaacttggcaaaaatacgacactgaagtcgacttgtggtctgtgggttgtatcttagcggaaatgattgaagggaaaccactattccccgggaaagatcacgtgcatcaattctccattataacagaattattgggctcacctcctgctgatgtgatcgatactatttgttccgaaaacactttaagatttgtccaatcattaccacatagagaccctatcccatttagtgaaagatttgcttcctgtactcacgttgaaccggaggctattgatttattggctaaattgttggtttttgaccctaagaaaagaatcagtgctgttcaaggtttgacccatccttatatggaggcataccatgatccaaccgatgagcctgtttgtgagagtaaattcgattggagttttaatgacccacacttgccagtggatacttggagagttatgatgtacagtgaaattttagactttcatcaaactgttggtgtggcaaatgaaactgagggttccgaacaaccagacctgcaagtggagcaaaacaacttggattccgccaacggaacttag

SEQ ID NO: 4390 - DNA, 1182 bp, Candida albicans
tggtggagaaattttgatcaaatattaaaatatacttatctgtgtgaacctttatcatatcatgtttttaaacaaattttaaatgctttacaagatttacataatacgttgaatattgttcatcgagatttaaaacccgaaaatttattattcaataaaatccctttctttaaaagaggaataaatgataataacctagagaaatatttaaggaaatctgatgatattaatgaaaaaatcgatgaaggagaatttaaatatggtataggtggtggaactattggtgtaataaaattagctgattttggtttagctaaacaattaaatgataagaatattgctcaaactccttgtggtactactggttatactgctcctgaagttttccaatgtaggaataataataataataataataataataataataataacaatagcaacaacagtaataaatcaagtggcggttcaggttcaggttcaggttcaatttatcatcaattatttaaatcttccaaatctaaagtcaaaactaaatccaaacaactaagtataaccaattattctaaatcagtagatatttggtcattaggatgtgtattatacacattattatgtggattcccaccattttataatgatgatattgaaatattaactaataatgtaatcaatgggaaatttgaatttttaaaaccttggtgggatgaaatttcaaatgatgctaaagatttagtatcaaaaatgttaattattgatcctaatgaaagaattactattgatgaaatttggaatcatccttggattttgaaacatatgaataatgaaagtaagcaaagacaacaaaaacaagaagaagaagaagaagaagtaccaggttatttccctaatcataataagaatactaatattattaaacaaactatatttgaaaatgttcatgaagatataatcaacccaattaataaagaaaaagaagaagaagatgatgactactctttatcattggctccacctccaccatctcaacaaatatttagtaaatcacctagagcaatagcaattaaaaaagtatttgataatcctgcaatgacaaccaataaatcaattaaaaataaagcaagtatttgtcatggtgataataatgatgatgacatttattttgctaatcaagaacaataa

SEQ ID NO: 4391 - DNA, 1803 bp, Candida albicans
ttatttgatttgctcattaaacgaaacagaccatgtctgagaatatcaaagcttttattcgacatgggaagcaagccaatgatatgtaaagaaagcaacaacagcagccacagcaatatcaacaaccatttagtactgctaatgtccaatgaaaatccatttcaacaagcttccaacgaaactccagacagtatcaatgttattacccccaacgatatcataaatgaataccaacaaccagatcaagaaccacaacaatactatccccaacgacaacaacaacaacaagacccatatcaacaggaaacccaattccaacaacagcaacaaggagtgtataccaactataatcaatccgatgttaccctcaatgacaaaaacgcagattacaatagagtagcgctgcaacttgttgaagaagagaatgaacagagaaaaaaatctgtcaaatatccaaacttggaaaattatcaaatattagaccaaatgggtgaaggtgctttttccgttgtttataaagccaaacacttgtcgactggcaaagaagttgccgtcaagattttgcgcaagtttcaaatggaccaagctcagaaacaggccgtactaaaagaagtcactattatgaggcagttggaccacccaaatattgttagatttattgaatttatagactccccaacatactattatattgtccaagaattagttcctggtggtgaaatcttcactatgattgtgaagtatacttatctttctgaagatttatcacgttgggtgattactcaaattgctcatgcaataagatatttacatgaagaggttggtattgtccaccgtgacattaagccagaaaatttattgtatgtacctattgacttgaagccaagtgccaatcctatatcgaaattgagaaaatccgatgacccaaacactaaattagatgaaggtgagtttgtgaatggggttggaggtggtggaattgggacagttaaattagcagattttggattatcgaaacaaatatgggaacataacaccaaaacaccttgtggtactgttgggtatactgctccagaaattgttcgtgatgagcgctattcaaaagaagttgacatgtgggcgttaggatgtgtattgtatacattgttatgtggatttccaccgttttacgatgaaagaatcgaaacattgactgaaaaagttgccaaaggtgaatttacatttttgaaaccatggtgggacgaaataagtgacggagccaagaattgtgttggtaggttgttgactgtggacccaaaaaagaggtacacaattgacgagtttttgcaagacccttggatgcaaaaaacttctcttagtcagcaaccacagattccaatacctgttactaaccaatacccaccagctacaaaagttgctcatcctatacaagttgccaataatagatactccaagaagtttagatctaccaattctgatttatattctcctgcagctgttgctttgcgtgatgcctttgatatatctacagctgttcaccgtatgggtgaagaagctgctttgcaaactaaaaagcaagccccaattgaaggtttgattgaagaagaagaagaagagcacgaagaaacagttactaaggatggcagagttgtacaggatacctacaaccaagtcctaagaactcatcgtcatagacatcatttgaaaaataacaacaatccaaacgcttttgatttgaatcttggaggtgcatcgataatagaacggagaaagaacaaacagattcctattcaaagcagctag

SEQ ID NO: 4392 - DNA, 1791 bp, Candida albicans
aaaatattattttgggaaaccgaacctactataattttattaaaggaggttgaattagttaccatttgttattcaccagaccggtggaggaaatatcgtataatgttggtacctaaaaatgaacctcctacgccagcagccattgaaacatcgaaaaaaattatgtcaaaatataaaaagcaagtttctggatctaaagctgaattgcaagaagaagttaatcaacttcataccaaagatgttcaagcacatagatcgaccttgagaaatttctttggacaaagacctcctagtgaattgatttcatcgaatttagcagagtatttccctgacacaagacaaaaagatttggaacaaaccgttagaaactctgttagacatagtgttagattatctcgaagatttaatttaccagcgggggcattttcttcaagcgtatattctctcaacaagagacaatctattttgagtaattcaaccggttttccttcaaatcgtacaatgtccatttcttctggtgaacaacaaagtggggtatttaatactagtggaggtggtagtggtgggttaagaagagcacaacgaaccattggggatgtgatggtgaatagtattactgctattgatgaagtagtgaattcaaacgatacattttctgtatttaataaaccttcaacgtcattttcaaatcagccagtacaaccattaaataatcatgattcgagatccataatatcgtcaaaatcattaagtgggggaactgcattgcataggatttctatatctccaaattataacgacaaccctgctcatgatcgccattctacaattgaattattgaatccatctgactcagagggtgaagatggtgaggaagatggagaatttggtatttctgactatgccggattgagttctagttctggggagaatggtccgcctgaaaattggttaaagggggctagaattggttctggtagttttggtacagtgtatttggggatgaatccatttacaggggagttgatggcagtaaaacaaatcccgttagtcaatgagaatgggaataatagtgatactgaaaacatccaaaactccatgcaagaacaacaacgagaaatgatgttattaaaggaattgaatcatgaaaatatagttcgctattttggatctacaaccgatgagaattttttaaatatatttttagaatatgtgcccggaggttcagttcaatcgatgttgaattcatatgggccatttgaagagccattgataagaaattttgttcgacaagtattgattgggttaagttatttgcatggtgaagatattattcatcgagatattaaaggtgccaacatattgattgatatcaaaggtactgtcaaaattggtgattttggtattagtaaaaaagtcagtgccattgatgaagaagatgaagatttcaaaaaaacaggtaaaagagcatctttacaaggatcagtattctggatggcacctgaagtggttaagcaaactacatatactaaaaaagcggatatttggtcagttggatgtttgattgtggaaatgtttactggtagacatccattcccagagttgagtcaaatgcaagcattatttaagattggtaatcatattaccccgcaaattcctgaatggtgtactaatgaagccaaagaatttctaaagaaaacatttgagattaattttgaaatgagaccagatgcaattgaattattagcagaacaatttttaaatccattaattatgtcgaaacaatcataa

SEQ ID NO: 4393 - DNA, 1005 bp, Candida albicans
ttgctgtacgattggttcaaaggtccattcccggataagacatacgaagtcagtttacaaactcttccaccaggccttgaccaaattactagagctcaatcactggctaatttcaaatatgcaaaggactcagctggaatttacacaccaaaaaacaagaacccagttgaaatcttgcgtgcagatttgcattcagaacaaccaagaactttacttcctctgtcgctatcacctaatgatactagaaacaaatatcaagaagtggatcctggtcaactaggaagacctagaagagtcaatttcagctctaatttttcaacagcaataaaaagactcaaccaggtgtgctttgaaacctatcaaaccatgagaagattggaacattcaagacacgatgaagttgatgccagtgaatttccaaattgcgagaatccaactttgatcagcaaatgggtagattactcaaataaatatgggttttcttaccaacttaataacgacgacataggggttttgtttaacgatgaaaacacattgttgaaacgccataattcagatagatttttggaattaatctatcatgaaaatgaagggtggacttgtattgaaaactctcttgcaaaccctccagctcaagctaaaagacagttagagattgttgatttttttgcaaagtacatgaatagtaacttgtccaaagtcagtgaaattgaggaaagaaaagaaactgtgtttttgagacgctacaccagaactcctgattacataatgtttgagatgacaaatggaaactttcagttcaactttaaagaccaccataagatctgtatatccaaaactggtttggctataacacatatttcgccagggcgtttaactcaaactcaaccactaattctggttttgaagcaaggaaactttcagcatgaaaatgttccggactgtatggagaagataatggtcatcaaagaagctatcaagaaaaaagcatttaaagaagcttag

SEQ ID NO: 4394 - DNA, 993 bp, Candida albicans
tcggcgcgtcgtgcacaacctttacagccattgaatagtggccagctcaatgctagagctaataacattactcctgtcaaatcaattagacgcccaaaggaaaatgttcaaccaacagaccaaaaacaaaagaaaaagaaggaaaagttatcggcattgtgcaagacacccccatctatagtgagaactagaaatggacgagactatcgtcgaggcaactttttgggtgaaggagggtttgctcgttgttttcaaatgaaggatgcctctggtcaaatctatgccgccaaaacagtcgctaaggcatcaatcaaaaacgagaaaacaaaaacaaaactattatcagaaatcaaaattcacaaatctttgagacatccaaacattgttaactttgttgattgttttgaagatgatgttaatgtatatatattgttagaaatctgccctaatcaatccttaatggaactcttgaaaacaaggaaaagagtgtctgaaccagaggttagattctttatggtgcaaattgtcggtgccatcaaatacttgcattctagacgtgtaattcatagagatttaaaacttggtaatatctttttcgacccagaaatgaatttaaagattggtgattttggcttagcatctgttttaccctcaactgattcaagaaagtacactatctgtggtacaccaaattatattgctccagaagttttaggtggtaagaacactggccatagtttcgaagttgatatttgggctattggtatcatgatgtatgctttgttggtcggtaaacctccatttcaagctaaagatgtcaatgttatttacgaaagaataaagaaaacagaatactatttcccagaggacaagccaatttctgagtctgccaagcaattgattaaagacttgttgagcttgaatccattacacagacctaccatcgatgagataattgctgtacgattggttcaaaggtccattcccggataa

SEQ ID NO: 4395 - DNA, 228 bp, Candida albicans
agactaaagagccatcctttcttcaaagatattgactggaataagttattgaataagagctatttgccaccattcaaacctaatgtggaaaatttgttagatacgtccaattttgatcccgattttacaaatgaaaaacctcaggattcagttgtcgatgactttttgactgaaagtgttcaaaaacagtttggtgggtggacatacaatggtgacaatgttttataa

SEQ ID NO: 4396 - DNA, 1185 bp, Candida albicans
atcaagtcaaggtcaatcaagaacgaaagaaagaaagaaagaaagaaagaaaaattttgtccaattactaacaaaaatatgtctgccaaaatagaacttgtaacggagaatgtcaccaatggccactcaggtgcgtcagaaaccatccaatacactaaatcacagatggttggacatgggtcattcggagtggtatttcaaatacaacttcaaccttccaatgaaataggagcagtgaagcgtgtgttacaggacaaacgtttcaaaaatcgtgaattacaaatcatgaaattggttcatcacagaaatatagctgatttgaaatactatttctacaccaacaatgaaaaaaatgaactttacttgaatttgattttggagtttgtaccagaaactctttacaaggctagtcattattatgtttccaaaagattaaacatgcctccattagaagttaaattatacacctaccaaatgtttagagcattaaattacattcattcacaaggcatttgtcatagagatattaaaccacagaatttgctcatcaatcctgatactggtgagttaaaattatgtgattttgggtcggctaagattttgaaccctagtgagcccaatgtgtcgtatatttgttctagatattatcgtgcacccgaattaatctttggtgctactaattatacaaccaagattgatgtatggtcagctggttgtgtgatggccgaattaattttgggacaaccattatttcctggtgaatctggtatagatcaattggtggaaatcatcaagatattgggtacaccatcgagggaacaaatcaaaaatatgaatccaaattatatggaacatcgtttcccacaaataaaaccaatacctttacaaaaaattttcaaaaaaatgagtccagattgcatacagtttttaatcaaagtattacaatattcaccaattgatagaatttcgtgtattgaaggattaatcgatccatattttgatgaattgaggaatgaaaacacaaaattaccaaattatagaaaaatattcctgcaacaatttcatagtaataattctagtgggtttggcaatgctgccaattatcaattgtacaattctcaacctgatttaagagatttaccagaattgtttttcttcaaccaccggggctggaaggatccgcgc

SEQ ID NO: 4397 - DNA, 1236 bp, Candida albicans
actactaccctagcaatgcctcaatcatcgtcaacttttataaatgaatatactttacctgatgtggtggaaaattcttcctcgcgtgccagtaaaatgacaattaaagaatacaagagaataggagaaggtgcatttggtactgttgttgaagctatgttgaaatatgaaactaattcgtctaaaggaaatgatggcactgggtcacatttacttggccatttccgtcatcatagccatagcgacaaggataataataatacaaccaacaacaacaataataacaacaaagatggtgaatggttaggaccatttgctattaaacgagtccctgcacaaactgaatataaatcacgagaattggaaattttacgatttgtcagccatcctaatattgtcagtttacgattttttttcgataagaaaagttcttctgataataaagtttatcaaaatttagtaatggaatgtttaccatcaaatttacaatcagaaatcaaatattatcgtcaatccaaatacactattccatatccccatatgaaagcttatactttccaattggctcgagccatgctctatttacacggatatggaatcagtcatcgagatattaaaccatcaaatatacttgttgatccaaacacggtgagattgaaaatttgtgattttggatctgcaaaaaaattagaaccaaatcaaccttcagtgagttatatatgttcaagatattatcgtgctcctgaactaattgttggatgttctttatatacaaccaaaattgatatatgggggttaggatgtgttattgcggaaatgtttttgggtaaaccaattttccaaggtcaatcacctgaatctcaattgaaagaaattgctaaacttttaggtccgccaccaaatacttttttcttcaaaagtaatcctcaatatcgtggtaatatgtatactacaagattattcaattgtagtatagaagaaagatttaaacaaattttcagtaattcaccactggatgcaattgatttattgatgaaaatattggtttatgatcctgatgtaagagctagtcctagaagagtgttgatacatccatttttcgatgaattgaaatcttcacaatttaaagtttatcctcgtgggtcatctactccaattgaattgcatttatttaattttagtgaatatgaattggaattattgggatctttgaaaaatgaatttgtgaaatcataa

SEQ ID NO: 4398 - DNA, 915 bp, Candida albicans
aaacagtggttaataatcaagatcctaaaccattatttagaattgttgaaaaaagctggtccaagtgctaatgggaatgtttatttggcggaaatgatcaaagataataatcgaaagattgcgattaaacaaatggatcttgatgctcagccccgtaaagagttaataattaatgaaatcttggttatgaaagatagtcaacataaaaatattgttaattttttggattcttatttaattggagataatgaattatgggtaattatggaatatatgcaaggtggttcattaacggaaatcattgaaaataatgattttaaattgaatgaaaaacaaattgccactatatgttttgaaaccttaaaggggttacaacatttacataaaaaacatattattcatcgtgatattaaatccgataatgttttattagatgcatatggtaatgttaaaatcactgattttggattttgtgctaaattaactgatcaaagaaataaacgtgccacaatggtggggacaccatattggatggcacctgaagtggttaaacaaaaggaatatgatgaaaaagttgatgtttggtcattggggattatgactattgaaatgattgaaggagaaccaccttatttgaatgaagaaccattaaaagcattatatcttatagctactaatggtacaccaaaattgaaaaaacccgaattattatcgaattcaattaaaaaatttttatcaatttgtctttgtgttgatgttagatatcgtgctagtactgatgaattattagaacattcatttattcaacataaatcagggaaaattgaagaattggcaccattattagaatggaaaaaacaacaacaaaagcatcaacagcataaacaagaaacactggatacagggtttgcataa

SEQ ID NO: 4399 - DNA, 192 bp, Candida albicans
ctgatattagacatttccttactgatgatttggccagtgttcctagataatccagctatgagtaaagatatggaacaacgtgaattggatgctaagaatggaggcggcagaaagaatccaaaggaagatttaccatttattggatacacttattctagatttgattatttgacaagaaagaatgcgttatag

SEQ ID NO: 4400 - DNA, 1251 bp, Candida albicans
catctagaaaattattatactctgtcagtgagccatgccattgagagaaatcaaagacgattggagttagaaaataaaattgccaatgaagatattggatcttcagaagaacgtaagaatcgtcaattacaaaatttagggaaaaaggaatcacaatttttacgattgaaacgaacaaaattggcattagaagatttccataccgtcaaagtcattggtaaaggtgcttttggtgaagttagattagtgcaaaagaaagatactgggaaaatatatgctatgaaaacattattaaaatcagaaatgtttaacaaggatcaattggcgcatgtcaaagcagaaagagatgttttggcaggtagtgattccccttggattgttgcattatactattctttccaagattcacaatatttgtatttgattatggaatttttgcctggtggtgatttaatgactatgttaatacgttgggaagtatttactgaagatatcacaagattctatatagctgaatgtgttttagccattgaagccattcataaattaggatttattcatcgtgatatcaaaccggataatattttaatcgataatcgtggtcatgtcaaattgagtgattttggattatctactggattccataaaactcatgactcaaattactacaataaattattagaaaaggaaccttcaaacactcatttacaacctaaccaattaacaagtggaagaaactcggtgatggtggacgccattcatttaactatgtccaatagacaaaccatgcaaacatggagaaaatcacgtagattgatggcgtattccactgttggtactcctgattatattgctccggaaattttcattcatcaaggttatggacaagaatgtgattggtggtcattgggggccattatgtttgaatgtttgattggttggccaccgttttgttcagaaaatcctcatgacacatatagaaaaatcttgaattggcaagaaagtttccaaattcctgaagatgttcatttatcaccagaagctgaagatttaatcaaaagatttttaacttctgccgaaaatagaatcggtagatatggtggtgctgaagaaatcaaacaacatccatttttcagaggagtcgattgggatagtataaggggtgttcaagcgccatttgtacctcgattgagttcaatgactgatattagacatttccttactgatgatttggccagtgttcctagataa

SEQ ID NO: 4401 - DNA, 1509 bp, Candida albicans
  unsure (1443),(1456),(1474),(1475),(1476),(1506),(1508),(1509): Identity of nucleotide sequences at the above locations are unknown.
gacatgacaacaaaccctgctttggcggctgctcaagcatctcataataatattcctacaaagcaaatgaatcattcaacttcatcttcaaacggtaacggtagcaataattcatccgtggttggacttcactacaagattgggaaaaaaattggtgaaggttcttttggtgtcatttttgaaggtactaatataataaatggagtacccgtggccataaaatttgaacctagaaagactgaagctcctcaattacgagatgaatatagaacttataaacatttacaaggatgtgacggaattcctaatgcatattattttggtcaagaaggattacataatattttagtcattgatttattgggtccttctttagaagatttatttgattggtgtggtagaagatttagtgttaaaaccgtggtacaagttgctatacaaatgttgactttagtagaagaagttcatcgtcatgatttaatctatagagatatcaaacccgacaattttttaattggaagaagaggtgctactgatgaaaataatgttcatttgattgattttggtatggccaagcaatatcgtgatccaagaacaaagcaacatattccatatagagagaagaaatctttgagtgggacagctagatatatgagtattaacactcatttaggaagagaacaatcaagaagagatgatttagaagcattgggtcatgtatttttttatttccttagaggccaattaccttggcaaggtttaaaagctcccaccaataaacaaaagtatgagaaaattggtgataaaaagagaactacaccagcagttacattatgtgatggcttacctcaacaatttgctgaatatttagattcagttagatcattaccatttgatgctgaacctccatatgaagaatatagaatgttattattgtcagtgttggatgatttgggtcaagcttgtgatggagatatggattggatgcatcttaatggtggtagaggttgggatgctacaattaataaaaaacccaacttgcacggttatggacatcctaatccaccaaatgaacgtgaaagaagacatcgtgatcaaagaagaacaagacaacatcaacaactgcaacaagtacaacaacaacaattacaagctcaagatcaagcacaacaattacgacaattacaacaagcacaacaggcacaacaacaacaacaactgcaacaacatcaaccactatctgcagcccagttacatcaacaaaaattacagcatttggttaatcgaccattaccaccaattaaacaagaatcacaatcagcaatacaaagtggtaatggacatcatgaacttttgaataataatttaggtgatcagcatggaggaaaacatgaaggatacagttcacgaccagatcaatatcaacaacaacaaatggttgcngaagaagccgggnaccccgggttttggtttnnnttgtgttgtcaaaaagttgtaaaaatatcntnn

SEQ ID NO: 4402 - DNA, 1419 bp, Candida albicans
attaacttctatctattcccattcccattcatgaattttggaactagtcatagcagtagtagtaaaaattcccacaataataatgttgtgggattacattataaaataggtaaaaaaattggtgaaggatcatttggagttatatttgaaggagtaaatattcttaataatgctcaagttgcgattaaatttgaacctcggaaatgtgaagctccacaattacgtgatgaatatcgagcatataaacaattacaagggagtaaaggtattcctaatgcttattattttggtcaagaaggagtacataatatattagtgattgatttattaggaccttcattagaggatttatttgattggtgtggtagacgattcagtattaaaacggtaattcaagtagctatacaaatgatacggttagtagaacaagttcatcaacagaatttaatttatcgagatattaaacccgacaattttttaattggaaaacctgatactccagaggctaatcaaattttttttgttgattttggtatggcaaaacaatatcgagacccaagaactaaacaacatattccttatcgagagaaaaaggcattaagtggtacggcacgttatatgagtatcaatactcatttaggtcgagaacaatctcggcgcgatgatttagaaagtttaggtcatgttttcatgtattttcttcgaggagcattaccatggcaaggtttaaaagcccccaccaataaacaaaaatatgaaaaaattgggatgaaaaagcaaactacatcaattaatgaattatgttatggatttccaatacaatttgctcaatatttgacttatgtacgtaatttaaaatttgatgaaactcccgattatcaatatttagtgggtttaatggaaaaagctctgatttccgctgggattgaacttgatggtcattttgattggatggatttgaatggtggtaaaggttgggatgctgcattaaataaaaaagctaatttacatggttatgggaatccttatcctcatccttctcagggacaaagacggcagcagcaacaacagcaggaacaattcaaacaaccactatcatcaccaaaatctcaacaatacaattcaccccatcaaccattacttgggaattctcgttcaagagataattcattatcatcacctagaaataataataagcttggttatcaatctatacaacaacaacaacaagattctcgcaatgcaaaatttttcaattccaataacgcccagcaacagcaacaacaacaagcatatttacaacagaatggaatgataccgattagagataatgatgtagaattacattcagatatgtctagttatacaaggaaaagaagtggaacttggttatcctggatattttgttgttgctcatga

SEQ ID NO: 4403 - DNA, 1035 bp, Candida albicans
ttaattatgccacaaccacctccaaatgcatataaagcaggtactcgattaacagtaggatcacataaagtttctattatcaaatatatctccgaaggtggatttgctcatgtatatacttgcacaattgatccaccttttcaaggatcgactgttgcctgtttgaaaagagtagtggtaccaagcaagtggcagttgagtttattgagacaagaagtagatgccatgagaagattaagaggtaataaacacattgtatcatacattgattctcatgcttcccgtttaggtgattccaatacatcaggtaccaatcatagtcaacaacaacagtatgaagtatttttattaatggaatattgtgagaataatggtttgatagattttatgaacactaggttggtcaataaattgactgaaaaggagattatagatataatgtatcaggtgactataggtgtggccatgtgtcatcatttacgtccacctttgattcatagagacattaaaattgaaaatgttttaattgatgggaaaggggttttcaaactatgtgattttggctcgtcggtaaattatttaccaccaccaagaaaccctcaagaactacaattaatgaaggatgatttaatgcaacatacaactccacaatatcgtgcaccggaaatgatagacttgagtaaaggtttccccatagatgacaaactggatatttgggcgttggggatattcttatacaaattatgttattacacgaccccctttgaacgacctaatcaaagctcgttacaggagttagaacatacaatattgaactgttcagaaactttgcgttttagtgaccaaccgggtctgatcttttcaccacgattgaaaaatgctattaaagtttgtcttcgagcagatcccagaagaagacccaacgccgtgcaattgttgggtgagattccggcaatgaaaagtgaaaagaccatccctatggtggttccatccgcgttttttaacaacagagaactaaacaagcactggctttag

SEQ ID NO: 4404 - DNA, 777 bp, Candida albicans
aatattttacttcatcaatcaggacatattatgttgagtgattttgatttatcaaaacaaagtgaacgggcgaaaaacccggaaatatcatttcataaatcaggtatgcatttatcatcagcggggagctctaatcatcacaatggaccagcaattgatactaaagcatgtatagatggattccgaactaattcctttgttggaactgaagaatatattgcaccggaagtgattcgtggtaaaggtcatactagtgctgttgattggtggacattagggatatttctttatgaaatgttatttggaactactccttttaaaggtcaagatcggaagaaaacgtttgctaatgttttgaaaaaagatgtcaaattttccgacacccaacaactgatttcttcaaattgtcgaaatttaattaaaaaattattaattaaagatgaagaaaaaagattaggttccaaaactggagcttcggaaataaaaaatcatgcattttttaaagatactcaatgggcattattaagacatcaaaaaccaccaatgatccccgttttaactaaatcaacttcaacttcaaattcaaacaaaaaatatgaaaaaccaatggaagatactgaagaaattgatgatgtgacatcaatatcaaaatcaattaatgaacaaatagatgatccattttcacaatttaactcagtgactttaagatatggtggtgaatttgaagatttaaatctacttcaaccccgacggctggaaggaaccgaatttgcgtta

SEQ ID NO: 4405 - DNA, 945 bp, Candida albicans
ggcgcggatccggccagcctcgtggtgaagaccataaatgtggacgagaatgaatactcggtaaagcatcatttggaacaactaacaccatatgattggcatttgattgctaatgccaataagatagttgagatcagtagtttgggcgaaggtaatggaggagctgtaaccaaatgttacattccacaattgcctaataaacagatatttgcattaaaattagtgatgtgtgatcctaatcctgacttacaaaaacagatattccgagaattggaagtggccaagaaatgccaacatcctaatattgtgaaatattatggaacatttttattagagaaacaatcaatgatagggattgctatggaattcatggatggtcaatcattggattccatatataaagaggtcctcaaacgtgacaaaacaaatagaataaatgaaaaggtattgggtaaaatacctaattcaattttgtcaggtttggattatttgcatctgaaaaatattatacatcgagacattaagccttctaatattttgttggataccaaggggaatgtcaaactttgtgattttggtgtcagtggagaagcggttaattcttttgcttctacttttgttgggactcaatattatatggccccagaacgtatcactgggggtaattattctatcaccagtgatatatggtcattgggtatgagtcttttggaagtggctaatgggtgttttcctattattcagtcgttaggtcctattgaagtagttgaaataattctgaggagtaatttagaattgaaagactgtgaagaagacaacatattttggactagagagtttaaacaatttattgcaaaatgtttgacaaaggattacctcagacgaccaaaaccaagtgatttcctagctcatgatgaatggtgcttgatccaactgaaagagtag

SEQ ID NO: 4406 - DNA, 951 bp, Candida albicans
aaatgtgagcacccattgcatgattatattcagcaagtgttacgagaatttaatactatgaaaatatgcaatcacaaaaacattatttctatatttgatcttgccacaatatctgatactaaagaccttgcattaattcttccttattatcccaaaggtgatttattagattatttatctcgattacgacgatttaaaattgaattatcggcaagtttaaaagattccatttttaaacaaattttaaaaggagtgaattatcttcatggtaaaggaattgttcatcgtgatttaaaaccagagaattttttaattgattctgatgggattttaaaaatatctgattttggttatagtttaaatattaataatcatcctttatgtcatgaatattttaaatcaaatcctcatgaattatattgtggtaccaatagttttaaggctccagaattatttaccattgaacatgaaataaaatcaaatcgatttgattttgatggatatttcaaagatgataataccattacgtgttttgataaactgaaatatttggattattgggcattgggaataatttattttgtcatttttttaatgaaaagtccttggacaactgcaaattctttagattcgaaaaatttagcttatattaattattgtaaacattatcctaattcatcattgaaattaaaagaaatcttgattgaattgaacaagaaatctccttcactgtttattactacttctaacaataacaataacaataatggtcataataataattcagcattaaatttatttaaaagtttacattatgattctcgtgaatcaatattaggattattaaatcctcaaccagataaaagattaactcctaatcaattattgaatactaattggttatcacaagtttatgctgatcctaaagatttaataaaattattaaaatga

SEQ ID NO: 4407 - DNA, 294 bp, Candida albicans
ttacacatatattgctatccgggggttccgcctttctattctgagagtaaagataaaatactcaaggcgtcacgtctaggccagctaaattttgcaaaaccacaatttagtaaaattagtctatcaagtaaatcgtatatcaagaaattactccgcgttgaagttacatctagaatggatatcaacgattgctttgatcataattggatcaaattgcaaagaaaaaaattagagaaaaagtattattcagttgttggagacagacaatcaagcctcccaccaccattgaattaa

SEQ ID NO: 4408 - DNA, 489 bp, Candida albicans
ccaaaaaggaaaaagcctaatattatccgaatatatgatactattacaagaaattcaaagatctttcttttccaagacttgatatgtggtggtgatttattttcctatctagtaaaagatgattatttgaaagtgattcctgaaagggaagccatttttattgttttccaaataatgaaagcactacattttctacataaaaaactaaaaattgtccaccgggatcttaaactagacaatatattgcttgagctacctattcccggatcaaaaatctatttatgtgattttggaattgcaaaacatcttgggtacaacaacagaaccaacacatgtgtgggaactctagagtacagtgcacctgaagtattcaaggctgacaaatctggaaataaagcagtgcaatcatacgacttcaaatgtgatacgtggtcattgggtgtaattacacatatattgctatccgggggttccgcctttctattctga

SEQ ID NO: 4409 - DNA, 807 bp, Candida albicans
aattttccagtacaaatcaatctactagggctgcaaaaagaaaaaatatataagaacaacgaaatatccagattatttcaaatcatctttttctttttagattgtttctcccacctaacaatggacgtgattgggatattacaaattattctaattgataatactcaaatacttcttagcaaattaaacaaagaccaagaaaaatatgcacggcctagtataagtgggaatgtaatcgttgttcctttactaagacaacaagtccttaccataggaagatctccaaaatgtaaagtacaacttatcaatccaactgtttcaatggagcattgtataatctgggcaattcagtttgatagtgactcaaaccttattacttatatatttgacaagtcaagaaatggcatcaaacataacgaagcagacatgctgtttggactcactggcattttggaaaatagagatacaattgaaataaaaacagctgcacatataacatataaatgtttgcaaaccgaagtgagctctcaaacagaactagaccaaccaatggaagattgggaaatctctaacaaaatgactggctgtggctcctttggtgcagtatatgtcgcaaaaaaacccaataacccaaaactatttgcagtaaaaatcactcagaataatcagtcgggatatttttcaaataatagtaaacccacacaggagtcttatttgttaagcaaaattaaccatgttagtatacacgctttaatgcatcttttgtatcgaatgtcaaatatactaaccaaaaaggaaaaagcctaa

SEQ ID NO: 4410 - DNA, 1533 bp, Candida albicans
gctgtggtcaatactaagtataggaacaaggacaacaacggtagctcattatttcaaagaaaacctttagcgccaataaatagtgaattcaagatatcaaaaccacaacatataaaacccactacccattctcatacatttaccacacctacaccgaaaacacgaaacaccgccaccaccaccaccaacaacaacaacaggaacaatcatcaatatagaaatcccaatttgaatacttcacttgttttcacaccaacgaaaaactcatcatcatcatcatcatcgcattcatcaagtttattatcgtcatcaccatttgtcgaagaaccggaaaatcaaccagaatcaaatcatactagagctacatcccattatagaacaacttcaacttctcaatataagtcatcagctaataaggatgcatcgcattcattgatcactagtagtaaaagaaaaacatctaccaaacaaacatcagaatcaacaaaccctaaaagaagaaccacaacaacagctacccaaaatacaaataataacaaaattttaaatccatcattatcgtcatcaactattcgcttttcaactgtttcttcttctacctcttcttccaccacctcctcatcatcccatacatcacctaaacctcaacaacaacttacattagatgattttgaatttggtaaaattttagggaaaggaaaattaggacgagtttattgtgtcaaacataaacaactgggacttatatttgcattaaaagtgatgtcaaaatcagaaattatgaatcttaaattagaaaaaagtttacgacgagaaattgaaattcaatcaaatttatatcatataaatattactcgattatattcatggtttcatgattctattaatatttatttattattagaatatagtatagaaggtgaattatatactcatttgaaaaaattaaaacgatttgataatataatggcaagtaattatatttttcaaatcactcaagcattgatttttttacatcaacgtggaataattcatcgtgagttaaaaccaggaaatattatgatatctttagataatcaattaaaattaagtgattttggttcgtcagtacaaataaatcagaatcagaatcagaatcagattcacaaccaaattcaaactcaaaaaactccccatcagaagaagcaaaaacagcaaagattaactatatgtggtacattagattatttacctccagaaatgattgaaagtaaatttcatgatttttccgttgatatttgggcccttggtatattatgttatgaattacttgtggggaaaccaccatttgaagcaattaatcgaaatataacttatgaaaaaatcgctaaagtagatattaaatatccttctaatctagacgttgatgctattgatttaatatcaaaattggtggttaaagatccaaataaaagattaagtttaaaagaagtattgaatcataattggataattaaaaataaaccaaaatggccaaaaaatatttacaaatga

SEQ ID NO: 4411 - DNA, 879 bp, Candida albicans
  unsure (357): Identity of nucleotide sequences at the above locations are unknown.
ccgccaacattcaatattgcttccccttttcaacaacatactatcaatatggatttaagagttggtaagaaataccgtattggtcgtaaaattggatcagtttcatttggtgacatttatttaggaaccaacattatatcaggtgaggaagttgctatcaaattggaaaacactaaagccaaacatccacaattggaatatgaagccaaagtttataaagcattgagtggtggtgttggtattccatttgttagatggtatggtactgaatgtgattataatgccatggttattgatttattgggtccatctttagaagatttgttcaattattgtaatcggaaattcacttataanactgttttgttattggctgatcaattaatttgtcgtattgaatacattcatgccagatgttttattcatcgtgatattaaacccgataatttcttaatgtgtattggtagaagaggttctcaagtaaatgtcattgattttggattagctaagaaatatagagatccaagaactcatttacatatcccttacagagaaaataagaatttgacaggtactgccagatatgctagtgtcaatactcatttaggtattgaacaaagtagaagagatgatttggaaagtttaggttatgttttgatttatttctgtcgtggatctttaccatggcaaggattgaaagccgctacaaaaagacaaaaatatgatagaattatggaaaagaaaatgactactccaaacaatattttatgtaaaggattaccatcggaatttttggaatatatgaattatgtgaaaacattaagatttgatgataaaccagattatccatatttaagaaaattgttcttcttgccccac

SEQ ID NO: 4412 - DNA, 1539 bp, Candida albicans
agaacgataatagaattactcatttctaaagcactcgtttcaactatacattcagtaacaacacccttaatttaccaaactacattaatggaagtaacacaacggacgcagagtcagacacaaccaacacaacagtcaccgacaactcagacgcaaacccaaagcaaagaggaccagaataggatttgtcaattgatttgctccacgggtcagtttggcaattatgatttgaatatcaacgataaaactatcgtacaaggtaaaatgacgtggtattttggaagagaccccaactcagatttgcaagtggcgtcgtcgtcgaaaatttcaaacaagcattttcaaatctggctcaacttcaatgataaatcactatggataaaggacacttcaactaacgggacacaccttaacaacagtcgattggtgaaaggatcaaactaccttcttaatcagggtgatgaaatagcagtaggggttggtagagacgaggacgttgtgaggtttgtcgttgtctttggtgacaaatacaacccggcaaagctacctgattcgaccaacacaattaaagatgaaggaatatacaaagactttattgtgaaaaatgaaacgataggccaaggagcatttgccactgtgaaaaaggcgattgaacgatctacgggcgagtcgtacgcggtgaagattataaatcgaagaaaagcattaaataccggtggtggaagtgccatggcaggagtggaccgtgaattgtccatattagagcggctcaaccacccaaatatagttgctctaaaagctttttatgaagatatggacaattactatattgtgatggaattggtgccgggcggtgatttgatggactttgtggctgcaaacggtgcaataggagaagacgcaacacaagtgatcacgaaacagattctagaaggaattgcctatgttcataatttaggaatctcccatcgtgatttgaagccagataatattttgattatgcaagatgacccaatacttgttaaaatcaccgactttggattggcaaaattcagtgacaatctgacgtttatgaaaactttttgtggtacattggcgtatgttgctcccgaagttatcaccggtaagtatggatcatcgcagatggaactgcaacaaaaggacaactactcttccttggttgacatttggtctttgggatgtttggtttatgtacttttaacttctcatttaccattcaacgggaaaaaccagcaacaaatgtttgccaagatcaaaaggggcgaatttcatgaggctccattaaattcatacgacatttctgaagacggaagagatttcttgcagtgctgcctacaggttaatcctaaactaaggatgacggctgctgaagctttgaaacataaatggttgcaagacttgtatgaagaggattctgtcaaatcattgagtttatcgcaatcacagtcgcaacaatctcgaaagatagataatggtatccatatcgaatcattgagcaaaattgatgaagacgttatg

SEQ ID NO: 4413 - DNA, 450 bp, Candida albicans
  unsure (12),(26),(27): Identity of nucleotide sequences at the above locations are unknown.
aagtacttcggntcctgccaggcccnngtggtgaagacgttggagccacttgcaaattcgttattccaagaaacaataaatatttcaaagtccccgttttctttcggaagaaatgacacttgtgattgcgagatagacgacgacagactatccaaacttcattgtgtcattaccaaagaaaacgactctatatggttattggataagagtactaactcgtgcttggtcaacaatactagtgttggaaaaggcaacaaagttttgcttagaggaggggagatattacatctcttctttgacccattgtcactgcaacatataggtgtcaaagtagtccttgttgatcaactgtctggtgaacataaaagtcaagtggaggtgttgaaacaaacctcagaagaaatgaatattattccacttatttcgggtttaagtagtataagttcatag

SEQ ID NO: 4414 - DNA, 1380 bp, Candida albicans
tgggacgatgtgctctatcggcggttaagaattttgactttgggtccttttaaacatcgtaaagatttgacacgagagtcagttttatcaacctatcaaattatgggatatattgctgctggtacttatgggaaagtctataaggctaaattgaaaagtaataaacttaataaaactgacgatgatagtggtattgatggcattaacaataaagatattttttcagaatcaatgaatgatcttcatcatgataatagtcccagcatcatgatcaacaccactactaacatcactattaataatagtcttccgcaattttttgctattaaaaaatttaaaagtgacaatcaccatcatcatataaataataacaataatggaggaaatcatttatccaaggggaacaatagtattcatcaagatgaagttttgcattatacagggatttcacaatctgctattagagaaatgtcattatgtcgagagttaaacaataaaaatatcactaaattagttgatattatactagaaaacaaatccatttatatggtttttgagttttgtgaacatgatttattacaaattattcattatcaactgcatcctgattttaaaccaattccatgtcctaccatcaaatcattaatttggcaaattttaaatggagtgacatttttacataaaaattggatacttcatagagatttaaaaccagctaatataatggtatcatcacaaggagttgttaaaattggagatttgggattagcaagaaaattcaaaagtccattacaaagtttatatactggtgataaagttgtggttactatatggtatcgagctccagaattattattgggcacaagacattataccccagcagttgatttatgggcggttggatgtatattagcggaattattatctctacgaccaattttcaaaggtgaagaagcgaaaatcgatttaaataataagaaatcggttccatttcaaaaaaatcaattacaaaaaattatagaaatcttggggacaccaacaactgatatttggaataatttgaataaatatccagaatatttatcatttactcaacattttaatcaaaattatcctaataatttatctaattggtttaaattgattaatggtggtaacaatcaaaattcagaaaaatgtcttgaattattatcaggattattaaaatatgatcctgaattgagattaactgcagatcaagcgttattacatccatattttttggaactacctaaagtcaatgaaaatgcttttgaaggtttgaattataaatatccaaacagaaagatttatactgatgacaatgatctaatgaccacttctccaaagagacgacgtttt

SEQ ID NO: 4415 - DNA, 696 bp, Candida albicans
acattctttgcgggactcaagtacatccattctgctgatgtaatacatcgcgacctaaagccaggaaacatattggtcaccactcaagggactttaaaaatatgtgatttcggcttagcacgaggaataaatcctgtatatttcagaaaccgctcagctgtcatcacaaactacgtagcaacacgctggtatagggcacccgaattaataatgtccactaaaaactacacaaaagcagttgacatctgggctgtgggttgtattcttggtgaattgttcggtagaagaccattatttcctggtaaaaatctgcacgagcaaattcatgaactattcaagataataggcaatcccccaattgaaaccatcaaaaagtataactggaaagtggaaggactactttgggtaaagtatcgaccggttaaatggaaaagcttgtatccatttgctcccttgaatgcattagagttgttagacagccttctacaatgggattacaaagcaagattagaagttgaacaaatactagaacaagaatttttcaagaacttgcgaaacgttcacgaagaaccatcaagcaaggcaatttttgactttagttttgaggagaaagggaaaagtattccacaattgaaagagatacttgaaacggaagtaagagtattcaaagagatttctaaaacgggaatagagtga

SEQ ID NO: 4416 - DNA, 207 bp, Candida albicans
actttgcaactttgttttgcgtttcattttactaacatgtgttgtcagattgcaactttgcttgacttagatgttgtatatgtgaaaccttatgaaggcttgtattgttttcaagagctagccgatttagatttagctcgtgttttgtactcaaacgtccaattttcagaatttcacttcttcaccacggggctggaagatccgcgt

SEQ ID NO: 4417 - DNA, 771 bp, Candida albicans
ttaaccattctgcaaaggaaggattcccaatcactgccatgtcgagaaattaccattttgaaacaattaaatcataaaaatattttaaccatacaggatatgatatttgaagaacccaaaatgagcaatcgaacagatattattactatgaggggttctttttatactgtaaccccatacatgtcgagtgatcttgttggattactagagaacccgaaaattaaacttgaacttggacaaataaaatgtatcatgcaacaattattgaaaggtattcaatatgtacacaaccaaaagtttttgcatcgagacattaaagcagctaacattttaatcggtcacgatggtgttttgaaaattgcagatttcggtttagcaagaatatatcatggtaacgtaccgagattggggatgggtcctggtggaggagaaaaagcatatactgggttggttgtaactagatggtatcgaccaccagaaatattactaggagaaagaaaatatactactgcagttgatctttgggggattggatgtgtatttgccgaattattcactgggaaaccaattttggtagggaaatcagattctcatcaagcacaaattgtatttgagttggttggatcacctttgacatggactgatgctgcaaaactacccaataaaaatgaatatagttgtggcttggcttgtaaacgaagtcttgaagcaaagtttcctagtatcatgcctacagaagaggctggccaccacgggcaagaaatcccgcgt

SEQ ID NO: 4418 - DNA, 534 bp, Candida albicans
ttcaaaatgccacataaaaaagttgttattgtggggggaggtatatcaggaataaaagctgccgcagatttatacaagagtggcatcaaaagcacggtaattttagaagcacaacctcgtttgggtggacgattgttcaccgttgaatcaactcagaataaaggaactacatatgactatggtgcatcgtggtttcatgattgtttgaacaatccattatttgataaggctcaacaattggaaaatgtcaaatattactttgatgatgggaaatctttatatttcaataaatttgaaggacagattgaaaaatggacgtctgaaactgttcttgaagaaatgatgacatactttcaatgggtgtataagcaggatcctgataagtcagatatttctgtaaagcagttagcacaagaatatgttgacaagtatcgaaatgtcttaacaaaagagcaaattgaattatctttgagtgctgtacgaatgtggagtgaatatatggcacggagaatcatgggatttactttctggtaa

SEQ ID NO: 4419 - DNA, 969 bp, Candida albicans
gtgctgtacgaatgtggagtgaatatatggcacggagaatcatgggatttactttctggtaaatatacttttgccgatgacgggcatttgggtagaaatgcatttgtcaaaaatggatacagtacagttttcatcaacgagttgaaagagttgccaagagcatatcgggattctgcaattaaattaaatgcccaagtcatcaagattgattatacaaataaaaagaaaattcttgtttatcttaaagatggtcgaacgtattcttgcgattatataatagtgacaattccacaaacaattttgaaaattacaaatgcaaaagatgagaattatgttgagtgggttccagaattgcctcctaatattcaaaaagttttacctgatgttcattttggctctttagggaaagtcgtgttggagtttgatgattgcttttggccaagagatgttgacaggttctatgggttgacaagcaataccccatcacaagatacaatctctgtcgatgcttgggattatccaacaatattaatcaactatcaagctgtaaataatgttccttctttagttgcgttgactcaaaatcctttatcaaaatacattgagaatttacaaccacatgaaaagcaacaaagaatttggtcaattttcaaacctttgatcgcaaaaatatgtgagctgaaagggattcaggatataccagaacctcactcaatttaccatacgccttggaataatgagtcgttatttaggggcagttacgggacgtctttggtcggtacacaagacccttcatctgttataaaagcttttgttgatgggtatcaggatagaattaaatttgcaggtgcagaaactatggacgatacttctaatggatgtgcacatggaggatggttttctggtcaaagagaagctaaatttatagtacaacaagaagctaaaaagaaagtagattctaaattgtga

SEQ ID NO: 4420 - DNA, 795 bp, Candida albicans
gttctagcaatgccggctgcaattagacctatgaaaaagacggtatccttcagtaaggatgtatcaaataacaacaacaatttagaatctgattctgatactaaacaaacacctcaatcatatttgacatttatccctcaaattaaaaatagtttattagttgttccatttcataatatatttatacttgttgggatgttttattccgggttaactcaagatttagaaacggtgatgtggaaagggtttcttacaagtatacctatacaagtaatttataattacattatttatatcaatttattaccattaaagaaatcaactagaaatgatcatcaaaatagttcaagtggttctgctagtaataataataataataatgttccacttttgattggatcgagtatatttgttagtattgtattatcattgccattatttgttgtgattattttaatgggggcaccagtttataaatattcattgaaaactttatatttgtctttacatttatctcaattaatttttaatcctttaattatattatccaatttgaatgtcaacaaaattaacagattattcaaacaggatcatttgtacagaattattttccatcatggtatattatctactgttttgttgactttgggtggttgttggttacgagttatacctattcctttagattgggatagaccatggcaacaatggccaattacattgttagttggaggttatttgggtggggttgtaggtggggttttgtcgttaatagtgaattatttctcccactag

SEQ ID NO: 4421 - DNA, 882 bp, Candida albicans
atgactacgatgactactgaagaaatattggcttcttatccacaaatcaccgctccaaccgatcaaacaggttacacatcaaatttaacacctgaacaaaaaaccactttagatatattcagacaacaattaactgaattgggttataaagacagattagatgatgcatcacttttaagatttcttagagcaagaaaatttgatattcaaaaagctattgatatgtttgtagcttgtgaaaaatggagagaagattttggtgttaataccattttaaaagatttccattatgaagaaaaacccattgttgctaaaatgtatccaacttattatcataaaactgataaagatggtcgtccagtttattttgaagaattgggtaaagttgatttagtgaaaatgttgaaaatcactactcaagaacgtatgcttaaaaacttggtatgggaatatgaagccatgtgtcaatatcgtttacctgcatgttcaagaaaagctggttatttagtggaaacttcttgtactgtgttagatttactgggtattagtgtgacttcagcttataatgtcattggttatgttagagaagcttcaaaaattggtcaagattattatccagaaagaatgggtaaatttaatttgattaatgctccatttgggttttctactgcatttaaattatttaaaccatctttggatccagtgactgtatctataattcatattttaggttatagttataaaaaagaattattgaaacaaatcccacctcaaaatttaccagtcaaatttggtggtatgtcagatgtttctgatgacgatttattattaaaagatgttggtccttggagagatccacaattcattgggtccagaaagtga

SEQ ID NO: 4422 - DNA, 657 bp, Candida albicans
ctatacttcatgaacttttttaggaagaaaacagaagaggatagagatagttcctcatcaagtcttccccgagatgacacagcttctgtttcatcaaaagcaacaagcacaagcacaaacactacttcaaaagtggaactcgtcaaatgttatattccctttgaacaaccggtgaaccctattaaagcacctgattttgaactcgataaagaacaaattgaaaaatatgaaaagttggtagcatattttgaagattatatttcgaaggagatacctgtaaatgaccagcataatgctaccacgcatccactcattgaagatgagttggcttggttgacgaaagaatgctttctcagatatttaagagccacaaaatggaaggtggatgctgctatcaagagaatcgaggacactatcatttggagaaggacattcggggtcgctaacataccaaaccatacagatcccaagaaattaattacagcagatttggtatctgatgaaaacgaaactgggaaacagttgattgtgggatatgataatgacaacagaccatgtctttatttgcgtaatggttatcaaaacactgctcctagtctcaaacaggtccagcatttggttttcatccttgaaagggttattttttacaccagagca

SEQ ID NO: 4423 - DNA, 1137 bp, Candida albicans
acccttgtctctccacccatacttctcatgtttgcaaaattaagaaataaagtatctactccaccacctccagttgctactactggttcaccaacttcttcttcatcggaaatcaccaccaccaccaacgaaaaatcatctagtaccactagtttatccacagtttatataccattttctactccttcatccgaatcacatatcccttcagaaccagaattaactcaagaacaaaaagataaatatttacatgtattaaaccatttccaacaatcagatttaaaaattgctattagtgaagaaactcataaacataaacgaaaaactaaagaattaactattggtgaaaaatcttggatcactagagaatgtatattacgttatttacgagctactaaatggcatgaatctgaggcaattgatcgtattgaattaaccttaagttggagacgtgaatttggtatatccgaaccatttgataatgaaaataaagttaatggtgaattagttagtgaagaaaatgaaactggtaaagaagtcatattaggttatgataatgattcacgtccctgtttatatttaaaaccaggtcgacagaatactaaaactagtgaacgtcaagttcaacatttagtttatatgttggaaagagtcattgattatatgcctgcgggacaagattcattagcgttattaattgattttaaagcacatcctgttggtactcaactggggaaaatccctcctgtaggaattggtagacaagttttacatattttacaaactcattatcctgaaagattaggtaaagcattattaacaaatataccttggttaggttggacttttttaaaaattattcatccatttattgatccattaactagagaaaaattagttttcgatcaaccatttataaattatgtacctaaagaacaattggataaagattttgaaggattagttaattttgaatatgatcataaaaaatattgggatgtaatgataaaaatatctcaagataaaaaacatcaatattttgaacgatttgaaaaatttggtggaatcgttggattaagtgaagttgatttaagaggtaataatgaagaattaattcatcccgttggatccatctaa

SEQ ID NO: 4424 - DNA, 225 bp, Candida albicans
  unsure (40): Identity of nucleotide sequences at the above locations are unknown.
aaaccatttatgatcaaccatttgaaaattttgttcccanaagaacaattggacaaagaattcaacggtatattagattttgaatacattcatgatacatattggccaaaaatgaatgagattgccgacagaaaaagagccaactacatggagaatttcagaagattgggatcaaagattgggttgagtgaatacgaccttagattagaacaagctgcattataa

SEQ ID NO: 4425 - DNA, 708 bp, Candida albicans
caaatcggtggtagaaaatcaaaattagcagttgttcaatcagaaattgtcaagaaggttattgaagacactttccccaacttgtcatgttcaatattagcattatcaaccttgggtgataaagtacaaacccaaccattatatacttttggtggtaaatcattgtggacaaaagaattggaaattttattactagatagtgttgatgaatttcctaaattagatcttattgttcattcattaaaagacatgccaactaatttacctgaagaatttgaattgggatgtattttccaaagagaagaccctagagatgctattgtcatgaaacaaggatcatcatataaactgttgaaagatttgccagcaggtgctattgttggtacttcatcaattagaagatcatcacaattaattaaaaactatcctcatttaagatttgagctggttagaggtaatattcaaaccagattaaacaaattggaccaaccaaataatgaatattgttgtcttatattagccagtgctggtttaatcagattaggtttgggtcatagaataacatcttatttggatgatatgtattatgctgttggtcaaggtgctttgggtatagaaataaggaaaggtgatgataatatcaaatcaatattaaagaaaattgaagatcctattgctactatttgttgtcttgctgaaagatcatta

SEQ ID NO: 4426 - DNA, 1047 bp, Candida albicans
caatccaatttcctaacacctacccactcaaacaaatacgcacacacatacatacagatagacacatactcaatcatggtcaccactgaacaaattcatgacacgtctttcccaattagagaaagaatggaagcacttatccgtttgaaacaacaacaaatcaccgatgctattgccgaattagacacagttaaatttcacaccgatacttggttaagaggtgacaatggtggtggtggtcaatcaatggttttacagaatggtactacatttgaaaagggtggagtgaatatctcaattgtgcacggaaaattaccaccacaggctgttgaaagaatgagagctgatcactctaatttgaaaggatcatccaaggatggtagtgtcaactttttcgcttgtggattatcattggttattcatccaattaaccctcatgccccaactactcatgccaactatagatattttgaaaccagtgatcctgaaactaatgaaatccaaacatggtggtttggtggtggggccgatttaactccatcttatttgtatgaagaagatgccaaatggttccatcaacaacataaagatgccttggataaatttgatccggaattgtaccctaaatacaaaaaatggtgtgatgaatatttctttatcaaacatcgtggtgaaactagaggtattggtgggatctttttcgatgatttcgatagtaaacctgctgatgaaatattgaaaattgttgaatcatgttttgatgcatttatcccagcctatgccccaatcgttgctaaaagaaaagacactccttatactccagaacagaaaaattggcaacaaattagaagaggaagatacgttgaatttaatttggtcttagatcgtggtactcaatttggattgcaaactccagggtctcgagttgaaagtattttaatgtcattaccagcaaccgcaagttgggtgtacgaccatcatcctgaaccaggatcagaggaagacaaattattgcaagttttgaaaaaacctattgaatgggtttga

SEQ ID NO: 4427 - DNA, 1059 bp, Candida albicans
gacttggaccttaaagcagccaagggtgaaaaggtggaaagaccaccgatctggatcatgagacaagctggtcgttatttgccagaataccacaaagtcaaaggtaatagagattttttcgaaacttgccaggatgcagaaattgcatcagaaatcaccattcagcctgttgaccactttgacggcttaatcgatgcagccatcatcttcagcgatatcttagtcatcccccaagcaatgggtttcgaaatcaacatggttgaaggaaaaggtccggttttcgctgctccattaagaaccccagacgatttatcgagaatagatttgaagccagacgtaaataccaaattggcatgggcatacaaggctattacattgacaagaaccaaattgaacggcagagttccacttttagggtttgttggtgcaccttggacgttgttggtgtatatgaccgagggccaaggatcaaaaatgtttaggtttgccaaagaatggatcttcaagtacccagaagctgctcacaaactcttgcaagctacctgtgacgcctgtgttgaatttttggcgcaacaagtcgtcgctggtgctcaaatggtacagattttcgaatcatgggccggcgaattaggaccagacgatttcaatgagttttcattaccttatttgaaacaaattgccgcaaaattgcctccaagattgaaagaattgggtgtggaagagtacattccaatgaccgtctttgccaaaggcgcatggtacgcgttagatgatttatgtgattctggctacgactgtgtgtcccttgattggttatacgaccccaaaaacgctgttaaagttgtcaacggaagaagaatcaccttacaaggtaacttagacccaggtgtcatgtatggatcagacaaagtaattgctaagaaagtcaaaacaatgttggaagggtttggtaagcaaaattacattatcaatttcgggcacggcactcacccatttatggacccaaagaaaatagaattcttcttacagcaatgccataaagttggcgaatcattatag

SEQ ID NO: 4428 - DNA, 744 bp, Candida albicans
agccaggtgtcaaggatgcattgggtacagctgcagatgatcctgaaggaccagttattaccgcgatcaaaaaattacgtgaaaatttccgtgatttatttatcatgtgtgatgtttgtcatttgtgaatacacagatcatggacactgtgggatattgaatgaagatggatcattgataagagaggaatcagtacaaagaattgccgcagtggcggtcaactatgcaaaagcaggtgcaaattctgttgctctttcagatatgatggatggacgtatcaaagatatcaagaccgggttaatgaatgctggtttagccaacaagtgtttggtcatgtcgtatgcggccaaattctctggcgacttgtatggaccatttcgtgacgctgctggaagtgcaccaagtcatggagatagaaaagcataccaattaccaccaggaggtgctggtttggcacgtcgtgctttgatgagagacatgagtgaaggtgctgatgcagttattgtgaaaccaagtaccttctacttggatattgttagtgatgcagccaaattatgccgtgattatccaatatgtgcataccatgttagtggagaatatgccatgttgcatgcagcagccgataaaggagttgttgatttaaagggaattgcatttgaagcccatcaaggatttttacgagcaggggcaagattaattattagttatttcaccccagagtttttagaatggttgcaagtatga

SEQ ID NO: 4429 - DNA, 513 bp, Candida albicans
gataaactggggattttccttttctttgaaaaattttcttgccaatatttttttctcttttgcatagttgatatcaaaatcaaaaaacccactaatcatctaatggtccatcaagctgaatttttaccttctacaggtaattctatatcatctgtcttacaaggtggatataatcatccattgtctagggaatggcaacaggaaagacaattgaccaaaaatatgttcattttcccattgtttattactgattcaccagatgaagaaactgcgatccccacattgccaaacatcaagcgttttggtgtaaataaattgattccatatgtgaaaaacttggttgaaaaagggttgagagctgtgatattgtttggagttccattgaagccaggtgtcaaggatgcattgggtacagctgcagatgatcctgaaggaccagttattaccgcgatcaaaaaattacgtgaaaatttccgtgatttatttatcatgtgtgatgtttgtcatttgtga

SEQ ID NO: 4430 - DNA, 1839 bp, Candida albicans
tcacaatatttatttttttttttttccacttcgcagcataatccgaaatatttatttttcaaaccccactacatctttgattcaaagtcattgatctttataaacaacagatttcgcaccttgattgtgtttcttatacactcgttctcaagcatgactaatttgctaacttccaacataactaccggggagacccacttattgattgggtattctgctgtttccaataccagaatcgtttcaatcatagaatcaggtgcaaacccaattctcattaccgattcacaaccacaaaactttccacccaacatcatgcaatatgtaactgacaataaactaccggtattaattgataaagatttcccaaccaagattccccattacttaactactctaggtcgagcagaggtggattctattgttgaccgagtttatgtgtcgttgcccagctcacggcttgccttgaagcaagagatatatcaaagatgtcgcaagttgcgcataccggtaaacacaaccgactcaccagatttatgtacatttacaatgttgtcaacctacacctcgggagatttccagttaggtgttaccaccaacgggaaaggatgcaagttagccctgagaataaaacgagagcttgtgaactcgttgcccagcgacattgatgcaatatgcaaacaggtgggagagttaatacgacaaatacaaatggaagacaaagctgaatctgagcacggagaacacgaagatgatgctatcaacaaccacaagttcaattcgtttgtgccagagttcaacaaaacgcaagaggacctaaagctacaaagggcaagatggttgtcgcaaattgtcgagtattacccattgaataaattaggttctatttcactcaaggatctaagcagtgcctataagttacacaaacaagctaacgtcccaggtgcaaaagaagaagactcggaagctggccagatgaccttggttggcagtggacctgggtctgtgtcgttgcttacgttgggagcgttacaggctatacagacagccgatttggtgctagcagataaactagttccgcaacaggtcttggatgtaatccccactacacaccacacaagattgttcattgccagaaagtttcctggtaatgctgagaaggcccaggaagagttgttgacactaggcctagaagcattgaggagaggtgaaaaagttgttcgtctaaagcaaggagacccatatatatttgggcgtggcggagaagagtttaactttttctcgcaacatgggttcaaaccaacggttgtgcctgggatcacctctgcattggcggcaccggtgttgtcaaacatcccaatgacacacagagacgttgctgaccaagttttgatttgcactggtacggggagacgcggtgccgtgcccaatttgcctgattttgtgtcgagcagaaccacggtgtttttgatggcgctacacagagtggttgagttgatcccattgttagtcaacgacaagaagtgggatgaaaacttgcccgtggcaatcgttgaacgtgcatcgtgtcccgatcagagagtcattcgcaccacgttgagtaaggtcggagacgctgttgaggcttgtgggtcgaggccacctggattgcttgtgacagggtatgcgtgtgaggtgatttgcaaaaatagtggtagcgagagcttaccttgggttgtggaagaaggttgtaattctggagatgatggtgagttgaagagaattgtcgagcttgtcaatggcaactgcaaggagagcactgctgttgtcagtcctaacttgcaaaaggaaatagctgcataa

SEQ ID NO: 4431 - DNA, 630 bp, Candida albicans
ttcatttcacaacgagccgttgaaatgtttaaagaatgtattgaagaattaaatcatgatatacgacaacggatatatcaaaaaatcggatatacagtggggccagcaacttataaaatattaaaatctgtagggtttaaagatgttcgtggaggtgatgaagcaggcaatggatcgaaattggccgatttaattaaacaagatactataggaagagaaaatatccccatggttttctttactggtgtgattagaaaagatattatacctaggaaattaattgatagtggatataataatttccaagaatttatactttatcaaactggtgatcgattagatattattgataatttcaaaaaagtgatacatggtttagataaagataaagataatgatgatgtttggatagtatttttcagtcctcaaggaacgaaagaaattgttaattatttaattgatcgagatggtaattcaaatcaaaaaaattggaaaattgcttctattggtcctacaacgagagattatttaaaagattttgatttatcaccacatgtgatagcaccaaaacctgatcctgaagctttatttgaaactatatttcaatatgataaaacttacgccttgtaa

SEQ ID NO: 4432 - DNA, 1092 bp, Candida albicans
gaacattttacaaatacagaatctaccacaacccatttaataaatttaattgcgctgattcaaatgacatcgataaaacatccaaaaccatctactgtaagtgctagcagccacggaatacgcactccaccaacagtttccacatccccagatttggatgtcaacagaatccccatggtgacaccgaaaccgtcaacaaataatttgccagttaccacgccacaacccccaccagcaataacgcaatcaatgcgtaacaaaagtggtttgcctgacagtttaccacatgttaaatgtttagccagagcacgtatcccaacaacacagggaccagatatcttcctacacttgtatgaaaacaatattgacaacaaggaacacttggcaattgtgtttggagaggacattcgatctcgctcattgtttaaacattatcctggagaaactcaacaagacagaatgactagaggtgcttacattggtagattgacacctggaagaaccattgctgattcagatggaacaaatgaattgaagtttgacaaagatggtaacttgataattgacagtttgacatacacggatccaactttggtcaggatacacagtgaatgttacactggtgaaactgcatggagtgcacgatgtgattgtggtgaacaatttgatgaagctggaagaataatgggagaagcgggccatggatgtatggtatatttgagacaagaaggtagaggtattggtttgggtgaaaaattaaaagcatataacttacaagatcttggtgccgatacagtggaagccaatttgattttgagacacccagctgatggacgtaacttttctttggccacggctatcttggttgatttgggtctagtagaaattaaattgttaactaacaacccagataagattgttgcccgtgaaggtaaacaccaagaaattaaagtgttagaaagagtcccaatggtacccttgagttggggtaaagatggtaagaatggtatcaaaaataaagaaattgaaggatatttgagcaccaaaattgagagaatgggtcatttgttagagaaacccatcaaaatctaa

SEQ ID NO: 4433 - DNA, 882 bp, Candida albicans
tcataccacacacacagcaccacctctgccaaatcttttattctttttttttttttattccttctgaaatattttcctttattttattttacttttttcagttccaacagatctatgttcaagcaagttgtttccaaaaaccgtataccaattgaaaatagtattgcatcaattagaaaaatgacccttaactcgaccagtgcaaatccggacactagacgcgaagatccggaaactaccacccaagaaccaataatttttgctccagcaacttaccaatacacaaaaggacatttaggcgacactgaagtggataaagatcctttagctcaattcaataaatggtttaaagaagcccaagacaacttacctgctaattcagacattattgttgaggcgaccaatttttcaactgcaagattgcctagtgggagagtttcctcacgtattgtattattaaaggaattggacaaatatggtttcctagtctattctaattggaatacctcgaagaaagcaaaagattttgagctgaacaaatacgcaagcttaacattcttctggccacatgtacaaagacaagttagagtggaaggtatcatggaacatgtgacaagagaaacttcagaaagatactttaatactcgtccaagaggatcaaaaattggagcatgggctagtccccaaagttcagtagtccaatctcgtgacgacttggatcaaattaaagataaatataacgacaaatttaaagatttgcaggaccacgaaataccatgtccagactattggggagggataagaatagaacctttagaggttgaattttggcaaggaggtttgagtacattgcatgatcgttttaccttccgaagagattag

SEQ ID NO: 4434 - DNA, 771 bp, Candida albicans
gcgcgtatccgtcgactccgcggtgaagacaccctgaactcgagcagtgcaaatccggacactagacgcgaagatccggaaactaccacccaagaaccaataatttttgctccagcaacttaccaatacacaaaaggacacttaggcgacactgaagtggataaagatcctttagctcaattcaataaatggtttaaagaagcccaagacaacttacctgctaattcagacattattgttgaggccaccaatttttcaactgcaagattgcctagtgggagagtttcctcacgtattgtgttattaaaggaattggataaatatggtttcctagtatattctaattggaatacctcgaagaaagcaaaagactttgagctgaacaaatacgcaagcttaacattcttctggccacatgtacaaagacaagttagagtggaaggtattatggaacatgtgacaagagaaacttcggaaagatactttaatactcgtccaagaggatcgaaaattggagcatgggctagtccccaaagttcagtagtccaatctcgagacgacttggatcaaattaaagataaatataacgacaaatttaaagatttgcaggaccacgaaataccatgtccagactattggggaggaataagaatagaacctttagaggttgaattttggcaaggaggtttgagtagattgcatgatcgtattacatacagaagagaaaagaaggaagaccctaattgggagattgttagacttgctccatag

SEQ ID NO: 4435 - DNA, 309 bp, Candida albicans
aacatgtcattaatcccattacctgaatcgttgataccattcctagatccttatttacctaacataaaagtcaccaccactaacaatgaatctttgaaacgtccatttgttacattaacttatgcacaatctttagattctaaaatagcagctcaaccaggtacacaaactaaattatcacatttggaaactaaaacaatgacacattatttaagatccaaacatgatgcaatattagttggtattgggaccattttacccgagtcttcacctcggaactcgacggatccgccgattatttttggcaat

SEQ ID NO: 4436 - DNA, 279 bp, Candida albicans
aattgcggaatttccagcggcgtggtgaagattggaataggtgctggaccttatacttcgggccaggttttggttatatctgacttgttgggaatgaaagatgggcacgtggctaagtttgttcagcagtataacaatttcttccaacagggtgttgaaggtgtaaaacagtataccaaagatgtcaaatcaaagaagtttccaaatccggatacacatggttataaaatgaagaaagatgtacttgatgagttcaaagaaattgccaaagatttgtag

SEQ ID NO: 4437 - DNA, 855 bp, Candida albicans
attgtcgttctgtttatgcaaaaaaaaatatatgaccgatttaggccaattatttttgtgatttccattcttaattttttcgaaaactgtattactctctttctcaccccctcaagcaaactacaattatttctatcaactatgtttactggtcttgttgaaaccattggtactgttttagactactcaaagcacgatgattcctccactggtggagacggagtttccattaccattggaaattgctcagaaatcttggaagatgtcaagttgggcgattcaatctccacaaatggtgtttgtttaactgttaccgaattcaatctcgggaagaccctttttaaagttggtgtggccccagagactctccgcagaaccaatctaggagatttgaaacacggtgcaccagtcaatttagaaagagccgttacaagtgaagttagattgggtggccatattgttcaaggacatgttgacactattgccaaaattgtcgacaagaaaccagatggaaatgctattgcctatacttttgaattaagagataaagaatttatcaattacattgtccacaaggggtttattgctattgatggggcttcattgactgttaccaatgtcgatccatctaaagttcaattctcaattatgttgattagctacagtcaagaaaaggttatcttagccaagaaggaagtaggcgacactgtcaacattgaagttgacttgacgggtaagtttattgagaaacaagttgagataaatttaactggtcaaattgaaaattccgacagcccattgaacaaattgattagctcgttggttgaaaagaaagttagagaatatatcaagtaa

SEQ ID NO: 4438 - DNA, 657 bp, Candida albicans
tacggtgttaatcctccaaatactaacttaacacttaggctacaagagatagcaatatcctataacggaggtaaagattgtcttgtaatgttgattttgttgatggcaactatccacaagaaattttcttcatcagaaatgaataatccttctgtcaatatattgcctcctgattataaacttgactcgatctatattaattccgaaacgccgtttccgcagttggtggatttcattacttcatccactgaatattaccatttgaatccaataattatacaaaagtctttgaaagatgggtttgaatactatcttaatgaagtcaacccaagagtaaaatcagtaatcgttggaattagacattctgatccgtacggagagactttgcaatatgaacaaatgactgatcataattggcccaaattcttacgaattcatccaattttacactggaattatgttgatatatgggattttcttattggatgtgatgtgaaatattgcgaaatgtatgaccaaggatatacttctcttggtggtattaatagcactgttccaaatccattactaaaattaccgaatggcaaataccaaccagcatatatgcttaaggaagatgctgacaataatgagcggttgggtagagttaagaaatag

SEQ ID NO: 4439 - DNA, 360 bp, Candida albicans
ccaactccctttctttatatatatattatgatcagtatgactaacatctttactcctattgaagaagctttagaagcttacaaaaacggtgaatttttaattgttatggacgatgaagaccgtgaaaatgaaggtgatttaattatggctgctgaattaatcactcaagaaaaaatggcatttttagttcgttattcttcaggttatgtttgtgttccattaagtgaagaacgagcaaatcaattagaattaccaccaatgttagctaatcgtagtgatagacatggtactgcttatactataacatgtgattttgctgaaggtactactacggtatttcggcccatgataaagctttaa

SEQ ID NO: 4440 - DNA, 912 bp, Candida albicans
aaaagaattatggctccagaatatgcaaatttattaccagtaagtggtaattggaaacaaaaaatcactgattatttaactgaagatgttccatcatttgattttggtggatttgtcgttggtaacacaccagaaaccggatcactttatatgaaacaatcaggagtaatttgtggtatcccctttgttaatgaagttttccatcaatgtaatttacaacataaatggatatttagtgaaggtcaatttgtttctgataaagaaatagcttctgctggtggtaaaattgttgtttgtactgttaaaggatcagcatcaaatattttattagctgaaagaacagcattgaatttattatctcgagcatcaggggttgccactcaatcttataaaactaaaaaattggccgatgaaagtggatatactggtataattgccggtacaagaaaaacaactccagggttacgtcaattggaaaaatatgccatgttgattggtggagtagatactcatagatatgatttgagttctatggtgatgttaaaagataatcatattacttctacaggaagtattactaaagctgtgaaaaaggcaaaatcagtttgtggatttgccgttaaagttgaagttgaagttagtaatgaaaaagatgctgaagaggcaattgaagctggtgctgatgttataatgttggataattttaaaggtgaagaattacgtcaagttgcacaatcattaaagaagaaatttgctggaactaataaatctttccttttagaatgttctggtgggttaactttacaaaatttgagttcttatttaagtaatgatattgatatctattctacttcatctattcatcaaggtgtttcaactatagacttctcattaaaaattgacgccaagtaa

SEQ ID NO: 4441 - DNA, 1407 bp, Candida albicans
aaaattggtgttgcagggtatcctgaaggtcatccagaagaagaggacgagcagaaaactttgcgctatttgaaagaaaagtgtgacgctggagctgatttcattatcactcaaatgttttatgatgttgataattttatttcttggtgtagcaaattacgcaaaattggagttgatatcccaatcattccaggtatcatgcctatttctacctatgctgcatttataagaagagccaagtggtccgaaatagctattccacaacactttttagacgcattagaccccataaaagatgatgatttcttggtaagagaaagaggaactgaattggttagtgaaatgtgtaataaattattgcaatctggatatgtcaatcatttacatttttacactatgaatttggaaaaagctactgttatgattttggagaaattaaacctcattgaagctattaaatcacacgacgtcgttggtggatccgagttaccttggagaaaatcattgcatccagaaagatctaaagaatcgatccgtccaattttttggcaacatagaaagtattcttacatttcaagaacagcaacttgggatgaatttcctaatggtagatggggtgactcaagatctccggcttttggtgatattgatttgtgtgctagtgaattattgagacaatcacctaaaaaggcttttgaattatggggtctccctcaatcattggcagaattgagtggtataattatcaactatttgaaaggcgacttgaagtcgttaccatggtctgatggtcctgtgggggatgacactaaagtaattgttgacgacttgatatatttgaatcaacacgggtttttcactatgaattcacagccagcattaaatgcagttaaatcgtctgaaaaagtttttggttggggccccaaaaatggatatgtgtatcaaaaacagtatttggagttcttttgccataaagatgttgtttctaaattgttagaccacgtcgaggaattcaacgtaaagggagccgaatcttcgtcagcttttatttcatactatgctgtggataaagatggtaatttgagtacaaactgtaaagatgatgacattaatgcagtcacttggggggtatttccgggagaggaaattcttcaacccacaatcgttgagaaaacatcattcttggcatggaaggatgaggtttacagattgtttactgaatgggccaagattgccagtagcaatttagttgaagccaatcaaacacaagtagacgaatttgtccaattaatgaaaaaattcggagatgaatttgtgttgtgcaatttggtaaacaatgattttgttgatggcaattccacccttttcgatttaatcaagcgtttgaatattgacgatttgaattaa

SEQ ID NO: 4442 - DNA, 1524 bp, Candida albicans
aattccgttgcactgtgtttattcagttctctcttttttttttcacttttctgtacaactataaaattaatcaagtggtcaatgatttcgagatttgtcagaactttagcaacgtcggccaagtttcaggatgttgtgatcattggaggaggacctgcaggtttaacgttactagcagcattgaaaacttcccccaaaactaagcatttgcaatgtacacttattgagggttcttcattggacaatgttcgaaaatttcataacgatccaccagcagactatacaaatcgagtgatttctcttactccaaaatcaattgaatttatgcagaataaagttgggagttgggattttatccatgaagacagagtaaaagcgtatgatgggatcatagcttatgattcacaagacgcaaactcgagaattgagtttgatattagtacaatcggacaaagcacgttagcagcaatgtgtgaggttattaatatacagagctcattgttggctaaaattgaaagcctccaagataaatcaactaccattaaggataacaccaaggttgtggagattgttaacccaatagaaccagatttggataatcacaacttgactgaaatagataccaatgttagtgatcctaaattggattggccaattgtcaaactagaaaacggagaaacaatacaaacgcggttattggtgggggcagacgggtataattctcctgtacgtaaatatgcccatattgagtcaagaggctggcaatacaatacctttggtgttgttgctacagtgaaattgcaatacgaagatttcagagcagtgggatggcaaaggtttttgactacaggccccttggctatcttaccgttaagtgaagacaatgccactattgtttggtccagcactccggaattagctgacttgcttttgaaagtaaatgaaaaaatattcccacatcttgtaactgctgcaatggtgttggaagaagttgacttgaactacatttacagtgtgttgcaagaagatccaaatgatttttctgtattagaggacattgaatggcgattatccaaattcaatcccgaagaattggaagaacgatacccattaccagttgttgatgtattgagtggctcccgtgctagattcccattgaaaatgtctcatgctgatacttatgttgctccaagagtagcattagtcggagatgctgcacatacgatacatccattagctggtcaaggattgaacatgggacaatcagacgtggctgctttggttgaagctttggaaaaagggattgatcgaggtatggatatcggttcaactttggttttagaaaattacgttgctaatgcttggccctcaaatcatgccttgctaggcatctgcgataaactacacaaaatattctcaactgatttttacccgttggtgtgggcaagaggatttgggatgaaatctataaattcatttggtgctattaaagagttaatgatgaaaagcatcagtggaagatag

SEQ ID NO: 4443 - DNA, 330 bp, Candida albicans
acacaccacaagagtacactgaatattcatcccataataataaaaacaatgtcaaacccatcacataatccaaaacatcatcttcgtgaagaagattccaatggaactcaagatggaccaaaatcaactgtacctatcaaaagatctaaattggttggctcatccaatttagtatctccaaattttttacctagagatttaatagaaactccattgcaaacacgtgctgcatctccattgactttaaacccaccaattgatagcgatggattatcatggccatctctcggagcaagaattttaatatatcacactctgaaagtgctctag

SEQ ID NO: 4444 - DNA, 498 bp, Candida albicans
cttgaaggattttttgaaacacctggacgatatgctcgtgccatgttatatttcaccaaaagggatatgcagataatttttagggatgttattaaaagagccgtttttgaagaagatcatgatgaaatgttattgtttagagatattgagatttattcactttgtgcacatcatttagttccatttttcgcgaaagctcatattgcatatattccaaataaaagagttttaggtttaagtaaattggcaagattggcagaaatgtattcaagaagatttcaggttcaagaaagactaaccaaacaaattgccatggcattaagtgaaatcttgaaaccaagaggtgttgcagtagtcattgaagccactcatatgtgtatggtcagtagaggggttcaaaaaactggctcttcaactactacaagttgtatgttgggttgtttccgtgatcaacaaaaaaccagagaagagttcttaacattattaggacgcaaataa

SEQ ID NO: 4445 - DNA, 1263 bp, Candida albicans
ttgttgaccataaaaccaactttgtgcaccaaaagagaattgttgagtcgactgcgcaacacctcatacccaccaattaaaaacaaattattcgtaatctttctgttttttttttctttaatcttcaacgtttatacaatgtctgttaaaagatttttctccatgaacgccaaagctttacgagcttttggctccacagttacatccacagccagtgggttcaagccaatgccaatgacagtatctaatgcagctgatactttggccaaagccagatcttcaaaacctagatctgactggaccaaagatgaaattagcaaaatttacaatgctccattgatggatttgattttcaacgctcaattgaaacatcgtgagtaccaaaaacctgctgaagtccaattatgtactcttgttaacattaagcagggtggatgtaccgaaaactgttcttactgttctcaatcatcgaaacatgatactggagttcaagctgaaaaacttgacttggatgctgtgatggacattgctagagatgcgaaagcacgaggtggtactagagtttgccttggttccgcttggagagatatgcaaggaagaaagtctgccttagacaaaatcagtaaagttgttaaacaaatcaacgacgagttgaagttggaaacttgtgttactctcgggatgatcaacgaaaagcaggctgaaattttaaaacagaatggtttgactgcctacaaccacaacattgacacttcaagagaacattatccaaacgtcgtcaccacccgtacatacgacgaaagattagaaaccattaaaaacgtccaaaaagctggtatcaaagcttgtaccggtggtattctcggattgggagaaaccgcacaagatcatgtttcgtttttgtacactttgtccaacatgagtccgcacccagaatcattgccaatcaacagattagttccaatccagggtactccaattgttgaagtgttgaaaaatgccccaaaggaaagacaattggaatttgatgctattttgagaactattgctactgctagattgattatgcctgaatccatcattagattggccgccggtcgatacaccatgaaggaacacgagcagttcttgtgtttcatgagtggggtcaatgctattttcaccggtaagagaatgttgactacaatgtgtaatggttgggatgaagatatcaccatgttgaagaaatggggtttgaaaccaatggaaagtttcactaagtag

SEQ ID NO: 4446 - DNA, 372 bp, Candida albicans
atgttggtaaaactattttattctaatggttgcagaaacgaacatgatgatttcttgtataaacaagaatggtctgaatatgctagtgtattaggtgacaaatttgaaatgttcaatgctttttcaagacaagatccatcgaagaaagtatatgtacaggataaaattgtggaaaattacaaaattgttaatgaattgttaaataatggtgccactatctacgtttgtggtgatgccagtagaatggcaagagatgttcaagcagcaattgctaaaattgttgccaaagatagagatatctcacaagaaagtgctactgaattggtcaaatcttggaaagtacaaaacagatatcaagaagatgtttggtaa

SEQ ID NO: 4447 - DNA, 1713 bp, Candida albicans
gatcatttcgacttaatggcattagacaaattagatttatacgttatcgtgacattggtggttgcagtagcagcatactttgccaagaaccaattccttagcaaaccacaagacactggatttctttccaatgatggtgctggtggaagttcaaggaacatattggagacgttgaagaagaataataaaaacacgttattactatttggatcacaaactggtactgctgaagattatgccaataaattgtctcgtgaattgcattccagatttgggttgaacaccatggttgccgattttgctgattatgattttgataattttggagatatcacagacgatatattggtgtttttcattgtcgctacttatggtgaaggggaacctactgataacgccgacgaattccacacttggttaaccgatgaagctgatactttgagtactttgagatttactgttttcggattaggtaactccacttatgagttttataacgctattggtagaaaatttgaccaattattggaagaaaaaggaggtgaaagatttgctgaatatggtgaaggtgatgacggtactggtactttggacgaagatttcttatcttggaaagatggtgtttttgattcattgaagaataatttgaattacgaagaaaaagagttgaaatatgaaccaaatgtcaaattgactgaacgtgacgatttaactgttgatgactctaatgtttcccttggtgaaccaaataaaaagtatattaactctcaaggcgttgatttaagcaaaggtccatttgatcacacacacccatatttagccaagataacgaaaacaaaggaattattcaattctaaagatagaaattgtgtccatgttgaatttgatatttctgactccaacttgaaatacagcactggtgatcatttagctgtttggccatctaattccgatgaaaatatcaaacaattccttaaatgttttggtttagaagacaaggaaaacaccgttatagaattgaaggcattagactccacttattccattccattcccaagcccaattacctatggtgctgttatcagacatcatttggaaatttctggaccaatttcgagacaattattcttatccattgccgggtttgccccaaatgaagagacaaaggctacattaactagaatcggtaacgataaacaagagtttgcttctacaattacccgtagaaagttttatattgccgatgcattgttgtttgcttccaaaggtaaagcttgggttgatgttccatttgaatttattattgaaaatgttcaacatttgacacctcgttactactcgatttcttcttcatctttaagtgaaaaacaattgatcaatattactgctgttttagaagctgaagttgaaagtgacggtagagctgttactggggttgttactaatttattgaaaaacattgagattgaacaaaataacaccaacgaaaccccagtagttcattatgatttgaatggtccaagaaacaaatttagcaagtttaaattacctgttcacgttagaagatccaatttcaaattaccaaagaatactaccactcctgttattttgattggaccaggaactggtgttgatccgttgagaggattcgttagagaaagagtccaacaagttaagaatggcgtgaatgttggtaaaactattttattctaa

SEQ ID NO: 4448 - DNA, 609 bp, Candida albicans
gtgaagacaggcgtaggtggtgttgcaatggcagtagagacaataaagattataacaggatactacaccaaggacaattttgtgccctttctcacatcgtattcggcttatcctcggcaacagttacgtgtatttaaaatgagaaagagacaaaaagattgtgctgtatgtggagaaaatccccagatatctcaacgtatgattgaggatggcactataaattataaaacattttgtggaagagcaacttttgaccctattgatgacaagtttagagtatcaccaaaagactatgatagtgtggttcaaaataagaagaaacacatattaattgatgttagaccacgcgaacaatttcaaattacgcatttaccaaatgcaattaacgttcaatgggaccctacattcagaaaagctgatgctatagaacagtatttaccagatgattccaccaaagatgatgagatttatgttgtttgcaggtttggaaatgattcgcaattggctgctaaaaagcttataggcatgggttacccgaacgtgagagatataattggtggtttagataaatggagcgatgatgtggattcgaaaattccaaaatattaa

SEQ ID NO: 4449 - DNA, 402 bp, Candida albicans
ttgcaaatcatctttatagacatgtccgaaccttcaaaggaagagctccttgccagaatagcgcagttggaacttgaaaatgagcaacttaaacagcaaaatggcaagaaatcccagcatgaacagtttaataaaatcgatgataatttcagtctcgatgagtataaacgatatggtagacagatgattgtacctcaatttggttccttagaatcccagatcaaattgaaaaactctaaggtgttagttgttggtgctggagggttaggctctcctgccttgctatacttatcttctgctgggataggaaagattggaattattgatcccgatactgttgacaccagtaatttgcacagacaggtgatacataacacggaaatgggtcttcaccacgggtag

SEQ ID NO: 4450 - DNA, 255 bp, Candida albicans
aatatacgtatgacatcaaaatttgacgatgaagaaaatattatcaaaccgcaagatggggaagctgaagactttcaacttttggatgttgatcaagtattggaaaaacttcataacaaggaatttaaaccgaattgcgggttgataatagtggattttttgattagacatggtcatattactccagagaatgagccaaattatttagaaattgtatcaagatgtcatgttgcgatgccatttgctactagatag

SEQ ID NO: 4451 - DNA, 894 bp, Candida albicans
aaacccccttggatggagatagatacacgcaatcaattgtggaatctagagctggcagaggagttgatttatggcgacgattttcagccaacatttatcgttgattgtattgataatttagacacaaagtgtgacttgttggcgtactgccacgaaaagaaattgccaatagtatcttcaggaggagcagccacaaagctggaccctacgagaattaatctagctgatatctccaaaaccgaagaagacccgttaatgaagaaaattagagtggttctcaaaaagcgtggtattattaatggtatacctgttgtgttttcagcagagaagcccgacccaagaaaggccaaattgttgccgttacccgatgacgagtttaccaaaggaaatgttgatcaattgtcagcactaaaggatttccgtgtgagaatcttgccggttttgggtacaatgcctggtatgtttgggttggctattgctacatatattttaactacagtcgcagggtatcccatggagccagttgaaggtaagaacaggtacaagatatacgacgacttgttgcaaagtcttgcgggacaacaaactagaataggcaagactgaccaacgtgtacagatagccatgcatgaggttaattatattttggaggaagttttccgtgggaaatcgccgatttcgaattactctacacgtttgacattatcgcgatgggaccccagtaaagaaatatcgtttcagaatgttgttgtcatgactaaagacgaacaaagaaatcacgaaaagagggttctcaatggtggtgaaaagattgaagatgtgtatctgaaagaagtggttgatttggtgaaatcaagatttgaagatgaaaagtacttttctcagtttagataa

SEQ ID NO: 4452 - DNA, 1329 bp, Candida albicans
tcgtggtcccaacgtccccatcccacaccccttccaatgccaattaatttaggattacaaagaatagctaaactattaggacatttaaataatcctcaaaatgcttataaatccattcatatagcagggaccaatgggaaaggctcaacattagcttatatctcatcagttttaactgaagctaaaatcaaaaatgggaaattcacttcacctcatatcattaattatcatgattgtattagtataaataatcaaacatatccaaaatcaaaatttgatagaattaatcaacaagtcattaaaattaataatgatttgaatttagaatgtactgaatttgaaattttgacagctacagcatttaagatttttgcattggaagaaattgaaatggcattacttgaacttggagttggtgggagattatatgctaccaatgtcttaataccatatggtgagactatcggtactagtaaaggaagcgtggtggcaactgctataaccaaaattggtctcgatcatgaaaaattgttaggtgggacattattagccattgcaaaagagaaatctgggattataaaatatggcattccttgttttgttgattcactgaatgattctattgtgttacaagcaattcgtgaaaaatcacgggaagtatcatgtccattaagtgttgttgaaccaattcaggccaacgacgacaaccaattcattaaatatagcccattaaaaggatcatatcaagccaataatctatcattggcagtggaaatattgaaatcattaccttatagaatatcggaagaaattttgataaatggtataagcaaaactaattggcctggtagattacaaactatacaacacaagagtctaggctcaatattattggatggtgcacacaatgaaagtgccgctattgaattgggcaaatatttaaatacaaaatatcgtaaacaagaaccagaagcaaatatgctggaaggcaatcatacacctataatacttgtcattggtatgactaaaggcaaagcaattggaaatttgttaaaacacgttatgtcagaaaacgatattgttatacctacaatgttcactcaacctgaaaatatgccctggattaattctgaactgatttccactttgacttcaattgccaaagattattgtcgtgatgtaagaaatattggtgatgatgcacatatacatcaagtatttcaatatttaaaaaacaataaaaacgacaaactgttagagaataaaccaatagtggtttgtggaagtttatatttgtgtggtgatgtgctaagagaaatagccaattga

SEQ ID NO: 4453 - DNA, 951 bp, Candida albicans
  unsure (9),(20): Identity of nucleotide sequences at the above locations are unknown.
ccccccccngacatttacgngaaagttcgtgtggtcgggccctccgaggtgaagacagaaggacataatattgtgaagcaggcagagaaattagtcagtgagggtgctacgattattgacattggaggagtttccacacgaccaggaagtgttgaacccactgaggaagaagaattggaacgtgtgattccattaattagagccattcgtcaatcactgaaccctgatttactgaaggtgttgatttcggttgatacttatcgtagtaacgttgctgaacaaagtttacttgtgggtgctgacataatcaacgatatctcaatgggcaaatatgatgaaaaaatatttgatgtggctgccaaatatggatgtccttatatcatgaatcatactcgaggatcacctaaaaccatgtctaaattgaccaattatgaatcaaatacaaatgatgatattatcgaatatataattgatcctaaattaggacatcaagaattggatttgtcacctgaaatcaagaatttactcaatggaatcagtcgtgaattgagtttacaaatgtttaaagccatggctaaaggagtgaaaaaatggcaaattattttggatccaggtattggatttgctaaaaatttgaatcaaaatttagcagttattcgtaatgcctcgttttttaaaaaatattctattcaaattaatgaacgtgttgatgatgtaacaatcaaacataaatatttaagttttaatggtgcttgtgttttggtggggacatcaagaaagaagtttttggggacattaactggtaatgacgtgcctctggatcgagtatttggcactggtgcaacagtgtctgcgtgtattgaacaaaacactgatattgtaagagttcatgatgttaaagaaatgaaagatgtagtatgtataagtgatgcaatttataaaaatgtataa

SEQ ID NO: 4454 - DNA, 1752 bp, Candida albicans
tgctaccactacgaggtattaaattggttccaagaggggaaaaaaacaattgactcaaatagttttttaaatcgttccaactttttagtaatccatgaaatatttttttttttaaatccattacttcacttcttgattcaaaccctccgccccacttttcctccaattaacaattacaattatttcaccattttgttttccaattttttcaagtcggcgattaacccgacaataaataaacaatttcgaaaagcattccattattctatcactatgttgaaaaacgataccgttttcactaaagatatttcttgtacggcgataactggtaaagatgcctggaatcgaccaacaccacaaccaatcactatatcattatctttcagtactgatttccagaaggcatcggaattggataatttgaaatgctcaattaattatgctgttattaccagaaatgtaactgaatttatgaaatcaaatgagcatttaaatttcaagtcattaggaaatattgctcaagcaattagtgatattggattagatcaatctagaggtggtggatctattgtggatgtgacgataaaaagtttgaaatcagaaataagagctgaaagtgtcgaatataaaattaatagaaacactttgggtcaacccgttccattagatattttccaagttaataaattgagattattgacaattattggggttttcacatttgaaagattacaaaaacaaatagttgatgttgatttacaatttaaaattgcacctaattccaatttatatttccatcaaataattgctgatattgtttcatacgtggaatcatctaatttcaaaactgtagaagcattggtgtctaagattggtcaattgacatttcagaaatatgacggagtagctgaagttgttgctactgtcactaaaccgaatgcattcagtcatgttgaaggtgttggggtatcatctaccatggtcaaagacaatttcaaagatatggaaccagttaaatttgaaaacacaattgctcaaactaatagagcattcaatttacctgttgaaaatgagaaaactgaggattataccgggtaccacactgcatttattgcctttggatccaatactggaaatcaagtagaaaatattaccaattcattcgaattgttgcaaaaatatggaatcaccatagaagcaacttcatcattgtacatttctaaaccaatgtattacttggatcaaccagattttttcaatggggtaattaaagtgaatttccaaaacatttcacctttccagttgttgaaaattctaaaagatattgaatataaacatttagaaaggaaaaaagactttgataatgggcccagatcaatagatttggatattatactatatgacgatttacaattaaataccgagaatctaattattccacataaatcaatgttagaaagaacatttgtattacaaccattatgtgaagtattgccccctgattatattcatcccatcagtgcagaaagtttgcatagccatttacaacaattaataaatgataaacctcaagagacagtacaagaatcgtctgatttattacaatttatcccagtctctagattgcctgtcaaagataatattttgaaatttgatcaaattaatcataaatctcctactttgattatgggtatattgaatatgactcctgattcatttagtgatggtgggaaacattttggaaaagaatag

SEQ ID NO: 4455 - DNA, 648 bp, Candida albicans
gaaatagaaatgagagcagtatttatcacaggtacagatactgatgttggaaagacgttcatatctgctttactcactaaagcttgggacgctaattattggaagcccattcaaacaggattagaatcatgtcaaggagataccgagacggtgcaaaaattgaccaatttactggaagatcgatttgagagaccacagattgagctcaacattcctttgtctccatggagggcagcaataaaggaaaataaaccacaaacaaaagttaacgaaattgcgattccagcaaaattcttgaatagctcaaggccattgatcatcgaaggtgcagggggcttatatgttccaatcaatgaaacggagattactacggatttgattttgcactttgatataccggtcattttagtagctcggagtggattgggtaccatcaatcacactttgttgagtttagagcatttgaagaaccgtggtatacataaagtatatgtagtcatgaatggaccaatcaacacggataacgctgaagcaatcaaaagattttccaaaggaattaagattattgcgaacatccctcattctaaactgaatgagattgagagccttttgagctacgtacccagtttagattctatagaaaaataa

SEQ ID NO: 4456 - DNA, 453 bp, Candida albicans
  unsure (94): Identity of nucleotide sequences at the above locations are unknown.
caattattccatcatttgtatttggtccaccatcatttggttcaggaaattaaacaaagtttaaccatttctagtgaattcattaattctattntgaaattgaaaccaaatgattcaattcctgcgtcaaaaggaggttgggttgatgtaagagatgttgccaaagctcatatcattgcctttgaacatgaggatgccaaaaatcaaagaatattgttgaattcaggtagatttacatctcaatcacttgttgatattattaatgataaatttccagatttgaaagggaaaataccagttgatgaaccaggttcagataaatctgttattgctgaaagtttggctactattgatgataccaaatctcgtgaattattaggatttgaatattataaccttgaacaatcagtttatgatactgttgaacaaattgttaatgctcataagttgtaa

SEQ ID NO: 4457 - DNA, 1041 bp, Candida albicans
aactatttccaatctttatcaaaatacatcagactaggtttagcgatgtccactactgtttttgttgctggtgccggcggatacattggaaaacatattgtatctcaattactttcaaagggttataccgttattggatctgttagaaatgatgaaaagggagaacgtcttgtatccttgtttgaaaatgataattttacctacgtagtagttgaggaagcggaggctaaaggtgcatttgacaagccgttgaaggatcacccacatattaaagtctttattgacacagcaagtcctttaccaattggagtcaattacgaaaagcagttgattagacgtacttcaaaaggaatcaagtacattttgagctcaattaaagaccacggacccaatattacaaaggtagtggttaccagttcaattgcctcgtgtatgaatgaaaaacaaagtcatgatcccaattttgttgttgatgaaagtaaatggaatccagataaacatagtgttggtaaaaataatcccacgtcggcctacttttatgcaaaggcatctgctgaacatgaagcctgggacttcatgaaaaagaaaacacatttcacacttgcaacaattcttcccggttatacatttggtccacagtgttttgatgaagatgtttccgatcttcttgaaacctctgttgagattgtcacgaaaatatttgaattaaataagaatgaccctatccccaaagagctgggattatttgttgatgtcagagatgttgctgctgcacatatacgggcattcgagctaaacgaagctcaaaataaacgtttgatgttagtctcagaacccttttcagctcaggaaattgttgatattttacacgaaatgtatcccgcggttcaattgccactcggtcaccctggagacaaacctaattacaaattcaacaatatcgaaaccaaaaaaattttaaatactgacttccgctctttaagatcaagcataaaggatgattatgaccaatatttaaggactcatggtattatatcttag

SEQ ID NO: 4458 - DNA, 804 bp, Candida albicans
caaaatcataaagaagttggagttttcattcatagtgcttcaccaatcccatttgctactgatagtgttgaaaaagatattttacaaccagctatagatgggacaaaaaatgttttaacatcaattaaaaaatatggtaatgagaatattaaaaagttggttataacttcatcaattgctgctgttgaaccattgggtacgggacaaactgaacctaaaacaattctggaaaaagattggaatccaattacttttgaacaaggtcttgctaatccagcagttgcttattatgcttctaaaacattagcagaaagagaagtttggaaatttgtcgatgaaaataaaaaccaattaaattttgatgttgccgtgattaatcctctgtttgtatttggacctcaagcatttggaattaaagataaatcagcagcattaagatcaacgggagaaatcattaattccgtattgaaattgaaatcaaatgatccaattccatcgttagtagcatcatttattgatgttcgtgatgttgctagagctcatattattgcctttgaggatgatgatgctattggtcaacgattaattttagataatgaaatattcactaaagaattgattgctcatttaattaaaaagaatttcccttctttggatatcccagaaggtgatattgttaaaagtgaagaagaaattgcaaattatccttggagagtagatagtaccaaaactgaaaaaattttgggattcaaatatatttcattggataaaagtgttgttgatactgttaatcaattgatttga

SEQ ID NO: 4459 - DNA, 453 bp, Candida albicans
catgaaaaaaaatacaaacagccattcataaagtacttaaatacatcaacacaactgtttttcaatatcttatccattcacgctcaactctatatagcaatgacaaaggttttcataacaggagcatcagggtttattgctcaacacattatcaaattattattatcaaaaggatacgaagttgttggcactgttcgttcaaccaccaaaggtgaacaattgaaatctttcatgccctcagatgccaaatttacatatgagatagttaaagaattgtctacacccaactcctttgatgaagcattgagtaaacacaacgacatagaatatttatttcatactgcatccccattgacatttgataccgaagacccagaaaatgttattcttcaacctgccattaaaggaacggaaaacattttgcatgcagcagctgacctttgtccaaacttg

SEQ ID NO: 4460 - DNA, 189 bp, Candida albicans
aaatgttgcaaaaggactcacattattgccttcaaaaaaaatgtaactcaaggtgaaagtttacttctagcaaaagatctatttacaacacaaagtaatttagatttgattcgtaaagatttgcctaaattggattctcaaatacctaaaggtgatccacctaaaactgaagattggaagaaaatttga

SEQ ID NO: 4461 - DNA, 1059 bp, Candida albicans
tcaattaaaaaatatcttcatataactactataatgtcttcatctactacagttttcgtttctggtgcttctggttttattgctcaaactttagtcaaacaattgattgaaaaaggttataaagttgttggtactgttagatccaatgaaaaaggtgattccttgaaggagaacttgaaagctgctaaattgcaatcagaaaatttcacttacgaaattgttaaagatattgctgttaaaggtgcttttgacgatgctttaaagaaacatcctgaagtcactgttttcttacataccgcatctccattccatttcaatgtcactgatattgaaaaagaattattaactccagctgttgaaggtaccaacaatgccttacaagccattaaaactcatggaccacaaattaaacgtgttgttgtcacttcatcatatgctgctgtgggaagatttgctgatttagctgatccatcaatcccagctactgaagaatcttggaatccaatcacctgggaacaatcattatcaaatccacttgctggttatgttggttccaaaaaatttgctgaaaaagctgcttgggattttgttgaaaaggaaaaaccaaatttcactctttctgtgatcaatccagtatatgtatttggtccacaagcttttgaaattaaaaacaaatcccaattgaatacatcatcagaaattattaatggattattaaattctaaaccagattctaaatttgataatttaactggttatttcattgatgttagagatgttgctaaagctcatattgtagcttttgagaaagattcaattcaaggtcaaagattaattttggccgaatctccattttcaactcaaagtattttggatttgattcgaaaagatttcccacaattggattctcaattacctaaaggtgatccatctcaagctgatgcttggaagaaagctgaaagtaagattgagaatgaaaagactagagaattacttggattcaaatttattgatttcaaaaaatccattgacgattcggttgctcaaattattggttaa

SEQ ID NO: 4462 - DNA, 645 bp, Candida albicans
acttcttcagatgctgccatttattccaatactgatgagacaaacccgacattatctttcaatgaaggaagttggaacaatagttcatatcaagatgcattgaaggataatattacagcatattatgcatctaaggcatttgcagaaaaattggcttgggaatttgtcttgatgcaaaaaccagtgtttggattagtggttgtaaacccatcttgggtatttggtccaaaagcatatgattttgatcctaaaagatttaatagttcgaatgaaatgattgatgatttgttaaaattgaaccacgaaaataattcaacttttgagaatgttagtggtggatacatttcggcaacagatatagctaaagttcaagtgtatgcaattgaatccgatgacttggtaaacaaaagattattaatgacaaatgggtatttcacctgtcaacagattcttgatataatcaataaacatttcccagaattaaacctaccaaaaggtaacccgggaacagaagcggaggagtttaagaaactagcaagagtgaacaataatgctaccagaaaattattgccttgggagtttgagcctttggaaactattgtcgttgatacagtaaaacaaattctagaatctaaacaaaactaa

SEQ ID NO: 4463 - DNA, 633 bp, Candida albicans
ctgctgcacctacagccattgaactcggggattgattttgatcatgacaaatactatacggaaaaagatgggaacccacccacaatagaacagaaattatcaaatcctgaagcagcatatgcttatgccaaaaaaatggcagaaaagactgtttgggattttgttgaaactgaatcaccaacttttaaagtaactgttgtcaatccaactgttgtttttggaccacaagcttttggagttaaagataaatcgaaattgaatttactgattgaaatgatcaatgatattcttactttgaaacctgacgatgaaattccaccctatgctagtcgatgtattgatgtgagagatgttgctaaagctcatttggttgcatttgaaaaagaggaggcaatcaatcaaaggttggtgttaataaaccagccattcagtaatgatttgcttgcatatattatcaaaaagagtttccccgttatcaatattccggaaggcaatttggaaagaagtcgagaatgcattgcaaaatcgtgtatcaaaacagatttgacaaagacgcaagaaattcttggatttgattacgttccagtggagaagacaatcctagatacaattcaacaactatatgacgcttga

SEQ ID NO: 4464 - DNA, 549 bp, Candida albicans
tcaaaaatacgatggtatgttttttataatagttgttcccacaaaaattcaatttgtccattcaatgttcatctgattactaacattttgtttccaggttccaaattaagaattggtattcttcatgccagatggaatagaaaaatcattgacgcattggtggcaggagccgtcaagagattgcaagaatttggtgttaaagaagaaaatattattattgaaactgttcctggttcatttgaattaccatatggttctaaattatttgttgaaaaacaaaaaagattaggtaaaccattagacgccattattccaattggagttttaatcaaaggttcaaccatgcattttgaatatatttgtgattcaaccacacaccaattgatgaaattgaactttgaattaggcattcctgttatttttggtgtcttgacttgtttgactgatgaacaagctgaagctagagctggtttgattgaaggcaaaatgcacaaccatggtgaagattggggtgctgctgctgtcgaaatggccactaaattcaattaa

SEQ ID NO: 4465 - DNA, 663 bp, Candida albicans
atgtcaaaatacattgttgagaataacattcgaaaagtaataccatattatacagactttcaaacatttgttaaaaaaagatgggaagcaagaacaataatcgatgtttatgaatcagattttggagaatgtcaacaaaatattcttgatgatattgaatcggagaaactatacattgtgaccaacagcaataaacctactgaacaatcaattctaactggagtcgaaacactaattaaaagaaagctcgatgagaaagatataatatgtcatactaaacatcgacacgaaccacctataccgtggcataatgacattatcaaactggtttatgaagatgacgagatattagtagttgacaaaccatctggtataccaacacatccaacaggcaattattattttaattcattatctgaaataattaagcagcaattgaatatggattctatttggacttgtcatagactagataaagtgacatcgggagttcttgtacttgcgaaaaccaagaatggtggagtgagattcctgaaattaatgagagattctaaacagtatacagagaaaacatatttggctcgagtttcgggtcatttcctgaaaggcatactccgattatcgaaggtcccatttttgccgtccaatatgattgggattttt

SEQ ID NO: 4466 - DNA, 1275 bp, Candida albicans
tactgtattgtcctttgcatgccaatatacaagagtggctgggtttcccctttgaaagctttagaaacgttatctttgacattatcacgaggaatgaaaagagccgcatcaccaagagctgaacaaccacctcatagcaaaaaggtggttgatgctaaaggatttagagtacgtcaacaaaacatcgataaacacaagataactagtgaaagcacggcaactcaaaaatcaattcatgaagaagaaactgaaggagccaattatgtaattgaaggtagattgcgtcgagttacgccgtacttctacacatatctaacctattgcaagttacgttggcaagataggaaattgatcgatgttttcattgatgaatttagagatcgtacccctgatgcatatcgtatggcagtaaaggaaaggttagtcaaagtcaattctcaagttgcaaatttggaaacgattttgcgcaatggtgatttgatttctcatagaagctatcgtcgtgaaccacctgtcagctccagagatataaaaattgtttttgaagatgatgatttgcttgtgatagataaaccaggtgggataccggttcatccaacaggtagatatcgatacaacactgtcaccaaaatatttgaacatgaaaagggtaaaattgttcatccatgcaatagacttgatagattaacctcgggtttgatgtttttggggaaactgtccaaaggagcaaataacatgatgctgcagattagagatcgaaatgtgacgaaagagtatattgccagggtaaaaggtgaattccctcttgaccgtattattgtggataaaccattgtctacaaagtctcccaaattgacattaaatgttgtcgatatggaagatgggaaagatgctaaaactgaatttcaaagagtgtcatatgaccccattacaaatacgtctgttgttaaatgccacccattaactggtcgaacccaccaaattcgagtgcatttacaatttttgggatatccaatagctaatgacccaatatattctagtgaatttgtctggggtaaaaatttaggggaaaacggagaagctgatttggatcaagtgatggaaaggctacatctaattggtaaatctcgtgcagcaacttcatggatccacccggaaggtgatggggaagtctcattatatgagatttgtcccattactggtttgcccctcttctatcctgatccagggttcacaccatacggattcattgttggcatgcttttcctattatga

SEQ ID NO: 4467 - DNA, 624 bp, Candida albicans
atgtcaaaatacattgttgagaataacattcgaaaagtaataccatattatacagactttcaaacatttgttaaaaaaagatgggaaggaagaacaataatcgatgtttatgaatcagattttggagaatgtcaacaaaatattcttgatgatattgaatcggagaaactatacattgtgaccaacagcaataaacctactgaacaatcaattctaactggagtcgaaacactaattaaaagaaagctcgatgaaaaagatataatatgtcatactaaacatcgacatgaaccacctataccgtggcataacgacattattaaactggtttatgaagatgacgagatattagtagttgacaaaccatctggtataccaacacatccaacaggtaattattattataattcattatctgaaataattaagcaacaattgaatatggattctatttggacttgtcatagactagataaagtgacatcgggagttcttgtacttgcgaaaaccaagaatggtggagtgagattcctgaaattaatgagagattctaaacagcatacagagaaaacatatttggctcgagtttcgggtaaatttcctgaaggcatacatcgatatcga

SEQ ID NO: 4468 - DNA, 336 bp, Candida albicans
agcctcagagagagggcgggggaaataatgtttacaagggaaaacattccactgtttttggaaaaattggacaagcaagagtggggtgcatacattcttatggagttgataaatccgccaactcacaagaataaaatcatcagaaacaacgaagtctttcacgaggatattatatccgagttgggggtgtttggaacaacagtatttaatgaaaagacgggtgaaattttgaccaacaaaaatgctggttggttgttgagatctaaattcagtaacagcaatgaaggtggagttgctgccggttttggctgcgtagataacatatatttatattag

SEQ ID NO: 4469 - DNA, 441 bp, Candida albicans
aagcgtcggtccttccagccccgtggtgaagagatgttaacccgaaaaaattgggctgctaggttgctattaggggatacgttagctattaaatgtccgtctgttttgacccagttatcaggaaccaagaaggttcagcagttgttaacgaaaaaagaggttatctccaagtttttgtccaactcgagtgatcaagaattgaatgaggtgttgtcgacttttgttgccatctattcgttagatgattccaacgaaggcgatacgggtagaaaattagcatttgaagagcccgaaaagtttgttttgaagcctcagagagagggcgggggaaataatgtttacaagggaaaacattccactgtttttggaaaaattggacaagcaagagtggggtgcatacattcttatggagttgataaatccgccaactcacaagaataa

SEQ ID NO: 4470 - DNA, 456 bp, Candida albicans
  unsure (401): Identity of nucleotide sequences at the above locations are unknown.
ccacatacattcattgccaagtctttgaactacaagaaaatgagcattaaaccgtttccagaattgtctcacgaccaagaaaaagaacttgtgaccaacttgtcacaatggtcgcttgggaatgggttagttatgtacccacccaactttgaaggtttccaagccaatgttgcgccaatcacattgttcccaacacctatccccaaagaaagtttccatcgcgccgtcaaagttcaaaaattgtttaatgaattatacatcaatgtgataacaaaggacgtaaagtggttctcatcgatccttgaagacttgtccaaacatgattcagagtttactggaagattattcgaggtgtatcaaaaactgagcaagattcagccattgtcgttggggttatttanatctgattatatgatacatcaggacaccaatgaaatcaagcaaattgaattcaat

SEQ ID NO: 4471 - DNA, 717 bp, Candida albicans
  unsure (658): Identity of nucleotide sequences at the above locations are unknown.
tctatcacaccttcagactcatcatcatcatcatcatataatcatatccaaccatttgtatatcttgaaagtacggcaactacacaaaccaatcacaatgttttacttattttaaatcaaaaaatcactattgatttaatatcactatggaaaaaatgtgaaatcatagtatgtgccgatggtggagcaaatagtttatatgaatatttcaacgacaacaaccaccaccaccaccacgaaaatttacaaagaagtgattatataccagattatatagttggtgattttgattcaatttctcctgatgtgaaaacatattatgaatctcatggaagtaaaatcattcgtcaatcaagtcaatattataatgatttcaccaaatcaatacattgtattcaattacattatcaattgaatcacaccaaagaaaattggtttgaatctattgatgaagttgatggattagctaaattatggaatggtttaaataattctagcgatgttgttgttgatattgatattacaatatatgttcttaatgctattggtggtaggtttgatcaaacagtacaatcaattaatcaattatatataatgaatgaagattatcctaaagtgacggtttttttcataactaccaatgatataatttttttanttgaaaaaggggggttaagtttttacacaagccggctggaaggaccacgctcgggtgtc

SEQ ID NO: 4472 - DNA, 300 bp, Candida albicans
tcgtatctccacggccgggaagatttgggattgaaaaagggggttaattatattagttataagaatagactcatgtttcataaagataatggatcatcaccaactccaacatgtggattattaccattaagtaataaaactccaattatattgaatagttatggattgaaatatgatatgaggaattggaaaacggaaatgttgggacaagtcagttctagtaatcgaataagcggtgaaactggatttattgttgaatgttctgatgatattgtaatgaatattgagattgatgtttaa

SEQ ID NO: 4473 - DNA, 1011 bp, Candida albicans
ctcttcggacatggatcttctacggtcgtggcaatattgggtgatttaagattttctgcagaagatattttgtatttgcatagagtattgccgcaattgccatcagactatttagaatatttggcggacttcaaattagtcccatcgtcccagatcaaatatttggataatgatgaaggggacttcgaattggaaattgtcggtaagtggaatgacactatactttatgagattccgttattggcattagtgtctgaagcttattttaagtttgttgacaccgactggaattacgaaggtcagtacgctttagcacaaaaaaaggccaagcagttaattagcaatgaatgtaatttcagtgaatttggaactagaagaagaagatcatacgagtcacaagaaattgttatcaaggcaatcaaagacgtgcaaatagacactcaatcaaagtacattgctggtacgtcgaacgtttattttgccatgaaatatgatttgccacctataggcactgttgcacatgaatggtatatgggaattgcatcaatcacacaagattatgtgcatgcaaataaattggctatggattattggattgatacatttggagcaaaatatgcagggttggccttgacagatacttttggaacagacaactacttgacaatgtttgttgctccctatgtaaatgaatactctggagttaggcaagattcgggggatcctgaattgtatgctgagaaaattgcccgtcattatgaaaaaatgggtatagcgaaaaataccaagatcatttgtttcagtgactccttgaacgttgaaaaatgtttgaaatataaaaatacagcagataaattgggattaatcagtacttttggaattggtacgtttttcacaaatgatttcaataagttgtcaaatggcgaaaagtctcagccaatgaacattgtcattaaaattaaggaggcaaacggtaaaccagccattaagatcagtgataatattggatag

SEQ ID NO: 4474 - DNA, 1557 bp, Candida albicans
  unsure (31),(80): Identity of nucleotide sequences at the above locations are unknown.
ttcattcaacacatgaatcaaacaactgaanctgattgtatgagaattaatttacaacgtacatataaagatgccattantgctttgaattctttacaatcaaattttgcatcaattgaagctaccaagaaattaggtccaagtgtaaatcgtaatgaattatcaatatatgaagtacatgaatttaccaaaagattaggatatactcctactgattttaatatactcaatattattcatattacaggaacgaaaggtaaagggtcaacttgtgcatttacagaatccattttaaaacaatatccaatttccaaaatcggattatatatttcaccacatttgaaatcagttagagaaagaattagaattaatggacaaccaataaatcaagaaaaatttgccaaatatttttttgaagtttgggataagtttaccactacaaaatctgatcctcaagaatggccaactttacaaccatgcgatcaagtcaaaccaatgtatttcaaatatttaacaatcttgtcattccatgttttcttacaagaaggggtagatacagcaatttatgaagttggtgttggtggaacgtatgattcgaccaatataattgataaacctaccgttactggtatttcagcattggggatagatcatacgtttatgttaggagacaatattgccagtattaccgaaaataaaactggtattttcaagaaaggggtaccggcatttgtatcaaaacaatcggaatatccagaaacgcatgaattgattgaaaagagagctaaacaattgggagtttcttcattagaatttgttgacactgaagatttaccaaatgtgaaattaggattatcaggggaattccaaaaacaaaatgctgcattggcaattagaatagctaattcacatttgaaaaccattggtataacccaagatttacctgagtttaataataacgatgggaaaatcaagaaattgtcaaatgaatttataaagggacttgaaaatgttgattggcctggtagatgtcaaataatcaataataatccaactgggataacttggtatattgatggtgctcatactatagaatcaataaatgcttcctcaacttggtttaagcaagaacaacttaaattagagaaacctaaaagacgagcattattgtttaatcaacaaggtagagaaaactatgctgaattattggaaaaattatttaatgtaacgtatggtacaggatcagaacctcaaatcaaatttgatgatgttatatttacaacaaatactacttggtcttcaggacaatttaattcggaattgatttctaaaaatacttcagaagatgctgttaaaaaacttgaagtgcaaaacaatttaagtgaagtttgggggaaattagatggtggtgtttccaaaagacacgtttttgctgatattgaaactgctgtcaattatttgaaagatttgggggatgaggatttacaagtgtttgtatgtggttcattgcatttagtaggtggatttttagttgttcttgataatgaaagagattga

SEQ ID NO: 4475 - DNA, 525 bp, Candida albicans
  unsure (485),(492),(516): Identity of nucleotide sequences at the above locations are unknown.
tgtatgactttatctaaaatgaaagtcgattataccttatatttggtaacagattcaggaatggttcctgaatcgtcttcatttctcaaacaagttgaagactctatcaattctggagctacaatagttcaattacgtgaaaagtccctttctactttagaatttatcaaaagagcagaacaagtccataaattgacacagaaacaaggaatcccattaattattaatgatcgagttgatgttgccctagcagtgaacgctgaaggtgtccatgtgggtcaagatgacatgcccgcggcaatagcacgaaaattgattggcgacgacaaaattctcggagtaacttgttctaatgttactgaggttcaggaagtggtcgagcaaggaattgctgatcatgttggtcttggaacagtttatccaaccaatacaaaaaaagatgtaacagatcctgaaggaactggtcctagtgggaccagaagctnttcttcncgagcgcacgagccgcgaagtagntatggagga

SEQ ID NO: 4476 - DNA, 1095 bp, Candida albicans
atcaaaggatatcatttttatactttaaatttagaaaaagccgttgcttctattttagataaatctgatgttttgcgacaggttttggagggcccttcttatgcaacgagatttgaagatgctgttgcatccgattctgatgacgaagatgagccagaaaaagcatcagaaagagatattacattaaccaagacaatcaaaccacgcagggtctcttccataaatgacaatgagcttacatctagcaaggctctagttggtaaggcattgttaaatgataaaaaagttcttgttgatattagtacaggaaagggagcacttggtaaagatgcaatttgggatgactttccaaatggtagatttggtgactcaaattcccctgcatatggtgaaattgatgggtatggtcctactttgaaaattcatactccagcagaagcatcgacgaaatggggtacacctgaatcaatagctgatttgacccaagtatttattaattatttatcggggaaagtagatgttgtcccatgggccgactcttcgttgtcaccagaaactgctttgatacaagaggagctatttcaattgaatgaaaaaggatggttctctgttgcatcacaaccagctgttaatggatgcaaatcaacggataatatttttggttggggaccacgtaatggaatcatatatcagaaatcattcattgaattattcatgcccaaggaggattggaagaaattattgttgaaaatagagttggataaaacagtgacttattacgtagggaataaggatggtgaaataaagtccaatttgccaataggacctaatgttaagttgtcaaagaatgcagtcacatggggtgtcttcccgctgaaagaagtggtgcagccaacagtaattgattatgaatcatttaaagcttggaacgaggaagcgtttttgttgtggctcgaatgggccagatgctacaagaaaaattccaagtcgtttgaattgttgaattcgatttatgaaaactacgtattggtcagcatgattcatcatgatttcataaatgaaaacgcgttatgggacctattacttgacgaatag

SEQ ID NO: 4477 - DNA, 822 bp, Candida albicans
cttaatgcggatccggcagtccgtggtgaagaaatgagtcctgtgatggaaaatgtaaatatggagtcattcaaagactcagtgaatgctgaatctagcaagccgtccgagtcggacatgaaattttactaccagcgtctcttaccgttccgttatattttccaatggctaagtcactcgcctaaaccaaccaaggatttcaccatgagagaatttgcgtatgagtacagatctaagatataccaacgttataactcatttggaacgttagaagagttcaagaaatctgtggttaccgccaaccccacacgttttgaaattggggcagtctacaaaatcaaccccaaggaacgtaaaaacttaccaaaacaagcatttaagcctgaaagtaaggagctcgtttttgatattgatttaactgattatgacgatattagaacttgttgtcagggtactgatatatgctgcaagtgctggaagtttattcaagtgggatcgaaaatcatcgaagcggccttgagagaagattttgggtttgagcatttggtatgggtattttcagggagaagaggtgcgcattgttgggtaagtgataaacgagccagggaattggatgagactagtcgaaaagcgataatcgattatttggatgtattgagttccaaaaaccagaatggtagtttaaatattaaaaaaccattccatccacatgttgaacggtcatttgaaattgtgaaaaaagaatttttgaatgtgattctacaagaacaagatccatggaataccacatcggaagagaccaaggcctggaaaccaagttga

SEQ ID NO: 4478 - DNA, 636 bp, Candida albicans
ttctacaagaacaagatccatggaataccacatcggaagagaccaaggcctggaaaccaagttgaggaattgttggcatttataccaaacaaggcatggcaaatagagttgaaaaccaagtggaaaggtcagacatttgggtctacatcaaaagaaaaatggggtgatatcagtacagtggcatcaaacgtgctcaaatcgaattctcaagtagcacaattaacggaagccaaaaaggatataattatttattatatgtacccgagattggatgtccaagtttctcgacaagtgatccatttgttgaaatccccattttgtattcacccgggtacaggtaatgtttgtgttccgtttgatccgttgaaaaatatatcagggaatcctgctgatgacgattatgggttcaatccgaaatcagcacccaatttacgcaaaatacagaatgaattggaagaatgggaacaaaataggtcggatgagaatgacagccaagaaaaagttattgccgattacgagaaaacgagcttgaagccatatattgattactttgccaagtttgtgaataatttgcttaaagaggagttgaaaggtactgaaaaacgatcgagagaagaagatccattgagtttttag

SEQ ID NO: 4479 - DNA, 1110 bp, Candida albicans
attcatcatcggattaatttgggccaaaaaattacttccgggaagcgaaaaacaaatttacatcaacaattatttaattctagtgggaatttaattaaaaatcaatttatgttacaaggagaaaatttaactaatgatcaattaaaacaatttataatgtataaagagaatttcattaaattaccatttgaaaaaattacggggaatttaattagtaatcgatcaatttttttatttaaaggttatggatatttaccagctagtttacaattaaatttattgtcaattgaatttataaatattttgaatgataatttgattaaaacttttcaaacaattccaagattagaagaagatgatcgattattaccattacttaataatttatcgaaaaatttttcaaatttccaatatgaatcagaaataaataagttagatgaagaatttatttctgatattaattcaaaactgataattactcctaaaattactaaacattatccattatgtgctcaacatttacaacggaatttaattgctaattctcatttaaaatataatggtagacaacaattggggatttttttaaaaggtattggattaaatgttgatgaagctcttaaattttggtcttctcaattcattaaaaataattccatgtctttagaaacgtttaataaagattataaatataatattcgtcatcaatatggattggagggggcaagaattaattataaaccttgggattgttccactattttatctaaacctcgtccgaatattaaatctgaatatcatggttgtccatatcgtgatttcaatttagatgttttaattaataatttgaataatatggggattacggatcaacaagatttgaattcaattgttgatgatgttaataaacatgtttatactattgcttgtactagagtatttgaattgactcatcaaaaacaattaatgggcaaagaaaatatgaatatgcatattaatcatccaaatttatattatgatagatcaagacaattagaaagaagtgaaaccaaagataaagaatttgttaacacaggtagtagtagtagtagtagtagtactgattcatag

SEQ ID NO: 4480 - DNA, 660 bp, Candida albicans
cgcgtgaaattttattttcttttttttttttattttaaacaacaaacaacaaacaacaaaactattcttcttctattcatatcaacacacttctacctctacattatgtttagacaagtgaaaagacgtacagctggtagaagaaattttgaagatagtactagcacagctactactactactactacttatactaacggtgaaaaggattcaccaaaatatcttaccccgtcagcattatacgcttcaaggttatcattttatgatttacctccaacccaagaaatcacattagaagaatttgaaacatgggctattgatagattaaaaatcttaattgagattgaatcgtgtttagcacggtctaaaacattaaaagaaattgaaacatcgattaaaccattattattaaaatatttaccattaaatccaacgagcggtggtggcacggtaaattatgaaaaagaacgaatgaaagatcattatagtcattttattcttcgattagttttttgtcgtagtgaagaattacgcaagaatttcattacaaatgaactgacattatttaaagttagatataatttattacaacctaaagaacaacaagaatttattgaattaattcttcaccacgcgggctggacggatacgcgcttaagt

SEQ ID NO: 4481 - DNA, 783 bp, Candida albicans
ttaagacggcgtggcatgctatcagagaaatcaactccaacaaaagggaaaacttacttgcagcagttgttacccactcaagcaggaaatgcccctaaatatataagagtgactgaatcgcctcaaataaggaagtctcctataaagagtatactggaaacactgctgccaattaaagttacaaaacaggaacctgtatatgaagagtctcagtcatatgatacctcagtattaaatgagttaccgtcttcgattaaggaatctgtcataagggatgtggagtataaagaaaagattaaaaagtttgacttggtttcaatgcgagataaattggctcaaaaattagagaacaaaaaagtgccagtaaacgaggttacgtcagactggctcaaaagccaagaaaaacttaataaaacacctttattcttgaatgagcaattgaaggataatgagttatctgtaaagttggatgattgggtgaaatcgtccctacttcaaggaggaccacacgaggaagacatggattattttgctttgtttgtacagacaatgttgcaacgagatcagtttaatagagttttgttgttattgagaagacttaaggaaagattaaagtaccataaaaccttaataaactgtcaagttttcaatgaagaagaatatttggtgtatgaagaatcgtttgaagattggtataaacaattagataacaaagtacagccactagttgattgttattcaaaggagaaaaagattcaagtgggctatataggagttgtttag

SEQ ID NO: 4482 - DNA, 2583 bp, Candida albicans
ttcaaccaactgttagaaaccttgatggataatgatcaggaaaacgccaactctgaagagtatcctagtttcttgagatctttagatgatgagagtttcatcacacatatccaagatttaaacaagcagcatctgcaaaagaatcggcaagactatccctttgaacatgtctctacacccaaaaagatggcgtctttcaacagtgccatcagttcagaccctttcgacgatggattagatgaagaaataatcaatcatgttaacaaaattgacgacaagaaagctttatccggtgacgaagatgacaacaacaaagaaacagtgggtaaattgcatgaatttggtgattatgccacttatttccattctaaaagattgaaacaacaaaaacaagatgaagagtatgtgaaatgggataagaagagacgcaaattgcaaaatgtcgaatacgagccgaagcagatttttaaagggtgttctatttttgtaaatgggcatacgaatccctctataacagagattcatagattagtgattctacacggtggacaatttgtgagctacatggttaataagtcaagtgtgacacatatagtttgtgatcgattgacaccccgaaaaagtatacagttcaaaaattgtcgcgttgtgaaagctcagtggattgtggactctgttgcacaacagacattactagattggacactttacagactgatactggaagtagcttatgaccaaagaagattggattttgccaaacaactgactattgaagaaagcaaggagataaacggcgaatgtgagaataataaagaggaggacttagatggtgagataaattcgtccttatttggtgaggataacgcagacttcttagataaactgcaagagttggaaactttttttgagaaacgtgaaggtcttgtacaagagccagaagaggacttgccagttgtaactgatgagcctccacaatcgggtaaaggtattcataaagtgaataacaagtacgtcctagatgcacggcatccagactttcttccaaacttctttgcaaactccagattacaccatctcagtgtatggaaggctgatctaaggcttaagtttcttcgtagaatagtgaaggaaaggttgcaccagccagctagtcactttcaaaatccattcatagacccaggtgagaaaaaagtaattatgcacattgactttgactgtttttttgctactgcatcttgtttgaagcgaccagatctagacctgagtaagcatcctatagcggtttcacatggtggtaaaacttctgatatagctagttgcaattatgttgctcgaaaatatggggttaaaaatggcatgtggctcatgcaagcgacaaaattgtgtcctgacttaattttgttaccctatgagtttgaaagttatgaaaaattttcttctgaattttacaattacctattgacaagcaaattttttgattctattttccctgtcctgattgatgaagtgttagttgatgccacatcttattgtcatagtggagtcagtgatagtgtgagtttagtaaatgaattggctactcgcattcgcaaagatgtgtttaagttaacaaattgtcccgtgagtgttggtgcttcaacaaatgtcctcttggccaaattggctcttagaaaggcaaaacctaatggccagttttacttgtttgatgacattgaaaagtttttggaatctatatatatcaaagatttgccgggttttggaagagggatattagagaaattaaattcagaaatacagtttagtaaccctcaaatcaaagatgttgtcactatactgaaacaaagacttgtccagttattaggagagaaaacaggcaccaagttgtttgaatatgccagaggaatggatgaaacaagtatcgaaattgataccaataaccctgaagcggtgttaggtagaaaatctgtttcggtagatgttaattttggtatcagatttgacactgttgaagaattggatgattttttgatgaggctttctcgagaattatatcagagacttgtatctctcggtatatgtggatctagtttaactcttaaacttgccaaaagagctgagggtgcaagtataaacccacctaaatttttgggaatggggcgttgtgattttgtcaataaatcttccaaattaggtgtaccaaccaatgattggggtatcataggcaacgaagtgaaagtactttacaggatggtgaacattcctgttaaggagttgcgtggtatttcaattactatttcaaaactagtggacgctgaaggtgtcaaatctaataaacagatgagattgccctttaaaaaggcagagagcaatgcattgagtgtgagggatttaaagcaattgcaaaagatgtctgattcgaaagataataaatctcagaaattgatattcagcaagcaactgccagaaaaaagacatgttaataaagttttaattctgcacgaatttgctgatttcaaaagcttggattgggaggttttccatgtactacctgatgaaatcaaactggaactaaaagtataa

SEQ ID NO: 4483 - DNA, 1545 bp, Candida albicans
  unsure (1321),(1441),(1474),(1533): Identity of nucleotide sequences at the above locations are unknown.
tactttcttgctcttccactaacgacattactaaagacgactcatgaatcatccaaaaaaaaattttctgggtgctcttttttctttttcacattttccacgccaacaatgaatgttttagtatattctggccccggcactacaactgagggcgtaaaacactgtttggagactttgagactccatttagggtcgtattatgctgttcttcctgttaacgagactgtgttattgaatgagccatggatgagaaaaacgtccttgttagttataccaggcggagcagatttaccatactgtaatgtacttgatggaaatggcacgagaaagatttccaagtatgtcaaacaaggtgggaagtttttagggctttgtgctggtgggtattttggatctgctaggtgtgagtttgaagttggcaatcctaccatggaggttactggacctagggaacttgggtttttcccaggaacggccaagggatgtgcatttaaaggtttcaagtacgaactgcgtactggtgcaagagccgtcaaattgctggtcaatacagctgcattacctggatgtgcaagtcacatttataattattacgatggcggggcggtgtttgccaatgctgaaaagtataaagatgttgaaatcttggcaaggtacgacgacaaaactgatattgtggatttagagaaggctgctgttgtatacagaaaggtcggtaagggtggtgttattttgagtggtactcatcctgaatttgcacctcacttgttgcatccacgagatgaagatggggcaggttattttatagtggttgacacacttcgagcatacgatcacaacaaaaaggtatttatgagagactgtttgaagaaattgggcttgcgagttgccgagagtgttgatacaacgattccaagagttacaccaatgtatgttgtatctccgttcaaggataaagttagggatgtatacctgattttaaccagcaagttaggtaagctgtttgaggatagtaatgatgctttttattttgctgacgaaacgcaggaaactagtgagtatgttggtagtgaagaagatccagtcaagtatatcaactttctcactctggccggtataccggatttgaaaatggttccctattttgacatccaaaagtattttgataatttgaggatgttgtcgggtggtgacatcaagtttgggagcattttaggttattccgaggtgattacatctacaaacacaattatggataagaatccgcaatggttagagcatcttcctaatgggtttaccattactgcaactacacaaatancaggtaaaagtcgcggtggcaatgtatgggttaacccccgcggtgtccttgcaacgtcagtgcttttcaaaataccaccttcaccctcgtcgtcgtcaacggtggttacattgcagtatntatgtggattggcattgattgagtcgattctanggtatggaaacaacgtttcagggcaaggcgttgggtatgaaaatatgccgttgaaaatnaaagtgggctaa

SEQ ID NO: 4484 - DNA, 546 bp, Candida albicans
aaccagaagtatttcaagtcgttggacgataaaagtgatataagtgccactgttgatggtgacgatgagaagtttgtcaaggtttcaggtgcattgattaactcgcaatttatcaacaaaaccttttatttggtatggggaggtggagttaatgtatcaaatccagcaccaacaacgtcattaaacttggttttagaaaagttgaatgagatcagacgtggaaagggtttatcaccattaccaccatacgaaccagaaatattgcttgcaaagcttatgtttaccattgaccagttttattctgtatttgaaaagtcaggattgcaaccatttttgccgttatactataaacggtggttccataccaaccagaaagtggacgttgacaatggcagtgggaaacaaagaacatgtataatcaagggtattaccccagactatggattgcttattgctgaagatgtagagacgaaaaaagtgttgcatttacaaccagatggcaactcgtttgatatttttaaaggtttagtatataagaagaattaa

SEQ ID NO: 4485 - DNA, 1329 bp, Candida albicans
gtggacaatctgttttccaggatgttgctgcccccacatcaagcatcaattgaacaatataatattgtcaagtacattggtggcagcggtccatatattcaaaattcagggtatgggatttctactgatataccagaaaaatgcactattgaacaagttcaaatgattagtagacatggtgagcgatttcctagtaaaggagatgggaaatactttaattcagtgatggaagttttcaagagatatggtgaatttcatggagatttatcttttttaaatgactatgagtatttcgttactaatccagattattatgaaaaggagactactcctaaaaactcaaaaggtccatattttggaactacaaatttattacgacatggagcttattttagaaaaagatatcaatcactatttgaccaaaaggagaagcttgttgtgtttactagtaattctggaaggtgttatcaaagtggtgtctatttcgctcgaggatttttaggagatgattactcagaagatacagttgaatttgttgttgttgatgaagacaaaaaaatgggtggtaattcattgacaccaagatacgcttgtaaaactttgaatcaagatttacacaaagatttggtgaatcagtacgataagacttatttggacgatattttatctagatggctagtagacaatcctggattagatttaagtgcagatcaggtctcgtcattatttctttggtgtgcctttgagattaacgttagggggtattctccattctgcaatctatttacaaaagatgaatttatcagaagtgggtaccgaaacgatgttggtaattactatcaaactggtccaggtaataatatgacaaaggtaattggctcacctatggtggaagcgtcgttgaaaatgcttcaagaagattcaaaaatttggttgacatttacccatgatactgatattgagatgtatttgacatctttgggattgattgttccaccaggggatttgcccgttgatcgagtaccatttcccaatccatataatgcagcagaatttttccctcaaggtgctagaacttacactgaaaaattgaaatgtggtgaaaagcaatatgttagatttattgtgaatgatgcagtttatccatatccggattgtagtggaggtcctgggtttacttgtgaattgaatgattttatcaaattagttaaaagtcgtttacatgatgttgactataagcttcaatgtgaagtggacggaccagcggaattgacattttattgggattataaagacagaaagtataatgcgccgttaatagatcagtaa

SEQ ID NO: 4486 - DNA, 1494 bp, Candida albicans
atagaaccctataagtccataataattcaattgaaggattattttcttttcccttttctgattactttcaccaattttcttctctccaaaaaaaacaccttcttcatggtttctgtttctaaattaatcaataacgggttgttattaactagtcaaagtgttttccaagatgttgctactccacaacaagcttgtgtgcaacaatataacatcgtcaattttcttggcggtagtgccccttatattcaaagaaacggatatgggatttctactgatatccctgctggttgtgaaattgctcaaattcaattgtattcaagacatggtgaaagatacccaagtaaaagtaatggtaaaagtttagaagcaatttatgctaaatttgaaaactacaaaggtacttttaaaggtgatttggctttcttaaatgattatacttattttgttactgataaaaacaattacgaaaaggaaactagcccaaaaaattctgaaggaacctatgccggtacaaccaatgccttgcgtcatggtgctgcgtttagagccaaatatggatccttatacaaggaaaattcaacattaccagttttctcttccaattcaggtagatgttaccaaacttcaagatattttgctagaggatttttaggtgatgactttgaagaaggtaaaactgtcaagtttaacatcatttctgaagatgctgatgttggtgccaatagtttgactccaagaagtgcatgttccaagaacaaagaactgagcagtagtactgccaaaaaatataacacaacatatttaaatgctatcgctgaaagattagttaaaccaaacccaggtttgaatttgactacaagtgatgttagcaatttgtttggttggtgtgcttatgaaattaatgtcagaggaagctcaccattctgtgatttattcaccaatgaagagtttatcaaatattcttatggtaatgacctttccaactattattctaatggtgctggtaacaattacaccagaatcattggttcagtgattttaaattcttctttagaacttttaaaagacactaaaaactccaatcaagtatggttatcatttgctcatgatactgatttggaaatttttcattctgctttaggattattggaaccagctgaagatttaccaacatcttacatcccattccctaacccatacgtccattcttctattgttccacaaggtgccagaatatacacagaaaaacttcaatgtggaaacgatgcttatgttagatacattatcaacgatgctgtcgtgccaattccaaaatgtgctactggtccagggttctcttgtaaacttgatgattttgaaaatttcgttaaagaaagaattggagatgttgactttgttaaacaatgtggtgtcaatagtacctacccatctgagcttactttctactgggattataaaaatgtcacttacaatgctcctttaggtgatttttaa

SEQ ID NO: 4487 - DNA, 1215 bp, Candida albicans
gatgcgggttgtgaaattgctcaaattcaattgtactcaagacatggtgaaagattcccaacagcaagtagtgggaaagattatgagaaaatttatgctaaatttaaaaactacaatggtacattcaaaggtgatttgtcattcttaaatgattacacttattttgtcaaagaccagagtaactatgctaaggaaactagcccaaaaaattctgaaggaacctatgccggtacaaccaatgccttgcgtcatggtgctgcgtttagagccaaatatggatccttatacaaggaaaactcaactttaccaatcttcacatccaattctaacagagtacatgaaacttcaaagtatttcgctagagggtttttaggtgatgattatgaagaaggtaaaactgtcaagtttaacatcatctctgaagatgctgatcttggtgccaatagtttgactcctagaagtgcatgttccaagaacaaagaactgagcagtagtactgccaaaaaatataacacaacatatttaaatgctattgctgaaagattagttaaaccaaacccaggtttgaatttgactacaagtgatgtcaacaatttattcagttggtgtgcttatgaaatcaacgtcagaagaagttcaccattctgtgatttattcaccaatgaagaattcattaagaactcttatggtaatgatctttccaaatattattctaatggtgctggtaataattacaccagaatcattggttcagtgattttgaattcatccttggaacttttaaaagacaccgagaactctaatcaagtatggttatcatttgctcatgatactgatttagaaattttccattctgctttaggattattggaaccagctgaagatttaccaacatcttacatcccattccctaacccatacgtccattcttctattgttccacaaggtgccagaatatacacagaaaaacttcaatgtggaaacgatgcttatgttagatacattatcaatgatgctgtcgtgccaattccaaaatgtgctactggtccagggttctcttgtaaacttgatgattttgaaaatttcgttaaagaaagaattggagatgttgactttgttaaacaatgtggtgtcaatagcacttatccatctgaacttactttctactgggattataaaaatgtcacttacaacgctcctttaggtgatttttaa

SEQ ID NO: 4488 - DNA, 1065 bp, Candida albicans
cttaataataataatttaattatgtcaaaaactgtcattttaacaggagcttcgggttatattggtcaacacattcttggagaattattagaccaaaattataaagtaattgccatagttcgttcccaaaaatcatcagatacattatcaaaactattcaaacaaacccccaaattacaatttgaaattgttgaacaatttgacaaaccacacgcattagataaagttttggaaaaacataaagaagcaacaatttttattagtacagctgctgtggtcacttttcatgctgaagattatgaaagagatgttttagatccagcaattgatctagttaaaaacattttttcaagtatcaaagaacatgctccacaaattactagagtaatattaacatcttccagtgcttcagtagttggattagataaggcattttcatatgatgctgaatactctgataatgattggtctccatttactcgtgaaatgagtacactggatggtaccatggcctattttgcatcaaagaaatgggcagagaaagaaacttggaaattccttaaagaagaaaaaccaaattttgatcttgttgtcataatgccagcattgattcttggtccagttcgttttagttctgaattgaaaaacggtaaatttccttccacatctggtatcattggaggattattacatttgaaatctgatgatcctatccaaccaatggcagcaggtgcggttgacgttagagacgttgcaaaggtgcatgttgatgtgattacttcggaaaaagcttcaaaccaaagaattttagttgaaagtggtaaagtaaccaatgataatatcattcaaaccatcattgacaattttcctagttacaaggacaagttacctacccctaacccagtgccacattctaaatttgtgaaacccaaagatgaacgctcaagaaagattattggattctcattaaggtcattaggtgattcagtagttgatttggtcaaacaaatcgatcaggagaattcagtaatcgaatcaattaagaaattagatattaaaaaatag

SEQ ID NO: 4489 - DNA, 543 bp, Candida albicans
ctcaaattgtggagaaattgtgtctatgtgtcagtttgtgttgataattttttaggttttactattttttttttgttcaggctggcactgatccatataaaagactccactcatcagattaccttcacaacaatccaattaacaatgacaaacttaccactcaaagaagtcaaacggcaattgcgaaagcaacttaaatctaatttaaaaaccattacgcaagattcattaatcaaacaatcccatctaatccatcaaaatctattgagtcatgagtttttcaaaactgccaacaatatagctgtgttcatgaatatgcctgatctggaagttaagactatggaaattattgaaagctgttttaaattgggcaagtctgtgtatctaccacgatgcaactatgtttcttcaccaggaagaaaatcaaattatatgtcattacttgaaatgccttcacttgaagcgatacaccaacttaaaccacaggggaaatatcaactcttagaaccattattattcaccacgcggctggaaaatcacgct

SEQ ID NO: 4490 - DNA, 621 bp, Candida albicans
aaaatccttttttatggatattttgtttcgaaaacttttgctgaaaaagaagtttggatatttttacaaattgaaaatccaaaatttaatataacgacaattaatccaggtatggtattaggaccacaagcatttcccataaacaaccataatggtggtggtgctggtgctggtggtactaacaatttagaattgaatacttcatcacaagaaatagttcgattattgaatttatcaactgttgatgatgttaataaagttaagatttcaactaaagtagagaatacatttattgatgttagagatgttgcaaaagctcatattatagcatttgaaaaacctcaactaactaaaaataaacgattactattaattgaagatatttataatgaacaaacattacttaatatcattaataacaattttcctcaattaaatttaccaaaaggtgaacctattactggtcaaattgatgaatccaaattaaataatacttggaatactacacaaactaaaaccatttttggtgataaatatattggaattgaaaaaagtgtgattgattcagttaatcaaattcttgaagctaagaatgagggtaatcctcaatgtaaattgtaa

SEQ ID NO: 4491 - DNA, 375 bp, Candida albicans
gaagtaataatttcatataaatttgattcaatttcccctttattccttgtcaatttttattcatttatttcatctattaatcaactcctaaaaaagatgtcaacaccaattactgttattgtttctggagccacaggatttattgctcaacacgttgttaaacaattattagctaaaagataccaattcttggttcctttaatatcacagccaaaagggaacttttttagaattatcccccaatcccaaaaattttcttatgaaattgttgaaaaaattggaactaaaggggccttgaaaaatttttcccaaaacccggaaaaacaaaattttctcactttaagcttccacatccacttaaagttaagagattga

SEQ ID NO: 4492 - DNA, 252 bp, Candida albicans
atatcctcctactttgattggcttgcttcttttcaatactttttttttttcattattctcccatttatctacctgtccatcatgactgataaaactaattttcctactacagtatttgtatctggtgcttctggattcattgctcaagaattaatcaaacaattgataataaaaggatataatgttataggatcagtaagatccaccactaaaggagaatcaattaaatccaatttaacatcctcatcaacc

SEQ ID NO: 4493 - DNA, 1083 bp, Candida albicans
accactcaatcaataaaaatgactcccccaacaatgttacaaactgctccagttgaaagcttcaatttgaatccaaaatctactcaacaagctattaacttaaaatctgacgctaaaaacggtaaggttagttttgctgactggaatgagttcaagtttgcacccattagggaatcaacagtttctcgtgccatgactagaagatactttgctgatttagataagtttgctgaatctgacattgttattattggtgctggttctgcagggttgtctgctgcttataccctaggcaagaacagacctgatttgaaaattgctattattgaagcttcagtttcaccaggtggtggttgctggttgggaggtcaattgttttctgctatggtacttagaaaacccgctcatttgtttttagacgatatgggtcttgactatgaagatgaaggtgattatgttgttgttaaacatgcagctttatttatgtcgactttgatgtcaaaagtcttgcaatttccaaacatcaaattgttcaatgccactgccgttgaagatttgattacaagaaaagatcctgcaacaaatttgcaaagaattgctggtgtagttgttaattgggctcaattggatcacgatacccaatattgtatggatccaaacactattaattgtaatgttgttttgtcaacttctggtcacgatggaccttttggtgcttttactgctaaaagattagaacaattgggtagagctccaagagatgttactgctggattcaccaagccatcaattaccacttccaagttgcaagaaccagaaccaatttccaatttccaattgggtggtatgaaaggtctcgacatgaacaaagcagaagacgctattgttaaaggtactagagaagttgtccctggtttggtcattgctggtatggaattggctgaagttgacgggtctaacagaatgggaccaacttttggagccatggctctttcaggtgtcaaagcagctgaatccgtgttgaatgttcttgaattgagaaagcaacaaaacgaagcttgctatggggcctacaaaggttag

SEQ ID NO: 4494 - DNA, 738 bp, Candida albicans
ttgaagaaaatatggtggcattatcatctcaagggtttaagagtattagcatttgcaactaaagaccttggtgatgctgatatcagtaatcgtgaacaagttgaatcacatttgattttccaaggtttaattggtatttatgatccaccaagagaagaaactgctccatcggtgaaattgtgtcacagagccggtatcaatgttcatatgcttactggtgatcatccaggtacagcaaaggctattgctcaagaagttggtattttaccacgtaatttatatcattatagtgaagatgtggttaaagcaatgaccatgactgctaatgaatttgatgcattaagtgatgaagaaattgacaagttacccgttttacctttagtcattgcccgttgtgcaccaaaaaccaaagttcgtatgattgatgccttacatagaagaaagaaatttgctgctatgaccggtgatggggtcaatgattctccatctttaaagaaagccgacgttggtattgctatgggattgaatgggtcagatgtcgctaaagatgcttctgatattgttttaactgatgataattttgcttctattttgaatgcaattgaagaaggtagaagaatgtcatcaaatattcaaaagtttgtattacaattattggcagaaaatgtcgctcaagccttatacttgatgattggtttagcatttattgatgcctccggatatcaattttcccattga

SEQ ID NO: 4495 - DNA, 390 bp, Candida albicans
ataccatttgcctcaatgacttggcaagcacttatattggcatgggaatgtctcgatccaaagaaatctcttttacttattcctttcagtgaactttgggctaaccaatttttattctggtctattgttggcgggtttgtaacggtgttcccagttatttatattcctgtcatcaacactaaggtatttttgcacaaatcaattacttgggaatggggggttgctgttggtactactgcattgttcttgttgggagcagaagcttggaaatggggcaagcgtgtgtttgctcgtagctccaaagccaaaaacccggaatatgaattggaaagaaacgacccattccaaagatatgcatcattttctagagccaatactatggttgtataa

SEQ ID NO: 4496 - DNA, 927 bp, Candida albicans
  unsure (849): Identity of nucleotide sequences at the above locations are unknown.
tttatgatgattttttctgtgccaatacctgtgggggatcgtttgaatttgatctattcttcttcaatcgtctcaaagggaagagggtctggtatagctattggaaccggattgaacactgaaattggttcaattgctaaatcattacaaggtgatagtggattgattagaaaagttgataaatctaatggacgtcaaccacaaaaaagagaatacttccatgctgggttgggaagtatttatgatattgtggggaacattttaggtgtcactactggaactcctttacaaaaaagattatcatggttggcaattttattgttttgggtggcagtagtatttgctattgttgttatggcatctcagaagtttcatgtcaataaagaagtggccatttatgccatctgtgttgcattatcaatgattccttcttcacttatcgttgttttaacgattactatggccgttggtgcccaagtaatggttactaaaaatgttattgttagaaaattagatgcattggaagcattaggtgggattgataatatttgttcagataaaactggtactttaactcaaggtaaaatgattgcgaaaaaagtctggttaccaaatgttggtacattagatgtacaaaattctaatgaaccttataatccaaccattggagatgttagatattctccattttcaccaaagtttattaaagatactgatgaagaaatcgatttcaataaaccatatcctgatccaatgccagaatctatgcacaaatggttaatgacagctactttggcaaatattgctactgttaatgaaaccaaagatgaagagacaggagaattagtntggaaagctcatggagacgctactgaaattgccattcaagttttcactactagattgaattacggtcgtgaatccata

SEQ ID NO: 4497 - DNA, 768 bp, Candida albicans
tatttgaaaataaacggcgctactaaaattaacgagaaaaatggctcttctgttagtgagagctatgaaaatgaaagcagtaagaaatcgatatatgataatactcaaaatatagaagcttatagattgactgtggaaaatgttgctcaagaatttactaccaatataatcaatgggttatcaactcacgatgctgcaaaacgtttgcaaacttatggtcccaacaatttaggtaaagaagaatcgatttcatatgtcaaaattcttgctcatcaagttttcaatgccatgattttggtattgatcattagtatgattattgctcttgccattaaagattggatttctggtggagttattgctggggtgattttaattaatgttgttattggatttgtccaagagttgaaagctgaaaaaactatgggatcattaagaaatttatcttctcccacggcaagagtaactagaaatggtgatgacttaactatcccagcagaagaagttgttcctggagatattgttcatgtcagagttggagacactgtccctgctgatattcgattgtttgattgtatgaatttagaaactgatgaagccttgttaactggtgaatcattaccagtggcaaaaaattttcaaatagtttatgatgattttttctgtgccaatacctgtgggggatcgtttgaatttgatctattcttcttcaatcgtctcaaagggaagagggtctggtatagctattggaaccggattgaacactga

SEQ ID NO: 4498 - DNA, 474 bp, Candida albicans
agacgaggtgatttaggagtcaattgtaattctattgatgccaacactgatacttgctcgttggttttcaaggggagatcagctgcatttagtgtaatgacatggtgtgctttggtattatctttagaatgtcttcacccaagaacatctgttttccgtttcccaacacaagatctttgggccaaccaatttttactttggtcgattcttggtggaattgtttctgttttcccagttatttatatccctgtcatcaacaccaaagtatttttacataaatctattacttgggaatggggtgttgcaattggttgtactttattgtttttattacgggcagagctttggaaatggggtaaacgtataatttcccgaacagccaaggcaagtaatcctgaatatgaattggaaagaaatgatccatttcaaaagtacgcatcatttagtaaatctaacacgatggtagtagtataa

SEQ ID NO: 4499 - DNA, 777 bp, Candida albicans
actgctgtggcagctccatttacttctaaattggccaatgttaatactgttactcatatcattcgtcaaggtcgtgttgccttagtgtcaacaattcaaatgtacaagattttggcattgaattgtttgatttcttcttattccctttctgtgttgtatttagctggtatgaaatttggtgatggacaagccactatttctggtattttattatctgtgtgtttcttatctatttcacgtggtagaccattagagaaattatctaaggaaagacctcaagatggtattttcaatatttatatcatgggatccattttaggacaatttgccgttcatattattactttgatttatattaccagggaaatttatattcttgaaccaagagagccaaaagttgatttagaaaaagaatttagtccatctttgttgaatactggtatgttcttattacaattagcacaacaagtttctacatttgccgttaactatattggattaccattcagagaaagtattacttccaacaagggtatgtattatggattattgggtgttgctgggttaacattttcttgttcaacggaatttattcctgaattgaatgaagttatgcaatttgttccaatgacaattgatttcaagactaaattaactggatgcataatattagatttggtggttacttttgcaattgaatacgttttgaaatatttctttatgaattctaaagctgctgatattgcattaagagaagaagatgaagttgatgcatag

SEQ ID NO: 4500 - DNA, 2061 bp, Candida albicans
tcaggagatatagaaaaaatgattagaaattatggatctaataggtttgatatcccaattcttacatttatggaattattcaaagaacacgcagttgcaccattttttgttttccaaatcttttgtgttgccctttggtgtatggatgaacaatggtattattccttgttttccttatttatgttagtttcctttgaaatgactactgtcttccaaagaagaaccactatggctgagtttcaaagcatgggtatcaaaccatacgatgtatatgcttatagagatggcaaatgggttaaaattcctactacagatttgttgcctggagatttgatctcaattacaagaactaatgaaggaagtgctttaccatgtgatttattgctagttgatggatcagcgattgtcaatgaagccatgttatcaggtgaatctactccattattgaaagaatctattaaattaagaccagcagatgaacaattacaaccagaaggatttgataaaaactcaattttacacggtggtaccatggctttgcaagttactaaacctgaatcaccaattgtccctgttgctccagataatggtgcatttgccgtagtcacaaaaactgggtttgaaacatctcaaggttcattagttcgtatgatgattttctctagtgaacgtgtttctgttggtaataaagaagcattctttttcattttgtttttgttaatatttgccattgctgcttcttggtatgtttgggtcgaaggtacaagaatgggtagaattcaatctaaattaatcttggattgtatcattgtcatcacttctgttgttcctcctgaattacctatggaattgaccatggctgtgaattcatcattatctaaattgcaaaaattctacatctattgtactgaaccattcagaattcccttagctggtagaattgatgtttgttgttttgataaaaccggtactttaactgctgaagatttggtgtttgaaggtttagctggtttcaaaaacgatgatattcatcatttacatatttgtgaagatgcaccagaaaccacttcttatgtattgggttcagctcatgcattggttagattagatgatggtgaagttgttggtgacccaatggaacaagctacattaaaagcagctcattggaatgttggtactcatgatactgttgaaagagaaagtaaaaagggtaaaggcaaatcagaaaaaataaagattttacgtcgtttccagttctcatctgcccttaagagatcttctactatttcccagattaataccatctctggtaagaattttgttgctgccaaaggtgctccagaaaccattcgtaatatgattgttgatgcccctgaaaattatgaagagatttataaatctttcactagatctggatcccgtgttttggcacttgcttataaatatttagaatccagtgtcaatgtcaacaaagttaaacgtgaagatattgaatctgatctacatttcgccgggtttattgttttccattgtccattgaaagatgatgccattgaaacaattaaaatgttgaatgaatcatcacatagatctattatgattactggtgataatccattaactgcttgccatgttgccaaagaggttaatattaccactaaagaagttttgattttggatgctcctgaagaccatcatgagattggtgaatatgacaatttggtatggagaaatgttactgaatcagttgttatcccattcaaatcatcagataaaattaatcttgaattgtttagcaaatatgatatttgtatcactggatacgctttgaattatttgagtgatcatgaacaaattttggaattgttaaaacacacttgggtttacgctagagtttcaccaacacaaaaggaatttattattacttcattgaaagatgcaggttataatacattgatgtgtggtgatggtactaatgatgttggcgcattgaaacaagccaatattggggttgttcttttgaatggtacttcttcactcaggcactggaaggtcagcgct

SEQ ID NO: 4501 - DNA, 672 bp, Candida albicans
aatttcttatcgtacaaacgggacacgaaaaaaaaaattgagagaagaaaaaaatttcaatgtttcgttggaaaaaaaaaaaacctaacggaagttcgattttgccatttggtctttttcaacatccttcttctttccagtattcaatacgatcaaaacctcactctatatcaaacaatgtctgatttagttgcaaatccggcaattcaaggtgctgaattgttggtaccgaaggcagtttttctaagaccttatgtatggcccttttctattatatatccgatctttttacaaatttatttccaacaatatgataaatacattggtggtaaagaatggacttttgtatacaccattgctattgtttctgtgaatttattgttttggttgatgccacattggaatattgatatcaatgccaagttcaattatactaaagttgacaagatttctgatgcttcatatataaagatcactccagcaccaaattccggtatgggtgaaatctgtgaaattaatcgtgaaactttccatgatggtgaaaaacaagttagtttcttatatcaaaagagaagatacttatttcattctaaaattgggaaattttctccaccagaatttgttttcgatgaagcaccaaaattggccgtttatcaaaatactaaaggttaa

SEQ ID NO: 4502 - DNA, 3039 bp, Candida albicans
aaacacgacacaatgcaccaaagtctacaagatcgtcatcaacttatcatttttgtccattccagaaaagagacattcaccactgcaaaatatttgatggagaaattagatatcgacatcgtggaacaagaaggtgtaaaagaaatattgaaacaggaaggtgagtcgatgtctaaccccaagttaaaagaggtcatacccagaggatttgggattcaccatgctggtttgaccaaaaaagataggggtgtggttgaagacttgtttgctcaaggttacttgcgtgttcttgtttctacggccactttggcgtggggtgttaaccttccagcacacactgtaattataaagggtacagaaacctactcaccagaaagtggggcctgggtccaattatcgcctcaggatattttgcaaatgttggggcgtgctggtagaccacgatacgacaagaatggtgaagggattatcattacatcacaagacgaggtccaatactacttggccattttgaatcagcagttacctattgaatcacaattgattcacaaattggtagataatattaatgcagaaattgttgctgggtcaatcaccactatcgaagaaggcatagagtggttgacttatacatatttttttgttagaatgttgcagtcgccagccttatacggtgttgaagccacatatgactttacgaatgacccaacactttacaaccgaagagctgatttgatatacactgcattttgtattttgcatgaaaacaagttggtcgtttataacgctgctttgggttcagtcgcctcaactgagttgggtaagattgcatcacatttctatatcaattttgaaacaataaatctatatgggaaaatgttgaaaccatggcacagtgaaaccgatattttgagtgtgttttcaaactcaggcgagttcaagtatgttcccgtgagacaggaagaaagattggaaataagcaagttgatggagaaatgtcctatcccaatcaaagaacaacccaatgaaccactagccaaaatcaacatacttttgcagacatttatttctcgattaagtctcgaaggatatgctttgattgccgacatgatatacattacccaatctgctggaagattgcttagagcgttatatgaaatagctttgttgcaaaaatggtcatcattagccaaaagtatcctcaatttgtgcaaaatggtagacaaacgattgtggctaaacaattcaccattgaggcaatttggtgatgtcgtccctcaccagatcattcgagcatcagagatgtcacatttgccatggattaggtattttcatttaaaccctgatgaacttgctgttgcgttaaatttaaagggaaatgcccaaatagctaaacagtatatcgattcttttcccaaagtatcaatccaatacatggttcaacctatcacagaacaatttctacgcatacaggttgaggtgattccagaatggtcttggattctggctattcacgggagccaagagattttcaatgtttttttggaaggttgtgatgggaataaactattgcatagcgaacaatttatcgtaaaacgcaaaaatattaacaaaccgcatattttggagttttttgtttcttttgttgcaccgcctttacccaattatattctatcgtttgtcagtgaaaaatgggtgcactgtacatggaaaagctctattttattgtctaacgtgatttctcccaaagtgtcacctcattacttggataacaatgtggatttagtacctacagaaacagtgggcgatttgtttccatttactcatttcaacaaattgcagtcgtcaacgtttgatacagtttacaacagcgaaaataatgtttttattggctcttccaaaggcgacgggaaaactgttttggccgagttggcaatattgaatcattggaataacaaaaaaggcagaatagtatacattaatccgtgccaggaacttgttgacaaattgtttaaaaaatggtccacattctttctgtcatatgagaaggaaatcaatgtgttaagtggtaacttgcgtgaagactcggcttctgtgaatcaaagccacttgattttggccacgcccgaacagtttaactgtttatcaaagcgttggaaaactagaaaggcgtttaggtctattgatttatttatctgggacgacttgcatttagttgggtcagatgttcactacgagatgcttgtcacaagagttcgtatgttaacctcacaatgggatgactataaactaagaattgttgctttgtcgagccctgtattaaacagtcgtgatattgcagaatggataggagtggcgaaactggaaacgtttaattttgctccacatagtcgcgaaaacagaatcaccgaaattaaactaagtgtcgaaagctccgacaatacagttaaaatttataaagatttggctaaagtgaatagtggtttgaggaacacgctaatctttgctccatcatatatccatgcctttgaaatggcacatagtatggtcgaaaataaccaagcacaagaatggagatcagttgatttattgaaattggaaaaatatatcctgaaaattcagaatcccttattgaagaacttgttacctaaaggaattgccgtattctattctggtatggcacgagtcgacagattgattgtggaaagattatttgaatccaagtccattggtgtattgttttgcaccatggatactagcaaatttgcaccaactgctaataacgtgtttgttgctgggacacgagtatatgatggccacgaacatcgattccttgattacccgcttaatgatttgtatgaaatggtaggctgttgtcaagatggcggagtggtccatatctatacaacttcgcagatggtcgaattctacagctcgtttttgaatctggggcttgcggtagagagcttgctctcaaactctttccacgatttttcacgaactgcctattcaacacatcgtggcgatccatgtcgcaag

SEQ ID NO: 4503 - DNA, 1635 bp, Candida albicans
  unsure (1630): Identity of nucleotide sequences at the above locations are unknown.
ccacagctctcacccaatcaacgcacaaccagaatgtctaacaatgttatacgacaacagagagatcgtaaccatgaagaagagattcccgccagctctatgactggtcgtatatcaaagagtgatatgagaagtaattacaagtcttcacctgcaccagcccagttgaataaaccaccacgcaaagaaccagaatcagaaccagtagacgaccaattatatgaactattcgtgactaaaatacggtcctacctacctgattcaagtcacgaagtcattcaatcagcatcagaagtggccagcgaacaattgagcaatcgtgatatatctgtcccagaaaagagaaaagaacttgaagaactattgaatgcatctatatctgatgatgaccttcatgaattgattaatttatccaactcaattgaatctgccaaacaaaatcatcaacaaggcaacggagatgacgaatgtgttgccatcgactttaattcgtcagatgacgaggaacaggctatagaagcagagattgaagttgaagacgagagcgacgaagaagcagacacggaagaacccacaagcaacgaacaccccaaagcatacgactggcattggcttcaacagatttctgaatttaaacattatgggtcacaagtatttgatctttcggctgacaaagatttggatctgctacagctagacagtaaactcaacgagttattggattccaaggggatggactttattgtcaaatgtattgaacatagatggcgtattgtattttccaagagattgcaaacagaaaacaaagaacctgtcataaaggaaatggaagaacttggtcttcattctttgatcaacgagttgcaccgcaaaagactgctagatgatgagactagcaacccacttaaacgacaaaaaaaggtaaaacgagtaccccaaaagattagccttgacagaattgtgttctctaccagtgttgaaaatgcccgtgtgactttaccagagggtaccattcacgaggttaaaaagtcttacgataccatcactgtcccagcaccagcacagtctttatccgacaatgatgaattgttgcctatttctactcttccagattgggcccaagaagctttccccaaaaccgaaaccactacatttaaccggattcaatcgaaaatatacaaccaggcatttgaaaccgacaataacttattaatttgtgctcccacgggtgctggtaaaacaaatgtggcaatgttaaccatactacgcactattgaaaacttccgtaacaatggccacattcaattgaaaaatttcaaaatcgtgtatattgccccgttgaaagcacttgtgcaagaacaaatgcgtgaattccaaagacgtcttacatcagtgtatggggttgttgttaacgagttgaccggtgacctgtctttgtcgaaacaacaaatagctgaaactcaaatcattgtcacaacgccagaaaagtgggatatcataaccagaaaagaccccagctatgtgaaattggtcaaactcatgatcattgatgaaatccatttattgcatgacgaaagaggtcctgttttagaacgtttggtcagcagatctataaatcgacaccacgggncttga

SEQ ID NO: 4504 - DNA, 1713 bp, Candida albicans
aggaagcgggtgaagatatggcagaacgccgtcgtgataaagagcaaaatcaagcaatggtacgaggtattgaatcgaaattcttcggatgcattaagtattgaatcaaaactagtacgggctctgggattacgtgttggagatttggtgcgattacataaagatgtccgtatacctgcagacatgattttattgcaatcttctgagctgacgggtgaagtgtttataaaaaccgaccagctagatggtgaaactgactggaagttaagaattgcatgtgccgcaacacaagcatcacaaaatactaagcagattgttgattctgtttctgtcattgtggggaatccttcaaaatcaatccatcatttcaacggacagttgatctacaagtcaccttcgacaacaggttcagcatccccaatctcaaataatgaaacatatgcattatctattgatcaaacattatgggctaatacagttttggcttccggaactgcagtaggcatggttatttatactggtattgaaacgagacaactgatgaacacaaccaagaccggggttaaaactgggttattggaactagagataaatggtctttccaaaatattgtgtgctgttgtctttatattatcgttggtattggtcttagcacatgggttccccttgaaaaccgcatggtatcttgatataatgagattcttaattctattttcttcaattataccagtttctttaagagttaatttggatttggcaaaatcagtttatgcttctcaaattcaaaatgatagctctatagctggcaccattgttagaacatcgactattcctgaagatttgggtagaattgaatacttacttagtgacaaaactggtacgttaacacaaaatgatatggaattgaagaagttgcatttaggaactgtgagttatgctggtgatgctatggatattgttaccgactatgtcaaggttttattgaagcatttggattctggtcaaaagaagaaggatttgagttcaagagtatgcgagcttgttttgacgttagcgttgtgtcataatgtcacaccaacgtacgatgatgatgaagatgtaggttttggtgaagtaacataccaagctgcttcacccgatgaaattgctattgtaaagttttgtgagctggttgggttaaagttgtacaaacgtgatcgacactcaataacattgttacatgtctacaccaataagtttttggaattcgagatattgtacaattttccatttagctcagaaaccaaaagaatgggtattattgttaaagacaaaaacagggaagatatatggtttatgcagaaaggtgcagatactgtcatgtcaagtatagtcagctcaaatgactggttggatgaagagactggcaatatggctcgagagggtttgcgtacgttggttattggtaagaaaaagttaggttccaaattatttgaggactttgtcgacaactacaaacaagcgtcattgtcgatgcacgacagagatagtgatatgcaaaaagttgtcagttattatttggagcaagatttggaattacttggtttgactggtgttgaagataggttgcaacgtgatgttaaaacttctattgagttattgagaaatgcaggaattaagatttggatgcttactggtgataaagtggaaacggcaatcttcaccacgggatga

SEQ ID NO: 4505 - DNA, 819 bp, Candida albicans
cctaccatcgtccttttaacggcctgtgtgaaaaatatgattcaatgtgccgatgttggtgttggtattgttggtaaggaaggtaaacaagcatctcttgctgctgatttcagtattgatcaattttgctatttgtcaaaattgttattatggcacggaagaaactcgtacaagcgttctgccaaattgggacagtttgttattcaccgtggtttgttgatatctgttgctcaggctgtttattccatttcgtccaagtttgaacctttggctttgtatcaaggatggttgatggttgggtattctacaatatataccatggcacctgttttttcactcactttggattgtgatattgatgaacatttgacaaagttgtatccagaattatacaaagagttaacattgggcaaatctttatcatataaaacattttttatgtgggtatttatttccttatatcaaggatgtatgattcaattgctttctcaacgttttcaaacattattggacaagaggtttactgccatggttgctttatcattttcatgcttgatctacaatgaactaattatggttgctatatctatcaacaaatggaacaagatcatggccagcaccataattctcacgtttttggcatatattgggtcaattccgtttttactggaatatttcaatcttacatatgtcagctcattcagttatatttggcaagttggtttattgctagttatcagtttgttcccggtatggttagtgcagtacttgaacagaagattaagaccaccaagttatgcaaaagttcaacaagattga

SEQ ID NO: 4506 - DNA, 672 bp, Candida albicans
  unsure (659): Identity of nucleotide sequences at the above locations are unknown.
aacatccaactgatacacataactcttccaatattcatattatctatgatgctgacgagtaatcaagtattggataaaattcttgaatctttaaatgccaatcaaagaaaagctgttactgctccatgtaatggaagattacaaatcattgctggtccaggtactggtaaaaccaaagttttaatatctcgtgttgcttatttattaatatctgaaaacattcgacctgataatatgattgttactacatttactaaaagggctgctaatgaaatgatagaaagattaaccaaattagtagaaggtacggatataaatattgataagttaattattggtactttccatagtatatgttttcgaataattaagaaatatgggaaattaatagatttagaaaactataccattgctgatgaaagagataaatcttatatattgaaaactatgttgacaaatttatctgctaaagatattgaaagattggatagttttggtgaagagtcattacaaaaacttcgttctcataaagctaatgaaaaatatcatggtcttgatctatcggttattctgaaaaaaatttctagtttgaaatcaaattgtatttcccatgatgtgtattctgggaaactgaaaagaaatccagcacttgcgttctnttatgaaaaatat

SEQ ID NO: 4507 - DNA, 1356 bp, Candida albicans
cttgaatgtcataggttggtggaaaatttccctgtattgaattatattaaacatgttttggttgatgaatttcaagatactaatgaaatccaattacggttaatgtatcattttgccaaggggaacactaatggtgatccaaagtatcaaaataatgtaactatagtgggagaccctgatcaaggtatttatgcctttagagatgcccaatcaattaattttgaaaaaatgtcaacttattataccaagctaaatctaagtttggataagatatctttaaatgaaaattatcgatcaacgtctagtattttaaatatatctgaatcactcatgaatcaacaaaaaggtagaatgcccaaaatgttgaaatctcaattagattcttctatcaaaccagtttattcttgtttaaattcagcaaaggaagaagccaaatggattgtataccaaatttctcatttgttgtcgctcccaaactcagcagtacaggagaaggatattgctgtgttatttcgtgctgcctatcaaagtagagctttggaagatgaattagttaaacgaggactttcatataaaatgattcgtgggaaagccttttgggatagacaagaagttattgccattatggattatatgaaagtttgttctgatgaatatgaacaagcagcagttataagaactttgaattatcctaaaagagggataggttcaaagacgttagaaaacatagagaaaattattgagaaaagagttaaacaaggcaaatcagtacatcaatgtttattggcaatgactaagaagtccgaagaaccagagataaaattgactaaaaaacaaatacaaggtgtagaagagtattatacaatgataactaaagtcaagaagaaattatatgagatggaagcactttctggcgaagacatgacgaacacagcaaaagaattgtttgatttgatttatgaaagctcgaaattgaaacaagagtttgaaaatgatgaagaacggagcaaacgattgaatgttgaagaagtagggaatttattagttcagtttaaaccaaaagatgaaattctacctgattatattggtggtgatattgaagatgatgatgctgttgatgaaggtgatcgtaatttccttgctcaatttattgaatctgtgggattatacgaaacaaatgatgaagttgaaaaaaatggatctgaaagtactggggatgataccgccaaggaagagaaactgtgtatttctttgagtacgattcatggatccaaagggctcgaatggcccgtggtttttgtacaggggttaactgacggattattaccagcttttcaccacggcgtgacgatccgc

SEQ ID NO: 4508 - DNA, 3147 bp, Candida albicans
  unsure (2278),(2342),(3065): Identity of nucleotide sequences at the above locations are unknown.
ccaatggatcatcacacgggaaacactgtcccagaatcacgtccatatgaagaaagtgcaagaatcccaattcggtttgatgccgaagctcctcgaaagaaactgaagccgaatacaccaaataatgaacgtaaaaattcaaagaaatcaccagacaatactgttgccaataatcaacaaacagcttctgaaaatgaagtcactattacgttgagtgaattgaatatgttgaaacaaagactacaaaatatagaagctaatatcaatgctcaatccaaccctcaatccaaccctctgtatgttccacaaactccggcttatcctactcaaccaaacattttacctccaccagtcctgttcaattcctggagtcctaagcaaagtaatgaaagggtcatgtttagtcctcaacagagattgactaccaattacaatgtgtcccacacacgagggcaatctccttcaattcaactacctccactttcttttaaagacacacccagggctagtatagactcagctcccttatatagtgaaatgtcaccgccacgaagtgacttgattgcttcaagtttgacttccccggaatcgatccaaatgtctgtttctggagatgtcgtcggggttaacccatatttgaacgagacagagactatcaatttttatgatggatacacatctatctgtgtcagagactttagaagagtgaatcatggaccgtttgcatggtcttcattaatgagaaaagataaagccttgagttcattatggaatcatatacttaagaaaaaggaaaaaaagaatgtagcttcacaaacgtttgttttcggtcaagatgttcatgaaatatcacaagaaaatactcaattagtagctagcgaatcacatgaatccgacacaaaatttaaaaagaagactttggaaacttttggtttcaatgatgttgttccctatgacatattgaaaaagaaacttcaaactcaaattaacaaaacaacactgcctttagggttgactttatatgaggaacaagtcaacatggagttgcaattggtcgatagaattcatcaacaattaccgaaaaagaaagttttatggaaattgattgataggtttttcagtttactttatccatttatgccatttttagatgaaattgatttcagagaaagtgttacaaaaatcattggtgaaacggaatacaaggatgaaaaaataaaggagttaaaagtagaaaaacgattagatttggccgtgattggtgttttacttattatacttcgaatgagttatttatccttgttttgcaataaagaaagtgtaaatgaaatgagattgaaaaccactgatccatcccctgaagcacaagacatgaaatatttacttcaaaacccaataggtatatcattaatagattcagctcaaaattgtctacagtattttgatattttcagaaaaacttccatgcctgttttgcaatgtgcttattttcttcaactttatcacatatttgcacctgaagatggagacgatggagacggtgcagacacttatgcactcaactctatggttgtcagaatggcttattctatgggtctaaatagagaaccagataattttaaggatgttttaaatgacaaaagacaaaaccatttagggagaaagatatggcattttttggttattggagatgtacataattcttacgctttcggaactccaaaattaattggtgatgatttttatgacacaaaagttccatttatagaagaaggcaatgaaaacttgattgataagagtttggatcaatatgtaaccaaactggtgtttcctgggtattttctgatttacaactcggtagatcaaatattgaaattgattcttagcgtatcgagacgactgaaagtttcagagatttgtaaaatattgaaccaatttgagattggtatagctgaacaatatggaactttgagtgattgtttaaagccaaaagagaatttaatccatatttttgctcgtaatatgccagtgaaaatgtatatttcattgaaatcattcttggtgtcagtatactttcatttgtttttgtattatgaacacaaaaatgattcattgtcattcttttatttgagaaaaatcctcaaaactggagccggcgatataatgccacattatttcgaattattgggcaatagtgaagttgtatgtgacatggtgatcaatccgaaattaattcaaattatccacaaagctaatcaaattaatattgctcttattnatcgagtgaatatgagcatttacagaatgaagaatctgcaacaccatgctgaaaattgtaaaanagatgatttttactattcgtattacaaggaattgtgcaaattttcttcctgtttgacaagatgtgccgaagttggaattgcagctgtatccaaattaagtactagatactattatgcgtggaagattaccaagggtcacaactttttgttgaaaaccattaccagtatggagttttatgaaaaagagtcaacgaatgctcaagaaattacattgccaaagtacaagttggaacaaattgctgatttggaaaacatttgtgaagtggcattgaataaattgggtaaaacgctggttatgggtgatgagttctgctccaatgttaattacaaaaagtataaaggtgaccaaacatattcaacttcttctgagtccagctctacacctaataaggattctccattagactcaagaaagtataccaatgattttggcttggatttagtaaataatcaagagattgacaaaatttggttgcaaatgttatctttgaaaagtgaagaagcccaacagcaaaggcaacaggaactgcagccgtttacaagttcgcagtcacaatctcaatcgcctttaacactggccaatcaaggttacatgccacgaccagaactgaggagaggcagttactatggcaatacaccttttgctcttgagaacttgaattttgatggatttggtggaacaagtaaaagttctaaccatggagaagctgatcttagttcatntgaattctttgttgatttaccatttgatcaacttttaccaattaaattgaatctggtgaaatggcagctcttaagtaaaata

SEQ ID NO: 4509 - DNA, 2079 bp, Candida albicans
ctaacagatatagaccgttctttcccatttgtggatgaagaatcattcaaaaaagagcttctgagaatatttggtacgagaacttacactgatttaccctttgaaagtattaggatcgagaaaaagttagatttggccaatatagcaatttgttttattttgctacggttaacatatttgtcatttttcaataaccgtaattgtgtcaatgaatttattatgaattctgaagaagaaactgtggcaaaatacattatgcaaaatcctatcaatttatctactatagaagtggcaaattcatgtattcaatgtttccaattcacaagaaaatccaatataactgttttccaagcaatgttgtatatgagaatctatcgaaattgtgcacctgaagaaagcgatggaattgatggtggtgactctcaggttgctactgcactactagtgcaaatggcgtattcattaggacttaatcgtgaaccagataaatttgatgtctgcaacgatgaaaaagttaaccatttaggacggaaaatgtggagttttttaatgagatcagatttaactcaatgctacactttgggtaatccaacaagtatagatccgagaaattatgatgttagacctccatttgtaaatgacaataactcaaatattgaagatagagaaatggaaattgctattgttgaaacatttgtctatttgaattcagagttggatctaatgcgtaaaatgctagatcacgtgctagatatcaataatggtgccaaaattaatgatttgactagagatgtacatgactttgaagtgattttgcatgatttcttcaatgttttaggaaacgttaatgccggtaaagtgaaaactgatagagaaagcgtgattcaatattaccatgttattaaattgaagatttttttgtcgatgaaaacagcattggtttcactttatttccacatttatttgcattatgagaagagatttgatagcgaattgtcatttttctatttgtcaaaaatgtacctaataataagagatgatttgatacctgctattggtcacacattgataggtaaatacagttccaaggctttagttttgaatcctaacatgcaattggctttacacaaaatcaatcaaattaacttgtcgtgtttaattcgtgttagttatttagtgcacatgtttgagcaaaaaccaaatcatgaagaactgatggcaaatgatatagtgtatctggaacatttcaataaactcaagagcttgatgacaaatgttagacgtactggtgactttgttagggttattatggaacgaattggatctagatattactattcatggcgtatagcgaaagctcacgttggattattcaaaatgttatcacaacctgaaaattacgataagcaattgtctgggataaggaaattaaagtctttccaattcactccaaagcaattggatgaactagacaatctgatccgtattttagggaaatgtgctgagaagttagtcttttatgaagatagtgttggtatgctgcccgattttgaaatgccattcaaaccctctgaaggtgatggaaatgaaaaagatcaaaatcaaaatgacagcaaaaccaccaccactactactactactactacttccgattcaacaggtatatcaataacacccgagaataatgcatcggcaatagtgacaccttattcatcacttgcatcccctcgactccacttggacaatattagcaatgattacgttgatcaaatgtggtttctgatgatggcaatgaaatatgatactctagagccaatgggaaataatcccgattgccaaaactgtaatagtgacgatcccaatgcttgtcctgtctcgtataatactcgtgacaatggagtcttaggtggtactggtggtcaactacttacacaacaaaaacaaatgacggcacaggaacaattagcgcaacaagagataacacgtcaaatgcaatttggtaacgagaatggatacaacaatggattctttcttaattctggatttgaccttatggatgatggatatttttatggatag

SEQ ID NO: 4510 - DNA, 735 bp, Candida albicans
tcaacccccttcccttcccttcctactaaaaacccttcatttaatatatatatcatgtctgacgatatagtttggcaaaccattaatcatcaattttgtgcttttaaagtaaagacagacaagggacaaaatttctgtcgtaatgaatataatgtttctgggttatgtaatagacaatcatgtccccttgccaattcacgttatgctacggttaaaaatgttggtgggaaattatatctttatatgaaaactgctgaacgaacccatatgccaaatcgatggtgggaaagaattaaattatcgaaaaattataataaggcattaaaacaaatagatgaacgattacaatattggcaaaaattcttaatacataaatgtaaacaaagattcactagattgactcaagttgctattactgaaagacgattggcattacaagaaggtgataatgaaagacattatgtcggagttaaaaataaagttaaacgaagagaacaaaatcgagaaagaaaggcattagctgctgctaaaattgaaaaagctatagaaaaagaattacttgaaagattgaaaagtggtgcatatggtgataaacctttgaatgttgatgaaaatatttggaagaaagttatgggtaaagtggatgatgaacaagaagaagaagatgaagaagaatttgaagatgacatagatttggtcagtggagatgaagatgatgaaagtgatgttggtgaa

SEQ ID NO: 4511 - DNA, 1155 bp, Candida albicans
ctccgtggtgggccaatggaagaaacaataaattatcagggcactccaaccacctcggctgcattgttgcataataagaaatcaacacaagatatatttgaggatgattcaatggaagaacaaagaatgagactcaagactcaaggtaagcagttatggtgtcaattggatttgagtggacaagggttggttaatatctcttcgaagttgtttcattacgactttttggagtcattgtatttgagtaacaataaattgaatagtatcccatccagcataagcaagttgagaaacttgagaactttagatttatctcataatagaatcaatgaattgccagaagagttgggattgtgttttaatttaagatatttatttcttttcgataacaatatcaagacattgccttattcgtttggcaacatgattgagttgttgtttattggtattgaagggaatccactagaacccagcattgccaatttaatcgcagaaaagggaaccaaggaactcattgcaactttgagagatcaaactaccgttaaaagaacaccaaaaccaagatgctggttgacattggaggacgacggtgaagttgttgactctgatgaagtgtacaaagttgaaccagaatctagcgacaactttacagttttgtcttacaatactctttgtcaacattatgctacacccaagatgtacaaatttactccttcttgggcattacagtgggattacagaaagaatttgttggaaaaagaagttttgaattacaatacagatattgtttgtatgcaggaagtggaaacaaaaacgttccaggagttctggcttccagttatgactgcaaatggttacaagggttattttttctctaaaacaagatctaaaactatgagtgaaactgattccaaaaaagtggatggatgtgctacttttttcaagaatgataaattctccttgatccataaacaaaattttgaatacaatagtgtctgcatggggtcagataactataagaaaactaaagatttgtttaatacgttcatgagtaaagataatattgcattgatctcatatcttcaacataaggaatctggcgagaaaattgcatttgtccatactcacttgcattggggatcctgcattccatga

SEQ ID NO: 4512 - DNA, 384 bp, Candida albicans
agacactcttctatagtcgtttgtggtgattttaactcggtgaaagatagtgctgtttaccaattgttttccactggtgcatcaaaaggtcatgaagatatgaatggtagagactatggtaagtttacagaagacggattccatcatccgttcaaattaaaatctgcatatgaagctgtgggcgaactaccttttaccaatttgactcctgcttttaccgacaatattgattatatatggtattcaacgccaactttgcaagtgaaaggtttacttggaagagttgatgaagaatataccagtcattcgattgggttccctgatgccaacttcccttctgatcatgttcccattttagccaagttccaattgaaaaaaggttag

SEQ ID NO: 4513 - DNA, 390 bp, Candida albicans
attaaatattttgggaggagagtattgtcaatattcaattataaatttgcaagactagacgggaatactccagttcaggaaagacaagatttgattgatcttttcaaccaagatgacaaaatacatatctttttaatttctactaaagctggtggtgtcggtatcaatttactagcagccaaccatgtcattatgtttgatcagtcattcaacccacatgaagataagcaagcagaggaccgtgcccatagagttggacaaaccaaagaagtgaaagtttatcgattaattagtgatgaaacaattgaaaagaatattttctcagtcgctagaaacaaattagagttagacgaaaagatttcaacattagagtcaatagtttatagttga

SEQ ID NO: 4514 - DNA, 1326 bp, Candida albicans
tcaagaactttcccatttttattgccattctttgaccccgtgtcaaatgagtcaatgattgatgaagtgctcactattaaacaagtgttgatgattggaggtgagatggataataaacaggtttcactttcgtttgcacagttgtcgatgaccaccaatgattggatatggaatacttcaggcactcaatatatattagtacaggatgaaatattgggagcagccaccattttcaacacattattggtaataaattccactgattcaaacaacaaaagagatgacagttatcacataaatttatatgatgctgagagttttaagccagtggaaacattgaaggaaaacactgccaagatcctaatgggagcaaagtccaaattgtcacaccagaacaacactgtgaaaattgttcttgggactgtcttacccattctatcattggcaatcatagctggccttataattttcttctttcttagaagaaataaaaagcacaaattggaattgcaacaacagcaatataatgaaattgattataaatatggatatttgaatccaccacagtcaacattaaaaccattttatcaccatgataatgactcaaattctacattgagcggtgcatcgatagattcatggatgaagaaaaggcaagattatgacaagcgacgtttacggaacagttatcttgcatccaatgacactttgaatatggtggatgacgaagattctaacagcaacagtggcagtagtaattataatgattatagtagatgtgatggggagattagagacgaagaaaaagatttgggtgaagggaaaacccctcaattggtgttatctaaacctggtagacctaaacttcttccgaaaaaggcattttcttttaccaaaagtccaccacagactccagttgggaaagtaaagagattacagtccacacgattgacaagctcagagcatttaattccaggaaatcacaaacatgaattacattctgacgctgaggaaaatcatgaacacaatggggctatcgattcagaagcaacatctttggatgatagaatggatgttcaagttttggttagtagtaaacgaagatcaatattgagagtagtgaacccagatgcacagtctatgcatgaaactatttctgatcagtctaatgtcatcagagaagactatgatagtggtgaagcattcagtcaagtactcgataatcattttgaaagaatattgaatgaatcagatgctgaagagaatgaagttggtaataaattactaaggcaaagggtgatatccggtcaaagtgaacccaattaa

SEQ ID NO: 4515 - DNA, 1038 bp, Candida albicans
  unsure (1008): Identity of nucleotide sequences at the above locations are unknown.
caaagtgaattacatatggtccatttggaccccaatgaggaacaagaagttgttgatcttgacaaggaagacgacgactttgatgaccacattataatggttaagaaaagatacttgacaatgaaatatatcaaagacaaaccggctttgttagcagacgacgtgacattgaataattaccaacaagtgggtatcaactggcttaatcttttgtaccaaaacaaattgtcatgtatcttggccgacgagatgggtcttggtaaaacttgtcaagtcattgcatttatggcccatttgaagcaagttggggaacgaggtcctcatttggtggtagtaccggcatcaacaattgaaaattggctacgtgaattcaacaaattttgtcctgacttactggttagagcgtattatggtagtcaagcagaacgagaagaactacgttacgaattactgaatgatgacgaatttgaagtcttggtgacaacgtatacattggcatgtggtagtcctgctgatgctaaatttttgaaaagccaaaatttcaatgtgatagtttatgatgaaggtcacttgttgaaaaattcaacttcagaaaggtacaataaacttatgaggctaaaaggtaattttagattattattgacaggtactccattgcagaataatttgaaagaattagtttcgttgttatcatttatgttaccacagttgtttaatgaaaagagggaagaattgtcttctatttttaatcaaaaatccgggactgttaccaaagagaatgatcacaacccattgttggcacagcaggcaatcaaaaatgccaaaaccatgatggctccatttgtcttgaggcgtcgtaaggatcaagttttgcagcatttaccaccgaaaatcctgcaagtggtgcattgcacaatgactaaagaccaaaaaagactatatcttgaccatttcaataatgggaaatatgtgagttcagaaagacagagaagaagaacgttaccattnttcaccgcggcgctggaaggtaccaacgct

SEQ ID NO: 4516 - DNA, 270 bp, Candida albicans
  unsure (32): Identity of nucleotide sequences at the above locations are unknown.
agacaagaatcaatcgaagctcaagcaataanacgggctcatagaattggccaaacaaaagaagtaacggtaaagacgttatatttgaaaggagttgatgaattgaaaatcctatcgaggaatgaaaaacttaaaaatgccaaaaacgataaagagagttttgatgcaaaggagaaagaagataatgacaatttgcttgaatttttggactttgataactcggaacatgaatatgctgcttttccccatcccatatctattttttcataa

SEQ ID NO: 4517 - DNA, 2040 bp, Candida albicans
  unsure (74),(123),(124): Identity of nucleotide sequences at the above locations are unknown.
ttgagtcaaaaaggtgggattgtaatttttgacgcaaatgtgacaagagaattggacaaaaagttagaaagcantacaataacagataaaaggacaatccaaagagatatagaaaagttacannaaagtggcatgattgagtttgaacttatacctctgacaaaaggtgggcagccaattaccagattattaatatattccaaagaagaaagattaaaacctagtgacgatgtgatcgaggactacagaaaatcatgctcaaaggattggagctctgctgctcaatccaagaaatcctttagtaatgccagcttgagaactattgaatcaaagtatgcactctttaaaattgaaagtccatttgacaggaaaggcctgaaaagattggaatctttggctcagccaaaaagaagaggaaaacccattgcagaaaacagacgcaagcctcgtactaaatttgtggatgaaatactgggagtgacccatgaagatcgtctggatgtaccagttggtcaaaatgtgaatacaacttttggtgccctgaagacggatattaaacaagacgaaaagctggctacagtatcaaagatcaccgattcgtccaagtctaccaagccgactaaaagtgagctgtccagttttgctccgaaaagatttaaaagaaaatctgctcctgaaagaagatctaataatggtaaactgctgaatagaggagtcaaaaaaaactttgctgtcaaattcgacaaaaccgacacgattaccttatttcgtgctgtgtgtatttccaaagctttcaacataagctctattgattacgatgctataagtgaactttttgacaatgtcactgttgattccttaagaaaaacgtggtctgtaactagaaaatctattggtgggggtgcagtggtagacaaaggagttgaagactttcagttgattgtgatgagaggaatagatgaaggaaaggttctggctggtgatttggaagatattcgaatactgttctttttagatttatggggcaattatgaaggtgccgacaatgagctggttgacaagatgccattgtataagaatgtggctgataattacaggtactacaataaaacaacaaccgaaacttatgttgatacttttgagcaaattgagcttttatcaatgaggatgaaggagatgtcgcttgccagtactccattctacgtgtctaaagatccagaggatccggttttgccaataaaaccgcatgatgagattcgaaccatgttgaaggcgatatttggtacgtccaaagaaacaagcacgtcaagcaagattgacaagttgttgtctgattttcctaataagcatattcaggaagcatctgaagcgatgattaaagatagagaattgttgtattttgggactgatgacagccaaaacaatttcactttgacagacaaggtgtatgattccttgtatgtgcgtattctggcgtcatttttcaataaagcagctcagtttaaagatgaattagttaatgttttcagttccaataagggttatcctttatcgcagggaattgataatggtatcatggcccaactattggaccttgtgtcgagctcttcggtacttctaaaaagaattgagaaggaatacacttttgacggatatgaatcacgattgatggataaaaatgatttggattgtgaaattgtattgcataaatcgccaacgggtgcagcaaatatagacgaccaagacattcatatgattataccggtccccactgggaagccatgtagcagaatttggttggatataaatggacaaattgacgctaagttatggcgagatattgttgtggcaattttgtatcatgttcactttcgtcctggtattccaatcgatctgattttccgaaagtttgattctttgttgagtgtaaatgattttactgcagtgattgactggttgaaaaagagcgggtgtattgaaaaaggtgcttataatggatattccacttcaaataattggctaaatatattaggatactga

SEQ ID NO: 4518 - DNA, 2232 bp, Candida albicans
actaatacatctaaaggcaatgctaatatgctgtttccgtgtgccccatatgaagtagttcaatttacaatcaagaaattatcattctcgggaaagtggggactaacgttagatgagttgtgggcgttcattcaaaccaaatttaaccaacaagatcaattggatgaatttcaaaaacaattaatatggcaatggttatttgttgcggaggatgaggaaggaaattcagagagtgctaaaatatatgtcacctataataatagcccagtcacggcgaatagcgattacaagatatttgttgccagttatgacgatttaactaacattcgagtacttccagaacaggaaacccaagtgctctatttgacaggaattaccaacaacaaaaagttcttatcatcccttggtgacaaaccatatgagttactacaagagattgccaaacacggaagcaaaggtatatgggccccaactttaattgatataactggtcaggacaacagatcattgacgggaagactcaataagttggaagagtggagactcatttacagggagaaaagattttttacagaaaagaaggtacattccagttggattgtgcacataaagtttgcttcaatatctgaaaagtctgaggataaacaacagaagaaaaaaactgaccacacaaacgtcgaacccgttgaatcagacagcaatgggagtaaaagcaaagatgaagagaatgatgaagagaatgatgaagatggcaatattagcaagtattggaagtttcgtgaaaatttgaaaaatgttattgttgagtcctgtaagaatgctccacattcaatcagagtattcagagatttgaaaagagaattgcgcatgcatcaaacaagatcgttatcaaatttgtttcgttcaattcttaatgctctccacgatgaaggagttatagaaaaggtgaatatcaaagacgaagagacaagtagattgatctatgctataaagtatttaaaagatcgccaagatctgaagttaaatatggaaactgaatttctggagatgcctcaattgggtgacaatggcgaagatcaagaagatggtgatgatgatgacgaggatgatgacgaagctaggtttgttccttccttcaatgtcatgtttcctcttgcgtcacaattgtatcagtacatctatgattcaaaactggatggtatttcgtcgagacaaatacttctgctggttttaggtcagcctagaaataggttagtagaaagattttttgagatatttccaagctatcagttgaaaggacaggcgttgcagcctttgagggtatatcctgatgaaaatgacaaaactggagtagtcaggattgttgaagccgagggtaaaatcaagttttacaaatactgtgctcgggaaaatattgattcagttactgtcacgaaacataaaaaagcaagaccggttttaaaaacaatagctaatgtcgatttcaaagcattaaataaaatgctatttgtgaaagacagaaaaaagaaacagatacaattgtttgatactcctgagaaattatacccagctataaagatgttacgggatgccaactataaacaacgtgaagatgaacaagatgaacaccctgttgacaagtcaatggtagctcctccgaaaattgttaaaactaaagtatctaaagtggatgaagttgttactgccgatacggtactgcctaagacggacaagccacctttgtcgaagcggaaagtatccaaggaatcacccaaaactactttcaagaaaagaaaggttgaaacttctactgaaaacgacattataacatgtttgcgaaggtctgcacgttcggctagaaagcccccaataaaaatcgaagatgatgtgttggtggatgaggtggacaatgattacactgaagttgacaatcaagatgaaatagaagtgttggaaaaagaagatgaactggacgtgaaagtggaaatggaccatgatagtgatgatataattactgtagaggggcttcagacgacagaaagtaggttaaataagacaggcaaccttgaaaatggaccggtttctttgagtctgactggtaaacgggtacggaagtacagccgaagaaaaggttttcaaacaactaattttggtgacgatgtacaaggtgaactgcgaagggatatgattgtggaattagttgagtcaaaaaggtgggattgtaatttttga

SEQ ID NO: 4519 - DNA, 1098 bp, Candida albicans
ataccaaattgttcagtcaatgttttttccatttttgccacactgacacacttttttgtgattaagaactttgaagtcttagcccctactagtgaaaagtctcctaataatattataccaattgatacttattttcttgaacacccagaagaaaattatttaactgtgatgaaaaaatccgagagtcgtgacagagaatctccagtgccaggtgtcaccccacctcttgctcagtcaacaaacagtttcaaatctgaagtaggaggcggtgttgcagctcaatccaaaccagccggtactcatagaaaggtgtctccaattgaaacaatttctccgtatcaaaacaactggacaatcaaagcaagagtttcctacaagggagaccttagaacttggtccaatagcaaaggtgaaggtaaagtgtttggtttcaacttattggatgaatcagatgaaataaaagcttctgcattcaacgaaactgctgaaagggcccacaagttgttagaagaaggcaaggtctattacatttccaaagccagagttgctgcagcaagaaagaagtttaacacattatcgcacccttatgaactcacattcgataaggatactgaaataaccgaatgttttgatgagtcggacgtcccaaaattgaatttcaattttgtcaagttagatcaagtccagaatttggaagccaatgccatcattgatgttcttggtgctttaaaaacggtttttcctccattccaaattacagctaaatctactggtaaagtttttgacagaagaaatatacttgttgtagatgaaactgggtttgggatcgagcttggtttatggaataacactgcaactgattttaatattgaagaaggtactgttgttgctgtcaaaggttgcaaagtgtccgattatgatggaagaacattgagcttgactcaagctggttccataatcccaaatcctggcacacctgaaagtttcaaattgaaaggttggtatgataacattggtatccacgaactgttcaagagtttgaaaattgacaatgctggtagtggaggaaaacaagatctcgcaaaggatttccattaa

SEQ ID NO: 4520 - DNA, 303 bp, Candida albicans
  unsure (177): Identity of nucleotide sequences at the above locations are unknown.
aaattgacaatgctggtagtggaggaaaacaagatctcgcaaaggatttccattaaccaagccttagaagagcactctggctcaactgaaaagcctgactacttttccataaaggcaagtgtgaacttctgtaaaccagaaaactttgcttatccagcttgtcctaatttagttcanaatgctgatgctaccacgcctgcacaagtatgtaataagaatgagttttccaggataatgatggtacttggagatgtgaaagatgtgcaaagacatacgaagaaccaaactggcgttacgttttga

SEQ ID NO: 4521 - DNA, 381 bp, Candida albicans
gttttccaggataatgatggtacttggagatgtgaaagatgtgcaaagacatacgaagaaccaaactggcgttacgttttgagttgttctgtcaccgatagtacgggccacatgtgggtaacattgtttaatgatcaagccgaaaagttgcttggcatagatgcaactgaattagtcaagaaaaaagagcaaaaatcagaagtggcaaaccagatcatgaacaacacattattcaaagagtttagtttaagagttaaggccaaacaagagacatataatgatgaattgaaaacaagatacctggctgcaggaataaatgaacttgattatgcaagtgagtcccaatttttgatcaaaaaattggatcaactattaaaataa

SEQ ID NO: 4522 - DNA, 1575 bp, Candida albicans
  unsure (142),(154): Identity of nucleotide sequences at the above locations are unknown.
ccaaaactaaatatgggagattacttaaacgacaattcagctgattatataccaaactcgaatgtgaacaaggcggaatcagaaacacccaattttgattacaccagtaattacaattatggtagtaatagtaacttagccntgcaacctcagntaaaccagcaacaacagcaacaaccacaacaggtacatcaaaaccaactgttcaacatgaattttgactcaaataacaataatactcaaaatgactattcattgaatatcaattatagcggttactccggcagtggtaatctgaacgcaaacctcaacacatccaacaattcagcagatatttcagcgtataattctaatactcagcttgtggatggacaggattatttaagcccaatgggatttacaagttacaatgcccaatctgatacaaatgtgtttggtgggagttctattcctggttcttttacaaatgagcctttcttggatgacgtagccttctcccaagcgattttgggtccccaattgcacttgcagaatagcaacacatccccacgtccgctttctcctaatcagtcaggtcaacaatttgtcaacccaatatccaattcggttaatttagatgaactcatatcaccacaaaataacgatgagtcctcttttctaaatccacagtttttttctccgtcaaccagaggtgaacacctaagtggattgggctctatcgctgaggatgacaagaataatttagctttcagcccagatttctctaaacgacaaagcattagtggtgcctccttttcaaataataacaacacggtatcagatcttcccgcattatcgtatttatctccacaactcaatcccacgtttgcgtctcctggggttgataccatcccctacttgaattctccacctcaatatccaccaatcaaaaccgagaattggaatgctttaagcccaccgcctcattcttcggtgttgagctcatcggtaccaacatcttccggaaatggaataaatcgtgatgtccctactaagcaattgagtaaagaagagaaaatgaaacgaagacgtgaattccacaacgccgtggaaagaagaagacgtgatcttatcaaggaaagaataaaagaattgggagttatagtgcctccttctttgttaaacccaacgttgagtgcagtccagaacttccaaagaaagggttctattgaatctggtgaattgagtgaattgattggttcagtcaaagtgaaagagactaaacccaataaatctactatattgaataggtcggttgattacattaaccatttaaattatgttttaaaacaacaagaaattgcaagagtaaatttattggcacagattgaagttttggaaaattccgatggatccaatacctcgagcctgtcacaaccacaatcccaaacttcttcgcaacaatcacaatttcaatcagaagatgcttattatttggatcaaaatacaagttccaccactactaacagagaaattgccaactacaatccagaagatttttttgcagatataggtactagtactgagaatatctga

SEQ ID NO: 4523 - DNA, 513 bp, Candida albicans
tattccataatacatcatgttatattcaacacaattactaactactgtgtcaccccatcaatagatatttatcaatcaccaaaacctactccaaaggacaatctaataaaactatatggattgatccccgtgacgaaatcactagctcgtaccaatcctgatggatccaaaggaatcaaattaagaaagtcatacgagaatcatattcaagaatttaccagtaaacatcaaatatcaccagctaaaccaatccccccaggattattagatcctctgattgaacaacatcctgatattataaaaccattggatccagaattattaaataaggcattaaaatttgatcgcacaccaattaatggaatacctgggtttaatagttcagatttggcaataaatgatcaacaaactttaatgaggggagatgatatgggagaagatgaacatggaaagaaaattaaacgtaagaagaagatacagaatggtgctgatccaaaaagacaacatatataa

SEQ ID NO: 4524 - DNA, 2646 bp, Candida albicans
tttatcatttataacctaatgcattctactacaggaggaagaataggatcaagatcaggatcaacctcaacctcaaactcaaactcagcagctggaggaacaagagcgacgggagccacaacaacaacaaccacgtcatcatcaacagcaagaatattaggtcctactcttttccaagatgaaaccaattctaatcctaatcctaaatatattcaacaatatttaaggtcgattattattcattcattagatactttaaattatcaaaatgctgaatttgccagtgagagattattggctttaatggaacaaaaacgtgaacaacaactgcatcatcataatcattcacaaccacaatcacaaagagatgatgaaaatgatgaatttttagattcaatctatttatattgtcttgtattataccgacaagataaatataaaacttgttattataaattaagtaatttgaaaaaatttgatcatcatttaagttgttcatttctttatggtaaatgttgtttaaaattgaataaatttaaagaagggatatttcatttgattaaaactaaaaaatatcacgacataaatactagtactactaacaacaacaacacgtctaaattttctggtgcaaacacaagtaataatgatcgattcaataaattcaattatgaatataatcgaaacattaatcctgatatatcactgatttatcatatattgggtgatttatatcgtgagatcaatgatttgaaaaatagttgtatgaattatactttatgtttgaaattaaatcaatttgattttgaagcatttcaaaaattgtgtaaattgggagttaatattagagtcaaatcaattttcaaatttcaacaccaaccatatagtaaaaataatatcaataatgccttcacaaatgttaatgttaacactaatactaattcaaataatgaaggaccaacaatacctgatttaacaaatccatttactgatagatcattcaactcaaaattaactccatcaattcacgttgatgactttaatttttcaacaccaagagtgaaaactacaaataataataccagtataagttccgatgccgctttacgtaaatctaatttgaacaatggatcaacaacaaatgcaatctcaaacaatagtggaggtagtaccaataatccgagttctatcaatgctgcagtttcagtggcagcagcggcggcagcagcagcagcttcaactaccacgacaaacaataataacaacaatttagatttcgaatttaccaaacctagttaccccgatgataaaagaaaaagtcaaagcacttatttaagaataacatcaagattgatatcacagccacaatctctgcacaaccagcaccacaaccacaaccaccatcaacaacaacaacaacaacaacaacaaacaggatcatcgcagatggaaacacctaaaaaaagaaatttaaagcgtaataactcggctacgttagatccaatatatcatcagggcacttctgcatctaattccactacaaatgcaattccaggtataagtgcagcaacatcatcacctgcaacatcatcatctactgcttccgcatcatctctatcttcttcatcatcaattataattactaaagagattgaaaaaagtgaaaaacatcttttgcaattatatttaaatttaggtaagagttatcgaagtatgtgtaaatatgattgttacaaggcaataagaatgttagaaacgtcattgaatgaatttgaaaaaaatactccttgggttttaagtaaattgggaagattacattatgaaattgttaattatcctcaatcagaattgtatttcaccaaattgagaaaattggatcgaactcgtttacaagatatggaatattatctgacattattatggcatttgaataaaaaagttgaattgacttatttagccaatgaattacatgatttacaacccaatgctgccatcacttggtgtgtgataggtaatttgttttcattgattcatgaaccaaatgaatcaatcaaatgtttcaatagagcaatcaaattagataaaaaattcacttatgcttatacattaaaaggtcatgaatatttcagtaatgataattatgaaatggcattagaaaatttccgtattagtttattactagatcctcgtcattataatgccttgtatggattaggaatgatttatattaatcttggtgattatgaaaaagccgattatcatttccgtaaagcaatttccattaatccaatcaatataattctaatttgttgttgtggtatggtattggaaaaattgaataaacgaactttagctattaaacaatatgaattagctcataaattacaaccattaaatccattaccaatttttaaattgggtcaattatattttagtttgaaaaattatctgttagctttgaaaaattttgaaattttgaaaaatttagcacctaatgaagcaagtgttcatttcttattaggacaattgtataatttacaaaatgataaatttttggcaattaaagaatttaccgtggctttaaatttaaatcctaaaggtaattatttaattcgtgaagctatggaatcattgaaaaagagttga

SEQ ID NO: 4525 - DNA, 735 bp, Candida albicans
attatgctgtctcccactcgaaggtttgagccggtgataattttcacagtaaattccgtgacaaaggacatctatttcaggggtgaaagcgatggaattaatatttggagaatagactattccaacaagtctagtttcattaaaaacaagtgtgataaagtttgtttaacaaaaggagggttttcaagtgttattccaaataaattgtctgggtttgggttttcttctggaccttcgtcgacaactgaaaattcttcttccagcattccagaatctatagttcagttggaagttgattcagacagggatattttatactccctttcgaacaaatctgtcattcgagtttataaacttcatccaaagcaagagcatttaacagagggaagtacattgacaccaagtgtgattttcaagtcagcctcgactgtatttgtcgatgcaagtaatttcaaggtatttgaaagattcaagattatcagcattcacaaaatatctcctgaagaatcaagttcaattcaattaattgctgttaccagtaatggttgtagaattttactcaagttgggatctacttccacattttcgtcattacttacttcatcgttcagtgctgccaacgctttgaagttaaaccttgtgaacataaagttccctccgactagagaggttcctaagattaatgctgagctagacacattttcacagagaccgacaatacatggctcgggtcct

SEQ ID NO: 4526 - DNA, 609 bp, Candida albicans
ttgtcacatctgtataaagccattacgagtctacaactttttcaacacaaagcattggccaatcaatcaatctatttttttaaatggtcgtacaagttccacaaggctttatcctcatgcacttctgcaagttcgtctagttcaaagtacatttcgccaactttgaagctacaagatgacgttgttgttgattcaccacaatttcatcaagataaatcaactggctcttctcgaggacaattatctagaagatttgttcaaccagtcggtttagagaccaaggaatccaattataagatcaatgttcccgactttgcaaatctaccacctttgcaattaggttccaaattcatttctgatttgaataaaattgattccagtattccacatgatatattttattcagaaacagtaagtaaaagtgaatcagggttggataactactattttgattatgaaaatggtttaaaagacttttcacgttttgagaaagttcagcaattggatttgccagatagattttttgaagaatataattccactgaatgcattaccaaaatagggttattccctgaaatagaacgaacgtggatagcaatagataataaa

SEQ ID NO: 4527 - DNA, 612 bp, Candida albicans
aacattgaaaattcaataaacatcatgttagatcttgaattctatgccggagctgttggtatgttattgaatattgcgcaaaaagtaggcaataatgtgaaagttccgagcctcacttttaatcaggatgatgatagtgctccattaaagagggatattgctgagattgaaaaaaagaagaaaagcttgtatgatttaatttttaatattcttatcaaaatggacatgaaggctttgaagattagtgataccaacaaccaacttttgattaatgagttcttggagataagggatactacttatgatacttgttttgcttcaaacgataagaatttccaatacactttctatgactggttcatccaacaaggagtaagtgagcgtttgttagacattaacactcctttcatattaccatatttagaagagaagtccgaaaacaacttggctctaagtgatctactttggttatatcatgccaagagggaaaactattttgatgcagctaaaatcttatatgctttgtctatttcgcagtttaatcttgagttaaaccaacgtattgaactctttcacgagttttcaccagccgtagaaggacaacgtcgggaa

SEQ ID NO: 4528 - DNA, 1230 bp, Candida albicans
  unsure (1210): Identity of nucleotide sequences at the above locations are unknown.
gatgctgctaaatctcctgtacttgttgaattgactaatgataattattctatcacagaaccatatattaccatcaatcaaggttatactagggcaacggccacaaccaccaccaataataccaccaccaccaactccaataatacagctggggcaacaccgaataccagcgcttcatctttagacacaaacctgaaacgaacatacaagtttgatcaaatttacggttctcaagcagatcaaaatttaatttattcccaaatagctcatccattacttttagatttcttacgaaggataaatgttactgttttagcatatggacaaactggtacagggaaaacctatactatgagtgggatggataataataataaacttgatgagaattcagatattgcaggtattatccccagattattaggtgaattatttcaaaatttatcctccaatgccactagtaagaatgattatatggttaaaatttcatatttggaaatatataatgaagaattgattgatttattaagcaacaataatagcaataatcgaaaattacgaattcatgaaaaaaccaatgctaataaagtgaaatctattgggatacaaaacttaactgaatatactataaacaattataatcaaggaatcaaatatttgaaaatgggattacagaaaaagaaaactagtagtaccaacttaaatgaaacctcatcaagatcacatactattttttcagtacaattgtaccagaaaatatcatcatcatcatcatcatcatcagagaacgataatgaagaatcagtttatcgaatttcgaaaatgaatttagttgatttggcaggttcagaaaatattagtcggtcaggatctattgtgaaagaagctggtgggataaaccaatctttattgacattgggtagagtaataaattcattaaatgagaaaaaattactgcatatcccttatcgagaatcgaaattaactcatattttacaagattcattgggtggtaacactaagactactttaatagcaacaatttccccggcacaagtcaatctactggaaacatgttcgacattagattatgctagtaaggcgaaaaacatcaagaatgcccccatgattggccatgattcagaaataatcatgaaaaagacattggttaagaatttggcccaagaattaacgttattaaatatggatntaattgctaccaggaaataa

SEQ ID NO: 4529 - DNA, 1692 bp, Candida albicans
gccaacacacctttttttttaaacacgattacgttagttgtaacaactactagtcaaagcacttctatcaaatccatgtcaaacaatatcaaagtatcagttcgagttagacctttattgccacgggagctaaaagctaaaaaggccgaaggggaggccacaccagtatcattagtgtcaatgcccccgtcagatcctcataaagttctattgaccaaccccaaggcacaatcgaagaacaatatcagtattgataacaagcccaagagttttttatttgatgagtgtatttggtcatttaatagtaaggatctgaattacattgataatcacaaatattatgaaaaaaccggaccacaattgttgtcccatttctttgaagggtataatgtttgccttttggcgtatggtcaaacaggatcagggaaaacatatacaatgatgggtgataaaaatgaactgccagggataataccattgttgataaaagatatcttaaagcaaatggagatttctgttaatgagaaaatcaattgtgaattgaagtttctgtacattgaaatatacaatgagcaagtcaaagatttgcttacaggtgacaccaaaaatgggaacgggaatgggaacagtacacatgcaagccaaaagtgcaaagttagagaacatcctgttactggtccatacgtcgagaatgtgaaagaatacaatatcgaaaattatacccaatttttgaaattgttggctaaaggtaattctagtcgttcaacagcatctacatctatgaacgataaaagttcaagaagtcacgcaattatcacattgacattaaagcaaaccaaatttgaaaaatttagcggttttagcagtgattctgatgaaaccaacagtattggtgatgcaagtgaagagatggtatcgaacatcaagttggtcgatcttgctggatcagaaagactacagaaaacaaaattatatggacaacaagaaagaatcaaagaagggacattgattaacaaatcattggctgttttgggaagatgtataaatttgctttcaagcaatccatcgtcattgatcccctaccgtgaatcaattttaacatatttattaaaagaaaatcttggtgggaattctaaaacatgcatgatcttttgtgtttctccagttgactatgaagaaacccatcaaacattgaactacgccaatgaagtgaaaaaaatcaaaacactagccaaggcaaataaaacaaaactttcaaatgttcctattgattggcaacagttacaactgacagataaaacagttatccaatctttgaagaatgacattgacgttttaacaaataaattaaatcaaatgcaacaattaaatgaacctagatctcatccaccacaatcaataaataatataattgaatatttggataaagaaactaataaagtgaaatttgaaaataaatatttaaaacaaatgatgaataccaaaaacaatcacataaaagaattgaacaatcacattgattttatttcgaacgaatatcaattgttgtataatgattacgaagaattgaaacgttcaagtttgcttaataggaaacaagaattgttgaaagaatgtgaatcaaataaaggacatatggatatggaattgaaggaatttgaacaatttttggtagatgctgtaggtaactaa

SEQ ID NO: 4530 - DNA, 462 bp, Candida albicans
  unsure (452): Identity of nucleotide sequences at the above locations are unknown.
cctaatatgactgtgacagatgaattcaaaaaacaagtatccaaaacatttggtcccaagacagatttatcagatgatgagtatatcaaattgcagtcattgttagatcttttcaataaatcgatggacgatatttttgtagaatgggaatcattcaatatcactgaagtaaaagaagatctagatttgaatttaagtaatttgattagatttcaaggatatttacaaactaaactagccaagaattcaacacatgtatcgaaaaagactagggacaccattggatcgacttctaatagaaaacaattccgaaccgtggacaatcatcatttaactcctcaattgaaaaagagaaaatttgaggataatactcctgaatttaaaactccagcaggaattccagttcttctcgtacaacggctacgaaacagcaatttttacctagcgaccgngatcggatga

SEQ ID NO: 4531 - DNA, 1131 bp, Candida albicans
cttcttgatttaagcaatttatccaattattcatttttcccaggtcaaatcgtcgtattgaaaggtaagaatccttcaggtaaatcgtttattgttgaacaaaacatgccattgcttcaattaggtgcaccagtgacaagttctgaagaattgaaagagttccaaacgttacaaaacaatcaaggattaaaagttttaatagcttcaggtccattcagtaatctgaacaaattgaattatgataaattggataaattagttgatttaatcaatacaaaaatattacctcaagtcgtaattttgaatggtccatttttagatattggcaataaagttgttgaatctggagaaataattattgattctgaccaatcacaaccacaacctaaaaccttagatgatttatttaaagcaattgttacaccagtattgaaaaaaattgattccaaaattcaagttatcttatatccaaatttacgagatacatgtattaaacattgttcttacccccaagattcttttgatagaaagaaattaggattaccaaaaaattttaaagttttccctaatccatctggattttcaattaatgaagttttaattggtaattccaacttggatattttcaaagatttacgagatatttacaaagaagatacagcaattatttccaacaatcgttttgaaagaattgtgaaacacatatttgaacaaagacgttattatccgattttcccaggatcaatcaaaacagaaccaaaacagaagtgtacagaattgcttaatggagcacaaggtgaatatttggatggtattgccgttggtggatcatctttagaaacaccatatttgggtttatcagaattaggagattccttacccgatgttttgatactaccttctgaattgaaatattttgccaaagtgattcaaggagtaattgtaattaatccaggtatatttatcaaaccaagtaaagatcccaatagagaagaaggaagctatgccgttgttaatatccaaccaccaaactttgatgctgaagataatattgaagcaattgatgataccaacacattatactatcacaacgtgaataagcgctctcgtgtagatatatattctagttag

SEQ ID NO: 4532 - DNA, 375 bp, Candida albicans
agaaatattaaacacaaatcatccgctatctttatatctacacattcatatatacatacattaatgttattttttagttttttcaagacattagtcgatcaagaagtgactgtggagttaaagaatgatattgaaatcaaaggtactttaaaatcagtggatcaatttttgaacttgaaattagataatataacttgtacaaatggacaacgatacccttacttaggtgctgtgaagaatttattcataagaggatccaatgtgcgctacgtccatatgaatccaaatagtgttgactgtaccttattacaagatgcatcaaggagaggtatgtttacaaatatattttttagcattataagtgctattaattga

SEQ ID NO: 4533 - DNA, 2061 bp, Candida albicans
aaaagaccaaccaatgatgccagttggagtgatattgtcagagagaatgctaattgggacacatattataagtcattgaatttgattccagagtcagaatgggatgactttaaaaaagcctgtcaaacaaatttaccaatgacctttagaataacaggttccagaaaacatgctgaagagatcagaaatatttttcttgatcgtcatgtcagccaattgaaagggaagacgtttgatggggttgacataacacctaagaatattgaattctaccctgacaatttaggttggcaaatagatgtgtcaaagaatgtgattaaaaaacagaaagagtatgcaaagactcaaagatttttggttgttgagactgaagtggggaacatttctcgacaagaagctgttagtatgattccacctttgttattagatgtcaagccacatcattatgtgttggatatgtgtgctgcaccaggatctaaaactgcccaattgattgaagccttgcatgcagaagatgaaaagaaattgccaactggatttgttttggctaacgattccgattataaacgttcccatatgttggtccatcaggtgaaaagattaaattcaccaaactttttggttgttaaccatgatgcaactttatttcctagaataagattgaacaactcttctcaagacttgaaatttgaccgtattttgtgtgatgttccttgttctggtgacgcaaccatgagaaagaacttaaacgtgtggaaagatttcagagttggtaatgcacttggattacacaatgtacaggaattgattttaaatcgtggattgcaattattgaaaaaaggaggaagattagtttactcgacttgttctttgtctccaattgaaaatgaagccattgttgcctcagcattgagaaaatggggtgaccaaattcgattagttaacgttgacaacgaattgcctggtttaaagagacgtgctggtgtttctgattggaaggtttatgggaaagatatggaattacgtgaaccaggtgccgaggatgtaccagaaactgccttcccacctactaaagaagaggcagagaaatttcatttagaaaattgtgttagagtttatccacatatgcaaaataccggtggatttttcattactgtttttgaaaaaatcaatcctgtagccgatgttgatgccgaagctgatggcaataagagaaaagcagatgagagcgattcagaagaaaacgaaccaaagaaacaaaaaagtgaaaacacctcttcaacccaaccagatctgtcatcaaaatcaggaagattacctcgtgatgccaatgaggaaccttttatatttttggatccaagcaattctgaattgcaaaaatgttattcgttttatggttttagtgactctttcccaaaagactgtgcattggttagaaactcaactggtgaaccattaagaaccatttattacacatcaccaattatcaaagatattttaactattgagaaacaaaaattgaaattagttcatggagggattaaattatttgttgcacaaaggaatgatgttggtccttgtggttggagaatccaaactgaatctttgcacacaatagagcatttcgttgacgaaaaaagacatgtcaaatgtaaccttaaattgttagagcgtttaatgaaagaaggattccccaagatcgaagagattaaagaatccggggttgacccagaattctcagagaaaataaccaatgttaccgaaggctgtttgttcttaactgttgacagaagcaacgagggattagagaatttactattaccattatggagaggcaaatcaaatgtcaatttgatggtgaataagaaggacacacatgagttgttgaatcgtgtttttgatattgaaaccagtgccaaagatcatggtaaagaaaaagctcatcaagaccaagttgaagctgccaaacaacaagcaaacgatcaaacagagatctctgccactgctgaaaatacagagcaagaaactcccgaggtcgaacaaaaaattaatgacgaataa

SEQ ID NO: 4534 - DNA, 1635 bp, Candida albicans
accggggtttttccacaattgaaatatgtcaaatttgattgtttgaaatgtggagtggttttggttccatacgttcaagattctaatactgaagtgaaaatctcattctgtaccaattgtcaaagtaaaggtccttttaaattgaattcagagaaaactttatatagaaactatcaaagaattactttacaagaagctccaggtactgttccagcgggtagattgccaagacatcgtgaagtcatattattatctgatttagttgatgttgctaaaccaggtgaagatattgaagttactggtatttacaagaataattatgatgggaatttaaatgccaagaatggattcccggtgtttgccacaattttggaagccaattccattagaagaaaagaaagtagtgcatttatgggtggtaataatttagtcaatatgtggacagaagaagaaatacgtgaatttagaaaattatcacacgaaaaaggtattattgataaaatcattgcctcaatggctccatccatatatggtcataaagatattaaaactgccattgcttgttcattatttggtggtgtgcctaaagatgttaatgggaaactttccattagaggtgatattaatgtactattattaggggatccaggtactgctaaatcgcaaatattgaaatatgctgagaaaactgctagtcgtgctgtttttgcaactggtcaaggtgcctcggctgttggtcttacagcatcggttagaaaagacccaatcactcgtgaatggacattacaaggtggggctttggtgcttgcagataaagggacttgtcttattgatgaatttgataagatgaatgatcaagatagaacttctattcatgaagctatggaacaacaaagtatatctatttctaaagctggtatcgtcactaccttacatgccagatgtgctgttatcgctgctgccaatcctaatggaggtcgatacaactctacattaccattaccagaaaatgtcgatttaacttacccaattttatccagatttgatattatgtgtatcgtgcgagatttggtcaatcctgaatctgatgaacgattagctagttttgtcattgattcccatatgagatctcatcccaccaatgaagaggatattttaaatgctaatggtaagggtggctctgacgctcaagacgatgatgaaaatatggaagacgaagatggtgtagatcaaccatcagcggcaagaactagatcagaaagaattgaacaattaaataaacaaaaagaacaagaaatatcacctattccacaagatttattaattaaatatattcaatatgctcgagttaaaattcaaccaaaattacatcaaatgaatatggataaacttgctcgagtatatgctgatttaagaaaagaagccatcactactggttcttatccaattactgttcgtcatttagaaagtattttaagaattgctgaatcctttgccaaaatgagattatcagaatttgttagtcaaaatgatttaaatcgagctattaaagttagtattgatagttttattggtgctcaaaaagtgacagtaaaacaaaaacttagaagtaaatttatgaaatatactttgtaa

SEQ ID NO: 4535 - DNA, 660 bp, Candida albicans
attgtacccccgtttttaccattattatatgttttgttttgttttattttattttattttactaacttatcttgttctcctttacatgtgaggagaagtatcgtattagttggaagagtaatgaaaaaggcattacctgaacatgcaaaattatcaaaagaatcaaaagaatgtattcaagaatgtgtatcagaattcatatcatttataactagtcaagctgctgatcgttgtttagtagaaaaacggaaaactttaaatggtgaagatatattatgggcaatgtatactttaggttttgaaaattattctgaaactttgaaaatttatcttgctaaatatcgtcaatatgaacaagaacaattgagtcttaaaccaccaagaaagaaaatacggaaaaggaaaactaaaagttctttgtcacaaactcaaagtaaagaacaagtagaccaagaccaagattttcaacaaatcgaacaacaatatgacgatggagaagaagaagaagaagaactggaaaacgaagaaggggatatgtctaatatacaactgaatttaatattacaaaatttacctgaatattccgatgactattttgatgatgaagatgaagaagaagataggcaacaacaaagacaagcaaatagtgataatgaataa

SEQ ID NO: 4536 - DNA, 330 bp, Candida albicans
aataagaatattatgaatcaacaaaacgcaagagatatagagttgagggagcaagaccgttggttaccaatagcaaatgttgctagaataatgaaaaataccttaccaccaacagcaaaagtttcaaaagatgctaaggaatgtatgcaagaatgtgtttccgagttcatatcgttcataacaagtgaagcaagtgataaatgtttaaaagaaaaaagaaaaaccatcaatggtgaagatatattatattcaatgtacgatttgggttttgagaattacgccgaagttttaaaaatttatcttgccaaataccgagaagccaggaagtag

SEQ ID NO: 4537 - DNA, 1425 bp, Candida albicans
tctccatcaattattggcgtgactacatatttggaattcatttgttcgacaatactatttttcagtcgagaatcaatcagattgtccgtgcaaagagttcgcaacaatctggataataaggactatgttgctcaaaaggtggttaattttggaattttggcaatagcatttgcattccctattttcatggttattgggtattggcaactcaattactcactggttatggacaagttatttgtgtcaccattttataaaccggttattgtcttgtttgtggccctggttattttggaattgcttgttgagcctatatactgtttgtaccaattccaattagattttggtaagcggtcaaagttcgaagggtcggcaattttcgttaaatgtatagtttcggttttgtcgattttacttgctagacaatattttgtcgatcagaagtttgaaggtgtggcgatttgtgcctttgccttggctcaattcagttattcattaactttatttgcatgttacttgatgtcatttagatttgagtttcacgataataagataaattacaacttagtgaaactaaaagacgagaatgcaagagaattttattttgaacaggacactttaaccattgtcaaggggttttttgtgcaaatgatcttcaaacaatttctaacggaaggtgataaattactaatcagtcatctctgcacaattgaggaacaaggtatgtatgcagttatggccaattatggctccataatagcgagattgttgtttcaaccgttggaggagtcaactcgattaatgttcaccaaactcttaaatgagaatacacgttcccagggggatgagaaaccccaaaaactggaatcacataagtgcatgcaaacatttaattatttaaagttaatatcaatcttttatttcaatttgagtttgattattttgtttgcaggtgtcactagtggtccttatttgctaaaacttttaatgggcgggagagcttcaaactgggaaagtacagacatatttaagcttttcccgcgatatgttgtgtatcttccgtttcttgcctttaatggaattttggaagctttattttcgagcatggcaactaattcagacttgaagaacttttcaaaatttatgacattaattaccatcttggtgttaatatttctgtacttgcttattgatgttttgaatttaagaatatctggtttaattttggcaaacgtattcaacatgagttcaagaatagggtattgttactttaagatttcaaaattctattcgaaagaaaatgtgaaagtctcttttgttgatatcgtcagatacagctgtccatctattttgattacctcgataatatggattattcagccttccataatagttttcaacagccgctgcagactattctcacca

SEQ ID NO: 4538 - DNA, 2436 bp, Candida albicans
tattgttgttccacacaaattcctacttctgatatgtggccacataaaaagggtcttggaaatcgactaagctatggagtatatggaaatgctatagtttcaatagattctgtaatagaggcacagaaccaggatcaactggcaaataccaatattacgattcctcataatgatttcgagatgagtaagaaatcaatacctatgatgttccccagaataaatgatgaaaccgtggaattaactcctaaacaaaatagtaatcaggaattggtagagaatcaaatttccaagttcaacattaattcatcaatggccaatacaattaactccccaattaacccccctaaagggaaactacccaaagaattgagcaataacacctatatacctcaagatataatacgagcatacatgtttgaatccaagtctttgacttctaacatggcatatgaccctatacatggagatcttttacaaacatttgatatttttgttaaatcagaggatgcatatgttgatctgatgacatttgtaacaggcgaatctctgtcaattttaaatataacaacgtacgaatcaaaagatgattgtatcgtgctatcgccagcataccaaattgacttttgtgacccaatattgcaaattgaagtctcagacaaaattgatggtgttggattggtggcagttcgaacaggtgccaaggtgtacattttaaacatttgtctagataagcttacgtatattgaagtgatcccaaatgtggtgctatttgtcttgggagaaatatctgcagactgcttggctggaaacgtgctagccgacgttcgctttagctctaatgacagcaggaaagttgcggtggtggacatcaagggtaatttgactgtgtggtatgtcaataaaacagtaccaagtataagaaagtttatcaaggaacaatttgtcaaagaattatcggattcacaatcattgtccaactggcgacgcatttgttggctcccactgtgtgatcacttacttgttatttcaagagtagaaatcttgaaggttatgcctaattcagagtcttcgggaaagataatagttacttcgaatacgtggtctcgaataagagatgtgaatgtggttgatgagtacatgtttttgttgacctcaaaagaattgatttggtttagtgctaatgacagcatgacaagattattatcctggaaacattttttagatgatagtgacccatcattaaaatttaaagttgtggaaacttctccgaaagtgtttacttgctttttatattcacaagtgaaccccttagttattgtttattcattcggatttaaaggtaataagccatatagtttacgagatccttactattttagaaagagttctgataattacgatttgagacaaataaacatcaccaaaacagaggacgcattgttaatttttgaattaactaccgggttagcaattcatctgagacgtttaattagcaaaaatgagaatgatatttccaattccctgtttcattccaaattggtagattctagtgtcaataagcacagaacaaattatttgaaacagttttccaagaaagaaatcaaaaaaatgataccccagtttttaaatataggtgaacatgattgtactacagcatcacagcagattgatttaatacagcgatatgcatacgaactaggaaacggatttgcccaaatgggtaattttcaagctgcacaacaactgaattatttttcattatacgaagtctgtaatagtgtaccgttaggggtaactgatttgttggaattagatgatatgattgtgcaattagagaactcattaccttcagagcgcctaaaaatgaaaagtttaatcaataattcattcatacgaaggaacaagtttattaataaaagggaaacaaacacacacatatatgatatttaccaaatgttagagcaaatctaccctacccataataaaccatcgtcaaaactagcagcatccatattaataggattatccctaataaaatgtcaatacgaatcagacgatttacaggaaaaattgcaaaaatctatagccaatgcaccagaaaaggtacaaacattgttgaatgaatgggacgaggaagacaacgatgataactcccaaacagagggtcttacacctactcagcatgattcccagtttatgattccaaccattaagtcgtcgattccggcactcagagtaaactcacaaccaagtcttcgccagcaagttttgactcaaaattcacaaacacaaacattactcccttcatctttaaactcaactgttccatctatttctagtttcccttcacaaaggtcaatatcatcacaaggaagccaatcaagatcaggttcgcagcctaaaaagaaacggaaaaagaaaggaggatttgcatag

SEQ ID NO: 4539 - DNA, 1263 bp, Candida albicans
catggactaattatagcggaaaacaaaactgtggagtgttatgcagtgacaattaataaggacggaaccagactagcgtcaggagggttagatgggaatgtaaagatatgggatttaactacaattaatgtgttttataaaatggccgatcaaccccacaagtccaaaaaagattctacttccaccaaactagaggaatcattaccagataaatctttacgacgtccactttgttccatgtctagacataacggtgtggtgacctccttgaagttttcaccgaacggtaggtggcttgccctgggttcagatgacaagatctgtttaatttgggaaaaagataatacacaaatagccaaactgtttggtactgacgaacatgatctagaacattggaccgtacgaaaaagattggttgcgcatgacaatgatatacaagacatttgttggtcgccagacggcaacttgcttgttactgttggattggatagatcagttattatttggaatgccttgacttttgagaaaatcaaaagatacgacatacatcaatccatggtcaaggggatagttttcgacccagcaaacaaattttttgccactgcttctgacgatcgaacggtgagaatcttccgctattacaaaaaactaaacgaatacaataattatgagtttcaaatggagcatgttgttgttgatccttttaagaagtcgcccttgacttcgtatttcaggagaatgagttggtcaccggatggccagcatatagccgttcctaatgcaaccaatggacctgttccttcggtggctataataaatcgtggtaattggggtagtgatatatcgctaattggtcatgaagctccggtggaggtttgttcgttttcccccactttgttccagattgctgataccccagctaacgaagagatcaaatttcaaaccgtagtggcaactggtggtcaagaccggacgctagcaatttggtcaacgtgcaattcacggccaatagtagtatgcctggatattgttgacagttcaatcaccgatatttgttggtcaccagatggtgaaaccctctactttagttgcttggatggctctattacaggtgtcaagtttggtgctagagaattgggtcaacctgttaaggaagatttgattgatcagcagttgaataggtacggtgctgatagagaaagtacaattctacctgaaagtgtagaacaattacaattggaagaacaatcaaaagactcaaga

SEQ ID NO: 4540 - DNA, 1404 bp, Candida albicans
ccaaatttattttccctcccaattacgaataattacacgctggtcatgacactcgatgaattgaaattgcaattgattgttaaatcattacatgaattaggttgtgatcaactagcaactgaattaatatctcaactcagacagactaattcattggatcaacaacctggggatgaattacacaattggattttggaacaactacgaataagaaattatactgaattagatgattatttttgtagtttgttgaatgacacaaacggtttaaatgaatttgtcaaaattatcaactatcgaggtgataatatggattcaattatatcaatattattgtatttgatcagaagagcaaattatcttgatgtgattaaacttctggatagtttaactgacaccgaaaggttgacctacgtcaacaacaaattgttaccgttattagactgcgttgacgttggcaataataagatagaagacatcagtagcgttatagatgtacgaatcttgcaacaattgtcaaaagaaaaggaatcaaaattgttaatggacagtaatcatgccattgagcaatatctttttcaattaccaatagatagtattcattcattgaatcaatttatatttgataaattgtttaatggttccattttcaatcttttaactacagattcattagccaacactcctgacttggcaactattattcaacaagcagctaaatatcaacaatctcagtcaccattttatttaccaccaagaacaaaacaagaacggaaaaaggcccctttaccacttccactgaaacgatttcatgataattttaatggcaataccactactttattgcacaccctcacttatcataaagacgaagtttggtttgtcaaattctctccatcaggaaaatttttagttactggttcattagatgggagattggtgttgtatgatgtattaaataatttccagttgattaaagttttggaaccaactatggcggcagacaatactgcctttagtccaatatcaactagacccactctgagcaagaataacaaagcagttatttattgttgctgggatcctaaggaacagtatattgtcagttgttgtttagatacggtgattcgtgtttggtcagttggggatatccacaaaagaagaatcactcgaagtgaaaccaatactataactgattataaattaattacatgttttactttggccccagatattaaaacttggacttgtgaatttttaccagaaaataggaaactatccggtgatttaagtggacaatcagattcacctcaattcattgtggggtcgcctgataaggttttgaaaatatttgattgtaatggtattgaattgtgtgatttttatggcaatatagaggatgaa

SEQ ID NO: 4541 - DNA, 1467 bp, Candida albicans
  unsure (328),(332): Identity of nucleotide sequences at the above locations are unknown.
tggagtttgatcctccaccgtctggtgaagatctcgattcggagaatgatgccgatacaagaggcaaagccagaacagactccgccaatttccactccagcaagcgcagctattgatatagaaaggcttcggaaacaaaccgtgaccatgacaaagtcgggaaaaaagcgtgttgctccattactagtttctacatctgctgcacccaaaaatgtgctacagaaaccactacaaaagaaacgtagaacaaaatccagttcgaaaatatcacaagctgcttatttgttgccaaaaatgggagttcaaactactgtccatgggattaaanaganagctgaatcaatgtcaaatgacactgaagttgaggaaaataatgataatgatgatatcggtgagaatgtgatggcaaacacaaacctggtttcagatgcagcattgaaaagacagagaaaccgccgtaagagaaagttgatggaattgaagtatccaagctcgttcaagtatataagcaatttgccagaaggactattcaacaatcatactttacagaacattgagataaataaaatttataaagcccatagcaaacacaaggatatactggctgaaatatcgtccagcaccgctgtcgaaattgacgaagatttggttttttcggttgtttttagggttttcgatcatatgagaaaggaaaacgaagtattgggacaaacttcaggaagaatacgaaccactatagaagtacgaaacgggaaaccatgggatgacgatatcagtgacagagatttcgatgatgctacaaaagtcattgtgactgaagaaggaaacgacaaacgcgagtattgtttgttcttcccttttagagtacagcatgttcttccaatcattttaaacgatgttttgaaatattatgtgttgtgctcgttccatggaagtgtacaaataatttcggccgatacaggtagctacaggtgcccgacatttgagttgggagaaagtgttgttactatgagacatagtcaaggttatatgttagttttaacgagctcaggtttattttacagttgggatttaaaggcaatgaaagtgactatgactgggatatctattgctgcgatactcaataattatgagattggtggcaaaattgtggtaagtccaattgttaggggattagaaattaatccccaagacggttcaccgttggttcttttagatatgacaaacgatatttatggctactctatagatttgcagtgctgggtcaaaactgtagactcttggtactatggtgtgggagctgacaaggatttggatgttgttttaacaggtttagtcaagaaactgaaaatgtcttatgaggaagataaagtcacagaaaagatttttacctacaagtttgatagtagtaatgatttggaagatgcaatgagaaaaagaggtcaagaactacttgatttgatataa

SEQ ID NO: 4542 - DNA, 324 bp, Candida albicans
tcaaaaatgtctggtaccggtagaggaaaaggtggtaaaggtttaggaaaaggtggtgctaaacgtcacagaaagattttaagagataacattcaaggtattacaaaaccagctatcagaagattggctagaagaggtggtgttaaacgtatttctgctttgatctatgaagaagtcagaattgtcttgaaacaatttttggaaaatgttatcagagatgctgttacttacactgaacacgctaaaagaaaaaccgtcacttcattggatgttgtttacgctttgaagagacaaggtagaaccttgtatggtttcggtggttaa

SEQ ID NO: 4543 - DNA, 348 bp, Candida albicans
aaactttttaattttataaatcaatcaacaatgtcaggtaccggtagaggaaaaggtggtaaaggtttaggaaaaggtggtgctaaacgtcacagaaaaattttaagagataacattcaaggtattacaaaaccagctatcagaagattggccagaagaggtggtgttaaacgtatttctgctttgatttatgaagaagtcagagttgtcttgaaacaatttttggaaaacgttatcagagatgctgttacttacactgaacatgctaaaagaaaaaccgtcacttcattggatgttgtttacgctttgaagagacaaggtagaaccttgtatggtttcggtggttaa

SEQ ID NO: 4544 - DNA, 507 bp, Candida albicans
tggcctctcgctcttgaaaaaaaatatgcgtacgaacaatccccaatagtaccatctgctacttcctcgtcacgatattcacaatttggaatatatagaaatcaacctggtgatgtagtggacacattggcatcatcgctaccacgaagaacgacaacaacgagaccagaggttaatcgaacagtacctcgagtgaaaaaaagatatcgtccaggtactaaagctttacgagagatcagacagtatcaaaaatccactgatttattgattagaaagttgccctttgcccggttggttagagaaataagtcttgattttgttgggccaagttatgggttgcgatggcagagcaatgctatattggcactacaggaagctctggaatcatttttgatacatttattggaagacacaaatttatgtgcgattcacgccaaaagagtgactatcatgcaaaaggatatacaattagcaagaaggatcagaggacagtcttggatattgtaa

SEQ ID NO: 4545 - DNA, 261 bp, Candida albicans
gaaattagaagatttcaaatatctactgaattattgatcagaaaattaccattccagagattagtcagagaaattgctcaagatttcaaaactgatttgagattccaatcttctgctattggtgctttacaagaagctgttgaagcttacttggttggtttattcgaagatactaacttgtgtgctatccatgctaagagagttaccattcaaaagaaagatatgcaattagctagaagattgagaggtgaaagatcttag

SEQ ID NO: 4546 - DNA, 459 bp, Candida albicans
ttatttttttattttttttttaattatcattttatatcaacattcacaatggctagaacaaaacaaacagcaagaaaatctactggtggtaaagccccaagaaaacaattagcttccaaagctgctagaaaatctgctccatctactggtggtgtcaagaaaccacacagatataagccaggtactgttgccttgagagaaattagaagattccaaaaatctactgaattattgattagaaaattaccattccaaagattagtcagagaaattgctcaagatttcaaaactgatttaagattccaatcttctgctattggtgctttacaagaagccgttgaagcttacttggttggtttattcgaagatactaacttgtgtgctatccatgctaagagagttaccattcaaaagaaagatatgcaattagctagaagattaagaggtgaaagatcttag

SEQ ID NO: 4547 - DNA, 471 bp, Candida albicans
gttgtcgaagagttgaaagaattaggtgctacacaggtgattactgaagagcaaaacaattccaaagagtttggccatactatcaaaggctggataaaagagtctggtggtgaagccaaattggcactcaattgtgttgatgggaaaagttctactggtattgccagaaaattgaacaataacgggttgatgttgacttatggtgggatgtcattccagccagtaaccattcatacgtcattacacattttcaagaactttactagtgctgggttctgggtgactgagttgttgaaacacaatagggaattgaagttgaagacattgaatcaaatcattgaatggtacgagtctggtgaattaaaagatgcgaaatcgaccgagacgagatttgatggtagcaaggaattgcatgagttgtataaagatggggtagccaattctaaatcgggtaaacaattgatcacataa

SEQ ID NO: 4548 - DNA, 1185 bp, Candida albicans
agaagacagctaaaattaatccacatcttgtctcaatttttttcttattctttacccgcccccctgaatcaattaactactagtatctttcaaaaatcatacacaatgacaatcaccggtaaagcaacaacatacagtgcaccaggttcagatttacctaatgttcttcaacaaaccacatttgtgattgatgaagctgctattcaacccaatgatgttgttgtgaagactttagcaaccccaattaatcctagtgacgttgcacaaatttttggcggatataacgatgcagttccaagcactcgtttaggtagtgacactacccctcaacctttaagtgtcggtggtaatgaaggagttttcaaagtgattcaaattggtagtaatgtcaagaattatgaagttggcgatgttgtcattcctaaattaccagggtttggtacttggagaactcatgctgtggtagatattactcaagatagtgatttgaccccatttatcaaagtcaatgatttgactattgatcaagcagcaacaatttctattaatccatcaactgcataccaattgttgcatcaattcgtcaaagattggaaatctggtgattggattattcaaaatgctgggaattctcaagccagtaaatatttgactcaattggctaaattgattaatgttaatgttctttcgattgttcgtgatggtaaacctcaagaattatacgatgaattatatgaattgggtgccaccaaagttttatcggaatcggaatttttgcatcctgagttcaatatcgaagatgtcaccaaaggagaaggtaatgtaagattggcattgaatagtattggtggggaaactgtaggtggattggtcaaaggtctttctcgaaatggagttttggcaacctatggtgttcttggtggtggaaaaatctcttatgatggtcgtattcaattgttcaagaatatatctaccagagcttattggttgacagctaacaccaaggccaatccacaatcgaaagttgatactgtggaagccgtttctaaattatttaaagaaggtaaacttaaggttgctgcttataataaagtgaaatttgattctacaggtgatttgaaagctacaatccttaacacaattggtaagtcaaagtcaggtaaacaagtggttatctatgagtaa

SEQ ID NO: 4549 - DNA, 240 bp, Candida albicans
ggaagaatgcatgaagattgtagtgatcgttatagaaattatttggttgttggtgagaataggaaacaaagtaattggacccaagacgaggtggacaaattgatggctattgttgatgagcaattggctgttgtatatattgtgaactggacacttgttgctgaaaaaatggggacacggtctggtatccaatgtcgctataaatggaacagaatgaaaggcattaatcaagataaataa

SEQ ID NO: 4550 - DNA, 1185 bp, Candida albicans
cgtaaatctgaaccttataaaccaagttcatggattctgtcagcaagattagaagaacaagatgggaagaatttaaaacttgctaaacaatatattttagaaggttgtaaaaaatgtcctagaaatgatgaaatttggttagaaaatattcgattgaatcaatctgatattaaattatgtaaacaattaattactaatgccttgaattataatcctaaatcagaaaaattatggttaaaagctactgatttggaaactaacaacataaacaaacgtaaagtattaatgaaaggtttagaaaaaatacttaataatgatcaattatgggagaaattaattgaattagaaaatgatcctaatatggtgaagaaattattattaaaagcagttcaattatgttctcaaaattgggaattttggtcagctttattaaatatatccaactatgaagaaagtaaaaaaatcttgaatcaagctagaaaatctataaaaggcgttaaaaatatattaaaagtttggataactgcttgtcaattagaagaaagagaatatggtgaagaaacaattgatattaataaattaattaaacttatggataaagccatgaaagaaatttcaattgatcaaatgacaaaggatgattggtataaattagcttgtgattctgaaagagaaaatttcaaagtcactactaaggccataattattagttatttgaagtttaaggggttagatcaatcatcaatatttgaagatgttgataaatttttcaatgatggatatattattgttgctaaatcaatattagattatattgttactaattcatctaatgatattaataaatggaaaaaagtctttagtgtgattaaaaaattcaatcaagaattaccattattgttttcatattatgataaggcaatttctttaaatcctcaagtaccattattctatttgatgtatgctaaagataaatggcaattatctaaagatatcccacaagctagatcaattttaaattcaggtgaattggcaaatccaactgatttatcaataaaatttgccattattaaattagaacttataacaggtattttactaaatgctgaaaaatatattaaacacataattgataccaaaccaatggaatcagagaaatttggtataaatatattcatattctaa

SEQ ID NO: 4551 - DNA, 747 bp, Candida albicans
atcaagaagcacctgaaggaaatgttgcaacgtctggcaagaggtactgttggatttagaaccagaacatctccagatagtttcaatcgaagaattgccattgtacaatatgaagtagtagaagaagaggatgaagacaacaataatgaaaccacaacccaattgaatgaagatgggattatatttacaattaaacgaggtaaagaagatgaagatgatgaagaagccgatcgaatatataatgaaattgaaaaaaaactacaatccaagaaaaggaaatcattaagtaataacaataacagagccaagccgacagtcaccaccaccaatgacaattattatactcagttttctgatttgaaacgacaattggcaaatttaacagaagatgattggttaaatctacctgaacctggtgatatgacaaggaaaaataaacgaacaagattattagaacaacaacaacaaaggatgtattctgctcctgatacattaatatccacttctagttcagccactggtaccaacacaacaaatttcaaatcattatctgaatcaagagataaattattagggtctcaattggataatttattacctgcatatgttaaaaccaatggacaatcgataaacaattccagtagtgttagtgaagaattacaacaaagcatattgaatatgacaggagttgaacaagattcaaaatatgctgatcttcaaaaaaatcgagttattttatcatcataa

SEQ ID NO: 4552 - DNA, 603 bp, Candida albicans
  unsure (18): Identity of nucleotide sequences at the above locations are unknown.
ttatctcaaattgatganatagctcaaatcataattcgagctcgttcaatattagatcaagcaatattgcaaaaccccaataatccagatatttgggtttataaaatacaatttgaaaaacgaattggtaatttatcatcattacaaaatttaactaataaagcccttatacaatttcctactgatccttggttatggattattaatttatcattaatcccgaaaatgtctcaacgtaaaacaattttcttggatgctttaaaggcaactaataattcaaatttaatattattgatcattggggtatttttttggtttgatgggaaatattccaaaagtaaaaattggtttgaaagaagtttacaactggataatactaatggtgatatttggagttggatgtataattatttgaaaaaatttggtaccctgaaagaactaaactcatttttaattgattatgaatcaaaatatgattcaattaataaaggtcattttttcaacaagatcaataaagatattaaaaattataacaaatctcctaaagaaattttagatattgtcgctttcttcaaccatcggggctcgaaggaaccgcgctac

SEQ ID NO: 4553 - DNA, 1242 bp, Candida albicans
agacctattccaccctcgatgctgacgggaaatatcactgacaaggagtacatctccaaatactttgatggagttgaccctgcaaagttcaaagaaggcaggtttgtggacgaaaaagtattttacttagaagggccagaaggatactttgaacagcaaactaccagagttaaacaaagtggcaactctttaacagcattggcaccccagattgagtacaaagattttgccaggttagtaaagttgggcgacaacctcagtttccaacgcaaacgccaccttttcgaattgcacaagtatatctatcaccagtggtgttttgaaatgtcacaagggttcaatttgaatttctacggagtcggatccaaaatcgatctactccgagattttgccacaaactattttggcatctggtgggaaaatgtggtacacgccgatttgccaaaggttttggtggttaacggttttaaccctagcatcaatatcaaaaaactaattctcgaaatcgcttccatccttttgccaaacgaactgtacccaaaacatatagctggaacggttccctttgtggttgattatctaaacaaccatagactgccctgtggaagtatcggtttccataaacccaaaatcttgttgattattcacaatcttgatggggaagtttttagagtagacaagacacagacgcttttgtcgcaattaatgacactaccagaagtatgggccatgtcatctaccgaccacatcaatgcatcattgttatgggacctgtccaaagttaaaaacttgaatttcatctggcataatctcacaacatatgccacttaccaacgagaaacatctttccgagacgtgataagtttaggcaaatccaaaaaatttgtgggtggccttggtgccaagtatgtcttgcgctcgcttaccgacaatcaccgaaacctctaccgcgagctattgattgcacaattggataaaatggagaaagctgtcccatctgcttctggaagagtgggtttgaaaggtaatgccaaggttgctgttgacctaaaaagcctatacaatacatgtttggacgagttcattacttccaacgagatgaactttagaacattcttaaaagagtatgttgagcataaaatgtgtcagctagtaaaagatccttcaggagttgagaaggtattcattccgttcacatacgaagagatacaatacatatataagcaagaatttgatgtatag

SEQ ID NO: 4554 - DNA, 318 bp, Candida albicans
  unsure (11),(17),(28): Identity of nucleotide sequences at the above locations are unknown.
attgtttaccntgcacnagggtgcgttnttattcaccaattgttggggcatgtaagtgttaaagatgcacccgattattataatgtggttcgtgaacctcgagatttgaaaaatattatgaaagcagtaaaatttaaaaatgaaccaccattatatcaatcagtgaaagaattagaaagagatattatgttgatgtttgctaattgtataatgtacaatcaatctggtgatgatttagtggaattgaccaagacaatgaaacaagatatcagtgaagtatttaaaatgtttgaagaagcagaagaggatattaagtag

SEQ ID NO: 4555 - DNA, 3006 bp, Candida albicans
  unsure (61): Identity of nucleotide sequences at the above locations are unknown.
tttcttcaagagtttaacaaagtgtatcacaattttgaatatgatagagagactttactanagaggaggaaattagaaaaatctgatatgcaattggaatccaacaaatcgaataaaggagataacgcgtctgattcgaaatctgccactcacatagatatgaatttgggagcagcatctacatctttacagcatttactttcgacaattcaactgaagagaaacaaagttcctttgaatgatcatgaattacgaacattatttatggatgttcgtaaaaatagagggaaatgggccaacgatgatagagttggacaagaagagttatatgaagcctgtgaaaaagtggtgactgaactaagaggctatactgaacattctacttttttcttaaataaagtttcgaaaagagaagctccaaattatgggttgattatcaaaaaacccatggatttaaacaccgtgttgaagaaattgaaaaacttggcatataattcaaaacaggaatttgttgatgatttgatgttgatttggagcaattgtcttacctataatgccgacccagcacatttcattcgagcgcatgccatagctatgcaaaagaaaactattaaattgataccaactatccctgatatcagaataagaaatagagctgaagttgagaaggaagaagaagttgaaaatggtaaacgagatgaggaagaggattcattaggtggtaaatcaatgaaaaagggaagaaaaagatcgagacaagatgaaatcaaggcagaagcagaagcagagacaccgaattcaccgtcacctgcaggaaccccttttttggccagtgaagtgaattcagtacgagaaaacacaccagcggccacagataatgggaatgtgtcaaatgatgaagaggaagaagaagaagaggatactgataatatcaatgggacagctactggtatcagcggtatggtagatggagatgacgaagaatttgaccctgaattacaagcatggaggacattaacagctaaatcgagagctaattactgtgcgcaaagagcagatttatttgatgaaaatggacatcttaaaagtgatgtccccgctatttgccggaaatccaatgaaatgtcaaatttcaacgaatatttaaataataaagaagtgatatcgaaatcgaaaagtttattagaaaatgatgaaccatatttacttgaatatgatgttgctggtgggattccaggtattgcatattgtggtgtcgacaaagaaactgaggaaacttatgaaaacaaattagttgacatttatttacaacaaactagtggtgatgcttccaaaattaaatcagattttgttttatcaacaaactcagggttgaataaagtctattttgagaatatttgtgagatacaagaaattagaaaaatctgttttaaaatttcacttattcgtcaaatgcaaacacagcaatttgtacatcatacacagatgaaacaaccagagattcaaacattgaaggaaattgatgttgatgctgcctccaaattgcctaaccatgacgctagtactggcgatgttcagttttcggtgtttcgaagaaatattgccaaaattgcgatgcaaactggatttgaaaccactcaacaggcagcaattaatactttgactcaagtagcagagagatatcttggcaatttaattaaatcgttaaagttgcacagtgaaacgacatcggataaccgattacctccacgagaaatcttgttattatcattactacagaatggtgtagatagaccagatgatttgtatacatttgtgcaagaaagagtggtgaagcaacagggaaaacttaaagatttacgaattaaattatccaattttttgaaagatttgcttcgaccgggattagaaaactttaatgaaaaaagttttgaagacaatagtgaacaatttatgacggttgatttttcaaatggaatcggtgatgatttctttggattcaaagaattgggattggacaaagaattcaaaatgttaacatcatccatccccatttatttattgcattcacgtttacataatcaatttactactggtggtggtactgctcaaagaaacaagtatgaagatttacaagaatatgaacccgacaaaatccatggtaatgaagttgataaacaaattggtatattgatatctttttatcagacattgtatgaaaaatctcagacattttacgttaaggcccagaaaaagaagggtgaatcaatggaattacctcctgataatattttcatattgacagaagatgaagatttaccacaaaagcaaagaaatgtaagaccaaaactaccaccaactggtagaatttcttctattaaaaagaaaatcattgctaattcgtttttcttgcctgaagaggaagagttacaaaaacaggagatggaattgaaggcaaaagaagaagccgaagctgctgctgctgctgctgctgctgctgcgaactcaacacaaacagctgaaacagcacaagtgatgaaaccagtagattcattggaaatgtcagagactctaaatacatcggatatagcagatatgctacgagaaatagagtcagcaaatgcgccagtctctagagaagaacaactacccgaaaaacaatttaatactgaggagaagaaagtaggtttaccaaagacagatgcaaatgaacttaaatatgaaccagtggatgagcaaagtaagatatatgccactactgaaaaaaatgataatgttaaaggaattgaaaataaaccaaaacaagaggattttaaacaaattgaaaacaatcaagagaataagaatcttgaagaaattgaagatacacttgaagatgatacagagattgaaaacagtgactcgaccaaactagatataaaggagaatgaaactcttgtttatgaatcagaagttgatccagatgaaagttccattgattctttgtttgaacaaaatgaagaataa

SEQ ID NO: 4556 - DNA, 1347 bp, Candida albicans
gatgacaatatcaatgacgataattgccaaaatgatgtttatgagcaacaacaacaacaaccacagcaacaacaacaacaacaacaacaacttcatcaacctaatatgtatgagaacggcaacgttggggttatttccaatgatccagtgtcttctgttggccactatgacaacaacccagtttcacatgtacctactggtgcttattcacgtgtccaagacactgacatctggtcagatgatgttgaagaagcttttgaagaagtgttgagacttattccaaagagtggtttgaacaaaataaagattgccggtagatcttgtggtagaaatgaattaatatcagattacatttatgccaaaaccgggaaattcagaacaagaaagcaagtgtcctctcacattcaagtgattaagaatttaggacaaaaactcgatataatccaattgatcaacgatggtcctattttcaacagtctcgaggaacaattggaatcaaccaagaaatttgaatatgtgttttcgaaaattaatttgaacaagtcacttgggtttagtgactcgatgaaaagaaaaagtgattcaatgcctatgcatctcccagccacaaagagaataagaataaaacactcgggcaatcctttgaataaaataaaatttagcaatttcttcatgtctgttaatgaccaatacggtatgaatccaattgttttgacgatacagcaaaatggcaatgacgttaaaagtttgaaattgaaagacaatgctaatatttccagtaggttccctggtttaagtgattttaaatcgtgtcctcatattccaatcattcacaacatggtgaaaatattgctcccgcagttgccagaatcatatagtatcgacgacgggtttagttccagttatgctttgaagtacgaagaaccagaaaacgcatcacccacacataccagtattatatcatcttctagaacttacagcttgttcacttgtgtatattcctatggtaaagagattgtgaaatttgatgaagacggtattcagttgaatcaagacagagaatttataccgggattttggaagttcttcttcagtacatttggggatcaaagtgaaggtggtcttagtgctgctttcaaaggtgtcaccattaaacaaatactttacgagtcaagccccgatagtgttaaaaaggaacaagatgctagtaaagttaataaactgaaagtcaaattggttttactttgggaatttgctaaagtgagtgaatgcaaagatgctttgactactactacaaagttggtgttaaccaacacgagcactggcttcaagctcaaagaccactga

SEQ ID NO: 4557 - DNA, 261 bp, Candida albicans
agaatgtcactctgggtaaataaatatcgtcccagaaccttggaacaattgacatatcatgattctattacgaataatcttagaaccttagccaagtcggtatactttcctcatttatttatttttggacccactgtgatttggttaaaagaacccaatctatggttcttgaaagaaatttttggaacccaggttgaatatttgaaatatgacgtccaaattttgtcccctcccccccttacaaatttccaattctccctt

SEQ ID NO: 4558 - DNA, 870 bp, Candida albicans
caccggcgtgatagcctgataattgacgtcaaagattttgtcacttcatctaatagaaaattagaattcaacgttttaagttcatcgaatcatttggaaattacacccagtgatatgggcaacaatgatcgtgttgttattcaggatttattgaaagatgttgccagtaccgaacaagttgattttgccaaccaactgcgagccaaacatagatttaagattgttataatcaatgaagccgattctttgagcagagatgctcaagccgctttaagaagaaccatggagaaatattcatcaaacattagattgattttggtttgtaattcaatatccaacatcattgctccaattaaatcaagaacattactagtgagaattccaagtcctagtgtcgacaatattaatcacattttgggtcacgttgcagaaaaagagtctctaaaatttagcacccataatgattctgagatcaaccatttttactcaaaaattgctgaaacaagcaatagaaatttaagaagatgtctattaagttttgaaacgataagcatgcaaaatgaaactattaatgtcagatcagatgtcgccaaaattgctttagattgggaagcaatcattagaaatatggcgatcagcattcaaaagaatcagaatgtggctacattggcaaaaacaagagtagtcttgttcgagctattatcacattgcatcccggcaagaatcatctggaaaaacttattgtttgaactaattgatatttttagtaacaaccaagaattagttctggaattaataaaccaagcatcgatatttgacgaacgattgagcctggggtcgaagaatatttccaattgggaagggttgtag

SEQ ID NO: 4559 - DNA, 798 bp, Candida albicans
ctaaataccaaattaatcatgttagaaggtaaatttgaagaagctgctttattaaaaaaagttgttgaagccattaaagattgtgttaaaaaatgtaacttcaattgttcagagcatgggattactgtacaagcagtggatgattctcgtgtattattagtttcattattaattggtcaaacttctttcagtgaatatagatgtgacagagacgttacattaggtattgacttggaaagtttcagtaagattatcaaatctgctaacaatgaagatttcttgacccttttagctgaagattcaccagatcaaataatggctattcttgaagaaaaacaaaaagagaaaatcagtgaatattctttaaaattaatggatattgattctgaatttttacaaattgatgatatggaatacgatgctgttgtgaatatgccaagtagtgattttgctaaacttgtgagggatttgaaaaatttaagtgaatctttacgtgttgttgttactaaagattccgtcaagtttacatctgaaggtgattctggttccggaagtgttatcttgaaaccttacaccaacttgaaaaatgaaagagaaagtgtcactattagtttagatgacccagttgatttgacttttggtttgaaatacttgaatgatattgtgaaggcagctacattatccgatgtcatcaccatcaaattggccgataaaactcctgcattgtttgaatttaaaatgcaatctggaggttatttgagattctacttggcaccaaaattcgatgatgatgagtag

SEQ ID NO: 4560 - DNA, 2001 bp, Candida albicans
caaagatccggaaagatgtatgcgacagcccatacaattaaacaacaacaacaacaacaacaacaacatccaccaccacctttaaacggtggactacatgcaagtggggctcctccaaattcccatgaagcagcagctattgctcagcaacaacaacaacagcagcaacaccacaatggtcctggtatgattgttgccgcagctgcagcttctgctaaccaacaagctgtccaagccagagcccaacaacaacaacagcagcaacaacagcgattacctagttcagctgctcttaatgaaactacagtatcaacttggttagccattggttcattagccgagagtttaggtgacattgaacgtgcgacagcttcttacaattccgctttgagacattcaccaaataacccagatattttagtcaaaatagcaaatacataccgttcaaaagatcagtttcttaaggctgctgaattgtatgaacaagctcttaatttccatgttgagaatggtgaaacttggggattattgggtcattgttacttgatgttggataatttgcaaagagcttatgctgcttatcaacgtgcattgttttacttggaaaaccctaacgttccaaaattgtggcacggaattggtattttatatgacagatatggctcattagaatatgctgaagaagcctttgtgagagttttggatttggatccaaatttcgacaaggctaatgaaatttatttccgtttagggatcatttataagcatcaaggtaaactacaaccagcattagaatgtttccaatacattttgaataatccaccacacccattaactcaaccagatgtttggtttcaaattggttcagtgtatgaacaacaaaaggattggaatggtgctaaggatgcttatgaaaaagtgttacagattaatcctcatcacgctaaagttttgcaacaattgggatgtctttattcccaagcagaatcaaatccatcaacaccagctaatggtgctgcaccaccacataagccattccaacaagatttgaccattgctttaaaatatttgaaacaatctttggaagttgatcaaagtgatgctcattcatggtactatttgggtagagtagaaatgattagaggtgatttcactgctgcttatgaagctttccaacaagctgtcaatcgagatgcaagaaacccaactttctggtgttcaattggtgttttgtactatcaaataagccaatatcgtgatgcattggatgcttataccagagccattagattaaatccttatatcagtgaagtatggtatgatttggggactttgtatgagacttgtaataatcaaattagtgatgcattggatgcatatagacaagcagaaagattggatccaaataatcctcatataaaggcaagattagaacaattgacaaagtatcaacaagaaggtaatactcacccacctcaaccaccgccaagttctcaacaacctagattacctcaaggaatggttttggaaagtactcaacaacaacagcaacaacaaccaccaccacctccacaacaacaacaacaacaacttcaacaccaactgcaactgcaacctcaaccacagcaaccacctcaaacccaatcacaaccactgttacttcaacaccaatcttcattgcctcctcaacaaatccaaccattacatcaacaagctgcaaagcctttagtgaatcaacaacaaagtccaccaccacctcacttgatgaacttgggacaaccggggcaacaaccacaacaattgccaccacatcttccaccacatacccagcaaccttctcaaattcaagaaaagcctccaactcaagaacaaccacattatcaaccacctccaacctccagaagattcaacagcaatcgcaatcgccaaccgcaaacctccaaccaacctcaacacactcaaaatccatggccccaattacctcaattgccaccccacatt

SEQ ID NO: 4561 - DNA, 303 bp, Candida albicans
  unsure (292): Identity of nucleotide sequences at the above locations are unknown.
gcaacagaaggacgtaagttgtatcgcatcctcattcggatgctcatatataggctgacaacattacagtttgactccgctcaggcagcctataggagggtcttggaccgtgacccgaaccatgcaaaagtattacaacaactcggttggctataccatcagcaaagcaacagctatgctagtcaagaaaaggccattgaatatcttgaaaaatcagttagcgcaggtaagacgtcagctaacgtcctcgaccctgagcaagccgtcctcctgttttcactacggacggcangatccgattaa

SEQ ID NO: 4562 - DNA, 606 bp, Candida albicans
  unsure (583): Identity of nucleotide sequences at the above locations are unknown.
attcagctgaacaatattttcaatactaaaatgcgtatatcaccagtaatggctaaatcagcatcgagtgcaacaacaaccacagcaccaacagcagttaacagtacttcgtttgatactgctgccactgaaacatggatcacctgtggtgaatgcgcaaacacgttagggttgattgtatcggccatcaaatcattcgaaagtgctgtgaatagggatccagcaaatgccaccgctttagtcggattgagttcttctcttagattaaatgatatcagtgtcaatgaaaccattggatcacaagcagcaattgaaaaattgaataaatcacttgaatcattcccaagcttatccaaagaagccaatattttcaaagaattgtgcgaatgttatttattagtcggattgaatgatcaagcttatcaagccattcaatcagcaatacagttggcaccccaagatgcgtcactatggttattgagtgcccagactctaattagagctggtgcaagagctcatgccaccgggagtttggctcattgtttatcattcttacctgatggtacgttttccccgtgttcanccacggcgctggaaggatccgca

SEQ ID NO: 4563 - DNA, 3207 bp, Candida albicans
tcattcaaccacaagagtataaatcctatattattcacattaaagtacttgctagaaaaaagttatattcaagctatttacaaagttgataaggtgactcgactgtataataggagtgatggcactaaactgatcgattatttgttctcaatgtgtcggatcagattgtattctatacccgctgacgtcgaaggggcaagacacattcgtgaataccgacaattacaatcaaaatctttaaaattggataggcaatatgcttctcattttgaacagttacttaaataccttgatttttcacattcaaattggtttattgggaaacaactatcaattgaactgttggtacatcaaggctctttgctattaattgattgtcaatgtacaaatgagttgggaacagcttcaaatgatgaattaaaatttcatctacaaagatggagcaataaacaatctgctacaaaatttactaatgacaaaagtcacaccaataacttatcaaatacagatacttctggggatagaatcaagaaaatatatgatcaaatcccctctcccgacttgtctaaatatatggttaatgaaaaaaattaccaattcataaaacaatcaaaagctagcatactgtcaacgacagataaattgtcaacattagccaatgattcagaacaccaggacatgataaagatagacggaataaagtcgacactttatccattccaagtaaagtcagttggactaatgctagagagagaatgtataaagagaagaactataatgccaaatttcatcaaacttgaatcacctttatctagcaacttttattttgatttatttaccaaaagaatttatttacatgctgatgttatgtcactaccacttggtggaattttaggagaaaatatgggattaggtaaaactttaatgtgtttgagtttaatcaatttaacaaaatatgaaataacaaaaattcctagtgataattttttattatataatgaaattgaaatccacgatgaaatcaagactttgactgagatatgcagagaaaaaataatccattcttctataccttggaagttatacaaccttcccacatcagtaacagcaaatctagctaaacacccagggtatttttgcatcgatttgaatgatcatgaaaagaacaaaagaagtcataagagtgggttcctcatcaatagaaatggagttgatacatgtaaacgtgcctctaggactactggtaccaagtcaacgagttatttgaagctttatatgagtagcactactttgataattgtgcctgataatttgtttattcaatgggttgatgaaatagcacatcatgttgaacccaattttcttaagattttgtgtgctgcaaactatatcaaaagcgaccagataaaggatcaatttttacccaaccccaaatttgttaataccattcctgaaagcccagttgaacttattgaatacgacgtgattttaatttcacaatcttgtttgaataattcctttgcaaataaatataggaatagccaaaagaatggtaacagccaagtaccatcgcttagacaagtatattggaaaagattaatcattgatgaaggtcatattgttcaatcaaaaacttctaatgcggctcaaatatgtcgattgctattttcagaaagaagatgggcagtatcaggaaccccaacttctgggttgaccaaaatttatatggaagaaggagaagaagacaccggtgagaaaagaaacagtcaccaagctcaaaataatatacatgtactagaaaaccaattttttgccaaaacagaattacagagattaggggttttaattagtaattttcttaaattggagccttattatacacaacccaaattatggacccaagatattattaatcccttgatcaactcaagatatgggtcggaattaatattttcaaatataatcaactcaataataattcgccatcaaccaaatcaaactaatattaaactacctaatttccatcatgaaaaagttatattagagccatgtttccaggattctttatcatttaacctattagctgctgtattagcagtgaatgcagtaacatcggaaagaacaggaattgactacatgtttcatcaatccaatcgacaacaattgagaagattattgagtaacatccaaagagctacattttattggactgggttccaacagcaggatgttgaaacacttgttagcatatgtgatgaggcattactgaaatcaggaaagtataatgaatcagacgttgaattgttgcgccgatcgaaaaatattgccttgattgcattgaataatcaacgctggactatagcacaactgattcatgaattaggttactacatttccaaggatgaaactaaccaatatgttagttctgtatggggaataagtgcttatacaccagatgtgagtgtctttgccgctccccaactactacgcttacaaatgttttggaaagaaaattgggtttcaagttttgacaatgaacagacatttcgtgataagtttgaaaacaccgctaaaacattttgggaccaatatttacaccaagaattcaaaaagaatgatagacatgtggccatggataaattaataaagaaaaatagtggtgcagaactttatactttggataatatatccaaaagttttaatgacgtgacaccaccaaaaagaactattgataaggaggcacaggcacagtcaccaccacccaagaagaaaagaaaagttacttttactgatgctgttatagaagaagatgaaagaaaacagaaggaacctccacaaagtaaagacgcttatgacaatgtaagtaaggataacaaaactattgagaaatcagatcgttccattccaccttttgatatgactggattattcaagaatatgaatattttaggtacatcctcagcaaaattgacatatttagccacaagtttattggaaaaccaaagaaatagaataaaatcaatagtattctttgagtttgaagatagtgcatattacttgattgaattattggaaattttgaaaattcgtcatataatctatgcaaatttcataacaccaattaaaagagctcagaatttatacgatttttcaaattatgatgttgattaccgaagaaaaatatggtggtatttgtttggtttatga

SEQ ID NO: 4564 - DNA, 2568 bp, Candida albicans
accttacagatggcaccttcaagaaacgacgtagcagataacgagtcttcctcagattcagacacgagtaatattggtggcggattcattattgatgatatttcaacaaccagaacaaaacgaccaagaagggcagcagccagaaaagcagcaaacatatcatatgcggaactgagtgacgatcaagaaagcgactctattgattcagacacttttgccaatgttcctgctccagttaagaagagaaagacgcgtacttctacgcgtgttcaaagcaaggagaaagagacaaagaagaagaagacagcaagcaaaaggtctctgtctcctgatgatgaggacgatgaccaagagttcactttgagtttggatgacgcgaaagagagcgaaactactgatgatgatgaagttgaatatctaggcagcaaccaaatagagaagaatggctctacaagtgcagaggcaatagatctagccgatgacttggatctcaataatgatcccgatgaaaatgtaccacttgcatcccggaaagctcctaaaaaacgcgccaagggtggtaaacgtacaaagaaagaacccaaaccaaaaatgtcatactatgagaggacaacgaatagattgtttgaacaccaccctagtttaaaagaagtgtttccatatttgaagaacaccccaaaaatcacaccagagagagctgaacatccaccaggaatgacaattaagcttttgccatttcagttagaaggtttaaactggcttataaagcaggaagatggcgaattcaatggtggaattcttgctgacgagatgggtatgggtaagaccattcaaactataggactttttatgcatgacaggtctaaaggtcctaacttagttattggcccaacagttgccttgatgcagtggaagaatgaaattgaaaaacacaccgagccaggtatgcttaaagttctactttaccacggttccaatagaagtaacagtattcaagaactttcacagtatgatgttatccttacatcctattctgtcttagagtctgtctatagaaaacagaattacggattcaaaagaaaaaacggattagttaaagaaaagtcggcaatacacaatattgagttctatcgagtaatattggatgaagcccataatatcaaggacagaaactccaacacgtccagagcagcaggtaaattgaatacaaagaaaagatggtgcttaacaggaacacctttacaaaacagaattggcgagatgtattccttaataagatacatgaaattagatccatttcattcatacttttgtaccaaatgtgattgtaaaagtgaggattggaagttttcagatggtagaagatgtgacctttgtcaacatccaccaatgattcacagtaattttttcaaccatttcatgctcaagaatattcaaaaatttggtattgccggtttaggattagaggggttcaataaccttagactgttgttggatcatgtcatgttgagaagaacaaaaattgaaagagcagacgatttgggtttaccaccaagagttgttgaaataagacgtgattttttcaatgaagaagagaaggacttgtaccaatctttgtacagtgattcaaagagaaaatttaacgattatgtcgctgagggggttgttttaaacaattatgcaaacattttcactttaatcacgagaatgagacaattggcagatcatccagatctagttttgaaaagagttggaagtaatgccatatccaatgaaattgacggggttatcatgtgtcaattgtgtgacgacgaagctgaggaaccaattgaatccaaatgtcaccacagattttgccgcatgtgtattcaagagtacatggaatcatttatgggtgccagtaataagttggagtgtccagtttgccatattggtctttcgattgatttagagcaaccagccattgaggttgatgaggagttgttcacaaagacatccattgtgaatcgtatcaaactgggagctcatggaggcgaatggcgttcatcgactaaaatcgaggcattggtagaagagttatacaaacttagatcggatagacacaccattaaatccattgtattttcgcaattcacttctatgttagatttaattcaatggagattaaagcgagctggatttaatacagtcaagttactggggtcaatgtccccacaacaacgtgacaacacaatcaagcattttatggagaataccgaggtagaagtgtttttggtatcattgaaagctggcggtgtggcattgaatctttgcgaggcatctcaagttttcttaatggatccgtggtggaatccaagtgtggaatggcaatcaatggatagagttcacagaattggtcaaaagagaccaattagaattactagattctgtattgaagatagtatagagctgaaaattatcgaattgcaggaaaagaaggcgaacatgatccatgcaactattaacaatgatgatgctgctatcagtaggcttacacccgatgatttgcaattcttgtttatgaattaa

SEQ ID NO: 4565 - DNA, 435 bp, Candida albicans
acaatcagaacaactatgcctgaactacaacagccagataaacattctatggatatcccccatgtggcagctattgatcttccactaaatgtgcacaatgtaactagagcggttgatatgttaggtggagaggagttgatacgggcatcaatcagagaatcacatccattggagttgaggttaagaaaagatccattccatcacccaatacaagccctgagtaataattcagaaagaatattgatgaaaatcaaaatccccaaaaaaagcttaccaaaaaataacgaatcatattccattcaacaattacttgaacttaataaccaagataaactgacacccagagaacggattcaacccgtggcaatcatagacaaaacatatctgtttaaagcaatggcagacttccaaaattctacttggaatgacgcactg

SEQ ID NO: 4566 - DNA, 1095 bp, Candida albicans
aaagaggaccaaatagaaatggtttcaataccacctgatacaactcctggaacttccaaaaaacgaaaatcaactactacaaatgatccttctccagaaaaagataaaaccagaaaatatgcccaagcctcaagaaccttaaaagcgtgtgaattatgtcgaaaacagaaaagtagatgcttccgatccccagaaaatcccaattcatgtttaagatgtcgatttttaagcaaaacatgttcatttgaaaatgaagaaaccgaaggtgaaataagtgggatgttaccatttaatttatcaaatcaagaaaccaccaagaaaattgatatgatacatgatggtataaatcaaatattaaattatatgaaaaatggagctcgtactgaagatgccaaattattgttagatgcatctgaatcaatgaaagatcgttccaatagcatagtaaatgcaaatgatcaaaatatcccacaatttgattcttttaaatctgttagttcagcatcaccaattgcaatattacaacaattatttccccaccaatgtaatacactgataaccaacccgatgttacaaaataccacgttaatccaaaaagaagatgttataactcttgggattttatcagaacatgaagtaacagaattgatttctaatttcagaaggaattatggacgttgggtttcattcccatcatctgtttccacggaaaatttgattgttcaaataaaagaaaaatctgacttattattaacttcttgttgtcttgtatcattcagatattataaatataagggaccaaacaatcgatcaatggaatgtcaattgttgacccaacatttaactcaagatttaaataattcattagtgaaatatacttcttttggaacttgtctgggacaagttgaatttttacaagcattagtgatattaagtatatatctgaaaagtttatccaaattggatcatagtctaaatctcgatccttggtttttatcaaatattggtttgtcgactttcatcaccaaaactgcattaatagatgattttaaagaaattgatgacgaaacagttgaaatccaacgtgaaacatat

SEQ ID NO: 4567 - DNA, 1422 bp, Candida albicans
gatagaccagacaaaatagatcaagaaggtgaagccaatccagaagaaggaatatcagaatacgtgactgatactaatgaagtgaaaaaattcaacgaacaaaatgtcaaattgggaaagttaccaatagatcctgatgttgccaaggaggttgaagcagaattgaagattaaagacgaaaaaatcgagccagtcaacaacaaaacattaactaaagaatttcaagatatgacaaagccagaccaggatctgcctgttagagaatcattgcctcttccattgaaggatgcaaatgatataaaaaagatgattatacaggttgaggattctcgatcaaagatcaagttaggtgcaatacaagcaagtttaccgtcagtttgtatgtacacatttcacaacactaacaataatatgacatgtattgaattcaatgacgattcgactttagtggcagcaggattccaagacagttacatcaagttgtggagtcttgatgggaaacctttgaaatcggtattgaaaagagatcgtcacaaaccacaagaaaataccagaaaactcattggtcacagtggaccagtttatggagtatcgttctcaccagataataaatatctcttgtcatgttcagaagataagacagtaagattatggtcattagatacatacactgcattggtttcttacaagggtcatacccagcctgtttgggatgtcaaattttcaccattgggacattattttgttactgcatcgcacgatcaaacagcaaggttatgggctactgatcacatctatccattgcgtatatttgctggacatatcaatgatgtcgattgtgttgaattccatccaaactccaattacgtttttactggctcaagtgataagacttgtcgtatgtgggatgtacatactggtaattgtgtacgtgtattcttgggtcataccaattctgtgaattgtctagcagtatctcctgatggtagatggttggcaagtggaggtgaagacggaattatttgtgtatgggatattggttctggaaggcggttaaagagtatgagaggacatgccagggcttcattatactcccttgcattttctcgagatggcactgttttggtcagtgggtgtgctgataatagtgtgagagtatgggatgtcaaaaagaatacaaatgatgctggacctgaacctgaagcgttcaataataatgtcaatggcaacgaaaccaactctgatgggacactgtcaacgcaacaacagctacagccacaacaacaacagcagcaaagcaaaaaggaatcaattgctactagcgaccatatgaatgcatttttcactaaaaagacacctgtatacaaagttcattttactcgaagaaatttatgtcttgcagctggtgccttccaaggatga

SEQ ID NO: 4568 - DNA, 1182 bp, Candida albicans
acaaccaaccaactttactattccacttcaatgggaattccaatattatcatcagatatccaagaatctgatttatacaaaattcgatatactatcaatgaaccatctataacattcactgccataaaattctcccccaatggacaaaatttcgcttgttcttcatcaaatgggaaaatatatatttataataccaccactggtaaattaatcaccactttatcaggtcataccaagggaatatcagatattgtatattctcctataaattccaatattcttgcatcttgttctgatgatttaaccattcgattatggaatattactcaacaacgatgcataaaactattacggaaacatacttatcatataacaacgttaaaattcactcaaaaaggtaatattttaattagtggatcatccgatgaaactattactatatgggatattacttcaaatggtgggaagattttaaccactttagcggctcatagtgatccagttctgtcaattgcattaactcctgatgattcaattattgtcagtgcttcatacgatggattaatgagattatttgatttacaaaccagtcaatgtttgaaaactttaactaatagtacgtttggtggtcatggcacggctacagctagtactaatgatgtaatcaatttcccaattgctaaagttgaattatcacctaatggacaatttattttaaattctagtttagatgggaaaattcgattatggaattatatggaaaataaagtttataaaacttatcaaggtataaatggtgagaaaatttgtgagaaatttaattgtgatataaaatttatcactcgaaatgttaatagcaatgccattactattactagtaataacaatgacgatgaacagtacaacaacgtgttaattgtttctggtagtgattcgacggggttattaatttgggatattcaactgaaacaaattgtttttcaagtagatccacaaacttgtgggaaagatgctattttaggagttgatacttacaagcaaggagaaatattgggctgttgtagtcgagatggaataattacaattttagatatgaataaaaaatatactgaaagaaatgatagtgttcaacaacagaaagaggtaattgatacagaatcacgaggtgaaacacctatttaa

SEQ ID NO: 4569 - DNA, 864 bp, Candida albicans
atctatcaacaagtattcaaaatggtggatgaaagtaagcaattgcaaggtaataaagatggtgacaaacaccaaacacaggaactgaccaatactagtgggaactctcaaccatcggcaccaacaccagcacaggttccttctgtacaacaacaacaacaacagaaatcatcaacacaaaatcaacaatcaacaacaggatctgcacgttcttcacagggtagatccaatcaaccacaatattcacaggctgatttgaataaaatcgttttagagtatttaaataaaaaaggatatcacagaactgaagcccaacttagacttgagagctccaacatcccgacaccagcagtaccccttgcaacaccagccaccacagaattggcttctgtcaatgaaattggtgacaataaagatttaaaagagaaattgactaaagctgaacaggaattgaaggagttacgagacaaacaatcaaaaattgagaaagagttacgagaggcaaaggatcgtgaagttaaaataagtaaagaaaaagagttgaaacagttgaaagagttggaaaagaagacgaaaagggaaagtgacccagagatctattttactgcttattctatgttaagaagatgggttggatcatctttggatttgtataagccagagttatctcgagtgttatacccgttgtacattcattgttttttggaattgatatctaaagggttttcaagtgaggctaaattatttttcgataaattcagatcagatcatttggttttgcacggtattgaagttgaaaagtttgctggtttgtcgttaccagaacatttagaagatcttcaccacgggctggagatcagcatt

SEQ ID NO: 4570 - DNA, 996 bp, Candida albicans
aaggggtttacggaattttccaagaaatcaatcacaaaacattcactcccattaaccgaatgtaattcaccatcaggtgttaatgataacaataagggtcaattattcatgtccacccgtgcatcaaagttatctgctttccaagaagttaaaatccaagaattatcaagtcaagtccctgttggacatattccaagaagtttaactgtccatgtcaatggtgatttggtcagatcaatgaatcctggtgataccgttgatttatctggaatattcatgccaagtccatacactggatatcgtgcattgaaagctgggttgttgactgaaacctatttagaagctcagcatgttaaacagcacaaaaagcaatatgattcaatgacattatcgagtcaagcacaagacaaaatcgacgagcttttacttcaaggtgatgtttacaataagttggccaaatccattgctccggaaatttatggtcacttggatgttaagaaaattttattattgttattatgtggtggtgtcaccaaagaaatcggtgatgggttgaaaattagaggtgatattaatgtttgtcttatgggtgatccgggggttgctaaatcacaattattgaaagccattggtaagattgctccaagatcggtctatactactggtagaggttcttctggtgtagggttgacggcagctgttatgagagatccaattactgatgaaatggtgttggaaggtggggctttggtgttggccgataacggtatttgttgtattgatgaatttgataaaatggacgaaagcgacagaacggcgattcatgaagttatggaacaacaaaccatctctattgccaaagctggtatcactactactttgaatgccagaacttcgatcttggcagcagccaatccattatatggtagatataatccaagattgtctccacatgaaaatatcaatttaccagccagctttgtggtcccgttttga

SEQ ID NO: 4571 - DNA, 948 bp, Candida albicans
  unsure (793),(893): Identity of nucleotide sequences at the above locations are unknown.
gaaaccgacgcgatttggtttcgcgtccaattgttttcacagaacaaaaagaatattgtaatattgtccactaccagcaccagcagcactaccaccacattggaaagaggaaaggaaaaaaaaatgaaaaaaaaaaggaaattgatttttactcttcttaacattttatttttattttttttacaatcgttaagcaataatcacaacatgtcaaccactacggcagctgtgcttcctacagtccaattacaagtcaattacaatgaagtcaaaaccattgccaaagactttataaccaaattcaaagatagcatgatcgatattgatgatgaaatcaatcaaacccacgaaggtaaatatatgaatattttacaacaagtcgccaatagacagaaaaccagtataaatattgaatttgatgacttgaaattattcttaactaattatgatccagattcatccaacacctaccaagaagcacgtcgtttattgccaaccatgttgaccaatactcgtcatttcgtcgaattgttcagtcaagtgattgatgaccttatgccagaaccaacagaagaaataagttaccgtgatgatgtgttggatgttatattgcatcagagaagattacgtaatgctagattgcaacaagaaagtaacgaagagttcaatcaattaagagatggtttcactcaacctgattctgctgctgcaaatgttggtgggcaggaagataatattgccaacccgactgatgccaatttattcccagcaaaacttacaagaagatactgtntgtattttgttcccttgagcaatgccaaaggcttatcggtgagaccaacaaaggggatatttgttgggtcattcataactgttaaaagtattgttactanaagttccgatgttcaacccaattgccatgggtccttggcttatacccgtgaataa

SEQ ID NO: 4572 - DNA, 2007 bp, Candida albicans
ttgcggcccgtccatacccatggtgaaggacccgatcgacaaaacttcaaaacaaaggtaaagaattacagtcaattgaccattcacaagcaaaattaccaagagtttcgtaaagttttctatcgtgaagcttatgaattactggctctactggatgaacaggtagaactaattagacaagatcttgataatataaaagtaaaaggtacagatgtaccgcgaccaatactaaaatggagtcatttagcattaccaacgaatctatcgtcggttattcatgataaattaaagtttgagaaaccatctgcaattcaatgtcaagcattgcccacaattttgtctggtcgtgatgtgatcggaattgccaaaacagggtcagggaaaacattatcttatgtattaccaatgcttagacatatacaggatcaacagtttctgaaagataaccaaggtcccattggtctaatattaagtcctactcgtgagttggcgttacaaattgaaaaagaaatattaaactttaccaaaaggaataataatctaagggtatgttgttgttatgggggtagctccattgaaaatcaaattaacgagttgaaaaaaggggttgaaataatcgtcggtactccaggtcgagtcattgatttgttggcagctaattatggaagagtcctaaacctcaagagatgtacatttgtggtattagatgaagccgatagaatgtttgatttgggatttgagccacaagtcaataaaatattaacgcaaatcagaccggatagacaaacggtattattttcggcgacattcccaaggaaaatggaaacgttggccaaacagattttaacggatccggttgtaataattgtgggtggtatcagtgtggttgctcctgaaattaaacaagaagttgttttgtttgagacttcagctgaagagcaggataaatacaaacaacagcgtgtggagaagttgcatgatatattaacaaattatcaaatagaacatcctgactctaagattctagtatttactgaaaagcaaaatgatgctgatgagttagttgctaatttattatcaaacaaatatcctgctattgctattcatggtggcaaggatcaaatggatagaaagtatgccattaaagaatttgctagtatggacagtggaattaatattttgattgccacttctatagctgccaggggattagatgtaagaaatcttgggttggttattaattttgacccaccaaatcatatggaagattacgttcatcgagttggtcgaacaggcagagctggtgcaaagggaaacgctataacgtttgttagttctagtcaaccaaaagaggttttcaatttagtaaaggcattaaaattgactcattctgatattgatcctaaactagaagaaatagctaacaagtttgtcaccaaagttaaagcaggtaaagaaaagattagttccggttttggtggcaaaggcttagataatttacaagaagttagagataacaagttgaaattagaaaaacaaagatttggtgatcaacaaccacaacgccaacaagaggaaacggagacgaaaaaactgaatgatgaacctgttccagatatcgctttacctgaattcaatatcattgaaggtaacactccagaaacttcgggtccagacaaatgtaaattttattgtcgaattgttattaatgatttacctcaaaaagtgagatggaatatagtacaacgagagagtttatccaagatcattgatgagtcaagaacctctataacaacaagaggtcagtactatccaccaggttcaaaaccattatccaatgatcaagaaagaaatggcagtttagcaaaattgtatttgttagttgaggggttgactttgcaatcagttaccgaggctattacgttgatcaaaaaaaaaatgttggaaagtttggatattttgaaccaaagagaaaacttacaaccaacaggaagatatgttgtatga

SEQ ID NO: 4573 - DNA, 942 bp, Candida albicans
gtttttctttacttattacagaaacgtaagaaaacatcaagagcatgcaatcattgtcataaggcacatatgacctgtgactcgggtcgtccgtgcaagcgatgcattcaaagaggattagattcaacatgtgaagatgcaccccgaaaaagaaagaaatatcttcaagatgtacccaattcttctttgatgtctaaccacagcatgaatagcagtgataatttggacagtaatggtgtgtcaccaatgcagccgacattgctgctacccatgccacctgtacaagaactgtcattgcccacaaatatacctaatcaatctcaagttccgtcacaatcgccaaacacagccctgcaaaaacagcttctgtattcacctccattggcttctacttactcccctaatcacaagacatatctggcaacattgtttcaacacagtgcaacttcaccggagttgatgcaaacagtgcccgaatatttcccggaactttacaaccaacactatcaaccttcggcaaatcctaatcagaaaagacgaacaaatttcttgtcaacagcagctgacttggagtattctacattatcaaatattcttcaagagaactttggtcatcacacaacatcaaacgaaggcacccctaattcgcataacttttcaccagcattatcaccgcataatatgcctacaaataatactaatgcgccatctacatcaacccagttacttactaatgatcagcagcggcaggcgacatcatttaacaatcacaccaaacacaacaccccatcaccgttaaatacaagccataccaaactttatgaggatgccaggtatccaaaatgtgacgaaaccattaatcaatatttcttgggtgacaccgagtcaggtaaaatggtcgtattcccagatgtgttgacagcaattgaaaatattaaaaac

SEQ ID NO: 4574 - DNA, 294 bp, Candida albicans
caaaatgtgagaaacgaattttgtgtattaaatgggtggcccaaagaggagttgattgggaaagataaaagaaaatttattgtagaattactagacgacaagtcggtattgcaatatttccaagttttttcaagaattgcgtttggtgatttcttaggggccattatgacagaatgtaccttattgacaccaaaccctaatgttaaaataagaacggggtgcatgtggaccttgaaaagagatgtatttggtattcccatgatgattgtggggaactttttaccaatactatga

SEQ ID NO: 4575 - DNA, 1941 bp, Candida albicans
  unsure (1275): Identity of nucleotide sequences at the above locations are unknown.
gattatacatatgtatatataaacttgcaagaaaacacagatcaagaaattttttttttctttctttttcctttattatttacttttagttctgggcaaccttttaatcaacatttgtgggaatatttgataaattggatctcatttggcattcattttcttacccatccacctatttccattccgaattgtattgaaaccatactccctttggccccccccacccgttttctatttataatgactaaaaagttaactccacaagaaaagaaaaatcgaaagccggcagtgagggcctgtgtgttctgccatcaaaaacatctacagtgttcaaacgaacgaccttgcaagaattgtgtgaaaagaaatattgctcatgggtgtcaagatattgtacgaaaacgagtgaaatatctaactggtgaaggtgtgccaggagcagtttcgaataaacagtccacaccaagaaagaaactaaaaactggtccagtgtcaacatcagtgtccccaatggattccgtcaagtcagaattgacaactccggtggagtcttcaaatcatttcccaccacctatgtcgtcttctgtggatgcgttgcctacaacacaacatagtgcgattgagattccgccaaatgaccaaccaatcagtgacatacttgaagtccccccattattcgatagctcacatatgattagcagtgaagcaccggaaaccaacattactttgacgacacaaaacttgatcacacctgatccactactgtttcatacaaacaccgtttcaaatactacaaccgacgttttgaataagcttttgaatgataactacgaaaccgaatctatgttgagtgctaacaacagcaatggcgaccacttgctagggatggcacacacactgtctggccatctttccaacggacaacaatttcaatcaaattatttgaacgaagaatatatgatgttgggagatatcattttgcaatcgaaacaaggtagcccgtcgccatcaaacacgagcacttctgagaacaacaccaacaccttgtcaccttcaagttttggatacatactgaacatcaactttgaggactttaatcaaccgaaaagaaaggtggtacagaaactaaaggattcaagaccgtttatatctttaggatttactgcagatttggctccccatgataataacaacaacaccgattactatgacgacaaaatgaccaacaatataacaggaaagactgaagagggaccagggaacccaattatcaantacaacaccaagttcacaacagattacgttccaccatctattacaaacaatctatacaagacagcaagtgatctctacagcaaggaacttaagaatttttattaccctttaagttatcacgcacttaccaagttgctcaaagtgatatttggtgggaatgatctatcgccagaggagaaacaagaaaaacgatctaaactattaattattttgaaattgatagccagttaccgtcccacatttattgccgctcaccgtgacttgatccaagaggatcttctcatgctagagatgacgttacaacggtctcttttggactacaagaaattggcagaattgaactcatcaccaaccatcatgtggaggaggacgggagaaatcattagtattactgaagacatggcacttcttttggagcacctgctgtttgatttgctaaaggaaagaagatttatttttgaattaatggacgacaatagtattgtcgattatttcaatctttttgctaatattgctgtgggtaatttgaagtcagtaattcaaacagcaattcaaatgaaaaccaaaagcagtaacctaattaaattcacctgtgttttcaccatcaaacgagatatttttgacattcccatgattgttattggccaattcttgccaattgtataa

SEQ ID NO: 4576 - DNA, 2427 bp, Candida albicans
aacatctactatattgagggtcttagaatgccaccaaaggaggacaaaaaggagaaacgaaccaaaccgtgttgtaactgtaaaagatcaaaggtaaaatgtgtttatacgagttctttaccttgtgaaagatgtgtgaagacaggacaagctgctacgtgtcagtttgtgccaaaactaccatcgtttaaactaccgtctatagattcgaataaccatgcgacgagactaccatttacaacacctgtgctaaatgctccatgtacgttcacaccatccctaaataattcaggtcctttgccgtcacatttaataaattcaaatctacataatcctattcctgcattaataccgacacatagttccatgaatactcaagtgtataataatctggcactgccgccaaccctacaaaatgcatctgatacagcttggaaatcgcaaatcgaacatcgattatctggttttgattcgaaaattgataatttagtggagatgttaaaagtcaaccaacaatttgtaatgaataatcagatgcagtttttacaacaacaacagcagcagcagcagcagcagcaacagcaatatagtatttctgaaagacaggagaattatccctcgggatatttgacgaatggaaacagttctcaacacgttgatactcatcgaactgaattgaatagtaaattgattggcgactcaaacgaatctcaaaaacgaaaaccggaaatatcagagactagacatgaaagtcccaaaaaacgtaaatttcaaacagaattctcccacgatttccgtgatgggtttttaaccaaaaaagatgcccacgagttattccatttttttgatgccaatatttcccaacaactattcggatttgaaatttcaaagtttgatgtggatgaaatatgggatagttgtcccatattagtgtgtgcaataagtacaattgcatcgatccatcatcctaaactatcaaccaaatcaaaacaattacaagtctacctccataatttatgtggctcaataatactcaacaagcctcgcaatgaacaagatggtttcaatacaattgttgccttgattttgtgcagcttttggttgagtgattcccaaatgtttactgggctcgccttgcaattagctaaagagtatggattaaaccagccaaaccaaaaaaataaagataaattaaagttgtggtatttgttgtatgtattggatggacaacaaagtttgacttttaatagacaaccacttttgaactcacaagagtattcattgaaacacagtaaagaattattattaggagaaaagggcaacaagttatctgacctgaaatccaaagcattgataaaaaacaaaaacaaatcaaattccaaaccattgacagacgaggaaatatccaaattaatggcaaaacaaagattaacggatatgagattagtttcacaagttgaatataaccaagcgattaatgaagcatttaagggaacggcgtgggatttattggcaccggcatcatttggaataccgtctaaatcaaatttggaattagatcgatggatggtttcttggactgtgttattatcgccagaaagtttcggagctatttggtctacaaaatcaacattaatttattataattttgccaaaatgcacataaactctagtgctgtgagaaagataacccttgatcctaacaatggtcaatttccaaaattggacacatctttaagtcataattctacgagtaattgttctaataatacgttggctgttaagaagcaacaaccaaattacgattcagaagattcctcagatgatgagtttgatgaagacgaatttatctcaaacaaggagttagtatctccagatgaagccgttataaatgctaatattgcattgaacgcggcgcagacggttttgaatttagtaatcaatgataaggacattttggacaacttaaagtatgtgcctgtacatatacatattatgttgtactatgcttcattattattgataaatcctcctaaaagatccaacaaccaaacagtacagatgaatgacatagattactatgataacttactaaataatttgaaagttgttcgaattttgcaacggaaaatctatatgaatttacccattgattctagttttggtaatagattaataaagaatctacaagatgtgttgggtgagaaactacacgagattcaaatatttgttgacgaattgcccgatgatcatgtggagaagcatcaattaaggacaaaagtcaatgcattgtttgaatcgagtgaaaataaatttgaagagattacagaatatgaagttagtagtagtggtgcaagcagtaagagtacaactccactacctgaaaaaatatcggcttggccagggtcaaaccatgggcatccttaa

SEQ ID NO: 4577 - DNA, 351 bp, Candida albicans
actagagattttaatcctgctacaacggttttcattagagttttaattgaaaaaaaatatgctttaccttatcaaactttagatgaattagtattttatttcatgagatttagaaatgctactattaatcaagatgaaaatatggaaaatatggatattgatcaagaaaaaaccaccaaagtcaataatggtcctcaattaccagtggtatggcataaagcattcttatcatttgctactcgttataaaaatgatcttactgatgatcaaaaagatttcttattagaaacagtaagacaaagatttcatcctctaattggtcctgaaattcgtagagaattactaagttag

SEQ ID NO: 4578 - DNA, 645 bp, Candida albicans
acgcggattcggatctcagcgcgtggggaagaacaaagaaacaggagaaagctgtatgttgcattactagctggtcagataataaaggatattgaggcaacagaggatttgttgttcgacgataacaaagacaaagagaatagatcccctacaaaaaatgatccatttcgtataagaatagttaaccaagcaaccaaattaatgagctattttattttagatcaggaacttaacaaactaatatcgctccacaacatcgactggctatatcatcatgcgtgtgtaatgcttacacatccaaaggcgtcgaaggcgatcatatctgcatatttagtaatcatgaaagaatgcaagctaagtgccaaaaaaaagaaggcattatttgaaactggtgatttggctgagaagatgttatttgcattgatcaatatgaaaaggttcccaagttcatcattggtgtcggagcaatttatgtgttttaagaattttgtgaatcttttccccggtataatggccaaaaatatctcccattggtttggaatgctattattaaatatttgtgaagttggttcaccgttttacttgaaatgcttttccgttcggggttcattgtttgttagaggtggtaaaggtatttttagataa

SEQ ID NO: 4579 - DNA, 1779 bp, Candida albicans
  unsure (89),(90),(91),(1738): Identity of nucleotide sequences at the above locations are unknown.
aatgcttttccgttcggggttcattgtttgttagaggtggtaaaggtatttttagataaccggaaaacaagagcttatgtaaaattgtnnnggtcttctacatattctattaatatcaaatcgatgtcaagcagtgaatcgattgtaatagattcagattccaacgattctcagagccagaaggtggtagatatagtcttgtcgaagcttctggaactaattcacgatggccaatttaaagaggccatggatatttgggttgcattaacggtgctcgttgggtattcaggggaatcctttgaaaggtgggaacatttgagtaaatggttgcaaatcacaaaactttgtttcaactcgcaggtacctcaagctagagtgttagctttgagttgttggaaagcgataatttttaatttgtgcagaaatgatttggatgaaataaggaaaacattggatccagtaatgggccattcaaatattaaagacaaacaacaacaaatcacgactgtcatgaagccaaaagtgaagcttctcacctatttgtttggtagtttcaatgctgcggaaatggaggatgaagttattgacacattacacaatctatttgttgccatattatattcaacaattaatccccttgttataaaactgcgcacgaaatacttgcatatcctttgggataaagtcttccaatttgtatttattaacttttactttaaaaaggatgcttctaacgcccgtatgagccaattaggctttgcggttttgtctaaattgattaaatctgctacaccggtgaatgagagaaacttcaatgaggtgcgctgtttgtcgaacgagcctgtttcaattaatgaagtaaattcgttgccgcccaggtggatctattccaagtttgataaaataatgcagaatatgatattaatatttcttctggaaaacttgcatgtggaagataaaattgggttttttattgcctttttggcaagcataaaaccgatagttaaaaacgaggcactggtttcccctactacatttgacattattgataatattcctatcgtcttgagtcaccttttcaagacaaatacgctttcacatgatttggctatcaaattaattgtaaacttacatgacacttttacatcgtctttattggtgaggagagcaaataagcaagatgagattgatacaagtaataacatctatcttcctgtgcttgctaattgttcaaagagtttgtcgaaagaaaagtacttggagatttttcagttaataactcagtcactttctcataaaaaaattcttgtatttattgctgattatgtacagctgggtcttaaaatggaagatgttaaagctgtaatttctgatattcttgccaaacgaacagtggaattatccagtgaagaattaggattgtatggggagatttgtcaatattttgatacagggtttgagacatttgtcaagaagttaattcaaacaattgtcgttgtgtctgattcagaaaaaatgttaaattgttttgaaaacttgaatattacttcctggaactattctatcgtcatctttcttttattattgttgaaaaatgctcctaataagcacatttttcaatttaccataaatttgattgaaaagatgatgaaaagcaatttcattgcaacattagaacttttgacagtacaagacttcgaagctgagattttcccattgaatggacagatttattccntttcgctggcatattccggtgaaaacccccttcacaatctg

SEQ ID NO: 4580 - DNA, 1446 bp, Candida albicans
acatcaacgtgctcccttccagatatagattttcaccaaataatgtcctcaaataaatcactgaaaccaataaggcaagattatattgccaaagtgcgttatactaataatcttcccccaccacccttaaatccaaaattcattgaatataatactactgatcccatttcaactcaacaagaaggagaatatttaatatcatcattatttcgtaaagaaaatttccaaaatctaatggaaagaattgatgatcaattaggattagatttaaacttaattaataatcgagggtttttatcggaagataaaatgaatgaaagtgttggtaaattaaaatataatcaattacatcctaatgatcgtgcattattaagagatgcaggaattgggaaaattctgaaaaatgaacctgaagtttcatttttaagaagaacagaatatatatctgatcgaccattatcaaaaggagggaataatttaaatactgctactgaagaaattaaagtgaaagaaaaattatcaaaagatgaacattttgatgctgattctcaattacaaaatgttgaagaaagttttactgttgctaatgaatcattatatgatttaaaaaatattaaacacccgaaaaagaaacatttacgagcagtaaatacttggcctttattacctgatacatcaatgttagataatgtatttataaatttaagatttatgggtagtgcttcaataaatcgtgaattgaataatttaaaacaacaacaacaacaacaacaacaacaaaatgataaaaaatttgatgaaaaattatttgatcgggcattagaatcatcacttttcaaaccaattaaactggaaggaggtgaatggatttccatgtatctgcttgatgcaaccaacacttccactactgctaacgataacgacaatgaagaacaaatcaatgacttatatgaaaaattacattcaacaaaaaaggaacaaccaataaatttgttagatgaagatgaagaaagtttagaaacttataaattcaaatatactaaaaattatgatatgacttatcaaccatttgaacatgaaaatgaagaattggccattaaatttgtatctgatgaaattgaagatccagtgtccaaggacaactttaagaggaaaagaaaaatggcatattattatccaattaatggtaaaattgaattgaaaaaacatcgtgcttctacaaattcagaaatcaataaatttataaaagaaagaacttatgatgggataaattttatattgagagaaccttcaactaatgaattgaaaagactggatactataaggtctgaatatgatcctatggaatatgaaggagaagatgaagaagaagaagaagaagaggaagaggaggaacctctcgaagaagaacaacaacaacaagaagttgagactaaagaagaatag

SEQ ID NO: 4581 - DNA, 1311 bp, Candida albicans
aattttgtcttgacgtcaacaatgagttttaatcagcaatcaccgaacttttcgtcttcttcaggtatgaatgctaatacgccacaacagcagcaacagcaacgtggtgggaatttacctgcattgacaccacaaatgttacaatcattgacaccccagcaattccaactattcaggtccaatcctcaatttcaagaagtaatgaaccagtatatgcaaaagcaacagcttttacaacaacaacaacagcagcagcagcagcaacaacaacaaggactgccacatttaatgaacggaattccaaatcagccacaagcaaacccacaattccgacaacaagtagtagcaaaccaaatgcctcccaacatggtaaatgtcccagggtctcaaacaataataaatcaacccattcatggagcgaatattccaataaataaggtaccatcccgtagaatgtcttcaattcctggaattcctggtggccaaaatccacctgtgggtgtccctggaggggcaggaccaccattagcaggtgtacccggtgctactcctttagtaccaggacaagggccggcgcgttctgtgggaggtgtattggctacaggggtacccaatcctgggggcgttccatcaactgggactttgaatggggctcatggaaatgcaggactcaatacaaatttacctcctggagtcacacctgaaatattgaacaaagttcctatgaaaccaatgcaaaacgttaaggagtggtcagaaaaattgaaacaggaaggtaaagatgtacctcttgatttgaaagtgtatgaagatttgattagaaaggataaggaatttgtgggtaaattgaataaacagttgcatgacaacaaatttattatggaaaatattaacagagatatcaagtcttataatcaaatcaaacaattgaggatgaattctattgcgttgtccaacaaaggacagtataataacagtatttggggggaaggatatcaaggttatggcaatggaataacaaactccagtacaaagttatttattcccaacagggatttaactgatagaatcatcaatgaaagagtgatgaaaaacaaaaataaaccaaaacattatgtacccattcgattagagtttgaccaagaaagggatcaatttaaattgagagacacatttctttgggatttgaatgaagagattataaaagtggaagatttcactgctcaattgttagaggattataaatttatctccaaagttcattatgaaacaattttgtcatctattaaagagcagattgctgactatctg

SEQ ID NO: 4582 - DNA, 669 bp, Candida albicans
gcgcggttccttccaggcccgtgggtgaagacgggagagttttgcactgccatcgcgcatagcataagagaacaatcgcagatgtactataaagcattgaatatggtagggtacggtttcgacggttcaccagtacacgaagatgagattagaaatcatttattgccacctttaagattagtatcatcggactctggaatcgtggatgattttttttcaattttaagaaacccatcaagtttgccagacttttcacctacgttaggtaaattgtcccaattggaagttgaaagattggacaaggaaatggagagagaaagtagaaggaaaagaagacacaattacaatgaagatcagcaacagggttctggtcgaggcttcacttcgagaagaattgcagctcatgctggtaggggaaacaccattcccgacttgtcagacatacccaagacatttaggacgcctgccccctcatccatattgccaggtgctgttgatatgggtgtacctgaggtgtatgaatataatgaagttttaatcaatagaactcaagttaggaatccagattatagaccgccaacacctattcgtgttgaaaatgaactagtggattataaccatgatccaattgaaggtacttttatggttacaatcaaattacccgtataa

SEQ ID NO: 4583 - DNA, 636 bp, Candida albicans
ttttttaacaattccgttcgactatgtgtaacagaagataccacttcaacagatatgggaaataaaaaaaaaactagaaagacagtacctaaagaattcatttctctttttcgagtacattctggtcgcgatgctccaagaagagacacaagagaagttcaaaaaagtaaaaagcatgggtttagattcacttcgttaccagatcttcctgttgctagtaatgctttacaagaattattgcttgaatatggtttactaaatgacataaaatgggattcaaaaggtttgaaggctagtaaaaacaaaaagacaaagctaaaaccaattaattcttttattgcatttagatctttttactcaagaactatttccaatccggaacaccaacgagaactatcatctaaattagcggatgtttggactcaagaatcaaatcaagaagtatggaaacaatacacacaatcatacaataattatttacttcttcctgatgcaaaattgaattttgtggactggttatgcgaggctttggattacacgattgataatacaacgccccagatagaagatattctgttaactagttacaatcagttactatcgggtacaattgaggatgtctacattatgaagtaa

SEQ ID NO: 4584 - DNA, 987 bp, Candida albicans
aataacttagtcaaaataaaaaaagacactgtggattattgcaaccattatgttcatactggtgagccgggagtcaaatttattaggaatgtcaaaaacccattagaaggataccccaaattagcaaaattgcatcatttgaaacgtcttcaaattaaaaagcacacatctcaagcttatggtgtcagatgcaccactggtgaaatagtacccacattaaatcgatggatagagaattacaatatccgctttgatgtcattatgattggtgctctagtcgagaatcaattcattttaccaatattgaatagcattccaattcatcggttgtgctcaaaacccgggtttcttttcatctggtcaacaactcagaagattcaagaattgacgagactattgaataatgacaatttcaataaaagatttaggaggtcagaagagttgatctttttgccgatagatgataaatcaccatattatccgcacgactctggtgctacagaggtaattccattatttgaaagacaacaatggcattgctggatgtgtattacaggtactgtgagaaggtccacagataatcatttgattcattgcaacattgatactgacttgcaaattgagtctccaagtgacaaaacaaagcaaaagtcgacatacaatgctgttccagaagctatatacagagttgcagaaaacttttccaactccaacaggagattacatttggtcccatccaaattgggatattcgactcctatcagattacgtgctgggtgggttattatgggacctgatgtcttgatcaataatttcgaaccagtcaaatacaatgaagaattgtacgcaaaatcaatgatcaaatacaagcctaataatggcattgctgctaatacaaatacaacaactaccactcaattcctagtcccacaaacaaatgagatcgaagaattgagacctaaaagtccaatcatctctactaagtaa

SEQ ID NO: 4585 - DNA, 249 bp, Candida albicans
ctgactatgggtaaacaacaaaagaagcatagtaaaggtcgtttagatagatattattatcttgccaaagaaaaagggtatagagcacgttcatcatttaaaatcattcaaattaatgaaaaatatggccattttttagaaaaatccaaagttgtcattgatttatgtgctgcaccaggttcatggtgtcaagtagcatcacaattatgtccgattaattcattaattattggagttgatattgttcct

SEQ ID NO: 4586 - DNA, 1536 bp, Candida albicans
ctgactatgggtaaacaacaaaagaagcatagtaaaggtcgtttagatagatattattatcttgccaaagaaaaagggtatagagcacgttcatcatttaaaatcattcaaattaatgaaaaatatggccattttttagaaaaatccaaagttgtcattgatttatgtgctgcaccaggttcatggtgtcaagtagcatcacaattatgtccgattaattcattaattattggagttgatattgttcctattaaaccattacctaatgtaatcacatttcaatctgatattactactgaagattgtcgaagtcgattacgaggtcatatgaaaacttggaaagccgatactgtattacatgatggtgcacctaatgttggtcttggttgggttcaagatgcttttacacaatctcaattaactttacaagcattgaaattggcggttgagaatttaactgctggtgggacatttgtcaccaagattttccgatcaagagattataataatttaatgtgggtattccaacaattatttgaaaaagttgaagctactaaaccaccagcatcacgtaatgtatcagcagaaatttttgttgtttgtaaaggatttaaagctcctaaaaaattagatcctcgattattagatccaaaagaagttttcgaagaattgggtggtggtaacgaaagtaaacaaaataatgaagctaaaatttttaatcctgagaaatttagtagtcaaagacaaagacaaggttatcaagaaggtgattatacattatttcataccatgcctataatggattttattaaacaagatgatcctataaatcaattaggatctttaaataaatttgacttaccagcaccaaaagatgacgataatgatgacgatgaccatgaccatgaccacgaatggaaaatcttgagtaaacttaaattatgtacaccagaattattagaatgtatcaaagatttaaaagttttgggaagaaaagaatttaaaatgattcttaaatttagaaaacaagccagagatattcttggtatagataaagatgaaaaagaagaagaagaagaaaatccaaaaattgaggttgaaccattgactgaagaacaaaaaattgatcaagaattacaagatttaatcaataaacaaaaacaaaaggctaaacgattgaaaaaaaatgctaatgaattaaaacaaaaagaaattattagaaatcaaatgaatatgttaactgatatgaatattggtatagaagcagcccaaattggtgcagattcattatttaatttgaaaacggcggaaaaaaccggtcaattggataaattagctaaaggtaaaaagaaaatgatttttaatgatgaagaacttgccaaagataatgaaattcatatcgacgaagaagagataaatgataacgataaagattctgctgatgaattggatgaattggaaaatcaattggatgatatgtatcatcaatatcaagctagaaaatcttcaccacgcggctggaaggaaccgcacttg

SEQ ID NO: 4587 - DNA, 375 bp, Candida albicans
ctagacctatcgatgagtgacgtaattggtacaaaagttgctattcctggagcatcaggagctggtataatcagatatgttggacaaatccaagggaaaataggcacatttgccggagttgagcttttggggacattggcaaccacgcgagggaaaaattcagggtcagtagatggaatccaatactttcaagtagaaataccaaagagcgggctttttcttccctacgaaagattgaaatctgtgaaccccggtttggcaaatgtgaatccatcttcgaaaacaccattgactccagtgaacaacaggacataccaaaatgttaggaatagcatgattaatgaaaactttgcaaaccctgatcgtcacctttaa

SEQ ID NO: 4588 - DNA, 1287 bp, Candida albicans
attccacaggatcgttctcgttcaccaataagagaaagatctccgataagagagagatctggtaactcatattctggtagtggaagtagtggtagggatagctactctagaagagactacggtggatattcaagaccatcttatggaggcgatagaagaagagattatggccgtggtagttatggaggtggtcgtaatggtagagattatggcagatcggttgcaaccagtgatgctgactatcgttccaaaacagaaagaaattttgataattccattttcattggaaacatcccctttgattgcacatctcgcgatattgaagatatttttaaaaaggatttttctatagtcagagcagatattgttacaaataagggtcgttcaagaggtatggctactgttgaattcaattcaaaggacgatgttagagaagctataaataaatttgaccgttatgaatatcgtggtcgtgaaatctttgttaggcaggattaccctccaccagaaaagaaacatgattacggaccaccaagaggcagaggaactacatacgacagcagatccgggagtagagatagatacaatgacagatatcaaagcagtagaagagatgacaataatgctcctcctgcaccaccaagcaaaccaggtacagaagttttaattggtaatttgccattctcggtaaattggcaagctttgaaggatttgatgagagacgctggtgaagttattagagctgatgttagattggacaactatggtaattcaaggggatttggtactgttgttttcaacaccgaagaggaagctgccaaagcagttgagatgtttcaaggttatgaaattgaaggtagaaaattagacactagaccaggccgttccactggatcatcatcaggatatgaaagagattcttataggtcgtcagatactactgagaaatctagttatggcgacagaagcaaatccgcagttgcaaataagaattctgagtttactgatggtgtcactgccgatggtgaaaagtcagatactatctatgttgccaacttaccatttgctactcaggatgatgatttgtatgatttgtttgaaaccgttggtagaacaaccaaggctgaaatccaatatgctgatgacggtagaccaagtggaaacgctgttgttcaatttgaaattgctgatttggctgaaaatgcaattctgcaattaaataattatttgtatggtggtagaaatcttcagatttcatatgccaaaagaccagaagaaaaagtctaa

SEQ ID NO: 4589 - DNA, 1158 bp, Candida albicans
tcctgccacggcgctcgtaaactgtgcgatatgttggtgagtttggagaaaaccaacacgacgtactgtacagctttgacgagaacgttaatggatgaccgttatttttatggagttaggattgctgctgcacaggctttagctgattgttcaaatgaagcaaacaattttattggtttagagtacttgctcaaggcatttggcaagttgtattgttttgacgacagctttattccaaaatcaaatgattttagtgattttaggggctttatgttgcaaagtgcattccctcgaattttgtgtggcgtcaaagataatgacggtaaagttcccaaaaggatacagaatttgttgcttaatctagtgaaattcaatgacaactcgatgaacgcgtttgtcgatagtctctatgtgagcgagttggtcgtttcgctagttaccagtactgtcagtggatggaggaatgacattgaagagtacaatgatactgaatttgctgggaaagtactgtccgaactttttagactccaaaagttggatcgttggataccgtcttaccaaaacattattgaagtaacatgcatacagcagaatatccgaatggctttggttggtgctcgaaaattgtcgtttgaagagttgttgtacatgacattggataaataccccatggaggcgagggtggaagcgtttaggggtatattggagttgggcggattaaaaaacaaaagcatcttacagtactttcttaaggtttgtttgttgaactttgaacgtccactatacagaagcaagttgattgaggcattggtgaagtcggtgtcgtcagttgcaacttacggcggtgtgtctactcttgacgatccagaattccacacaaaagtggacactaatgttaaaagctcctccaaccgtattattattgatgatggatcgcaagataattcggcgatgaaatcaaagagagatgatatggctcgtgcaagtataaagggtgccattgagattttgcgaagagacttttctgagggccaaggtttgcgtgaaacgtcgtgggagttgcttcacacatcattgattggtttgcatgaacgtagaagtatcttttgtctgtgccaggtgttgttcaaagaggtagatccatatgttgtgaagtag

SEQ ID NO: 4590 - DNA, 1443 bp, Candida albicans
gaagaaagcgatcaggggagggctatacaaaacttagcccagcaaaataatgatagtgatgatgatgatgatgatgacgaggatattggcaactacgacatggttgttccatctggtgatttcaacaacgtcaaggaaacgccacaccccattgatttgtcgaaaaaagttgtgtcgtggtctatattcaatcctgtttgtgcccatcatgtaggctgggccgtgggatgttttgaaagctttgttctttctgatgagtcagctggggcaaaagaggatgatgaggaagatacggtgctaagaggtgacgatgctgagaatgtgaataatccagtgacaatctattcacttccggaggacgttgagtgggcaaaaaacactagtattatcaccaacaaggcgttggatttctttctgaaagagtatgggtcgttcccatttagttcttatgccatagtatttgtgcggtacctgccgtgccaaaccagtaactttgctggactctcggtaatgtcatcaaagttgttgtacccaccagatatgattgaaccaatgtttactgtaactgatatactattgaaaagtatagccacacaatgggctggcatcaatatatcgccacaaacattcaatgatatgtggtgcaccatcggtattgctgggtttatggcaatctcgtttatcaaaaaattgatgggtgctaatgaatttcggtataagctacgcaaacaaatggataaggtggtagctgaggatgtggggcgacatgctattgcatcccagccatttaagtaccctgtttcggaagacgatttatcgtttgtgtggttgaaatcgcccattgttttatttattcttgataatagaatgacaaagaccgacaagtcatttgggttgtcgagggttttgccaaagttatttcttcaggcaatgtcaggaagcttacccaacggcacattgaacacagaacatttccgttacgtctgtgaaaaagtgaatcgaaacaagttggaaaatttcttcaagcaatgggtgtttggtgctggggcgcctgttttccgaatcagccaaagatttaacaaaaaaaaggggatgattgaaatgaatatccgtcaggtccagcaccatgaaaggacacccaagaaattggatagttctagttttattggtgatgcagttgcctacttggacaacgaaccgctgccaccgcaacaacatgtgtttactggccctatgactataagagtgcatgagtctgatgggtcaccttacgagcatattgtcgagttgaaagaagcaaacaccaaattggatattcagtacaattcaaagtttagaaagattaaaaagaaggatgatggtgttgatcctggtatagcgtttaatcaatttggtgatgtgttactatcccatgccgaagattgcagagtggaatttacgtga

SEQ ID NO: 4591 - DNA, 663 bp, Candida albicans
  unsure (663): Identity of nucleotide sequences at the above locations are unknown.
cccaccacaatctttaatgtttggtaccacaaaacatttaacaacatgcggtctgctttaaaccatggaacgccaagaatggttgggggacttataataactccacttgcgagacacattaatgctaaaaaagttgttaacccagtgattcaatcttttaaagttgcccatcaaagagttaacatcgatattgacttatctagcaatagtattgatgggtctacagaattgacagtcatacctacatcgaataaacttaaagtgataaagttggattgtcgtgagatggaaataaaagatgttttgattaatggaagtaggtcattgaattatgtatatgacgatttattatacatcaacaaccccgagtattttgagcactgcatcgactctaaagtcataaatgttatggacttgtactccgatacattcaatgtacatcagcaccatataatacggtctaaattggattacatctttaagaatcccaagcacgacgaagagagtttggagtacaacacccaggaacttaagattcttttgccagacaatatgaagtttgagttgaccgatatcaattctatacaaacaccaagcggaactagtcatccagggactactacgcccctgcatctaaaatccaagggcacgggaaacgagtan

SEQ ID NO: 4592 - DNA, 189 bp, Candida albicans
tacacacctatacagttaaaggttgtttacaaagtcaagaatccacagaatggagtcaattttgttacaaacgaagacattgaaaagaagctctggcatgcatatacaacaaactccaaatacaacgtttccaattcatcatggttcccctgcattgatgatttgtgtagcagaagcacatggtcgtag

SEQ ID NO: 4593 - DNA, 720 bp, Candida albicans
  unsure (703): Identity of nucleotide sequences at the above locations are unknown.
gcgaaaaaaaaattaatatacctttggatcaagatgtcttctgtcatggataaacctacatcaagacaaccattaagggactcctctaattacaagaataattcagaaacgacaccttcaaaatcacgaacacaattatcagtagcacttccaattactcagaacacaccacctgaaagtatatcagcaatcagaagatccgacgcaaatctatttgagacacctacaagattttacaatatagatactacttcattggtgggtgactctcaacatttgatgatgcaatcatcctatttatctccggctttttcatcgccaacccaaaggcatagtcaagaacaaaattcagacaaattagctagctcgcctataaaaaaaccttcggaaaccaaaaaactgaagtcaaaagcaaaaacaaatacttctcctccaaaagctagtagatctttcaacttgcaatctgaagacaaacctccttactcatatgcaactttaatcggtatttccatattatctcacccggagaaaaaattgacgttgtctcatatatatcaatggatatctgatactttcaaatattataagaagggagatgttgggtggcagaattctataaggcacaatttatctttgaacaaagcatttatcaagggtgagaaatctaaagacgggaaagggcattatgtctgcccccacgggnctagaaatccgcgctcc

SEQ ID NO: 4594 - DNA, 777 bp, Candida albicans
caccttcataatccattctatatatttgcttctttattgtctacagtcatttccgttgcaatgtcctcttctaatgatacaccatctttatttgtcacaccacaaacaccaccaagacagcaacaaaggagaaaaagtaatacaggagctatatctacacccgttgcctcatcagtattattaactccatctacaacaacaaaaaaacctacaagaactccagtatcacagaaaagaaaacaaggtgtacagttgtctccaccacaggcaaacaaattcccctttactccaatcacccctcaaaaatcaccatgcaagacaagaaagaatttggatttattcactagtaacgaaaaatttggcttattgttaccatcgccatccactattggttctggtagatgtcataactctttcacgcaagctccacctccattatttgatttgaagaatgttaatgagtttaaagtacctaagacacccgcaaaacaaattatagacaactctagaacaaaagaatcagaaaatgaagatgactgggaagtgatggacatagatgaagttgccaaaattcctcgtgcaaagttgaggaacccttttatagacacttttgaaccaacgagtccggttacacctgaggagagtactggagatagaattaactatgacacacatatggaattgataaacagtaaaactggtaagaaaagagttgtaaagttaacaaagaatcaaatgaaaatcaaaccaaagagattatcgtttgataatatataa

SEQ ID NO: 4595 - DNA, 1176 bp, Candida albicans
atatttatcccagttgaaaacactatttcagtatactatatgaacctcaaagatattaccgatccgtcggattttaaaaccacaaaattgcctgcattagcagagctagatattttaaagaggtgctatatatgcaaagatctattgaatgcacccgtgaggacacaatgtgatcacacgtactgttcacaatgtatacgagaatttttacttcgagataatagatgtccgctttgtaaaacagaggtttttgaaagtggtctaaaacgtgatccattgttagaagagatcgtcattagttatgcctcccttaggcctcatttattacgattattggagattgaaaaggtggaatcgaagcaagaggtagatcgtgagaaatcagccaatgagtcagcgctgaatggtaatagaaatgtaaacaacgatgttgacgaaactgtgcgcgttaaagatcaactgaatgcagataaactaggtgaagaaaaagggcaagctcaacattgggaacaagtaaacgagcagactactgaagttattctgttgctatctgatgatgaagagaatggttctgatagcctagtaaaatgtcctatttgttttgagagaatggaattagatgtactacagggaaagcatattgacgactgtctaagtggaaagagcacgaagaggacgcctacagacattttatccccaaaagccaaacgaccgaagcaaatcacctcctttttcaaaccaacaatagataccaaaacgccttcgccacctacaagtaaggcgtcaacaactccaacagcaactccgacaactacattgttgaaagcaaacgtcgcatctccatccccagtggcgcaaagtacagttcacaagggcaagccattacctaaactcgatttcagcagcttgagtactcaaaaaattaaagccaagttgagtgatttgaaactacccacaacaggtagtacgaatgaaatggaagccagatacttgcattactatgtgatttataatgccaaccttgattccaatcatcctgtaaaggaatctattttgcgacaacagttgaaacaatgggaaatggtgcaacatcaaccgtcgtttggtgatgcacagtggaaaggagctgaaactgggaattggaaagaactcattgcaagagcacggagtaactaa

SEQ ID NO: 4596 - DNA, 942 bp, Candida albicans
agacctaatatagttaaatggaatcctatgaatacaaacatattagccgcaggacatggtgatggagttattcgattatgggatattagaaaacaagattcttatattgctgaattgtatggtcataacaattacagtattactactagtatggaatggaataataatgatttatttactggtagtaaagatggtaatataattcattgggatttatcaaatatatccaaagattctcaatgggaagaaaatgataataccaagttaccaatatcttgtggattaaaagaaggttttaatagtattgaatttaatggtaaagcaaataaattagaaactaaattggatcaatatcaatgtggaactatattacctgcttctaattcatcaattgttgccatgtgttctacaaccacaacaacaagtagtaacgatcatgatgatgaagaaatcaaaatattatcaattgatagttcttcatttcttggtgtgcataataaagtatcagaatctattaatgttaatatcaacactaataaattatattatactgaagaagatattcaattattattacaaagtcaacttaataacaataatattacttctagttctgctactggttcaaatgatactttaatttcttttggtaataatgtatctcaagatagtttagtgaaaccattaaccatttcaagaaaaccaaccaccaccattaagaataataataataatactactactagaccaactaatacccatacccatagtgcttctattgatgagagtatagtgtctgtgcataatgtttctaatgacactttggtcaacagtccaactagattcaatatttgtgaaagtgaagatgaatttacattcaattatgtccagactaacactttttcatctacgggagcgagcaaggatccgcatctattgtct

SEQ ID NO: 4597 - DNA, 1224 bp, Candida albicans
aattatcttacgtggctaataataattgtatgtgtgtgtctgttcgtttttttcttcgttgtctctgcctcgttgaatttttcaccttccatccaaatccacatcaattccattcttggcagtaaacaaagaaaaaaattctggtcaaaacgaaacgaaacgaaaccaaccaatatactaaccaacttaccaccccctttcccaaaaatgctgagtccaaatgatagaaataaaaaattctttaatagtttaactccaatagttttaagagataaaccaatttcaagttatgcttcatcagaaattataacagttgcaattaatcaaactggtactagagtggtatattcacgtacagatagatcagtaaggatttggaaatgtcttcctgcttcagtagttgacccaaaaactattgttgatgcccatctgaaagcagtcgaatgtttatctttcaatccaatgacagaattcacgtttgcaacagtggctaaagatgaatatgtcaaaatttggaatgctaatactggggataaattacatgaaataaaatgtgaatttgattcgttaaaattggttcgttattcaaatgatggacaattgttagtggttgttgatagagcatctaatttcttgtttttcaatgttggagcaaattataaattaattcataaattcaaattagatgaacatatctatgatttaaaatggttcaatcatgatcatcaatttttccttgtatcttcacatgatggaagcatacttttatatgaaattattgatggtgatggagacaatgaactatcttcaaaattaagagcatcagtgtctggtcacaattcatcaatcactaccattgctatatcgccaaaaggtaattattttacggttggaagtagtgaaggggtgataagtttttggaaaactttagagaatctaattaatctgaaagtgattactgatgttgatcaaagtattgcccaattggatatcagtagagatggtacttatttggcagtcgcatatgatactgatagtaatctgagaatatatgaagctgaaggaagtgaattggttcatgaaatacccaatagtggcagtgggaaccaaacttttagctcaatagtgtggttcccaacgaaaacaggattcgcatataccagtgaccatggtacagttttaactgttatgattaaaccgatagaacagaaacacaggcgataa

SEQ ID NO: 4598 - DNA, 993 bp, Candida albicans
ccttctaagaaacaaaagagggaagcacaaaaagtccgtgagttggatcttataccaaaagatttgccaaatgtccttatcaaatttcaagcctcagatacaggtgaatcaactggtggttcaattcgagttcctggtggaatcactgaaaaacaattagaagaattattgaataatttacaaggtgaatctgatgatccagttccatatacattttctcttttgaatagcgatgaaaaagataccaccaataataataataaactaattgatattaaagatgatttatatcattcagtattaaaaccaggaatcaaaacaactgaagatttcttaacattagtatataccccaagggccatttttaaagttaaaccaatcacacgttcaaatgcagcaattgcaggacatggatccactattttatgttgtgcatttgctcctaatgattccagtcgtatgtgttcaggagctggtgattctactgctcgtatatgggattgtaatacccaaactccattgcatacattaagtggccattcaaattgggtattatgtgtcacttattcccccgatgggaaattaattgccacgggttcaatggataatactataagattatgggatgctaccacgggtaaaccagtggggaaaccacttttggggcattctaaatgggtcagttccttgagttgggaacctttacatttagttaaagccagtgataatccacgtttagtttctggttccaaagatggaactgttaaagtttgggacaccacagcaagaacttgtgccatgacattaagtagtcatactggagccgtttcttgtgttaaatggtctggttcaaacattgtttatagtgcgtctcatgataaaaccatcaaagcttgggatataagtgctaatggcaaatgtattcaaactttgaaaagtcatgctcaatgggttaatcatttatcaatatccactgattacgttttacgtaaa

SEQ ID NO: 4599 - DNA, 471 bp, Candida albicans
ttacgtaaaggtgggtttgatcatacatcaaccaggaccacccaaatttcaccagaagaattacgtgctcgtgctttacaacaatatgaaaaagtagctaaattaaatggatcaattagtgaaagattagttactgctagtgatgattttacaatgtatttttgggaaccattgaaatcatcaaaacctatttgtcgaatgacgggacatcaaaaacttgtcaatcatgttaatttctcacctgatggaagatttgttgtttcaagttcttttgataattctattaaactttgggatggtattagaggtacatttatttctacacttcgaggtcatgttgctccagtttatcaaactgcttggtccgctgataatcgtttattggtaagttgttccaaagatactactttgaaagtatgggatatccgaactaaaaaattgagtgtcgatttaccaggccattctgcatga

SEQ ID NO: 4600 - DNA, 1185 bp, Candida albicans
ttagccgccccacctggtccaccaaccccagtcacatcattatcggttatcgacaagtcacaatacattgtcaaccccacccaaagagctaaccacgtcaaggaaatcccaccattcttgcaagatttagacattgccaaagccaaccccgagttcaagaaacagcacctcgaatactatgtgttgtacaacccagcgttctccaaagacttggatattgacatggtccactccttagaccactcgtcagttgtttgctgcgtgagattttccagagacggcaagttcatcgccaccggttgcaacaaaaccacccaagtgttcaatgtcaccaccggagagttggtcgccaaattgattgacgagtcctccaacgaaaacaaagacgacaacaccaccgcctcaggcgacttgtacatcagatctgtgtgtttctcccctgacggaaaactcttggcgacaggtgcagaagacaagttgattagaatctgggatttgagcacaaagagaattatcaaaatcttgaggggccacgaacaagacatttactcgttagactttttccctgatggcgataggttggtttcaggctccggcgataggtcagtcagaatctgggacttgagaacctcccagtgttccttgactttgtcgatcgaagacggcgtcaccaccgtggccgtctcccccgacggcaaactcattgctgccggctcattagatagaaccgttagagtgtgggactcaactaccgggttcttggtcgaacgcttagactccggcaacgaaaacggcaatggccacgaagattcagtctactctgtcgccttctccaacaacggcgaacaaatcgcttccgggtccttagacagaaccgtcaagttgtggcacttggaaggcaagtccgacaaaaagtcgacctgcgaggtaacctacattggccacaaggactttgttttgtcggtctgctgtacccccgacaacgagtacattttgtcgggctcaaaggaccgtggtgtcattttctgggaccaagcttcaggtaacccattgttgatgttgcagggccaccgcaactcggtcatctcagtcgctgtatccctaaactcaaagggaaccgaaggtatcttcgctacaggtagtggcgattgtaaagccagaatttggaaatggaccaaaaaataa

SEQ ID NO: 4601 - DNA, 690 bp, Candida albicans
agtagatttttcacaacaattaaaccctctcaatctacagaatctactttaacggaaaaagtatcatcaaaatcaccaccactaccaccaccaccaccaccacctactgcctctccttctcttccttctgaaaaactattagagtttggatttgatggaaccaaagacagtacctctacccgcaccaccacaaccaaatcaaaagatgttgaaaaacgcaaatcaacaacatcatcaggttcatccttttcttctgaatctaaaccgaaaaggccaaaagaaaaacgacttacaccattagagaaacaaatattagaattaactgaacaacatcaagataaaattttattaattcaaattggttataaatataaagtatttggtatcaatgcacttaaagtatcgaaaattttaaatatcatgtatatcagtaatgatattgaagatacaagatttcattattgtagtattcctgatacaagattacatattcatttacaacgaattttaagtcatggatataaagttggagttgtcaaacaaatagaatcaacaattgttaaacaaattgaaaaaacatcgaaatcatctgatgttatgcgaagagaagttactggggtttatactaaggcaacatatgttcctgagttttcacacaactggggcatggaagaaccccgcgaattgcgt

SEQ ID NO: 4602 - DNA, 234 bp, Candida albicans
  unsure (15): Identity of nucleotide sequences at the above locations are unknown.
ttaaaagtacttcanaccatcaatagatatcggaaaaaatccgtcactgaatatttaaaattattacaatatcatgaagaaatgttaattaaaacatgtgatgaagaatttcaaaattttttaaaagatttagattccaattatacattattttataaaatcattaaaaatttagcaatttttgattgtttattagtctttaaccactacaagtccacttcccaattatactag

SEQ ID NO: 4603 - DNA, 897 bp, Candida albicans
tctttaaccactacaagtccacttcccaattatactagaccaacgcttattgatgatgatttgaccatacttgttaaacaagcacgacatcctactattgaacaattacgtccaaattatgttgccaatgatattaatattaatattgaatatgataaaaatcgagtattaataatcaccggaccaaacatgggtgggaaatcttcatatgtgaaaaccgtggcattattaaccgtgatgactcaaattggatgttatttaccttgtcaaaatgctaccatggggatatttgattcgatatttataagaatgggagccaatgataatatcttgaaaggttattcaacatttatgatggaaatgttacaatgtaaaaatataattctgatgatgagtaatagatcattaattatattagatgaaattggtcgtggtactggtactattgatgggatttctttagcttattcaattttaaaatatttgatagaatcagagtttaaaccattagtattatttattactcattatccttcaattcatgtattagaacaagaatatcctaatcaattagttgttaattatcatatgggatatcaagaaattaaaaataatacaccaggagagattccggaaatcatttttttatataatttatgtcgtggtgtggttaataatctgtatggattaaatgttgccaaattagctgggatatctcatgatataataaaacaagcttatcgggttagtgaaaaagtgaaattagatattgaattaaaagaatattggaaatttgctcattcattaaataaagctttaaaagaaggtggtagtagtagtccaaatcaacttgatgatatagattattatatattatctaaacattcatcattataa

SEQ ID NO: 4604 - DNA, 675 bp, Candida albicans
tctcaagatactatctcctgttccggccgtgttgacagaatcatgacgacaacgggacctgaacgagaacaagaacaagaacaaaaagatgaaaaagatgcaaaagatgcaaaagaacaaaatcaagaacaagaacaagaacaggaaaactcacaacaaggacctgaagtgatcaatgtaacttataaagccatcaacagaattttcattggtattttacatgatttccctgaatttttagttgaatgccattatcaattggtgaccagtattccaagaggatatattcaattaagaaatattgttttatcggccacacctaaagatatccatgtaccagatcctttcactcaagggttaaaagttgaaagattacctgagatcaatgaatcaccagtagtgttttataaaccaattgaagatttgagtaaagttggattaaagaaacccgttgaaaactttttaagaattcctgccccagggttgatgagaacaatttataatggattaaaattgaatcagcctaaagaagtgaatgaattagggtatgaggaaacgatcaatttcaatataaaattgatcaatgcgttggtgttgcacgttggaatatccagtgttgctgatagattacccaacaatcgaggatttaataccaagtcatcacaagtggcatga

SEQ ID NO: 4605 - DNA, 282 bp, Candida albicans
  unsure (44),(218): Identity of nucleotide sequences at the above locations are unknown.
ttggttgatttaatgaattatggaaacactgaattcaaatatcnattgatcaatgctattgctaatcaattgagatatccaaataatcatactcactggttcatgggtattattttacatgttttcagtaataacaatatgtggaacagtaatggtaataagtgggtgttcaaaaaattatcactagaatattattggaaagaaaaaacagtaataancacctccctggggattaactatttatttactgactgggttatactggggattaggaatttttga

SEQ ID NO: 4606 - DNA, 957 bp, Candida albicans
agaaaccatttggcccaggaagagaaatctccattcttcccactttctgttgaaatggaaatgaaagcttattattctaaaatgtataacaaagagcttgagattaaagaaattgttgacatgttgactcaaatgaaggccagcgatgatctccacagtcaagatgtctttgcatgcatgatccactctttattggacgagtataagtttttctcagagtatccattgtcagcattagcttcaacatccttgttgtttggtgcacttttagaaaaggatttgattcaaggtacgactttaactgttgcattgaattttatttgggaatcttgtaaccaaccacaagattcacatttgttcaaatttgcggtacaatcattgtacaacttcaaatcaagattgcatgagtatccaatttattgtaaacacttgttggaatgtcgttcattatctgcgcatgccaagatgtaccaaatagtgaaggatgcagctaatggtattccatgtaccactggtgcagctcctactcagactaatacaccagatgttggtccaaaatatcagtctattaattatgttgatagaactataggctatgcaacccaagaagaaccaccagagtctatcagagataagttattattcagtgtcaacaatatgacaggtgaaaatcttagattatctgagatccaagaagtattgactgagagttatttcgcatggttttcagattatttggtatcagacagagccaaggcagaaccaaacaaccacgaattatattccaagttggtcaagtcgttagcaaatccaatcttttttgagtatattttgaatgtttctttgaaagaggttgattatattatccgtaattttaaggattctagaagcgaaagaaaccaactaaagaatttaggtgcttggttaggacgaatcacattagccaatgataaaccc

SEQ ID NO: 4607 - DNA, 486 bp, Candida albicans
caacaacaaaagaaagaacgctttgcacaagcacaaggtgttcctgatgatattgtttcgtttgaccaattgtttactgctattactgccaactgtgacaaagccgttcaacttgtttctgaagtcacagaaaccaagttagcagatttgccaccaaaccattccattatggcggcattgactcaagctttggtgattgcacagaccaatgccataaaatatcctgagttgttattaaaggctgcacaatatgcagtcaactgtttgtttactcagacacacgaaaacccaatgagtaatgaaatctatgttgttattttagacaaattgtgtgagtattcaccttctaccgccaaagatgttatttggtggcttgtacactcatctgatcaacgtaagtttaatatgccagttatgctttcattattgaaagttaaattaatccagccaattaaattagatttatctattggggaaatggattaa

SEQ ID NO: 4608 - DNA, 678 bp, Candida albicans
aatttgctgctaattttgtggaacaacatatttttacttccgaagagatgcgtcatattgtgttaccgatcggaatttgttaatacattagatgccttatctaaataccaagcaaatgatcaaagtgaagaagacagacaagcaaaggaggcaattagtacattgttcaaactcttgagtgaggcagcacatgcttcaaaccaattatttgctcaattgggttatatatttgctgaatgggtaagattgttgactcatggagacgatgcaacacatgaattacagattgaatttgtcaagggattgattcaatctggtatacttaataatcctgcatatgtaaagacttttttcaaagcgaccattgagatttccattacatcgtttgccactgaacatgaattacgttcaagaactcaacatgaaacatactttgccgttgatacattggctatgttgattgttcgaattgtattgttagttgaagattctaagcaagctattgattatttgaaggaagtattgggaataattattttgaatttaattaatgaccatgaaacttcaaaggccaattggaatgaacgtgcttatttcagatttttttcatctttattatcgacatggtgtgatgcttcagttttggtcttgcccacaggggccgaaaatcccgatgaa

SEQ ID NO: 4609 - DNA, 1761 bp, Candida albicans
ataaacatcatcctgaaaacaccacccgaagttaatatgacaacacttgcattaggattaagtttattgaatgggaataaagatcgtgaattgagtttaattgaacaaataaaatcagcaatgccaacaaaaaaagttatttggttattaataaaacgttatttccaattaatatatcccataattccttatgtggtcgaagataatttccgtgaagatgtggaaagaattgttggtaaagaatcatatgaagatgttaaacccgatgttaaaattgaaaatcgaatgaattttgctactattagtgttttatttgttatttgtcgtctactgtttttatcattatttcataatagggggttttataatgaacaaatattaacgaaaaaaaatttaactaaagatgaagctgaaaggaaatttttgattttaaatagtataaaaatccataatatcgaagtggcacaagcttgttatcaacatttacaaagattaggtaaaatcactttaccacttttgcaatgtgctatttatttaagagcttatcgtactttggcacccgaagaaggtgatggcattgatggaggtgattctttagtacagcatagtagtcttgtgtctatgagttatcttttgggattgaatagagatccagataaaatctcatatgtgagtgatgctaaagtgaaacatttgtatcgtaaaatttggtattattgtttgatgcaagaatacactttagcccacacttatggaactccattatatataagacccgagtcatatgacaccaaaagaccatattttagtttagaaggtgctggttgtcgagatttagaagttgaaaaatcatcactcacggtatttgcattcatttcagctttggttaaaggaccaattaaagacttggtcgttctttgtaataatgtgggacaattagttaaagtttccgaaattaccactgaactcaattgtattgaattagccataactgaattattagggaaagtaagtgattatgttcacaatttggaagaagaatctactagttatcatacaaataaaataatgaaaattggtattttgttcagaatcaatagtttactcatgaccatgtattgtaatatgtttacatattatgaaaggaaaaatgtgaaattgagtcttttttattttaagaaattttttaaactttcagttcatgaaacattaccatacgtgttttccttaatcactagaagtaaagaattatttggtgaaggttcagacttgtatatcaacccagcaatactactatttttagttcgaactatggatgtttgttttagttcgatggtgagaagtaatttttcattatacaaaatgtcccataaacccaatcatcaactgagattgagttctgatccttcgtacaaggagtattttgattcatgcaataggtttatgacagtcatggaaaaagttagtcgtctttgtttagcagcttgttcaatttttagtagcagatactattttgcctggggggtggtcaaaatgagaggatattttttgaaattgattactacaccgaaattttataaagttgagatcgaaggagattatgtccccattgctacagaggctaaacaaatcaatgaattatcagaattgattgaactgggattaatgcatttagaatcacaagtaactaaatattgtgatgacattgatttcacaacattcctcaagaaaattgcctcaaataagaaactttccaactga

SEQ ID NO: 4610 - DNA, 543 bp, Candida albicans
tcctttatccttcttatcatgtccattgatccagaaactcgtagaaaattattaaatttacaaaaaactggtgaaaacaaaaaatgttttgattgttcagctccaaatcctcaatgggcttcaccaaaatttgggattttcatttgtttagaatgtgctggagtacatagaggtttaggagttcatatttcatttgttagatcaattactatggatcaatttaaaccagaagaaactcttagaatggaaattggtggtaatgaaagattgaaaaaatatttcattgataatggtgttgatttaaatttatcaccaaaacaaaaatatgataattatgtggctgaagattataaagaaatgttgacatgtgaagttgaaggtaaagaatttgttgccaaagatcatagtggtgaaaaattacccgatattaataatactgctagtacaacaacagatccagtatgtagaggacgtcctattcctgttccattaacaaatgaacaaatacagaaaaatgttttcacgcgccgtagaagtaattgt

SEQ ID NO: 4611 - DNA, 1542 bp, Candida albicans
ccagttcataatacaggagagaaaaagaacttatcaattatgaaatttggtttgccagacaattttgaagtcgtcgtagatgtgtcatcgaaaccagcaaatcaaatcacattatctttgattaagccatcacgacccaagaatactttcaatgatgttttcaaaaaaacttgcaatgatatagatgaaaacacactagacttcataaagttcaagcaaaatgagatcaatgaaagagttgacacgttgcagtcaaaaatgaagtctcgcgaagctcaagccgacataaatataacacatttaattcaagactttaatagccaactaaggattcagaatgaacaagtagaggaattgatcagaaaagaaaaagaaagaatacgtttggaactagagagaaagagaagagaagaggaagaaagacgacgccgagaagaggaggaacgcagacgccaagaagaagaagaaaggagacgcaaggaggaggaagaaaggaaacgaaaagaagaagcaaagagattggaagaggaggaacgtaaacgtaaagaggaagaagaagctagaaagaagagagaggcagaattgaagcggcaacaagaattgaaaattcaaagagaaaaggaattgttagaacagaagaagaaagaacgagaactgcgttttactacagactataatcaaatcgagaaaacattatacaagtataaacaagatatacaggatataaagaacaatgtcaaattaaaattgaatgaagacccagacttgaaaaaacaagtgaaccaatacaaacgaaaaatcaatcccaagtttggtcaattatctaactcattatctcaattcaacaaaataagtactgaagtgattggaatgatcaaagcagtcgagaccaatgccttagtatttaaatgggtattgaatttcactgcaaaggcaataatagatcaagcagaaactgaagtcattgttagaccgaactcagctgtcccattagctaaactagcatatgccatattgcaggcaattccagattttgaatattatttaaacgcaagatttataaaaaagtgtccatatatcatagggtataactgttccattgattcagaagaaggtagagaaaggatgggatggaaacgtcctgatggtagcaaatgggaagaagaaacgaaatatgatgaaagaatgggtggtatagtcagtgtttgggcagccatgaccactattactaaccatggatcacagaaatctttatattcgtttgaagcatcatggcagtttttagctagaacggccaacttacaaacaagcatgttagttaatacccatttcacaattttgggaaattggtgggaggctgctggtgcgagcttcttaggtgtttacggcaatcaaagtcaaaaactaatgtacattgtcgtagtccaactaactgacgttgtggcttcgaaaaaatttccatctgctgccagattgagaattatgggtgaagaatgggttactaggcgacaaattcaatctctaaaggcaatggaatattaa

SEQ ID NO: 4612 - DNA, 558 bp, Candida albicans
tgccttgatctagtcaccaatgttcttttcatgtctaacctatattatactgtatttgacactgatgtgtgtacggtgttactcgtattaactttgaatggctttgtatgctatgcttcattgggtaagccagctatcgagctaaaaggaataatggccaaagatttcctgtctttgccatatcaactcaaaccattatctacaatgacgggtgataaaatagaaattgataaatcggtggaaaaattcaagctattggtggaaacaccatcggtatctcaggatatcaaaaccgaacttgtatttggtacgccgttacagagaaaagtatggaaagaattagtcaagataccagcaggacaaactcgaacttataaagaattggcagatttattaggtacacatagccgtgtgattggaaattgctgtggtgcaaaccgaattgctgtattaattccgtgccacagagttgtgggtgcaaataataagctaactggttaccggtgggggaaatcctataaggaatatttattgaagcaggaaggtataggtatttaa

SEQ ID NO: 4613 - DNA, 561 bp, Candida albicans
aaatcagcaaacatggtgtcatttacgctaccgccagaagaaggattaggtaaatatggaatgcaagggttgacctcattggttaaaatggaacagtctgatattaccaattttgcccttggtcaagatataagtaaatgtggtttggacttgactaaggattccgaaatattaaaaaacttgtcgtcgccatgggctgaaacttcccgatctgaagttgagccttactacaacttaccgaaaagcataagagcgtccagtataaatccaccaccgggaccttgtgatagcaagatccagaattttactgatgaaacattgttctatatattttacatgaagccaagagatacgttgcaagaatacgctgctagagagttggtggcacgtaattggagatatcacaagggtatacaagtctggttaacaaaagatagtaatgtggagcccgtcttgatcaatccagatgtcgaaaaaggtgtctacattttctttgatcctcacaactgggaaaagataaggaaagaatttgtgttgcattatagtctagttcaagcctaa

SEQ ID NO: 4614 - DNA, 198 bp, Candida albicans
  unsure (177),(183): Identity of nucleotide sequences at the above locations are unknown.
caattattgccattatatcacaatttttgtttggaagttttacaacaactgacaattgataaacttattcgtattgtctatttatgcataaatagacttggtcctgattatgaaccagggttggaattagggttatttgttaccatagggatggccgctcctagtgaatgttatggnagaganacatcaaaaatctaa

SEQ ID NO: 4615 - DNA, 939 bp, Candida albicans
agacctgatttgatttctattggtaagcaatttgccgttagtggtaatactatttccatgattttagattgtgaagcagtagcttgggatagagaagatcataagattttaccatttcagaaattaactactagaaaaaggaaagatgtcaatgaagaagatatcaaagtgcaaatttgtttatttgcctttgatttattgtattacgataatgaatcacttttacccaaatcattagctgaaagaaggaaaatcatgcaggagaatttatctccaattgaagatagatttcaatttgcaactgccacgaattcatcttccaatttggaagtgctacaacagtttttggatcaatcaataaaagattcatgtgaaggattgatggtaaagatgttaaatggactggaatcgttttatgaaccatcgaaacgttcaagaaattggttgaaattgaaaaaagattatcttgaaggagttggtgattcgttagatttggtagttattggagcttataatgggaaaggtaaaagaacgggaacttatggtgggtttttattagcttcatataatgaagattcaggggatcttgaaacttgttgtaaaataggtacaggttttagtgatgaagatttactcaatttatacaacaaattgcatccaacagaaattgcatcaccgaaaaattattttgtttatgacaccaataattcaaatgctgttcctgatgtttggtttgagcctagcatgttgtttgaagttttaacggcagatttatctttaagtcctatttataaaacaggtcatcaagaatttggaaaaggtgtatcattaagattccctagatttatacgagtaagagatgataaaggtattgaagatgctactagttctgatcgtgtttgtgaattttaccaacgtcaagcccatgtaaacaattga

SEQ ID NO: 4616 - DNA, 1107 bp, Candida albicans
gaagctaaacagaaaagagaagctacaccacctaaatcgccaccccgttccaagaaagctagaattgaaacaaagtctgatgagagtagtagtagtagtagtagtaatggtgatatcgagatggaaacagaacccaaattggaaaaaaataatgggtctggcaatgatgttcgtaatgaagctgaagaattgatcaaactcagcgaatcagaacaagctaaacacagtaatgaaaaattgggtgtcaaaattccctatgccaaattagcatctgtgtttgaagcaattgaaaatgaaagttctcgattagcaattattgccattatatcacaattttttttggaagttttacaacaactgacaattgataaacttattcgtattgtctatttatgcataaatagacttggtcctgattatgaacccgggttggaattagggttaggtgaaaccattttaattaaagctattagtgaatgttatggaagagaaacatcgaaaatcaaagctgattataaatctacaggagatttaggtttaattgcccaaaaatcaagaagtttacaaccaacaatgttcaagactgccccacttgacgttgatactgtttttgataattcattgaaaattgccaaatcaactgggaaagaatctcaatcgaagaaaatcagtatcatcaaacaaatgttaactgcatgtcaaatgaaaagtagcgaagccaagtttttaattcgttcattacaagggaaattaagaattggactggctgaaaaaagtattattgtgggattagctcaagcatttgttaattatgaaaataaatctaataaaaaaattgatccatctaaattagctgaagccgaagaaattatgaaggaagcattttcacgtgttcctaattatgaagtggtgttgaaaactgcttatcaatacggtatcttcaatcttttggaacattgttttgttaccccagggataccgttgaaaccaatgttggcaaaccctacaaagtctatcggagaagtattggatcgtttccaaaatgaagaattcacttgtgaatataaatacgatggtgttagagctcgagctcatatattgtattga

SEQ ID NO: 4617 - DNA, 1149 bp, Candida albicans
agcgttggtctttccagcccggtcggtgacgacgatgaggctgacaagatgttgtcaagagagttcaaaggtattattgaacaaattttagaatttttccctccaaacaggcaagcattgttgttttcagcaactttccctcttgccgtgaaatcatttatggataaacatttgaccaaaccttatgagatcaacttaatggatgagttgactttgaagggtatttcccaattctatgcttttgttgaggaaaagcagaaattacattgtttaaacactttattcagcaaattgcaaatcaatcaatcgatcattttttgtaattctacaaatagagttgaattgttagccaaaaagattaccgagttggggtattcatgttactactcccatgcaaagatgccacaacaggcaagaaataaagtatttcatgaatttagacaaggtaaagttagaaatttggtctgttcggatttgttgacaagaggtattgatatccaagctgtcaatgttgttattaattttgatttcccaaaaacggcggaaacttatttgcacagaataggtcgttccggtagattcggtcatttaggtttggcaatcaatttaatgagttggaatgatcgatattcattgtataaaattgagcaagagttgggtactgaaatcaaaccaattcctgctactattgataaatctttatatgttgcagaaaacgccgatgctgttccaagaccatttagaatcgatgaattaccaaaaggcaatgagactgttcataataaaggatatcagtataaaggtcaaccagtgaaagatgaaaatctgggttcatcgagtcagcaacaacagcaacctcctccacaacaacaacagcaacaatcaacctcgccaccccaacaacaacctcaacaacaacaacaacaaccaaacccacaacaccaatttgctccacatccaaatggccagttcccaccttatccacaacaatttcaccaaccaggagctatcccaccacaacaatttaatggataccctccttatccacagtatcctccacaatttgctggctacccaggtcaacctccacaactcccacaaggtcaacaacaacatgctcaagcacaaaatcctgctcaacaatattaa

SEQ ID NO: 4618 - DNA, 621 bp, Candida albicans
tttttatttagtttgtcttatttacattcgaccaaacatacactcacatatcatatatcaaatactattttcacacataacaatatgacggatactaattggaaacaaaatttaaatcttcctccaaaggacactaggccacaaactgaagatgtgttaaatacaaagggtaaatcgtttgaagattttaatttaaagcgagaattactaatgggaatattcgaagcaggatttgaaaagccttcgcctatccaagaagaatctattcctatggcattagccggtagagatatacttgccagagccaagaatggtactggtaaaactgcttcatttattattccttgtttacaattggtaaagcctaaattaaataaagtgcaggctttgatattggtgccaactagagagttggcgttacaaacgtctcaggttgtcagaacattgggcaaacatgtaggcactcaatgtatggtcaccactggtggtacttcattacgtgatgatattgttagattgcatgatcctgttcatatattagttggtactcctggtagagtattagatttggcagcaagaaaagttgttgatttatcagacctccacttttgtatgttttaa

SEQ ID NO: 4619 - DNA, 1725 bp, Candida albicans
gtcagaaaaccactaaccaatattgataagcttcttgagagacaaaacactgtcaaaatactcagtcagtcagaattacacgagatcagatcaaatattagaaaaggtttgaaatatactaaaaatagcaagtcaatagtcaatgggttagaggctggtaagctgaattggcaagtgtggaaaaaccttgttttgtttttacaaaatgtcatgtacctactgaagcaaatcagacttggttttctggaagaaaatttgcctacagagctagccctattttataaccaagaattgatgattgcctttaatgaactagaaaaattgattcttctgtatgctgagcccataacatctgaagaagacaataagttgagaatcatcaatggtgttgatgatacccttgatgaattgagaattcaatataacaaccttgaagaagttcttcaagaaactaccagaattatagctgcaaatttcttagaagaggtgttcaataccgtttatataccacagctagggttcttggtgtctcgagaagctgatgtccaaactgctgattccactttcatgcccaatgaatggcaagaagtgtttagaacaagcaccaacatttactacaaaactgacgaggtttggcaattggatgagcagtatggcgatatttacacctcaataaatgatcgtgaaatagaaatcattcagagcatgttggccaaagtatcagaattcaacactgtaatcatccaagtgggagaagcggcagtagaattggattgtttatgcagtctatcagaagtgtcccaatttaggaactattcgtttccttgtataactgataccaatgaattggaaatagttcaaggcagacaccctcttgtggaaacgtttctgaacatgtttgttccaaacgatacaatatttgactcagaagagaaaataatggtcgttacaggagcaaatttatctgggaagtcggtatatcttaatcagactgcgttgatagtagtgatggcacaaattggatgcgcaataccagcagagaatgccactcttggaattgctgataaaatactcactagaattctgtctcgagaatcgttagataaacaacaaagcacttttgcaatcgatgtttatcagctctcaaaatgcatttccttagctacagaccggtcgttggttattgttgatgagtttggaaaaggtagtgatccaattgattctacatcaatgtttggaggtacgctaagctatttcaaaaagaaaagtctagattgtccccgttgcattttttctacccatttcctagatttattcaaagataaggaattttgtaatatgtcccaatcaccaaaaataaaaatgatgtcaactgagaatttgcttgaaaaaactacaaatagtatgctagacaatgttacctatcttttacaaggtgaaacccaggacttgctaccaaagagtttctgggaatatattgtgcaaaactttgttggaatttcagagaaagttatccaaagagcagagtacattgctcaaatgctagataacggagatgacgtggcttatgaattgacaaaattatctgaagaggaagaacaaaactattcagttgcaaaaacagtggttacaaaatttttagaaattgaattggaagacgcggaattgtctataaatgactctatacgctatatggccaaatttgatgaaatatttcaaagctaa

SEQ ID NO: 4620 - DNA, 981 bp, Candida albicans
agatcctataaattgcgatcctttattttggaaaataataacagtgaagaatcattatcgttggcaatttctattcctaaacctcaatctgattcaattgaagaaatattaaatatcttatcaaatgccaattcagaagtatcattggaaagtcgtaacccgttaagaataatcagtggtgctattatgatagataaatttgaatctttgattgaaaatcttaatcaagatttagttaaccataatgaaaatattcttagaatattagttcatttatctattttcattgcaattataaaaccttggggtgatgatcaactggcgaatttgactgctattataacactttatatctcaatgttgtctgaaaccaataaatctgaattaattccagtttatttatcatttattcctgatgaaaaagatgctagagagacttattctatgattctttcatcaataacagataaggaacaacaaacaaggcaattacaagcagcgaaaaaattgactcaacctttcgtgaatatcaatgaaggcaaagataatggggatgttaatgttaatgttaatgataatgttaatgataatgttaatgttgatgttgatgctgatgctgatatggtgatagtggaagatgatgataataataaattgattaatgtattgagaagaactgtggaaagagtgatgatagaaacggcaccgaattatgaacgtcaacaaaatgatcctgtaatagttaaagatgatgaatcttcagttgatgaaattgattttaaattatatcgtgctgttgaatggttttatgaaaatcaaatgtatggagatgccattaatgctactattgtagtgatacgtcgatttttaattaatgggaaattggctagtttgaaaaaatttgctaaagaaaataattttaaacaattgatatctgattatgatatagaaactattgggttgaaaccagaagacgactaa

SEQ ID NO: 4621 - DNA, 1479 bp, Candida albicans
catatagtaaccatgtctcctgactctatttcatcactggtgaaccaggatctatctacacctactccgccaacatcattatcatctactagcacaaatagtaatactaatgcgagttcaggtcaaaaaagaataagagccactggagaagccttggaatttttaatatcggaatttgaaacaaatccaaacccaagtcctgaacgtcgaaaatttataagtgataaagctcaaatgaatgagaaagccgttcgaatttggttccaaaatagaagagcaaaacaaagaaaatttgaaagacaaatgttaagaaaagaaacagattctcctggtaattatgctggcatatataatacgtatacaccaaatccacctactgttacaactgatatgacaaattttaatgtcaatggtagtgctggtggtgctactgccgatttcaatgacaagctcaagaacatatcaagtataccagttgaagtgaatgagaaatattgttttattgattgtcgttcattatcagtaggatcatggcaaagaataaaaactgggtttcatcaaagcaatttgcttacaaataatttgattaatttagctccagtcactttgaaccaagtgatgtctaatgctgatttattaatcatactactgaagaagaatttggaattaaactattttttcctggctataagtaataactcgaggattttattccgtatattttatccattgaatgctgttgtcaaatgttctttgtttgataacaattattatcaaaataataacactaacgggactaacagctctgacgacaacaatattagtgaaattagattaaacttgtgtcaaaaacccaaatttctggtgtattttttcaatggaagtaatacaaacaatcaatggtctatttgtgatgattttagtgagggtcaacaagtgagttgtgcttttgctgccaatgacaacagtctaccgtcaaatggaaaaaaccaatcattttcaaataccatcccacatgttttagtgggcagcactttatcattacaatatttaagtcaattcattttgcaacaccagcaacgtcaacgtcaacaacaacgtcaggctcagccacaaccacaaccacaaccgcacaaccaatttgactttaattcacaaccatttgagactattccaaccagtgcaatcaataataatttcaatactactaaaactgtcaattcatccagcatgcaaggatttgttcccggtgatttccaagatttgccagccatttatgaatcaatctcaaatagtaatcacactaccacaactgatttaaaggataccaacgccaccaccaccaccaccaacaagcatacaccatcatcgactacattcacacctcaaaatttgaatggtagtaaccaatcacaaaccaatgtcacttctaccagtcttcaccacgggagcggcaggaccgcgccaatgttacgccca

SEQ ID NO: 4622 - DNA, 201 bp, Candida albicans
  unsure (167): Identity of nucleotide sequences at the above locations are unknown.
atgtcagactctcaaatttattcagcaacatattcaaatgtccccgtatttgagtttgtcactctggaaggaccaataatgagacgcaaaaaggactcttggataaatgccacacatattttgaagattgctaagtttccaaaggctaaacggacaaggcttttgtnttcaccacgggactgcccgagcgaaaaaagtgag

SEQ ID NO: 4623 - DNA, 555 bp, Candida albicans
accgatgtgtacgaatgcatgatgaacgagtcctcaattatgagaaggtgtaaagatgactgggtcaatgctacacagattttgaaatgttgtaattttcctaaagcaaaacggacgaaaatcttggaaaaaggagtacaacaaggattacatgaaaaagtccaaggtgggtttggacgtttccaaggtacatggattccactagaagatgcccgtaaattggcaaaaacatacggagtcaccgaagaactagccccagtgttgtttttggatttcagcgatcccaatttgattatccctcgaaaagaaaagccagcgtccaaagaaccagcagcagccaaaagaaagtatatgaaaaaggccaaacaagcaggtgaccctccacgaagatacaaaaccgggaaaaaggctgctttacaagcggcagaattattctgctgccgccgccgctgcagcagcagcagcctcaacaggaactggaccgggaaacacactcccaataacgacgtccgcatcaggaattatttcgcaattatctgctacaactcctgctaa

SEQ ID NO: 4624 - DNA, 1461 bp, Candida albicans
tcccaccaatatttcatcaggacaacgacttttcccattgaggaagttcaaaatagctcggactcggattcaaatggcgatgaaaagaaatcaaacagcacttcgttgcgaaataagagttctaatagaaattcaagagttctgccttttgtaaaccagtactcaacccctccattgtcttcagatcacttgaatactgacgaaatatcagcagatactggtgaaagaacagtttacttggacgttatagatactcctccagaatcccaagctgatccacttgccggaaatcaattaaaaccagctcttgacgtgtcaccaggacgaaacaccgagcaaaaatccaagagctttcttattttatcacctaaccaattccacgataatgagtttcataatactagatccccaatgattgattctccaggaacaatcattagtctgaactcgaaccaaaacacgaaagcagtcaacttatcagtagaggataggcctcgttcagcatgcccttctccatttgccaaagttaatagacaggcaagagttgttgaaacgaatgatgaaatcctgacagatggagttgacgaggatttagcaatcggaactccgagacaagaacattcgagggcaggtaccttgaaatcagtgtcttcaccaccaccaaaggtgccattacctagtactccatcgagaggtgaagatatttccaaaaaattcagttttgttgaaacacccaaaggtttgggattggagggcgtggactacgataatcacgaagaccaaagaagttatatcaaactgcaacaagatcaaagacagcatgatattagcgagaagactagcccgtcttcaataatgtctacgcccaaaagggttgtaggcaatttttcacctgcagtaaccaacttggaaccaaagaattccgatttatcaaatgaccaacaacacaaacatctgcaaaagaaccagaatgtttcacgtacagcttcacttatcaagaacttgaaacacaaacgttccacctcaggaaatcaaaataaactagctgcacttttcactacaggcagtaaagaagatcacagaaatggccatacaagacaaacatctgatgggtcactttttagtagtattgccaatgcctacatttcgccaccaataactaatggcgctttagggggacgtaatcatattagactgacctcagactccacagtattgttatcagatgaagaccaccactacagcaatgttgcggttaagaatgatattgagcaattgaatagcagtaaggttttgctagaagaagatgttaagaagttgagagatgaaagacataagctcaatgaacagttgaagatgatacaatctaagatctcttcggaatcgattagatacgacaatttggtagctgaaatttccgagttgcagatacggaagaccaagatcacagaccgagaataa

SEQ ID NO: 4625 - DNA, 2238 bp, Candida albicans
aggagaaacagaaatgccccacctgctccaaaacacaatcatgcatccgctttgaatgtagccaaacgacaagcactgttattgaaaaagcaaaaggaaaagcaagtgcagccaactttgtcagatactagttttggcagcagcacttctgtgccacctaccacggtgccgaaaaagagaggtagaccaaaacgtgccacattgagtgcaactccttccttacaacgttcagacacaactccaataaataaaagtttaattgactttaatgcaaatgatcatagtgccaagagctcatttattggtgtggtaccttcatttgcaagaaacgatacagagcaagatgcgttacagataatgaccaacaatatgaatcttcgacaggaggacctagcatctgtagaaacagacgatgacgaggaatatcataatggtagtagaggtgatggcctccaaaacggttcatttacaacaaaaaggagaaagtaccctggcggaatgactaatggaaatggattagagtcgcaggcagatcttttaacgtcaaaggaattatttggagtttcaagaacatcttttgaaaaacgggcaaatcaacaacataaccactacctgccgttgcagccgtatcatcaaccaagcatatctttatctcaggaaaatcaaatatattcagactactttcaaagcctattgtcatatttcctagatgacaataataaaatacgatcgccgataccagattcattacttagtcctccactacccttgtctaaaatccatatatatcaaacaattgacagtgacgggaatacgattttccactgggcatgctctatggggaatttaaacatggttgagtttttgttgaaaacatttacccactccttaaatccagatgtgagaaataacaatggcgaaacacctttaatgtttatggttaaatttaacaattctttccaattaagaaacttcccactaattctagacttattgaaggaatcagtattgttggtggactccaatggcaaaaccgttttgcatcatatagtggacacggatagcaagcacaaacgggaaaaatttgctcagtactacttagaatcattattggaaaagattgtcgatgagcgacaggaacagggggattccaatggacacgcaatggaagatgacttaacaaaggatgagcttgtcaccaaatttataaaccaccaagattcagatggtaacactgcctttcatattgctgcccacaacttgaacaaaaaatgtattaaagtatttatcaattaccaccgatttattaattttggattaagaaacttggtctcttgtaccgttgaagactatttggcatcacataattacgtactcagattggatcctgtggaacatgatcaaagtaacaatagtgatggtgacgaagacattatggaagattacacaaacgaaaaccaatcatttgagacccaacttcacaattccaaaatggccatcaatttgcaaaataccactgccaacctccttacagaaaaaatgacacaattagcttatgccattgattcagaattgagtgagaaagacgaagtgatattaacgtatttcaaagtgttgagccagattaatcaaatcaaactcgaatcacaaagaaagatattgtcgttttttaaattggatcatttgattgaagaattggaacaaaataaagatgatagtcagcaacagcagcagcaggtaacagatgatgatgatcctacttcagttcatggcaatgatttgcatctagattttaaacgtgatcatattctccaagaagaaatataccggttgatgaacgatttgacatatcaggagttgcatcaacaggatgaattagataaagttgaacatagttatcgaatgacaaaggaaagattacacgaaaaggtgttggacgcttcgtcttttgtaattgatcaaacccaccaacaaggcaataagcacgaacaattagagttagccaagcaactacaagtggaaataatcaaaagaaagaaacttgtggatgagatttctaaattaaccaaaaatgttcctttaccggaaaatccaaatgctaaaaccatcatcgatacgtatccaagtactgataagctatataaatattgcaaattaatttcgttaagctgtggaattccaatggatgaaattgaaacttcgattgatgctatggaagaatcattggtcaaaaaataa

SEQ ID NO: 4626 - DNA, 789 bp, Candida albicans
gccttacatggtagcctgcaccggcgtgttgaaaattttgcttcaagattagcttctttgaacttagtgtcctcgtttattgaattgggattgaattctccaatcagaggtaacaatgcaggcgagtccccattaatctcctgtattcaagtaacaaactctatggaaaaaggtaacttcaccaaaatccttagtaattggttgtatcctgatatttggttgttagacaaaagaaaaagaacagtattccaccatttaactttacaaatagataagaacgatagcttcaggttctacaccaccaagattttggagtatattataagcgataacaatcagaatttactagattttcgtgccaatatacttaacgcacaggatgaagacggtaatacggcattgcatttggctatagaaaaggattcaaaatggtttattaaagttttagtggatttgggggctgatacttctatttctaataaacgtggcacaaagccctccgattttgaaattatcagggacttgggttcaattgaaaacgatgatcaaatatttgacttgatatctaccggattagagtttttaaataaaagattggaaattgggggtgaaaaattaccagaagtagaaagtcccaaggtggtaacaacccccaaattgatagaccaggaaggaagttcgtcctctggaaaaatattcaatagtattcagcaattgctttccaatactaatgttgaatatgaaaaacattttgaactccaaaagagagcagatcaaacaattagatag

SEQ ID NO: 4627 - DNA, 798 bp, Candida albicans
catgtacacatttctgtaatcacaaccatggattactcaggacgagttaactctaaaaagggtgctggtggaatagcaagtaatgaagatatcaacatccagacaaagcaacgagtacaagaattgttatccacccatgttttggatatagacaacgatccttacgttttccgaaaccatttgggtatgctagagtgtaagttgtgccttaccacacatatcaatgaatcttcatatatatcccatttgggtggtagaaagcatcatttaaatttggagcgaagaaggattttggatgagaagcagaataaactgagagagcatcagttgagttctcaaaacattttgagtatcaataacatagaaaaacgatcgtggaaaaagataggtaagcctatttataagattaccaaagttagggatccggaaactttacgtactggaatcctagttaatattaaattgccaaaaattacggtaaaagagcctatgtttagaattatgtcgtactatgaattgacttcgaaaaatcaaaacagttgtcggaactttattgaaaaatataaaagcgatgacgatgatgatgctgaagatgatgatgacagtgatggtggtgatgataacaagtatcagtatcttgttgtgtctgctgaaccatatgataacattgcaattgtgatacctaataaacatgaaattgacaaacctttagaagagaataaaatgtccgacagttactggtggtatcgggataatgatactaaggaattctttctacagttcttatataaactataa

SEQ ID NO: 4628 - DNA, 918 bp, Candida albicans
tccttcggacccccgcgtggtgaagactcgaaatacgtgacagaattgagtctgtttctagaggctacattaataaagttgcaaccgttactagactacaatgccttgttgcaaaattggaaaaaagattatgacaatgctaatgaagaaaggaagtctaatggcaatgacggggacaaattgttttgcaaagcatgtaataaattattttcaaaagaaactgtttaccaatcccatttgtcaggaaagaaacataaaaagaatgcatctcaacaaaacccagacaactttgtgtcttcgttgccttggttggaatatttcattgaaaagttgtgtcaagtgttggccccagaattggaatatactagagcacaagttgagaaattgtcaaacttgtcggaaagagagctacaacttgatcgacaggtgcaacacaatattgaaaatgaattcgttgccatcaacaacgaatttgatgacgatgatttgtctcaaaatgaacatggcgatgacgatgataatgataactatttagatgacagctttaacaatttacctttatgcccagatggaacaccgatcccattttggctatacaagctacaacgactacataaacaatacaattgtgaaatttgcggtaacataagttacaaaggtaaaagtgtgtctatgaaacatttcagtggatctaaacatcaatatggtttgaactgtcttggtgttgatgacaacaatatgaaaatgtttaaaaatattaccaaaattgatgaatctactgaattatggaaagtgttgagaaaggagacccaattgaaagtgactgaattggaaaattcagttgaagtggaggataaagaacgtaatgttatgtcagacaaggattatatatatttgaaaaaacaacggttattatag

SEQ ID NO: 4629 - DNA, 423 bp, Candida albicans
tggtttgtttgtaggatagatagtggaatagcaagttttaataatgttagtgatgtgggttggagggagaaggagacggtggtggcagtttcaacacaaaattcccacaatcttaggaaaaagataacagtgagaaaatttccttacacattaaatttctgtgcttgttttgtttccaatttagccagcatgagtaatttcattgaagtccagaggtctaatattcaagagattggtattatagaagattcattatcaaggagattattaagaaatccttatatattaccgtcaaacttacagccacgaccaaacatccttgtatcaaaagtaacaaaaccaaattcaaccaaaagaatatcgatactacaacaatatgaattacgttattttaaagatcgatataatcaaataataccaccc

SEQ ID NO: 4630 - DNA, 1218 bp, Candida albicans
ggtgcatggaaaaaccaagtgaatccatttaatgattatggtaatccagactcgtttataagggctcaggaacaacaatcacaagtaccacagcttcaacaaccaatatcgcaacaagacatacaacgaccacaatcaccacaacaacaaggtactaaagctcttttaccacaagcttttccaacgaggagaaggagaaagattactttgcttaatgatattggtggttcatcgactagaaagaagcattttgacgaagattatttgttatataacccagatatatctccaggccatattgtaactgattgttctttggattcatctttagtcattccaccaaatagcaacgagttgtttttaacagagtcggaatctccggaatttgctaatgatataattccaggatatgagaatgattacttatttttagatgacgacgatgagcaaattgaagaggatgtgtctgacgatgaaggtgacaattatttccaagttgacgaagattttgacgattatttgatgaacaataacggttatgatgggtatccaacatttaataattatgaaagttctggcaacaatactgatattattaataataataataacattgtcgatgaaaccataagtgatgctaatagtaatagtgaactagaggtagtttttgatcaaccaaaggaagtatcaccttcagccatttcacctgcatctccagattcggatgatatgatgattgatgttgaagacgagactgaaatagccgatgctactgctgctaaagaagagatcaataagaaacattccaaatcaggtaaaaaagaatccaagtcccaaaaagagaatcagttgacgacgacgacaaagtcaaagaaacattctcacggcatatcaggagcagaaataaccctaaataatccaaaccatcaatgtaacttgattaatccgtcaactggtgaaccatgtaacaaacagttttcacgtccctacgatttgatcagacatcaagataccattcatgcatctatgaagaagatttttagatgtgtaatttgtgaaggtagattaaatggtggacctggtaatggtaaagagaaaacattttctagaggtgatgccttatcaagacacatcaaaatcaagcatggtttagttggacaagacgcattagatttaatcaatgaagctaaagagaatgttgaatatattccagtataa

SEQ ID NO: 4631 - DNA, 1560 bp, Candida albicans
  unsure (1504): Identity of nucleotide sequences at the above locations are unknown.
aagatggaatccacattaagtgtatctgatgaaaagcttaccaactcatcaactgcattgaataactgtggtgataataaagaactgtctcaggttcttactacggcaaacaccacaacagataatcaacaagtacaaccaaaactgcaacatcaacaatctgcatcaacagagccattatcgaaagaaagaaccaatattctgctagaaaatgaccttattctagtggatccaaatcaacaactgaagaatacagtctctgattcagtacaggatacgacgggtgttccttcagaccatggcaaacaacagactattggcgaccaaattaaaattcttatatcttcgaacccattaaatattgaggaatattctagtcatttgaaccgattggttactattctatacgaggagaatttcacttctgatttcttagttactttgcattataaaatacttcaactaatggacgaattgccgaaatttgttgatttgcaaaaccccttgaagtcacaactatatacaattatagacaagaactttgatatattaatcaagttggccacgaactataaagtaatggaggtttcaactgcttcaattaggtttttgactacggtatttatgaatttgaattattgggaggtctacaacttgttgaacaagaaaccagttttatatcattttttgaatttgattgaatttgatttgaatgattgctacactcgatttatcaatgattaccaacgattcacctacgataagataactcagccaacagttaaatctaggagcagatccaaagtcaccaagaaaagaaaagtgaagggcgactctgatttagcgggatcaaacactgctaccgccacgacaagtgtgacgacgcctgatgctaatacatctcatgaaggcaagcaacatcgttccgaagcatttttctccctagacccggatacatccgaccatgataaatatgttgctgacgtgatatctggtgcaaatgtacaaaaaagaaagtttagaccagatgtcaaattggagcaccataggataatcaagaaaccacaaccagctgccgacaaattgtccactaaatcatcaaattatgatcctgatgtgatccatgagtgccagttgccatctgcagaagagccccataaattatgtttgagaagattttcaagaaaatacgagttgattagacaccaagaaacagttcattcaaagaagaaaaaattgttcaaatgctttgtttgtgtgaaacagaatcctggtgttggacccagaattttcactcgtcacgatacattggctaaacacattagggtaaatcacaaaatatctggtaaagaggctaaagcagaagttgcatattccaaaaaacatgctgaagtggttgaagaaggagatatcactgttcatgtaggtagaaggaaaacaaaagtcgattttgaattacgagcccatatggagaaaacgatatcaagtggtgatgaaccaaatnatatggaaactagtgaactacagtctggagaagaaagagtaaccttcaataagtag

SEQ ID NO: 4632 - DNA, 1506 bp, Candida albicans
gtgcttctccaatacctgctcctaataatccagcaactcattcgtatccctactatccatattcacaatcctcttatcattatcgacaccaaaccaatgatcaaaccaatatactgtcattgcaaaatccgaaatcaaacactatatcaactatgcagtcgccaaatgagatttttgtttcaggacaacaagctgagttctcttatggggaatccatcccaggagggttcagaaaaacaaagcggtcttgaggaccattcaaacacaaacacttttcatggtttgagtccgattacaaattatcaatcaggagcgggtaatatattaccttcaatagatcgtttgactaacaaatcatcatcacaatctggattcagtgatgttggtcattacccgaaaacgtcatcattcagtaagcctctgagtgttggagcttttggggcaggacataatttgtcagcgggggaacgagataaatatccttaccaaggtatactccattcaaaggattctacgtcaccacagcaacttgagaatactagcgaaaatgtggttaaacatgaaccacaatctattataagtgattctgctcaattcaaagacccaatggaaggctctagcagcaatcttgtggattcttctgatgcacaaaatcatttatctgttgacgataagagcaaaaagcccaaaacaggagttatacatcaatgtcatttaacagatccaaacactttacaagagtgtttaaaaatcttttatggtaaaaacgaacttttgcgccatcaagaatttgttcatgcaacaaagaagaaaatctacaaatgtatatactgtgcaagaattggagccaaagtacagagctatcctcgtcatgattctttggcaagacatatacgaagaaaacatggtattactggaaaggaaaacaaaatggcagtcaactatgccaaagagaatgttgagataattgatcctgatcagttaataactaaacagcatgattttcaagagccagtggtttctgaatcccaggtggtgtttttaccgccaaaagaggtagtgccacaacaacaaaagagtcaataccaacaggaaccgccccagtttgatcaaaaactaccaccattaccacctcagcaacaatacccagatccaattagatttgagaaacctgcaggaatcccccaattcatgtcaaagtttggagaaagtggtacccagttgccctctctacaactgtattcaataggtgtttctcaacgacatccaagtacaacctatccttcaaggtataccacacaaccaccacagccacaagatgtgcataaatataatgatacattaccaactgtatcaccctctgttgggccagggccagggccagtaccagtgaggcaacctctgtcggtcgaaggcaacaacaataacaatagttcatattacaacgtgacaaaccattcacaaagtccctccaacatattagagcaaccgaaaaaaaatcaataa

SEQ ID NO: 4633 - DNA, 480 bp, Candida albicans
aaagttttatacttgggtgctgcttccggtacttctgtttcccacgttgctgatgttgttggtccagaaggtttggtttatgccgttgaattctctcatcgtccaggtagagaattgattggtatggccaaaaagagaccaaatgttattccaatcatagatgatgctagacatccacaaaaatacagaatgttgattggtatggttgactgtgtctttgctgatgttgcccaaccagatcaagctagaattattgcattgaactcccacttgttcttaaaagacggtggtttagttgtcatttccatcaaggctaactgtattgattctactgttgatgccgaaactgtgttcgccagagaagtccaaaaattgagagaagaaagaattaaaccattggaacaattgaccttggaaccttatgaaagagaccattgtattgttgttggtagatacatgagaagcggaataaagaaatag

SEQ ID NO: 4634 - DNA, 297 bp, Candida albicans
aaacattgccccaggtgtatcagtttacgaagaaaaaagatttctgttgaagagcccagccaaagaagaaggtgtgctcccaaccaaattcggataccggtgtgtggaatccattcagatccaagtttgactgccggtattatgagtggtattgatgaattgggtattgctccaggtaaaaagttttatacttgggtgctgcttccggtacttctgtttcccacgttgctgatgttgttggtccagaaggtttggtttatgccgttgaattctctcatcgtccaggtagagaattga

SEQ ID NO: 4635 - DNA, 1557 bp, Candida albicans
agcatacccttcttcgatagcatggatgattacaaacaactaggaccaggaattttttcatgctctaggaaatttccatttttaacaacgcgtctacaacaatatggcaagtcaatcaacgatttacttcagtatgacgaagcttctgaccatgcacaactagcgcgtcttgttgatagaccaatgaaagaaatcaatgattactatagaaatcttaaaaaggatttgcaagtcgatcctacgtcagtgaatagcttattggattcggagtttattagcacgggtctaccaagtattgatcgagaactaggtgggggtattccaattggagaagtaacagaaatatttggtgctagtggctgtgggaaatcacattttctatttcaactactatccaattgtggtaaagaattcccaactagcaaaaacatatatatatcgactgaatcatttttagaaaccaagagattaaaagatttcataggaagaaactcgtctaatattgacactgatttggatcggatatcttatatatattgtcaagatttggaaagtcaagatcatattctatttacccaattgccattgaaattggattcagacaaggggaagacaaaattattagtgttagattctattgcacaacatttccggagagaagattctattatgaactcgacgtatttaaaagaaaaattagaagtgcaggaaggagagatagcagacgatagactgttccaagaagtgaaaaggaaacaaatgaatcaattgcgaagatttaacaagtcacagaaatatgcttcgcgaacagccaagttgtattatatctgtcaattatatcaacacttgtctagattagcccaagactttaacattgctattgtgatagtaaaccaggttagtgattattcttttgaatcatctggatcattcactgaggcagaggcgggagaacttgattatccattgaatttggatttccaaactgccgtgtcttctggatgggatagtaggaccatatacaatagtattcctacggctaatataactttgaaaaacgaggaaatcgagaatttggaaatggagttggcaaagtcgcttgaagagagaagtcctaataaacgtcaaaaactctccaataccagctccccacaaaagcaggaacacaacttgaatcctcgtgaaaggttagaaagacagaaatctttaatttccaaatcgcatgagatgaggaatagaggttcaaaaaagattgtccctacattaggttacccatgggcaacaaggatcaaaaatcgaatcatgttatccaaggtgtacaagcctatattgaagtcgaatatggatggtgacattgtgaatgatgaccaatctttacagactaatagtatacacgacaaaaggtctagtgcagaactatataaactgtttgtttccattgatggctggcaagttgaaaggtttgcaaaagtggttacatctacgcatggctacaatcctaatagatttaaaagatacagatttataataaattcacaagggttagcagaagtataa

SEQ ID NO: 4636 - DNA, 1917 bp, Candida albicans
aaactacgcggtgccgctactcgtagtgaagatcatcgtcatcataaccaacaacaacagcagcagcaacataatcacaaccaagatcaaaaccagaatattttcaatactaattcaacttttgcatcttcacattcatcagtaaacaatacttcattcatgtctaatactgctgctagttcgagttccaataccattccatcccttccgccaatcaaccttcaatcgttaaaagaaattgatttgcacgaaatattgaagaacccacaactaagacacgatattttatttgatccacaattacaatttagacctaatttggatggtgaacgcggcaaacggaagaaatctattattgataaatattggttagaagtgcggaaagaatgtcaaggatttttcaaccaaaaagtaaaacctgaagaaataaaaatccatcggttacctatattatttactacattaagagatattttattgtcgttattgccaactaaagatcgtcaacaagtgagtgaaattatggatattgaattattggtacaacaattgaaacatggatcatttgattttgtagaaatgagtcaatggttaggtgatgttttcaaactgcattgtgcaccaatgagagatcaatgggtggtggaaatgattgaaaaatttgttgatgcttataattacaataatgtttcatatttggttaatggattgagaatgattttccaaattttggaagcaatgaaattagatgttgccaatcatcaaattcgaattttgcgtccagttttaattgaaactgcagtagattttgaaagagattattttcaaactttaatcaatcattcaaaaataaacattcacgattcattaaattggttttataagaattttgtcaagaaatttgatagtatccaacaacaacaacaaccatctggaggtgccattgaaagtcctgctaagaaattatccaccttacaccaagatgctattaataacaccaatttgaaaccaataataatatcatcagttattgatttattgagttgtcgacaaatggctagtgaatttccttcaacattagctttcgatcatacgagattggtattattgagagctgatgcccgtcaattagtttgtattcaattatgtgtggtattgtataaacaattggtgattaatgccaaagtctcaaccaatttattatctgcaaaaaatattgccaaagttcaacaagaaattttagcaattgttactgatgataatgggaatatcaaatggacgaaaaatatatcggctatttcattacaattggtgaagaatttatatcctaatgaatcaaatattaatgtatcagatccatcaatcaaaagcttagtacaatttagtcataattggttaatgaaacatatgcaaccaaattctcaagtttatggcttgatggaaattaaagttttcaaagaattattagcagagatttcagtacttgttgaaaatgacgatttaataagtgacaacagtaacatcaccatcaatagtaatgtgactagtactactactaccgccaatgtaactacaaacactagcactagtactaccactagcacaacttcaaatagtaatgaattgaagaatattgctacaagaatagctacattggttaagtttcattggaatgtttttggtggttattacattgattatatcaaatctcaacgatcaaaattacaacaagaacaagacaattctacaatgttaccaaccatgatggaagatggtgatgacagtaatgatgttagttcgaagaagaaaaatgatgataataaagccaataatactaatccaacatctcatcgtggtggtgaaaataattcaaacattgataatactacttcagccccattaagtatgttatcatga

SEQ ID NO: 4637 - DNA, 756 bp, Candida albicans
  unsure (37): Identity of nucleotide sequences at the above locations are unknown.
ataactcaatgcggatcgtccggtccccaggctgaanacgttgtgcgttcttcagaacaaatcagtcacgatcaaaaccaagaagatggtaatgtttctggggacgttgaatccaaaggtgaaagacacatacattttaatgacgaagtgatgcaatgtattgccattgatgtgtattcagatgatgagcaacgatatgattctgatgaagaagattatgattctgatgatgacgatgatgattattatgatcaatatgaaccatctaatgacagtctagctcaaagtcacctatatgaaggagacgatgaatccattgaggaagcggatgaagaggtagaggatgatgaagatggatctgaagatgaagaagacgatgaagggggattctttttaaatgtgaaatccaattccaatgccccaataattttgggccagcattcaagtgcatcaacttctactccagtggcaccatctttaagtcgtcacacagatattactgatgatacagcatcaatatctaccaccaacagtagatcttataaaacaattcaattattaccttcaacatctattaattatggttctgatgaatctagtgatgaggcaaacccttatacgtcgagtctttctcataatgtccataatgatattagtagacgttatgattattattatgattacaacaccgtatacacctgttatcccaacaattcagggtttgcctccttatcaaagtccagaatgttgtggaag

SEQ ID NO: 4638 - DNA, 621 bp, Candida albicans
cttcaacttataatgtattgttacgatgatatgatgatggagacttctccatcaacaacagcaacccttcaatttcacaacaatattgattatttacaatatataccttcttcaaccacaactgcctcctccaataacgatctacattatttgcaggacaatttaatgttgacaactttccataaatttttaaaatcaaatcctcaatataagtatcatgatgaattattatttcatcgattattaaatatatgttggcgaagcatctataaaaatcataataatttaagagtatataatcctttagaaattaattcggataaaaattccgatattacttggttacacggtccacaattagaattgattgaaaaagaaaaggaaactatacccagaagttgtgatttcgaaatggaagttgataatattagtaattctagtactagtgttaattctactgatgaagataatgatgttggtagattagatttatttcatgatgatttagataatagttctatatcttcaattgaatcctattgttcaacattagaagaagaagaagaagagaaagaagatcatgacaatgtcttcaccacggggctgccaggatccgcgcta

SEQ ID NO: 4639 - DNA, 1188 bp, Candida albicans
cttccaccttatcggccactcggcgtgaagacaagtgaaaaatcggaaattgaaatagttgaaaaaacggacaacaaaaacatagctgttcatgatgatattgataccagttataaaactaaaattaacgccactagattagaaggtccatctgaggataaagatgatttgaacgggaatgataaacaagaaaaaacgggtgatcaagacgaacaagaacaagagaatgatgatgaacaacaacgaccagaagtcgacaacgatgtcatcaatttgagtgaaccggttagaaagaccgataaggattcagacaataaaaaagtatccgaaatcgacaataatgaaaatgtagctaaccaaatatctacagtgaatcaaccttcaaatctgcaaggtgttttgtcaacgaacgaacagaatgagatgagtgagaatattaaaatcaccacttttgaacctattctcgaatctgctgaacctctgacaattgaaaataaacatataatattagacgaacctgtggtattggaatcatctcaagagaacaataacaattcaattttcagctctcatgatattaaatcatctcctcaaaacacatgtacggctgataccttagaaatgaacaaattattttgtcatcaagaacatgatgaggaagaggacaaatgcgatcatcaagataatcatgggaagaatttctatcctgtcaaacataaattggatgatagtgaagaagaaaatatgacagtgattagtattggggatgaaacatttcaacagtatgatgaaagacgtccaagtaagagacttaaacgagatatgcttcgtaatatgtacaataaaaaaattgtcaattcttcacaggatattctcagttcgataaataaaaacttgcaatctccccaaaatcaaagcgagtctatcgttattaaaaaagaaccagacgaggttaaaccaaactcagttgaagacttgcagaccaatcaacaacagcaatatgaagaagttgaaagttatcaaattaacaaacaagattttttaaaaatgaagctaattggacaattcaatctaggatttatcatagtcgattttgatgacaataataatctctttattatagatcaacatgcatcagatgagaaatataattttgaaaagttaatggcaagtttcaaaataaactat

SEQ ID NO: 4640 - DNA, 1953 bp, Candida albicans
gatcgcggatcttccagggccgtgggtcaagataatacagctcctactcataagactagtgtggccaaattacaaagcttgttgaaaactcccaattcttcatcttctgctagtttgaaagatttgatgaaagatgaagccgttgttgtgccttcttcagaacaaatcagtcacgatcaaaaccaagaagatggtaatgtttctggggacgttgaatccaaaggtgaaagacacatacatttcaatgacgaagtgatgcaatgtattgccattgatgtgtattcagatgatgagcaacgatataattctgatgaagaagattatgattctgatgatgacgatgatgattattatgatcaatatgaaccatctaatgacagtctagctcaaagtcacctatatgaaggagacgatgaatccattgaggaagcggatgaagaggtagaggatgatgaagatgaagaagacgatgaagggggattctttttaaatgtgaaatccaattccaatgccccaataattttgggccagcattcaagtgcatcaacttctactccagtggcaccatctttaagtcgtcacacagatattactgatgatacagcatcaatatctaccaccaacagtaaatcttataaaacaattcaattattaccttcaacatctattaattatggttctgatgaatctagtgatgaggcaaacccttatacgtcgagtctttctcataatgtcaataatgatattagtagaggttatgattattattatgattacaacactgtatacacatgtaatccaaacaattcagtgtatgcatcttatcaaagtccagatgttgttgatgttccagaaaatcttgatatgggatccaattttgattatgaatttattgaaaataacgatagtatccctgtagtagatacaacatttgagaataatagtaccattaataatatgccaattctgtatagtctgccgtcatcacctttatcagttgctatttccggtggaggtaaaaattctggtgtcactgttaattccccaaatttccccatagttaatgtcaactctaacccacaacaacaacaacaatcacaagcaaaaccaaagccaaagacaaaggcatctcctttccaattgagtgattcagaagatgattcaaatagtgattcggatgatgatggtatttcaggattatcaataggtacaagaagatctagtcaagctttagctgaactggtatttcaatcatcattgacaagttctacacaagaaacagcaccacaacatttccccgatgctaaagagattgaaccggttgctgaacatgtttcgagtattaacccacgatattcttcgacttcgatttctaagcaacctacaagttcaagttcactttcacaactgtttttcggaggtgctggtgggttaagtagtactgataaagagttgtcgaaactgtttttaggaggatcaacgtcagcatcaacatcaacatcgcatgatgagaagactactactattgattcttcaagtactgggtttttccaagtaccaaatagagattatactccttctccagataataatactttgactcgtacattatctaatacatccaagaaatcttcaccattaccaccacaaacaacttcagagaatgcattcagaggtgatggacaacaatcacaatcacaatcacaatcacaatcacagttgccactgcaacaacaactgcaaccacgacggggattattatttgatgaagaagattctgaagattctgaacatgaaggaatggttattggtggtaaaagagaagataagatattacatggaccacgatataatgcattatgtcaagtcgcaggtagaaatggtatccatagtccaagtccaccatttggtaatgctagtgcacatcttcaatatctagattcaagtcttgat

SEQ ID NO: 4641 - DNA, 222 bp, Candida albicans
tccccccttttttttatcatgtcgttatcaggagaagtgttttcaggaggagcaaccacttctcaacatatcgaggcacaagatgatgaccattttgaaaatacaacctttaaattgaaaagaactagatccatgggtttattagatgaatttatccctgataaactaaaagaacaagatggtaataattcagaagcaaattcatcaacaaccagctcatga

SEQ ID NO: 4642 - DNA, 807 bp, Candida albicans
aatccccgttgttttatatttatatttattaatccccctttttttatcatgtcgttatcaggagaagtgttttcaggaggagcaaccacttctcaacatatcgaggctcaagatgatgaccattttgaaaatacaacctttaaattgaaaagaactagatccatgggtttattagatgaatttatccctgataaactaaaagaacaagatggtaataattcagaagcaaattcatcaacaacagctgcatcaacaaccagctcaagaaacttggcagctatggcagctatagcatcacaaacaaattcgtcatatgttaacgaaactccaagcagtcaacatcatgaaactatagaatccatatctaataactccgatggcgatgtaacccattcatcagatgtagcgccatcatctacatcacctgtcaattcaccttcaccaacttcctcaccagcattagatttaaaatctccagaattgttgcctcatgatgatacagatttagctgttgaaccttcacgtcatgttgattatttatcccaccaatgggatgtttctgatatttggaagtcttggcgatacgttatttccaaaagaaaagatgttgctaatgctgcaagattggaaaatgcttcatggagaacttgggctcaaagacgctctaatctcaagactataagtccagaagtggtgaattggtcgaaagatagtgatgtcacttggctttatggaccaatattaaaagatgatgaccatgtgaataatgaaaatcacgactctgatgctattgaaactactgctact

SEQ ID NO: 4643 - DNA, 216 bp, Candida albicans
  unsure (170): Identity of nucleotide sequences at the above locations are unknown.
gatccatatccaatagtcatggcaaagaagaaactaaattcaacaataaagcgcagccggacacgttctggttgcgttacctgtcgagatagacatataaaatgcgatgaacaacaacctgtttgcaaaaactgtcaaaaatcaaatcggaaatgttatcgaagaataanggtaaactttacacaatatactttttacaaccctgatgataataag

SEQ ID NO: 4644 - DNA, 948 bp, Candida albicans
attttgcaagttttgagaatcttgttacaatacctgttgggttcaccttatttattaacagcgatattagcaaccagtgctactttccaatttattgaaactagacaaatgatacataaggatcaccagtttaaatataccaatataagtctcaaatacctaagtgaggcatttcctcaagaatcaaataaagatattcataattccaataattcgggcaccactgataatgcaaattttaaaatgatgactaaagatgttgagaaattgttattgactatattagttctaacattgaatttcactgccttggcatatttccaaagtaataaccgagatggttcaacaggaataagcagtgttaacaaaaataattggaaaattcatctacgaggagtgaaagatttgttgttgaaatattcaaaattagcacacagtaataatcaacaatatattactgatggattagcattagctaaaacgtggttttttgcaattgaatcagtggccgagttgaatgaccctttgggcggaaccattaaatattcaacgaaaaacatttctagtcatgttgatattatcaagacaaatcaaaatgtacttgattgttccgatctgagtagattatgggtcgaaactggttatttcaatagagggaaaaatcaagattatcatgatgctctttatcgtattggaatggtgaccaatcccaatttgcctattagtactcaatttaatatgtttcttggattctctattgatgttgtcaaattgattgatgaaatgactaaactgttggatttattgcgcgaaaataaaccaggacaattatcaggaactagtatagccaatattttcacgcttattagtcgagctaggaataatgatattgtccccaaagtaaacaaagaaacatttgttatccccaaagaaagtattggacatcca

SEQ ID NO: 4645 - DNA, 696 bp, Candida albicans
agaaaattcttttttatttctttctctctttctttctttcttaactttcgtgataacattataaaacagtgtttgatttgccaaaaaaaaatggaggaaaagaagaaaatccgtcgaagtcgtaacggatgccatacttgcaaaagatcaaagattaaatgtgatgaaaacaaacctacatgttcatactgttctaaaaccaaagcaatatgtgattattcgctcaaattgacttggggcggtcggccctttaaagatgccaataaaagaaaacaactaccttcggtaaaaaaagaggttcaaccaatgttgaatgatttccctgttatgacatctacatcactaagtacatcaattaccaacaactccaatacaaaaggagataccggattaacgtttattttacatgaatttaacacagagtcaataaaatctccactgtcaccttctgaatcagtttcttcacacattgacccacccgcaccccacagaaacggaaaacgaaaaatcatagaaattgatagtatcgctgacctggaaataaagaaaagagacacccatatgacattaaccgacataaccccagaattgaacaatggtattgagaatttaacaaatgcattaatagactttggtggccaacagtttcaattgctaaacttcttcaccacgccgtggaaggaccgaattgctaca

SEQ ID NO: 4646 - DNA, 873 bp, Candida albicans
gttttagctggtataagttcgcaaaaggggggtacgttgcaaactgaacaagaaattgacgaattaatcaattctggggatgaatatgaacaacaagtattgaaagaattaggaattatccttgataatgggtttaatattatgggaggttatcaacatgaatgctataactattttgggaaactaataaaaattttgaatcaagatagaaatgggaaattaaatcctcaagaatcatttgagtatataaaactatttgttgatcttgaacgtcagaggaatcttcaattcgttgataaacgaggaagttgggttacttccagcaatagtgaagacaacaataatgatgttacagatgaaaagcatattaattcactattggttgaaagagttccaactactgacaacaagtctcaagtaatatcctggatggatgtatcccatcaagcttatactatggcgttaatgattacagttcttgaaaaatgttttggtgagaattattccaatcctcaaattcaattactaagtgattccataattcaatttgttgactatttatatcatcatgatgtacagaatctgttaccaaaacataaaattgaaagtgcattaatgatgttacaatggccgcttcttgttgcaggaagaaatattgcaagcaacggtactgctgataataacggtaacactcccgaaacaattcaacacaagaaggatgtcgttataaaattctttgaagctctgtctaaagtaggttctggaggtgcattgatcgcctctaaaattattcagaaaatttggaataaaagagataatatcgaagaaagcgataacgatgacaacgagaacgaggatttgttatcatactaa

SEQ ID NO: 4647 - DNA, 1917 bp, Candida albicans
ctttcaaatataatttactatactgttccaaagatgatggatatttatcagaaggctctcaagaaccctgatcctcccaaaaaacctgcatcaacaactactactccgccttcatctactagcactgattataacactcgtctcccacccatgaaccataataacaataatgttgatagcatgaattacaactactcccatgacaatggtctgttcactggatccactactactaccaccaacattagcaacgagaatagcaataataatagcagcactaatagccccaatagcagaccatcatctactaataccaataccaatgcgcatacctcagaagaaatcaaaaataatgtcattagaaagaagaaaaactcaaggcgaaagcatcgtaattcccatttgggttgtggaacttgtaagaaacgaagaatcaaatgtgatgaaactttacctgcttgtttaaattgtttaaagggaaaattgcattgtgcttatttaaacttggataataatgctataaatgcccttagagtcgcccaatacaatcagactattcgtcaagaaaaattggatgccaatagttcatcatcaacaacagcaaatattaacaacaatacaaagctaattgatccttcgaaagacaatatcttggtgcaacaacagcagccagtaggcattgtccaatctcttgcacatggtatatcaattgttcctcctcatccatcgacagctgctgctgctggatctcaaaacgccccaatgatggctactggtccaggctcttatccaatggcagctactgttttaccaaataatcaaactcttgttactgcagtaccacaacagctgcaggctagtatgtcaataccaccatttgctaattcaatacttgcaccagggattcaagctaatccatccccctcaattaccactaataatttaaattcctcaatcgctaacacaacttctaacactaacaataatactaatgccgacatgacttcttctggttctacttctggaaatattcaaaatattgccctgactccacaagttgtccaatcaccatatggaccaatgatcccattgttaacccaatcagggtcagtggtttatgctccaactcattcattggttccagcacagccatcacaactaccacctcagcaattacagaataatgtagcatttagtaataccactgtccctgcaactggtacattaccaccaccaatgagtcaaccttcggttttgtcaacagcaaatacagcagctacgacttctcctaatattcctccattagctgcacctccacccactacgggagtagcaggaacagcatcaacaggtatcatggctaatgtgtcacctgtattaacaaataaacaacaaccttcatcaactccaatcacctcatcagcagctagtgtagcaactatagcgtctcaaactatccctgtcaaaactggtaatggtacttcatcaactgcttcgacatcatcaccaactacagcaacagtgtcaccaccaggtattgccaatatcttaccaccaccaataaacactcttggaaatagctctaatggagctaacagttctgggactgatgtatttaagccaaatgtatctgattcatcaattaaagaattgaaaccaattaatgattcaaatggtaacacgccaccatcgacaacaacctcagcaattggaaattatggtgatggtgttaaactctcaccaaattcctcaatgactaatttaaagaaattaacaattagagaagataataatagcggtagtgatattaaattaccaagtatcaccacattgaaacgagaatcatcgaagtcaccatctgaaactaatggatatgttgatgaaaaagtacctaccatttccaaattgatcacttga

SEQ ID NO: 4648 - DNA, 1863 bp, Candida albicans
cgtaatataggttgcccaaattgcaaaagcaaaagaataaagtgcacagaagagctaccttcttgctataactgtatcaaaaagaactatagatgtggctatttagattttcctgaacataaactacagataattagaaataagaataataagcgtttattacaggagcaaagattattggaaatggtcacaccaggaattccacaacaaatattacagccattaccaccattaccacaacagttacaaccaccaccaccaatagcagcagcagcagtagtacaaccaccaatactgtcattgataccaccattacagccaccattacagcagcagttgcagccaccagccccaccattcctatcaatgccacgcccctaccataatattactgaacaacactcgttgcaaagtaacaatgatgtttttaatcacgacaatcctacgtcttacagtcatactcctgtacctttgcatttgaacgaccaggctcagcttatagaaaataacaccggtttttcaatgccagcggcgacactgggtcctcaatatcatagtaactcagcatcattatattcatcgcctttgtcaacaactccaaattgtagcaatgagctaataccaaattttcaacctccaacaataccgaatgaagaaaactcaataacacctcccaacatctttgaagctgtctccaatgacaaaatcgattattccattgaagttccaggctcaaaatcagatttgaaaatcgctctttacaaagattcagtaagaaaaatatcccttgcacgtaatgatttgcagttaccatcttattcttcagactccccgatttacgataaacagactccaaagaacgaagattatctagtcgatctgcaacagcaacaacaaaactgtgttagtcaccagagtccttcacaacactctaaaagcaaccacaaccatcagcaccaacaccatcgtgataataatcaaaattcattgcagtacaataacaatactccaattgaccgactttctgaatttgatactggctatgaatctcaatctagtgatggttttgggaacacaaggcacatttttgctgaacactttggtatagtaattaccaacgacgatcatggaattggtagaaataataatatagtccataaccgcagtatgggagacacgatttcaggaaatgtcggtaagccattacctaatgctagaaatagccctatttcaatcaatttgttaaaccctactgaacattgtggaatactgttaaatcaacaacatcaagcattcgagaataaaatgttagtacctaccatcaattggactctggcagacaataaactgctctggaacagcatgttcaatggtgcagtgagctcccgttattcctttttttcattctttatggatcgttcattgaatgttattttgaaagcatgcattaaggccattaattcaggaagtaacgaaacttgttttaaccaacatgttcaagacatattactcaaaaaatcgtacatttattacgggacattaatcaaagacttgagagaatcaatggcaaatgattcgatagaaaatagcacaatattgctgtggtttgcaaattggtcattattcatacatagaagcagcactttgaaggcagaaaacttaattttaacaggttcagcatcattattatggaactgcttaaaccaataccaatcgacaactcaacttaaccctacattgtcattcataatccattcaatcaaatggcacacgctagcatgtactacccctgattataaattcaatgttattgaagagctttttgatgatttcaaacatttcaaaagattcattctcttcaat

SEQ ID NO: 4649 - DNA, 579 bp, Candida albicans
ctagaacgagttaacttagtttaccagaggatttacattcctgaatccagaaagaggcccatactattatcatatccccatatctttattagtttatctatggcgtcaaatatttcacaagatagatcatcaccttctgttgctttcgtgtctcaaaaaaggatatattccaaacacggatgtaaggaatgtaaaagaaggaagattaaatgcgacgaaggcaagccatcttgttggcaatgtatccgattaagaaaagattgttcctatcctaaacctggggagaaggtcttaagaatactgagaaagaagcaacgagagcaattgataagacaagaagaggcacaaaatcacctgttacttctacaacaacaatatcgatttgaacaacctcatagcataattacaacacatgcaccatcaatatcatctaactcatcgcaagacagttatcgtgacactagatcaccaaatccaatagctaacctggccccgatgtatcaacaacagcatctcccacaaaaccattaccaacctcaatttcaaccgccgccgccaccaccacagcaacaacaataa

SEQ ID NO: 4650 - DNA, 2145 bp, Candida albicans
gacgtcggatattccagcccggtgggtcaagaagtaccaccaccaccaccagcacagcagctactgccgtcacatcaacaatatcaaatggcacctccttctatttcctactatcccaatcccccgtcatatatgcaatatcctgcgcatataattcaagcaggcccacccacattacctcagaatgttgttccaaatcatcctaaccctcctcctccaccgcctccccctcctattgtaccacagcagccaccacaaccatacccacaaaataaccactcagttgttttgcctccgcctcaagcagctaaattaccaatagctcctcttccggatcacttaaataaaaggctccaaaatcccgcagctgctccttctttgaaagctagaaatagcagaaatgacagcacgaattcgatccctaatttgttgaatgatacaaatgtgttgtctgatagtaatacaatcagtggtgctgggaatactccacaaactccacctcaacagaattcaaataataacattcatattgaacatagccaattttctaatgacgatatcgtggagtattataatcaaaatgatttggaggtattagctaccgatttgaataatattgttagtgaaatcatgtttgattttaattttgttaaagataaaaacccacctttagagtcagaagatggttcactaaggacagcaacatcaactaatgggagcccacctcctttggaaacagctccttcaagccatcataatgttcctatagacttcattcatttcaaaaaggaatccgatagaacatattttgaaacattctacaatgaatttgcacaaattatactaccattcccaagttttgacaaacataacaagtgttatttcaatccagcaagagacataattcttaggagtgctgctaaagtaaaatatttattagcagcggtattggcaaatggggcccgacaacagtttaataaaacaaagagcgaagaagatgaacaagcttattgcttttacttgtcgagatgtttagagttattgggaccagcgatagccaatgatgataaagaattggcatcaaacattgagaatgttttattgacagtattgttattgacagcaggtaatgcatcaaatttgagacaagattggcggtctcatctcaaaggtgcaaaggatttattagttaagaattcaccaaagagtactaccaaaagaaagcattctaaagtgtttatattttgcaaaatttggtttgtcactattgaagttttagctggtataagttcccaaaaggggggtacgttgcaaactgaacaagaaattgacgaattaatcaattctggggatgaatatgaacaacaagtattgaaagaattaggaattatccttgataatgggtttaatattatgggaggttatcaacatgaatgctataactattttgggaaattaataaaaattttgaatcaagatagaaatgggaaattaaatcctcaagaatcatttgagtatataaaactattcgttgatcttgaacgtcagaggaatctccaattcgttgataaacgaggaagttgggttacttccagcaatagtgaagacaacaataatgatgctatagatgaaaagcatattaattcactattggttgaaagagttccaactactgacaacaagtctcaagtaatatcctggatggatgtatcccatcaagcttatactatggcgttaatgattacagttcttgaaaaatgttttcgtgagaattattccaatcctcaaattcaattactaagtgattccataattcaatttgttgactatttatatcatcatgatgtacagaatctgttgccaaaacataaaattgaaagtgcattaatgatgttacaatggccgcttcttgttgcaggaagaaatattgcaagcaacggtactgctgataataacggtaacactcccgaaacaattcaacacaagaaggatgtcgttataaaattctttgaagctctgtctaaagtaggttctggaggtgcattgatcgcctctaaaattattcagaaaatttggaataaaagagataatatcgaagaaagcgataacgatgacaacgagaacgaggatttgttatcatactaa

SEQ ID NO: 4651 - DNA, 726 bp, Candida albicans
tttccctgtagttgtcaaattcatattcaccagcaccaagatatcatcatgtctacttccaagagagcttatagtcgaggtggctgtaaagaatgcaaaagaaggaaaatccgatgtcctgaagataaaccatcctgtgcaacttgtgttagattagggaaagtttgctcgtatcctttgccaggagaacgagttccccgtgtttccatcagagcattagccaataaggaaatcccacttaatgattcaccagaacccaaagcaaaaaaatctaatcccaaaccactaacgattcaaatgtacctggttgatgattttggggctaaaaagaaaaagcggagactaagattggatgatgattatttgaccaacaactttaatactgaaactaattcgcctatatccggaaacaataatggatatttatcaaattccaaatcagcaaataataataacaataatggatcaaatactactgataatttaatgcaacaaataaactcgcaaatgatccctcccattaagcctgcacttagtattacacaagccctggaaagtatgctaagcactacatcgagttcttcattgcttggtggtctatataatgatgacgatttgaacctacttgcatctgacttgaataatatcgttaatgacattatgtttacttccaatatgccaaacaccaatgatagtttgattgatgacaacttctttagtccgttc

SEQ ID NO: 4652 - DNA, 1197 bp, Candida albicans
ttttatgctgccaaggaaccatttttattatcagcaatattatctcaaggggctaaactttctttccaaaaaacatcaaaacagtccgaccatgacaattatgggtcatatttatctagatgtttaagattattgggtcccgcattaagtaaaaatcgtgataaactggtcaaagatgatttaacgtcaaatattgagagtatacttataaccgtactactattaacatcttccaatgccatgacagaaaagttgagttggagaccacatttgaaaggtgcaaaagatattattataaaggcaacacatagtaaaattcgactgtccaaaactttaatattatgcaagatatggtttgctgattttgaaattttggcaggcactagtagtcatttgggtggcacgataaaaaccgattgtgatttagattcagtgataaattttgaagatgaatttgttaaatctgtattggaacaatttggattacttcaaggtgggagtttcaatatcatgagtggatataatatacaaatgatttatttattccgggatttatccaaacttttaaaccgcaaacgagaaatgggggaacaatttgtccccaatcaatcccttgagtatattcgtttaatttcgggattttatgaacattatgggaaagtgtatatcgatagaaaatgtctattaccaggaccaatttccaccccactaacagagttatataatcttgtcgattccgtgcccacaacaagtgggaacacactttatattagctggatggatatttctcaacaagcgtatgctttagctggtttaataactgtgtttacttcaatattattagatcctcctgatttaccacatattcaagatttaaattccaaactagttgatttgataaagtttgtcgaacaaagtgtgaactcttttacaatgaaattcccaaatggatttctgatgattcaatggcccattacggttgcaggaataaattgtactatcaagagtcaacagccagtgattgagaaatttttcaaaatatgtattgagttaggatcagtcagtgctgaaatcactttgaaacggataaagaaaatatgggaattgcgtgaaaagggtgaggagtattatgatcttcatattaagcatgaaaatggtgaaattgacggaattcatatcgataatgttgcctactaa

SEQ ID NO: 4653 - DNA, 2070 bp, Candida albicans
gaaaacagaattgtttatttgtttttgttttacttggctaaagctttgttctgctttgttttgttttgtttgttgttcctgagttccatactttttggtcttattcttctacttctcattgttaacacaattctcttttttctttatctctttactgtctcaatctatatcagcctttttgttttgattatccacatcacagcgttgcattttttttttcatcacatctcaatcaaccaactatcatcccaaccactacaactattcataaaccaagtactgacttcgtcatgtcacaatcaccatcttctttatcacctgctaccgcgtcttctctcgggtgttaattctccactggatcaacctccacttcctccgagagttcgtaaaagttatagccgcaatggatgtcgagaatgtaaacgaaggaaaatccgatgtcctgaagagaaaccatattgttccacgtgtgttcgactaggcaaacaatgttcttatccattagctggtgaaaaagtacttcgaatatcaagacgattgattaaagaagaaattgaaaatatgggtaaatcaactcaatttttaccagtacaatatgatatcccaaggagaataaaaccacaaactcaatcagtgattaagccatcaccattaaacattgaaaatttaatcaatagtaatgatttcttaaatggtgctgatttgaatgttttaactgccgatttgaataatttagtttccgatattatagaagtatctaatatccccatattagaagaagatttccaatttgatttcctaaatgaacctataatagtcgaacaaatcacgaaaaatgtccccattgactatattaaattaccacggaaacatgaacaattatattgggaagaattttataataattttgcccagattatagaaccatttcaagcatatgatacgaaaacgaagaaaacttcaaatccagcaagagatataattttacaaacagcagctactgaaccattcttattggcagcaatattagcagaaggtgctaatacttgttatcttaaatataaacgtcccgaagatgaacgagcatatggggcatatttatctaaatgtctaaaattattagaaccggcaagagaaactgatattaatgctaatattgaagcagttcttttaactttattgttattgacggctgctactgctacttcacaaactcaaaaatggcgacctcatttaatgggggctaaaagcttattattaaaagccatcaatcaaaatgtttctaagaaatttgtattttgtaaatattggtttgtttcaattgaaatattagctggattgagtaccaatttaggtggaactttacaaaccgatgccgaaattgatcaattggttactcctgggaatgaatttgagattgaagtgttgagagacttgggtattattagtgatcaaggattcaatatattgatggggtacgataatacatgtcttgcttgtttccgagatttacttaaaattttgaataaaaaaagattgaatatgtacattgataccatgagttacgtcaaattgctttcagatttctataatcaagcaaacattgtatatattgattcacgaggagtgattgctgaaaatgaattgacaagatacgtgcctggattaccaattgaagaactaagaataaataatgctagttattggattagttggcaagatatttctcatcaatcttatgtattatcgtcattaatcatgattttaacaagatttttcgtcattgatgtttctgggttagttgataaagtcatacaatttatacattatctcaatcagttttctgatgtacaacaacatgcttctccatatttgttattaatgattcaatggccattattggtgacggggttaagtaccacgaaacttgaacaaagacatttattactcaaatatttctccatggtggggcaaattggtgctgctgctgctaatgtttctatacaaatcttactaaaacattggaaagggacaattgatattgaaaatgatgatacattgatatactaa

SEQ ID NO: 4654 - DNA, 786 bp, Candida albicans
agacggcccatttatccgccacagcagccaaattttccatatcataacaattttgtatcaccacctacatatacaactgcatatccacaatattactaccagccagtgatgacaccaccacatcatcaaccgcatcagcaagcaccaattcatcttgccaataatgtttcaattctacaatcccaagcagtaatgcaaaatgcttatcctactacacactatttacaacacgttggccctcatcacatttacgccaatgtcaattctcaagtatattaccaagacatggccagagaagaggcaaacaaagcccttattaataagcgacgtattattaaacgtcgtacaagaactggctgtcttacttgcagaaagaggcgcataaaatgtgatgagcggaaaccaacgtgtttcaattgtgaaaggagcaaaaaatcatgtcttgggtatcaagatttactgaaattaccaccaaggaaaagaaatcgtgataccagtttagatttgccagatggaaatcagcaacaacaacaacaacaacagaatcaacaatcaatagttggtggtgctggtaatgttagtgatgagcctcataatgaaacacatcaaattacttcgatctctggatcttcaaccaattcaagaaatcttgatatgatgattcctcaaagtttcagaaataatatatcttctcaaccaataaatttttatggtcctgttgcaacaactgcttctggtgctaatgctgtaattaataaaatttcagtggctgatttacttaaataa

SEQ ID NO: 4655 - DNA, 672 bp, Candida albicans
tgtgatgaatctaaaccaacatgtgaatattgtttgcatactaatcgacaatgtatatatacgattcctaaattacaggaatatcttgatactttcacatcatcttccgatttattagaagcaatactgaattgtgaagagttattatcatcaacaacgagcactggcagtgtcactaccaataccaccaataccaccacaactactactactaccagcattaataacaacaacaacaccacaataatgacagaatattctctgccggttgaaaaagatcatttacatcgagaattaattttgacacaaccaacaacgatattaggaatatcaaaatttgaattaaaattattaaaattttatgattatcaatgcatttcaatgttttcatatggtcataatcaagaaatccataatacttggaaatataaagtaccgcatttatttattcaaagtcaattagttcgaaacagtatatttgcccttgcttcaatggtattacaatcaactataacaccagcttttaatgattctttacaaattgctcaaattcaaaataatttatttaattccacattagaatattttttaaatgtcttgaatcataccaaatcaatcattaatggatgtcccgaaactatagatttccaaaatgtttacaatggtaaagta

SEQ ID NO: 4656 - DNA, 1194 bp, Candida albicans
cacaagccaaagaaatcatcacatcagctgaaaaataatgacaagcttgctggggatgaaatgcacgaatggcaacagtcttggagaagaattatgaagagttcaattgtttactttgaaggagaccagcaactgctagaatatagaaaagcacataaactattgagactagttgggtgcaaagtgactcctttttatgacaacaatgtaactataattatttctaaacgtccgtacgacagtaagacagaatattctccgcatgacattttcagcaacgtaagcaaagcgagtatcaaggtttggaactatgataaagtgtttcgttttttaaaacatcttggtattaatatccagaccggggtagacgagcttgcggttaacacacatacaattcttcctccatcgttgaccaataacaatgagaaacccgatttatacaatttgttgaaagaagaaaaaatatatggctcaaccgatagagatcctaatgcaaagcgtgatgatttgcattatttgggcaagaactatttatatgtttatgacttgacccagacagtacggcccattgccattcgtgaatggagtgaccattatccggttatgcagttatcattggacggcaagtgtccatttatagaagatcccacagaccagaacctggagagaaaacggcttaaacgattaagaaagtttgaagctaatcaagcgcatcgtgaggctttgagattggccacatataagatgatcaatggcatttcaatgagtgtgcatggtttcactgccacgagcaccagcacagacaaggttgatgaagaggaggattccactgtcaaggaacctagtgaagatccaagattccgtcaaccacttaacagaaactcttcttgcatgcagtcaaaggcatttgaggcaatggcttctggatataatggggcatctaatgcggttcagccctcaatggattctaacttgaatagtgctgctgcaatggctggcgggaacggtttaggtccagcattatcacaggttccttccaaacagttaaataacttgaagagaaggattttgatgcagaagatcacgactaacccccctgaatataaagataaggaacttgcctcggggtcattggtgaaaactgtcgtgtttaagtttacttattttcgaatgaacatttttatgatcaattaa

SEQ ID NO: 4657 - DNA, 786 bp, Candida albicans
cataagcattttagcatcatcactcccatccaagtaaataaatcatttatcatgtcatccaaatcagcagcagctatcttacaacggcaatttaaagacttgactgatccgaaaaaaggaattccctcatttcacattgagttggacgatgacaacattttcttatggaatgttggtgtaatggtcttaaaccctgaatcattatatcatggaggctatttcaaaggtcaaatgagatttcctcaagactttcccttttcgccaccaagtttccgattcacccctgcattatatcatccaaatgtttatcgtgatggtagattgtgtatttccatattgcaccaagggggagaccctaccagcgacgaaccagaaagcgaaacttggtcgccggcacaaaccgttgaaagtgttttgatttccattatttccttattggatgaccccaacggcaactcaccagcgaacattgacgcttccgttgaatttagaaagaactacaacgtatacaaaaagaaagtattacaagaagttgaacggtcgaaaaaagatattccagaggatttcattatgcctgaaacttctgacaacgcttattcaaactataacaactcgaagaacaaagagggggccgaggaaccggttgacgaagatttttggtatgagagcgaagaagaagaaagctttgatgaagaaagcttaatggatgaaaatatggacgatcagtttgaagatgacgatgaagaagaagaggacgacgaggatgaagatatgggtggaaaataa

SEQ ID NO: 4658 - DNA, 972 bp, Candida albicans
caaacaaaaatatctcctacaattacgacttctacccaaatcatcttttaccaacagtttcacaatatgccaaagtatcaaccaaaaaacggcgagttaaacccatatattcctcgatatatattagaaaccccaagatatcaacaagatatcatcaacaaatctcctgaacaagaagatgcccaagaccaaacaacaacagcacatgatccattagcacatcaacggaaaacgggagaaataatcgataatagtatagcacaatcggggacaggcattaaagatgaatttaaaggtacaataagagtagaagaaaatgaaagttatgatagtaaacgagatcgatggtatgggtattcaactgaagaatggctaacgcatttgaaaaattggaatgacaaaaagcaatctcgaaaacatgcatcagcccaagataatgatgattcagatgatactgataatgaattggaaataattgaattagagttggataaaaaagatatgaagaaaaatatcaaaaaagatcccatggagaaaatgcttagagatagacaagatataccagcgtatatttatgatatcacttctaaccctaacaataaaataagaattgaatacgaccctaaatctagattagctaaagactcagcaaaggggttcttaaataagagaaatcaatttgtgaaaaaattaaccggtgatggtgatgagttgatgaaactacagaaaatggcccaagagcttgataatgagcacgaaaaggatcggaaattggctaaattgaaacaagaattttatggtgaagaaaatccgaaaaccgttccacaaactgatttgagtctaagtcttgaagcaagtcgtacattaatgatgttgaaatccaaacaattgcaaaatgaaaaactagcaaagtcgatacaaagcaaacaagaagttatggaaaaattatcaccaccgggctggaaaatccaa

SEQ ID NO: 4659 - DNA, 1764 bp, Candida albicans
ttactaagtatgggtcaggtatcaactcctacaagatcatcaccaaatgttggctcaaactccactgggtcaacaaagaaacaatcatccttgatggattttttcaagccaatggcatccaaagataaactgaaaccaaaacagcaaccactgccattatcatcgtctccactcaaatccaaatccaacgatactaaaccatttttatcaagtgacaaagagaatgacgatcattcgataatggaaaatcataagaatactactttggtcacatctcaacctgacgatactggtgataaacaaatcaaaccacaattagcttcgtcacccaagagagaggaattgaagaaagaaagaaaacagcagccattaagagagaagactacagctgcattaaactcgagtcccgttgctgcaactcgtcgtagcaagcaaattaactatgccgaatctgacgacgaagaagaggtttttaccagtagaaaaaagagaagagttgtccaagatgacagtgaagaagaggaagacgactttaagccagccgagtcaggaagtgacgatgacgatgatatgagtgattttgttgttgatgacgacaaagatgaagatatggaaccggtactggatgacgacgatgaagtagttgctccaaaaaccaaaagcaagaaaccattgtctaagtcttcaaaaccaactagtctgctggtatctggaattcttggcagatttgatgctggttctggttcttctcgtcaatctagttccgtggccacaccaaaacctaagagtaccaccatcaaatctttaacaccttctaaaaagtcttttgaaaaagaaaacgaagaaagatatcaatggttggttgacatcagagatgctgaaaaacgtcctattgaccaccctgattatgatccaagaaccttatacattccccaatcggcatggtccaagtttactgcttttgaaaagcaatattggcaaatcaaatcaaaaatgtggaacaccgttgttttcttccaaaagggaaaattttatgaattgtatgaaaatgatgctgttattgccaatacccaatttgatttgaaaattgctggtggtggcagagcaaatatgaaattggctggtattcccgaaatgtcatttgagtattgggccaaggaatttatcagtcatggatacaaagttgccaaagttgaacaaaaggaatccatgttggtcaaacaaatgagaggtggtgctaccaaggaggaaaagattattgaaagagaattaaagggaattttgactgcgggtacattgactaatttggatatgatcagtaacgatatggctacctattgtttgagtatcaaagaagaagataaagaagatggtactaaaacttttggtgtggcatttgtagatacagccacttctgaattaaactttattgaactagatgatgatgctgaatgtacaaaattggatactttaatcactcaaattaatcctaaagaaatcatttgtgaaaagggaaacttgtgtcaaattgcaaccaaaattcttaaattttgtacccatagtgatcaccaaatttggaatgctttgaatccaatcaccgaattttgggattatgatattgcccttgaacaattggttaaagccaaatactatgatgcagaaaacttggatgattactcaaattatccaaaagtcttagttgatttcaaagagaaccatcaagttgctttcaacgcatttggtgggttattatactatttgtaa

SEQ ID NO: 4660 - DNA, 1671 bp, Candida albicans
atgttgaaattggatacaagtattatgagtctcggcaatatccatgaataccacatttctcgcaattcagcttcacatatgattttggatggtgttacattgaacaatttggaaattctcaacaacacaagcgatggtactactaaggggacactcttcaagttggtaaatcgtgcaacaacttcatttggtaagagacaactacaaaagtgggttttgcatccattgtttaaagttgacgagatcaaccaaagatacgattcagttgactatttaatgaatgatggattagagttgaggtctattttacaagatactttggcaaatattcctgacttggaaagacttttagcaagagttcatggaggaacattgaaatttagggacttcttaaaagttatagaaagttttgaaagcattgccggtgttagttccaagttggtcgatttcaccaatgttgaaagtggtatgctttacaaatacttgaaaagtttccctcatgaaatgcgtgaattgattcaacaatgggaagatgcgtttgatagagaacaggcaaaaaatgatattatagttccttcagctggtaccgatgaagaatttgataattcacaagcatccatggaggatttgaagactcaattggacaaactattaaaggagtataaaagaacctataaatcacaagagatctgttatcgtgattcagggaaagaaatctatcttattgaagttccattcaaacttaaagtaccaggtgattggaaacagatgggttctacttcaaaagtgaaaagatattattcaccagaagtggaaacattggctaaagagttaagaggtcaacaagagctacacaaaatggtttgtgacactttgaagataagaatgtatgagaaatttgataaacactacaatgtttggatgcaagtcattcaaactattgccaatattgattgcttgttagcattaaccaaagcttcagaaacaatcggatacccttcttgtcgtccaaaacttatcgaagctgataaaggttgcattaacttcaaagagttgagacacccatgctttgtgagcactaaagaattcattcctaatgatgtacaattagggggtgacgaacctcattttggtcttcttactggtgccaatgctgcagggaaatcgacattgatgagaacaactgcattggcaattatcttgagtcaaatcggatgctacataccagctgaactggcagaattgacccctgtggatagaatcatgactagattgggtgctaatgataacattttgcaacgtaaatccacatttttcgttgaattgtcagaaacaaagaaaattttaagcaatgccacaccacgatcattagttatattggatgaattgggcagaagtgggtccagtagtgatggttttgctattgccgaatcaattttacaccatttagctacccatgttcagtcattaggatttttcgctactcattatggtactttggggatatggttcaagactcacccaccgatccaacaactaaaaatgggtttcgttgttgacagtggctcgcgtaatatcacatttttatacaagttggaaacaggaccaccacttaagtcctttggtatgaattttgcattccatgtgtggtatcctgatggcaattgttga

SEQ ID NO: 4661 - DNA, 261 bp, Candida albicans
attttgcattccatgtgtggtatcctgatggcaattgttgataatgcggaaattgcagctaaggcatatgaacaaacctctaaattgaagaaattagcagaagagagtaaaggtgatgatattagtttaggtttacaaagtgactttgtttggttggccactggcaaaattaatgacttgagtaaagatatactcaagtatgacgaaccaattaaaaagagtgctcttgaaaacatctacaaaatgatagataggttataa

SEQ ID NO: 4662 - DNA, 1719 bp, Candida albicans
  unsure (1711): Identity of nucleotide sequences at the above locations are unknown.
tttatatcaatcgtcccaaattttgaaaaaaggagtatccaaatatattttattttcttttttttttgcatttcatcaacacatacatcattttttgttttgttcatccatatgtcatcattcggaagttcaacaattgcaaatggtgcttcactgggtaacatatttgccaatcaatccaattttggaaattttctaggagaaagtcaactaaatggtaataaccaaaccaatttcaaagcagcttcggttttcaataatgacaataacaatatcaacacaggatcacctgaaaagaatgcaaatacaaagaaaacacagaaacaaaccaacaaaacctaccaaaatgggcaatcaacatctacaacatctaagcaaatttcgaatctacaagtgttcaaagagagtgatattgttgcaactggagctttattcgaacagcctgagcgactaggttttaatcatagacgaccaacagaagtaagatcaataccgaaatactttttaacccaaccaaagcttttgtatactcctgagtttgttcaaaatccttgggatcaagaaaatcaaaataaattgactttgatggaagcagagaatggtggtagagattatcaaggattgtatgaagacatgcaaaaacttcgagaaatagaaagaaccaagatggaagagttgggattagtagatgctgagaatgtagctaaagatttaacagaagccatatcgttttctggttcttgtcttgatatgtgtccagtatttgaaagagtgagaagacaattggaaaataatgtaaaggcattggaaaaagatcccatatcaaacaaaatttcacgagagcgtgcagttaaagcgttttcaagaccagctgctggtcaaccaccgccattaccatcggatgttagaccgccacatgttttgagtcaaacattaaactatttggttgacaatattttacaacagcttccagaagcacattcatttatttgggatagaacacggtctataagacaggattttacttaccagaataactttggacccgaggcagttgattgtaatgaaagaattgtcagaatacatttattgtcattgcatataatggcaggcagtgatgtagagtattcccaacaacaagaattagaacaattcaataaggcattgcaaacattaatggaaatatatcaagatgtcaggaataatgggggcaagtctccgaatgaagctgaatttagggcttatcacttattaagtcatgtaagggatcctgacttggaaagacaaattcaaaagttgcctgatgaagtatataatgacaaattggtacagctagcattaagattcagaaagatcactacacaaaacaatgttgttgaaaggggtgtaacgaatctagtgggtgcattaaatctctacactgaatttttccgacttgtttacagcgaggaaacacctttcttaatggcgtgtttattagagacccattttaacgagataaggttttatgcactcaaagctatatccagaagtttccacacaaagactaaaccttatgcaattcaacgattgcagcaagttttgggatttgattctgtacagaaattacaaaaatttctcggttactatgatatcgatattatcaacgttaatggcgaagtattggttgatttattcaataaagagaaattggaaaccacgtataagttanattccatc

SEQ ID NO: 4663 - DNA, 711 bp, Candida albicans
aaaaagaagtatccaaatatactttattttcttttttttttttgcatttcatcaacacatacatcattttttgttttgttcatccatatgtcatcattcggaagttcaacaattgcaaatggtgcttcactgggtaacatatttgccaatcaatccaattttggaaattttctaggagaaagtcaactaaatggtaataaccaaaccaatttcaaagcagcttcggttttcaataatgacaataacaatatcaacacaggatcacctgaaaagaatgcaaatacaaagaaaacacagaaacaaaccaacaaatcctaccaaaatgggaaatcaacatctacaacatctaagcaaatttcaaatctacaggtgttcaaagagagtgatattgttgcaactggagctttattcgaacagcctgagcgactaggttttaatcatagacgaccaacagaagtaagatcaataccgaaatactttttaactcaaccaaagcttttgtatactcctgaatttgttcaaaatccttgggatcaagaaaatcaaaataaattgactttgatggaagcagagaatggtggtagagattatcaaggattgtatgaagacatgcaaaaacttcgagaaatagaaagaaccaagatggaagagttgggattagtagatgctgagaatgtagctaaagatctaagttcttcacctgccgaatag

SEQ ID NO: 4664 - DNA, 954 bp, Candida albicans
aagctccaggttgagatgattcccactttaaattcactcactccttctaaacatcaagctgctggccatgatggctgccttgcaaccgattcattatttattaaattgactgttcagcaagaaattgatttctacactcaagttcaactgcacgatcaaagtgttcaagatgctccattagggtcccaattgtcccattggatgcctacattcatggggacattgacacaaggagatgtatcaaaaactcaaacagcaggtctggatcaactgtcatcagcagaaggacaaacagataaacaatacattgtactactgaattcgtaccatggctttacccatcctagtatattggacatcaagttgggcgccaaattgactgacgatgaagttactgctccagagaaaattgccaggttacaaaaagtcagtgattcaactactagtgggagtttaaatttcagaatttgtggtatgaaagtctacaatgggaaatcagatactaaaccagctaatgaactatacgagaatatgaatgactcgtccgtatctgttaatataaatgatgctgatgaccataagtatcttgaatttaataaattttacggcagatcgttgagtaaggacaatataaaagagggactagaattgtatttcaacaatcatttacctaaagcaatcgttaagagattattagttgtgttccataaacgccttcagttattgtataactgtttattggactatgaagtaagaatattttctgggtcattattgttcatctatgaatctgatttaacaaaatgggaaaatgttacagaagataactatgatacatacgatctgctagttagagaaatagtggatgacgaagatgaagatgacgaagaatttgaagaagactcaaagaaagaccaaacacaaccgttttcaacacgccgtgcagatcaagct

SEQ ID NO: 4665 - DNA, 891 bp, Candida albicans
  unsure (53): Identity of nucleotide sequences at the above locations are unknown.
agcgcaacaaagaaacgcaaaattgttgcagcagcgacagaagctgatgccanagaagaaaaggatctagtatctgaagccgatggaaaagttgaagatgagctcgatgagaaggaagtaaaagaatacctcaattcgaaagacgaccccataccacccgtacaaacaggaaattttacacaagacaacgatactaggttaaagaatccaaaatcagagtatgtggaaccgcagacattatctgcgtcagcgattgcagaacttgggttattttccgaagaaaacaatggtttggaaacacaaggaagagaatacttgaaaaagaaatatggagttgatttgtatccagaaagagacttgcaggatttattacctggggaaataccaaatatcgatttttccaaaaataaaccaccaagcaaccaggtgcagttcactactttccaatcctatattgaatcctattttagaccgtatctgactgaagatataaaatttctaaaagagcgaaatgtggtaccccctgggtttgaaaagcaaggctatgatgcagatgttactccgtttataataccgaaattgggtaaattttatgcggatctttggtcggaagaggattccactctcggttcaaaattgaattcgccagccttccagcagccgtcctctgattcttataaaccaaaggggtctattgaagggttgactgatgaagcattgttcacagaagatatttcgtgtgggccgctttccaatagattgttgtctgctattttaagtaaccgagaaggcggattaagtgatgaagaagatgcaccagccaatgattccaagtcagaaacgaaagatgcaagcaaatcatcattggctgagtcttcaccacggggatag

SEQ ID NO: 4666 - DNA, 876 bp, Candida albicans
aatttaaaattgaatcacaagggggaagtaggagaagaggaagaagaagaagaagaagttgataaatcaattcaaacagataaaattgaagaagatacaactagtatagatattattgccccattaccttcttcacctaataaaggaggaagaggaagaggtggtggtggtggtgttaaaattctgtttgaagaagaacatgaaccttctgatttagaagaatttgatattgatagtgatcaaataaaaaagaaaaatcaggattttattgaaattgatgatgatgaggaagaggaggaggaggatgaggtagtcgaagatgacgatgacgacgatgatgacgatgacgacgatgacgacgatgacgacgacaattcagaatctataaaacaatcagatgaaataatcccaattatagcaccaaaatcaagaatcaaaaaacgaataattgatttacaatcaatgaatagtaatactaatgatgaagaagaagatattgattctatcattgaagaagaagaagaagacaataataatactgaacccaatattttacgtcaagaaaaatccaacactttaacagaagatgatattattaatcatgatagtgtatgggccatatataatttaaaaatgtatacggggaaaatcgttgccaaatatattgaagatctgaatattgaattttatgaaggaacatataatattaaaaatgttgatttaaatgtattagatattcgtattggtgatactgttaatattaaaggcaatcgtcataaatatattgttaccggattatcaactctcacaaccaatggtggtggtgatataaaatgtatgagggggtataatgttgtttatttaagaaggtgtcaa

SEQ ID NO: 4667 - DNA, 399 bp, Candida albicans
ttaaaaatggccccaaaagcagaaaagaaaccagcttctaaagctccagctgaaaaaaaaccagccgctaaaaaaaccgcttccactgatggtgctaaaaagagaactaaagctagaaaagaaacttattcttcatacatttacaaagttttgaaacaaactcacccagatactggtatctcccaaaaagctatgtctattatgaactcatttgttaatgatatctttgaaagaattgcttctgaagcttctaaattggctgcttacaataaaaaatctaccatttctgctagagaaatccaaactgctgttagattgatcttaccaggtgaattggctaaacatgctgtttctgaaggtactagagctgttaccaaatactcttctgcttctaattaa

SEQ ID NO: 4668 - DNA, 549 bp, Candida albicans
aaagtagtaatcaaatgttttaaatacagcatagtttgccactttgaagaaaacattctttctttttgcttttcctttttatatttcttcttcagtttattccaattgaaacttagtatattcaaatcaaataatagcatattaacaataatgtcaggtggtaaaggtaaagcaggaacttccgaaaaagcttcaacttcaagatcagccaaagctggtttgactttcccagtcggtagagtccacagattgttaagaaaaggtaactacgctcagagaatcggttctggtgctccagtgtacttgacttcagtcttggaatatttagctgctgaaattttggaattagctggtaacgctgccagagacaacaagaaatccagaataatcccaagacacttacaattggccatcagaaatgatgaagaattaaacaaattgttgggtgatgtcaccatcgcccaaggtggtgtgttaccaaacatccatcaaaacttgttgccaaagaaatcaggtaaaggtggtgttaaggcttctcaagaattgtag

SEQ ID NO: 4669 - DNA, 1134 bp, Candida albicans
  unsure (128): Identity of nucleotide sequences at the above locations are unknown.
tccgaacagtccctagtgaacgatattaaccaattaattcctattttcgaaaaaaaagtacgaactaacccaaactccaagtcacaagatagacttcgggcattaaatcaattaagatcaatacttcntagccaagtgatgaaagctaatgaattacaggctattcaaaatcaactacaaaacattaaggagcaagaactctcatcgtcatcttcttcagcatcaaaaggtggcacccctattcctaccccaggaccaactcctgccactacgccgggaccctcttcgattccacctgtgtctagggtgaacccggcattcatgatattcaatgatttggttctttcagggttggttaaaaaggatcaagaaccaatccctggatctaaaccagtttactcgttggtttttccacaaaccaaatatgtaccatcagcaagtggtctcggctctaatagtactttagaagatttattgttatctagtagttcaatacaaagatctgattatgataaattgaagtttacggaaatggttaaggttagtaaattgtctttcaacaatttgcaagactttattaaaaataataaacctacaacaaaattgcgtgatttgctttatgattcaaaaccatccaaatgttcaatttgtggtaaaagatttgcatctgataaagaaggggcagataaaaagagattacatttagattggcattttagaatcaacaagaagctctctaataaaggcagtaatgttcaatctcgaaattggtatctagatgattatgaatgggttcattttaatgaaaacgatcttttggagtattcgacagatgtaagaataccagatattactcaggaaatggatgaaactatttcaaccgatagccaatacgtgattgttccatcaacagaaacaaatatgaacaataaatgcttaatctgtcgtgagcaaatcaaggctacttataatgatgaaattggagaatggtgctggtacaattgtattagacaacctggagagcctaaaaatagcagaaaaattgtccatgtcacttgttataatgaatccagcaagaagagaccagcggacaatgatgatttgaatcctcatgtcaaacgagaaaagttttag

SEQ ID NO: 4670 - DNA, 954 bp, Candida albicans
ttctttgcaataaatatgaatattgacgagtttaagtctggcctaaagaaactaactgtgaataaacgggttattatcgatgatctaactacttttgctgagaaatactcggctgatgccgctgaagaaatagccgcagctattcacgaacacatcaggacgtgccctccacagcacaagctacttgcattctaccttttggataacatctccaaaaccgttggtaacccttacaacattcttctagctaatgggctatatcaactctttaaagacacgtacgttattgttgacgatggtacacgacatagattgatagagttgttcagaacatgggaacactacgaaaacacatctgtttttaatatgcaggttctagaaaatattgagaaatttattcaacaagcacagaatcttcgttcagcttctcctggacttgaaagcctatcaaaatctgaattaacacccagaattcttattcagaatgcgaaagacttgttgaaattacatgatgagttgattttgcaagttgaaaattttgtcaagggagactatcataaatttttactggacgatgatttttgtttcatcgagcaatttaaacagatacaagtacaattgtatgagctgatcaatgagatacttaggcacatttatgaggacgtgaattcatatcataatggtaaaaaaaagcttgtcaatactcctcaattcaatattaatgcaggaaaatacaaaatagacattgtcagaaatcaaaaagaattgtttaaacaacaacagtcattaacagattttcttgctacctgcaaagccacgaattgcataaggcttatattgttgaaacaaaggagaacccagaaaaagattacttttcctacaagaaaatacagatttgtttataagaagaaacgttccccaataaaaaagttttttctccgcaatgtttttgga

SEQ ID NO: 4671 - DNA, 912 bp, Candida albicans
cctatttattcattgattatacaactaaaaattaaaataccgaattacaccatgtctttaccaatgtcacctgtttcaccaataaacacaaccacttctacttccacaactacaactcctctttcaccaccatcactgattgaaaattcatcacatccattatcaacgtcaatatccaataattctatcaccagcgattcatctctagatagtaatacatctacctcaagcaccaccacaaccaattatggaaccaaaactccatcaggaaatgctcgaattttcaactgtacattatgtcaacgagcattcactagagaagaacatcttactcgacatactttatcgactcataataaattgaaaccatttacttgtggtatttgtagtcgaccattttctcgaagagatttgttattacgacatgctaaaaatttacaccaaggaagtgaagttgccgtcagtaggattagaaagagctataaacactgcaacaaagataatgacagtaaaagtggttccgattccaatactaataagaccaataagaatggtaagaaacaagaacaggaagatgatgaggaagaaggactgagaagtgacagtagtagtggagcagatgatgaagatagtaataccagtagtggtggttctaattatcatgctattggtagtggaaacaaacgatttgtaaataatagtcctcaactcaagaaaatcttgactaatggatctgtaccgtctactactacaactagtactaccactgttcctacttcgactaataacgataccgcttcaattacaaattcatcaactagtcatatccatcaacgttcactaaatgtcgaagattatgataccccggagaaaaagagattgaaaatgtcagttaatatgttggtcagttaa

SEQ ID NO: 4672 - DNA, 873 bp, Candida albicans
  unsure (801): Identity of nucleotide sequences at the above locations are unknown.
acgcctactcccgcgtccactaccaagaattataagcacaaaaaacagaataccaatactggaacatccatgtcgccaagtaattcaataaattcaacaaacaacaatgcagcagcagcagcagcgacaacaacaacgtcaaaaaagtccaaagacatcccattagagttgactgcatttggtacaaccccctctgggaaaccacgtttatttgtttgtcaagtctgtacaagagcatttgctaggttagaacatctacgtagacatgaaagatcacacacaaaggaaaaaccatttagttgtggtgtttgtcaacggaagtttagtcgtcgagatttattgctaagacatgcacagaaattacacgctggctgtactgatgcaataacaagattaagaagaaaatcaattaagaaatctcaggatggggacgatgatgatgacgatgatgacgacgatgaagaaatggcaaattctgaagacgaaaacgatcatgatgaatcgggcaatgcaagcacaaagaatggtaaaaaggataaaaaagatccaccaccggagttcaatttaaatttattcaatctgaaacaaaagccaactaaagcgaacacgacaaagtcaaaagtggctaaattatcaacaacgacatcaaggaaaaattcaaccaatcctacgagaaaaaactccagctctttgcacaagcaggttcttgatcaacgtcaaaaggctgccgttaatacaaaaattgtatcaagtaccaaaattgtatcaggtaccaatagtggagtgtcgataactccaacnaggtctagaagaagtgcatcattttctgctcaatcgggtgccaactatgccatcaacattactgaattgtaa

SEQ ID NO: 4673 - DNA, 957 bp, Candida albicans
aaccaaaatactattgtgatgagctcaaacatatttaaacgttttaaatcagcagaagaatcatcagacgaagatgagtcggtcgcccctgtgtatattcccaaggcaaaacgtgccaaattggaagtattgaaagcaaagaaatcacaaattgcttctcgactatcgacccacaaacaacaaagtgctcccacaaccaccaccaacactagtactactgcctccaccaccacaacagcaacaacaaataataccaacaactcaaagccatcaatccaaacaaagaaaccaactgggaaaaaatttcaatttgattgggatgtagtagaggaagatactgcatctgggtttgttcccttgatagaaatggatgaagaaattgatgacccattatttagcggtcaggagctgacccactggaccaataaaaacctagaggaaatgacagatagagattggagaatatttaaagaggattataatatcactaccaaaggtaaaaacatacctaatcctttgaggtattggaatgaaggatcgattaatgacaaattggtttcaattatttctcaattaggttatgaagaaccaacttcagttcaacgagcaagtatccccttagcattaaagaaacgagacgtcgttggagtggctgaaactgggagtgggaaaaccttagcatttttaattcccgtattgaattatatcctatctattgatgaaaattatctcaaatacgaaaaaatatcaaatgaaccggtggggttgattttagcaccaacaagagaattggcgttacagataacgaaggaagcagagaaattttgtaagaaactcggatatcaagttctaccgattattggaggacatcactatcaagatactataaataaaattgaccaaactggagtccacttgatagtggctaccccaggtagattaatggattctattgaa

SEQ ID NO: 4674 - DNA, 381 bp, Candida albicans
cgtgtccttccagccccggtgcgtgaagacataaacaatgttgtcattcatggttctaaatcacaagatatgagagaacaggcaatcacaaactttcgaaatcacgaaagcgaagtcttaatagcgactgatgttgccgcaagaggaatagatattccgaatgtcacattagtgattaattatcaaatggtgaagaaatttgatgaatatatacacagaataggtagaactggtagggctgggaatttgggtgaaagctttacatttatttccgaccaagatacggaaattttcacacccctaaagaagttcttgaaaaaaggtggcaagagattgcctgattggttgtataagcatcagtcacaaactgtccaagaatga

SEQ ID NO: 4675 - DNA, 591 bp, Candida albicans
tttcggtatttggactcccctatgctgatggtactgtggaacatgttaccacttggggcaattgaggatcatcaagtatttaaaagcgaagcagagattgacgaggagactaatgaaacagaagatgtggataatctaaagcttcaacgattgaagaaaattgcaaatctacgctttaaagggtcacttacaggtaataaacaatccagcaatgaggaaccaaatcaccaccagcaacaacaacaaccagaacaggactctaaccttgaccaaactgaaagagaaggacaaaccaacgatacagagtttgattctattgctccaattcaatacgccgaatttattcttaaagaaaaaactacagctactagaactgaaaaaagtatcggtgatgatggaagaactaacattaagtttaaaataacagggtcagatgtgtttggaggtttgcatgaactctctgtgaaatcaacagaaccagaagaaataatattaaatccagaagaagtccccaattggctaacaggtgaagaaggtgcttcaattggggaaatcagaaatgggaatttttataacaaaatcaatggatga

SEQ ID NO: 4676 - DNA, 564 bp, Candida albicans
aatatattaccaaacacatatgtgccgtaccttggacataaagttttatataatattttggataggctatccaaaaactctatacttcaatttatcatcttatggaccaagctcaagaacacacaaccaaaaccaccttcaaagtacactcagcatggtttcaacaaaaaaattaccaaggaagtgagtgagtttagaaaattaattaatcgtactccgaaacgtaaactcatcgacaagataatctttgaatactggacccaaggattgaatctactacaaatatctcaaatcgactgccaacttattgtggacaaatcaaatagtgctcaatcatggatttattcaactgtaaaggatatgcatgacaagatagtgccgatctcaatcaacccaagagagtttttaaataatttggtgaaaaatttgtcatcattgtacttgtcatacatttatatatgcaaacatccaaaactaccgataatcttgattaggatccaagtgtttgatttaaatggaatggatattaccgaaaaaccacatattatatctcacaaggcatat

SEQ ID NO: 4677 - DNA, 210 bp, Candida albicans
attaatagatccccacgaacatacatcatggatgaattcaatgagaaatcaaaattatttcaagattggttgatcaaaaacaacgttgaaatttcccctaaaatagcaattcacgattattgtgataccaatcaaggccgaggaataattgctttggaacacactaatcttcaccacgaggagcggccatccgcgataacattaaaagag

SEQ ID NO: 4678 - DNA, 1167 bp, Candida albicans
acccagacttttcagggggttgaagaatttaagtcgaggcccttgacatttgaagaatataataaaattgccactataattatgtcatattcatttgatgttgaagtacccaagtccaaaaagatgactaaaaatggaacgaacgagaaaggcaatgacgaagaagatgaggaagaagacgaagacaaagaagatgacgatgacgatgaagaggaagataatgaatattataaatcgatggttccatttgctgacactttgaatgctgacactcatttaaataatgcaatcttgatatattctactgatcaattaatcatgacttgtataaaaccaattgcaaaaggtgaacaagtatacaatacttattctgatcatccaaacctggaacttctaagacgatatggatatgtggaattgaatgggtccaaatatgattttggtgaaatcccattatcaacgataaaatcagttttcattgatcaattcaacaaattatctacaaataaaaacaaatctaatggcgatacattcatgacaaaacaaaagtttgatgaattgttacaactcatcaatcaattacaaatcaaaaaatcaattgaacaggatggattagaagaagatgaagctgaagaattgattttggattcttatgattgtttcaattctggagatgttataattgaattagtattcttaatacaggtattgtccacaatattagtagtttatcaatatgaacaacaacaacaacaagaaaaagacaccgacaagaaaaaggaatttgaaatcgatcaaaatttaatcaatagaatctttaataaaatttatcaattaattgaactgaagaaaatcacctcaaaatgttttgaaatttatcaatcgataataaatgctagaatgagtcaatatcctgacattgccaaacaaccattcaatggtaatgttgctgctgctaatagtgaagatgaaactattaattccattagaatctatatggctgaggtggtattgaaatcagaatatcaatcattagaaaaatgtagttcaacaattaaagattttaaaataatcaatgatgttaaattaaataaaaatattttgaagaaaagaaataatgatacaaatggagttagtgaaactaataataaaaaatcaaagaattag

SEQ ID NO: 4679 - DNA, 762 bp, Candida albicans
  unsure (742): Identity of nucleotide sequences at the above locations are unknown.
cttgttatttccatgactagaggtagaagcaaatcaattgtacaaaagatagctaatgatgtaccgaaactcaacaattcagaaaatgctttagactatttgctaaaggaaaacggtggtgaaaataatcttacccatacctctaccacttacaaaatgtcacgatcaaagtctctatcgcaagagggtaggaacaacaatatggagttagagaaagtccattatgcggattcaattacatatccttttaccaaaagtgaatttcaaaaggctgagtctgacaacattaactcatacgactacgatactattttgaagcccagagatatttcacatatcacggatttgcagttggataatatattgaattttaaaaacatggtccaaaggaacaaggttgaaattgaggtttttgttagtgaaacaaatgacgttttgtctagtgttgaaacacttttatccaagtacaatagaatctcgaatgaaactcttgatttcgacaaaagagccaacgagctattggagttacagaagcacaaccagacgaaatatgacgaaatcaatagctatttgcaacatcttgagcaattggattttataacgaaaaatttgtctagatcacgatctcatttattgagcctgaaaagagagtcttcatcaatgtggttttgcgcaagcttgacactgcgttggattttattgcgcaacacccactgttcaaggaatctgaaatataccgtantaggttccgacaatgcatga

SEQ ID NO: 4680 - DNA, 543 bp, Candida albicans
tatttgttcccccaaaaacctagaaaaagatacagggaattggatggagatgccttgcttcagtttttgaactccccagaattttgtcaagtggagtttgatttcaaggaggtgttagcagaagagccgctgcttattcagtatgagaatgagttctatttgataaatgccaattctatgagcaacaatagcaatgaattgacaaacttgaaggaagttaatgacgagctagtggtgaaaatcaacgacttgaaacgaaagatcgatagtctacaagcaacacattctgaaatttctgatcagagtgagcagtacaccaaggatttgtctgaggccgaaatagagaatcaaaagttattgaagagacaggctgaactccaagaaaagtaccagaatttgactatggcagaaaacttgagcaataccattaaagcaaatcaagagttttctcaaaggaattttgaattggaactgcaaattaaaaatctacagaactcaatagaagagaagaatgctaaactagctaaggtgcaacaaagctga

SEQ ID NO: 4681 - DNA, 1350 bp, Candida albicans
aaaaaaatatgcatcattagcttcccaccagctattagattcatattaaactatttgattcctttctttttcgtttgcataatggcatcgtctaataatggatttgagtcaataaatctagcttccactattctgggaccttatcaagaagaagacacccctatcaaacgtttacattctatccccgcttccacctccgaagatgaagatgaactcgatcccgaagagttcattttaaataaagtagataaaccagctacaaaagactcacatgtgctgtacaataaatttctggataagcatataagtgatgagcaactatcacacttactcgacaatcataaacccaatgtagtgactaccacaactttaattgattctatcaaagaaagtgaactgttatataataccatggacagtttgatgataaaatccatcaattttcctgcagccatgtaccagtcaaatgacaacaattcacaatcaccaatcgagtatttatctaacagagtaaaattgctcacacaagagttatacgaagattcagtcaaatatggcaagtttctacagagtggtaataatcatatatatcaattacgaagtaggattttacagacctttgatcagttgtcagagagtcatatttctttaaatgaactatataataaagacatgtcttacgcagaaacattacacggatctttcaagaaatgggatcaacaaagaaataaagtattgtccaaagtgaagtctataaaaagtgatacaagcaaacatggagccaaattattcaccttattagatgaagttaatgatgttgatgacgagatcaaacttttggaagcaaaactacagcagcttcgatctaaaaaagaaattttaaataaagaaattgaagataccagcagtgttttggaaagcagaacagcaaaatatgttgacatatttaaggatttggaaaacaaaggtaggtcagcaattactgatttccttcagtccaatggtgttcccgaaaaagaaattgatacaattgtgagattctcacctgttgatattacgatttctagcaactattcactgaaaaaggaaccaaagaaagagattcacattacaaaagagtcaattcctcaaaatgagtcggctagtaaacccgcaaatactcccagtataggtatgcaaccgtttataatacctgaagcagaagccaataccaaaacaccggatttgcaatcaatgaaccacgatcatgggcctactccttttgaaaaaggatatgctatggggacacaaaattctacggcgttgaaaaaccaaatggttcatataatgaaaaaatttatagatttttaa

SEQ ID NO: 4682 - DNA, 405 bp, Candida albicans
cttccagccgcccgtggtgaagacagaagttatactcgaaaagttagagaagcttgcgggagaaaagacaccagcaatactctactagagaaagagcaggaaatggaaaacaagattcggaaaatggaagacaagtatgctttgcttagtacaagatatgaggaaaagcttcaacagtataaagatttactgatcaagtatcaacagttacaagcacaaattgaggacactcaaatgccccaaaataatcgagaatcaaaaatggaaaaattgagaaattttcataaacttaaaattggggaaattgagcaaagtgaattcatcaacgaaaggaaacgtatcgctagtactccagttgtgcaaactagaaatattcaatttaccaacaattcagatgaagactga

SEQ ID NO: 4683 - DNA, 387 bp, Candida albicans
  unsure (28): Identity of nucleotide sequences at the above locations are unknown.
cattgctgttcctcttcttttttcttcntaataccacttcaaattatttccaaagtgattggatctacacaagatggatcatttttcaatgtattccccattaatgaagcagcatatcgaagaatgtatattttgcaacaacaattaattgataaagagtttcattattgtggattaaatcctagacttaatcgaattggtagtattaaattacaaaataatgaaactaatactaaaccaatattagattatgatttaattagaagatttacaaaattgagtgatgataggaaacgaaatttggctaataaagtcagtggtaaaggtatttatcaggatatttggaaagatattataagatttgaacatacattaaatgatctatag

SEQ ID NO: 4684 - DNA, 1587 bp, Candida albicans
gacgatgaaattttgagtagtattttgagagatgaatttttaatgattttcttagctagtggtgatgtcatgatttttgtcattaatacttataatgaatcatacgataaaatagaaattccaaaattattagacgatacaattatcaccactgggtatatcactaattctcatctattgagtgcagtttctaaaaacgttaatttgttattagataataataccagcagcaataagagaaagagaaaacatagtgcattaagtaattctgaaggaagcaagaagaatactggaaaatcacaaccctcaacggctgcaccacctccaccaccaaaagtaaataaagtaaagacatttgttttagtcactggtgataatcgtattgttgcatttaatagatttcatggagaaaaatgttatcaattaaatcatgttgataagtttactgaaaatctttcccttggattttttgatccaaatcaactgacagttgatccatttatcaaacaaatcatgttgaatgaattgggtgataaatttgatactaaagatgaatatcttactattttgactattggtggtgaaatatacatgtataaactttattttgatggagaaaattattttttcaaaaaggaaaaagatttaactattactggtgctccagataatgcattcccctatggtacttccattgaaagacgtttagtatatttcccaaatttaaatggatttaccagtatttttgtaacaggagtaattccttatttaattttgaaaactgttcattcaattccaagaattttccaattttcgaaaatagctgccatgtcaatttcagcattttccgattccaaaattaaaaatggattgatttttttggataatcaacaaaatgcacgtatttgtgaattaccattggattttaattatgaattcaatttaccaatgaaacatgtggatattggagaactgatcaaatcaatagcatatcatgagacttctgatacagttgtattatcaacgtttaaacaaattccttatgattgtcttgatgaagaagggaaaccaattgctggtatcatcaaagatataaaagacacacctgccatgtcatttaaaggttcaattaaattagtatcaccttataattggaccgtcattgaaactattgaattggaagataatgaagttggtatgactttaaaatccatgattcttgatgttggatcagaatcagggtcaacccttggttccgatcccaattcattgatcaaaaaatacaataagaagaaacgagaatatattgttattggaattgggaaatatcgtatggaagatcttgctgctaatgggatttttaaaatatatgaaatcattgatattatcccagaaccaggtaaaccagagaccaatcataaatttaaagaaattttcaaagaagaaactcgtggagccataactagtatttgtgaattgagtggaagatttttagtatcacaaggtcaaaaagtgattgttagggatttacaagatgatggtacagttccagtagcatttttggatacaactgtatatggtttctga

SEQ ID NO: 4685 - DNA, 1107 bp, Candida albicans
gaagaaaactggtggcgtaaaaaaaatggcgaccaaaaccatcaacaacaacgatcaaccaaaaacaaaaatgtgcgttgcaagaaattttttttcattcaatcttcgccaaaacaaattgactgcttaaatcatatccaccttcttttctttcctttcttaccactatcattatatcccgccatggatgcctatccagaatttattgatccatcaaaagtgaacaactgtgtgggatgcaatttcatctcatcaaccaagaagaaccttatagtgggtaaaggatcattattacaaatttttgagaccattcatttaaaacaatcaactattaataaaccacaatatcgattgaaattaattgatcaattcaaattacaaggaactatcactgatttaaaatcaattagaactattgaaaatcctaatttggattatttaatggtatcgacaaaatatgctaaattttcaataattaaatgggatcatcatttgaatactatagctacagtttctttacattattatgaacattgtatacagaactcaacgtttgaaaaacttgctgtgtcggaattgattttagaaccaacttataattcagtgagttgtcttcgattcaagaatttattatgttttttaccttttgaagttatagaagatgacgaagatgaggaagaagaagaagaagaagacgaagaggatgaagatgaaggtgaagaaaatatcgatgacactaaagaaaagaaagacaaaaaacaatccaaaactgatacaatagaagaagataaaaatagtaccaccactaatcaagagccccgtttattttatgattccagttttataattgatgcaactactttagattcgtcaatagataccgttgttgatatgcagtttttacataattatcgtgaaccaacaatagcagtattatctctgaaacaagaagtttgggcaggaaatttgatcaaatctaaagacaatattcaattccaagtattaactttagatttgaatttgaaatctacaatttcggtatttaaaattgacaatttaccttatgagacgatagactttccttttcaccgccatggcgacaagtca

SEQ ID NO: 4686 - DNA, 465 bp, Candida albicans
agagttgaagaaaaagaagataacaaagatgatgacgataatgatgacgacgacgaagatgacttgtataaagaggaagaagaagaagaaactcaaaaaaccataagtaaatctcatattgagtttttatatcatgatgaattgattaacaatggtccatcatctactttcacattaggaatatgctcaaaagagaaatttaaatgtaatttacctaatccaaactataatgaggtttctattttgagtaatgctggaacagattcacaaaccaaattgaatataatcaccccaacgatccaaccatcaatctcctcatcattaacattctctcaagttaaccgaatgtggaatttaaatcaaaaatatttaatcacttcagatgatgtcaattataaatcggaaatttttcaaattgaaaaatcttatgcgagaatgaaatcaaagcattttattaataatgaa

SEQ ID NO: 4687 - DNA, 672 bp, Candida albicans
acacaacacagaattggcttctgcacacgaccttacttaacacttgaatcaaaaaaaaaaaaagtcacaacaacaatattgaaaagttcaatccaacctatacaccaagaccaactaacccaacattccttaattatggcagatagattaactcaattacaaatttgtttagaccagctaattcaacaattcaattcaacgataaattatgtcaataccagtgccgaacccagtctattagatgacgatgatgtcaactcctattccaatatggcagctaatgccccattgccacaatcccaacaacaacggcaacaacaaaagaaacaacaggaaccacagcaagaaatagaacaaccacaacaacaaagtaaccctgaatcaaagagtatttctccgccaaaagaaaaagtgagttttgataatgtaatcaatgagttatgcacagatttaattttgaaaagtcgacaaatcaaaatgttaattgattcattacctggtataggagttacacccaatgaacaaatgaatctaatcaatgaattaagtgataaattgcaagctatagaagaagaaagaattcaaaaaatcaaagaaaaagataatctattaaatctattagaaagtatgattaaagaggtagttaatggtataaccgaaacaagaatatga

SEQ ID NO: 4688 - DNA, 1716 bp, Candida albicans
  unsure (852): Identity of nucleotide sequences at the above locations are unknown.
gggttgaaggtaccagtactccaactccagctccagcaccagcttcaacatttggggtcagcaccacaagctgattctaccagagattcgacatcatcatcaacaccaataccacctacaacatctggaacttctactagttcatcattattatcattagcagcatcacaatcattatctgatgcaaatttattgaaaaatttcgaactacagcaaaaacttttattagaagatcgtcaattacgtgatgttttcactaaatcagtcatgcaatttaaattatctcctcaagtattttggtcatcaagattaaatcaattacgaacatttgctttgacaatatctcaacataaaggtccatataatgtattgagtacaattaaaccggtggccacttctgataatcaagtgaatgttaatgttacgcgtgataccattaatgaaatatttactatttaccccatcataaagaaagcatttgatgatttggttcctaacaagtttaatgaaggagaattttggtcgagatttttcaattctaaattgtttagacgcttaagaggtgataaaatcagtattagtaatagtcgaggagatgttgtattggacaaatatttgtatatagatcaaaactatcaagaaaaattacaaaaatcatctactttggaaaacaacggttctggtggtggtggtggtggcgctggtggtggtagtggtaattcagaacaaggaatacaaacattggaatctccacatgttaaaaaatttcttgatttgatgggaaatcaacaagataattcacaaaaattggggaatagaccagattttactatgagatatgatgaagacacnaatgtagatgatgataataaaaaacctactttaggaaatgaaaatgaaatgattatattgatgaaaaatatgaatcgattatcgtcgaaaatgatgagtatgagttctactaatggaccagagaaaccttcagaaactacaattgatggattatctgctgctgaattgaatgaatatgaagaagaattagatttgcatgatttaaatgattcagaaaatttacaatatataaaattaaacattaatactgatattgccaagggaacaaaacttgattcatatgaaggatcaaatactaataacaagatttctcaagatgaattacataaatatttacaatctcaaactttccaaggacaaatagaattaacagaaacttatacttgtaaaagtgaagaaattgaaaaaacctccatggaaatagccatgcttattaaacaaaatttccgaacatttaaattaattaataaagaaaatgatattgcggggacaaacattgttcctaattcattaatacaagaaatcattacttataatattacgatagttgaatttttatctcatttttggaagatttttttacatgggaataatcctggtcaattaaagaaaattttcaccagtttgaaaaattgtcaatctggtttaatagaattagaaaataaagcgattgatcaattcaaatctatggatatattacaaaaaaatcaaaaattacaagataaagttttaaaagattttgcatcatgtcttcaacccatgaaaatagcattagataaagcatgtaatgaatatgttgaagcagtaaagaaagctaaacctgaattaaatgaaaatggtaaacgtcctctaccagaggagtga

SEQ ID NO: 4689 - DNA, 423 bp, Candida albicans
gtgtttttccatcatatacttgatctcatatcacttgtcctttacttcaccatggatataattagaggtgcatgttcagttgataaaattggggggatggtgtatattagagaagatttagcaccgctgatgttggaatggaaaccaattgatgaacaagaagaagatagagcaatttcaatcccattgaattctttaactacattacaaagtaccaaagaaacctcaccgaaaatgatactaaaaattgtatacaaactaacatctggtccacctaatacaaatgcagatggaactgacaatggtggtggtggtggtggtgaacaaaaatcatttaaattgacatttactaatagaccaaccatgaacactattaaagattctctacaaacaattgttgctagatcaagaactaagggttga

SEQ ID NO: 4690 - DNA, 549 bp, Candida albicans
catactctttcttttcacagacaacagtccatatatctatcaattcaatcaaatatgtcatctcctaaggttattattgtttcttcagataatgaaaagttcccagttgaaccaaagattgctgaaaagtccattttgattaaaaacatgatcaatgatttacatccagacggattggaagaagattttgaaattccaactcctaatgttagagccaatgtattatgtaaagtgttagaatggtgtgaacatcataaaaacactgtattccaagatgatgaagatgaagatgctaagaaatctgtgcctgttgaagaatgggacagaaatttcttgaaagttgatcaagaaatgctttacgaaattatcttagctgccaactacttgaacatcaaaccattattggaaagtggatgtaagatggttgctgaaatgatcaagagtaaatcaccagaagagttaagaagaacttttaacattatcaatgatttcagtcctgaagaagaagctgccattagaaaagaaaatgaatgggctgaagatagataa

SEQ ID NO: 4691 - DNA, 714 bp, Candida albicans
ttgaatccgttaaaggaacaaatcaatgaattaaccactaatcttgaatttgaacaacaaaaggctaaattgcttcatgaagaaaatgaaagaattaaactggctgctcttagcactgatgaacaaaaatccgatgctaataaacatactaatgaaactattgccagaatgcaagaacaaatggataaattgaaaactaaagcaaatgaaagaattagatctatgaatgaaacgattgcttccaaagatgaaactattaaacaattgaatgaaaaagtggatcaattaagtaattctgcaaacacaaatgaagataaatcaaaggaacaaattgaccaattaaataccaagttatccaatcttcaaagtgaagtagagaattctaaaaccgagaaaaatgaattgttgaaaaaattgagtgaacttgaatctaatttacgtgctgaatttgacaaggagaaacaagaaattatcaagtcgttggaattggcaaaacaagcaaatgcatctgatgaaaatttacaaaagagatataaggagcttgaagaagctttgacaaacagcaagaaagaatttgaaacaaaattagaagctgaaaggaaaaagaccagagaagaagttgaaaagaaatatgatattaaattgaaaatgatgaatagaaaaattgaaaaatatgaaaaggccaacattcttctaccccaacaactccattag

SEQ ID NO: 4692 - DNA, 690 bp, Candida albicans
tttctccaactcaacaacaatcattttcaaaagtatcaacccccaaatcagaaaggaaattcaattggaaagaaagattcacttgagccacgagatgaattgacagattattctccaaccccaccaatagagaagaatcataatttggatgatgaaataatggatgatattttaaacaaaggaggatttaaattcaagtatgatcctaatcaattagttcaagacaaggagttggtgaattatcttttgaacattgacaatatacttgatcataatgacactacccatgatattaaaaataaaaaagatacttccttaagcgaattgaataaggcgatgtctaatttatatgagacaactttactcaagtcaaagaaaatattgacaccacacaaaaatgaacattttgattcattgactgaattaagccatttggaacgatatctagatgaattgcataatagtattgatagtttgggacggtcattgggtgccaacagagacaaagtaaggggaagctataaagatgaaatcaatgataatataactagattaaatcaagtatctaaggagttggaaactttggaagctaaagcaaatacgtttagagatcaaataagtcaacaaaaggcaaataataccaatcaaatgatgggtaccatagctcttctaactgatgttatatcttag

SEQ ID NO: 4693 - DNA, 1449 bp, Candida albicans
ctggtcacaatgaatgagaatgagaaagaatccaagaatgtcaagttaggcgtacttgaagaagtggctaatatgtcagtggatgagttgactaatcttgaacaacaattggctagtgaattcaacacattgagtaaagaataccttgagagtcgtttatcacgaattaataccatattagataaattaaatagtctgatcaaatatgcaactgcaaatgacaaaagttggttaaagatttacaattttgaaatcgaaactataaatagtataatgacaaacacagaagatttaataatatccaataatggagatttgaaaaacaaacctgatttgttaaaatctattgatgaatatcaagaagaattgaaggaaatttttaaaaacttacaaagtccttttgattttgatagtactttcaggtatgataacgacgataaattgaatgatggcagtaatccgaatttatcaaaattacctttttcccatttatttaacgattactttaaaaaacatcgtgatgctttaaatgcaattattaaagaaaaggattatcaagccaatttgcttcataataatctgtacggtaatcgggtcattctatggaaacaatactataacaagttaaatcaacagaaacaaaagttgattgataagactaatgatcagttgaatcaattatacaaagactactatcatttgaatgagcaaaaaaatctagatttttcagaacggcattattataggtctttattaactccgaaagaactagctactaccattgatgacagtatcaataccgtggatacacaggatgttgcagcagtacttgagaccaaccatgattctaattatgttgaattagatactagacacaagagtaagaataaaattgagatttctgacattcgaaaaaagatcattgatgaagatcaaatgttgaataatattagctgcggtattaagcgatcatgggatgaaactgatactaatactagtatagaccctttgaaaaggagtcgttttagtttaactgatgcagaagccattgaagatctactactgattagacacaatattaccaagcaaaattcacaccatgaacagaataaaaatcaacagaaggaaggaattgaacagaatcaagagaatcaactggaggaagttgatattgatgaagcagaagaagaagaaggccaggaacaatcaatacagcataatcaagaaggcgtagaacgagaaggagaagaagaagaagaatatggagaagaaatggactccgacaatgatagggaagagacagaagcaccaatagagtcgattctaacatctgaacaaaaaaatcaacgtgaactatataaagaaattatattcaaaaatgatactactgaaggtatgaaaatacaaggtttacctccattggattgtttccccagatttttcaattaa

SEQ ID NO: 4694 - DNA, 900 bp, Candida albicans
caagagaagacgtcttatttgaatcgaggtaaaagagtttcttcaattggtaatgggtttgtgggagtgccccataaagaagttcctgtgtctgattattataagcttttggatactacgatgccgggaccagataggttgagacaattgttgatatggaatatgaagaagcaatttgagaaagatgaggaagatttgaaacagcgggaatctgaggatcaaaccgcgccaagtatagcaagggtaatcaaggaagagattataagagatttgacggaaaagaagatttctacaagttggtacgataacagaaacaacaatatagaaacgataagtgggaaagtggttactgtgcccaatcctttaaatattacaaatctaaagaatattgatatttacaccaagaaattgaaaaatctaagaaaacagaaagctgagtggcataaagtttacaaacaagcaatacgaccgttagaaacaatgaagattagtttatctgacgacaagaaacaactaaataagtacataaaggaagaaagggtcggaaacatacaaccagatgcaattgacaactcaatggttgaaacaattgaggctaaccatactgaggttaaatcaaatataacaaaactagagcctgaagtggataagctttatttcacagcattccaattaaatcgtgcaagcgacttgttgaaatcggtagagcaacaacaattaaacaaaaaggtgtcacagtatttgcagggttactcaaataaatcaaaagtggaagcatataaatccctaccgtccagcagcggtagcaataacagatggtctataccgctgaaaaatgttgacacaaaagatcttctaagagctatatgtcggttggaaacccaaaacaaatcttcataa

SEQ ID NO: 4695 - DNA, 2775 bp, Candida albicans
agacgaagatgtactcagccaactgaactgcatcccaactcatcacgtagctgtcttgtggttaccttctattaccaaaatactagaaccacatttgttgatctgatggcaactactacttcaaatgcctttgcaaattcagaaaatgcatcaattacccaattgatagtcaaccacaaaaatgttagcaaagcagatgacttgatatccaacttcatttccaaaaaccagaaattgaaagttgtgttaaacttggacccttatggagactcagctttcattgattcgagcttgaaagacgtttcagattttgtcaaaatctttgaaccaccagctaattctcctgtaaactccttggcaaaaacaaacaatgacactgttaccaagcaagttagaagagtccccagttacaccagacctactttgtcttccagtcgccatagtcccaaaaacttgtcgaaaagatcaaggattaacagtaacagtcctgataagatgacacttagcaaacgagttagattgaaaaacagtcccttgagtcaatcagttgattcaaatccttttattgaaaaaaactcgaaaatctacttgaagaatttagctctgagaacttcaagcactgatactcttaccgatagtgactctcatcacgattgttgtttacaaattgaaaccttacaaaatgaaaaacgagtattacacaaaaaatacgttgattcaattaaagatttgaaacaagattttcttgcatttaaacaagaagcagctgggatcatcaacgtgttgaatgatttagatgcacagctttctgaactcaagcagaaacaaattgatttagaaaataccaaaaatgaccaaatcaaggaattggttagtgaacatgaattgcaaattgagaaaatttcaaaagatttgactgaaaaattcaaattggtggagacacaattgctttccaaacatgaatcgcatgtccagcaatttaccaaagaattgattgctgaatctgaatccaaacagcaagtggaagaagagttggagaatttgaaaaccatccatgctaaagattccgccagaattttggaattggaaacccagttaagtgacgcagcaaaagagaaaagcgaatctgattataagcttactgacacgtctgaaattgtcaacgatttgaaaagtcaaattgaaactctcaaagcaaacttgaacaaactggaagaggaacgggaaattcaaaataaaaaacttgaccaagtatcagaattgaaggagttgaaagaattgaaggtagaggaattgtccaataatctactgaaattacaacaagaattacaccgtaaagaaattgaactgaatgagcagttggaaaaattacacggagtttctgctgataaggaaaaactgttgcaacaatcaattgagcaatccaaaatttacataaactcattgaaggaccaaaatgcaaagaccgatagaaattgggaaataaaatatggaactcttgaacaaaaccaacaaaaattagtggaagaacatttagcaaatagacaaagggatcaattggagattgaaaaattagtaaagagcaaaactgagctcgaagccgataaccaggcattaaagaatcagttgacagagatttctaaacagttttcaaccctaggtgttgaatcttctgagttgaaaaagcagcttgaggaaactcaaatcaagtatgatcaagctgaaatcgttcatcaagaattgaaagctcaaattgagaagttactcaaagagtctgctggcaaagatggacagcttaaggaattgaatcaaagtcacgagaagtttgttaatgagttgaagaatgaacacgaaaaacaagtaaaggaaactaaagatcagattatcaaagaaatggaggaaaaacatcaacaagcaatcaaggagattgaggactcgcacaatgaaaacattaaagaaatcaacaatgaacacgaaaacaaagcaaagtgtataattgactctttaaatgaggaaattgaagaattgacttctcaacttaaaaatgccgaatcggaaaagaatacattacagtcattaaaattggagtacgaaaacgaaattattgcttacaaatccaaaattgaccaattggaaaaagagtcagcagaaaacttgaaagaatatgaagccaagttgcagtcgatgaaatttgacttggaatctgacctagcgattgagaaacaattgagaaaagatgatggacaagattttgaaaatcaaattgaaaaattaaatcaactagtaacggaaaaggatttacaattgagtgaaaaagatgaagaaatagcttccattaagaaatacatggaggagttggaagatacgaaagcaaaattggaagaaaagtctactactcaaaatgggatgaaactgttggacaatagccttaccaaaaagcacgccgctgttgtcgctgaattgagcggtaagattactaacggtgatgctgacattgatggtgacaacgaacctcttgacggaaatgaagatggtactagtatggcgattacatcatccatcaataaaagaaacgttttacaaccattattgaatattactacttcgccatttgaaaaaagccaaatcccaacaattcagaagacgatgaatctacatctccaaagtctgaaagtcctgatttggctacagttgaataggagtctcttaaactttcttcttgaattttttttttatataaaaataatatactttcttgttttcgttccttattga

SEQ ID NO: 4696 - DNA, 1011 bp, Candida albicans
atgacagaattgccaaagaagaatcaagtaaggaataatgaaattgataataaaaaactcgaaagaaaaagggaattcaatgcagcagcaagcctaatcagcgaacacgaagattctaaaagaaggaaattgaacttaccagaaccaggcacccacaattttgaaaagaccaagagtgatgttttaacccttactaaccaagccaacaacaaactatccgaaaaggagattgctcgaaatcagaataaaaaaagagctgcagtagcacaattaattaaagcaactttcgagagacttcctcctccaaagcatgaaactggagaaattctaccgttcgtttccaccaatatccttgaattcagaaatgacgtaaatgctaatgatatatcggacattgcaggagcaaagttacctgatgaaactgcaacaaatgtaagtacattgatatctcgtgttgtgcagcgagaactaccaataccccatccaaataatctacgagatctaagcactgtaaaatttgatacattggtagacaaattgattgctgaggaatgtcatagattgatacggtccgactacaaacaatatcatgacactactatcaatggtgtttctactgataagtatgaccgagacttacttgaaaagatcaaccaagatattgataaagagtttgctcaaatggatgtttcaacagttcacagttttgaagattacgttcttcctaaaaactttaaagtggcagaatccataatagaaaatttacacactttccataatgagaatgaaaaattgacaaataaaatactacaatctacaaattatgaagatcaacgagaccaaaagttgcagcaattgactcatttatggcgtgaactatcagatgttaatttgtcttatctgatagaaaagaaattgtttgaacttgaaagttcagctattgacaaagaattgttatgtttgcgcagtgaaattgacaaattaaacaaaaagattgaaacacttcggtag

SEQ ID NO: 4697 - DNA, 2166 bp, Candida albicans
ccaatccatgtcatgcagcagcctccatcgtaccaccatcaccattatcatgatgcaaacggcaagggagtcaaccaagagatattagagaaagccaccgctggtctgcgttcacgatccacatcagatcttcaccaccaccatcaccaccatcactaccaaagcaataatgccaacttcccatcgtcttcgagtttgcgtgatatcttgtcgctagttttcattatgctttcgttcccacagtacatgtccttagggctattggttgtgtatttgatgttggggtcaaactttatgggtgggaaattcttgataaactttttattgccacaactgcataagttggcattcactaatgtgaaacactcgttggtgacttttatcaagatgggtgcaatagacgtgtttcttttttatgggttgggtaaagttgtaaagaagaagagttatttcaattatctagtcattctttccaaggcgattgttgctagtgagtttattgggtcgtcgtcgataaactatatcaactcgatatcatcaaaaaagtttaccacaaagatccagtacgacgataagaaccgtatattcaacagcaacttgatcaatgcgattgtgtgttttattattatcaactatgtcaagtatgtattgaattgggtcaacttatcgtttcagctatttagcaccccgcaatactcggcgcatatcaccaactttaatttcagccactggaatgtgcaggtatatttgtttttatgcatacacacaatcatccaagcgttgtttaggcaatcgccaattgcccagagctatatcccaactgacgacatatcagtaaatgtcgataacaatcaattgttggatatttacaccaagaatttgcccaagtttaatggtaattacaatagcaactattcggtggcattaaagaactttgagaatttcattatttcgcctttcaatagcaagttatcggttatgaagaaccgtatgcgggcgtcgtcgttatcgaatttggccatgaaaacgactactacaagcaccactacttcgctcaccagttctaccacgtcgacgtctttgactacaacgaccatttctcccaacgtgactcttattgaaaacaccattattgtacagccattttggtcgatcattgcagcagtgaaagcgattttgaagaaccccaacttgtttaatggcgagctgaccaagaagaaaaatgagggtggagtgtttttgacgaaggaagtacaacccaatgtccccatggcgattatggtgattgattcgtcgaaagtggtactccatgtgttgtcgtcgattcgagaggatattgaagtgagacttaacaatatcaagtggtcgtatttcaaagttgttggtgagtatcttgtgatttatgggttgacgccattgtttcagtatgaaatagacatcgtggccaagtcgctggtgtggaaccatcttgtgataaacactactgatgacgacaaccaggttattaacaagtcgagcaaggaaacttcgtcgttggccacgttgcagacctcgcttgagtcggtaatgaacaaaacagaatccctcaaggccaagcttaaaaagtataagaaagacgaaaacaaaaagatcactgagatgagaaactctattgagttgctcaaaaacaaaatctcaaagaaccgtcagggcaatgataatcgtatttttggaaagatcaaggggttaaaacattctgtgatgcagttggagaacgagattgagggattgaacaaggagattctggagttgagtaaaaccgaaggcaagttgcaggaggcaatgaaaagcaaagagtctgcgcagttacaagaaattgctgaattgaacaagatctatgctgattttgagtcgagaatgaaagatgcccgagccgaacttaagactgccagccaagagttaacgtcgctcagtgcaaagagtcaaaagttgatggtcaaacaagcagccaaacaggaagaacttcgaaacttgtcaacggacattaagaacattaagaagaatgagattctggccaagtttacaaagaggttgaaacgcactaacgaaaagtttgagacgatcttgccgaaaattatccaggaaaccgaaagtttaactcgtgagtataatgaattagtagcatag

SEQ ID NO: 4698 - DNA, 813 bp, Candida albicans
  unsure (101): Identity of nucleotide sequences at the above locations are unknown.
caatatcaattattaagaatttttaaaggacataatttacccgttaaagatataatttttaatcaatcgggtgaacgatttttaagttgtggatatgatanatatataagattatgggatactaaaactggtgaaatgattaaatctataaaattaaaatctattccaaatgtattattatttaatcctaacaataaaaataacacagagttcattgtagggttatcgaattttactattgaacattatgattttaattctatacaatatactaatccaatacaaatttatgatcatcatcaaggatcaattaatgatttgaaatcattgggtttagataaatttatttcttcatctgatgataaaaccgtaagaatttggtcatggcaaataaatattcctattaaagtaataactgatccttcacaacattcaataccttgtataaaaattcatccacaagcaaattatattgctttacaatctatggataattcaattaaagtgattcatctgtatgggaaatttaaatggtataagaaaaaatttttcaccggacatcaaattgctgggtatggaatagaaattgattttagtcctgatgggaaaatattaatgagtggtgattgtaatggatttgcttatttttgggattggaaaacttgtaaattaattaaaaaattgaaaattattgataacaccacaaccaccaccaccaagaagaaaccattgacttgtattgttgctcatcctcaagaaactagtaaagttgccattgctgggaattctggtgaaatatattattgtgattaa

SEQ ID NO: 4699 - DNA, 984 bp, Candida albicans
tttcttaaactccattttaatcagctagactataacaaaacaagaaaagttatgtcgaaagatatttatttgaagaagatacttggtgaagagtgtgtttctcggatccgaaactcaaaaatccttatggtaggagcaggaggtattggatgcgaattacttaaagatttagtgttgactgggtatggggaaattcacattgttgatttggataccgttactttatcaaatttgaaccgtcaatttctatttcgtcaaaaagatattgataaatcaaaatcattcaccattgccagtgccgtgcaatcatttaattatctcggagtcaagttgattcctcatcatggcaatgtcatggatacaaaacagttcccaattgaatggtggggacagtttaattttatttctaatgcattggataatttagaagccagaagatatgtaaacaaaatggcattgtttttgagaaagccattaatggaaagcgggactactgggtacgctggacaaatccagcctatctatccgtattacagtgaatgttttgattgccatcccaaagagacccccaaatctttccccgtatgcactatcagatcaacaccatctcaaccagttcattgcattacctgggctaaggagtttttgtttcgtcaactatttgatgaaaacgataattcaaattcaatgaatgatgccaatcagattcaaaatgaaacagacgacaaagacgagttggagaatttgaacaaagaggccaatgaattaattgaattgcgttctaaaattctactgttagatctgaatttctttattaatgaattgttcgaaaagatttttaaagtggatattgaaagattattgagcattgaaactttgtggaaggctaggaaaaagcccattccattagatatgactgaatatcgagaggcattacagcagttattagagcaggaactgagtcgttccatattgttttcatag

SEQ ID NO: 4700 - DNA, 777 bp, Candida albicans
gacattccatttgaaatccaaaattggacatcaaaggaaattgccgggaatattattcctgccattgccactaccaatgccattataaccgggttatcaagtttgtccggcacacaattttttcagcaccaaatagatcttacaagttcagactttagtaacatttttacaagggcatcttctgtgtttattagtataagaccgaataagtacattactggcgatagattatcaaaaccacctgaaaattgtgccagtgattcactaacagcaagaggagtcctcacagttgcattgagtgaccttgctgttttgactctcgaaggattcattgatagacttgctgataaatatggatattccaaagaagatatatctatccaaattgggaaatcgaagttaatttatgatgttgatttcgatgactatcttcaaaccaaattgaaggacgttcctggcgtggccaatggagaggtcatgctaatacaggatgatgctgacgagttagaaaacttagaattgtatttgaatataaaagacgatactgtcgagttgaaattgccaacattagagttgagacctaaaaaaatggtcccacagtcaaatcataatgaagagaacaatggtgagtatgccaaggagttagagggaggaactattttattagatgatgatgacgatgagctgtttggaaacgaaatcgaaatacttgatgatgaagaggaggaagatatgaagattgtagaaccacctgtaaagaagagaaaacttgactag

SEQ ID NO: 4701 - DNA, 828 bp, Candida albicans
tgcggaaatattcaaagtgttattttttttagggctaatacgacaacaccacttgtcaccactaacatacagaaaatggcctctgataacaagtacaaatacaggattgagattctgcagatgatgtttgtgctgggagaagcaaatgatccaccaatagaaacaacatcgataattgaagatatcgtacgaggccaagttattgaaatattgaggcaatcaacaaaaacagcaaattctcgaggtagcagaagtatgataccagaagacgtgatttttttgattcgacacgataaggcaaaagtgaatcgtttacgaacttatttatcttggaaggatgttcgtaaaaatgccaaagatcaagaaggtggtggaactgaatccttgattgaaaataccaatgatgttggtgtaagagccggtggcccgtcacaatcccaatcaaatgattcttcaaaaatgctttcaaggtacaaaaagtccaagataagattgccttgggaattgcaatttatgtttagtgaacagcatttagaaacacaagaagaaaatgaacttatcgatgacgaagagaaagctgcctctatagcgaaggtgaaaaaattgaaaatggcagatgatcgaactaaaaatatgactagagaagagtacgttcattggagtgagtgtcgacaggcgtcatttacttttagaaagggtaagcgtgttaaagaatgggccccaatgaattcattatgtgataccagacccaatgacgatgttattgatatcctaaggtttttaacttttggagattgtgtgttccttaacagaagaaggcctgaataa

SEQ ID NO: 4702 - DNA, 1026 bp, Candida albicans
  unsure (710),(926): Identity of nucleotide sequences at the above locations are unknown.
acaaaacgttggtcctgtcaaaagtcgtgtgtgtgtgaaaaacaacaacaaaaaaaacgttactttttgctggctcgtcgccactttcaaaggaaaaaaatttcatcccatcttactttttcttcttgtttttttaattccctcaatagatcaatcaatcaaaaaatggatggtccagttgaagttactaaacagttgtttgtcagaccattgagaaacgatgttactcgtgaagaggtccaagatcatttttccagagctgcacctgttgttgaagtgcgtttgatggaaggttatgcttttgttacatttgaaaatgaagatgatgcaaaacaagctttagaattacttaacgatgccgaattcaatggtgaaaaattacaaattgaatttgctaaggaaagaagagaagatacacgtggtaaataccgtcttttaatcaccaacttggcagaaggtactgcatggcaggatatcaaagatttcgttagagaaaaaactgatagtcaaccaagttatgtcaaggttttcactaactttgataacggtgaaactacttgtagcatgcaattccagagccgtgaagatttggatagagctattccattgttagacaaagctgtcttcagagatatcactattggtgctgaagaagacaccagcccatacattccaccaccaccaaaaggtaaaggaggtttcaaaggtanaggtaaaggaggatttgatcgtggtttcagaggaggaagaggtggctacgatcgttatgacagaggcggcttccgtggaggaagaggtggtttcgatagaggattcgatagaggtggatttagaggaggaagaggtggttatgataggggtggatttagaggcggaagaggtggatttgacagaggcggattcagaggtggaagaggtggattcanagggggaagaagcggatatgataaaggtggatacaatcgtgataacttcaacgacagaagtggatcatacgatcgtgaaagatctccaacccgtttttaa

SEQ ID NO: 4703 - DNA, 2769 bp, Candida albicans
  unsure (2575),(2631),(2648),(2696): Identity of nucleotide sequences at the above locations are unknown.
gcgcgggactttccagcctcgtgggggcgatgggaagatgttaacagcccggattataaagatcctggtgcccctcttcccgttgtcccgactccactagttctgtctaccgtttcacaatcagctgtgacaacgaatccaccttcggtaggatcagcgccaggaccagcgccaggaccatcgccaggaactgagacattatacgaagcaaacaatgcatatgcacagtcttcacagattctgcaattaccccaacaaaagtctgctttttctccaattttatttaatcctattataaaaagtgatatacacaccaagtacggaaaaggaggtaaattttatgttgcaaaagacagttccactaatggaaaccttgacatgaagaatatatcactcagagcaactagtgtaagtggtatggaaattccattctctagtgaggacaaaaaacggctacaacaaaatttagaagtactcgactcttctactacaagtgataatgagggaggagaagatatagaagatgacgataatgactacgaagatgaaggcgatgacgacgaagaagaagaaggggaggaagaagaagaagaagaaagtgatgaggatgaaatatcagatattggtaaatctacgcctttgaaacttaacactcaaaacgagtcagtgccaccccaacaaagtaattataatcctgtcaatatcactgatctgggatccaataccaccaataacattactgataaacagggttatgaaaatacagaagggtttggcacgcctttccccaatcaaatatccaaatattctataaagcctgaatcaccattcgctagtaatgaattgcaaagttcagtttcgcccatgtattttgacacatcacagagtcaccaatcacctcaattgcaaccatccactggtactttagaagttttgaaagccagctccttagagtctccgtctaaaatcagtgaatcctcaaattatttgccgctaatattaaggagcattaatgtctccactattccaagtctgtatttgatgaacaatttaataagcagtaagttgttgccttcgtttaccataagtgatgatgacttggaaaatgatctagatataactaaaagcaatgaaatgattgtcaagttgggatttttgaaggaatttcttgatttcatgtctccaaatattatttttgatttaggcttgatgaaaaacgacgaatccgattattatataaatggcgtgaatgacttgttgttgaatctggacccaggtatatcgtctgattggattttgaatagtttgtcaaaagtttttccttgcacttatccaatgaaattaatcgagcttctttatgattttaaaagtttagaattggaagatcaactagatagtcaattgaattttttgaatgaaattgccgacgaagaagactttgttggaccaaaagcattataccgaaaattaaaggcgttggaatgggattcgttttctttgaatgaactgaacaaaaccagttttgagaagtataaaaatgtgatggaaaaattaagtgctgaaaacacggtcagtgatgatgactatttcaagttaccaatggtgaaaactagaatattgaaaaatggcaatattgtgaacttgaacaatattggtttgaaattttggaaatatttaaactttagtcctgtgaaaaaacagaaagactttcaaatattgttgattgctgaaactcatcgtaacacagcttcttatgcaactgagtttttagaccaaatcattcaaaactataaggaatgcaattttggaacaatttcgaaagtgaatttatcaacagtagagactcgttctgatttggagccaatttcggatggattggttctagtccacaaagagcatgatcaactgtacaatgatttttatatacagacaaacaagaagttgatttcactagttgaattgataaaattggatttgattaataaaacaaacaattttgaatttggtaaaccattgctattgtttttcattgatttcaatgacagttcaaattcaaacgtgcaagtgtgcaaaatctttagaaatttcaaggtggcattaacaacgcatcaattgccattggtggatatatttactaaaattgtaccatcatcccttttagttaagaaggtgcatcatgaaactgctttgaaagtgtttagcaattacaaactaacaaagatttctatgaatttatacaacgaatgccctaatgatttagctaacaagtccattgttaagaatttgttcactacaattgtgaaagatcctccttccaaaatacagtttaaattcatgaatagcagctatagagacaatagttcaaatgatgacattttccttcacctagcttatgaaagatcgatcgataacagttggttcgtggcatcttggtcggatccattgggtcgggtagttcatgtcaaatcgtggtactgttctgattctgtctccaaatctgagaaatcaacatacagaggtgacataatggatattatgagtattacagacgatatatggagcatatccacagatntatttaaagttttaaacgacgaactaggttcatttggaagggaaaaaattttggtnttgaccaggatcaatancctcatacccgatgtggaattaattccatggaaacgattgagtctgangcataaagaaatatcacttataattgtatctgtgcgttcgactcccagaatagtgggttctaatgaagtctga

SEQ ID NO: 4704 - DNA, 1734 bp, Candida albicans
cttcagctttcttctggctactacaatcttcacttacaactagaattcatactaaaaacattcgatagaaacatcatggtaggggcaaacgcttcatcgatatccactcaatattacaaattggctcatttggggtccataagttataccatttatacatcgtcagataataatgatcaagcattactagagttggaattgacaatcagacacaaatggccacaaatcctagtgacttattataacaaaagtttgtattattttgtgtttggtcacaacaaggtcgattcagaaacgattgacttgactaaagaattcccacaactatctaccaaatataccgatactgtgaacgttgatcagttccccaaccctcacaaaagcaccaaaaatgacgataacttggcgtgggctagcttgagttttttgaaagcgacgaaaaagatgatattatacaacttgtccttaagtggcgcaataaaactatttggcaattactgtgtcgcacccaccggtgattctgtgtattctattctttgtattgatccaatattattccaaaatggtgatttggtggtttcttgtgttgaaaaacctttcacacaattattcagctcatccgttgcatacccaagaaaccttgcaattgacactaactttgtcatttatttgattcccagtggtattagatgtcacttatttgatccaacaagtttgagaaataatttgattgagaagccacaaatcgaaaacggtaagctattagagttattgaaaataacgacaggtgttcagtgtgatgagtctactttatgggtaaaacttataccgaacctcaaacatttgaacaaccaaacatcggcaattggaaaatttattcattccgtggaaaataagaaattcattttgtggccatgggatttgtgtttgctacagtttggaaagtttgaacccgccatagaggaggagggattgcttgaatcgtcagaattaaataatccactacacttgatttccgactttcttgacttccgcatagcacataatactcaattgcaacaacagagagatagtttgctggatcagcaacaaggagaaacagttaacgtgcccttaagtgctggtagtgtacacgctactggtgcaaattcttttggaaatgtccctgatatctcaaaagatgtagacaccgtcggtttgagcacgacaactcctatagaaacggatttattcaatttgcaaaacacagaagagtttttcaaaaacgatagtattcatatgaatcttgaagaccaaattcataaaaaggaaactgaacctgaaaatgaaagtgaaaatgatatggaaattgacgatctatttggtggcgatgagagtgatgataacgatgatttggaagaggctggcaacgaagaagaaaaacccacaccttcaaacaatactattgacaaaaatggcgtaattggtaatgccttggaagaggcatttattgccgatgcaacaccatctaaggaaaatataaatctcgattctaaaataatgccacctgattcaaccagcgaagaagcagtccctgataaagagaattttaaacccaaagagacaaaaccatcatacattgacattttgaaagataaaatgaatattgaaaagattgttaacagcccggattataaagatacgtgccgcccttattcaccggtgctctacacaggcggtaaatggatccgatga

SEQ ID NO: 4705 - DNA, 630 bp, Candida albicans
  unsure (25),(26),(46),(144),(149): Identity of nucleotide sequences at the above locations are unknown.
gaaaactatagtttccgatcaagannatctaaggtagaaaaagatntattgataaaaatacatgcatttattagaatactaacaccagcagactttgaaagtttttcacgtgatttattgacagaattgacatgtcgtatgcanattcnacaataccacacatggagacgtgatggacttactactttagaggatggagcaaaatgtgaaaaggataaagtcatcagagctgcccattatcaaagaatgggcaatggtacaggctctggaagacattcccaaacaccaggattaacgaatggtaattctttcaatggtaatggccatcgcaataaattttcaccacaacctgaattcagatcgaaatcaactactgctagagctccattggatattagtcatgcagctgattttgagttattatcagctgaggaaaaacaattatgtgctacattaagaatattacccaaaccttatttggctattaagaaccaattgatgagagaagcagttaaaaataacggtgtattgaaaaagaaagacgctagacaagcattgaaaattgatgtcaataaagcttctaaaatctatgaattctttgtgcatatgggatggtgttctcaggggtaa

SEQ ID NO: 4706 - DNA, 768 bp, Candida albicans
  unsure (756),(757): Identity of nucleotide sequences at the above locations are unknown.
gaaaaaaaatatttgacaaagaccatggattcaagaacaaaattattccatagtgatgtttgcagttcagattgtactaataggatacgtattcaatgtgccatttgtacagaatatgatttatgtgtgccttgttttgatgcaggattgactactggagatcataaaccatggcatgattatcaaattattgaacaaaacacatatccaatatttgatcgtgattggggagcagatgaagaattattattaattcaaggatgtgaaacttctggattgggtaattgggctgatattgctgatcatattggtaatcgatccaaagaagaagttgctgaacattatttcaaaatatatttagagagtaaagattatccattaccggaaatgaataaagatttcaccgatgtgtcaccattacaatttcttgaggaaagaaaagaacgattagaaaaacggaaaaatataccattaccaccacctcgagggaaacctgttgcttcagtcccattgtgtcatgaaattcaaggttatatgcctggtagattggagtttgatcatgaagcagaaaatgaggcagaaattcctatcaaagatatggttttcgaccctgaagatctggctaatgatatagatttgaaattaacgatattggatatttataattctcgattaacaactagagctgaacgtaaacgagtaatgattttgaatcatttattggattataggaaaactatagtttccgatcaagannatctaaggtag

SEQ ID NO: 4707 - DNA, 1497 bp, Candida albicans
tctcgacgaataacttctacggcgcctttaagaatcgatgttgtcaacaatgaatttgatcataaattcactatacatgaagacaaactgaatggtatatatgtgaaggggctagctacaagactggttactaatgaattggagctattaaatattctttctgaagggttaaagtaccgttccatatcatctactcaaatgaatgaagaaagttcgcggtcacacacaattttccaagttaaattaactcaaaagcatatggagactgaagtgattaaacgatcaaacttgtttcttgttgatcttgccggtagtgaaaaagttgacaaaactggtgctcaggggcaaactttagaagaagcaaagaaaattaattcttcattatcagcattgggtaatgtgatcaatgccttaactgatggcaaatcaactcatatcccctatagagattccaaattgacacgtattctacaggaatccattggtggtaattcaagaacctcgttaatcatcaattgttcaccatcttcgttcaatgagttggaaacgttgtcgacacttcgatttggtaccagagctaaatcaattaagaatagtgctcatgtaaacactgaattgagtacagcatctttgaagaatcgaattactcaattagagaagatgaatcaaagtaatcaatcttatatcaagcaattggaagatgaattatcatcgtaccgttcagaacctcattcatcaccactgatgttctccatgatgagaaatagtactgctaccacaactagtattgccacgtctttggccactaaacccagcaacttccaatctcggttaccaataccatctaccgcgtcaattatatcgtcaccaccgcctagtcttgcgagaaatagtcacatgagcgatgaattagatcgtcgtgataagaaaattgaagaattagaaaatgtgatattgaatttgaagatgcaaaatttgaaaacatcacatcaagaagaaagtaaattgttttcattggaaaattctttacagaatattactaataaattgaatgaagttgaattggttaacattaatttgagaaagcatttgttgatcagtgaaaaaattattgagagtagagacaataaaatcaatacattgaaattatcattaaaggaacaacaattattgatttcacgtgagacgctagggttcagaaatagattaggagaaattcaaatgaaattagaagatttgaataaatataaagaagaggaaatgagtattaaacgagaaactttattattacaacgccaacaaagtattggtggagtcagcagtgctggcactggtactgggtttggaggtggacttgatattatgcaaagatctggtacaacttctacagatgacattcaaagtatctcagcatttaaacctgatccagagttaattgacaacatgtatgatgatgatagttcttcacacacgggcgcctggaaggtccgcagaatg

SEQ ID NO: 4708 - DNA, 1083 bp, Candida albicans
gttttatcaacaaaagagaaattggcccaggaaaaaagttgtgaatcatctcaaatcaaattagtttattctggtaaagttttacaagatgataaagatttacaatcatataaacttaaagaaggagcatcaataatttttatgattaataaaacgaaaaagactcctactccagtacctgaaactaaaagtactactggaacttctaatgtcgaaaataaatcaactacagaatcaagtactcaaaacaaagctcaaggttctactaatgaatcaacaacaacaacaacatcatcatcagcacctgcaccagcacctgcaggagctaccacaactacatctgagcaacaacaaccacaaccagcagcatctaatgaatctacatttgctgtaggtagtgaaagagaagctagtattcaaaatattatggaaatgggttatgaaagaccacaagttgaagctgcattaagagccgcatttaataatcctcatcgtgctgttgaatatttattgactggtattccagaatctttacaacatccagtagctccagcacaaccaccagcaacaggaacagcaccagcacagcaaactgaaggtaatacatcagaaagtggtcaacaaggtgaagatgaagaacatgaaggcgatgaatctactcaacatgaaaatttatttgaagctgctgctgctgctgctgctggagctggtgccggtggagctggttcaggagctggagctggagccggatcagccgaaggtgatattggtggattaggtgatgatcaacaaatgcaacttttaagagctgcattacaatccaatccagaattgattcaaccattattagaacaacttgctgcttcaaatcctcaaattgctaatttgattcaacaagatccagaagcatttataagaatgtttttatcaggagctcctggttctggtaatgatttaggatttgaatttgaagatgaaagtggtgaaactggtgctggcggtggtgctgctgctgctactggtgaagatgaacaaggtactatattttcacctactggggctggaaggccccgcgaatgcgta

SEQ ID NO: 4709 - DNA, 798 bp, Candida albicans
ttgtctcgtttggatttgctcttggttgtaacagatgatgtcaacccaacaagagacagggttatttctgagcatgttttaagaatgcacaggtttgttcctcctggattgatggagggagagccaatcagagaaaaatcagcagttacattggctgtcggagatgatgaaaccaatgaacaagaattattagaacagccaatgtttgaaaaatttaacacattattgcatgctggtattcaaaacaaaaagtcaaataatatactttcgattccattcttgaaaaaatatgtccagtacgccaagcaaagagtgcaaccagtgttgaccaagggtgcatccgactacattgttactacatattcctccttaagaaacgatttgataggcaacaaccaaagaaatacagctccaataactgctagaactttagaaactttgattcgtttagcaacagctcatgcaaaagtccgtttatccaaaactgttgatgtgaaagatgcaaaagttgccgaggagctattgagatatgcattattcaaggaagtagccaaaaagacaaaaaagagacaaaaaactacaagtatagtggactcagaagaggaggaagaggatgagtctgatgcagaaatggaaaattccgataacgaaataatgcccagagaaagtactagaagaaccagagctacagcacaaacacagcctccacaacagcaacaagcatctccttcactaacacccgaaccgccacttggacatcgggacgatggagatgacgatggagtgggtgaagaatga

SEQ ID NO: 4710 - DNA, 186 bp, Candida albicans
agatcacgttctgcattatttgccaatgatcaagctgcggcaaactatcatgacgttactcgtgctatcaatgaacagatggaacaagaagatattttctcagagcaagagttgagtgctggatttgaagtgatgagttctgaaaacaagttttacctagaaagtgataagatttggaagatttaa

SEQ ID NO: 4711 - DNA, 1305 bp, Candida albicans
ataataatggatgaacgatttttgaatccaccacctacagctgatcaagatgatactaatcagccacttgatgccatctttggtgatagagtcagaagatttcaagagtttttagatagaattgattctaatacaggtatagattacagatctattatcaaagatatgttgatcaagagtaagtttagattgagtgtttcaattgatgaaataagagagtttgacagagaattttggttggggttgctcaaccagccagctgactatttaccagcttgtgaaagagctttgagagacacagttttagctatttacgacccacaggatccaagtttcccacatgacagttatgaccctaaccagcaatactatttatcattcaagggagcatttgggggacattcgctcactcctagatcgattgattccagctatctttccaaaatggtttctattgaaggtattgtgactagagcttcattagttagaccaaaggttattagatcggttcattatgctgaaaaaactggtagattttatgcacgtgaataccgagaccaaacaacatcctttgatgcaattgctactccggctatatatccaactgaagatatggaaggtaataaattaaccacagagtatggttattcgacatacagagattaccagaagatctctgtacaagaaatgcctgaaacagctcctccaggtcaattgccaagatcggttgacgttattttggatgatgatttggtggatttgacaaaacccggtgatcgtgtacaaattgttggtgtttatcgtgccttaggaggtgctgcaaacaatagttcttctttcaaaacggttatcttaagtaattctgtttacttgttacatgccagatcaacaggggttgcttcacaagaaaagttaactgatcaagatattagaaatataaataaacttgcaaaggatagaaagatttttgatattttatcccgttctttggccccttcaatttatgggtttgactatattaagaaagctgttttacttatgatgatgggaggtgttgaaaaaaatttagataatggtacacatttgagaggtgacattaacattttgatggtgggtgacccatccactgccaaatctcaagtattacggtttgtgttgaacactgcttcattagctattgccactactggtagaggatcgtcaggtgtaggtttaacagctgctgttactaccgacaaggaaacaggagaaagaagattggaggctggtgcaattcttacccgccgggctggaaagtcaagcgct

SEQ ID NO: 4712 - DNA, 945 bp, Candida albicans
  unsure (47),(141): Identity of nucleotide sequences at the above locations are unknown.
gcagattctttatctgaatctcaagatttatttgcttctccatttanacaacaacatcaaaaggttgatactgttgctaccaaaaacgaaattggtttggaattaaatttaggtttaccagaaatgcaaaaggcttcaganactgtttccactccatttcaaatccattccagtgtattggagtcggttttcagcaccaatttggatggagtcaatgatattgatcatactccaatgtttgatgaattggatttgattatggacggagccaaagtcaattcatcagaagattgggttgctctttttggagatgacaatgatgatggtgttgctatagctggtgctactagcaaagaaccaatgttatcattgaatgaagataacgagaacaatgatgacgacgctgatgacgctgatgatgatgatgatgctcttgttccaagagaagatactattgaagctttattattggaaccatcaccaaatcgtaccatttctgctgctacttctgcttctacttcatcattaaacagtccagaaagtactattgctaccacagtcactgctggtggtgaagttgttgttgcaagtaaaaagcaatttcaattggtaacaccaaatccttcatccactttaccaacaccattattggattctaaaaattctaaaaaaagagttaaagttgatcatttgggttgtgttacctattcgaaaaaacatagatctcaacctttacaaccgattgttgttgatgacattaaagatgctgctgctttgaaaagagctaaaaatactgaagctgctagaagatccagagctcgtaaaatggaaagaatgagtcaattggaagataaagttgagaatttgattaatgaaaagcaagctttacaagatcaagttgaaagattacaagaattgttaagagtcaatggtattcaattttaa

SEQ ID NO: 4713 - DNA, 1176 bp, Candida albicans
  unsure (23): Identity of nucleotide sequences at the above locations are unknown.
actatcccgatggatactggcanctgtcgcgtcgcaaaacaaaatggacatggtgagttcatcactcccctggcagattctcatttttacaaatcagggaatttgaattacgaactaattgcacatgtaactcgtttcatcgataaacgactcacacaggaagcaaagcaagatggttcaattttaatatttttacccggggttcttgaaatctctagtaccattaaagaaattaacaagctgagtgacaacaagtttatggcactaccacttcattcaggtttgacatcagctgaacagaaatctatatttaagacagcaccaaagggtaaaagaaaagtcgtattgtccacaaatattgccgaaacttcaatcactattccagattgtgttgcagtcatcgatactggtaaatcgaaaaaccttttctttgaccataaattaaacactaccaaattaatacaaagttggtgttcacaagctgaagttcgtcaaagaagaggtagagctgggagagttactgctggtacttgttaccatttgtacactaaggaaacatttgaagcaatgcaaaagcaacctattcctgagataaagagaactagacttgaaaatctttatttggtagtaaaatcaatgggtatttctaacgtcaatgagtttttatcgagtggacttgatgctcccgataagtcatctcttgataaggcaaatcaatttttacatgaaatcggagctttacaagaaaatatccttacaaagttgggaaattatatatcatacttgcctacagatccacaaagtgccaaattattgattttggggtgtatatttgggtgcttagatatatgtttgactctagcagctataagttctaccgggagcccctttatcaacagttatgaacaaagagacaagttgaaacagattcagaagacatttggaaatggtcaaggtgactttattagtatggcaaatgcatacaatgcgtatatgagcaataagtcaaaaaggtttttgacagagaattatttatcttacacaactattaaagacatcacgtcgacgagatcacaatatttgtctttgttagtagaacttgggtttgttcacagaaaattagacgattcttgtaataagaatgccgagaactggcctgtgcttcgacggcatagt

SEQ ID NO: 4714 - DNA, 1857 bp, Candida albicans
acaaggtcggtggaccagaccaaattgatagggtgtacccaaccaagaagagttgctgcagagtcggtggcgaaaagggtgtcagaagaagttggctgcaagcttggagatactgttggttacaccattaggtttgaagatgtaaccagtgaaaacaccgtaatcaaatacatgaccgatggtatgttggaacgtgaggcattgaatgacccaaatatgaaccggtactcagtaatcatgctagatgaagcccacgaaagaaccattgccactgatgttttatttgcgttgttaaaaaatgccgccaaacaaaaccccaacttaaaagtaattgtcacttctgcaaccttggattcaaacaaattttcccgatactttaacaactgtccaattataaccattccaggaaggacgttcccggtagaggtattgtacaccaaggcaccagaaatggattaccttgctgcagcactagagtcagtcatacaaatccacgtttcagaacctgcgggcgatatcctagtattcctaactggtcaagaggaaatcgaaacaagctgtgaggcactacatgagagaatgaaattgttaggcgaaaatattcctgagctaattatccttcctgtatactcagcactcccttccgaaatgcaaacacgtatttttgagccaactccacctggttcaagaaaagtgatattggcaacaaacatcgctgagacgtcgatcactattgacggaatatactatgtcgttgacccggggtttgttaaaattaacatgtacgactccaaattgggtatggattcattgagggtaacaccaatcagcaaggcccaggcaaaccagcgtagtggtagagcagggagaactggtccggggaaatgttatagattatacaccgaacaagcatacgaaaaggaaatgataccaaacactatcccagaaatacagcgacaaaatttgtcgcacaccattttaatgttgaaggcaatgggcattcacgatctcgtaaactttgaattcatggacccaccatctaccaccaccatgcttactgcgctagaggatttgtatattcttgatgcattagacgacgatgggaacttgacaactttgggaagaaaaatggcagatttaccgatggagccggcactagccaaaacattgatccaatccgttgaatacgagtgcacggaagagatcttgagtattgttgccatgttgtcggtgcaaacaatattttatagacctaaagataaacaggcattggctgaccaacggaaaagtcggttccaccactctttgggagatcacttgacgttgctaaatgtatttcagctgtggtgccgcaacaactacagcaaaacatggtgtcgggacaatttcatacaggaaagaagtatgcgtcgagctatggaggtaagaaaacagttaaagctgattatgcagcggtttggatacaagaccatgtcgtgtggtaatgacgtggaccgggtaaggcggaccttctgctcagggtactttaaaaattcggccaaacggcaagaaggcgaagggtacaaaacattaaatgaaaacacattggtatatttgcacccgtcttcatctctctacggcaagaaaccacagtatgttatctaccatacattattgcttacatcaaaagagtatatgcattgtgtatcgatcatagaccccaactggctttacgaacttgcacccaaatactttagacccgcggatgctaaaaccgtgcaagaaatcaaaaagaaacaaaaaatagtgccgttattttctcgacaaaagaaagataattggcgactcagttcccatcgcccagctaaaagaagatag

SEQ ID NO: 4715 - DNA, 1287 bp, Candida albicans
ctaactaaacaaccaccctttatggcacaacctactacccaactcctatccatagtccagaaacatttggatcttcctcaagatgatgaaaatgtggtgctaattgcaaagttcttagtgaacttgcatggaaactcgacacttgaggagtttaaaaaagttgtcaaagaaaatggaggtgacgaatttgaagatgagtttataaaagaagtttacaacgaaatatcaccgccaccaccacaggtgggcaaaatatattctggtgtagtacaaagcgtgaccaactacggggcctttatcaagatagaaggtacatcgggtctatgccacatctcacaaatgtcatttgatggatcaagagttgagtgtaccaacgtcctagcaccaaaccaaaaggtatttgtaaaggtcatcgacattcaaacgcatgccaatagaatatctttatcaatgcgaggaataaaccagaatactggacacgaagagcccatcccacaacggggaagacaccaagaacgacagcccagaccaaaacgaaagttgacttctccagaacgttgggaaatacgccagctcatcagttccggcgcagtatctgcagacgactacccagagttggatcaggaagaagacacacaaacagaatcagaaaagacagataatttacacatcgaattgaacgataagaaacctgatttcttaaaaggtgtcaaagtcaccaaggactttcccgaaaccacccccattcccgtcaaccagctgggcccactaaccaaatcagcccagcgaggatccaagtttgccagagactttaaggaagaaaagtttaaacagaaaaagcaaagggaaaaagaagaaaaaatacagtcggaattgtcagatccattatttcaaacatcagaaccggtaaagaactccgacctcgatccagatactgaatcattcatctcaaaatggaagaaatcaaacaagaccgaaacgtttgggaaacggacaagtcttccaatacaggaacagcgacgcatgttgcctgtgtatgccatgcgatcacaattacttgaggctatacgcgataaccagtttgtagttattgtcggagaaactggttcagggaaaaccacccaaattgttcaatacatctacgaagagggaatgaacaaggtcggtggaccagaccaaattgatagggtgtacccaaccaagaagagttgctgcagagtcggtggcgaaaagggtgtcagaagaagttggctgcaagcttggagatactgttggttacaccattag

SEQ ID NO: 4716 - DNA, 558 bp, Candida albicans
gcggtccttccacggcgtggtgaagacttagattcaaatcaacaaccagaaatccaacgagttaatttgacgtcagtgattttattattattatcgttagggatcaatgatttacttggatttgaatttatggatccaccatccaaagaagcaataattaaagcattgaatttattatatgcgttgggggcattaaacacacaaggtaaattaactaaaaccggcaagaaaatgagtgaattcccacttgatccagtattcaccaaatgtatactaactagtgataaatttgataatactaaacaaatcattagtataattgccatgctcaatgaatcgtcaaatttattttatcgacctaaagataaaaaggaattagccgataagaagaaacaagaatttaatgatttacaaggtgatcaatttatgttattgaaaatatggcaacaatgggttgattctggatattcagtacaatggtgtcaagattattttattcaatacaaaacaatgaaacgaatcaacaatatttatgaacaattgattagattgagttaa

SEQ ID NO: 4717 - DNA, 1467 bp, Candida albicans
ccaagagataaattgaaacttgaggaactaattccacgaattttatttgaacgtaaatcatttttgaatgtgacggaggattctttgagaaaagaaatagacaattcattgaagatttccgaagaggatgctttagacactgaagaaagtagagaggacacagttgaagcagatcaacaagaagtgttcaataaacacaagtttgaattatcgaaaaatataaacaatgcacttaatgaaacccaactttccttagattttgtatccttattaatatcttcagtgaaaccaagtttggcaaaatctaccatttcaccacacttgtcaaaatttgtcaaaccgacatctttaaattcggatagattgggtcaagatagtaatgataatcaagagagtaaggctactgattcttttggacaaggatggaaattggagtcacttggaaagataaccgatcttttcagagaagctagtactaatttaaacgatcaagttatcaaagaaagacgatattggaatatgataaatttggtgcttgccaacgacgaggttctatttcgaatgagggacccccaaaataatgctagagcaataggagtgaaatatgggtatggagattcaggatcaaattttcacgaccaagggttggcattgttacgcaaggacaaccaaacaggagaaatctcatttcaccccatatcgtcaatcaacaatgctaaaattgtagaaaaagtttcgagatttattagagtgaaaattttgagccaaatagatggggactatatgcttacaggacagtcaatttttaattttgattttgaaaaaagcaagcaaagcataattaatgacatcgaaaaggctagattctttttatttgaggaggacttgtttcatcaattgatacgcgaggccaaattgttggtaaactacaatgtgtcaatcatatcgaataaaataataattgaaatcaacaacattattattgaaatagagtctatcgtgtatgatgagttgaatgaggaggaactagaaaactattaccagaatgtaaatgaatattccaccttacacaataaaaagtgtcagcttattttaaactacttgaaacttatgctttgttgttattacaaatacaatctcaaattgaaacagaaggttccaacagcattgactaaatggaagcagagtaactcccatcctttgattttgcgtccgttagtgggtaatatgaggcatgagttaaatttgctaaatatgaagagtgttttagatcgattaatgcacgctcatgagagtgaactttcttattccaaactagatgtggagaagtttattaacttagccacaagaagcaaaaagcaaaacccattccaaaagtcaattgaaaagccaatttcaaagttccatttagttttatgcaacaaaacctctaatatgttggacgtcaacatacaattggacaactaa

SEQ ID NO: 4718 - DNA, 858 bp, Candida albicans
gggtggatggaggagttgaaggatgcaagggaagaaaggtctgtgtgttgggctagttgtcgtactagctcgtcctcggtagatgacatgaccacaccactttttttgcatcgtaaaaagattgaaggaatttttttttttctttctgtctcacaactttctttaccagccatgaactttccaccatttgaacaaccactctttgaccccaaccaagcggagttgcttgaagaggcagagagggccaagaactccagtatcccatttcataatccatttgatgtgaactcgtatccgattactaatccgcctatatttgattcgacaatgacagttccgtatactacagatggggttccacgtcgaagaagaatatcgatatcgaatggtcagattggccagatagtgagccacgaagcgtactttgccgaggatttggatgtgccacccgagtttgagagcagaccgcagacgtcagtgattgagccaccaccaccgccgccaccacaaccacaaccacaactaccagtagaaattgctggcgttccaccaccaaaccatcaactaatctacaacaacgaagtgatttacaaccccgagaatgggcctatacccgggacagctgcatggaagaaggagcggttattggagagaaaccggattgctgcgtcaaagtgtaggcagaggaagaaacaagagcaggtgcagatccagaacaatattgccaagatggagaaagagttgaagaagaaagacgcaaagattgctgagttggagtatacggtggaattactaaaagcaagtataaaaagctgtatagaagatggcaacaccgacaggttgaagcaatttatttag

SEQ ID NO: 4719 - DNA, 1734 bp, Candida albicans
ttcattgtgagttattggttcaagtgtatattaacatatataattatctatagcccattatgtgttgaggaaatggatatatccgacaaaaatttcaaaccttgcccttgtggatatcaaatttgtcaattctgttataacaacattagacaaaatccggaattgaatggaaggtgtccggggtgtagaagactttacgacgatgagagtgtggaatataagacagtaagtgctgaagagtacaaattgatgcaattgaaaaaggaaaagcgtgaccgtgaaaagaaacagaaagaaaaggaaaagaaagaaatggagatggtcaataagaagcacttggcaggtttgagagtagttcaaaaaaatctagtttatgtcactggattgaatccaccttgtaatcctgatgatttacattcagttttaagatcagacaaatattttggacaatatggtaaaatttccaagattgtcatcaataagaaaactccaacaacgcaaacatcaactcatcatcaccagaatccgggattggtagtgtatgtgactttcaccagaaaagaggatgccttgagatgtattaccgaattggatggatcgttatgtgatggcagagttttgcgtgctgctcatggtactactaaatattgttcatcgtatttaagaggccaaccatgtccaaatccaaattgtatgttcttacatgaacctggagaagaagccgattcatatacccgtaaagatttatcaacacaacaaggtatcaagatgggaatgacagcaagaagccatacaacctcttttggtgaagaatccagtaataatagccaatctaaccaggctggttctgatgatgatcaccacgaagcccataaggaacatttaccatccacggctcattgggcagcagctggaactacatctggaagcaattcgccttctgtcaataataacattccattagcgaattcagctgctttccctacattaggtgagattgttcgtgatcaaaagcaacaacagaagaaggaaaccaagccccgttcaaagactacgaaatctaacaacaccttagtccctgacgaattagatgcgggcgataactcagtgttcaagttcgtcgaaacaacgactgaacaattgcgaggtttagaagatataagaaatgtacgcttcaagggtttcgacaacgggaaaatattacctttattctcatttaaaggtaatttcctgaatgatactcagcttgaagaagaaaaggtcatagcacgtcaagtaattgagaagtttcttttgagaccattaaagaactaccatctagcatatcaaaaccatccaatcacccaacaacaagcaatattacaacgtcaacagcagcagcaacaacaacaacagcaacaacagacaccagcattacaggttgctcaattacaacaaaacaaaaatgacgagcaacaaaagcaagctcaacaacagctcttgctacttcaattgcaacaccaacaacagctccagcaacaacagcagcagcgacaacttcaacagcaacaaaatcagccacatcaattgaatatattaaaaacttctgatagagtaaacacctcaactccacctccacctggcttgtttgctggaaaagatgttgccgcttcctcagatatgtcaaatactggagcacctttaccttcatctagttcgcaattgttaactcaattgatgagcgggaaaagataa

SEQ ID NO: 4720 - DNA, 774 bp, Candida albicans
atgagttcaccagagatagaggcaagtggttcttctgaatcaaaatccggatattccagtcaaaaaaacccttcccgtacaccaacatcatgggacgcagaagatgatatacttttaatgcacttgaaagacaaccaaaaattgggttggaaagagatagccagtaatttcactaacagaacgcccaacgcatgtcaatttagatggagaagattgaaatcgggaaatttgaagaaccctccaaaatcagcagcagctttaggggctcaatttaaacagaatcctaatatgaattctgcaccaaaaaagaaaaaagccacaactaaaaataacaaaagtacaactgagtcatcagataatactaccgaaaaagaaaccaaatcaggaaaagtttcaaaaacaccaaaatccagtggtccaacaaataatggttcaaaggggaacactcctagcagtagtagtaatagtacaaccaacagcaataactttacttataatcccatgacaactggtacttttcaagggtttgacaataatatttcaacagcattggccggattgaatgctttgtccaactcaccatcttatatttctaattcaagtcctgctacccctaaaggtttaacatcgccaactataaacggaagtggtcctcaccatagcggtaatccgaatttggctcataaatatgaggcatctcctgcatcggatagatccgtagatcaacgtcgtcggtcaaggtatcgtcaccacgggcctggaaagaccgcgtaa

SEQ ID NO: 4721 - DNA, 651 bp, Candida albicans
cagcgcggctccggccagcctcgtggtgaagagttagccgtcacgtgtcagttaccaattgatatgggtggtggtgaaggaaaatgcctttacattgatactgaaggtacatttcgaccaaatagattggtttctattgctcaaagatatggattaaatcccaatgactgtttggataacgtggcttacgcgcgtgcttacaatgctgaacatcaattaaatttattaaatattgctgctgaaatgatggcagaatctcgattttctttattgattgttgatagtatcatgtccttgtatcgtacagattatgctggtagaggtgaattgagtgccagacaaacccatgttgccaaatttatgagaactttacaacgtttggccgatgaatttggtattgccgtggtcattactaaccaagttgttgctcaagttgatggtatgtctggtatgtttaatcctgatcctaaaaaaccaattgggggtaacattattgcccattcatcaacaactagattatcgtctaaaaagggaagaggtgaaacaagaatttgtaagatttacgacagtccctgtttgcctgaaagtgaatgtatctttgccatatacgaagacggtattggtgatccaaaagttgaagataatgagtag

SEQ ID NO: 4722 - DNA, 1152 bp, Candida albicans
ttgctttccttcaattacagtaacagcatcatgactactccatttgttgaattacaaactccgaagaatctagatataatttcagatgtatgttttatggacaatactgatcaacatcggttattggtaagcaattggaatagtgagattttactattttcatgtgattcgttactccatgaacatcaacccccacatttacaaccaatcaatacatttactactccggacattccattatgtttattatatgacaacaaacagaacgtgtcacctcttgttggattgttggatggatcaatacgagaattggattttgaaaatggtaaattaggcgataatattggtgatgccgttgatgacaataatgaaattgatagcgggatcaataatttaaaaaatgtcaatattagtgggcaaaatagtagtagcattgtcgcttcatcattcaatggtaaattgcaacttattgatacccgtcagtctcaaagacaacaacagaaattaagtccacaaactttccataatcaacggaaaatattcactatggacaccagcgatcaatatttgatattgggtttacaaaataatatcattgaaatttatgatttcaagaatttacaccatccattggaaacaagacaagttggattaaaatatcaaattaaagatttgaaaactttcccggataatcaaggatttgctttgtctactattgacggtcgtgtatcaatggaatatttcaatcctgatcctcaatttcaattacaaaatcgatttacattcaaatgccatcgtcaccctgatcctaaccctgaatcagcaggtgatttagtgtatccggtaaactccttggactttaatcataaatatggaactttatttacggcaggatctgatgggtatgtatgtttatgggattgtaaaaagaggaaacgaatgagacaatatccaagatttttatcagcggaaaatgaaccggaaagtatcgttaaattgaaaatcaatcgtcaagataatttaatggtagtggctactagtgatgataattataaacgaagacgtagattaagtgaaagtgaaaattccaaaactcctagtcgtgtatatgttaaacaattggcagaaaatgaatgtaaaccaaagtcatag

SEQ ID NO: 4723 - DNA, 1773 bp, Candida albicans
ttacccgtcacgtccttattttatagtcattactcaaaaaaagacatgtcattaacaactaatagaattgcattatcaacaatcaaggatagtcatttgaattcatctccttcaaatactccttccaaagacaagaaactcccaacattatacaattcaaacaaacctaaatcaaaattgtttagtccttcacatctgaggattagacaacctgatttaataacaaaatccttttcaattgctcattcagcaactagcttgaataaaaagttttctccattacgtgctgtcagtttttctgattatagatcgaccttatcaaataaaccactgtcgtcatcgtcgtcgtcgtcatctccttcaaatttgaaacttcaatccaccgatgacgcgtttaaaaatgatacaattggtttggctgctacaaaattgaaattaaaattgcaattggccctttataaagttcaacagaacaaacaaacccgcctcaaaaccacaaagtactacaataacaataccaacaacattaatagttacaaccataaaatccataaaaccaatggtcataaatcaatggcaattaaacttaactcaatattgggatcacttgaaagtcctccaacttcaaatagatcttcaccggtttctgcttatgaatcaccaaaccccaccaataacaatcacatggtcaaatcttcaaccgcgtcattacccacaccaccagaacaagtacgcactagcaattactactcccattctatcaatgtcaatttaaatgctacaccaagattcaacaaaactaaattgttgaaaaatataactaaaccaactaatagtgctacatcaactttaaataaagttgccagttcacgtactaaaaataccaaaattaataaaccctccaaacttaaattgtttcaaattaagaaagattcaatttattattgttcaaatcaaaagaaattacctttaagtcaaaacaataccacccatgtcactaaccaatcaaaatatactaataatttagatatcactgctactaatggtactactcattcatttaataatatgagtactccttcctctcaaggtactgtaactggtggtgctggtaatggccaaagtatgtcattttttacattctatccaaccagtcaagaacaagaatcatcacaaaacagtactactaatgttggaaccactagattaccatcaataactgttgatcgtacaactaacgaagttccaagtaacagaaacaccaaccacgcacaaaattcattttattcaagtcttggcgctaccaatactgcattaccatcaatcaacaaaatattgaaaaccccaattagaagagcaaataatgcatcgaaacaatttctgtttcaaagatcatttaataatgctgctccattagttaccaataacaataacaacaacaataacaacaatagtaatacttatggtaatgatgaaacaactattgatgaagataatgacataacaattattcaaaacactacaattagtaacacaactatagatcaaaatgccaccattgatgaacaaaagactgagtatgatgtcgaacaagaagaaatcactcaagaaatcaaaaacagtaacgaagaagatgaatatgaacacattaataatccttcaaaacaacatgatattcttacttcatccccattaagtaatcaacaatttaccaaacctaataaatttaatgttgctaaatcattattaccattgggtggtcatagaatgtga

SEQ ID NO: 4724 - DNA, 711 bp, Candida albicans
acgcggatcttccatccccgtggtgaagacatcaataactgttttgaattgaaaaacttccctacagtgttggatgacttggaactatgtttgataaacaccgacatcaatggaagaactcctttacattatttgtgtcaatttgcaaagtccaaaaccaagaatgatagcttggtttattatttgaaagttatattgaacaaattaaccattttgtccaatcaaagtcaagtgagacaaatcaatttgatgaaaaacgttttagaccatcaagatgtgcacggtgatacttgcttacacattgctgttagatctgggaatattgatattgtaaagatattgttacagtacggggctatggatgatttggaaaatataaatcgtgaaacagctagacaacttattacccaatgtaatcttataccgaattacacacaagtggacgcagcacaagtggcatatcaaaaccaaatgcaattgggaatgggggactatctgaattacaatgttaataacaatgctatgaatcagaaccataacgaaagtagccataatgttccaattgttcctggtttagctacacctatacaatcaacttttaccaaagtgggaattcttataacgcacggaattacatttcaagaggacattatggacgatgataatgaaagtgttgtgacaagagtgaataagaagcatttagaagcttga

SEQ ID NO: 4725 - DNA, 390 bp, Candida albicans
cttccattatatttattaacggcagcgaaaaataaaccaatattaattgaattaaaatctggagaaacttataatgggaatttaaccaattgtgattcatggatgaatttaaccttacataatgttatacaaaccgattcccgaggtgagaaatttatgaaaattcccgaaatatatattcgtggtatacatattaaatatttaagaattcctgatgatattatgggatatgcaaaagaacaaagtatgataaatatggaaaatagaaatcgataccaaaaaagaagaggtactagcagtggtggtggtggtggtggtggtggtggaagtggtgattcaagaaggtttaataatagacaactgcatggacataattatggacgtagatga

SEQ ID NO: 4726 - DNA, 1455 bp, Candida albicans
aggcacgactttttcaaacttttgaacaacaacaccaaaaaaaaaaaaatctcaacaaaatcaagaacaactccaaaactctttcaaccttgccacgtcatgtctgataccatagcaacaaaagaagaagcgtctaaaatctttgatagattgaagaaagatccagccaaccaagtgtgttttgattgttcaaacaagaacccaacctggacatctattccatttgggattttcttgtgtttgcagtgttcggcagtacataaaaacttgggtgtccatatttcgtttgtcaaatcgtctaatttggactcctggcaacgtattcaattgagaaatttcaagtttggcggaaaccagcaagctaaagactttttcctcaagaatggtggatcgcaatttgttaataacaagaacggagtcgatgcaacagccaaatacacgtcaccttgtgccaacaagtacaaggagaaattaaaacaaaaggccgcacaagatgccgccaagcacccagatattgtcacattggacgacgttactgatgttatgtcattgagcgactctcctagcgaatccactgatgatttcttttccaactggaacaagccagtcaacaactccaatactgcgtcgccattatcttcaagagctgctacaccaaatgcttctacagacgacttgacaaagaagaaacctgttgtgcgtaccactacgacttcagctagattgaagagcaacaatactgcagtcaagaaatcgatattgtcaggtaaaggcaacggaccaagaacttcacgtttggcagctaaaagaattaataagactgaggacgatattgattttgatgaaatcgaaaagaaggccaaacaagaagctgaagaagcaaagaagttggggtacaagccaacagagacggttgagccaactgtgaagaagcaacctactagcacctcattgtcgttgaaaaaggaaaatgaagaagtaaagttgacacctgcaccaatccaagaaacaacccagcaatttcaaaaattagggtttggtatgacacagggtgataacattgtgggcagttctacaaagaagtacaaggaagtcaagtatactggtgaagtttccaacaagtatggaacacaaaagggtatttcatcagacgagtttttcggtaggggacctagatttgacgaacaagcaaagacagaagctagaactaaactacaagcgtttaatggtgcacagtccatttcctcgtcttcgtatttcggtgaagaagaaggtggtgctcgtggtggtcgatcgaatagtggggcaggtgggttaggtgacttggaagcaagtgcaagagaatttgcgtccaagttttctggaaatgccaaccaagacttggaggtgttgaaagatgctttagaggatggtgccaccaagttaggttcatacttgagagatttcttaagataa

SEQ ID NO: 4727 - DNA, 951 bp, Candida albicans
aagaaaaaggtcaagaaggctaaattatcaaaaccaaagcctaaattaaccaaatcgacactggatcttgaagatctattaactcatataactataccacaagatctttcgcttccacccaaatacattcaagatcatacaccagaatttatcaaggggattcaacatatacttaaaattgatccaagtttatatccagttatcgtgcatcagaattttaaaagtttcagcagtttaatttacaccaatgtaactatgaatgagaattacaataacagcaacgacaaggaaaatcgaattcatacttactggtattcactaattcggtcagttattgctcaacaagtgagtggtgcagctgctaaagctattcaaacaagatttgaaggattatttgatggaataccaactccaaataaaacattgaaattcacgcccgaagaattaaagagtgttggattatcaaatatgaaagtcaaatatgttcagagtataagtgaggcatttaatgaccctaataatcatttgactagatttgaattttataaacagtcaaaattagacgacattttaattgaattgtgtaaattaaaaggtattggtatatggtcagcaaaaatgtttgccatgtttacattagaagaaatggatgtgtttgctgaagatgatttgggaatagctcgaggaatggctcgttatttaaataaacgacctgaattgttgaaacaaattaaacaagaatgtatgaatgatgaagaaagtcaattattattgaaacggaaactgaaatttgctaataagactgattctaaaaggaattggacgcctatacatgatgcatatgttaaatatgctgctaagagattcctgccttatcgtagtgtattcatgatgattttatggagattaagttctacaaatattgatgtattagaaaaattagatgaatag

SEQ ID NO: 4728 - DNA, 759 bp, Candida albicans
aaatttcctgcatactctcaacccgtaaacaacacaaaaactatggatttaaaattacccccaactaatccaaccaacccacaacaagcaaagacttttatgaagtcaatagaggaagatgaaaaaaataaagccgaagatttggatattataaaaaaggaagacattgatgaacctaaacaagaagataccactgatggtaatggtggtggaggtattggtatagtgcccacattacaaaatattgttgctacggtgaatcttgattgtcgacttgatcttaaaacaattgctttacatgctagaaatgccgaatataatccaaaacgttttgctgcggtgattatgagaattagagatccaaaaactacggctttaatctttgcttcggggaaaatggttgtgactggggctaaatccgaagatgattccaagttggcttcaagaaagtatgctaggatcattcaaaagttggggttcaatgctaaattttgtgatttcaaaattcaaaatatagtggggtcaacagatgttaagtttgctattagattagaaggcttagcttttgctcatggtactttctcttcatatgaaccagaattatttcctgggttaatttatagaatggtgaaaccaaaaattgttttacttatatttgtttctgggaaaattgttttgacgggtgccaaaaagagagaagaaatttatgatgcatttgaactgatttatccggttttaaatgaatttcgtaaaaattga

SEQ ID NO: 4729 - DNA, 1038 bp, Candida albicans
ctacattcagcttacgtctggtatacgcattggatcaaaatgggcttgtcatctattcttcaacaaattgaaaaaaaggggaaaattcaacagaagcaagttcctgttgagaaaaagtccgatactgttgtgacaaaagataagtttaagaactatagccaagaccgcccaatagatccagtggttgctagattgaaggaaaagcgacgattggaaagggaacaaaaggaaagagaacttagggaaaagaaaggcttgccaccaaaaaagacaactactagtaagcctaagtcatctacttcaaccagatctggaagtcgtcaaccttcttctcaaagatcccgtactctgtcgccatctttagcaccacagccaccacaaccaccacaaccacctaaaaagaagttaaattataatgaactattaaagaaagcagctaccatcgaccacaacaaactatcgataaaccttttgcagaaaagcaaatcaccagaagcaaaatctaagccattagacactaaatcgggcccagcaccacgtcaaagtacccagaaaccaattggcaatcctcgtcatacgtcccctccaactactgcatatccacaaaaaccacatgtgaaacctattcctcaacgggcatcgaaaccagttcctgtgatcaaggcacctttgccaccaagacagccatcatccaaaataaaacaaaggcttgaagaaaagcgcaagtccagatcatacgaagaggtagaagaagaagacgatttgagtgattttgtcgaggacgatgaagaatacgacgatggttatggtgcagatgaaatcaacagagaagaaatttgggcaatgttcaataaaggtaaaaaacgttcaatgtattacggtgacgattatgattcggacgatatggaagctactggtgcagagatttttgatgaggagtaccagtcaagattagatgctgagagggaagatcgccgagaaatggaagaagagaagagattgcaagcattgaaacgaaaaagattaaataggagttag

SEQ ID NO: 4730 - DNA, 1179 bp, Candida albicans
ttccccccatactcaatgagcaaccagagccccaatttacatcaccgaaagctattgaatgatgttaatataagagaagaactgccactgagaaagaagcggggatatcagaagccagagacaattcccgtagatgatacatcagattccgaagaatttgaagacgtggacttgaatatacttgacgactccgatgagtttgaaaccattgaccttgaaaatataccaaaagaatcaggtaatgatacattggttatacgaatagacaacaataagaaagaggaaaagactccaaaaaacttgataagtcgtgaagaaagacatcgacgcgtcctacttcacaaaatgtacttggtaatgatgttggtacatggaagcattagaaatttatggtgtaataacaaagaaatagcgagaagcttgaaattatcctgtgtgacacctcagattacacagttattggagaacaacacaaatgctctggaccaagtcaagtcacggagattacttgatggattaaagaaattgatgacaatatttctggcgaaattcagaatcatctcacagggaattataagaaaggattgggacgagcttgaattgtcccagaaatcagatattgttggcaaaaggacttttagaaagttggcttgcaatttcagagggagcagagatgtcgcagcacaaacatttgtaactctattgcgagggctaggcttaaatgccagattagtgttttctttacagccgccagattatacgaagataactcacggaccccacccatctggccatgagaagagtggtacaccaaaaagaaaaacaaaaactgccggatttcaggattccgaatatcctgtattctgggttgaagtttggaacaagtacacacgtcaatgggtcagtatcgatcccatagtgatgaagttaattgaagtatgtcctaagagaaaaaagtcgccattcgagccacctcctactgatgagcgaaaccagttaacctacgttgtggcttttgataaattcggacgcgttagagatgtgactagaaggtacagctataattacaacgcgaaaactattcggaaacgaattgaattcaggtcaagcgaagataaatcttggtatttgaaagttctacgctgctgtgattttaaaaagactcaaaacgtagctgac

SEQ ID NO: 4731 - DNA, 774 bp, Candida albicans
cgcaatcgcggacggccatggcgtggtgaaaaagcaaaagcttggtgtatgataggaaggcaattaaaagtcggggcaattcctttgaaatcaaaagaagaagatgtacgcttatatgcagagtttcaaacgcagttgtacatacctccacccgtgactgatggcattgttcctaaaaatcaatatggaaatatagatgtttacacgaaaacaatgttacccgagaactctattttgatagagtgtgatgaaaactgctcaatgaatatgcttcagaacgcagctaatctcttagctatcgattatgctaaagcaattgtttcgtttagttttaaagggaaaaagaacaaacataatatcactgctacagaaggaggtatagttattgcaaaagaatatgaggaggcaatgcagctcacaatatacaaccttattgaacaagaggaggaagaccaacgggcattatcagaagcaaatgcattaagaaattggaaatactttttgttaaagctaaggttagaatatcgtttgaataaatcacatggtgcgattttagacacgccaggcacagaagaactgacctcaaacgaaaatcccgaaggcggtgggttcgttgtatcagatgaagaagtagatgagggcggatttattgtttccgacaaagagccagaggaaggtggtttcattgtttcagatgaggaaccggaagataattccgtagatgtcaccagtgaggaatattctgatatagattttgaatacgaaagcgattaa

SEQ ID NO: 4732 - DNA, 894 bp, Candida albicans
  unsure (741): Identity of nucleotide sequences at the above locations are unknown.
ctcggatattcagcgcctggcgaagttgaaaaacaatacgaagctgttagattagaaaaattggccaaataccaaggtgtcaacttgtttgttaagaatttggatgacactattgattctgaaaaattagaagaagaattcaaaccatttggtaccattacatctgccaaggttatggttgatgaagctggtaaatcaaaaggttttggtttcgtttgcttcacaaccccagaagaagccaccaaggctatcactgaaatgaacaccagaatgattaacggcaagccattgtatgttgctttggctcaacgtaaggatgttagacgctctcaattagaacaacaaattcaagccagaaaccaaatgagaatgcaaaatgctgctgctggtggtttacctggtcaattcattccaccaatgttctacggtcaacaaggctttttcccaccaaatggcagaggtaacgctccatacccaggtcctaatccacaaatgatgatgagaggtagaggtcaaccattcccagaacaatggccaagaccaggtccaaatggccaaccagttcctgtctacggtattccacctcaatttcaacaagactttaacggtcaaaacatgagacctcagcaacaacaacaacaacaaccaagaagtggatactatccaaaccgtaaccaaaccagcaagagagacttggctgctatcatttctagtgtgccacaagaatcacaaaagagaatnttgggtgaagaattgtatcctaagattgttgctaccggtaaggctcaagaaccagatgctgctggtaaaatcactggtatgatgttaggtttagaaaaccaagaaattttggatttgttagatgatgatgaattgttcaataaccatttctaa

SEQ ID NO: 4733 - DNA, 531 bp, Candida albicans
tccgtaatgtctgctgctgaaactaatcaacttcaagaatctatggaaaagttgaacattggttcaactactgaagaacaatcagctgctgctgctactaccactgctgatcaatcagctgaagaacaaggtgaatcatctggtgttgccgagaattctgcctccttgtacgttggtgaattgaacccatctgttaatgaagctaccttgttcgaaatcttttctccaatcggtcaagtttcctctatcagagtttgtcgtgatgctgtctctaaaaaatctttaggttatgcttacgtcaactaccacaagtacgaagatggtgaaaaggctattgaagaattgaactacaacccgatcgaaggtcgtccatgtcgtatcatgtggtctcaaagagacccatctgctagaagatctggtgatggtaatattttcatcaagaatttgcatccagccatcgataacaaagctttgcatgacaccttttctgcttttggtaaaattttgtcttgtaaggttgccaccgaatga

SEQ ID NO: 4734 - DNA, 2121 bp, Candida albicans
  unsure (1837): Identity of nucleotide sequences at the above locations are unknown.
ataaaattatgtagccccccaaaaaaaaaaaaaattttttataactcaccaatgaagttctttattgacgacttacctgtactattcccataccccagaatatacccagagcaatattcgtatatgtgtgatatcaaaaagaccctagatgtgggtggcaactgtatattggaaatgccctcagggactgggaagacggtctcgttgctttcgcttacggtggcgtaccagatgcattatccggagcataggaaaatcgtttactgctcgcgtacgatgtcggagattgagaaggcgttgattgaattgcacaagttgatggagtttagggccaacgagttgggagaggtggaagattttcgtgggttggggttgacaagtagaaagaacctttgtcttcacccgacgatttcaaaagaacgaaaaggggtggtggtggatgaaaagtgcaggagaatcaccaatggacaactaaaggaaaagattgaaaagggcgtgcctacagaggatagtttgtgttcgttccatgaaaagttgtacgatttagagcctcataatttagtgccgccgggagtctactcattcgatgcattgatcaagtattgcaaggaagaaggaacgtgtccatactttacagtaagacgaatgatcccgttttgcaatataatcatctattcgtaccattatttgcttgatcccaagattgctgaacgtgtttcgcgtgagttgtcaaaagatagtattgttatatttgatgaggcgcataatatcgacaatgtctgcattgagtcgttgtcgttggacttgactgatgagactttgaagaaggcgtcacgtggtgccaataagttgggtgaggccattgaggatatgaaggcgcaggatagtgaaaaattgcagaatgagtatgagcagttggtggaagggttgcgacaggccgagattgcacgagaccaggaattgtttatggcgaacccggtgttgccgcaggacttgttagatgaggctatacctgggaatattcgaaagggtgaacactttattgcgtttttgaaacggttcattgagtatttaaagacgaggatgaaggtgttgcatgttattagcgagaccccaacaagttttttacagcacttgaaagagttgacgtatattgagaggaaaccgttacggttttgttccgagaggttatcgttgttggtgagaacgttggaggtgacggagattgacgactttaatgcgttgaaagatattgctacgtttgccacgttggtgtcgacgtacgacagtgggttccagttgatactagagccgtatgagactgaggggagtactgtgccgaatcccattttgcattttacgtgtttagatgcgtcgattgcgatcaagccggtgtttgacaggttttcatcggtcattattacgtctggtactatatcgccattggacatgtatccgaagatgttaaaatttgaaactgttatccaggaatcgtatgccatgacgttggcgcgtcgctcgtttttgccaatgattgttaccaaagggtctgaccaagtgtcgatatcgtcgaggtttgagattcggaatgacccgtcggtggtgagaaactatgggtcgttgttgattgagtttgccaagatcactccagacggtatggtagtgtttttcccgtcgtatctttacatggagtcgattatttcgatgtggcagagtatgggggttttggacgaagtgtggaaacacaagttgattttggtggagacgccggatgcgcacgagacgtcgttggcgttggagacatacagaaaggcgtgttccaaccgaagaagggcantgttgttgtccgttgcgcctggtaaagtttctgaacggattgattttgaccaccactatgggaagaccgtattgatgattggtataccattccagtacaccgagtcgaggatcttgaaagcgagactagagtttatgcgagaccatttccaaatcaatgagaatgactttttatcattcgatgcgatgagacatgccccgcaatgtttggggagaattttgaacatggacagacgattatgggattatgggtttgggccgatcgaaaggtctgcactgaagtaa

SEQ ID NO: 4735 - DNA, 564 bp, Candida albicans
agacaaggaggattgggatatattgacaccgaaggtactttcagaccagatagaattagatcaattgcagaaaggtatggtgtggatgctgacacttgtcttgaaaacatctcttatgcccgagcattgaatagtgagcatcaaatagaacttgttgagcaattaggtaatgaattagcagaaggtactttcagactattgatagttgattctatcatggcatgtttccgagttgattattctggacgaggtgaattaaacgaaagacaacaaaaattaaatcaacatttatcaaatttaactagagtcgctgaggattataacattgcggtatttttaacaaatcaagttcaatctgaccctggagccagtgcattgtttgccgcagctgatggaagaaagccagttggtggtcatgttttagctcatgcctcggcaactagaattttgcttagaaaagggagaggtgaagaaagagtagctaaattacaagatagtcctaatatgcctgaaaaagaatgtgtttatgttattggtgaaggaggaattaaagacaccgattga

SEQ ID NO: 4736 - DNA, 711 bp, Candida albicans
attcatcacgtggcgaacatcaatttaaacaaacaaagaaacgaatcgattcataaattggtcaattgtaaacgaaagaaaatcaaatgtaatagacaacaaccatgtgtatcatgtattaaatcaaatttagaatcaatatgtgaatatcaacaacaaaaatggttagcaactcctaataataagaataatggtatttttcaaattcaacgattgaatgatgataagataaatgaaagttgtcaaaataaaaaagatgaaatagtaataccactactacggaatcaagagaaagaggaaaagaatgttggtgatggtgatgggttatcacaattgaaattattgaataatatattgaaagaacctataaataataatgaaaggaatgagtttcatgaatttgaacacgaaaatattggaaatatcgaatcagagaagtatcttctgggtttatttgaaaatttcattaaatatcatgaacatttattagagaatttggaattgattcttggtatacgaaataaaatagagaaaatatcacaattggaaccattactttttaaatttgagatttatcttgatgaaaaatacccagaaatcaagcatcacgaactcattaatacatctgaaaatgaggtttctttttcttcttcatcattaagtcccaataagattaggaattatattaatatgaagatgattttacatatg

SEQ ID NO: 4737 - DNA, 744 bp, Candida albicans
  unsure (662): Identity of nucleotide sequences at the above locations are unknown.
ctttgtttactttgttacacaagttttacatatactacaacaacttacaaaaaaatggagttaactgttgataacaccaatactacttccaatatagatgatttatctgttgctacaccaacttctttaatgacaagtactactacatcaccatcaatgtcaacatcaacaagtagtcatagcaacactttagatatagatccagctacttttaaatcaactttgccacctaggaaaagagccaagactcaagaagaaaaggaacaaagaaagattgaaagaatattaagaaatagaagagcagctcatgcatctagagaaaagaaaagaaaacatgttgaatatttagaaaactatgttttaaaattggaaacaaatttaatgaaattgaataataattataatcaagcatttgaattattaactaaagataatcaggagttactattgtctaaacttgaagttttagatgatgtttctgatttaaaagaacaaattcattctaatatgagtggtacaagaaggtctcataataagaagtcaaatgatgaagacatagaagaagaagatgaggatgaacacctagaagaaggtcatgttgaaaaacaagaaattaaaaaggaagaaccagtttctaaaaaaaggaaacttaataccaaaantaaatttaaaacaaaaacaaaaagttccaacaaaaggatcacgtctacaccactattatacacgccggctggaagatatcat

SEQ ID NO: 4738 - DNA, 1416 bp, Candida albicans
atgcacataactaagataaatgggaaaatcgacaaagttaatgaaaaaatgaaatcaagcaaggatttgatatttgctgaattttgtgaaaaatatggttttattaatggtattgaagattatgaaaacatgcatggaagcacattaagagtgagagcaaaagaaagagctcaattctctaaaaccatttccgttttacaaaacaaattggatttcgaaaaagaaagattgaaagaaaccaaagatcgaagaaaaagtattgaaagtttgattgttgatttagaagatgatttagcaaaagtattaacagaaaagaagaaattagaagaatctttggataaagaagaggctgaatatgaagtgttgcaaactgaaatatctcaatttgatgatctgatgcaatctcaattgaaaacatcgaagtctattgaaagcgatcttgacgatagtaaactgctagtttccactttggttaaggagattactcaaatagaggaaaacttattgaaaacagattctgaaagagcaaatgttttaaggaattgtaaaattcaaaatatcaatttgccgttgattgatggggatttggatagtatttcagtaggtgaaaacttggaaagctccataaaggaagtctataaaatagaacttgattatgaaatgctagaagagagatttaaggaagtttttaacaataaactcgagagtgaattagaagtcacattacaaaataccattagtgacttggaaaaattgacacctaatgctaaagccatagaaagattgcgtgaagttgaaactaagttacgaaattacgataaagaatataacgttgccagacaaaaagagcgacaagtaatcgaacgtttcaaaaaagtgcaagagaaacgttatgataaatttatggatgcatttaatcacatttctggttgtattgattcaatctataaagagttaaccaaatctgccatgtcaccattaggtgggtcagcatacttgacgttggaggatgaagatctgccatttttgtcgggtataaaataccatgctatgccaccaatgaaacgattcagagatatggaattgttatccgggggtgagaaaactatggcggccttggcacttttatttgctattcattcctatcaaccttcaccattttttgttcttgatgaaattgatgctgctttagataacgccaatgttgctagaattggaaattatatcaagaaatatgctgggcctaattttcaatttattgttatatctttgaaaaattctttatttgaaaaatcagatgcgttggtaggtatttatcgtgaacaaagagaaaacagttccaagactgtaactttggatcttagagaatatccagatgatgatgttcctttgagtactgtcactgccactacatag

SEQ ID NO: 4739 - DNA, 2379 bp, Candida albicans
acatctacatcttttcattgtattactcgtgcgaaatcccaatccgaaacttttatcatgggtagattaataggattagaactattcaatttcaagtcttataagggcaaatccattattggatttggctcctcgtactttacatcaatcataggacctaatggggctggtaaatcaaacatgatggatgccatttcctttgttttgggggttaattcttatcatttaagatctcagaatttgaaggatttgatttacagaggaagaagaaatattgacactgatagtactacattagatgcaattgaacaggatcccaccagtgcttacgttatggcgacttacgaaaaggatgatggagaaattttgaaattaaagagaaccattaccgcttctggaaatagtgattatcaaataaatggtcaatcagtgacaatgttgaattatagtatggttctaaaacaggaaaatattttgatcaaagcaagaaactttcttgttttccaaggtgatgtagaaacgattgcatctcagaatccaaaagatttgaccaaattgattgaaaccattagtggctcgaatgaatacataaatgaatatgaaagattgaaagaagaacacgaaaaagcccacgagttgactacttcggttttctcaagaaagagaacccttaattccgagtcgaaacaatataaagagcaaatggctgaacaacgtcaatttgaagagaaaattattaccaaaaatgatactgtcaaaaagatcaatttgtataagcttttccataatgaaaagaaacacaatcaattaaaagatgaaattaaatcaaaaaacgaggagttgaaacttgctaagaaagagttatcgaataaggagaaaacatacaaatccataatgacagattactcaagcagtgttttgaatgccaaaaagcaaaagcaacaaacagaggcagctcaacagaaaatcgactcaacgaaacgtgaattaattccagttgaagctaaccagagatcattatcgaataaaatcaatttccataaacttaaggttggtgacttggtaaaggatattgctagacaaaagacgcaagtttcctcagtggaaagacaattgagagatgctcaaagaatgtttgatgattttcaagcaaaaatagctgcagctgttgcatcatctacgaatatttcaccagaggcccagaaagagtatgaagagttgaggtctaagtttttagcagagaatggatcagaactagaagagcagatttcgttgttgttgaacaataaggatagtttgaactcagcaaagtcaaatcttgagaaccagaaaactaatgctgaaaatagaattgcggaattggaatccattgtagccactgacttgaaatcgaaattacacgatgtttccaatgaaatcaatgaagtgcttgacaaaaaaagtgacaaagtggaagcacgaaatgctcttattaaacagaaagatgaattcaaccacgaagaactaaaattaaacactaggttgagagatgtcttagttaagctcgacgagttagcttcccaacagagagaatcaaacaaacaaaaaaagttgagagagaatgttgctacattgaagagacttttcccacaaggtgcgattaaaggtcttgtatacgaattagttcgtcccactcaacaaaagtatgagtcagctttggcaacgttgttaggaccaaactttgacagtattattgttgaatcatctgcagttgcgtataaatgtattgatattttgaaagagagaagagcaggtgttgctacgtttattcctttggattcaatagaaactgatataatcaatttaagtcacctcagatccattcatccttcggcattacctggtgttgatattattgagtaccaagataaatctttggaaccagcagttaattatattattgggaacacagttgttgtcgatactattgacacagcaagaaatttgaaatggcaatccaatacccgttttgacaacaaaattgtaacattacaaggatcagtgattcacaaatctggtttaatgaccggtggtcaacagcaacagaaatcatcagcaagtttaagttggagtaaacaagaatggactaaattaaacgaattgaaagaagagttgaatcaaaaaattttcaaattacaagaaaaaagaccaaaagatttagagattaatttattagcagaagaaataggagcactagatgacaagttgccagtgttgcgtaatcaaaagaccagtattgaacgaattatcaaagatagagaatctgaaattgaattccaaactggtttatttaaagggtttgataaatccatacaagagaagatgaatgcacataactaa

SEQ ID NO: 4740 - DNA, 2481 bp, Candida albicans
gaaatacaaacagaaaatatattttggttgcaaagattttcttttataccctctagggtagttgttgaaatggctttggcatcacaattatcagttactgacgatagtgcatacgggtttattacaataaatgccgagatagtctcaaagaaacgcaaattggctcaaaatgacgacaggtttgaggtagtaatgtcagtatattcaccaaaagccgactccatggatgtgggtgtttctgttctaaaattgaagactctagaactcactctaatgagtttttgtgactccctgacgtttgtgagaacagttaatcaaatacaggtatacgaaccaactagtattattttacctgaggctcagtcacactctcaaattgagaaactaaaatacattatacattcaaatatatcagataaagtgagagaacgttttatgaaggcaaaagctttcaatgcttttgatgggatgaatagcctaaagctatatacagatatcaatgaatccactttaggacaagtaatttctaacagaaaattgtctttggctgctgcaaatgcatgcatcgactattgtgtttcgacaaagatgtttcgggtaacaaataagattagattgaagtactgtatgtgtgagaatacaatgttgattgatacatgtacggttcgagatttagagttggttgatagtttgtcagaaacaggtacaactttgtattcgtttcttaattgttgtctaacaaaaatgggtatgcggatattgagaacatcaatcttacaaccatcaacccacgagaatagcattatactacgctcagagtctgtacaggagctaatcaatgatgaagatgcactcattagtatcagatctctgttaaaacatacttgtgatttggaaaaggttttcagcacgtttttagaacctcgaggtttgttgagccaggagcaagagataaacaatatcattttactaaagactgtattgcaaaatacatttgttataaggaagagcatacagaatgtgtctagtcatttgttagtacaagtgaaacaaattcttgagcatgaaaatgtccagcacttgctagcgataatcaatgaatacatccgcaatgattgtcagtgggcaaataacagcacagagcttgccaatcaaagagcaaacgctgtaaagtcaggggtcaatggtttattggatgtatctagaagaatccgggagactttgttggaagaagtttccgaattggtggccaaactttcagaagagttggaaatattcatggaatataggtttgaaatatctagaggatttttcatcaaaattaaagggaataacactgatatcaactcgttaccagaagttttgattaatagagtgaagaagagaaaaaccattgaatgcacaacaattgaattgatgaagcaaagctcaagatacaacgacattgtttctgaaatcaccactttgaatagtacaatcatacacgatatgtacactagcatcaacagctacacaccaatactattaatggtttctgaagcaattgggactttagatcttttatgttcttttgcctacttcaccagtttgcaaaaagactcttatacctgtccagaatttgcaaaagaggttactataatgcgatcactacaccccattctcggaggcaacaattctaactttgtagcaaataattattcgtgcaaccatgagttatctcgcattcatgtcattactggagcaaacatgagtggcaagtcagtttacttgcgtcaaattgcatacttggtgattatggcacagatgggttgctttgtccctgcagaatatgctagaatgagaattttcaatagtttgtactcacgaatatcctccgataatgttgatataaatgcttccctgttttcaaaagagatgagcgaaaccgctgttattctaaatgatctggatggggacagtttaatattgattgatgagctaggaagagggtctagcttgactgatggcttttcgatatgtctagccattttggaggatttgatatgcaaagaagcaacagttataacaacgacacactttagagatatagcacaagttcttgccaataaatcatgtgtcgtgactgcccatatgcaaacagtggaaaccaacgggcaattagagatgaagtataatctggtattagggcgtaatggcattgttgggtatggaattcgattcgccgaagtttcaaacttgttaccacaagaactaattgaagactcaaaggtagttgccaacattttgagatctcgaaaacctgtccatggagataaagagttgaagctattatcacgaaggagaaaactagtgttggaattgtattttgctttgaactatatttccaaattgaattgtgacatgaactataaaatgcagctattgcaaaccctacagtcaaaatttgttgaagaaataaatatcacacctaatactgaatag

SEQ ID NO: 4741 - DNA, 489 bp, Candida albicans
atttctgatagattatataaacccgatagtgatggagatttaccagaaccagttaaacgaggacatatgttatcgattgtattatcaccaacgagagaattagctaatcaaattcaaagtgttttcaatcaagtattacaatatttacctgaagataagggtacccgtattaacacacaattattggttggatctataggtaatgttcgagaagatttaaatcaatttttaacgaatcaaccacaaatattaattggaacttcagggagaatcttggaatttttaggtagttcacaatcaattaaaacatcatctttggaaatagttatcctagatgaagctgataaattattagatttcctgtttgaaaaagatgtgatcaatatattgaaaaaattacctaaacaacgtcgaacaggattattttcagcaacgatatcttctgcaggtaatactattttcgtcttcaccccgcggtggaaaacaacg

SEQ ID NO: 4742 - DNA, 315 bp, Candida albicans
acatacaaaaaagttttttttttttttttggcaaacctcccatcccatctcaaactcatctctctaatacaaccaaccaaccaaccaacctacctaccaattatgaaatcaaatactgaatctcttgcatgggagaatttacgttatgacttgcattcatggatcaaagaagctatatcttcaatgggtattcccactatgactccacttcaagcatcgactatcccattattgagtggtaataaagatgttgtagttgaagcagtcactgcatcagggaagacattatcatttgtcatccctgttttacaataa

SEQ ID NO: 4743 - DNA, 384 bp, Candida albicans
ggtgaaggatgggtacgtgaaattatcgatatggataaatatagttatgctgataaattacaagagaaaattcgattagaaaatttagagaatgataaattgaaaaaaattcaggatgcaaaaagaagaaaagaattaaaaattaaaaatgaagcttggtcaagtaaatcagaaagaaaagaaaataaattagatcgtaaagaaaaattgaaaagaaaacgtgaagccattgaaaaacaaattatggaagaagaaagatcaaatggtggaggcaacaaagatgaggaggatgaagttgttgaagattggaaagatatggttagaaagaataaaaaaaagcaaaagaaaaataattctatacaaggttcatttgatgatttataa

SEQ ID NO: 4744 - DNA, 1233 bp, Candida albicans
aattctatctatacaccagatcatctcaattcaataacaacaataacttcaatgtttggaaataaaccagctacatctggaacagggttttcttttggtcagaccaaccaaactgctgcaaatggaacaaaccagacctcacaacaacaacagcaacaaccagctgtaaccattggatcaacaacacaatcagtaatcaaccctccaaatggtccaactaccggaacaacaacaaacttttctcttcctgtatcagtaaacacttcgaatagctctaaattattgaaggagttattggaatcagccaacaatttaccgaagactaatgacaacattcaattgggatccattcaccttactttgaatgaattagaaagaaaatcacaacaattaaggaaacaatcagaaaaagataccaatttcaccaaagcccattacttattggcaggtagtggaatcagtgctgatgatattgaagatgaattaaatgcaatccatatacctaaaactggtgggagaataccaagccatcgtgccattgttggtgcagaaaatattgaaaattatttaagtgccaagaaggatgaaaatattttaaacaccattgaacaatcattatcattggcatcaaaagattttgacaactacattgatgccaacatatccattgattggaaagttagaagagatgaattgagaaaagcagttggtttgaaaacaaacactaaattcaatgaagaaactttgaaaaattccattatttggaaatcaaattctgctgcttcaaacattttaactccattaaatacttcttcttcttcaatcagacaaatttcaagagaaaaatttgaaaatcaagccaaaattatttattcattgaatgaagcaagattacaaaataaaagtttccccttgtgtttaaatttcaatgaagttaataaacttcaaaatgatattaaagctaaacaaattgctgaaatttggaaaattttgatttctttaactggtgaaaaaaccgctaaaacttctcaagaacaaaaatttttcaatactaccaaagcagatcttaatgctataattgtcaccaacagtataacttatttgcaacaagaatttttcaattatattgatgaattatatcttaaagatggcgataaaccacagagttttgccccaccaacaaatattaataaagtatcttatttggttcatcaaaattgtgttgaaaaatga

SEQ ID NO: 4745 - DNA, 1839 bp, Candida albicans
cttatttgcaacaagaatttttcaattatattgatgaattatatcttaaagatggcgataaaccacagagttttgccccaccaacaaatattaataaagtatcttatttggttcatcaaaattgtgttgaaaaatgaccccgatttgatcaacaaaactttattggttaatggaactcctattggggtatggatctgttatcttatacgtgctggattatatttggaagctgacgaattggttcaacgtaatcgtgaacagttcaacaagtttgacaaaaatttccctgtttacgtaaagagttatgtggaaaacactaatcacgttttaccttcagatttgaatgaaagattacacaaagaattcaatcaacaattccaattcattattaatgatgtggataacaatgtgaactacgatccttataaatattctgtttataagattattgggaaatgtgatttaagtaacaaatcattacctcgttcagtgaatttaagtattgaagattggacatggtttcatttatctattattaatgctaatcaaccgggatctgaatctaatttaatttttgaaaattacactttatcagatttacaaaataaaattattcaattaggtcctaaaaatttcatgtcatctccaaataatccattatatctcaagactttaatcttgactggactttacgaaatggcagtacaatactcttatgagtacgtaaatgaatctgatgcagttcatttggctataggtttagcttattatggattattgaaatgttctaatttcaacaaggacaatattttgactgtcaataacaatgaatatgaaatcaattatggaagattagttggggcatataccaccacttttaaaataagtgatccaaaagttgcttgtgaatatctcattatgattgccttagccaatggaggtgaatctaaaagtgctcttcttgtttgtcatgaagcattacgtgagttgatattgatttcttgtgaatttggtgtattacttggagaattaaatcaaacgaatggaacaaaaataccggggattttagaaagacaacggaaattgattaaattggaaagtttagatcaattttatcaacaaattattgaagttgctgctaataaatgtcaagaagaaagtagaatctttgatgcattgttattatatcaattatgttgtgattatgacacggttgtttctttgattaacaaattattagcagaaatacttgccactactgatttgaataaacctattattaaatcaggtaattatgaagctatatctacgggatatattactaaagaagttgatgacaccattgacaataatattattttattggctcaacatattatgaaagttttcaataataatagtcatatacttggaaaattatcatctaaagtgaaacaaacatcagagttattacttccaataattggaattagagatttatttatcaaaaaagattggcgtcaggttatcaatgacattaatcaattaggacttattccagttggggttaatgatgatcttattaaaattagaacaatgagtgaatcaatacaaaataacgatttagatgataatttaattaaaattattccatcattattaattatggtaatgaccagtatttctcatataaattataatattttaactaaaaaatatcaatcttatggtaatgaaaaacaagaattgattcattggaaaaaaattgctaaaaattgtatgatttatgctggaatggttcaatataaaatgcctagagaaacttatagtctattaattaatttggaatcactgttataa

SEQ ID NO: 4746 - DNA, 2469 bp, Candida albicans
atcaaactgttttcgataatcaagagaatgaatataaacattcaaattcaggaattagtacaattaaaggaagaatatgctaataaacaagaattattatcaacattatctacggggatttcatcgactgggaatgtcacttctgggtatatcacccaattaaatgatgtgaaactgaaattaaatgcttcagaaaatttcattaaaacatcaactctcaagataaatcatcttcaacaacaaatggaaagtgatcaaatgaaattgactaaagcgaaaactgaaaatgaaacattattatctgccattgaacttcatcgtcaattcattaaaactaaacaattggaaattgattcaaaattaggatttgaaccaacgaaaatccatcaacttcgagatcaagaatcagaattaattagtcaacaaaataaatttaatcaacaattaaatcatatgagacgagaaattgggaatttagatttccaatataatcgaccttcacgggattttaatgatcaattagtaagaggtgttgtagctcaattgttcaatttaccagaaacttctcatgataaggcattagcattacaagtatgtgctggtggtagattatataatgttgttgttgataccagtgatgttgcttctcaattattagaaaaaggtcaattgaaacgaagagtaacaattataccattggataagatttcttcacgtaaattagatcatcaagtcattgattatgctaaacaagttgcaccggggaaagttgatcttgcccttaatttaattgattttgaagatgaattatacaaggcaatggaatatatttttggtacaacatttatttgtaatgatcctaattcagctaaagcagtgacgtttgatcctaaaattaaaagtcgatcaattacattagaaggtgatatatatgatccagaggggaatctttctggagggtctcgaagaaataattcgacaattttattaaaacttcaacaatataataaattaaccatacaattgaaaaaaattgaatttgaattacaaaatgtaaagcaagaattatcaagaatggattcattaattagttccacaagaactattcagaatgaaatcaatttaaaacgacatgaattatctttattagagaagaaattggaaaataacccggcagcattaatattgaaacaaaatgatttaaatcaactagaaattattagattgactgaagaaattgaaatcactaaagagaaatgtcgtcaatataaacaagaaatcgccattattgaaaaagatattgctgaatttaataatgataaaggatctaaaatcaattgtttgaaaaaagaaatggcccatttgaaacaacaagttatttccaaagaaaaacaattagaaaatcaaacggataaattccaagcagcacaaattgatagtgaacaattgaaaattgaattacaaaataaacaagaagcattaatatctaccaagaatcaaattgatgaattaactcacaagatcaaacaacaagatcaaaccaaagaacaattgattgaacaattaaccttggttaaatcagaattagatgatgctcgagctaatttattgggattagatgaagaaatcactgaattaactaatattgttaaattgaaaattgaaaaaatgacaatgacaaaattagatatacaaaaattaactcatgaattagaaaaatcacaaaatgtcaccaagaatttgaaaactagattagatgaaattataagtgaacatgaatgggtcatggataatcaaatggtgaataatatcatggatcaatatcctaacattgatattgaagaaactcgagaacaatgggaattattacaagagaaattctcaagtatgagacgcaaagtgaatgttaatattatgagtatgattgaaaatgttgagaaaaaggaaacatcattgaaaaccatggttaaaaccattgaaaaagataaaaataaaattgttaataccataaataaattgaatggttataaacgtgatacattaaatactacttatcaaaaagtatctaaagattttggtgccatttttgcagatttattaccaggatcatttgctaaattagttcctatagatatgatggatgtaactaaaggtcttgaagttaaagttaaattaggtcaagtttggaaagaaagtttagtagaattatcaggtggtcaaagatctttaattgctctttcattaattatggcattattacaatttaaaccagcaccaatgtatatattagatgaagttgatgcagcattagatctttctcatactcaaaatattggtcatttgattaaaacaagatttaaaggatcacaatttattgttgtttcattaaaagaaggaatgtttactaatgctaatcgagtatttagaactagatttcaagatggtacatctatagtatctgttatgtaa

SEQ ID NO: 4747 - DNA, 903 bp, Candida albicans
ccaactagccaaatgaaagtcgatgaattgataatagatggatttaaatcttatgctgttcgtaccgtgatatccaattgggatgcacaatttaatgccataactggattaaatggatcagggaaatcaaatattttagatgccatatgttttgttttaggtatagcgtcaatgtcgactgtgagagcttctaatttacaggatttaatttataaacgaggtcaagctggtgttactaaagccagtgttactattgttttcaataatagtgaagtatcaaaatcacctattgggtttgaaaattgtcccacgattagtgtcacaagacaaattattcttggggggacatcgaaatatttaattaatggtcataaagctcaacaacaaaccgtattaaatttatttcaatcagtacaattaaatattaataatcccaattttctaattatgcaagggaaaatcactaaagtattaaatatgaaaccactggaaatattatcattaattgaagaagctgctggtacaagaacttttgaagaacggaaagataaagctcaaaaaaccatggccaagaaggaagcaaaattgacggaaattcgaaacttattatctgaagaaattgaacccaaattagaaaaacttcgtaatgaaaaacggaattttcttgaatttcaacaaacgcaaattgatttagaaaaattatcaagaattatcgctgcttgtgattatactttattatcgaaaaatttcactcatcattcgaaatttttaaatgatcatgaaaccaaaatgaataatttacatttagaagtggataaattgaatcatgaaattaaaaatttgaatgaagatttagatcaagttaaatcacgtaaggtcttcaccacggcgctggaaggaccc

SEQ ID NO: 4748 - DNA, 711 bp, Candida albicans
caaggtcatacaagcaatgctaccacggtcaatggtagtggtaaaccatacaagtcaccaattacaaaaaatggcaagaattctcaaaagcaggacttttcttttacaaatcagtttgaaaagttaccggaatctacgataactgtgaaaagtgaaccaatggaaacatcagtagaaccaccactagcaccacaaggacaacaacaagatgacagtaatccaatgttacctccaaatggtaaaccggttgaaataaccggagctccattaatggggttcactatgggtaaactagctgaaggtggagccggaacagttgctgataaaaagctggccaaaaaagcaggtgctaacaatggcaaactatcacgtaaaccaagctattcaaaaaacaggaattcagtatcttcaagctccgatgaatcatcttccacttctgcttcaacatcaccaaaaatgctagcaaataatggtaccaactccagtggtaaaagatctgaaaagccagcaacaaaaaaggcttcccataagttagcagaacaagggagaagaaatagaatgaataatgcagtacaagaattgggaagattgattccccagagttatcacgatgaagtaagtattccttcaaaggcaacaacagttgaattagcctcgaaatatatcactgctttattgaaagaagttgaggagttgaaaggaaggaagtaa

SEQ ID NO: 4749 - DNA, 840 bp, Candida albicans
tctgttttagaacaacccaatgaaaagtatcccgtttctggtcaacaccagaatgtatctgaacacgtttccgaaaggctgaaactgcaagtacataatcatggtttttttgttggtaagaaatgtgatataagttgtaaaaatttggaaatgaacgacactctttcagaattaccacaaaagacaaccttccatgaaatacccgagaattctgatatattcaattacctacctgactcagctagcggaaccaaaacctccataactgaaaataccaatttacggcaattaaaccaactgcaaaacaatgcttcagagctgagtagacaccagtatggaagcacatcttctttagtacttgctacagaagtgctcccctacaatcaaaggtctgtctttccatttaatcaattcaatgagatgcaatcaaaagcttttagttcaatttacaactcgtcaaacaattgtgtgatcagctctcccacgggttcgggaaaaacggttctctttgaattggcaattttaagagagctagaacaagaatttgaacccaatttcaaagttctttatttagcaccaacaaaagctctatgcagcgaaaggttaaatgactggacgaaaaagttctcgtcgttaaacatcacagttggaattttaaccggtgacacaacttttaaagaggcggagaatgtaaggaaatcaaatattatagtatctacccctgaaaaatgggacatgataacaagaaaatggaaagactactctaggttatttgggttaatcaagatattgcttgtcgatgaaattcacatccttaaggagctgaggggtccactctag

SEQ ID NO: 4750 - DNA, 906 bp, Candida albicans
gacgtagaattgtccttgccgccgccgtgtgtgaagaacaaaaattttatgaatcatacagaagatttcgaatttagtgacctggatgatgataacttgtttgatattaaaccagcaaatcaaaacgagtccaaaattattgagttccgcaatgagacaaaggaagatgaaccaaaaacagaagtgactaagccaattgaaaatgaaatcaagacccgcagagttctagcaaatgggaactacgaatgtaatcatgcctgtaaagataaacagagatgtcgccatttgtgttgtcgtgagggattacccccgaaaaccagtggtggaaataaaactccacagactgagaattccaaacctgtaaattccaatactcaacagaatccaactgaaactgaggataatagtgccaaaccagaaccaacaccaattagtgcaaagaggcattttaaaatccgaaagaataaagccacattaaaaagaacattattcgatgactctgatcccgaagacgtagcatctcctgttgaaatacctcagtcaacaacgaaaccaaagaagaaaacaaagagtacaattttctctattgatggcagtgatcattatgaaaacgaagaaacagtacatgaactaaacacgattcaaaatgtggatgcactagcggctacttctggaaaaactagtcaattggaaactaagagtaagctggcagcaacaagtctaagtaatagttctgaattattcttaattgaaataccgaagaccccaattgagtctttgccttctcttagtaacgcaaataatgcgatagcagattgcaataaatcagaaaacgaggaagtaaaagtatacaacaaagaactattacaaaatttacttggattagatgtagatattgatttatag

SEQ ID NO: 4751 - DNA, 594 bp, Candida albicans
  unsure (570): Identity of nucleotide sequences at the above locations are unknown.
actctagaagtggttatgacaaggatgaaacgaatatgtataggattgagaatattggccatttcagcaacagtcgctaatgcaattgatatatcaaaatggattggactatacgatgagtctacgcttccagcggaaactttgtgttttggagaaaaatttcgtcctgtgaaattgtcaaagattgtttatggatacaaaccaacaagtgataacgattttcagtttgacatttttttgaatagcaagttgattgaagtgataaatcgacactccaatggcaaatctgtactaattttttgctcgactagaaacagttgccagaatacagctaaatatctattcaataacttgtcggaaacaaccaggacagatataaaattaaaggatcgagatgctatgaactatgccaccaaagggattgcttaccaccatgcagggttaacttttggtgatagaaaactgattgaaattgcatttttgaatagtcgcttgaagatactttgctctacatcgactttggctgtggggatcaatcttccagcatatttggttatacttcgacaacgngcctggaagatccgcgaatgcgtt

SEQ ID NO: 4752 - DNA, 1392 bp, Candida albicans
ccttcggatatacttcggcgtggtggcgacttatttaaaacaacagcaccaacgacaacaactacaaccactaatactggtgctacgtccgttcatccaattttacaagttgatgcaattaaatatatttatattttccgaaatcaattgactaaagaacaattaatgatgacattacctcgattaattgatcatcttgatattaaatcaaatccggtggtatatacatattctgccattacgattgaaaaattattatcaatgacaaattttaatcaagatcataccccaattttcaataaaactgatattcaaccatatattaatgaattattaactaatttatttaatcttatttgtattaacaacaacaacaacaacaacaacaacaacaacaattcatcaccagaaaaattggcggaaaatgaatttttaattaaatgtattatgagaattttaaatactggtgaagattcattaaatgaaaataatagattcccaataattaaccaattattaacaattttaaaattaacggcgaaaaatccttcaaatccaaaattttctcattatatttttgaaagtttaggattattaattaaatatggtatcaatgataatgataatgataataatgctgctaatcaatatattgaaattattattcctgctttattagatattttaagtgaagatgttcaagaatttgttccttatacgtttcaaatattggcatttttattagaaaaatatcctaaacaacaaggattaccagaaacttataaaaatttgattcaaccattattatcacctctggtatggcaatttcgtgggaatatcccagggataacaagattattaattgctattttggaacatgatccaaattcaacttttataaatggtggcgaaaaaactttaactccattattaggagtatttcaaaatttattagcaagtaaaattaatgatggttatggatttgatttaattcaatcaataatgttgaatattcctatacaaccatcattacaatcatttttaccaaatattgctcgattaatgttgacaagattacaaaaatctcgtacggataaatatgttaaacgatttgtaacatttttatgtcttttatccaccatatcattacaaggtaccaccactactactaatgttaataaagaatatttgaatggtgaatttgtgattcaatttctggaatcagttcaatcaggtcttttccaacaaattttaacatcatttatattaccaacttcatcaattttaactaatttacaacataaaaaattagttaatattggattatcacaaattttagtgaccatttcaacaacttctgaacaatatgcccatttgactctattaatttaa

SEQ ID NO: 4753 - DNA, 192 bp, Candida albicans
aaatcaattgaaaatgaaccaggatttagtataaatttattacatgttattgcctcgactaatttatctcaatcaattagattagctggagcattatatcttaaaaatttaattaaaagaaaatggttagatggtgatggtgatggtaataattatttattaccaattgatgatgtcaataaaattaaatta

SEQ ID NO: 4754 - DNA, 906 bp, Candida albicans
  unsure (661),(730): Identity of nucleotide sequences at the above locations are unknown.
aatttagtgacagaattttcattaactaattttattaataataaagccattttattagtatcacatctgatttttaaaaaatggcgagcattattcagatcagatgaattatttttagaaatcaaattagtattgacaaaatttgttgatccatttttaaaattatttattgaattagatcaattaattgataaatctctggataatgaagctcaattgattatttattttgaaaatttattattattagtacaaatttattatgattttaattgtcaagatattccggaatttttcgaagatcatatgaatgaattaatggccataattcataaatatttagtttatgaaaatggattattaaaatatcatgataatgatgaagaagttaatgtattaattaaagtgaaaacttcaattgttgaattattaagtctttatattactcgatatgctgatgtattccaaccattaattcaaacttttataacatcagtttgggaattaattaataattatgtcactaaacaaccgaaatatgatttattagtggttaaatcattacaatttttaacttcaatcattaaaattcctgattatcaatcacttttccaacaagaatcttctattaatgaaataattgaaaaaatcattttaccanatattttattccgagaaaatgatgaagaaacttttgaagatgacccaattttatatgttcgatctgatntagaacgttcagattatgattcaagaagatcaagtgctactgatttcttccgtgaattgaaagaatcaatagtgaattataaacaccacagtgaagatatatgttatcaatttttaaatccatcaacttatcatagtgattggagaaatcaagtatccgccacttttttattatag

SEQ ID NO: 4755 - DNA, 642 bp, Candida albicans
catcgaattttgcacagaagaattgctcgaggtaaattagaagaaaatttaaagattgctcgtactagaaaaccatatttacatgaaagtagacataaacatgccatgagaagacatcgtggtcaaggtggaagatttttcactgctgctgaaattgctgaattggagaaagcaaaacaacaacagcaactacaacaactacaacaacaacaacaaaatgaacaatcgaatcaagagaataataatgagaatgggaatgaaatcaaaaaagaaaaccagcatgttgatgacaataatgaaatcaagaatggcgataataatattaataaagaaaatataattgagaataataaggaagaaatagatccaaataatgtgataatcaagaaagaaaacaataataatgaagttaatcatgaaatgaataatattgagaatgaacagtcatcaaatgaagattttaatcaaaacaataacaataacattaacaataacaatactaccatcagcaataatgataatgaaaatggtaatactattagtagtagtaaatctaatgaacttcaagaatcaataaagaatgataataacaataacaataataataatggtaatgatctacaagaagaagaagaacgataa

SEQ ID NO: 4756 - DNA, 840 bp, Candida albicans
accgaaatgacatcactagaagatccaaatggacaagcacaagcaacttattttcaagaatcagtttctacaactggtaattcaactccaacagtaacacaatctaatgatccacagcatcatcaccaccaccaacaacaacaacaacatcatcatcatcatcatgttggttcatattatcaagattcaccaagttctacttatacatatgaagttgaaggagattatctagagaatcatcctaatgttacttccacatcagcagaacaaggaacaggaacaatgccaacatatgttgataatgataatattcatggaggagtagatgtgggaatgggagtagaaactgaagaagaagatgatgatgacaccaatggtgcttccattggcaatggttctggtagtggtggtgaacaaccattttatgttaatgctaaacaatatcatcgaattttgaaaagacgaattgctcgagctaaattagaagaaaatttaaagattgctcgtactagaaaaccatatttacatgaaagtagacataaacatgccatgagaagacctcgtggtcaaggtggaagatttttaactgctgctgaaattgctgaattggagaaagcaaaacaacaacaacaacaaaatgaacaatccaatcaagagaataataatgagaatgagaatgggaatgggaatgaaatcaaaaaagaaaaccagcatgttgatgacagtaataaaatcaagaatggtgataataatattaataaagaaaatataattgagaataataaggaagaaatagatccaaataatgtgataatcaagaaagaaaactatcctttttga

SEQ ID NO: 4757 - DNA, 1605 bp, Candida albicans
  unsure (1555),(1603): Identity of nucleotide sequences at the above locations are unknown.
acgcattataatcaattcagtgacgatttaatcgaggatgagttcaatgaattgaatgaaggtattgttgaaacagaaatggggtcacttcaaaggaatattatacctgatcaagggtttggaaatgacccaacaaataccacatcttcatcggactctactggaacatacaactattcatctactttaaatgacgatatggaaattgatgcacctttccctcatgatgacgacgatgataatgatagtgatggtgttaataaggtgttcccccaaagtcggtcaagaacccctacaccagatttaaccaaagttgatttcacgaaaataataagtcaagcacctcctgggtatgatggtgatacaaatatgaatggatctggatccgtcccgccaccaactcaaatgatgtctgctgcctcggttgccagaaatgctcattcgcctttaccaaattctgaccaccaccaaaaaaatttgcaacagcaacgacaaccacaacaacaacagcaattgcaactgctgttcccagacaattcttgtggcaacactcatgcctatccacaacaacatggtcgaccaactaaaatattaaagactaatcaacaactgcagcagtttttaattcctattgaaattaaatgggtgaatactacaaaagaagccatacataaaatagctattattggatcattttccaattggagagatgttattaaaatgtatccatcaactagtcaccctaatgaatttgttacaacaattaacttacctttaggtgtacacaaattactttatattatcaataatgaatatcgagtaagtgatcaattacccactgctacagatcaagaaggtatttttttcaactggtttgaagtcattgatgatactcatcttttcaatcattcattaaatcaaccaaatcatattggtgccagtacagattatgatgctaatattattagatatgataatacaacaactacaacttcagaaatgagtactactactactgctactactactactacaccaaaatatgttcaaccacaaacttgggcacctagaccagctggaaaatctgatgttgataaaatcaatcaaaaagaaactgatttactttataaaatgagtaaagaggcatcaggtgaatttgaacatgtggaatttattgaagatactgatgccactggtaatggtaatggtgctactgccggtactgctggccaatcacaagattcttctacaccacaaggtcataataatcatgaagcaatcaattcagttgatgaaattgcatttgacaataatccttatcaaaattatgaattatcgacgagttcaagttcatttttacaaaccactggacaaatcattgaaaaccccgtggaatattcttcagaaataccggaaatgttcattaattatgattatttcaaaatgaaaccggcagattatgaattacctgaaccacctcaattaccaccacatttaaataatgtattattgagcaaaatgacgtcatcatcatcatctggttctggttctggtnctggttattcttctacttctcatggatcaggatcaatgactcaacatnta

SEQ ID NO: 4758 - DNA, 1182 bp, Candida albicans
ctggccaaaaatatccctcaagcattaattattgttggtgctccgtatgataaaaacatttataaaaaatcaacagttttacaaaatgggttattaggttatgaattcattcatacggcaatttatatcactgataaaaaatgtattttcataacttcggaagagaaatccaaacatttaaaacatttgactaatcaaaaacatgatttggttgaattatggattagaactaaagatgttgaacataataaacaattgtttattaaattattggaaacaatgacaaaattagattctaaatatgggaaaattttaaaagataaatatgatgggaaatttattgatgaatggaatcaaattttgaatgatgataacaacaacaacaacaacaataccaccaacgaccacgcgttgagtgctgttgatttggccgttacggtttctcaagcattagcagttaaagattctgaagagtttaataataccaagattgcatctaatgccagtgtagttatgatggatacatttgttaatgatatgatgattattgttgatgatgagaaaaaaatcaccaatagtcaattgactgatcaaattgaagataaaattgaaaataataaatggtatttaaaaactaaattagggaaaaatttattacaatcaattaaagattttgatccagaatatcttgaatattgttattcaccgattattcaaagtggtggtgattatgatttaaaaccaagtgctgtttccactgataaaccattaattggtgaaggggtcattttatcatcaattggtttaagatataaatcttattgttctaatattgccagaacatttttaattgatccaactagtgaaatggaaactaattatgatttcttattacaattacaaaaatatattgttgataatttattgaaagatggtgtcccggctaataaagtttatcaagacacgatagactatattaaaaaggaaagaccagatttagttaatcatttcacgaaaaactgtggttggttattaggtatggaatttagagatctgacatttattttaaatgctaaaactactgatagaaaattgactactggacaaatcatttctttaactattggattcaataatttatcaaatgataaaaatgataacaatgataagaatgattattag

SEQ ID NO: 4759 - DNA, 1350 bp, Candida albicans
ctattggattcaataatttatcaaatgataaaaatgataacaatgataagaatgattattagactaatcatccaaaaaataaaccaacttatggctttattattgactgacacaattaaaattactgatgattcatccatcttattaaccaattattccaaagatagaactgccattattttctcctgcaatgatgataatgagacccagaaggaaaataataataacaataataaacgaccaggattatcccagacatcaaacaccacaggcttgaagttagagtctacagaaaatactgctattcttaaatcgaaattacgtcatgaaaatactaatgctgatgatgccaattctgaaaaattaagacaagaaattcaaataaaattacatgaaaaaagattacaagaaggattagcaagattttcaaaagctgatgccactgatgctgatgattttaaaccaatttttaaaaaatatgaatcttatgttagagaatcacaaatccctaatagtgttaatgatttaaaaattcatattgattataaaaatcaaacaataattttaccaatttctggtcgtcccgttccatttcatatcaattcttataagagtggatcacaaaatgaagaaggagatttcacttatcttcgattaaattttaattcaccaggtgctggtgggaatgtcaccaaaaaacaagaattaccttatgaagattcccctgataattcatttttaagatcaattactattcggtcaagagatcgtcaaagaatggttgatgtttataaagccattcaagatttgaaaaaagattctgttaaacgagaacaagaaaagaaacaaatggctgatgttatcactcaagctaatttaattgaattaaaaggttcaagagttaaaaaattaaataatgtatttattagaccaacacctgatacgaaaaaaattggaggagttttacaaattcatgaaaatgggttaagatatcaatcacaaccacaatcacaatcaaattttaaaaatgatcaaagagttgatgtattattttccaatattaaacatttatttttccaaccttgtaaagatgaattaattgttttaattcattgtcatttgaaaaatccaatcatgattggtaaaaggaaaacttttgatgttcaattttatcgtgaagctagtgatatggcatttgatgaaactggtggtcgtaaacggaaatatcgttatggagatgaagatgaattacaacaagaacaagaagaacgaagaaggaaagccctcttggataaagaatttaaaggatttgctgaattaattgctgattcttcttcatggtatggttga

SEQ ID NO: 4760 - DNA, 291 bp, Candida albicans
ttgctgattcttcttcatggtatggttgatttagatattccattccgagaattaggattccaaggggttccatttagatcctcagtattatgtgttcctacaagagattgtcttgttcaattaattgatccaccttatttagtcgtcacattagaagaaattgaaattgctcatttagaaagagttcaatttgggttaaaaaatttcgatttagtgtttgttttcaaagattttaataaacccgtggttcatattaaaactataccccgtggaattaccaggagccgttaa

SEQ ID NO: 4761 - DNA, 234 bp, Candida albicans
  unsure (40): Identity of nucleotide sequences at the above locations are unknown.
cccccccccccccgaatcggttcttccaggcctgtggtcnaatacaatactatccccgtggaattattacaagatgttaaatcttggttaactgatgttgatattcctataagtgaaggacaaatgaatttaaattgggtacaaattatgaaaactgtattggcagatccttatcaatttttcattgatggtggttgggcatttttaactggtcaaggtgaaagtgatgaataa

SEQ ID NO: 4762 - DNA, 1638 bp, Candida albicans
atagagatgatttatgaattgagagactttattccatttattgagtttattttgaatcaagacaataaaattttggacacaccaatatatggtgaactttggataattggacccttaattcaaaagtccagtaatttaagatttacatcaacaaaagactttttggattatattattcaatttaatattattagtggttacctgttagaatttagtaaagatttaaataacaacatcgatattaaacatttaccaaagttaataagtataaactttaaaggagtcttgatgttgcaaagccgattgaaggggaaacaaacattttcacaaatatccaactccaaaaatcataaattaccaactaatttattacagattttggaaatgctgtcaaagcgtgacatattgccgtatacctccactaatagtagcttgtccagtgacttatcgtttgatgtggaatttttacaagaattgattaataaacctactgctaggacaattttgaataagcaaaaggcactgttgaaaacaccagaaaaacccttccattcaatttgcagtgatcacaatcatattaatttgctagccactgttgggttaaacaaaaaagaatatagtcattttggatccaaacaaacaattcctgtagatgttattcatcaaagaattctcaagtgtagaaacattttatcaaatgatgtatacaaatgtgttcaagagagaattcattttttacccattatcaataatcacacagatttaaatttaggagactgttcatatttggatacttgtcataaattaaaatcttgccgttacttgcattattatacacttactccgatgaaaaaagagttgtcacatagtagcaaagaagaacagcaacaaagacaaataaaactaaaaggtctcgaatacactattggagactgtttttcagaatcgtttagagaaccattacctcctcaatggattaattgtgatgtgagatgcttgcctttttcgatattaggtaagtttgcagctattatttctgatccagcatgggatatacatatgtcattaccgtatggtacctgtaaagatgatgagttgttatccttacccatgcatgaattgcaagatgaaggtatcattatgttgtgggtaactggaaggtctattgaaattgggagacgagcattgttgaaatgggggtatcaaatctatgatgaaatgatttggatcaagttaaaccaattgagaagaacaattgtcactggtagaacgggacattggttgaatcattcaaaagaacatttattggttggacttaaaggtaatcctatttggattaataagagaatcgatacagatgttgtcgctagtccaactcgcgagacgtcaagaaaacctgacgaattttacgatattgtggaaagattggtgggtactcattcaagaaaattagagatatttggtagagaccataatactagaccaggttggcttacaattggaaatcaattacaaggagtttcactatttgaaccagaactcaaatataagtacgaattatataaacaaacaacaacgggtaccactgctactactagtattagtatgagtactagtggtagtggtggaaaatattaa

SEQ ID NO: 4763 - DNA, 1023 bp, Candida albicans
atcgttggtccttcgacccccgtggtgaagacatcaaatactagtggaggtgggttatttggaggaggacaacaacaacagcagacaaatcaaaccgcaaataccagtggaagtgggttatttggtgctaaaccagctaatactaataccactagtggaggcggattatttggaggtcaaaataatactgctaatacaacatcaactggcggaggattatttggtaacaaaccttcaggaggtggactttttggtcagcaacaaaatactgcaaatactgccaatactggagtaggtggagggttatttggttctggaacaacaaccaacacttctggtggtgcaggaggattatttggaaataaacctactactacaacaacaacaattggaggaggattgttcggtggtggtcagcaacaacagcaacagcaacaacaacaaatacagacaccacaattaactggtatgaccagagtaggtgatctaccaccaaatatcaaaaatgaattagaacaatttgacaaatatataaatactcaacatgtaattgccactacattaaattcagacatgtcaaagcataataatttaataaatactatacctaaagatataaattatttacaaaataaagtattatcaaccaagcaagcattaaaatttgatattaatcaattaataaatttgaaaaatatgaataatgaaataactgaagatataaacaaaataatgcaattaatattacaattgagtactccagggaccaaattatctagttcgtttcaattgaatgaatttttcattaaaaaaattaaaaaatattatcaaatgttaactcaatatgaatcaatgataaaggaattggaaatgattttaactggattagaaaaaagttgtactgaaggatttggaaatttgtttggtattgttcaagttattaaatctcaatatagtttatttatggaattgactgaaacaatggctcaattacatagtgaagtgaatagattaactaaatag

SEQ ID NO: 4764 - DNA, 528 bp, Candida albicans
accatctactgtgaggaggacttttcggaggttcatctactacatgcaaacacagggtccactacttttggatcaaatcaaggaacaactggtggattatttggtaataaacaaccaaatacttccggaggtctttttggaaatactcagcaacaacaaacgcaacaaccgcaacagcaacagcaacagtcttcgggattattttcttccaataccacaaacaatgcccaaccatcgtttagttggagtcaaccaccacaatcatcaaattcaacatctactaatggcaatactaatcaaatttcaaatctaaccagtgggccatttgggtctaatacaaaccaacaattgaacaataatacttatacctatacaccatcaataaatgatcaattaactaaaatttgggaacaatgggatccaaattcttctaaatgtgcattaaatacttatatctataataaatttagtgatcaagaaatcaatgtattattaaatcaacctcgtcctgctaatgaatcatcttaa

SEQ ID NO: 4765 - DNA, 1212 bp, Candida albicans
agcgctggaccttccagccccgtggtgaagacattgacgatgataaaaccaaaggggagaccagtgacacaatgtcaacattgtcgtgaaaatagaaagtcgaaaaatttacacgttacatgttcatgtggtaaaaagggtaaaaatggttcacatttaccttcatgtgcttgtcataagactaatcattgtacttgttccaccaatatgactaagaaaactacaacaaaaggtgatattcatcatatgacagcttcggaaaaggccaaaaagaaatcattaatagatgccgcaaatgctggattaaagaaaagatcagattcagtatcaacaactcaatcagctgcaagtagtagtgcttctccatcaagtgccgcttctccaaataaaaaactgtcagtgccaccaccaggaccaacaaattcacagcaaaagaaacaacaactgaccctgccaaatcaatcacgacaaacaacacaaccagcatataacaatcttctggatcaaaactttgtgatagaagatattgttttcccatttaatactgataatggattgtttgatatgttttcgtcgaatgcgacctcggaagttggtggtgctggtagtggtactagagactcacaaattgccaccagtaatcttgcaagtgataattcaaccccatttaattccaattacgatactgggatcagttattctaataaagatgtagggttaccgctaagtccaaatgaaactgaagctgaccctatgttccccttatttccacttgtggggacacaaagttttgatcgtgaaaatcaaccacttctggcattatctaatgagaaagaaccaccacaaccacaacaaccgacaccagtgagacctagtcataatgttagtactgctatgaataatattagttctaattcatattcctcaattccatccgccgtcgaagttagttcaataaatcatcaacaatcacgtccaaaacgtccagaaagtgttttatcaatagcatcaaatagttctactagatcatttgatttttttggcaacaatcataccaattataattcttcttttatgaatggaagtttaccgacatcttttacttcagcggcatttcctccatctaatggatttgatgaaaatagtttatccaatcttaatccagatgaccataataatatgcaacatcattttggaaaaaacaaggtttag

SEQ ID NO: 4766 - DNA, 816 bp, Candida albicans
cttcggtccttccagccccggtggtgtaagaatggaggatcagcgagtcgtaatcgtgaaattcaaacttggttcagtgggaaatttttgatattggaaagatttcttcaaaaaattaataaagaaaccgatgataaaattgttttaatctcaaattatactcaaactttagatttaattgaaaaaatgtgtcgttataagaaatatggagttttacgattagatggtactatgaatataaataaacgacaaaaattagttgataaattcaatgatccaaatggaccggaatttatttttttactttcttctaaagcgggtggttgtggtattaatttgattggtgccaatcgattagttttaatggatcctgattggaatccagcactggatcaacaagctttagctcgtgtttggagagatggtcaaaagaaagattgtttcatttatagatttatatctactggtaccattgaagagaaaattttccaaagacaatcaatgaaaatgtcattatcaagttgtgttgttgatgaaaaagaagacgttgaaagattattttctgttgctaatttaagacaattatttaaatttcaaccagatactcaatgtgatactcatgatacatttaattgtaatcgttgtaaaggagataaaggacaattcataaaggcaccagcaatgctttatggtgatgccacaacttggaatcatttgaatcatcaggcattagctaataatgaagatattctaataaccaatgaagctcaacataatgatgtaactttgcatttcagtatatatctcattaaataa

SEQ ID NO: 4767 - DNA, 1257 bp, Candida albicans
cagtactttccattcttcatggcagtaagaaaacctttgactcaatttactacacctttatgttccggtgcaggtgtaccaaaggataaacgaccaccacgcgtcaccgattctgctacacgtttatccaaaccatttaaagttccatttgcatcatcaacacataattcagtatcttctgaaactataacgatttctcgtagaccagttagatctacacgtaaaagaacaaattatgcggttgatggtattacactggaaaaggacgacgaagaagaatacaacaacgaccaaaatgtcaatggagatggacaaattataaaacgtaaaaaatttggtgcattattaccacgatcaattattaattccgataatattgccaaaaatgaagataaatttaaacgttcttttactgtgccatttgataaaaataatagtaaacaaacagaaattcaaagaggtccaccaccaccattaggaacaaaagtaagagcaattcttccacctcgggcattacatgatccaactagtgaatttgctatagtactttatgatcctacagttgataaaatccctaaaatttctgaagtagaaagttccacttctagttctacctcacctgaaccagagccagagaccaaagaaacagaggaacgaccaattaaaaggaaaagaactcataaatctttagcagaaatattaggaattgtgactaatcctgaagaaaaattatcgaaatatcccgatgtaccagttgttatagatccaaaattagccaaaatattacgtccgcatcaaattgccggggtgaaatttttatatcgatgcactgctgggttaattgatgctagagctaaaggatgtattatggccgatgaaatgggtttagggaaaactttacaatgtctaacattaatgtggacattacttcgacaatcaccaagagggaaaagaacaattgaaaaatgtataattgtttgtccttcttcattagttagaaattgggctaatgaaattgtgaaatggttaggtgaaggagcattgactccattagccgttgatggtaaaagtacgaaaaatagtgaattgggtactgctttacaacaatggtcaactgctcaaggaagaaatattgttcgaccagtattaattatatcgtatgaaacattacgtagaaatgttgataaattggctggtactgaagttggtttgatgttagccgattcttcaccacgggggtcgaaggagccgcgatga

SEQ ID NO: 4768 - DNA, 378 bp, Candida albicans
agtgcgggcggggctggtacctccgtggtgaaaacagtcaactacgcaggagcagatggagaggtggaggacaacagcgtcaagccatggaccaacgaagaacgtcttgctcttgcgacaagagatgccaataaatttcccgtctttaaagtcaaggacaaggaaaccacgtttaagcaaagatttcggatacctttgatcaacaagtcctctaatgattacaatccttcgagaccagctcccactttgggaatgaggcaaggcgccacttttgttgtgaaaccactacacgatcctagtggagaatttgcgatagttctatatgatcccaccgtcgacgatattggcgaggctccagaatcgatgcctgaagactag

SEQ ID NO: 4769 - DNA, 762 bp, Candida albicans
aaaatgactgacatagcaccaccatcagcagctactcctaacgattatatattgagtttgtcgcctgaacaaattgaacatgaccaaaaaattgggatcaaggctattcgattatttttacaaagcaaaacatcttacgatgtcttacctgtgagttatagattaattgttttggatacttcattgttagtgaaaaagtcattaaatattttattacaaaataatatagtttcagcaccgttatggaataaccaaacatccagattcgctggattgttaacatcatcggattttatcaatgtgatacaatactatttacaattcccagaaaagtttgaactagttgatcaactaacattgggtggattaagagaaattgaaaaagccataggtgtagatcaaatcgaaacagcatcaatacacccattcaagtcattatatgaagcatgtgtcaagatgttggaatcaaaagctagaagaatcccattaattgatgaagatgaaaaaactaaacgtgaaattgtcgttagtgtgttaactcaatacagaattttgaaatttgtggctttgaattgtaaagaaacgaaaatgttattgaaacccctcaagaatttgagtgggttgggtgatgtgaaaaagttgtctacatgtactatggacacacctgtcatagaagtcattcatttattaactgagaattctgtctcttcaataccaatagtcgacggacaatcttcaccacggccgtcgaagatccaagaa

SEQ ID NO: 4770 - DNA, 906 bp, Candida albicans
actacctacagcatggatgctaaaccaccaacctcacattcattgtggtcaccgtatgatactgttcgagacgcagctgattctttaggtgtgactatttcagatgaaactgccaaaagtttagccatggatgttgaataccacatccatgaaataatagagactgctgtcaagtttatgagacattcgaaacgaaggcagttgactacgtcagatgtaagtaacgctttaaaaatactcaatatcgaaccattatacggctacgataatactcaacctttaaattacaaagaaacaatggttggtgctggtggacaaacattgtattatattgatgaacacgaaattgaatttgagaaattgattaatcaacagttacccaaagtacctcgtcaagtgaactttacagcccattggctagctattgagggtgtacagccaatggttcctcaaaatcccttgcctagtgaaatcaaaagcttaccagcagcagtacgtggagcaacaacatcgatgttgggtaatgatattttaagtctcgggagcaaaaatgaaaatggggaaagtaacgattcaaccaaacatgaatctgaattgttatcgaatggtggttcttctagccacacaaataacagtaactccaataaaaaatcaactgaaaaagatatggaaatcaaacctttgataaaacatgtcttgtcgaaagaattgaaattatattttgacaaagtggttgatgtattgatttccactgatccagaaaaggaacatttgaaaaatgctgcattaacttcattgaaatccgatccaggattgcatcaattggttccttatttcattcaatttatagcagaacaaataaccaatcaatttcttcaccacaggggtgcaatatccgcgtacaat

SEQ ID NO: 4771 - DNA, 528 bp, Candida albicans
gattttggccgcctccgtggtcgaatatcatccgtggaatttgcagcgatattgttgcaacacattatcaaagtatatggatcatcttatagtacgttgcgcccaagaataacacgtacattgttaagagcattattggattcaacaaaaccagtaggtacgcaatatggcgcattattaggattgaaaaatatggggaatgaagttttaaaattagttttgcttggtaatttgaaagtatggtatctggcaattatcgaaaagaatgaaaatgattatgaacgtcaaattttgattaatgctttattggatacacttcgaaaatcgaaacttgaagataaacttttgaatcaaactaaagctcaagatagtgatgatatggatattgattcaaataatgaaatcagtgatgaagtaaaaacaaaattagtagaaagatttgggaaatcattagctgatttattaatagagcaagaggatggaaaacaaattattaaaggaattttctttggcgaattatcagtttga

SEQ ID NO: 4772 - DNA, 1140 bp, Candida albicans
ttttactttagacaatctcttttttttttttcagataccgccagccatttcaaaagaaagtgcactaagataaaaaaaaaaaaacatgatattcatatgtctatagactccttgatatacccggcaatgaaaccttttattactggccatgaagaattgatacatgacatcaagtatgacttctacgggaaacatatagcaacagtttcttctgatcagcacataaaggtttttgatttagactcagcaacttcgtcatggattttaaatgacctgtggaaagctcacgattcgctgattgctaaaatttcgtgtcctcatccagaattttcaagctccaaaatcatagcgtcatgttcgaatgatagaactgtcaatatatggcaggagcaacctgacgaaatgcatggttcaggaagaagatggtttaagttggcgacattagctacagaatcatacggaccaatctatgacgttagtttcgcccctaatcatctaggattcaagataggctgtgttggatctgatggaatattcaggatatatgaatccttggaacccaatgatttgactgcgtgggtattgacgactgaaattgcaatcttgaatctgctgttgccagctaaaagcttacaaagtagttttggtgttgagtggtgtccctccaaatttacaaaaacagaaaaatttatagtagttgcattagatcaaggatttgtttacggaagtgtacagaaagaatcgagtggagaagaaagtgcaagcgacaagtacgtcaaaatatgtgatctacccgaacacaatgggcttataaggtctgtcagttgggcaccctccatgggtaggaagtatcatttaattgctactggttgtaaagacggatttgtgagaatattcaaagccactgaacaagagaatggagatttaaagattgaaacattggctaaattgaatgaccacaagctggaagtatggagagtaagctggaatatgacaggtaccatactttcatcagcgggtgatgacgggaaattacgtttatggaaatgcagttatttaaatgaatggaagtgtatgagtgtgatcaacactagcaatagatcagatagtcgtggtattgaaactgaaaaacctatatag

SEQ ID NO: 4773 - DNA, 462 bp, Candida albicans
gacgaaattgctgcgagtgagcatcatacattggcactaacagaggatggacaagtttatgcatggggtaggtatgatatgaaagaaattgggattccaaaagacaaattgccgaaatcaacttttaaagatcaacacgggaacccacggtctgttcctgttcctacaaaacttgaatttgccgtcaaaattaaaactattggtgttggatcccatcattcctttgccgttacagaagatggtgttgtttatgcatggggatttgcagaaacctacggacccggtttaggtccatctattgatgatgttgaaaaaccaacaagaattgtaaatacagctacaaagaatgaagatatacttcttattggtgccggtgggcaattttcagtgagtggtggtgtcaaattcgaagacgaagagaaagcagaagttagacttgataagtatgaagatttagaatag

SEQ ID NO: 4774 - DNA, 1014 bp, Candida albicans
caaatggtggcattgaaaagagaggcagagcctcgtgaaaatgggaaatccaagaaagcaaaaacatctttggcaacatcttcgtttgttttacattcgtactcaaaattaccgaacattaatgaatacgcaaaggccaagtcaactccgttagacgtttttgtttgggggactgggtctatgtgtgaattaggattaggtccatcagcaaagaataaagaggttaaacgaccaagattaaatccctatttaacggaagaaaaactcggaggtacaaaaatagttgatttcgctgtcggtggtatgcacactttagcattggatgggaagaatagaatttggtcttggggaggaaacgacagtggagttttaggtagagacacttcccaagctaaggaggtattgaaagatattgatgggaaaaatggtaatgatgatgacgacgacgacgatgaagatggtgatcttaatgaagctgaatcgacacctgcattggtagagaatcttcctgaaggtgaaattgtgcaattagccgccactgacaatttgagtgccgctttactttcaaatggtgatgtatatgcatgggggtgtttccgttgtaatgaagggttattgggatttttgagagatgaaataaaactccaaaaaaccccactaaagattaaggaattgaaaaacattgtccaattagcggctggtaaagatcatttacttgctcttgactcaaagggaattgtgtatgcctggggtaatgggcagcagtatcaacttggtcgtaggattttagagagacaccgctatcgaagtttggaaccacaacaatttggattatacaatatcaaatacattgccagtggagactttcattgttttgcaattgatcattccgacaatgtttatgcttgggggttgaaccaatatggtcaatgtgcattaacaggtgataacggtgagttggaggatgggtcagttttgatgaaacccactttgattcctgaattgtcccacaag

SEQ ID NO: 4775 - DNA, 1215 bp, Candida albicans
tcacaccagatgctacgaccacaactgaatcaactagtatttcagtaccaccgttggtacctgctccaactagttctgctttacctcaagggaagaagggaaattactcaaccagaaacaacaccaacatcaacaccagcattgacttatcgtccttctaaaatcaaagaatcaaactttatatcaagattatttttacctccacttcctcctaatatgaaagacaatttagaaaaacgaaaaattatatctattagcgctggtagagaacatattattgctttagataattataataacatttatacatgggacactggatgtcaatcaaatgttggagttatgcttgaattccccggtatttcttctaattcttctaattttggtcgagtaatgaaaatatctgctggttggaatttatcagcagcattaattgataattatggattaattgtatggtataccagaataggtataactgaagaacaatttcataatcgagaatttatttctcaagctaaatattttattattccatttacgaaaaatgatgttattgatttcactgtagggtcaaattttgtcatgtttattagaaaatccgatgaaaaattatatcaaacaagattcaatgttcatgaaattgccacaagagatgatacatcaaatataaccattgatgaaattaaacaatttactaatccaatggataattttaatcattggaaacagcaacaatcagaaaataataaagaaaatattaggtttactaaagttactggttgttttaatgatttttccgttttcactaatcatgatcaagtattattaggtaatcttcatcatttggaatatcacgataatgggaatgatcaaggaatgaaaccaatcattattgatgaattacaaggtaaaaatattaaaagaatagaaattggtgattatcattatttagcattaactgctgatgggacattattgagttggggcacagaatcaagattttgtggatgtttgggcttaggaagtaaacaaagtattcttgatcagtatactactcctactaataccgaggatagtgatgaagttaagttaagagggaataatttggtagtgcttaaaccattacctgtgaaacccccaccatacaaggggaaatgggtgtgtattgcagccagtggttggcattctggtggtatatatgtgcctacatag

SEQ ID NO: 4776 - DNA, 1464 bp, Candida albicans
ccaaagatgacttgtttaaaagagatatatttggtcgtaccatataacatatatgtatttttggtaaacaactctgatgctttgaaaagcttaaccaaaaaccctgatttcaagactttattaaaattgaatgattacgaaaatggttggaattgtttgcattatatttttttccataaacgcttacagtgtcttaaagtattgattgattatttacaaggaacaatagttcaaggtaatatttttgccaccaactcccctttgttagagttgcttaagtttaaagatcggaatggccatacacctttaaaccttcttaataatgattttaaagatttgctttggttccccgagtatattactgacaagaatgaatttcatatgacttacaaatatgaacgtatcaaatcaactaaagacgtggttcaaccggaatatgaacctgatacattgccatttttgaaatcatcagagatattatggactgataaacgaggggcatctgagatttatgtttttggatgtaatagtaacaatcaactaggagtaggtgattctaccgatagagcaaccccagcactattataccacgacaactttaaatttgctactgaccttactggctccattagtgagaggtttaaacgtccaagatataaacgcattaccatatcgaaaaatcattccgttgttgttactcaagatggagaattgttttcatgtggtgttggatcaagaggaagactaggacatggattaaccgatttgaataattatttcaaattcaagagaatagagtttttcaatgacaaaacaataaaggatgtggcaatttctagtaatcattctattgcattgactaccgataatgaagtgtatgcttggggtctcaatagtttcaatcagttgggtgtgccgaatatgaataacaaaaaatcgacaaattatttggataaatttattgccactccaattatggttggaggagaactccgcaaaatgcaaaatatcattggtatcgaggtttccaaaattcattcattagcatggtcaaaaaactatttgtgtttttggggattgaatgttgggcaaatgggtatttcgtacactaatggtgatattgaagtcaaagtacaagagcggtcagtgagaggtgagacacaagtcaacccaaaagcaattcagttgcgggatgatataaagtgtgtgagtactagtgagttgtgtacctgtgtggtgacaacactaaacgacgttcacgtatattacaattaccaacattttaaactaccgaaaatccccatgaaagggcatggtgataagcattttgattatttcaaaccaagaagtatcacagaggcagcagttattaaaaaaatagttacccgaggtcccgaaaactctatgattttattaaagaatggctctattttcttcattttcaggttaatgcaaacgatataa

SEQ ID NO: 4777 - DNA, 942 bp, Candida albicans
agacaacagaataataatttacaagctccatcaaatcaacttactgtcaataataacaatccttatagttattcccaagttatttctaatttacaagcaaatacttcaaatatgccagaatcaatcaccacatcacttttttctggagttggcaaagaatcatcagataaaaaaagaaggttttcatatttggagaaactggaaactcataaaccaaagtcatcgctattgagtaaattgggtcaaacattcaagtttattcgtaatgggaatacatcagcaacttttgaatctttaaaaggattattcactagtagtgatgtattaaaaccaaaggaaaagagaatcatgctttctgcagcagcagcagcagcagcatcatcaaccccatttgttacccctaaagcgatttctagaccttcatataaagcagttgatgccagacgagttgggagtatgaaaaggttgatcatcaaaagtaaaccaatgaaatatcatatgatcgatgtgaataaggttttcaatacaaagagaagaaaagtaattgacaacaaagttactgctgatagattattgacagccagctatccaagtgatgacgatagcgatgacgaaaataatgatgacaatgaagaagttgttagtgataagacatttgcaaggtactcatacaaaactggtaacacttttgaagaatctgaaactaaatctaccacaagagtagttgaaaaagaaccacgaaccaccagagacgaagataaaccgacagttgaacttcatgatggatattggtctactcctactattcaacaattatcagaaatgaatgttgaacaactctcgagtttagacaactttattattggaagagttggttgtggtcagattgcctatgatttccctgttgatttgtctcaaatatatttcaatgctcaacaataa

SEQ ID NO: 4778 - DNA, 1656 bp, Candida albicans
agaggatctaaagaggaattgaaaaaacaaaaattgaatgaaaaaacaaaagttgttcctggtggttgggaatatgtcattccgacatctgacgaaccgttgaatattaaacgtagattagtttccgatgaaattagtcaacaattgataaaatatcaacaacaacataataagacagaagaacttagtgcccaagtaagcgatataactatagattccgatcacgagtcaacaacccctaaattagtgacttatatggaccaattggcaaattttattcctccaggggttgatttgaatgaaatcattgatgaaaaagtttatgaaccaacaatttctaatgaagttgtttttgattcaatacaaattcgtccaaacttgccaacatcagaagattggttacttcaattggaattggccaatcaattgacatctgctttagctccttatgtcactgaacctaagaaaaaactggataaattaaatattgaaagagttgatgatattttattttctgatttcaataaaaatgttttaaaagtttccacaccaacaaagaaaaaattaagtgttgttgatgatatagatgaatctcaagatatttatattgataatatctcaacaattttccataaacttttatcgaaaatagttattggtcatcgaggaaatgagttccctaaaattgacaaaactactggatttgaattcaaagatataatcactagtcatcaagaaagagaagaaaaagatgtcactattttatgttctgctttgtttgataatctaactataaatgaacctaaccctgcaattagtgctgccttggtggacaatactagaaagaagttattaggtgattggttgaaaaattataattcagcaacagttgagaaacttttggctgaatacaagaatgatccattggagacaacattcatttatatgtgttctggtgatatgattaaagctattgaaacggccatacaaacaaataatagtcatttatcagtagtgataactttatctgattctaatgatgttgtagtgaaatcaattgcacaaaatcaattgacaaattggaaacaacgtcaaaccattctgtctattccttcagctgttgttaaagtttatcaaatattggctggtgatttccaaccaattcttgaaacgttaccttggaatcttgggttagcattaaaattgttttatggtaattataatgatatcaaaaaattgattaatgaatttagttcgctgatacctataggaaatcccgttggtgatgttttacatgcatatgtcaatggtattgatttggaatctgtcacttcaagttcattgaatatcaaattgaaatggctattctgtaaagtattagcagatttcaattatgacaccataactaaagaatttggtgattatatactgtcaattgattattggaaggaaagtattgtggtatttgcccatttaactaatgataatgatattggtgatgctattacaaaattgataaattccaaaatactgcacataaagagtttgacaattgataaagaacaatatgcaatagaagtattgaaaattccaagaatggttatatacaagtcttttgctatacaaaagagtcaaaatggagatttcgtggggtga

SEQ ID NO: 4779 - DNA, 1194 bp, Candida albicans
ctaattgattatatccctataccatttactttgaaaatgtcctcaaaggaaaaaccatcaaaagaggatattagaggacaattgtccgatatacagaaacgattatttagcaaaaagccttcttctggtgatacatctggtgctactaccagtgccagcaccaattctaatcaccgaccagttctaaaagaatcgaaccaccatccacaaggcaaatcatctttattatctggtggtgttggctctcatgaacaagaaagatttgctgatttcttaccaccacttcccaaaggcagtggcaatgcttctgcctcattaggaccacctgcaccaacatctaattctttgaaacgcgttccacccctgcactcctcgcgtttaggaccagagtcaaaaggtaatgatatgaactttgttgttggattgagtgaaaatcttttaactgaatgccgtcgattaaatgccgaaaattctaaatatcgagaaaaattgaaatcagcattagatgaagttcaaaattataaggatgaagtgtttaaattaaaagatttcaacaagtcacacaattccaatgaacaagcattaaaagataaaaattgggaattggaaagtaaagtgattaaattggatgatgagttgtccgtgttgaaaaaatcacacgaaaaaactattcacgaaaactccgaattggctaatcagatcagtaatttgaataaaattaatgataaattagaaataagtaatcaatctttgaccaagagtttacatgacaccaaacagtcatatcaatcggagattctggcattgaatgcccgaattgaaaatttaaatgatgaaaatgatcaattgcatttacgtttagctggtgaggataccactaacagcagtcgcgtggaaacttccaaggaagcaactttaccttcaatggatgaaacaacagaaagtgatgatgataccactgaatttgattccatattgaaagaattacagccttgtgatatgccagagtctaacccaagtaacccacagttggaaattgatactttgagatgtactttgcaacattccaatagaacaattgccaaattaaggtcttctatgcttaaattgagaaagtttgaccaacagcaaactaacctgtcaaatttacaaaggactccaatgttttcaccacacggccaggatcccacatag

SEQ ID NO: 4780 - DNA, 1923 bp, Candida albicans
caactgacaatgtcaacaggttcatctccatttgttgatcataaatcaaataatagtaccatcagcatcaacaataatagtagcatactaaatgaaagctcaatttccaaggcatatgtttctaaattagaattccaattggataccatcaagactgaaaatcgtattcttcaacaagaaaaggatcaaataacatcagattatcgaaaaatcatagatgaaaagaatcaagaacttgaaaatttgaaattaaattttaaatatgtttatgatgaaaaaaatcaattagaatcgaaattaactaatcaagaacaagtttctaccaataatataaatcaattatccgatgaaattcaaacttataaacgagagaatttaaaattaactaaagattataattcattacttgataaattcaataaactcaatcggaaaaaccaacaaattatgcatgatttgaataaagaaattgaagtaaatgataaattacaccaagaattgaaaattaaagagaaaacaaatcaagaattacaaaaagctagtgatacagcaatcaatgaattagaacaatattctaaaatattagataagaaaaatggatctgataatctattgtataagaatttaaccactaaaagtaacaatttacaaaatatcaatcatcaattacaaaacaagatagatcaattattacaaaataaaacttctaatgaattattgaaacaacaaaaccaatcattattgcataaattacagaatttggaaaatattgaatccaaatatttacaattggaaattgagaagcttcaattagaaactaaatataatgatttgtttaaggcattggatacagctattgcctcatcaaatgaatataaagataacgagaacaccgatgacaccattcataccagtaaagtaaaaagttttattgaatattgtaataatcttcaagctaaaaatcttactttacaagagaaatatgactctaaaataatacaggtgaaagaattaactaaagaattagaagatcacgctagagaaattgaaacagattttcttccaacgattactgatttagaatctaaattaaaagtatatgctgaccaaaataccaaattggaacgaacaaaatcattacgtgaaaaggaaattacatttttaagaaatctgttgaaacaaatggaacaaattcatgctaatcaacaacataaacaacaagagcaagaaaaagaagaaaacactgaaaataaatcaattctgcaatatatgaccaatttggaaaaattagttgatgaatacaaaaccaagattgatgaattagaaaagaaaaatttggaatataataaatcatcaattataaccaatgaaaaaaccccttctaataaacgtcaaagattggaaagtaattatacatttaaaacccaagcaattgaattggaaaaagaaaacattgaaatatcatcaaaacttaaacaagctgaatcaacaatcgaacaattgaagtttaaaatatctgaattagataaagttgaaaccagaaaggaacaatatcgtatattacaattgaaaaacaatttaatttctcaagatcaatttataaaacaaacaacattaattgctcttcggaaagaaaatgaagaattgattaacaaatatattaaaaatttacctatagaagaacaaataccaaaaggtgttttccaacgacaagaagatgataaacaacgattacaagcacaaattgatcatttaactaaacgatcaactcgattaagagaagtattcactaagaaaagtaaagatattatcacagtgatagcgaaatattttggatttataattgaatttttacctaatccaataaatcctaccgatctattttcaagaattaaattaagatcaagatatattcctacgtga

SEQ ID NO: 4781 - DNA, 960 bp, Candida albicans
gacgcggatttccattccgtggggcagagtgctgtttatggtggggtttctaaagatgatcaaattagaaaacttaaaactgctaatgttgttgttgctacaccaggtagattagtcgatttgattaatgatggtgctataaatttgggtaaagtgaattatttggttttagatgaagccgatagaatgcttgaaaaagggtttgaagaagatattaaaactattatttctaataccagcaattctgaaagacaaactttaatgtttactgccacttggcctaaggaagtgagagaattggctaataatttcatgaattctccagtaaaagtgacagttggggaccgtgacgaattaagtgctaacaaaagaatcactcaagttgttgaagtgatcaataaatttgataaggaaaagaaattgattcaattgttacgtaaatacaatgctaatgaatcttctgataataaaatattaatctttgccttatataaaaaggaagcttcaagaattgaaaatttcttgaaaagaaatagattttcagtggctgctattcatggtgatttgtctcaacaacaaagaacggccgccttaagtgcattcaaatctggtcaaagcaatttattattggccacagatgttgctgctagaggattagatatacccaatgttaaggtcgttatcaatttaactttcccattgaccattgaagattatgttcacagaattggtagaaccggaagagctggtgctaaaggtactgcccatacgttattcactgaagacgagaaacatttgagtggggctttgtgtaatatcttaagaggtgccaatcaacctgtacctgaagagttgttgaaattcggtggacataccaaaaagaaagcccatagtgtgtatggtgccttttataaggatgttgatatgaccaagactgccaaaaagatcaaatttgactaa

SEQ ID NO: 4782 - DNA, 915 bp, Candida albicans
atgactgatagagtcactcatcgagtttcccttgatgatttgaatttggaaaaacaaaaatttgactccaaagatgatatcaagccatggctacaagacaatctacagtctactaaaggtatcaatgtggttatagagcgatctgatacttcgaaaataatattcaagtgcaaaaacaaggaaaagaaaacaaaaattgtggagtccaagaaaactgcatccaaaacgatgattagaaaacataccagttgcccctttaaaattagagctaactatagtgtgaggaataaagtttggacattgctgatagtcagcgatgaacatgatcatgtggtagaccttccgcgactgtttgttggcaagaatctaataagcaataccataccagggtcttcattaaatgtgctagattctgtcgccccgagactgaataagaaaggaataaagccgacgtcagaaatagccaatactcccctggtgacatcatattcccccagttgtgctgttaaacgaaatgaagatgtggatgcacctaagatttccagtaaaaaggcaaggaacctaacaaagaaaccctctacacagagtactaggagctcactgagtagtgatggaagttccatagtcagttttggatctttaacatcccaatctagtctgacatccttaccagaaaactataagggtcaagttccaacatctatggatctgatggttgttgaagaaagtttgacgggaaagagtttgaaacctgctgcatctcaccccgtaaaaaggaaaaatatgaaagcaaatactatgaagaaatccaaaaaattaaagcagaatccgattgttgtttctcccattgaagaggatctgaatttaaacagttttgacgacgcaaacatcgacttgcagcgacagcaatcataa

SEQ ID NO: 4783 - DNA, 411 bp, Candida albicans
tcagatacaccatttgaagatggtacatttcgattattattactgtttgatgaacaatatcctaataaaccaccacaagtgaaatttatctcggaaatgtttcatcctaatgtatatgccagtggagaattatgtttagatattttacaaaatagatggtcacctacttatgatgttagttctatattaacatcggttcaatcattattaaatgatcctaatatttcatcaccggctaatgtcgaagcagcaaatttatataaagatcatcgatctctatatgtgaaaagagttagagaaactgtggaaaatagttggaatgatgatgatgatgaggaggaggaagaggaggacgaggatgaagctgaagatgaggacgatgatgatgatgataatatagatgaggattaa

SEQ ID NO: 4784 - DNA, 1122 bp, Candida albicans
aacaacatttctctttttttctttgttttttttttcctctcatttaaaaaattgtttgtctttttttttattcatcaccttgactattataacatcataccattaaagatgccccctcctttaaactctaatatcctctacgtgggcaatataccttatgattgggacgagagtacagttgagtctgttgtttgtggatcaggaaatattgtagatgttcgattaggtttcgaccatgttggaaaaaacaaaggtttctgttttgtcgaatacaaaacagtacaagatgcacaaagggctctaccactattacagcaagttgtgatatatcaaaatggacgaaacaagaagctaagggtagagttgtcgaaagaaggatacaaggcccaaaaaataaaacccgatacaagaacaattatgcaactaaaccgttctagattgccagccaatgtgaggttgcctaacgagatgatagcaaatatcccctacgtaagtcaagttccagtcttgccgtccagcggattcagaagcggcaatatgccattcccaattccacagatgccactaccaccaccggctccccctatagttgttggtggtccaattcaacaaatcccatcaaggcttttacaggcatcgaagtttttaccatttgcaccaaattttaaactagaaactgcaaataacataaatgtattgctaagtaaaatccctcctccacagttcattgagttactttctcaaatgaaatctttgctgcaaacggacccgacaatggttcgtaatttttttcaaagccaaccagaaatatccttgagtgttgctcaagcattactattaatggggttcatagataatggtgttattgaagagtctctgaaatctatatcatctacacctcaggttcaaaccgtacaaccaggaattcaatccacattttacatgggcggtcaaatagggggatacaataacaatatgtacataaataatggccaaaattttcaaccgcagcagcaacaacaagctatacctggctccaactggccatatttaccacctcatgttcaacagaagcttgtcaatatgccaccagatcaagcacatttggctgcacaaatatag

SEQ ID NO: 4785 - DNA, 837 bp, Candida albicans
aaaaaaatgtatcgaaattggttgtactttggaagagattctatcgataatttgttaaataattatagttttttgttaccaagaatcaggaaaactaggcagctcaaactaaatatggatagtaaaagcacttgtgtttcaataggtaaatttccatttgattacactgaagaacaggtgcgggatattgcaagatcagttggaccagtattagatgtgaagttattatttgatgaattaacgggtaaatccaaagggtatgccattataaattatggagataatgaaactgcgtcatcagctgttcgtaatctaaattatatgacattgcctaatggtagatttctaaagtgttcatttgtgacagattatgacatgtcgagtaaggaatcagtaaaattgccacctttgccacttgggatacaaatacatcctaatcagaatgcatcacaggttatatctactatactatcgaatattgattccaattcggcactacagatattgaaggaaataaaggttatgagtattgataatccaaaaagtacaaaggttttattagaaaggttcccacaattgagtttagctttagtggaattagggctactttcgaatactacaaaccaagagttgattgagttgactttaaacaagagacctgtggatttgaccgagttatctttggatcacgttaggttgttgcagtcagtagagaagctaacagacgaggaaattgacgagttggatgaaagtcaacaggagatagttagaaaagtaaaggaggaaatagcgaaaggcacatatggtgaagtcctggctgtcaaagataatgcctga

SEQ ID NO: 4786 - DNA, 939 bp, Candida albicans
tatttatcttaccctttcatcatggatacaaaggaaataagatctactgtatctaatcttgaaaaagcagtagatgacaccaccattttaaagttgttgaatatcttgaatgatggggttaaaccatccgaaaaactcttgagagaaaccaaagtaggtgtagctgtcaacaaattcagaagtcacgacagtgccgaaatcaacggtttagttaaaaaaatgatcagaaattggagagatgccgtgcaagccgaaaagaacaacaaaaagaagttagcaatagcagctggaacaggaacaggaacaccttcaagctcagcaatttcgccatcatcatcgggttctggaagtacaacaccaaaaccatcagagtcaaccacaccatcggctgcccgtaaaggtccaagaaatccaaaaactgacggtgtaaatactcaattatacgaaaatgataccagaaatgcatcggttagtgctttatacacgtcgttagcagttgatcgtgacgattcaccaaaacacattttgagaatagctattgaaatcgaggctgaagtatacaagagcgaatacctgaaagtaagtgacagttatagaaataggttaagaagctttaccatgaatcttcgaaataagaaaaacccagaattaagagagagaatcttatcgaaacaaattttacctgctgcgttcatcaaaatgacccctaatgaaatggctcctgaggcattgaaaaaggaaattgaaaaattgcacaaacaaaacttgtttgatgctcaaggtgctactgaaaagagagcagtgaccgatagattcacttgtggcaagtgtaagcacaagaaggtcagttattatcaaatgcaaaccagatcagcggatgaacctttaactacattttgtacttgtgaaaattgtggcaatagatggaagttttcataa

SEQ ID NO: 4787 - DNA, 753 bp, Candida albicans
  unsure (395): Identity of nucleotide sequences at the above locations are unknown.
atttacttattctacttctgtttatttcattttcattttcactatacaaaactagacttattaatcaagttaatcaacgtcgcaatgtctatgtccacacctatgcccacgcccacttccctcgacaccaaaaaaatgccaccaaaggagaaaaagaataaggatgacagaccttataaatgtacattttgtgataaggctttccatagattagaacatcaaactagacatattagaacccacacgggagaaaagccccatgcttgtacgtttccaggttgtgttaaacgattcagtagatccgatgaattaactagacatttaagaattcataccaatccaagttcaaggaaacggaaaaataagaatcaaaatatgatgattaatcccaatgntactacagctacaactacaggacctgcaggtatggccattccaaccagtaatttacctcctggttcttatgctatacctaatacagctattccattttctatagatcgtaatggaaatcatgtatatcatcaaccttatccagtatattttgtgccccatgctaatggttatatgcaaccaatggtacaaactcaaggagttacagttgttcctaataccgatcagcaacagcatcagcaacagcaacaatatcaccaacaacaacaacaataccaatttcaagaacgtccacaacatcaacaacagcaacaaacaaatattggatattcagcccgaggctgccagaaccgcgggcaa

SEQ ID NO: 4788 - DNA, 1527 bp, Candida albicans
acttgtttattcaagttaatcaacgtcgccatgtttatgtccacacttatgcccacgcccatttccttggacaccaaaaaaatgccaccagaggagaaaaagaataaggatgacagaccttataaatgtacattttgtgataaggctttccatagattagaacatcaaactagacatattagaacccacacgggagaaaagcctcatgcttgtacatttccaggttgtgttaaacgattcagtagatccgatgaattaactagacatttaagaattcataccaatccaagttcaaggaaacggaaaaataagaatcaaaatatgatgattaatcccaatgctactacagctacaactacaggacctgcgggtatggccattccaaccagtaatttacctcctggttcttatgctatacctaatacagctattccattttctatagatcgtaatggaaatcatgtatatcatcaaccttatccagtatattttgtgcctcatgctaatggttatatgcaaccaatggtacaaactcaaggagttacagttgttcctaatactgatcagcaacagcaacaatattaccaacaacaacaacaacaataccaatttcaagaacgtccacaacatcaacaacagcaacaaacaaatattggaaccaataatcatttgcaacaaaatggatcggcagtattttcattaccttcatcaccaactatggcatcggctcaaacaccaaattcaggtacaagttcatcatctgaaagtattaaattagctccattgtcaataccaaacaacatatctcgttcacaacaacaacaacaacagcagcaacaacaacaaattcctaaatcggaatcttcaactagcctatattccgatggtaataaattattcagtagaccaaattcaacattacattcattgggttcatctccagaaaacaataatgccctgggtccattaagtggagttccaactccatcattttctaatttgaatgattatttccaacaaaaaagtaacagtaataattctcgattatttaatgctagttcatcatcattgagttcattgagtggaaaaataagatcttcttcatcgactaatttagctggtttacaaagattaactccattaactagtactacaaacaatacaaacaacacaacaacatctaatactactaataataatatgacaaaaccaagtataataccaaaacaaccatcttctacatcattaaatttagaattttataatggcaacaatcaacaacaacagaattatcacactcataagaaatctcgaccaaattcaccatcacaaaccccaattcatttatcaagtgcacgtaaaagcgctaataatctgtttataatatcacctaatgaaaccccattacaaactccattacaattcacacgattaaaaacatatcaagatcaaccagcaactaatgttcatatcaaagtgagtgcaccatcagaatacattatggaaatgctgttactgaagaaataa

SEQ ID NO: 4789 - DNA, 528 bp, Candida albicans
aaaaataaaaaaggttcttacataagccacccctccagctccttcttttttttttttttcggctttctcatagctaatttctttttttttttgttttctccatataaaaaaaaattttttctctccccacgaaaaacaagctttcccaaaaccatcaccataccactccttatgagcatagtagaccaacaaaaacctaaaaaggaccctactgtccgtccatataaatgtccacactgcgataaagcgtttcagaggttagaacaccaaacaagacatatccggacccataccggagaaaaaccccatcagtgtacatttcctggctgttcaaagagattcagcagatctgacgaactaactcgacatctgagaatacacaccaaccccaatagcaggaaaattcggaataagaagaacgaagaaacccccgtagccattatcatctcctttctccaccggaggcggaccccccaatttcccccacttcccccaaaaacccattccactcccagttataaaatattc

SEQ ID NO: 4790 - DNA, 909 bp, Candida albicans
catagctttgccgtgatatcaactacaatgcctagcgatccagaagaagactatataccttggatacaacagttttgtgaattgtttggtcacgattattttgtacaggtgtcacaggactttattgaagatgatttcaatctaactggattgtctctgcaagtaccttattatagagaagcattatacacaatattggattaccaagttgaaacggcagaagatcataacactgacaatacaaccaccaataccagcaataacaatgattcacggaatggtacaagtaaacgaaatgcatcagaattgccaaacaaagcgttattggcacattctgcagaattattatatggtttaatccatgccagatacatagtctccaaacaaggtctaactgccatggcatccaagtttgagagaaacgactttggctcttgtccaagatatttttgtgacggtatgcatttaattcctgttgggtcgactgatgtgccgggacaagaaacggtgagattgttttgtccttgctgtaatgatatctatataccttccagttcgaggtatttgaatattgatggtgcattctttggaacgacgtttcctggactattggtgaagatgtttcccgagattgaaaaccagtgtagaataagaataacaaagtttagtcagaatgattttgggctaaaattgtttgggttcaaaatcaacgagttgagtgccaccggtccaagaatgaaatggctaagaatgcatccaaagacagaagatgaaaaacaagagtatgactcatgtgaatataatgttccaattagctacttagatgaagacgaagagatggaagaagacgacgaagaagaagacgaagtggaagaagaagatgacgatcgaacaatggccagcgagtaa

SEQ ID NO: 4791 - DNA, 696 bp, Candida albicans
tatattttttttcttcccacttcttccattcttatttttattttgggaatagtagctactatggatgttgatttagataaacgaaccaaagtctccagagcttgtgattattgcaaaaagagaaaattcaaatgttcaggagtgtcgccttgtgaattatgcacaaaaaagggaatccaatgtgagtttaatattgttgatagacgtacaatacgacgcaagaataagaaaagaacaatacgaaataaacccgcaactgcaacaagctcaactaccagcaaaatcaaaaaggatgagaatcaaattgataaaactacattgaagatgttaactagaaattcaaaagttccagttcaacttcaaccattgttgtccttcccgttacacaaattagacaataaacaaaatgaagaggaaaagcatacacaacaaagcccacctgctgctgatgatacaccagacgatgaaagaaaagacaaggacagaaaaatcgacaagaaaacccatccagatcctccaaaaaatgaaagggcccctcctaaagttttatacgattctgaaggtaatttaagatatgtgggggaaagttcaccgttgtcctttcttttcgaatgtcggaacatttttttggatagaataggggaatcagatttcacgtcagatcttcaccaggcggctggaaggacccgagcttgg

SEQ ID NO: 4792 - DNA, 564 bp, Candida albicans
ttaaaatccttttcatatattctcccgtaccccctccatatctattcacaaatatttcaaatggatgccgatttagagaaaagaactaaagtatcacgagcttgtgattattgcaagaaaagaaaattcaaatgttcaggagtgtcgccgtgtgaattatgcacaaagaagaatatacaatgtgagttcagtattattgatcgacgcacaatccgccgcaagaataagaaaagaaccatacgaaataaaccaataaccaataccgtcataggatctcataaaattagtaaaaatgacgatgataatgatcaaatcgataaacaaaccttaaaattgtggactaagaaatctaaagtacccgaacaacttcaaccgttgttaacatttccattgcacaaattagacaataaactgaacgaagaagaagaagaacagcgtgagacaatgatcacgataggagcgaggaaagagagcaccaacacaacgaccaatcactccctcctgggtctagttcagagtcgcataatcgtcagaaagtggacattcagggaaacgagagccacg

SEQ ID NO: 4793 - DNA, 909 bp, Candida albicans
atccttacaatacccacagtctccatctccaaaataacgtggtggtgtcacaatcatagtctactgcacgtagagcaacaagaagttggaatttttttttttttaattgatataccaggggcgacaaaaaaaaaaaatagccaaaatcaatcatcgttttctctttgtacagcacccatcatgagttcgattaaaacaagtccaaccaaaaagacatctgaatccactaccaaacaagatacccccaatgatcagactaatattgaaaactttgatgaagagccatccatgctctcggatcctgaagattatttagaggaaaatgaaacattggatatgaatctctccaagggggatcagaaagtgtggttagttaaactaccaaagtatttaatggatgattggtccaaccctgactcaatgaatggccaacaattgggtaatgtgaagataaaaaaggacgcacggggtaaattacaggttaaattgttattggacaacaagaacgacaggataccaaaagagtatgatatcaaaatgttaaacacccaagtccgcaattcgtatgtgttcaccgaagagaatttgaaaaagttcaaacaagaagtgactgaagtttcggatatgccagagcagccacaactaaaagagttgaatccagaaaagaagaagttccaagtaagacgaaaatttaaatactttagggtacagaaagagggagagaatggccaaccagttaagaagtatattccgtttgttaaaacaatcccgaaaaagacaagtttaatgggtaaagtgtgccacgattgcacagtggtaccagcaaggacgggcctgaaacatggcgaatcgttaatgaaacatcaaaatatgacccaagtcgtcaccacgggctggaaaatccgcgtc

SEQ ID NO: 4794 - DNA, 684 bp, Candida albicans
ctttttcttgtggctatggacttttcaaacttgctatctaacgaaatcaataagaaacgtaaaaaggtagctgcaaatggaaggaaacgcagcaaagtgtctaccaccgccaaagaaccggcggtagttgttgagcatgcaccagaaacaatcaacccccagcctactacgacaaacgatgagccaagtgaagaacaattagatacaaagttgtcacaatttggtgaactagatacgtccttatcgaaatcagaaaaggccaggaaattgcaattactactacaacagcaaatcaaaaacacaaagtacaaggcatggctagatcaagaggctccgttgtaccaagaccccgaaaagcaattgatcacgcttgatttgataactgatataacaaataaacaagacgaagtatacctaaagctacgggtatacataaagcagctaattaaacaatggcaagaatgcgataacgacgaccaagagttattgatggaaacgaaaaagagtatagtcaaattgttatacaagctaaggagccataaactttctatggacatgctaatatcgctcctgaccattggttactatattcaaccaaacgaattcaacaaaggcaaacgaaagctacatgaaactaagtatcggcaacgtctgtgggccaattggggtggtcaatgtaagtaa

SEQ ID NO: 4795 - DNA, 1218 bp, Candida albicans
acaaaccatggccgtgctggtcttaaacccaactacatgcaagatgtgtgtttgaatgactcttgctcattaggttcacctgttaactcaatcgaaaattctggctgtactacaactaagacaacaccaattatctcgcccatgtcattgaatgactatgtgttgccaccacctaatcatcatgattttgatacatttatggggaataattttgtcgattataccagttcttataatcccgagcatactttaccgtcgccgctgtcaccgctaactatggtttgcaatgatggtagacgccacgacgatcacatgaactttgcctcaactttttcagttcatccagcgtcatcaaagtgtgccatccaacattatggcaactctaatcaagaattaaccaaaggttatccaaacccaaactctttggtttataatacaactaataattgcatcaacaacaacagcaacagcaacaacaacaaatattccctgcatgaatataaagatactagaatgatggagatggccacaccggaatctccacacaaacggaacctgttgcctaatactcgggtaccaatcattccaacttcccccacatttccaattgcattgaatttgattcatagtaatgctaacaccaaaagacataaatctttgggctctgctacctccatgttacagccaccattggaggatagcagattaatgaatagcggccacgcagaaccaatgaagaagagattattatcgagattttcgtcacggttaatacaaaagttgagactcgctgaaagtgatatgaaatgtcgtaagcattgcaacactaggtttggaaactacttagagttgattgaccattttgaagggcatggcttgcaacggtacttactgtcaagaacttttatttgtccagttaaagagtgtcctatgaatatgattggttttgataaacgagcagagttgagacatcatgtccattccgatcatgtcactcatggtttggtcagcattcagtatgccaaatacagtgaagaaatcaaagagtttttgtttgtttgtgacgaagaaaattgtgggaaagggttttatagaagtgatacattgactagacacattaaattggtccataaacgtgaaaagcactttactaaaagaaaaagaagacaagtggttgctcatcaagaagacaaggcaattaaaaaatcgaaaggttag

SEQ ID NO: 4796 - DNA, 351 bp, Candida albicans
ttcatcattacaatgtcaagtagatctgaaagagcttgtatgctatgtggaataatccaacctatgaaatcttttattgattatggatgtcccaactgtgaaagtcttttacattatcaatataatgataataaacaagtgcaggattgtacttcaccatcttttgaaggtttagtagcattaggtgaagataataaagggtcatgggtagcacgatggttaagaatcgattcatttacagctggattatatgctgtcaaagtgaatgggaaattaccaccttcaataattgctgaattggaagaacaaaatgtgatatatcgaccaagagatggctcagctgaggattaa

SEQ ID NO: 4797 - DNA, 366 bp, Candida albicans
tacacacaccacaacatgaagttggtacgctttcttatgaatatccccaattctactaaccagccgataacggttgagttgaagaacgggaatattattagtgggacattgctatcctgtaatccgctgatgaatttgcatttgaagaacgttaggttacaacagccattgcaggacccgattttgttacagtacatcaacatcagaggaaaccaagtgagacagatattgttgcctgatgagttgaatatagagagtgttttggccaagtcagagactaaaatcaaaggtagtggcgccggacccggtgccaaagcagtggcacgaggtgggtttagaggtaggggcaagggtagagcggtttga

SEQ ID NO: 4798 - DNA, 942 bp, Candida albicans
ttaagtactgaattatcaacaattatcaataatgaaattgaacgatttcatacattaattaaattgaaatataatttaatattcccagaattagaatcattaataatcaataaaattgattacattaaattaattaaaatttttaaacaagatttatctaatataaaatcatatgaatcacaaatgaaattgattattgataatgaaaaagtattagtcattataatggcagcattacaacaacaagtatcaaccaatactaatagtactattagtctattatcaaatcaaattataaataaaattttaatagtcattgatattatcgaacaattgaatgatttattacaattattatcgaaatttatatctgataaattggccaaatttgctcctaatgtatctgccatagttggtccaataacaacctcccaattattaattgctactggatcgttaaaaaatttagcattaacaccttcatgtaatattgcttcattaggaataagagatttatccacgaaaaagaaaaccaccacaccaagaaattctaatagtaaaaatgttcgacaaacaggatatatttatcatagtgaattggttaaatatatcccaatagatataattcgatcagtaatgagaataatcagtgggaaaattgttttagcagcaagaatcgatttatcgaaatctaatccaaatggtgaattaggtgaaacttataaacaagaaatattgactaaaattgacaaattattaactccacctcaacaatcaattgataaatcattacctaaacctattgaaatgaaatctaaaaagagagcaggaagaaaatatcaaaaattacgagcaaaatttgaaatgtcagaattaagaaaagctcaaaataaattacaatttggtaaacaagaagatacaataatgaatggattatgtgaa

SEQ ID NO: 4799 - DNA, 2007 bp, Candida albicans
acgcgggtcttctgcccgtggtggtcacatttgttagttgaatgtttgaagaatttaaaatatgggttaaattacaactccagtgaatttgatttattcgaattaaacataatcaaacaagttttattgtatataaaatataatggaatgatagatgaattgattgacattattgaaattttactagccaaatcaattaaagacgaacaatttgagaactttctaaaatttgaatattgtcgagcattattatctcaaactaacaacaaccctaccaatgatgttaagttttcacaaatatttttggatttgaagaaacgctcacagaattggaaatcatttgatgatattattcaattgagtttattacaactacaatattgcatatatgtcaagaattcaataaaggcaaaagatagatttaatggaatcttacaaacacttttgaaaaaaccacaattcaatatatcaaaatcaaagaatttacccattgtttccaaattacagaattttttaattttaggaaaatttcaattacttgcatgtcatgtaaataatcatattatacataataaaattgaagcgtttaataatattaaaacaggtattcaattattatattcaattgtcaaaaaacttcctactaatatcaacaaaactttatggcaagaacttaactgggaaatcactcgattattatttgatagttataaattggcaattgatttatctattgatattgggatatctcgagacatcccattatttttgaatgaatgggttaaactcaataatagtattgacaatgatgtaccgattgttaattgtatcaatgagtttgaaatcggtcgatatggattgctttccaataatgaatttcaaaaatatatcagaattgctcaaggaagactcggatatagccttgtgaagaataatagtgctgttcaacaatatattaatagagaccgggatgacgagatttgtggacacgcttcaagtagtcgtcaattaaagagtcttgtgagaactattttcaattcagataattcactcagtgaattactgaaatcggtacaattattaccttgtattattggtgacagctctactatgtgctctaaggagttacttgataagttggttcaactaaaaaatgaaatattaactgaagtaactaattatgagaaatccagttcattatcgttaaatcagcaacaacaactaattaataatttgaatcaagttgtttgtttattgtcttctttgactttgtttaaaggtgatggtttgttatcagagatttattatcttcaggattatgttagaaatctaccatttgctaatgaacgtaaattgatggattcttcaaagcaagatgagagtaataatttgttaccccatgcattagatttcaatcaagttgttgaagatccaagtaacaacactattaacaatagtatgatagattttaatgttgatttacaactttatttaccccataattggattcttgttacgttagacatttgtcagaatactggagatttattgatttccaaattgactaaggggtcaccaaatccattttttatgagattgccattactgagattcccttcaagtttgggttttcaacaattgatgcaaaattttgaaaaaatcattgatgatagtaatttatctacaaaaaggaaaactacttctaaaattttaactgttgaagatagaaaacaatggtggagatctcgattcactttggattttcaattacaagatattttgcatcatgttgaaagcaaatggtttggtgggtttatttcaggtattttcactaatgacaatgacgttgaaaatgaatccaagaacgtgtttcataaattcaaacaagatttaatgaaaattttgaaagattgtttaaccgtaagtgacgataaatcgaatatagagaggtctcttcagtttaatgaatttatttattactgcttttactccatggaaggaatataa

SEQ ID NO: 4800 - DNA, 735 bp, Candida albicans
  unsure (13): Identity of nucleotide sequences at the above locations are unknown.
cacgaattaattnagaatttgattgataaagttaatgaaaacaaacaaaatgtgactagcgacaacaacaacaacaacaacaacaacaacaacaacaacaacaacaacaacaacaacagcaacagcaacaactcccaacatattgttttgatacctaatgccaactgttccaatttcccatgggaatcgatggaatttcttcgtagtaaatcaatttcaagaatgccatcaattcatatgttacttgatctagtcaaatcaaacaccaataacaagaacaagttaatgtttgttgataaatctaatttgtattatttgattaatcccagtggtgatttaattcgatcagaaaatcgattcaaaaaactatttgaatcaaatcatttatggagaggggaaattggaaaattatcaagtaatgaacatgaagattatcaagattcaatattatgtgaaatcttgaaaagtcatttatttgtttatattggtcatggtggttgtgatcaatatattaaagtatcaaaattatttaaaaaatgtggcaataatcaagattcactgaataaattacctcctagtttattgttaggttgttcatcagttaaattagataattgtaattataactataattccagtatgttacaaccactgggtaatatttataattggttgaactgtaaatcgtcaatgatactcgggaatctatgtacttggcccacaggggccggatag

SEQ ID NO: 4801 - DNA, 753 bp, Candida albicans
tcgaattacgtttgtggaattcaggtggggaaaaaaaagatattttcatgggctccagaagtagaaacatattctttgttgatggtaccaaatgtggatatcacagaattaccagcccacgattgttgggaggcattaaagcttaaggaaacaacatccccaatcaagattgaaagcaagcaggatgttagtcaggacttagacgacgacgacgacgacgacagcttaccaccgcaaaccgatgttgctgatccaatatatgtcaagcaattgatagagtacttcagtgtcgataccagcaatcaaaatgcatacgaaatgcgtagaaaggcattactcaaaggacccaccttgctccaccagaaatatcgctatggcacagaagttcatttctatctggaagaattgctagctttgttgatcgggctagacaaccattttgatgataaagattttaacgagttgaagcttaataacatggttgctgtaattgttactaatcctagcattaccacgtttatgtttaatttgttattgactggagactattcgttacagcagagagtgttaatcttatctgcaacattaatggcagctcgacagttgagaggattcagtccaacaaatttcccgtcgcagacgctaccggaacctttacatcgaaaataccttgagttggagggcggttccaaatacattgattttattgaaaatgaagtgcagaaagaattgttagccgacgcatcaagctga

SEQ ID NO: 4802 - DNA, 585 bp, Candida albicans
ccgacgcatcaagctgaagctcagacccaattgttggggtttgccaaggtagttagggtatcgtcaagattaaagcgaccagcgaaatcaactgagactccaactgcaggtttttatactattattggcaagctattttatttcccgttgcttaatgtatggtacgaagcaggcaccatagatatcgggcactactcgccagtttatattggccattatatcaagactttggcgttgttgatacactgtgcgtaccctctgtcaatccaactaaatgatatggttaaggagtttttaattttgagttgcaatattcttcggaagatctcgttggaagcgacacctgtggtcgagagtatagttactggtgtcttgatagtgtgtgaagtatccaaccccgagtttttggtaactaatcacaatgacgaaatagtcttcattcaaaactggctatcggtgtcgtgggagttgttggttgatgataaactaaagagtgttgctgctggcttgttgctaagattacaaaaactagagtctagtttagagagaactataatggatcaatctaatagtattattacttaa

SEQ ID NO: 4803 - DNA, 897 bp, Candida albicans
gcctgggaagtcaatcagatcgaacaatattatatgagatgtataaccacatggaattcagataaacagggagatgatgagaaggttgaaaagggattcgatattctggaaccgtttataaacaaggaatcaaacattgtagtaagaaaattgtttacggaggaagacagtgttgaaagggtttggacattacaagtaagtgacatccctgtagccggtaagaaccagggatgctgtcaacaacaaatatatgaaagtacgttagtgcacacccatacagcaattgagattaaagttgggaatggtgatccaatagatatagatacaaacaatgataaacagggtgacaataataccgataaaccgaaacaagaacacgatggtaaacttccagaggcaatcgatgaagacataataaaaaatggagatgaaaaaaagactacgcatgatgacaatgattctgatatcatggaaattgatgagccaaaccctgaaacacagacccttccacagtcattatcaaacggtgtatcacagaggacgactaggaaagactcattcttaatctttctttctgacttgggatacgaggtgataaaccaatattggcagaaaggagttcgatttttctacggtgacataattatagagatatataaaatattcatcagagatgagagcagccaagctgattcaaatgaaggaataaaattgaaattgttagatgattcaaatcaatttcaaatcaaagcatacattaatattaacaaatccaccgagattgactcaattaacctgggtgtcaaagaactaatcaaattgcaagagtttcttaaaaatttatttgtattagagattcccgaccgaatgttcatggacagcagaatcaagcagtag

SEQ ID NO: 4804 - DNA, 1119 bp, Candida albicans
  unsure (1082),(1099): Identity of nucleotide sequences at the above locations are unknown.
ttggttaaggaggttgttgaatctgcgttagttgatcttgttaatgctgttggtgttgatattaacgaatctgtgcgtgattcacgcttggcacagacgttgaagtatgtgggtggtcttggtccacgtaaagcttcgggtatgttaagaaatatagctcaaaaattggggtccgtgttgacaacaaggtcgcaactaattgaatacgaactcaccaccagaacgatcttcattaactgttctgctgcgttgaagatctcattaaacaagtccattaatgtgaaggattttgagattgagattttggatacgactcgaattcaccctgaagataatcagttggctatgaaaatggttgcagatgcccttgatatggatgaggagtcagagcttcatgaaaaggggggtgttatcaaagagttgcttgagaatgaccccagcaagctcaatttgttgaatttgaatgattttgctaatcaaatatacaagctcacccataagctaaagttcagaagcttgcaggccattagacttgagctaattcaagggtttgccgaaatacgatctccatttagaatcttgacgaatgaggatgcgttttttatattgacgggtgaaaagccgcagatgttgaaaaatacggtaatccctgcgaccatcaccaaggtcaccaaaaatcatcatgatccatatgcacgaattcgaggtcttaaggttgtgaccccgtcgttgattcaaggtacgattgatgagaatgctattccgcgtgatgcagagtatgtgcaagggcaagtggtgcaagcggtggtgcttgagttgtacaccgacacgtttgctgcggtgttgagtttgagaagggaagatatttcgcgtgcgatgaaaggaggtgtggtgcgtgagtatgggaagtgggactacaaggctgaagatgaagatattaaaagggagaaggctaaggagaatgccaagcttgcaaagacaagaaatatccagcacccgttctaccgtaatttcaactacaaacaggctgaggagtacttggcgccacagaatgttggagattatgttatacgtccgtcgtncgaaggcgccagctatntgaccatcacgtggaaagtg

SEQ ID NO: 4805 - DNA, 522 bp, Candida albicans
  unsure (30): Identity of nucleotide sequences at the above locations are unknown.
atacttggatccttgacggctgttgtgaanacgtcagatgggttttccgatatttctgaaaagtggaaccaggaaagacaagctgttctccgtacggccatttcgaggttgtgtgctgttgtggccttgaacacgaaagatgatcttcgtcgtgaatgtgagaggttgattgccagcaaggtgagacatggtcttttggccaagatcgaacaggcaccattcactccttatgggtttgacattgggtcaaaggcgaatgttttggcgttgacgtttggtaaaggtgattacgacagtgctgttgttggggtgtacatcaaacacgatggcaaggtgtctcgatttttcaagtccacagagaatccgtcgagaaaccgtgaaactgaagatgcattcaaggggcagttgaaacagtttttcgatgaagatgagacccctgatgtggttgttgtctccgggtacaatgccaacaccaaacggctccatgatgtggtgtacaactttgttagtgaatatgggatt

SEQ ID NO: 4806 - DNA, 606 bp, Candida albicans
aaagtcaactcctttaaagacgttgcacaaagtattgaaacacaattggattatgttgttaaatcaagagttatactcaataatatcaatcaaaatttagataatttgtcatcacaacatgatttagaaaataccacaagaataatgaaagctaaatcaagacatactaaattatcgagaagattattaagattagcaacaattggacctattgtgaaattgaaaggttatccattattaccagaagaagaggaaatctcaaaacaatttgaattattaacatctaaattgaatgacccaaatagttcgattggtaaattgagtgatgtgtttgctacattagccatactaaaagaacgagcagaagaatttaattaccaatgtgaaaattctgtcaatttattaaataatactttgattgaaggtgaagaatctacatcgaaaaagggatcggtaactactgcagcagaacaatctgacagtatcattgaagaagcaattcataaactttcaaaagttttattgaagcaacaaatgggattaaattatttgaatgatattttagaaaaagatattgaagctgtcaataagatatctaaaaagtaa

SEQ ID NO: 4807 - DNA, 1209 bp, Candida albicans
tcgaatatggctaaagcatctaaagttgacaagaaattgtctaagaagaaagaagaaaaacctgctaagaaggttgaagaagaaagttcaagtgaagaaagcagttctgacgatagttctagtgaagaaagcagttctgacgatgattccagtgacgacagttcaagcagctccagtgatgaaggttctgatagcgacagcagtgatgaagaagaagtagaaaagaaagagagttctagtgatgaaagcgatgatgaagacaagaaggaagagagctcatctggttctgacgaagaagaaaagaaggaagaaaagtcttctagttctgacagcgaggattccagttcttccgatagttctagctcagagagtgacagcgatagcgactccgattctgactccgactcagaagaagaaccttgtaagaaacgtaaagctgaagaatccaaagaagaagagtctgctccagtcaagaaatccaaaccagctgctagcactgaagaaccagctacgttatttgttggtagattatcatggaacattgatgatgcttggttaaagagagaatttgaacacattggtggtgttattggtgctagagtcattatggaaagagccactggtaagtctagaggttatggttatgttgatttcgaaagcaaatcagccgctgaaaaagctctcgaagaaatgcaaggtaaggaaattgatggcagaccaatcaacttggatatgtctactggtaaaccacatgcatctaaatccaataacgatagagctaaacagtatggtgacagtcaatctcctccaagtgacaccttattcattggtaatctttccttcaatgctaacagagacaatttgtttaatgtttttggtgaatatggtaatgttatttcatgcagagttccaactcacccagacactcaacaaccaaaagggttcgggtacgttcaattctccagtgttgatgaagccaaggctgccttagaagcgatgaacggggaatacattgaaggtcgtccatgtagattagacttttcaactccaagagataacaccaacaacaacaacaacaataatagaagaggtggttttggtggtggttttggcggtcgtgaaagatcagctactccaagatccggtaacagcaccccaagaccaaataagtcaactgaattcaaaggtactaagaagacctttgattaa

SEQ ID NO: 4808 - DNA, 1635 bp, Candida albicans
tttacccagaccggtaaaggttgcacagaaaagatcccaagaaatatgcaattccatttaacccgtgaggaattagatcaaaggaaaagggaaaaccaacaaatggaaaaattgaaacaggaagaaaaagaagcaacagcaaagccaaccgaagaatcagaagaaaaggaagaaaaggataagcctacagctgatgcagcaaaagtagcaccggaaaaaccaacactaaataagaatcaggcagatatgtctcaggtagcccctgatggtggagccagaaagaatagaaagaatttgttcaaacgtaaaactagacagattaatcttatgaatgaagaaaaaagaaagttgagatatgaagagcattatccttgggtaatagaagattatgacgggaaaaacgtttttgtggggaactatgaagcagggtcaacagaacaacaacatgtattgtttgttttcgataaagatggattcaaaatgattcccgcggagaaagtatacagattcacacctagaaatagatatgccactttgactttggaagaggccgaagcaaaaatggaaagaaactctagtgtaccaagatggttgatgaaacatatggaggataggtcaatttctgaaggtacaccagatcaaagattcagatataattcacctgcagccaacgggagtgtgatagcaaatgttggcaatggaagtgctggaagaagaatgagaacagtcttgggtggaagtggatctggaaatgacagagactctgatcatgatgatttagattacgatgaagaatttgctgatgatgaggaagctcctattatggacggagatgaagaagaaaataaattgtcagagaagaaaatcaaaaaagaaatgttgaaagctgcacattttgatggacagctggaggctgaggcagaagatgatttggatgatttgtttgaaactgaaaagaccagaaaagtcgataaagaaggtaagaagttaagaaaagtattgaacaaacgtgaaggtggtgtatatgatagcgacgaagaagacggattaatgccatatctttccaaatcagatttggaaagtgatgaagagagtgatgacgaagttcaagttaagaaggagccatcgagtgattcccaaactgacaacaatacgaataagacatcacgtgcaagggaagtaagtgtcaaaagtattggggatggttttgtggttatcaaagctccaccatcatttttaggaactatgcccccaggtgattggaatcctcaagctcgcaaacgccccactccagaaattgccagtccaaggaaaaaaatcaaattggacgaaactatcaaggttaagaaagagagaacattgtcaccacctcctgtttcaccaactacgaatgctgccacaaacaccagctctccaggcaatggaatggacttgaatgatgctggaccagacaatttattggtcacggtcaaagatgtgttggatattgtaaaagaccagccattgactacaaaagaattattaatgggattaaagagcagggtcagtgctcacaaggataataaattaagaattatcagtattgtaaagcaaaatttacgattggttgatgggaagctagttcttaaagactaa

SEQ ID NO: 4809 - DNA, 633 bp, Candida albicans
aatacaatatttgctaaggatttagaattaggtaattgggatttaaaacaagatcgaaaaaataatgatggggatttatttgtaggtaatgaaggtgatttagtatttattgataaatcatcaggtttagaagttccatattttgaaatattgaaaactagaagtgtgaaaaaatggttagataatttacaaaaatcaaccccagaaacagattctaatgaacaacaacaacaacaacaacagcatgagcaattattggatgaattgaaaaatagtcaagtttcaattttgactttgagtaataaaaaattccaatctattgatagttttattaataataatttgacattaattgatagtatgaaaaaatcagaacttgaagggaagactacaataacagctaacaataagactaaattatcatcaccatcactgccagttacatttactaataatgctagtaaaatcaaaagtccattatctcaagatgtcaccgaaattattctagaaggaggggaagaagaagaagaagaagaaaaagatgccaccaataagaaatctacacaaccagcaccacgaccaacaacaacaaaaacgaatatagatcaaacattagaagaagtagatttgtaa

SEQ ID NO: 4810 - DNA, 1296 bp, Candida albicans
caaattgttagaaatttgcccgatgatttccgtcaatttaataaacgtcatgatggtcaattaagaggtggtaaaccaacaggattgattatggggttagttttattagatttagaaaccattgttgaagaaaaattcttgtggaccaaagttgctgaaagattagaaggtcaatattatatggcacaacatagacaaagacaagataatataatgaaagaaggttccagtaataataaatatggtccaataaataattcatttgttgccaatcaaagatcaatacctcccaattatattcaaccatattattatcacaagggttgggtcattttattgaaagataacattggtaatcaagtggcaatggaccttttacctggtcctgctggtcaagtaggacaaatcatattatttggacgtgatttcgacaccaaattagtcattgcttcaagtttacaagaatttttatttggatttgtcactgatttagaacaaggcaatttccaaattgattcgagtgaatatcaagaacaattgggatttttatcaaatgatcgtaatggtgactttatggttggtgatgaagatgaagatcaaggtgaattgagtttttgggataaagatggacaagaatttggtaaaaatgtgattagaggaagattaagttatattgaagtattgaaaagaagagctttgaaaaaatatgggttatcggaaacttttgaaacttcatttgtgcctcaaagaataccaaagaaacaacaaccacaacaaaaatcatcaggatctgggtctggttcaactactcctattataagtcaatcaagaaacgcttcatcaagtaatttgaaaaagaccaccacaaatgggaatgctgcttctccagctactgctgccggctccgccagtactgctactactggtgctggcaatactaaaaataaaccaccagttccaagtccattggctaattcagataatgcttcaagttcattttcaattcctaaagaaactatattgaacaagaataaaccagaaaaggaggaaaaggaagataaacaagaagtatcatcttcagaaaaagctactgttgaatcaaaagatccaattgaaactgtaaatgtcagtgtgaatactgacaaagaaaagccagaatcaaaagcagaatcagaagcagtgaaggcagatgataaagaatctgaagaaatcaaagtgaccaagaacaatgatactgaagaaagcgagaagaaagttgaacctttcttcaaccacgagggctggaaggaaccgcga

SEQ ID NO: 4811 - DNA, 426 bp, Candida albicans
acaactcaacttataaagaagttaattttattatccatcatcatgggcttattagataatcttaaagcttttgttcattcaattacaacagaagatcattatgcttcatatgattcaccttatagaaatgacgataatgaaccaattggtaccaattctcataggtcatcaactaatgactcagcattacctttaaacaacgatttaaacaattctcaatattcattagataattctactggtgcagcagggttttatagaccaggtatgaaatcatctcaacaggatttaccattacaaaattttagtgccaatggccaaccaccattaccatctatagattcattatgggatcgaatcgaatattggatagaacaagaatatcctgaattggaagataatttgaatgatggggtacaactctga

SEQ ID NO: 4812 - DNA, 693 bp, Candida albicans
aaagaggaaaagtggttaaacatttttttttatttaaactaccatttccccattcattattttgtttgtttgtttgtttgtttgtttctccaaatatcatataatctacaaaagttacttgcttactttcttatttccatatttgattctttcccttctttcctgacaactatgaagtttggtcaaaaattacaagaatttgtttattttttaactaccaatgataaatattctgaatttgattcaagaaaatcatttaatagaatcaataaacccgattccgaaaatttattagggcatcatcataataattcttcattagaattagtttctcatacaaatgatgatacttcatcggccaagaatagtaataacagtaacaataatttacaaggaattcatgaagttaatttagcttggagacatataaaaaattggttacataaatattctcctgatttaaataattcattacaaagtaaatgtactgattctgatttacaagattttcaaaaagatttatcaataaaattaccaaattgtgtcattcaatattttaaattggttgatggtcaatattatgattttgaatcctcaggattaatatttggattaaaattaatgtcattagatgaaatcactacagcaacagaaaactggcgacgagtagctggttattcagcccggggctag

SEQ ID NO: 4813 - DNA, 1083 bp, Candida albicans
cccaatttcaattttgatggcgaaatttacacattcaaggaaagaccttcgttaattgaagaaaaagaaggcaaaatagagtttcgtgtggtgcataatgacaatagtcgagaaaacttgattgtgctaaccgggttaaagaatattttccaaaagcaactacccaagatgcttcgtgaatatatctcgcgtttggtgtatgatcgatcacatttgtcaatggcagttgtgagaaagccattaaccgtggtaggtgggatcacataccgtccatttaacaaccgtggatttgccgaaattgtgttttgtgctatctcgtcaactgaacaagtgcgtgggtatggtgcacatttgatgaatcatttgaaagactatgtgagggcaacatctccaatcaaatatttcttgacgtatgcagataactatgatattgggtatttcaaaaagcagggtttcacgaaggaaatatcattagataaatcggtgtggatggggtacatcaaggattacgaaggtggtacattgatgcagtgctcgatgttaccgtcaatattaaggtaccttgatctgggtaaaatattacttttgcaaaaagctgctattgaaagaaaaatacggtctagatctaaatcaaaaatagtgagaccgggtttgcaagtttttaaaaccaataagaatgtgacattagaccccaaagatatccctggattagcagaggcagggtggctggaagaaatggataaattagctcaaaaaccgaaaagaggaccacattataactttatggttacgctattcagtgaaattcagaaccacccttctgcttggccatttgcagtggcagtcaacaaagaagaagtaccagattattatcgagttattgaacatccaattgatttggcaacaatagaacaaaaattggaaaacaacttgtatttaaaatttactgattttgtggatgatctaaaactaatgttcaacaattgtcgagcttataattcggaaaccacaacatattataaaaacgcaaataaactagaaaagtttatgaataataaattgaaagactgtagttttgtatag

SEQ ID NO: 4814 - DNA, 948 bp, Candida albicans
caccaagaatccagtcagaaaatttgtgtttcaattgttgaagcagtatcgaaaaggttttccagctatagacatctttacaccggcaatccaggaaatacagcttacagtatgtcatcatcagttaatttgtcatcaaccagagaaatcaaaaatgaaatagcaaaggaagatgtggacgggaccaactcttcaaatatacatgaatcaacaacaaaaataaaagacaatgtgtcttcaaaagacaataatcaacattctgttaatgatgacaacgattatgacaataaaacaccagagcagttatcaaaaatttatgaagaataccgaaatcgattcaaagtggctatggaaaaatcaaaccaattatttgaatcacaacagaatcatttcattaccttatcttattattatcgtcgtaatcaaatttacttgtcgattttgaatgatctatatgctgccaatgaagatgaaattaatatcgatgaagattttggagtatcacgacttgaagatttaattgccaaaataccaagaacgaaaaaaatgttaactcctataattaaactgattaaacatagtacaataactgataagcgtgatgaactaaggataggtaattatatgattgaaaaagtttctgatttaattaatgatgatttaaccaagtatcatacaaatcctcaaagtattgaaaattggtgtcatcgaaatagtgttccgaacttgataagtggtaattatgtccccattatattggatgataataatgactaccatggaattgagtataatttgaacttgaatgatgaaggtcatcaaggtgccactacttctacgaatactactgccaatctgaactcgaacactggtagtgttaataatagtgccaatacccacactagaaagagacgttcagtagagtctacacaaaactcaatggaataa

SEQ ID NO: 4815 - DNA, 447 bp, Candida albicans
ttcgttcaagttggaattattatcatgggagtacactcattatggaaaatagttgggccaacagcgagaccagtaaggctagaagcactttcaaaaaagaaattagctatagatgcctcgatttggatatatcaatttttgaaggcaatgcgtgataaagatggcaactccttaccatcatcacatattattgggtttttccgaaggatatgtaaactattgtattttgggatattgcctatatttgtgtttgatggaggagtgcctgctttaaaaaagcaaaccatcaataacagaaaacaacgaagagaaaagaattctgaatcacggcaagagactgctcaaaagttgttagccatacaattgcaaagagaagcagaaaacgcgttgaatcgactgaaaaaaccatcaaataacactaccaatggcgacgatgaacgacgttaa

SEQ ID NO: 4816 - DNA, 2385 bp, Candida albicans
  unsure (2361): Identity of nucleotide sequences at the above locations are unknown.
aaaaaccatcaaataacactaccaatggcgacgatgaacgacgttaaatattttgaagacttgccaatcaataacagagagagagaatcatcaaccccgtcatcaatagttaacagaaagaatgatgagtatcatttaccagatctaaaggagttcaaagtgtcgaaattcgatgaaagaattatgcctgaggaagatttgacagaattttatgaagattttgatcatgttgatgggattaatataaatgaaattgacccgaaatctaaagaatttgaagcactacccattgccacacagtatatgatattgtctcatttaagactaaaatctcgattgagaatggggtatagaaaggaacagttggaagaattatttccaaatagtatggatttctcaaagtttcaaatacaacaagttcaaagaagaaacttttatacacaaaaattaatggatgtaacaggaatgggtgcggacgcgaccatatcgaagcgacttgcgggtgacaaagacagaaagtatgctcttgtaaagaatgaagatggttggactttggcattagaaggtaattccgaagacaatccaatacaggtggactccgatgaagctgaagatattacacgtgaagtcaatagttacaaggaagatttgaggcaagacaagaaggacgaagatagtgattcggattttgaagatgttcctttagaggaaataccagaaacagaagaagataaagactatcaacgggcattaatcaaatcaatttatgaacagtataatacacaggaaaatatgcaagctccaacaagtactataaatggtgttgatgacgacgaattgaggaaagctgtagaaaagtctaagattgattactttgagttacaggctaaggaaacacaacaattggaagaagaaaaatttgatttcggatcgtcaatgttgttttcaacgaatgctgtgaaggaagaagctctccaaaatagtgaggagatttccaatttaactgaacatgctcatactcaagtaaacactgtccatcccagtgagcaagataaaatcataaatagtgataccaagaaggaattacccaattccataggtcaatcttttttgtttaatgcagatcctcacaggacaggtaaaatagaactccgtacaaaagaagaaacaatctttgaacctgaagagagtgattttgaagaggcaaaaactaataatgatcaactgatatcccacatagaaaaagcaaagaaacaagaacccacaaaggatcagcaaaagttacctgattggtttcaaagtgaagttaacaagactttgaacccacataatgtcaagtttgttaactacaatgattatcaaatacgtaaccaaaaaaatcaagaagaaaaggatgctggattggttccttggtatgaagccaaagaaattttggagcaagaacagtcagatgaagaagagcaggaacaggagcaggagaagccagacaatgatagtgatgaaattgaggaaatcagtaaggaacaagtgaatatatccatttctgaagagaaggaaagtgtgccaccactgtcagttgaagatataagaaagccagctgtgatggattaccagtttgaagaagaagacgaagaagagttggtccagcagttacaaaaggaagaacttgatcatgaaagtcttaaacatcaaatcaaagcatcgcacgcaattccattgacatcacttgaaacaagaattacagacgagcagttattacaagaaaaatttcagaaagcaaagagagattctgatgaagttactgaaacaatgataaatgatgtacaagagcttttgaagagatttggaattccatatatcaccgcaccaatggaggctgaagcccaatgtgcagagctttacaaaattggtcttgtagatggaattgtaactgatgatagtgattgttttttgtttggtggagacaagatttacaagaatatgtttgaccagaaacaatatgttgaattttatctacaggatgatcttttcaataagatggcgttaacacagcacaagttaatcgagttggcacttttattaggaagtgattacactgagggcatcaaaggtattggtccggttcaggcaatggaaatacttgctgagtttggaaacttggagaagtttaaagaatggtttgacaagcatacaaaatcagttgctgataaaacagagctcaccaaattgcagaaaagtttactagatcgaattaaaaagggtaaactttatcttcctgatagtttccctgataaagtggttgaacaagcgtatatgtcaccagaagtttattctgataaaggacaatttcaatgggggttnttaacgcggcgtagcggtatgtaa

SEQ ID NO: 4817 - DNA, 1089 bp, Candida albicans
agacaagaaaataaacgacaattgaaacggcaaaaactacaaaagattgttaaacatcttgagaaggaacaaatcaaacgaaatataaaatattatttccctacttattcaagacatagaccatttaatttccacaaatttttttcaccaagtcctcagtattaccgttatcaaagaccagcaattggcttgtcgaaaaatataaaaccattaatacctacaaaagtaaatcttgaaatcgaggttgatcaaaagaaaattttcaaattaagaagtgctgatactgcatcgttgtcacacgaagacaaaaatgtcaccaatattactcaagatgacttggattttatcaaaaatttagaaagcaaaagatcttctattgattcgtttattaaagaaattgattacgttaaacgtgattggactaattgcgacaagtttgatcattattcgaaagatttagttctatctaccactgattgggatgatgatgctattataaatgctggagacaatgagtactctattgtgaagccaatcaatgagcttttgctcaacaatcccttggacaatagtaaacagaatagacaaaaaatcgagaatgacaatactaccaacaactataaccaaaacaatagtaatgtccaagatgaggaggaggatgatgatatcttcaatggacaaataaacttggataaattgaaacttgatatgaatgatcctaacttgttatttgttcctagtaaaaaagtcgatgctaccaaatcagtggttccaagtacagataaattattagaattaaagttcaacatatctaacgatcaagagtatgaattattgagaaagaattacaacaccaaacaaagatctcaattgagtaatcttaatattgaacattcagttcccgcattgcgattacagacaccttattataaagtcaaacttagcacagatgaaacgagatcattccatcgaccagtgtgtaatgtcagacctggtacattggtgagcttttctaaattgaagttgcggaaacggaaaaaatatcagggaaatctttgcaacagattttttcccaaactattgacttga

SEQ ID NO: 4818 - DNA, 564 bp, Candida albicans
aaccggagtggattttctaccgctggttcagatccaagattaattagagcatatgttaagcgtaagaaacaaattgaagatgagttattgaagaatgctgatgttgatgaaatattacctactaacgacaaggagttaaacaaaatccgtcgtaaagcattggaagaaaagttggctaatttggagaaacgggcaaaacaaagccgggccaaaaaaccaccaaaggatctgatccatgcagctgctgctgcgggggcaacaattatagatgctaatactgtgatgttaccagatggatcgtatgttattggtggtaagggtattggtaaggggaaaagtcgaactcgtcgttgtaaaaattgtggagcttatggacacattcgtactaatgcaaaatgtcccttatataagaaaatggtgcttggaatcgatgatgattcagcggcagttgttggctcgacaccagcagttagtgcaggtgacgttattggagaaacaaccacatctaccgcagtaactcttgatacacagcgtatcgaggaacagaatctggctgaagcgtga

SEQ ID NO: 4819 - DNA, 528 bp, Candida albicans
ttgggaaatttagaaagcaccaaagaagaagttgatgctttctacagtttctggggaagatttgactcttggaagacttttgaattcaaagatgaagatgttccagatgacactgccaacagagatcacaaacgttatattgaacgtaagaatattgccaacagaaagaaattgaagcaagaagataacaagagaattatcgaattggtcgaaagagctcatgctgaagatccaagaattaaattgttcaaagaaaaagccaagaaagaaaaggctgctaagaaatgggaaaaagaatctggatcaagaaaagctgctgaagaggctgctgccaaaaaggctgctgaagaggccgctgctaagaaagccgccgaagaagccgccgctttgaaagccaactctaaaaaagctaaagaagctgctaaagctgctaaaaagaaaaacaagagaaacatcagagctgctgttaaagacaataattactttggtcttcaccacgcggtggaaggagccacgctctgggttcca

SEQ ID NO: 4820 - DNA, 615 bp, Candida albicans
ttgttttggttcttttgttctgaaaagtctccattattcccattgttaaaaccgtcattaagcgtctaccgagagtccaatagttggtcttgttataatttgaggacaatccaaatcccgttattaatttttgctgctgctagtatctgcatttttgtttgcatctgctatatcttaataaacaaaaaaagctttaatatctggaaaatgtcagctcctatagttgaaaccaaaaaagcatctaaaagaagaattagaagaatcccagatgaccaaagacaaaaagtttcaagtgcttgtgataactgtaaaaagaggaagtttaaatgttcaggagaaaaaccttgttttgagtgcctgaaaaagggacatgattgtacatatacgattattgataaacggtctttaagaggtgaaagaatggcaaaattaaaacagaagaaagacaacaatgagaaacaaagagaattagttaacgaacaaatcgctcaaagttccattattcatccacaaatcactccagtcttacccgttcccgagtatgctaatgtaacgtaccaagattcttcacattccacggtaagtggaaacgattcctatcatttatcatcttct

SEQ ID NO: 4821 - DNA, 855 bp, Candida albicans
ttaatcatgtctacttctgaagaaactaaagtcaccaaaccagtcattgaagacagaatctacgttggtaatgttgatttcaaagccactgaagatgaattgaaagaattatttcaagatttaaaagtcactgaggttgaaatcccattcaaggagaatactcgtggcgataaagttttcaaaagacatttaggatttgcctttgttcaatttgaaaataaggatgatgctgataaggccattgccacttataatggtcaaaaattccaaagaagaaacattttcatcaaaaaggctgttccaccaccaactgaagaagaaaaaaaggaaagagttgaagctttcaaagccaaaagagaagaaatcaaaaaggtaaaagaacaaaagaaggctgaagctaaaaagaagagagaaggggctactgctgacgctgctactactgctaatggtgaatctgctaccactgattctacaccagctatccccgatggaactccttccaaggataccatttttatcaccaacttggattacaaagttaacgttaaaactttgaacagtttattcaaggaattgaaaccaaaatggatccatgttccatctagaagagttccttataatagaagaggccgtggtggcaagtttagaaaaccattcaacaagggtattgcatttgtcaagttttctaatgaagaaacccaaaagcaagctgttgctgaatttaacggtaaagaagttaatggcagagaaattattgttgatattgctattgactccagaattccaaaagaagggtcaactgaagaagatgttgatgatgaagaaaatgctgaagcaaatagcaatggtaactaa

SEQ ID NO: 4822 - DNA, 342 bp, Candida albicans
cagaattcaaaccaatatcacaacaaaaccttcaacacacctcttcaaaaactgaatataaacgtgactaattatattactcctccaaacccaaatttatatcaaaacttagacaactctagctctatacaaaaaagacttaagagcacaaacctctatctacccaaacaactcgaactacattttcatggaccaaacccactacaacacatgcaccacactgcacctcccctaaaaagcaaaaagcgtcacgtaacctttaattgtcatccattttccgctataaattcaatcaatattgtcgtagcctcccaacttttgaacaaactgatcgatcactaa

SEQ ID NO: 4823 - DNA, 1062 bp, Candida albicans
acaatgaattacaacattcatcccgtaacatacttaaatgctgatagcaataccggtgcaagtgagagtactgcaagtcaccatggttccaagaaatcaccttcctcagatattgatgtagataatgctacgtcaccttcatcttttacttcgtcccaatcacctcacattaatgctatgggtaacagtccccattcctcattcacttctcaatctgcagccaattctcctatcactgatgccaaacaacatttggttaaaccaaccaccaccaagccagcagcttttgctcctagtgctaatcaatctaacaccacagctctgcaatcttatacccaaccagcacaacaattaccaactcagttacacccaagtcttaaccaagcctacaacaaccaaccatcttattatttacaccaaccaacttatggctaccaacaacaacaacaacaacaacaacaacaccaagagtttaaccaaccatcacagcaataccacgaccatcacggatactactcaaacaacaacattttgaatcagaatcaaccagctccacaacaaaatccagtcaagccattcaaaaagacatacaagaaaatcagagacgaagatttgaaaggtcctttcaagtgtttgtggagcaactgtaacattattttcgagactccagaaattttgtacgatcatttgtgtgacgaccatgttggtagaaagtcttcgaacaatttgtcattgacttgtctttgggaaaattgtggcacaactacagttaagagagatcacattacttctcacttgagagtccatgtcccattgaagcctttccattgtgacttgtgtcccaaatcgttcaagagacctcaagatttgaagaaacattccaagactcacgctgaagaccatccaaagaagttaaaaaaggcacaaagagagttgatgaaacaacaacaaaaagaggccaagcaacaacagaaattggccaacaagcgagcaaactcgatgaatgcaactaccgcatccgatttgcaattgaactactattccggtaaccctgctgatgga

SEQ ID NO: 4824 - DNA, 993 bp, Candida albicans
ctttctttaagaaacaaattacaggtgctcctaaatatttgggaacaagttacatcctcattaatgaactatcatgaagtgacaattataattaaaaactcactgaacaactcattaaggaaattaggaagttattgcgttttgtctatcaaagaaaccgagactagaaggtttgcggctgtgtgtaaattaataagcatattgataaaacatttaaaagcacaaaatcaagtaacaaccattcgtgatatatattaccaagatgtggaagttttcaaccattgtcaaaatgaatgtagatttcttttaggtcagcttgtggaacgcgggttagggtggtcattatgtgacgacctaaatattcatccaactcagaaaggattagtatatggtgactatttccaagaattaagtattaaagctgaaccaattttgataccgattaattacactaaattttttaatacaaaaatcacacaaataaaagttgaaaaagtaattgttgtcatattagagaaagatgccgtatttcaatgtctttgcacccatttaagacaacacaacataataaatcgattcttaatagtcaccgcaaaagggtattccgataacttgacccttcgatttcttacatggttgcaaaccaatgaaaactgcaaattcattggatttttcgattcagatgtttacggacttaacatttattggcaatacaatcagaaactcccggagatggtatattctggtatctacttgcttgaatcgcagccccatacatggttaagcataaccttgcgcgatatcgctatgatgataaaaatctgtaaaaatggcaacaacaaatacaatgatattccatatcgtgaactcacaagaggattatatttatttaagaaggcagaaatgaatgtggttcaagctaatgatgccaaccaatcttatgtgaactatatggtatcaaaaattcttggaacgcctagctatacgaaataa

SEQ ID NO: 4825 - DNA, 624 bp, Candida albicans
ttacgtttgtccttcgaccccgggctggtgaagacaaataatcaatatgcgattcctcaggaactagtggatactcatgaacaagcgccagaatcgaaatttcttttcacgttgtcaccatcctatttacgtgattccacaattacattaatcaatggtaaatcggcgggtgtatttaccaactccattgaagaagaattgagcgagttggggcatccaagtgatttgagtataccaaatgatcacttgcgcagaggtgctactacagggttaaatgacaaatttgataactttataagtgccaaattgcaaagtttgtggacacaacgacaattgattaaaggagatggaggtcaaatatatgaattggaaaatggaaatttgtgtattagaacgtcaaacgtatttttgcatggtaattttcgtggattgttgatacaaattgagatgagcaatagtttatgtgatactaataatcataatagcttcaaggagcatttcaacaaaattgtcgaaaagtatgggttccccgaaggaaacctttgttgtgatgtattggataagaagaatttagataaatatggagatctttgtttacagtattcaaagatcttgaacttttaa

SEQ ID NO: 4826 - DNA, 453 bp, Candida albicans
atgttaaaattccatacttcaatgccccaatatatttgggaaaacaagacacaagtagggaaagtggacgaaatcttgggtccattaaacgaagtgttttttacaattaagccatcagaaggtgttaaagcagaatctttcaaagaaggagacaagttctatattggtcctgataaattattaccattagaaagatttttgccaaaaccaccaagcgtgggtccaaaacctaagagaaaaactggtggaaagtctgctggtggaagcagccgtggtgggttttcctctagaggtggtggccgtggtggattctcatcaagaggcggtggtcgtggtggattctcatcaagaggcggtggtcgtggcggtttctcatcaagaggtggtggtcgtggaggtgcccgtggaaacagtagaggtggatttagaggaggaagaggaggaagattttag

SEQ ID NO: 4827 - DNA, 567 bp, Candida albicans
tttctctactctgtcttgattcttcttcttctttgtatactattttttttttcaaatttttcaattacgacatcgagtattcaccccaaggtctcagtacaaatgtcctcttctcaagcacgaaaagctcttcaagatgtaattcccaattatttaggtgaatttacacccaagctactagattatatcaattccttatatcaacttagtttaaggaaacaagcaatactaccaaataaatcggaaattgcacgttttcatctatgtgctgttgttattgttgaaaaatataaacaatcttttgaattgccgactcctgatgtgtcaagaataccaacacaacctaaagtagcagcaaagttactagacacttttcgtgagttgatagaacaaatctccgcagccagcacacctgtatcaagtcccaaaaaggtgaaaccaccatcccaaagtccactgacaccaacaaagagtcgaacaagcaaagagaatttgaaatcaggatcccctttaaaacgtcttccgagcaagaaatgttgcagtcttacacgaccgggccctggaagg

SEQ ID NO: 4828 - DNA, 2652 bp, Candida albicans
cgcgccctaactttagcgcggtcggccatccccgtggtgaagacgagagaggtgttgaaccatgtatccgaccctagaatagctcaatcgaatctgaatttgcaaaaaccgaccaaaaaaactaaaaagacaccatataagcaattacctcaaccaaagtttgtgtacaatagtgattccttgggaccagctccaatgtcaaccataataatatgggacttgccaatctccacaagtgaacctttcttgagaaactttgtttctagatatggtaaccccttggaagaaatgacgtttataactgaccccacaacagctgtacctctcggtattgttaccttcaagtttcaagggaatccccaaaaggcttctgaattggcgaaaaattttatcaagacagtccgacaagatgagctcaaaattgatggagcaacattaaaaatagcgttaaatgataatgaaaaccaattattgaatagaaagcttgaaagtgccaagaaaaaaatgttacaacaacgattgcaaagagaacaagaggaagaaaaacgacgtcaaaagcttgtggaagaacagaagaaacaagaacttttgaaaaagaaagagaaagaacatcaagagtctgttaagaaagaaaaaagtgttgaacatgaaagtaccatagtatcaaccagggataaaaatttggtttataaaccaaactctacagttctttccatgagacacaatcataaaatcattctgagtgtgatattacccaaagatttagagaaatatattaaaagtcgaccatatatattaatacgtgataagtacgtcccaacaaagaaaatttcgtctcatgatatcaagagagcattaaagaaatatgattggacaagagttttatcagataaatctgggtttttcattgtgtttaattctcttaatgaatgtgaaagatgctttttgaatgaagacaacaaaaaattctttgagtataagctcgtcatggagatggcaattccagaaggttttacaaacaacataagggagaatgaactgaagtccacaaatgatgttcttgatgaagcaacaaatatattgataaaagagtttcaaacctttttggcaaaagacataagagaaagaatcatagcacccaatattttggatttattggcacacgataagtatccggaattggttgaagaattgaaatcccgagagcaagcagcaaaaccaaaggttttggtaacaaataatcaattaaaagaaaatgctttatccattcttgagaaacaaagacaacttttccaacagagattgccttcatttcgaatgtcacacgatagaactcaacagcataagccaaaaagaagaaacagtattatccccatgcaacatgcccttaattttgatgatgatgaggattccgagtcacactctcaatcagaatctgaggatgaagatgaagatgaaactactgcaagtagacctctcactcctgtggtactgacaatgaaaagggaaagaagttctacaatcaccagcatagaagatgatatagagcttgaggaacgtgaaatcaaaaaacaaaaggttaaagtgccagctatagaggctgaaatagctccagagagtagccctgaagaaggtgaagaagaagaaaaagaggaagttgagatcaaacaagaagctgaagaggttgatattaaattccaaccaaccgaagaatcaccaaggactgtttatccagaaattccatttagtggtgatttcgatttaaatgcattgcaacatactataaaagattcagaagatttgttattagcacaagaagtgttatctgaaactactccatcagggttatcaaatattgaatattggtcttggaagagcaagaacagaaaagacgtacaagaaattagccaggaagaagaatacatagaagaactaccggagagtttacagtcgaccacaggatctttcaagagtgaaggggtcagaaaaatccctgaaatagagaaaattggatacttgccacaccgcaaaagaactaataaaccaattaagactattcagtatgaagacgaggatgaagaaaagcccaacgagaacacaaatgcagtacagagctcacgtgttaatagagctaacaatagaagatttgcagctgatataactgcccaaataggttctgaatccgatgtgttgagtttgaatgctttgaccaaacgtaaaaaaccggtcacttttgccagatctgctattcacaattgggggttatatgcaatggaaccaatagctgcaaaagaaatgattatagaatacgttggagaacgtatcagacaacaagttgccgaacatagggaaaaaagttatttaaagactggtatagggtcgtcgtatcttttcagaatcgatgataatacagtcattgatgcaactaaaaaggggggaattgctagatttatcaatcattgttgtagtccaagttgtacggcaaaaatcatcaaagttgaagggaagaaaagaatagtcatttatgctttacgagatattgaggcaaatgaggaacttacttatgattataaatttgaaagagaaaccaatgacgaggagcgtatcagatgtctttgtggggcaccgggatgtaaaggatatttaaattaa

SEQ ID NO: 4829 - DNA, 258 bp, Candida albicans
cacaactttgttttttttcaaataatggcagaaatattatacaatcaaccagtggtcattgataatggatcaggtaatttaaaagcaggatttgccggtgaagataaaccaaaatcatatgcttcggcaataataggaagaccaaagtatcaaaagatcatggcagcaggtagtacttcattactactggagcagcaatcacatgatcaattatttattgggaactctgctcaagataatcgtggattattgaaatga

SEQ ID NO: 4830 - DNA, 660 bp, Candida albicans
atagttttaattggtgaagatttttcgccggacttgcaatggatccacaaaatatttgatgagaaaaacaacgtgctatttttggactatgatgcggtacctgctgttgaagaaaatgtgggtgaaatggtaattaatactaaggaagcgcttttaattcaacaaatcgtcaacgcattggttcacggcggagttaaagaagacgagattggggttatgtcgttttaccgtgctcagttatcagtattgaaaaagaatcttaacaacttgaaggatttggaaatactcacagctgatcaataccaaggaagagacaaagaatgtattatcatatctttagttcggtcaaatgaacggaagtttgctggtgatttaatgaaggagtatcgtagattaaacgttgctacaacgagagctaaaactaagctaataatccttgggtcaagatttacattatccaccaacgagctaacaaagacgtttattgactatttggaaaacgaaaagtggtattatcctcttccaaaatcggcacacaagatttacaagattccagaagtgaatgggccatcaccaactagatcacaaaaaagccaagattcgccaatattgaatagaaaccctatacttaagaatgtggttcaagacattactagataa

SEQ ID NO: 4831 - DNA, 765 bp, Candida albicans
  unsure (424),(651): Identity of nucleotide sequences at the above locations are unknown.
ggacatggatctattatcggcctgttggacaataaagtgctggggtcgattgatgatagagtaacaacccagagatttcgaattgtgaatatcatcgaacagtattatggtcccaagagcgaaaaacaattaattttagaagttgtaaattcgctgagagataaatcaaagttggttgttcgtggtgagtactgcgagttggagttagaaaaaggagacgtgattcacgttataatcaccgatagtacttgtccaacattagttgatgacatgcataacctattaatttggaacccagacattatgctatcagcaacgacaatttcccagcagctcaactgctcgagaaaaacagtgatattgtctcgatacaagtttcctggaaccctgacgatacccatcattgttggggaaatagttcatnttatttttcaagaatgtatttgtactgaaaggtgggatatggaattcatgagccaagtattagatcagttattgctgcaatacatgttggcaatattcgggatagggaaggagttgaaagacgttagggacgaagttgttaaacattttgattatttggagacatggtttaagacatactacaaacaaccactcagcaagataaatttaattgacgagacatctganaaagaccagatcatgtttgctgtggaagatgctttggatattgaagaagaaatcggatcaccaatatttggcatcaaagggaaaattgatgcaattattacagccgaaatttga

SEQ ID NO: 4832 - DNA, 519 bp, Candida albicans
ctagcagtcttctgtccttcgacccgcctgttgaagactagatgcgaaattagaagtgcttgtatgaccttaaaccacttgacagaaaatggcaccaaagaagaatctggtattgaggaagagttgtacgaagctataactagagatatttttgaaaacgattcataccgtaagtacttccaacactgggatgaacttatttctaaagaagaagacgttatgggtagagcagtcaaagagttatggacaatcccagcagaggaccaagagtttcaaggcaaatgcttttctggtatgacgatcacaaattcgaatgagacggaatcgaacaatttcttattctcatcaacacatcatgacaaatcccaggatcagcaattcgtgtacacgtttgccaaggcagaaaacccttcccggttcaatttagcaaaatcacaggttactatcaacgataaagttattataagtgacgaagaaggccattttgctttaacaacaggatacgtcaagcagataact

SEQ ID NO: 4833 - DNA, 486 bp, Candida albicans
  unsure (14): Identity of nucleotide sequences at the above locations are unknown.
gaactacgaccaangaaaaggttccgtattgataaggataggatgttttatggtttggggttagctagatataacgtcctaagtttattcttacctaatggagcttcacagttgaggaaattagtggttgatcttgaaaagcctacttttaccgcatcttcttgggagattcctgatgcggaaacgttcaaccctgatcaaattgcggcgttaaaaaaagtatttagtgctgataattattctttgatagtggggatgcccggtacaggtaaaaccactgtgattgctcaactcataaaagtgcttgtggcacagaggaaatcggtattgcttacttcctacacaaattctgccgttgataatatattacttaaactcaaagacttggatattgaatttttaagaattggctacccccaaagagtccacaaagacattaaagactacattcctgaattcaaagactcaatcactacatatgaacaa

SEQ ID NO: 4834 - DNA, 1128 bp, Candida albicans
  unsure (1107): Identity of nucleotide sequences at the above locations are unknown.
acgcggatcttcagctcgtgggcaagaaatggtgccggtaagcaacaagttccaccacctcctcctcctccttcatcctctcaatctttgaatagcaaacttcgaccacctccacctccacctccacctccaccaccttctgcagatagtaaaaaacaatcagcaccatcaacatcccttgaaaatgaacaagaaccaagaaaaagaacttggtctaatgtggtgaaatctcgacgtcagaaaaagtcagatacaaagagatcagccactcaggtcataccacagaagccagagatgccaccgcagcacttgcgcaagattatgattgatcatggtgatttgactctgaacaagattgcatctgataaacgctcacacttgggatctttaaaatatttaccacatgcattgttaaaattactcgaaaacatgccacaaccatgggaacagcaaaaggaagttaaagttctttaccacacaacaggagccatcacatttgtcaatgaaattcccagagtcatcgagccagtttacatagcccaatgggcgactacttggaacatgatgagacgagagaaaaaagataggaaacatttcaagaggatgagattcccgccatttgatgacgaagagccgccgttagattggctcgaaaacttggatgatacagaactagtggatgccattagactgaaagaaatagaggatgacgacgaattgagagattggttttatgatacaagacctttagtagaagacccggacattgtgaatggtgattcttaccgtaaatggaatttagattttggtaccatgaacaaattgtatcagttgtctcgacctatattacacgagggacaaacacagaaattcgataaaaactccttgttcacagcaaaaagtctaaatgttgctattccaggaggaccaaagtttgagccacttttcaaagacaaaatcaataatcccgagctcgaagattttacagaattcaattccgttgatagaatcatatttagacagccaatcaagactgaatataaagtggagttgccattcttatacaattcctttgtcaagaaagtatcggtttcccctcttggtgcnacattggattgccgatctcag

SEQ ID NO: 4835 - DNA, 846 bp, Candida albicans
cgtttaattcatggacaggcttttaaaaatattttgcccgattatatcacttccaaaaacaacgtgagtcttacattcaaagacatgaaccatgtcaaccagtacggaatcatcaggggacttcaatttgcgtcatttgtgtatcaatactatggtttagttgttgatttgttgattcttggcttggatagggcattggaaatagctggtcccgttcagaacccaaacaattttcttcaatttaaagatttggagactgaaactgcatcaccaatcaggttgtattcgcgttatttggacaagattcatatatttttccaatttgacaatgaagaggcatctggtttaattcaagactatttgtcggaacacccagatccaaattttgaaaatgttgtggggtataacaatcatagatgctggccccgcgactctcgaatgcggttgatgcgacacgatgtgaatttagggagagcaacattttgggagattagtggacgcattccaacttcgttgacgtcgatagaatgggaggattcgtttgcatcagtgtactcccgcgataacccaaatttattgtttctgatgtgtggttttgaagtgagaatattaccgaaaatccgagccaaagagcttctgtcatcgcaggaaggtgtgtgggatctcgtagaccaaaacaccagagaaaggacagctaaggcgtttttacaagtgtcacaagaagctgtcgatcatttccacaatcgaattcgtcaaatattaatgtcttctggatctactacatttaccaaagttgctgcaagccggagtcttcacctggaggatcgccgatccgcgataattgag

SEQ ID NO: 4836 - DNA, 1254 bp, Candida albicans
aaaatgattgttgattcccacatccagtatcgtttaggtaatgttgatgcttaccaactagcagatgggctttactatcttttcaatcacttgggccaattgacaggtatctacagatacaaatacaaggtcatgcaccaaatacgtcaatgtaaagatttaaaacatattatttatcaaagattcaacaaagtaataggtaaaggtcctggatgtggcttttggcaaccggcatggagagtgtggctcttctttttgaggggtatcattccgttattagagagatggttgggtaaccttattgctagacagtttgaaggtagaagacaaaatgatgtggcaaaaacaattaccaagcaaagagttgacgcatactacgatattgagttgcgagcccaagttatgcacgacatattagatatgatccctgaaggattgaagcaaagcaaatctaaaactgttcttcaacatttgagtgaggcatggcgatgctggaaagcaaatattccttggaaagttccagggttacccaagcccattgagagtataattgaacggtacataaaagccaaggcagatggctggatttcagtggcacactacaacagagaaagaattaggaaaggtgcacatgtggaaaagacagttgctagaaagaatttggggagacttacaaggctatggatcaagaatgaacaagaaagacaaatgaattttggcaagaatggtccatttgtgtcaccagacgaaggggtgaagattttccaaacaatggtgagctggcttgagagcagaaagtttaatcctattccgttcccaccaatatcttataagcacgacacaaaattgttggttttggcattggagaatttgaaagaaagctatagtgcaaatgccaagttgaattcggcacaacgtgaagagctcgcattgattgagcacgcatatgacaacccccacgagtgtttggttcgaatcaagaaatttttgttgacccagagaattttcaaggaaattggtttaaagatgatggattactatagccatttggtgccaacgtattcggtggatccattggaaaaaattactgatgcctatttggaccagtacttgtggtatgaagcccataaaagaaagtgtttcccccactgggttcaaccccttgatgatgaaatcccaccgttacctgtctacaaattgtgtccacgaatccaatattttacatattggtgtgggattactttcgcacggtga

SEQ ID NO: 4837 - DNA, 201 bp, Candida albicans
  unsure (182): Identity of nucleotide sequences at the above locations are unknown.
agaatagccatgctgcgattgagtcctatcgacgtgcagtggacaccaaccctaaagatttcacgtgcgtggtatggtttaggacaagcatatgaagtattggatatgcatctttatgcattgtactactctcaacgagccacaaatttgaaacgactggataagcgtagtaactcaccacngggctggaaggtcgcgcgc

SEQ ID NO: 4838 - DNA, 477 bp, Candida albicans
cttgagcaacttgggggtcttgtcccggggttgtgttttttgaaaatacaacatggtcttatatcataccatgacttggattactttcaagcagaggcaacatttgatcagatactagttgaggacccgttgagattggatgatctagacacgttttcaaatatgttgtatgtgatggagaagcgctcgaaactttcgtaccttgcccagtatgcgtcgcaaattgacaaatttcgaccggaaacgtgttgtatattggcaaactattattcaatgaaatgcgaacatgaaaaagctataatgtattataaacgagccttgactcttaacaaaaattgtctaagtgcctggacattgatgggtcacgagtttgttgaattgaagaatagccatgctgcgattgagtcctatcgacgtgcagtggacaccaaccctaaagatttcacgtgcgtggtatggtttaggacaagcatatga

SEQ ID NO: 4839 - DNA, 516 bp, Candida albicans
tatgatcgttacgccgggtggccacctaaaaacgaagacaaagctggagaattgatcaagaagttaaacttgaagcaaatcaaaggtatttccagagtcactttcaaacaaagaggaaacttgatttatgccattgattccccggatgtctacagatctgctgctggtacttatgttgtctttggtgaagctaaagttgatgacatgaaccaaagaattgctgaagctcaagctcaacaagctcaactagaagctttacaaaaagctgctgctgatgccggtaaaaccgaagacaaatcaccagaagctattactgctgatttagaaaaggcttctttgggtgacaagaaagctgaagacgaagaagaagacgaaggtgagattgacgaaactggtttggatccaaaagatattgaaattgttgttgaacaaacccaagtttctagagccaaggctgtcaaggctttaagaaatcacgacggtgacatggtcaacgctattatggatttgtcttag

SEQ ID NO: 4840 - DNA, 240 bp, Candida albicans
acggggcaaccggccacaagtgtgattcgttctttcgatacaaaaaccccaatcattgccatgacaggaaacattgaggataacgatttggtgacatatttgcagaatggtatgtcggatattttggccaagccatttacaaaagatgatttatatgcaatattgtcgaagcatttattagatcctaaagaaaataagcaagataatgaacctacggtaaagaaacagaaattgagttaa

SEQ ID NO: 4841 - DNA, 948 bp, Candida albicans
  unsure (831): Identity of nucleotide sequences at the above locations are unknown.
aagtctaagagaacgatacacataggtggtatcaagaaattcagtgtgttggaaagaaaatacaagacggtggttgaaaatattgttgcaagaacatacatcaacgaaaggtattaccgttcaatgaacgtattgataaattctatagtgcaaaatggaatgaagttgcctccattggatttcccgcctccagtgcaactaggtcctgattctgggataggtagtaatttaggtccaatatcatcagatacagcattacctagcatatctcatcatcttctgtcacctttgccacatcatcaacaattattgaatcgaaccatacgtccaatatcgagtcctattgacggaatacctttggtcaagcttcaacaacagtcacttggacagaatcttcaggcaccgattggaacaccatcagcagtccctttctctgaagaagcatcttcaagtattcaagccgcgaccccagcaccattggcgcaaccagttgctcaaccgatcaaccagccgccgccgccaccaccaccaccagcaacacagcagcaaccactaccaccaccgccgccaccagcaacagctacatcccaaattcctagtgcacctccacctccgacacaacaacaagtggggacaagttcttcgagtgttcctacgatatcaccgaaatctcaagggatcgttgttagcaattctgcatcacctaccacatcagctcagatcagtacaactagtgtacccaatccaaagtttcatgttttactagtggaagatgataatgtttgtattcaattgtgttccaaattccttgtaaagtatggatgtctggtnactgttgtgaacgatggtttgaacgctatatcgacagttgagcacacgaaatatgatttgggttttaatggatattgttatgccaaacctagacggggcaaccggccacaagtgtga

SEQ ID NO: 4842 - DNA, 477 bp, Candida albicans
atgtcttcattacaacaacccatacccccaaactcaacacttgcgacaacggcgagctccaaccaaagtggctttaatgattttgtcaagaaattgtttctaatgctacaagaagatagctataaagaagttgtacgatggactgtcaaaggtgatagttttgtggtgattaacaccaacgagtttaccaaagatatactaccaaaacatttcaagcactcaaactttgccagttttgtacgtcagttgaacaagtatgatttccataaagtaaagatctcaaacgaagcaaaggctagctacccgtatggagaagatgcttgggagttcaaacaccctgaatttaggataaacgacgccgaggcattggaaaatattaaaaggaaaggacctacagcgaaaaagtctgcttcaaatgttacaatcaagacagaagcaaacaataatggaacacagcatacatgcaatcacaattct

SEQ ID NO: 4843 - DNA, 942 bp, Candida albicans
tatataaacatttctttgaaaaagcaacacgattctgtggaaatcgtaaaacgtagatgtcaagatattgagtatccggttctagaggaatatgatttccgtcatgatgcaagaaatccagatttggaaattgacttgaaaccatcaacccaaattagaccatatcaagaaaagtcattgtcaaagatgtttggtaatggtcgtgctagatcagggattattgttttaccttgtggggcggggaagactttggtggggatcactgccgcttgtactatcaggaaatctgttattgtgttgtgtacgtcatcagtctcggtcatgcaatggaggcaacaatttttgcaatggtgtactatccaaccagaaaacgtagctgtcttcacctcggagaataaagaaatgtttgctagtgaatccgggttggtggtgtcgacatattcaatggtggcaaacacacgtaatagatcacatgattcgcagaaagttatggactttttgcgttcaagagaatgggggttcattattttagatgaagtgcacgttgtgccagctcagatgtttagaagagtggttacgacaattgctgcccacgccaagttgggattgactgccactttggtgcgtgaagatgataaaattgatgacttgaactttttaattggtcccaaattgtatgaagccaattggatggatttggcccaaaagggtcatattgccaatgttcaatgtgctgaagtttggtgtcctatgacagcagaattttatcaagaatatcttcgagaaaatgccagaaaacgtatgcttttgtacattatgaatccaactaaatttcaagcgtgtcaatttttaattcattatcacgaaaaaagaggagataagattattgtgtttagtgataatgtttattttttcacacacgagccctggaaggatccgcat

SEQ ID NO: 4844 - DNA, 708 bp, Candida albicans
caggagtatgcattgaggttgggtaaaccatttatttatgggtctactccgcaacaagaaagaatgaaaattttacagaatttccaacataatgatcaaatcaatactatattcctttctaaagttggtgatacctcaattgatttaccggaagctacatgtttaattcagatttcctcacattatgggtcaagaagactagaagcacaaagattgggtagaattttaagagctaaaagacgtaatgatgaaggttttaatgcatttttctattcattagtttcaaaagacactcaagaaatgtattattcaactaagagacaggcgtttttggtggatcaaggttacgcttttaaagttattacacatttaagtggtatggaacaattgcctgatttggcttactcatctgctcgtgaaagaagggagttgttacaacaagtattgttgaagaatgaagatgcagcagggttggagattggggatgatgctgataccaattttatttctaaagaaaagagaatgcgtttagaacaagaacgaaatggtggtggtgcaacttattcatctggttcattggcaggattggctggtggtgaagatatggcttatattgagtatggtaagaataagaataaagaattgagagaatctcatcatccattgattcaaaaaatgtattacaaacaaaataaagccaaaaaatga

SEQ ID NO: 4845 - DNA, 831 bp, Candida albicans
tctaatatgtcaagtcgaaatagagaaccggttaactatgcagatcttgaagatgaaaacttttcagatgaagacgtgtatgtgagcaacaagacaggtgccaaggataacgatgatgatgagtataatacgccatcacagaaatcaagaaaatcaactgggaataattccaaaaagcgtaaagctcaggagtcagtggattcattaaaacagaatttagatgaaacaaattactccgataacgaattaatagaattaactcctgatgtaccagcagattatattcctgatgcggtttccaaaaattttggcaaaggtgatttttcatatttgaaactaaaaccagaccatttttcaagaccaatatggatatcaccgaatgatggaagaatcattttagaatcattttcgcccttggcagaacaagcacaagattttttaatcactattgctgaaccaatatctagacctagtcatatccacgaatatcgaataacagcatactctttgtatgccgccgtttctgtggggttggaaactgatgatatcatactggttttgaatcgattgtcaaaagtcccggttgcggaatcaattataaatttcatcaaagcagcaacggtgtcgtatggtaaagtaaaattggttttaaaacataatagatattttgttgaaagtacacaagctgatatcttgcagatgttgttaaaggatcctgttattggaccgttacgtatccagtcttcagaaaatatcgtcaccagtaatggattgattacttcggcatcagaaccctgtcattttcacccacgagactggaagatccgcgtc

SEQ ID NO: 4846 - DNA, 1272 bp, Candida albicans
cagatcggatatggcctggttttggcacaggttagcaaagaacatgaagaatacatcaaggatgaaagtgagtttatgcaagaattattttctgaaaatttgaaaggcactatcaagagtgaaggttttgacaatgaattatttgaaaaacaagtagctgggttattattattgtctacggattatgatttaccagaaaaattccaaaaggaattcactactattagtgatcaaactaagaaagatgatttagtgaatgaaattttggaaaaattgacagagttggagactgattttgaaacaagagcacaaaatcttgggatcaaagtaccgtcgccgtcatcatcaccatcatcaaaaactgacaaagatactttacattcaccattaggtactatccatgcagagaaaatcatcagtaataagatttctcaaagattaaaagaattggaaaacttacctgctaatattggaacatttggcgatactgatggcattgacaaatttaaaatccaagcattaatagaacttaaagcacttagattattagggaaacagaaattgttgagacacaatattttggttcatgaagctcaacaagtgaaatatgctgaccctaatttaaagtcgctcccattagcattactggaaaagagatctttcaatgtgagaccaaaaatagaacaacgaaacccacaattattggcagtgcaactagaagaattgaaaaaactagaggctagagaagccaaacgtaaacaacacattgaaaaagttgacctagtagtggaaaagtcaacaagtcgtagtgaagccaaatacgtcagagaccattatcgatctcattatttggttagacagatcaacaactttcatcaaacaacagaaaaagaggaaagtaagaaattggaaagaactgccaaacaaagattgcaagctttacgatcaaatgatgaagaagcttatcttaaattgttggataaaacaaaagatcatagaatcactcatcttttgaaacaaacaaatcaatttttggattcattaactgagaaagttagggctcaacaagaagaagctagtggtggttctatgggcactccaagacatggaagtccagaagttgctgtggaaaataaatctgatgacaaagccgaattacgtgaaaaaaccgattattatgaagtggctcatagaattaaagaaaagattaccgaacaaccaactattttagtcggtggtaaattgaaagaatatcaaatgaaaggtgtagaa

SEQ ID NO: 4847 - DNA, 1722 bp, Candida albicans
cctggaattttcaactcggttaaatcttttgatgattggtttaacacaccatttgccaatactgatgctcaagaaaaaatagaattaactgaagaagaatcattattggttattcgaagattacataaagttcttagaccatttcttttgagaagattgaaaaaagatgtggaaaaagatttaccagataaagttgaaaaagttttgaaatgtaatttatcaggattacaatatgtattatatcaacaaatgcttaaacataatgcattatttgttggtgctgatgttggaggtgctaaaagtggtatcaaaggtttgaacaataaaattatgcaattacgaaaaatttgtaatcatccatttgttttcgaagaagttgaatcggtgttgaattcactgagacttactaatgatttgatttggagagtgagtggtaaatttgaattattggatagagtcttacctaaattcaagaaaagtggacatcgtgtattgatgtttttccaaatgacgcaaatcatggatattatggaagatttccttagatggaaagacatgaaatatttacgtttagatgggtctactaaagctgaagaacgtcaagatatgttgaaagttttcaatgctccagattctgattatttctgtttcttattatcgacacgtgctggtgggttagggttgaatttacaaactgccgacacagttattatttttgatactgattggaatcctcatcaagatttacaagctcaagatcgtgctcatagaattggtcaaaagaatgaagttcgtattttacgattaattaccaatgattctgtagaagaagtgatattagaaagagctcatcaaaaattagatatcgatggtaaagttattcaagcaggtaaatttgataacaaatcgactgctgaagaacaagaagcatttttgaaaaggttattggaagcagatgccaatggtgctgataatgaagaaaatgattctttggatgatgatgaattgaatgaaattttagcacgtagtgaagaagaaaaggtgttatttgcttctatggatgaagaaagaaaactggaaaaagtgccttataaatctagactcattgaaaaggatgaattgccagctgtattcactgaagatatttctcatcattttgagaagaaggagaaagaattatctaaaatgagagataagaaacgtgttagatatgatgatgggttgagtgaagaacaatggttaaaggcaatggatgatgataatgatactgttgaagaagctattaaacgtaaagaagaacgtattgctaaaagaaaaagaaataaggccataagagaaggtttattggaagaagatatcaaagatgatgaagttggcgaagaagatgatgaagactttgaagaggctgctcaacctagaaaacgtcaacgtcgtgctagaactcccttaccacatattgataacgatgatattagtggagacagtggtaatggtggtggtgctgcaatagaacttgatgttgatgatgatgatgacaatgaaccagaaactgatggatttacaagcaaatgtttgagtgtaattgatgaaataacagccttaacagatgagacagatggtcataatttaagtgatattttcatcaaacttccatcacgtaaattgtatcctgattattatctgattattaaaaaaccagtttccattaatcaagttaaaaaa

SEQ ID NO: 4848 - DNA, 1254 bp, Candida albicans
cttcttgtagcctcccaacatggtcgtgcaccacacaatatttcttctcatttaccagaaatatttttttgctctagattttgttttgattctttacccaatcaacaagcaatgtcaattgaagaagaaatatcagaagacttggggttcaaactcgacatcaaggataatggcattccactttttgagccattggatttgcaaaatttagcaacaaagcacttgaaattgttggccatacacgatgatttgatggtggcatcaaatagcaaatgtataaaagttgtatcattaaaggacctagacgacataaccactattgaaggggaatttagtattacccaattgcattttgttggaaacgaattgtttgttcttgacgactctaaaataaaatcgttgacggtagaacaactcaagaataaggactacagttttcgtaccatcagagaagggttcgtcgatatacttccatcgccatctgggatattggcactaaacacaaacaacgagttgtacctcaatgcagataaggttgcttccaatgtctcggcgttctgttggacatcgtcgctgtacatttatgcctcaaaagataagccataccatatcaataacaaaaaaatcaaagtcaaagacgttgacgaactttgtattgttgagatgtttgccataaatgaaaagtacttgtttgttgcttacgatacggtagatgccgagttggattaccacgatgtcaaatcatatattttggaggaaacagataatgactatactgcattagaagctgatatcgccccagcatttgggtctgttgctagagccgtgacttattatcatgcacaattgtcggactggtataaatcaaacaagtttgtgctccttacctcgtcgttggccatagatttaggaatattggacaccactaaaggacaaacaccaaagataattgcacaatcggaagatatcaaccgtgcacaatttcctattgacgacgaatcaggtgacgattgctcgccagttgggtttggtgtatccttaaacgaactaacttcgaaagttcttgaaccgtgtccaggcgctgacgaggttactggagttttgcctagaatatacaccttgcttcatacaggtaacttgatttcatggtgggttttccataagtcagcaatcctaaaaaaagaattgtctttagagaacgcaatcaaggcatcatctactcaaactcttgaccacgggcctgaagatccgcat

SEQ ID NO: 4849 - DNA, 786 bp, Candida albicans
attacccaccagagaaacggtcaaccaaaccatgtctctccaatatcatcaattaagaatgaaatagataaatatttgactctggaactaccggaacgtgaatcaaaagcccaggctgtgccgaagaagatttcaaaaatcgtgaagcacaaacaaaaacaacacgaagcaaacttgaaacgtttggccaaagagaaagatcatgaacgacaattagaagaatggaacaatccaacactttttgcaaaacaagaacgcgaatttatgaaagatccttttagaaccgttttcattgctcgattggactacaatttaactgagttggatatatctcgtgcatttgctagatatgggatgatcgaatcgataagaataataagagataaacagggtaaatcaagagggtatggatttgttgtatatgaaagaaatacagatgccatgaattgtgttaatgatctaagtcgtactgggctaaagttagggaatcgaccaattctcgttgatatcgaaagaagtagagtattgaaaaattggcgaccacgaagattaggtggaggagaaggtggaagaggctacgttaaagaggggaaagtacaatctgttgctgcttcagcaagaagaattgtcattgctaataatccatcttttaacactgcaccaccacagcatgatcaacaacaatttcaatatcaccatcaccagcaacagcaacagcaacatcaacctcaatttcaaactcaatacaatacttgtcttcacacacagccgctagaaggatccgca

SEQ ID NO: 4850 - DNA, 1119 bp, Candida albicans
acttggattgacgaacaacaacaacaacagcagcagcaacaacaaggtttttcacatgcacagtcactagtactcgttggagaagggcgaccagacaggaaaaaagtaaaacttgatactgaagataatcacctaaaagttgtgccaacatcggttgtagtgagaaaacgtccttggaaatcagtgtattcagaaagattcaaattagagaaaaattggcgtaagggaactcatacaattaaaacatttactggacacagtgatggagttacatgtttacaatttaatcgtaaatatcttatgacaggatcatatgatacaacaataaaaatatggaagattgatagtggtgaatgtgttaaaactttaactggtcataccaagggagtaagagcattagttttcgataatcaaaaattaatatctggtggattagattcaacaattaaagtatggaattatcatactggacaatgtattgccacttaccgtggacatgaagatgcggttgtttccgttgatttcacaaataaatctattgtttctggatcagctgatcatacagttagagtatggcatgttgattcaagaacttgttatacattgagaggtcataccgattgggtcaatcatgtcaagattcatctggcttcaaacactattttcagtgctagtgatgatacaacaattagaatgtgggatatgaatagtaatgaatgtatcaaagttttcggcggtatggaaaataatggccatataggtcaagtccaatgtattatccctttcacttataaagaagaattaatagaagatgaaagtgaaagtgattctgaaaataatcaaaattcaacaacaacaacaacaacgacatcagcagcagccacagccacagccacagaaatgggtgcaacattaggaaccaataatatatcattaccaaatgatacagctacaattaatagatcgacatgtactccaagcaacaacaataccgctactactgctactacccctaattcatatcctacacatttcttaacttctgcattagataatacaatcaaattatgggatgtcgccaccggtaaatgtataagaactcaatttggccatattgaa

SEQ ID NO: 4851 - DNA, 1149 bp, Candida albicans
tttacaaccaacatcgaaaagaagtgtctgccattgacaatgagtgcaagaaaactacaacaagaatttgacaagctaaacaaaaagatttctgaagggcttcaagcatttgatgagatcaaagataagattaatgccacagaatcagcttcacaacgagaaaagttggagaacgatttgaagaaagagttgaagaaattgcaaagactgagagaccagttgaaacaatggttaggagatagtagcattaaactagacaagaatgtattgcaggagaatcgtactaagattgaacatgctatggatcaatttaaagaattggaaaaactgctgaaaataaaacagttttctaatgaagggttggagttacaaagccaacaaaagcgatcacgatttggtgatgatgcgaaatatcaagaagcttgcacctatataaatgaggttattgaacaattgaatggtcaaaacgaggaattagaacaagagttagattcgttgagtggtcaactgaaaagaaaaggaggtagttcaatacagctgtctattgacgatgtgaaatacaagatagaacgaaacaattctcatatatccaagttggaagaagttttggagaatttggataacgacaaattggacccagccagaatcgatgatattaaagatgatttggattattatgttgagaataatcaagatgaggattatgtcgaatatgatgaattttacgatcagttagaagtggatgaagaagatgatgttgaagttcaagggtcattggcacagatggctgctgaaaccgaagatgaaaggaggagagaggaggaaagaaaaagggaagaaaaagagaaagagaagcaacagcagaatccaccaaggacgtcttcttccgtgtccagctccagtagtagtaatcaaaataatattggcaataatactcctcctgcaactcaaataaagccatcagtagtgacagtggcagcaattggggaccaaaacaataacagtgcgtcatcggcatcttcaacatcaacgcctgtgaagaagttgaaacctacacttgctccagcacctgcaccaccaccaataacaagtggaacttcgtattcaattttcaccacgggcctggaaggagccgccatggcgggtgag

SEQ ID NO: 4852 - DNA, 2334 bp, Candida albicans
  unsure (1683): Identity of nucleotide sequences at the above locations are unknown.
agaaagaaagaaagagccccactaaacattttttttttcttttcattcatagtgctacccttgttgaagaaatcacaaagattactaactttatctagggaaattgacattattttcaagaaaatccaagaaggcttacaagactttgactaccattatgaacgatacgaaagtatacaaaacactgaagatgattctgataatcaaagagaaaaagagaaattggccaatgatctaaaaaaagaaatcaagaaattacaaaaatttcgagaacaaatcaaacattggctacagaatgatactgtgcatactctaggacccgttggaacatcgtatgaatctaaactagctgaaaataagagtctaattgaggattccatggaaacgtataaactagtagaaaagcaaagtaaattgaaaacattttccaaccagtccatcatgatgacatttatggatagcacgaatggcgatgacgatgatgatgacgacgattcagatgatgatgagttgttcagtggtagtgatgaagacgaggaagacgaatacagtgacttaccagaagatgcggtgaacgccattcatttcttcaaagattctatactacagttgagagaacaaacacacaagttggatcatgaatacgaaaagttggcagccaagaagttacgtaaaaacaatttggcgaccatagaggccaagaaggaaaagattcagctgacgatagggaacaataaatttcatcagaaaaagctcaagaaattactcagacagttgacaagtggtgtagttacagaatttaatttaatatggttgttgaaagacgatttgaataaatatttggaatctaatggagactatgagtttactagagaaaccgaattatacgatgacattttcaatcaaattgcagcagtcgaagaagattattctgaaattcacgaagacaaccatgaccattcgcattcccaccttgaaaaaacttcaacggcgaatggaacacaccatgaaagtgcgaccaccacagctactgctgctaaaaactcttctgtaacaacacgaacatcgccgtctccaattttaacgaaagcaaatggccatatcaaagaattatccgttgaatcaggatctcctacgacttcacgtctgaaacttctgaaaatccataccaatacactgcaactgagtacacattcaaacacttcctcatcaacgcacgcacaggctcctcgacaaagccccgaattaacttcaccggcaattgtaaagactttgagaccggcaactgctccttctaagccagttggtactctcaaatggtctgcggcggcggcagcagcaattcccgatgttcaagaaaaaccagaattagtagaaacagaatccaatggatctagtgtacacaaaacagtatctaaggatcaatatgaggaaaaaataaattaccaatcaccagcaccaacacaacaacaacaacaaccgcaaacactggtagaactgaagactctttctaccacccaaagtttggcttcttcaatcaccgacaatataaatcttgataaatataaggaagtgatcaagaattcgaatttaactaaaaccgagttggggttgttttccgacatgaacttggccagagttccaccaggtattcaagatctagtgatatcgtttgcatcaaanagaaataacgataactttaaagttttagtcgattcaaccgaattcaatcaatttgctttaccattacacaaaccatatttacctgagattgttcagccatcatattattcacaatataccagtaccagttttaagcatccaactccattagtcaaatttcaaagctattggaatcaagtaagagcaaactttggatttcagaaattaatggacgagataaaatcattgactttgcaaaataatgctgataatttgccaattattgctgagttaacatttgtattattttatggattttattatggtgttactccagctgaaaacttgattgctgaatcgtatttatttgaattgggttggaaaccttacaagaaccaatcagaagatggtagtaataatttatcaactgattcaattagtttatcagatattgatggactgaaatccaagtataatagatatagtaattattatttttggttcaaacgagtaaaattaatttctcgtggtgaagatatgggacaaccatctaatattgaatttggtgattaccaagtatttgatttgagtttttgggaaatatttgtcaaatatggtttcaaatttgattataatttgtgtcaattggaaccatcaaaaacattattttga

SEQ ID NO: 4853 - DNA, 633 bp, Candida albicans
cggtcggccatacccatggtgaaaagctcggatataaggttttacatgtacgaattgttgaaggcattggattattcacactcaatgggaattatgcatagagacgtaaaaccacacaatgtaatgatagatcacgataaaaagttgttgagattgattgattgggggttggctgagtactatcatccgggaacagagtacaatgttcgtgttgcttcgcgctattttaaaggcccagagttgctagttgactacagattatatgattactccttggacatgtggtcgtttgggtgtatgttggcgtcaatggtatttatgaaggaaccgttcttccacggcaaatcaaatacagaccaattggtacagatagttcgtgttttgggctcaaaaaatttcaagaaatacctcgaaaagtacaacatatcgttgggagaggaatacgaagatataggatactataataaaaggcaatgggtaagattcatgaatgaaaataacaaggatttggtttcgcaagagttcttagatcttattgacagattgttgagatacgaccaccaggagagattgacagccaaagaggccatgaagcatgcgtatttcgacccaattagagtagctgttagttag

SEQ ID NO: 4854 - DNA, 1491 bp, Candida albicans
ctttctttactttcaaccttctttctacatcaacaaccatccataatgaatactactccatcaagaaaaagaacaattagagatatttctaatactcaattaccacttactccaactaaaacaccaaccaaatccaaaaaactcaaaatagataataataactcttttgatactgggaaaccttcatgtgttaagaaattagattttggacttcttactcctaccaaaaaaccttcaacttcaccttcaattccaacatcaatttattctcaagccaaagcattatttcaacgtggatccaacgtgaactattctaatgattattttttaactagtcgagaaaaagaagctaaatatatcgctgattttgttgccaatagtattcaacagaaaatatccaatagtctatatatttctggtccaccagggacgggtaagactgctcaagttcaattaatcctacaaccttatcaacagaattcaagaatacgagtagtgaaaatcaattgtatgacattaaataatccagaacaaatttatcatgaaatatattgtaaaataatgaataaattatcaatatctttccataaacgtaaaacttgtgatgattttatgacattaatgaatgataatgaaaatcaacaatttgattctgtgattgtattacttgatgaattggactcattaatcacaagtgatcaacaagttttatttcaattatttaaaatggctagtataaattgcatccctcaaactaaaattaaattggtattaattgggatatctaatactttagatttgaatagtaaatttttaccaagattagttagaaataatattcaattggataatttacaatttttgccatacaatgctgatcaaattaaatcaattataatgaatcgattatctaatcttaaacaagaaattttccacccgggtgctatacaattttgttgcaaaaaatcagcatcaatatctggtgatttgagaaaggcatttgatatatgctataaatcaattgaattagtagaaagaagttgtcaaggtactgatacgattaataaagttatgattcaacatgtggcaaaaatttgtatgacatcttttggcaataatgaaaatcaattaaacaatttgaatttattacaaaaagcaatattatgtcaattattcaattatcaaaaggaaattttttcgaaatgttccaacaaaactgctgctactactaccactcttacggtgaattcattttatgattattataaaaaacaatatgaaatgaatgatttgattggactgttaaaacatactgaattcattgagatattatatgcattggaaagtagtagttgtattttgttgaccaattccaataaaaacagtggtaatagtaataaaattattaaattaaatgtaccttacgatgatatagtgaaaagtgttgaaaatattggaatcttgaaaaaaattttacaaaaaccaaattaa

SEQ ID NO: 4855 - DNA, 561 bp, Candida albicans
ttgatgaatgaaagttctaattctaactcaggagaagttaaacaagaaaaacaaccaccaccacagcaacaaaaactaaatgggaataaaggtaagatacatggattagtagaagaagaaaaagtagaaatagaagggagtcaaccaccattaaagaagaaacaccaagaagatggctggaccaaaacagaaaaagatgctttaattagtgcagttaaaacatttaaaaatgattggtataagattgctcatcaagttggagggaataaaactcctgaacaatgtatacttgaatttttaaaattaccattagaagataaatttaatcctataaatgatgaagatgaaactaatattaaattattaaaatatgcatctaattatcctattagttcaattgataatcctgttttagcaaatttaacatttatgactaaattagttgatagtaatgttgctaaagctgctagtgaagctgctaaaaaagcaatggatggaagtattgaaaacaaagttcaagaactacacattcttcactacgagagactggcaccgagatag

SEQ ID NO: 4856 - DNA, 1686 bp, Candida albicans
agaccagtgggatcaaccacagaatcggaattgacaccaataatagagtctaatggagacgatatgatgagactagaggaacccgatgaatcaaatgcaaatagtagtggtggtacaacttttggattaaggtatacaaagactatacgagggagtagtggtagcagcaaaaaatcaagaccgaaatcgaaatcaaaaataccaattgttaaatttttccaatcagggaaggaaagtggctcagtttcagactctgatagcgatagtgatagtgatgttaacgatagaaagttgcaactatatcagagtgatagtataaattcaaccaataatactttggaggaagttaccaccgaagatggagatatcactgagcaggaaaatgagccagagattgttgaagtcaataaatcacataaaaagtctcaggaaaatagtgatgtcatcacaatagacagtgattttggagtccccgtgaattctcgtggacatgttgttcaaaattatcaaccagaggatcaaggagtgtctgatgaagagattgaagctgaaattgacgaagattatgattctgaggattccgatgagtatgaatacgaatatgatgaagatggtgaagaagattctaatgattcagagtttactgatttggataatgattcattagtgggttcatctttgattttagattccacctacaacgataatggaggcgatagtttttcatttgttcgaacaagtaatgtttcggaatttgatacacagaaaagcagaaagaagaagaaagctgattcatttgatcaacacacaataccaaaaggtaacacccttgttagacaaaggtcatcttctgctggtaatagcaagtcatatttagcgttaactgctttgagttataaaaacccaacatttcagtttgagaaagtttctcctaccaaagtagacactcccaaggcttccaaattgagttcacttattcattcaagatacaaatcagacaacattaatccgttaaattattattcattcgttgatgccagctcatcttcagtaaagcaaacattggttgatatatttgtgccacctaacacaaaggctacattgataaaattggccatggttgagaatgtggctatttctgattgtattgggtttgttttgcttaatctttgtaaattgccggagctgaatagtatcaaagatttagactacctcaatccgaatcattggcggttagagctagttgatgaagatggtgaaaattatggatcatttggtgttttggatcgtacgagattactttcatcatataataatccgaaagaattggcaatttgtcgaatcactgattataatgaaatcaagaaaaatgatttacagtctccattgcccgttgaagtaaagaaagatcttgaagcattgcaacgcaaacgacacagtattaatcaaattgtggaaagtggaattgaagaatctactggggagaaaattgagtttcaaattggagtatttgagtatgatgatgatggattaccaagaaaggaactgataaaagtacctagtgagtataccatgggtcaagtattgaaagagttttgcgctcagcaagggttaattttaataaaatatcgatttcgattagtggatcaaagtacaggacaaagtagatttgttaaaggatgttga

SEQ ID NO: 4857 - DNA, 2754 bp, Candida albicans
  unsure (50): Identity of nucleotide sequences at the above locations are unknown.
gcaagaggaaaaaaaaacaactttcgccgtttaaaacgacgacaacgacnacaacaaactcaatacacagtaacagcaacaattagaacaaccacaggaggtttattttatttttatttcattatattttattttttaagtttgcaaccaattttttttaatcatttatccttactttcatatatatatatatatacatacattaatagattttactgcttcgacaatatgagtgcttcacctccagaggaaacccctcttgatactacttcatcaatacctgaggaaactgaacaacaacaacaacaacaacaacaacaaccagaatcatcaatagaacatcaagacgatgaggaaggagatgttaatgaagcagaagacagtgaagatgaagatgaacaaaaggaagaaaaagaagatgaagatggtgatactgaagcaaaacaatcttcagacaacaatgatgctgcaaatgataatgaagcaggtggtaatttatcagaagcatcaactgaagagtcaaccgaagaatcggccgaagaaacacaaacaaacccaactgaagataaaaataatgaacagcaacaacaagatgatgatgatgctgagtccgagaataaagttgagtcaaacgaacatcaagacaatgtcaattccaatgataacagtaaacaagacagtaatagtgataatgatatgcaatttgatataccagatgcaccagatgtaatcgattctgcctctgaatctggaaaacaggaaccaaccaacgttgatgctgatgacaatcaagataaaatggatgtagatattcctcaagaaacatcaattgctttcacaacaaatacacaaaacaccaatactgaagaatatgaaaaggaagaatctaaacaagaattgggtgaagatgaagaattgaaacatattcaagaagatgacccatcatttgatgaaaattataattctaataatgaccctgataaatctaatgatgattttgacacatctgctttaataaatggtgacgattttaatatggaaattgatgatctagattattcaaaagatgtagaatcagaatctaatcaacaagaaggaaaaccagaagaagaagaagaagaagaacagaaaaaaaattctgaattatctgaagtgaaatcaaatgttgaatctacaagtgatcaaaaagaatctgaaattaaagaagaaagtacaggagaaaacccaaatgaatcacaaccaactacaacttcggttgttggtgcttcagcgactgaacctttgtcttcaaaccaaaatactagtattgctagttcagaagtaaaaacaaatacaactgataaagatgttgatatggaccaacaacaaaaagaagtagaaccagaatcaaaagaaaaggaggaagatgaagaagatgaagaagatgaccaagaagaggaagatgaagatgaaccagaagaaccaccaaaggaaaaacctcaatataaacaaacacatttaatagttataccatcatatgctagttggtttaatatgaaaaaaatccataaaattgaaaaagaatcattaccagaattttttgattcaattcatccatctaaatcacctaaattatatgttaattatcgaaatttcatgataaattcctaccgattaaatcctaatgaatttttaactttaacttcatgtcgtcgtaatttagttggtgatgttgggacattaatgagagtgcatagatttttaaataaatggggactaataaattatcaagttagacctcaatttaaaccaggttatgcccttgaaaaaatgcctaatggacaatcaatggatttaccttatactggagattatcatgttaaatttgatacaccaagaggtcttttcccctttgatacttcacgtatacctgttgaaagagttgatgtgaaaaaattacaacaattgatgaatgaaagttctaattctaactcaggagaagttaaacaagaaaaacaaccaccaccaccacaacaaccaccacaacaacaacaaaaacaaaatgggaataaaggtaagaaacatggattagaagaagaagaaaaagtagaaatagaagggagtcaaccaccattaaagaagaaacaccaagaagatggctggaccaaaacagaaaaagatgctttaattagtgctgttaaaacatttaaaaatgattggtataagattgctcatcaagttggagggaaaaaaactcctgaacaatgtatacttgaatttttaaaattaccattagaagataaatttaatcctataaatgatgaagatgaaactaatattaaattattaaaatatgcatctaattatcctattagttcaattgataatcctgttttagcaaatttaacatttatgactaaattagttgatagtaatgttgctaaagctgctagtgaagctgctaaaaaagcaatggatgaaagtattgaaaacaaagttcaagaagtatacaatggtaataataacaccaatggtggtaatggtggtaatgttgaaagacaatcaagtgggaaagatgctattgctacaacttttggtataattggtggtcggagtcatttattttcaaattatgaagaacgagaaatgcataaaattggttcaagtatagttaatcatgaaatttcaaaaattgaaactaaacttgataaagttgaagaattggaaaaaatttatgaacgtgaacgacaaaatatgttaaaacaacaagaataa

SEQ ID NO: 4858 - DNA, 1413 bp, Candida albicans
atcatgtcaggcaatgtatctcatagtacaccattatcgatatcaacttgtaggagtaatacccctggtgaagaaattgataaatccacaggagatatactaataaatatcgatccgtatgctatactactaaaagatggatctactaaagccaccatataccctatctcatctcccaatgacatatcacccaatttactagcatttctatgggatgaatataatatggaaattgaaaaaggtgaaactctaactttctatgaaccattatcattcgaatcatttatttctcattggtttgattcaaccagtatagtggccataatggttgttggtgatgaaaccaacatggatgaccttggtaatgatgaattacatgaatggcctagtgaattacttggaattttcaatattaagccaaatttccctggttgtcaaagaagtggacatatatgtactggagaatttttagtcaatgctgggataaggggtcgagggattggcaagactttaacggactgttttatgcaatgggctcttaaattgggttatacttatgttatatttaatctaatactagaaactaatgttgcggcaagaaaattgtgggaatcacttaatttttccagattaggaaaaattagtaatgtggctattatgggtcatgatgatcaagaacgtgaattagttgatggaataatatatgggaaaagtattgaaaatactataggggaatcaagtaacagggacaggaaaaccccggaatcggaatcggattcaaataatagtaaatttgaaaatttgaaatattatttacagacaggcaattatccacccaatgtcgataataaggaaaaatcacgattacgagcgaataaagccaattattatttacaagatgataaattaatggtcaatgggagagaagttgtatctaatatagatttacaattgaaaatatgtcaattgactcatgaagaaaatggacatctggggattaatcgaacaactacattaatcagtcaaaaatatcattggataaggattaaagaaacagtggcaagagcattaaaattatgtcaagaatgtaagaataattcacttcaggcaaaggaagaatttttaaatcaatccaataaaagaattaaattacaaaagaaaacaagcaacaatgatacgccaatgccattattagataatcgacaatttgaacaggcagtaattcaagcaaaacaacgactaaatgatccaaatggtgtatcttatgctgatgtagctagatctgctattgatgatgattcacaaatccaatcaaaacaacaaagcatacatcctgaagttaaaaaatatgataaattgtccaatagtaatcaaaccctgtcagtcgatccatcagttagaacttactactag

SEQ ID NO: 4859 - DNA, 576 bp, Candida albicans
  unsure (564): Identity of nucleotide sequences at the above locations are unknown.
cagtcagttttagtgatgaactccgaagaagtttttgagtcagttaaagatcttccatttgctgatgggaattttaaagacacaccaaaagttaaagaatcaacaataaatttcaagttggccaaagatgctaccaaaacagtgactttgttcaatatccacgactacaaaactgttccagtcaatttggtgaaagcacttgaaaacgagtttaattatgtggtcaaagaaggtagaacatatccttatcatagtacaatggaaggggaaacctttgtcaagtattggtttactcattttgtatcggtgttactagaaggagaatataagacattcgatgaattgggtgacttatcggtagagcaatggaatcaaatctttttggggactttttatgtgaaaccaaattatactggccgatgttcccatgtttgtaatgctggatttatagtaaaccacgagaaacgagggttgggattaggtaaggaattggggaaaaagtatcttcaagttgcaccggaattaggagacgttattcgtcttcaccaccgggctggaaggtcncatcttggttaa

SEQ ID NO: 4860 - DNA, 2226 bp, Candida albicans
ttacaatttattgtgagtccccattttactaaggtcatgtcattgaaaccatttacggggttattattctgttgcactgggttggaatcaaccacacgacgagaggtggtagaaaagatagagacccttgggggcattcattattcagatttaatgacagatgtcaattatcttatagtgggagacagagacactgagaaatatcgattttgcattaaatatagacctgacattatttttattgatgctgattccattttcacaattcataaacattggataaacggtgaagatgaaaacctggacttactacgaatagagaaatataggttggcaatatttgctcaattgaatgcatgtttctcaagaatagaaatgtcaacctctcaaattgatcatttggtcaacacagtaaaatttcgacagcgtactaatacttcacctgagtatttccgtccgaaaaacctattcaaattgtttgttgataatggtggtattgccaaagaatctttactgtgtcatcagaattttattatcacagctgatccacgaggaacaagatacaacaaagctcttgaatggaatgtacctgcaatacaccctatttggattgtcgatagtgtattgagaggtgctgcattagattggaaagattatattttaaacaacaatccaaatgattgctatgatcgagggtgtgatgtttggcccgaagttttcgattgtcaggagaaacaaaaacagaaatctcaacaacaacctaaaagattagagtctactgaaccagaagtaaaacggaaaatcaccaataataaaaccaatgctgatatttggaactcgattatggatcataccaagaagcaaacaaagcaattgattcacgacaagacctgggatgatgatgaggaggaggaagataatgatgatgatggtgatacccaaaccaaaaatgaaaagaataatcaatacaagaatattactacaattcctaaagatggaaagcaaaaaccagaattaaacggtaaaatacataatttggatcttaaattggtgtcagaaagtaaagaaagctcaccaaatgtcctggaaagtcaattattcttagggtttaactattatacggtcggttttgactctcgtgagttcgacttgttatccaaagcaattgaaaactacctgggagaaatatctaatgatccaaatgacgattctatcactcatgtggttattccggcgaaaaaggggtatcagtcaatgctggttttgaaagtcttacctgctgaccttaagctgagaattgcgaatgggtttgtcaaaattgttactgagtttttcattgaaagatgtatgttttacaagaaaattatattagatagatggggacagccaatgaagggattagtgccgtctaaaaaatcatttaaaatttgtaccaccgggtttactggcattgaattattgcatattgaaaaactaatacgggcgtttaactttgaatattgtgaaacattgtcagaacagagagatctactaattctcaacgtaaatttatttaaaaaaagcttgatgaattcgccaaagttatttcaatacaaatgtaaggacattatcaattgtccaactggtggatctgtgtcgttgatgtcatctaaacacaaagttgaagctgcaaaacgatggaacattcctgttgtttcagtggcatatttgtgggagattttagaactttcaactaataaatcacatattattatgccggatattacagatttgcaatggtgtgtctttgcaccgagcaactataataaaccgaaatcattattggagtatgtgaagaatttggataaggctagtagagaaagttcttttagtcccaaaagtcaagaaaatgaagcattggaagaacccacaatggataatctggtgagattgccatcaccacgaagagttaacctgaaacaaaaatacggtaaattagtgggaggcaaatctcccaaatcaattaaacggaaattactcgaagctgcaaatctgtttgctgatggacagaatgatcatagtattaatccagatgttacaattgaagaggatctgatgtctcaaataaggtatcaagacaacgaatcaatgatcaaccaagaaagattattagagaaattggatggatcagctgtgcttgtggaaacactgatacgacatgccagtaaacgaagtagaaaaaactaa

SEQ ID NO: 4861 - DNA, 1317 bp, Candida albicans
ttaacaaaaatagaagaaaccatgtcaaagaaaaataaaaaatctgatgaaaaaaacgtttcctccaatttcaaactaataagtacatcttcaggagttcgtgtttcacaagcttgtgataggtgtcgaataaaaaaaatcaaatgtgatggtcaatcaccttgtcgtaactgtcaaaaagttagtgttgaatgtaaaaccagtgaccgattatcgagaaaatcgttccccaaggggtttaccctgtttttagaagcaaaagtcaaagagttagaggatgaaaaccgggaattacgtgaaaaattaggtgacaatagcgatgctcctccttttgaaccagtggaaaataaacatctggttagtactgctgacaccagtaatattacaacagtaaacaccactccaacaccatctacaattcccactacgacaacaactagtaatgataaagttttatttcaaacaaacaatcaatcagttccaattaataacccgattgatcaaattttcaatttggatgacaaaggtataattataggtaatgacaatttgaattttgagtcacaattcaatcatttattaatcaatttgaatttgccatttttgaaaataacaaacagtcacaactatttactagatgaccctgatagctacttgtatcatccttcctacacaaagagtaacaaattccacaatcgagacttggatttaatttataacccattaactggtacaaacactgaaacaggtttacggaacgaattacctactaacgtttatgatttattcattaaattaatcaacaatttcaagaagatattcaaatctaaacgagaaatggataatcaaattgtattgttctttttacactataacattttcattccgatttttgattataacgaattcatggaatcttataatgctttccatactatgtatccgtttattttcacctatgatgattcttcaatcaatggattcaatttatcgaatacaaatgattatcaaattgtcaataattatttgatgaccattattcaaatctatgccatgatcctgatcaataatccaaccttaaatttaaatttgctcttaaatcacacagaccctcattattcaatcaatcgagacaaatcaataatcaagtccctttatgatttcctaccatatttcaatggattccacatttcaattggccaattacaaacgtatttattatttttgtactattcattgttgactaataacaaggaaaaatctttgatactttcttctttggttaatgcctttattggtattttaggaatcaatcta

SEQ ID NO: 4862 - DNA, 1491 bp, Candida albicans
aaactgaaaactgaaaaccaaaaattgaaaaaaaaaaaagaaaaactaaccaaacccacaacaacaacatcaatacatagaacgttctctttcaaaaaaaaaatggcaacagcatcaacaacaacagtatatggaggtgatgaaatcaatgctatagttcttgatccaggctcttatactacaagaataggatatgctggtgatgatttccctaaagtaatcacatcatcatattatggacaagtgaagaatgacaagaaaaaaatctttggtgaatcaattaatgttccaagagccaattatgacattaaaccaatattaaaagaatctattatagttgattgggatgcagccattgaacaatatcaatattattttgatcaacaattaaaagttgtggggccagaacaaccgattttaataactgaaccaatatggacagaaacttcatatcgtcaacaattggtggaaacttttttcgaaaattttgaatttagtgggatatatttagctaaatcacctacatgtgtttcatttcaacaaggtagatcgaattgtttagttgttgatttaggtcatgattctgtactggtaactccagtgattgatgggatttgtttattgaaaagttcaatgaaaactaattatggggggaaatttttatctaatgaaattcaagattatcttattgatactaaaaaagttgttatggaaccaagttttaaaattaaatcaaaaattccaactacttatcctgatccaccaaaatatgaactcaaaaataataatactatacccacatcatcatcatcatcactatcacaatcatttcttgaatttcaaaatgaaaaaatatatcataattttaaagaaattttagaagttccagaaaagaatagtagtagtggcactactaccaccaccaccaccaccaataaagattcatctagattatttgaattgcctactggtcaatctattgttatcgatagatttaaaattgctgaatcaatttttgatccaacaatttataaattcaccaattcaaaattatcattcccacccaataatggagaaatctcaattactcaagctaatgaatatcgccctcttaaaagagttcgtaaaaatgatgatgatgaagaagaagattctaatcaatctactccaaaaccagaagttaatattagaggtatatcacaattaatttctcatacattatcaaatatcgatatagatttacgtgcatcattagctaataatattattgttactggtggtgtatcacttatttctcaattaacagaaagactttatcttgaattatcaaataataatccaggattgaaaattagattacatgctgtggggaattcaacagaaagaatcaatcaagcatggattggtgggagtgtattggcttcattaggaacattccatcagatctggctgacaaatttttctacacagacgaccgaaggaacattgaac

SEQ ID NO: 4863 - DNA, 510 bp, Candida albicans
gtaaagctgggggaaaccattaatgatattgctgatggtacaggtgttgaatacactttcaaccgtgatagtgaagaaactaaaggtcattctgaagttgaattgaccggttcaaaatctgctttgaaagaagctgttgccaaaattcaagaaattattgatgaagttgaaaactttgtttcacgttccattaaagttgagccaatttatcatcgtgatttaattggtccaggtggttccattatgaaagaaattatttctaaagctggtggtgatgaagtaccaagaaatagacaatacaaattattgaatattcctaatgaaggttctggtagtaatgaagttacatctcaaggtgacaaaaatattgttgataaaatcattgctgcaattgaaaaaattgttgaagaaaaaagagcttctgtaactcaagaaattgatttacctaaagaaaaacatcgattcaattattggttcttaacgacgccgtggaaggaccaagtcttcccg

SEQ ID NO: 4864 - DNA, 2499 bp, Candida albicans
atcattatgccaactcctgctgaaatcattgctgcccgtctcaatcgtgccgatgcaactcaaaatgtttatgaagaagaagaagaagaagtagtcacttccactgaaactactccttcaaccaacgccaaaccatcaatcactgatgaagctgctttccctactttaggaggtaagaaatctgcttccccagttatttctaatactggaggagcttcatcttggggtcccctgatgaaaactccagttcgttcttctactgcaagtcctgtcccaacccctgttcaacaaaccaccccaaaaccaactaatggaatcaagtctaaagtttccactattcaagaagctttttctttggatgttgaagatcaattgaatgttgcccgtccggaatttatcaagattttaacctttgtcaaacaagaaaccaaaactaacattgaatgtaccacttctcaacacaccaaaaagagaactttcttgatcactggtagacctgatgaagtcaaattggcaaaacgtttggtcattaaaaaattgactaaaccagtcaaaatctctttcaatatccctgccaaattgagatccagagtcattggtcaaggtggtaaaaccttaaagccaattatccaagccaatgaagttaaaattgaaattggtgaccaagttgaaggcgaagacactggtgatgatgggactgaagaagacgaagatgaggaagaagatatttttgctaaaactgttcaagttactattgatggtgatgttgaaggttctaaacgtgccaaaaacgccatcttggccatcgttaaagaggaaacaaagaatttgtctgctaaagtttctgtcaatgaaaccattaaaccatttgctagcaaagaattgaaatcaattgttgacaagtatccaactttagaatttgctattccagattataaatctaacagacacacaattatcattgttggtgaacgtgatttggttttggaagccaaaccagaagttaaggctgctttggaaaaattgtctaacaaggttgttgttgaagaagtgccaattcctaaaatcaaacaacaatttttaccaattgaacaagttttcgaagaacataatgttttgattcaattaccaaaagatggagaaggtaaagtcaaattcattggtgacaagaagaaaatcgctgctgctcaagcctctgccaaaaaaaccacctctcaatacaaggttgaaattttggatatgtcaaaagcccataaggggaacttgaaacacgtcaaggctgttgcttctgttttgaccaagactggtgtctttgatgaaatcgctaaagccaatgacgttaccattcacgttccatctagtaaagatctcgaatcaagtgctacaattcctattgaaattgtttctaaaggtgatgatgaacacattaaagtcgccaagaaggcaattgttaaccaagttaataaaattactcctgatttgactaaaaccattgaagatattgatgaatttttattaaacaaagttgacgataccattaaagatgtggctaaacagcaaggtgttgaatatgttgtttcgggtaaaatcatcactttattcaattttcaacaatctaatgaagatgctgaagattttgatgatgtcagtgatccagattctgcatttaagaaagttgacgaagctttgaataaattaagagaattggcagccaatttgactagtgctactttatctgtcccatcaaaggaacaagaccaagtttctggcccaagaggaactactttgaaatctattttggcttctgttgaaccaaacacagtcactgttgaattgcaccaaccaacatcagatgaagtgtacattcatggtatcaaatcctctgtggcaactgtcaagaaagaaattgaaagtgttttggcagatgctaaagagtttggtaatgaatatagtactactattcaagtaccatctcaagttctttcaagattgattggtaagaatggtgctaatttgaatcaaattagagatgaatttggtaccagaattgatgttcctcttgaaaaagatgaatccaaagataagtcatcatccaagaccgaagtgacaatcactggtgttaagagaaatgttgaagaaaccaaaaccaaagtctcagcattggccaagagatgggctgatgaaactttggtcagattgagagttgaaagtcaatatcatagaagaatgattggaccacgtgctgtctacatcaaccgtttacaagataaatacaatgtcaagattaggttcccatcagaaaactcagccaattttgctgatgctccaaactctaaagatgaagttaccatcaaaggtccatctaaaggtgttgccaaagccgaagaagagttgaaggaattgtatgcctttgaaaaagagaatggtttcaaacaagttgttcaaattccattgaaagcaattgctagagttataggtaaagctgggggaaaccattaa

SEQ ID NO: 4865 - DNA, 1635 bp, Candida albicans
caaacaaccttaacaatgccacccataggatcatctgatcaattcattcaccaaattacacagcaatttgtgtttcaacgtttatggactggaaatgcaacaaccccagagttagcaccagcttcaaccccctacaatcgattggtatgccgtaataataccgatttattctatgcaactggcaatattgttcgatgctgcacaattagtcccaatcataaaaactacaagctatttaaggttgagaatcaattctatgaagtagcttctttgttgatgaataaatcgggtaccttgttagcgatcatcggagaagagcaggtcgatgttgtgtcattacccaccaatgttatgaaaagtagtggtatttatgttgatggtgcatcgttcaagattaagaatttaagaggtaaggtaagaaagtgtgtttggcaaacagttgcggcaaacgattcaacattagtagtgttgactgataattcacaaatccaagcttatgatttgacaaaatctttggaggtccctgtgattgatgttgatttgaaaagatatgccaactttgcaaatgaggaagccatttctattgcatttgggtcgtctaaaaatttggctggtggattgactttgtatgtctcaacattgtcaaacatctatgctatttatccattcagtgcaaaatttggtaatttggccaccactaaagaagcaattgatatagctttggaagatacaaaagcagctatggagttgattcaggaaaaataccctgtaaacttattagacacggcaactagtactttgaataaagcagctatccgacaatttgagtattacctgcatttcaaatcccagttaagtggcgcgttaccaataattaaggaagtaagagacactcatacaaataatccatacgagctttttgttgttagtcagaccttaagtgattggactggttacagcttacaaggtcccctcatttcaagtaatgctggtataaaggatttagcttcaattggtgacaatgatttagttagtatacttgctagtatcgatgctaatgctacagttacttactatgctcaacttgcacccatgttgatgaagtacaacataatgagtatagcaagtgaaggtgcaccaagtgaatcaagccaaacagtttgcaaaccaaagtatgttaaaccaaaaagaggatttggtttcatagacaactccgaggaagaggagaaagcattggtaaaactgaaacaatcccaggaaagcttttggaaagaagaattgacaagcttggatcttttgcaaagggacaagcttccagttgatgaaaatgatgatgctactggcttcccaactttctttggagaaattgattctaatagattcagtgtttgtgtgaattccaacaaattggttttagttgattgttcttgggtgaagacttttgtagacgatcttaaagaagacaaaatagattccgtgtcgatcacagcaaattatggtattacctccacagaaaaagaaaccatcacggcatttgcatatataaaagacgatgtcacttccactggcgaatacttgactgtttgcagaagtaaacttgtcaatgacatgggaagttatccagattgtggataa

SEQ ID NO: 4866 - DNA, 243 bp, Candida albicans
aatcttgccttagttgaagttgtatttgtatggtctaatggtgcttcattcagttcaatttgtaaaatgactgatatttatgaaggtagtataattcgtgccttaagaagagaaatcgaattgattaaacaattggtagatgcatcaaaaatcattggtaatcaagaattggttgataaatttgaaaaatgtattgaattgatcaatagagattttgtacaagtatcttcattgtatatgtaa

SEQ ID NO: 4867 - DNA, 516 bp, Candida albicans
ttgaaaggtagagtagctgctgaattatctactggtgatgaattaatgattactgagttattattctccgggtttttcaatgagttaactccacagcaaatttgtggattattgtcagcatttattttccaagaacgagctaaagaattacctaaattaaaaccagaacttgctgaaccagcaaaagtaattcatgaaaccgctaataaaattgctaaaatttcaaaacaaagtggattagaaattgttgaaaaagattatattgaacaattcaatcttgccttagttgaagttgtatttgtatggtctaatggtgcttcattcagttcaatttgtaaaatgactgatatttatgaaggtagtataattcgtgccttaagaagagaaatcgaattgattaaacaattggtagatgcatcaaaaatcattggtaatcaagaattggttgataaatttgaaaaatgtattgaattgatcaatagagattttgtacaagtatcttcattgtatatgtaa

SEQ ID NO: 4868 - DNA, 2757 bp, Candida albicans
atagaacaagaactacaaaaagaaaaaaaaaaattcatagtaaaattcaatcctttaaccatcaaacattacaaccaactacaaaagatggatgacttgtttgatgtctttgatgaagctcctcaagcagctccacctaaaatagaagaaatcaaagatgaagtgaaaccagaaaccacagataatcaaactcgctctacgaagaaacgtcagttagacaacaacaacaaaacaactaccaacagcaacaacagtagtagtagtaataacaaaaaacataaacaagctgaagatattaaaccagttgtttttgattcagttgaaattgaaacatctagagaagtcaaaccaagtgaaggattgagtaattctgccacggttgacgcagataataaattgaaattaaaacatcaaattagacatcaagtagccatcccaccatcatatccttatgtaccaattggtgaacataaacgtaaacatgaagctagaacttatccattcacattagatccgttccaagacaccgctatttcatgtatagatagaaatgaaagtgttttagtctcagctcatacttctgctggtaaaaccgtggtggcagaatacgctattgcccaatccttgagagataagcaaagagttatttatacttcccctattaaagctttatcaaatcaaaaattccgtgaattacaagcaatttttggtgatgttgggttaatgactggtgatgtcaccattaatcctgatgctgggtgtttagtcatgactacagaaattttaagaagtatgctttatagagggtcagaagtgatgcgtgaagttgcttgggtagtgtttgatgaagtccattatatgagagataagtctcgtggggttgtttgggaagaaacgattattttattacccgataaggttcattatgtatttttatcagctacaatccctaatgctatggaatttgctgaatggattgtgaaaattcacaatcaaccatgtcatgttgtttacactgattttagaccaactcctttacaacattatttgttccctgctggtggtgatggtatccatttagttgttgatgaaaaagggacattcagagaagaaaatttccaaaaggcaatggcaactatcagtgataatagtggcgacgaccctgcttctagtgatagtggtagaggtaataaaaagggtaaaaccaataaaggtcgtaatcatcaagatggtaaaggtgatatctataaaattgtgaaaatgatttatatgaaaaagtataatccggttattgtattttcattttctaaacgtgattgtgaatctttagctttaaaaatgtcaaaattagatttcaatactgatgaagaacgtaattcattgacacaaatcttttataatgccattgaattgctacctgaagctgatcgtgaattacctcaaattaaaaacattctaccattattgaaaagaggtattggtatccatcattcagggttattaccaattttgaaagaaattattgaaattttattccaagaaggatttttaaaagtattatttgccactgaaactttttctattggattaaatatgccggctaaaaccgttgtttttacatccgtgcgtaaatgggatggtgttggttttagatgggtttctggtggtgaatatatccaaatgtctggacgtgccggtagacgtgggttggatgatcgtggtattgttataatgatgatcgatgagaaaatggaaccacaagtagctaaaggtatggtaaagggtcaagctgatagattagattctgcattccatttaggatacaatatgattcttaatttaatgagagtggaaggtatttccccggaattcatgttggaacattcatttttccaattccaaaaggcatctagtgttcctattttagaggggaaattagctcaatgtaaacaagaatttgctgatattactattgaagatgaaccaattataaaggactattatgatttgaaacaacaattgttaaaatataatgaagatgtacgtaaagttattactcacccaggtaatattttaccatttttacaagatggtagagttattaaagttaaaattggtgatcttgattatggatggggtatggttaccacatttacgaaaaggaaccgtagacaccaagaagaatttgctccacatgatgcatacgttgttgaagtatttataacaaccatgtttattgattcaccagtcaatttaattaaaaaatttaaccctatgttgcctgaaggtattcgaccagctaaatcaggggaacaaaccagagctgaatttatttctatcaccttaagctcaattgagaagattagtactgttagattaagagttcctgatgattataagagttcgactgccaagagaacattggttaaaactttgaaagatttaccgaaaagattacccgatggaatcccattaattgatccagtacaaagtatgaaaatcactgatgatgatttcaaaaaacttctacaaaaaattgatattttagattctaaaatagtttctaatccattgaataatagcgctagattggatgatttatatgccaaatacactgcaaaagttgatttaaacaatcaaatcaaaaaattagaggaacaaatattccaagccaaatcaatcattcaattagatcaattatcgaatatgaaacgagttttgaaaaaattagaattcactggttccaaaaaagtggtg

SEQ ID NO: 4869 - DNA, 366 bp, Candida albicans
gtgctagcgcgcgcgtgtgaaaacagtatcactgagaacttacgtgaaaatgcttatcacaatgctgagttgttagatgaaagattggataacctaggtgccaacttaggaactttgatcaatgaaatcaattcagtcagtgatgttttcaacaagaatttgatcaatgagttagctaacaaagccgatgcaagagattctaccagtaagaaggatgatataaaaccagatgagaataatccatttgaagagattgtgagattattgaatttacatttggaaaacttgaaatacattgaaaatgcagaagaagagttgaaaagcaagttggagaaattgaacaaaaccaaaaaattaaatcattaa

SEQ ID NO: 4870 - DNA, 1314 bp, Candida albicans
atgtcacgacaagattggttcaatggtccagtatgcgggactgataattgtcgatcacgactttatcgaaatcaggatgggttgacaatatgtcaatttggacatgtgttggaaggggcggtggagtacaatgatgatccagacgcaggtgggatagttcaaactagaagattgaatacaatttcctttgatgaaagagggcatttgtcaagtgccgtggtttccaattcacaaaccatcaaaacaaaactgaatcgattatatggtgaagatgccatggccttgtattatagatgtttgcaaattttattgaaaaaggaattgaaaatttttattgacttatttttcagtgaaggtataagacatgatttgacgttgattgtgaaaaataattgggtgaaattattatcgactgatgaactacaagaaaaccatccgaaacgacaagtcatagacacgctagatttgatttgcatgatttatatttcggcccttcagctacaagcataccccatctacattccagatttgatagataatataaagttaaacacaattccatatataagaacactccatttaattcctaagcacatgctagatcaattgcctactgtgtatcataatagattgcaaccttattctttaccagagaacagtcagatctataaacgtttacaaacaactgggtggagaactgttggagcaactttaagaataccgacaagcttttatttcccgtttatattccgaatattatctgaacatttcttattggttaacgcagttgatttatttgtgtctgcatttaacgtactaaaatctaccccgtcctttgaaattaattttcgaatcaaaaagtttattcaaaagtttccagagatttatatttcttctgtattgataatactaatcagggaaaattttcgtagtaacgacaatttaaagccatggttatatgaattgaacaaatatgaattaaacaacgagtacaattcgggcggtacgtcattactaaattggtcggacgataaggtggataaatactgtgactggatatatgataaccttataccaaagaaagctaagttgaacgatgacaatacagaagctttgaatactatggaaaagaggttgttccagatctttagcctagacaatgatatagagaacacagcacccgaaacaaatgaaactccaatgtacttagccttaagaagtataatgaatggctctgaattgaaggaaagtggtggtttacaagaattggatacgaaacttgatgcaaagttatcaaatatattgggtctttaa

SEQ ID NO: 4871 - DNA, 1041 bp, Candida albicans
ggggaaactaatcaagaatcagaatccgtcctccataatatagacgatggcgatgaatcgttataccaacagagattgcaaacttgggtacgcaaacgagcatcactcagaacgcagcaccagcaggagggaattgaagaatggtttcttccacatccaaatattgctgatgctaagctaaatgagaaattcaaactacctggcgatatatatccttccttgtttgattatcagaaaacttgtgttcaatggctatgggaattgtacactcaaaagactggagggataattggtgatgagatggggctcggtaaaactattcaaattatatcgtttcttgctggcttgcactattcgggattgttagataaacctgttctagttgttgttccagcaacagtgttgaaccaatgggtcaatgagttccaccgatggtggccacctttgagatgtataattctacacagtatcgggtcagggatgaacggttctgtatcggagtcaaaactagaagagtacttggagtcgaccgacccagatgcgacacagtcctcccttcacggtatcaagagtcaaattaatgcccaagagatcgtcgatagagttatggaaaaaggacatgtgttggttactacttatgttgggttaagaatatattccaaacatatactaccgcgtgaatgggggtatgtggtattagacgaaggacataaaataagaaacccggatctggatatttccctcacttgcaaaaaaatcaaaaccgtcaataggattatcttatcgggtacgcctattcaaaacaatttgattgagttgtggtcactatttgactttgttttccccggtagattgggaacgttgccagtgtttcagcaggagttttcgatccccataaacattgggggctatgccaactcaaacaatttgcaagtgaaaacagcatacaaatgtgccgtggtactacgtgatttgatatctccgtatatgctccgacggttgaaaagtgatgttgctccaagatttgcccaagaaaaatga

SEQ ID NO: 4872 - DNA, 1575 bp, Candida albicans
aaagtgatgttgctccaagatttgcccaagaaaaatgaaatggtcttgtttgtcaagctaaccaaaattcagcaggaattgtacgagagctttctacaaagcgaagatttggagtctatattgaaggggaaaagaaacgttttaatgggggttgatatacttcgcaaaatatgtaaccatccagacttggtgtatcgtgacactttaatgaagaggaagaattacggcgacccagcgaaatcagggaaaatgcaagtattgaagaatttgttacgtctttggcaaagtgagaatcataaaacattgcttttctgtcaaactcgtcaaatgttggatatattagaaaagtttgttgctaatttatctttgattaacggtggtgatttcaattatttgcgaatggatgggagtacgcctatctccaagcgtcagatgttagttgatgcgttcaatcaagatccagatatgcatgtttttttgttgacaacaaaagtgggagggttgggagtcaatttgactggagccgatagggtgattatttatgatcctgactggaacccttctactgatatccaagcgagagagagggcatggagattaggccaaaaacgagatataacaatttacaggttaatgaccacagggtctattgaagagaaaatttatcatcgtcaaatcttcaagacatttttgaccaacaagattttaaaggatcctaaacagcgacgcttcttcaaggccaatgatttgcatgatttgtttacgttgggagaccaggacgaggagggcactgagacagcacaattgtttgaaggtggagaacaatcacagcaaaaatattctgggaccaagccccgacaatctcgaggattgtttaagaagaaatataaagatgacgatgatttctcgcaggttgctcgcatatctggtgtttcaaaactagacaagtttgaagatggtgatcacaatgacggggacggagacagcacatatctggcgaatgaagataatcgtatcatgtcgagtatttttgctcagagtggggttcatagcacgttgcaacacgacgatatcattagtggatcaaaagaaaaggaatctagtcttgttgaaaaggaagcagataaacttgccactgctgctgcggaggcgttaaagaaatctcgcatgcaaacgagaaaaaatacaataggcacgccaacatggacggggaaatttggcagtgctggtaagtttgggttgaaaaggagaaagttgttaaactcgtcaagtaccattttgcaaaatttgagacaaaaaaatgaattgacagaatccaaaaaaccagatgatgttaaagttgaaccagatcgaaaacaaatcatggagaatttggtggagtatttgggagaccaaatggacaatttcagcacttctaatgatatcataaagaatgtcaagttatccatgagtacggaaaacgagatgattatgattaggtccatgttgagagaaattgcaaattgggactcatcaagaaagggctggaaattgaaggatgagtttttgcaacaacaccaacaacaaccagagtga

SEQ ID NO: 4873 - DNA, 1101 bp, Candida albicans
caagagtcaaccataaatatgccagaatataccaactttgagagcaagtttgatgacattgacatgcttgaaatacctgaggatgatgatggggaaaacagcattgataactcaatttcatctgaaactgaaggtatttctgattcttccgactcaagcaaaagcagttacgaccaatggagtccagtagcaatattcaaatcagataaggagtacattgacttatcagactggttgaacactcaaaaatctttagaatttaagtttgatgttcaaaagtataggaagggaatagaaaaatctagaccatttgatgagaaatatatcttgtacgtcaacaacatgttcaaaatcattcaaaaacttactgaggatgacatcactagatttgacttggaggaagacgattctcctataggcttggttatggatctgatgggatcaaaggccaaacaggtgcggaaattcaaaaagattgatgaagcattgagagagataattgattatttgcaagatttggtaaattctataccgaaggaggaacaagaatcttatgattcccaatgtttacaacatgtgttatatattttagaatgttttgaagccaacaatttatattttgatatccagcaaaaaccggaattgattatcaagtgggtaaatacttttgatcccaaaccggacccagaattgttgaatgacgttattgtgaacacaccacaaccttatttgcatcctcggttttggaacacttgtatatctcagcttcttacaagaggattgtttactcagattcacgaagtaattgagcattcacagtaccaggaattaaaggaaaagtgtccggaattgtatgctgtgattggtgacatggatactttgttatcgaattacacttcctactcctccaagggacaatttaccgcatggaagcttttggcatgtgaattccgcgattctttgtcatcagtgagaaatgaaagtatcaccgaaactaagcacaaattgattatagatcaaatttacgatttggcatgcatttttacaggattacctaaaactatttctagctcttgcgagacctggtatgaaatatgtccg

SEQ ID NO: 4874 - DNA, 1191 bp, Candida albicans
tactttaaaacagctgtttccgaaaagccgccttcggacatatttgatgacgaaaacgagaacttagacgggttaaccgaagcatgctttttgaatattttggaaaataactttttgaaagttttagaaactttacatgagttggatcctccaacaacagcttatttggccgagctaatggaattgaggtttttacttagaggctactacttcgatgtcactgtgacctcttcagcaagttttgaagatttacttaataggaggatagtatctgagtacttcttaactagacatgcatacgactgtttaaatattcatgaattggtaccagtgggtattggtcttctattgaataacgtagtatgcacgtccaacaatgctgtttctgccaacagaaaagttatcgcgacatttttacccaactatatctgtaatactaatgatgatcttgaatgggccttgactatatgtgccaatttgaatttggtgtcgacggctatacaattgtactatcaggctggtttgaagtctttggaagaaggttacatgtacgaagcattgaataattttgtcaattgctacgatccaacattattgagtggtgaaaatcacagtgaaggtatgaagaaagtgcattatattgtgtgggatttaatatttgcaaattgtcttgttcataaccgaccaataaaggatgaactaatcaacaacatcgttgacaagaaagttgatcttaatttcaaaatacaccctgtcattcaacaatgtcttgctccatatgctgtattgaaggagttttatgaaacattaccacaaagggatataaagctctctaataaactttcgaaattgattcatctattaaaattcaactacttgccaaaaaaatttgttccattgttactagcacaatttattccgtttttaagtgaaccaaacacaactttccagttgcctgatttggttattattattgaattgcttgacaactacgaaagcgatagaaatgagaaagaacttaaagagggtgccgatttgtatttgtactcaattaataatattgagtcagatgctgatgaaaacgactggcgaaaactagtgggtaaagacaatttgccaaaagatattgatctgttcacaagattgttgagaaacctaattgcagcaaaggttggtaaagtgtttatatag

SEQ ID NO: 4875 - DNA, 366 bp, Candida albicans
gaattattcaaacattcaggtcatacattggtggaattaagtatcaattcattggatttgttgacgaaaaatttcttaagtcaagttttcactgaagatctgcatcaatttaagaaaagattacttcaacaattggaagaaagtcaagatgaagaagttgaatactataatcatataaggcttccattattgacatatttggatctgggatttgtacgtgctgttgataatgaacttttatctttgattggtgagagttgtcctcagttaaagataattgaagtatatggtgataatagatgtacgtcaaaggcaagaattagacccggtttaatggtaattggtcgtcaaagtgatgaaatttaa

SEQ ID NO: 4876 - DNA, 1596 bp, Candida albicans
tcaatggctagaagacaaagatctaaacaaggttcaagctctcaaagtggtgttaaaggccctaactctgccttaactgagttcttacgtaatgaaggtattactgacgcgtttagacaacgtagacaacgcgaacaagagacagttaatgaaggtaatgaaaatgataacgatgctaatgaaccagagcaatctacatcagctgtggaagtgacaccagaagcgcggcgtcggagtacacgtcgatctcctagtgctccagtggaagacaccaaagataccaatgacgatgatgacgaaatcagagaaatgagacgtgctgctaaaagaaaattacgagcagcaagacgcggttcaacacgtcaacctcgaaatcgtcatgatcccgataatagtggtggtgacgatagtagtagcagtagcagtggcagcgataatgatggtgatcctaatttcagtgaagatgaagatgatttgggtaatttaaatatgagaaaatttggtgaacaagatgattgtgttgattgtggtcaaacatttgaattaaccgttagttctcgttttcttaaagaaaagaacggatatctatgtaattcatgtaatcaattgctcaaggcaagagaacggaaagcgaaaatgaaccaaatgaatgctcgtaaaaagaggaaaagagtggctcaagcattattaaataaaactgatgtgaaaatccccaaattacaagatgtttgtatcaaaaaaatcacggaaaatattgaagatgtggatgtattaggtgatattggacaaatgaatatgaatagaatatccatgattctatctaaaaatcgttcattaaataataaaaccatttcattatttttatctccagatttgaaaagtttacaattttgggattgttccaatgtcgattctgactctttgaataaaatagcttcatattgtcctcacttggaatcattgactttatttatgtgtggacaacttcataatgataatttacaatattttgctactcaactaactaaattgacagaattatcattaaatggaccatttttaattagtgatgtaatgtggcaagattattttgaagaagctggtaatcgattaactaaatttgaaattcgtaacactcaccgatttggaaatgattcattaattagtttattaacaaatgctggcagaaacttgacttcattaaaattgtctcgattagatggtttaaatgctgcagatgtatatgggatgattcctcatttcttactgccatcgaaattgactcatttggaaatctcatacccagaaaaggaagaattgatcagtgatgacttgattattagtatactttccattaccgatgacactttggtctcattgaatcttgatggttgttctgatctaacagaaaaattcttaattgatggtgtggcacagttttgtccaaatttaactcatttgtctattcaaaatttagatcaaattagtgatgacgggtttgcccaagctttgaaagaatatctgaaagtcaatgttggtggattattagaagtttctcttacaaaatgcattgtattaggcgataaagccatttag

SEQ ID NO: 4877 - DNA, 747 bp, Candida albicans
agtcataaacgaacattagaaaaagacgaagaacatcaggagaagaaaaaagccaataagatttctaaagatgatatggaaatcgatgctgaattgttaacccaacaagcttctgattctgcccacactgacactgctactgctgcagtggctgctgttaataacgaacaaggcaaagaattagaacaaaccgaatccagtactaatcaaacatctgcattggacaaagatgataaggagacgaaggataatttgaaccctagagaagaaactcaatcttctcatcaagaaatcgacattccaaaggatcaacttacgaatcaacaaaaccttgctgatcaacatcaacagtatcagtaccatcaacagcttgctcaaacaaacttcaaaaccgaacccactaattcagccaaacctccacacggatcagaggaatggcatagacaaagaagagaaaatcataaggaagttgaaagaaaaagaagagaatccataaatactggtataagagaattggccagattgataccaactaccgataccaataaagcccagattttacaaagagcagttgaatacattaaaagattgaaagaaaatgaaaacaataatattgaaaaatggactttggaaaaattgttaactgaacaagctgttagtgaattgagtgcttcaaatgagaaattgaaacatgaattagaatcagcttatcgtgaaatcgaacaattgaagagagggaagaaataa

SEQ ID NO: 4878 - DNA, 186 bp, Candida albicans
ccacccactctatcaatggacagcactggtactactattaggaaacaaaaaaatcaagcttatgaagaagaaaaacttcatcataccccttgggttgaaaaatatcgtcctaaatcccttaatgatgtatcatcacaagaacataccattaaagtattaactcaaaccattaactcaggtaattta

SEQ ID NO: 4879 - DNA, 741 bp, Candida albicans
  unsure (13): Identity of nucleotide sequences at the above locations are unknown.
gtaaccccaccanaagaagatttacaaaattatccttgtcctccttataaaatcattatattagatgaagctgattcaatgactaatgatgcacaatcggcattaagaagaaccatggaaaattatgctggaattaccagatttgtattgatttgtaattatattaccagaattattgatccaataacttctcgttgttcaaaatttagatttaaattattaaataatgaaaatgctcaattaagattaaaatatattggtcaacaagaaaatttacgatttgaatcagaaaacaatgaacatcaagtgattcaagaattattgaaaattagtggtggtgatttacgtaaagctattacttatttacaatcagcggctaaattaagtgaaacttttgatattaatcatcatcaaagtttgattactattcaatcaattagagaaacagcaggaatattacccgatgatattttggccgaattaattcaattcataaaactgaaaactcaacagtctaggttgattaaatatattgatcaatctattatattatctggttggagtgcacaaatattactcgatcaattacatgataaattaattttagatgaatcaatcaattcattactgaaaaataaaatttcacaaatttttttccaactggatcgtaaattaaataatggtactgatgaacatattcaattattaaatgttttattacaaatatcacaagttttataa

SEQ ID NO: 4880 - DNA, 693 bp, Candida albicans
gcgcgggtctttccagcctttgtggtgccagactcggtcgaagaatcaacatcatcgtcgtcgacaacagcagcagcaggaacaacaacaatcaacaagagacaatctagctcaactattaatcttgaatcggtgcctcgatatcaacaagaagaagatggagaaggagatggcacgttgataactcaattagatattgaaacattaaaacttaaaccatggagagcacctggtgttgatgtatctgattatttcaattatggatttgatgaatttacatggttggcttattgtcataaacaagataaattaagaggtgaattcaatcctcaaaaagtgatggaaaatattatgaaaggtcccggtggtgctgtgggtgctaatggtactaatggtattaatttgggtgacaaaacaggacaacagcaacagcagcagcaacaactacaacaacaacaactactacaacagccaccacaaccacctatgggtatgatgatgccacctccaggattcatggctaatatgccgatgccaccaatgggatctatgccaccaatgcctaatatggccaacatgccaaatatggccaacatgccaaatatggctaatatgcctccgccacctccagggtttaatggccagttccctgcaccttataatatccctcatactatgaatcaaaagcaataa

SEQ ID NO: 4881 - DNA, 654 bp, Candida albicans
tccttccagggcccgtgtgtgaagaatatccctcccctctcaaaaacaactatatatctaatcatgtccgccgatgaaaataacaaagtgagatttgagcggttgaggcttgttgccaggaaagccttagaacaactgattaaaaagtctttgactatggagcaagtaaaaacatgttttccgactctagtgacttctcaagatggagtcagatcactcgaattggccctttcacaaatgtccgggttttggcatgcaaactcgttggacgaatttgatctaatatataaagaaaaagatattgaatctaaactagatgaattggacgatataatacagaatgctcaacgggctaaagacagtgggacaaaaccaagtaatatagatcagctttcacctttagaaattgtttattccaccattgttagcaatagcaaaaatgttttggatagtcttcaaatgatatacgaccaattgtgtctcgataatgctgagctatatacagaactttcagaactcacaaaagaaagcactagaatcaataattctataaaatccggtattgaacaattaaacaaagaagctaatagtgttgagctagaaaaagcgggacttcaaattgacaaattaatagatatccttgaagaaaaataa

SEQ ID NO: 4882 - DNA, 1023 bp, Candida albicans
tttgttatttataatacatattctatagaaaactaccccaatatgagatttcccaatgttggcttggccgagctatctaagagtattatcaaaatccgtggccccgatgcaaccaagtttttaaatggactagtaacttctaggttacttccaaacgtggtgaagaaaaaacaacacactataagtgaatctgaaaatagacattcaaatttttcagagattattgacgtttccaaaaactatggattgatgcatgaagatatttacgaccccgattataacataaatattagcagagacgggatcaattcaatgattttgaattcaaagggtcgagtagtaacagattgctttttatatccagaccctttccataacgtggattgggttttccaagagagtatgaatgagccgggatatttattagaagtggatacactgatactgcaacaattgatgatgatactaaagttacataaacttagtgctaaagtcgatatagttcccgataaaaaactttattcatattactattatgatgacactgccacatttgatgcatggttggaaaatattcaattcaaatactttaaaagtcttgatccaacaactgctttacagaatgcgaactctttcatcaaggacaacgttttcttcaatcaacaaatagctaagaatattttgggatttgccgttgataacagaattccaaactttggtataaagtttatctcgaataagccaatatccactaataatgacaatgacggtcaacaggatgtgatcccggtagagtcacttttttctgaatcatttagccaggaatttgacacacctactattaacgagagtggtgttgttcaaagacgatttcaaaatgggttatttgagattcaggatgcatcaaagggcagttctttattgccatttgagtgtaatcttgattataccaatggtttgtcgttggacaaaggatgctatgttggcccagatgtcttcacctcggggcttgaaaacccgcgt

SEQ ID NO: 4883 - DNA, 870 bp, Candida albicans
ggcgtggtgaagactgctgacattaaaggtttgtttggtcaaatatttgtggattttggagacaaatttactgtaattgaccaaacaggtgaagaaccattgagcggaattgtgtctgacattgagaaaaatggtacagttacaatgttggatgataatagacacggtttacaagatggcgattatgtcaagtttgccgaagttgagggcatgcccaaattgaacgaaggaaatccccacaaggttgaagttttaggaccatatgcattcaagattaagattgatgaaagctatggtgaatacgtcaaggggggattatacacccaagttaaagttcctaaagatttatcgtttgaaccattgaccaagcaattggcagctcctgaatatttaatttctgattttgctaaatttgacaaaccagcacagttgcacttggggttccaagccttgcatgcattccaaaccaagcaccaaggtgaattaccagctccatacaatgaacaagatgcaactgaagcatttagatatgctgaagaattggctactcaaaatccatcaattttgggcgaagacaaacttgacgaaaaatacctcaaggaattgttctaccaagctcgtggtgatattcctggggttgttgcattttatggtggattaattgcccaagaagttttaaagaactgttcttccaaattcacccctatccaacaatggttatactttgactccttggaatcattgccctcaaaaaccgaatatcccggaaacgaagagaaccacgacccactgggatctagatatgatgggacaattgccgttttgggtaaacattcccagaaaaaattgccacttgaaaagtatttctaa

SEQ ID NO: 4884 - DNA, 216 bp, Candida albicans
cgcggatcgtcagccctggcggatatgggtactaaaggtaacagtcaagttgtcattccaaacttgactgaatcttattcatcctcccaagatccaccagaaaaagtccattccgttgtgtactttaagatcattcccaaacaagatcgatcatactatagcttgggcaaaatcattattccaaggttattttgccgaatctccagaaagtgttaa

SEQ ID NO: 4885 - DNA, 747 bp, Candida albicans
  unsure (734): Identity of nucleotide sequences at the above locations are unknown.
ctgaatcttattcatcctcccaagatccaccagaaaaagtccattccgttgtgtactttaagatcattcccaaacaagatcgatcatactatagcttgggcaaaatcattattccaaggttattttgccgaatctccagaaagtgttaatttatacttgagccaaccaaattacgtggaacaaactttaaaacaaaacccagatattaaaggcacattggaaaatatctccaagtatttgaacaatcgtccttacacttttgaggattgtatcaaatgggcaagacaagaatttgaaaccaagttcaaccacgacattcaacagttgttgtacaatttcccaccagacgccaagacttctactggagctccattttggtctggtcccaaaagagcacccaaaccattggagtttgatattaacaataaggatcatttggacttcattattggtggagctaatttattggcatttatctacggattgaaagaacctaatgcaactgttgatgatttcaagaaagtcttagaacaggttatcattgaaccattccaacctaaatctggggttgaaattgctgccacggatgcagaagccgaagaaaaagccaacaatctttctggatctattgacgatgaacaaattagaaagattgctgcttctttgcctgaaccaagtaccttggctggttacagattgaccccaattgaattcgaaaaagatgatgatacccnccaccatatttga

SEQ ID NO: 4886 - DNA, 1080 bp, Candida albicans
  unsure (255): Identity of nucleotide sequences at the above locations are unknown.
atctcaacgagaaacaattgttattttacaggcacatcactctttgcaagcaattggtactctagtacgaaggttatgattatgagtcgggccttaaagtttttgccagatgtgtttcccaaaattgacaatgccgctcaagttgttttaattaccgtagaaaacttttccagtcacgagatgattagagatgcaaccagatttgcctttgccagattcattccgattttcaaaagtgacaatgataataacaancaaaacaacttattcattagccagcatttgtcgaaattgattactattatatggtcatcctcatatttgaaaattagtgagtatagtgatttcttaagtttcatagggcaaattgtccataactttagaacagatgacaacatataccagttattaaataagtttataacaccattatttcaagaaatatttcaggttttacaaaatccagttaccgaagacgaaaacttgcgaccagatattatcagagataaaaattcccttaaacgtgcaactttgaatttcattagttcaattgttatgaatcatctttcaagtttgttgatcactgaatccaataaacaagagttgcctgaaattattggcaaagtatttgaatattcttatgatttgagtgatacgaccacgtcaaaattagccattgtccagttgactaattttgtcaatgtttttggtggaagtgggggtaaattggatgacaaagaggataagtacagtgaaaatttaccaccaatcgaaggtatagatgaattcttgatcaacaaagtcattaacctctcgtttgaattaccatttcaaaaacaagaatttaatttaaatgatgcacagtatcgattaattgctcaagaaattgccatattgttaaagagttttgaattgaaaaaacacgacgaatttatagttgttttgagtaattatttgttaaatatgggattatctcaagatttgtgtaatgacttttgtttgaacttgcacaatttggatttaaaagattttaaaaagtattttatcagttttatcaacaaaatgaaaagtgggaaatag

SEQ ID NO: 4887 - DNA, 1773 bp, Candida albicans
gaaacaagtttgcctcaaatttcttgcgaaacatttttgtcaagtgtatataaaacatttatccccacttttattacagatttgcttgaattaatcaatgtatcggaagccacttccactaatcccaacaacctattggctattgattactatacgagagttttaattggcattcattcggaaattggtgacaagtacatcacaagatcccaagaaatacataatagacataatcttttgaaagatgccattcgtactcaggatatgcaacaaatggtgaccagttggattcaaatcttaactaacccatcgtttgcgcactctgaggaaatcttgaacaacactctcaagatagtggggcaatacgtaagctggatggagatttccttgtttatttcaccagaatttatcaacacagttttcagctttttacagaattcaaaattgagaaatacaacttgtgaaactttgatagatataatttccaaaaaaatggctccacagaataagctagaattactttcattattgaacttgactgagtttattgggacattaaatttaatcgaaaaaaacaaaaatgatgacgacgacgaagatgaagatgttgagtttatggaatttgttgccaaattattgaatcaaattggtcaagaattgttaatagttttagagaatcaatcgggtttattggaacaagtcaacgctcaattgttcaagttgtggccagcaattttggggtgcttgaaccacaattatgatgatgtttctcaaaatgtgttcccctttttacaacaatttttaacgttgagtaaaaaaaaccctcaattgtatactgtggatttaatgtctactctattaaataaattgattttgaaaatgaggtttgatgacgacgatgacggagttctggatgaagacactcaggcccaatttttggatttcagagcaaagttgaagagctttcaagatactattgccctcttagaaccacaattataccttgaagcaattccagtaataatcaacgagtctatctttgagactaatgtcgatgacgtcaactggagaaaagtagaattgggattgtatcaattgaatgggttttctgatagtattagaaataatgtcttccaaatttcgagaaatgaaatcaaccaaagtaaaccatacttgattttccaagagtttctcatcaagttgatcaattcagatttaatcatgaaaataaaccaccctatgatccaatcaaactttttcgaattgatcgtcaagcattataatttcttggttagtcgagaatcaaattttgaattgatcatcaagattctacaaattttcaccagtcctttgggattgttcaacgaaaacgaaaaagtacgcattagaagctggtacttgtttttccgattcatcaaattaaccaaacctaaattggataacgaagcattgatcgaatctattgttgtgaagatgcaaccacttttggtgattaaggcagagttaccaacaaaagatgaggacgacgatatcgttgaaaacggaaatttcaacaatcaacaatatttatttgaaactatgggattattgatttctttgattcctaatgagttatcgcaattgaaactgaagttgatcgatttgattttccagccaattttcaatgacctagaaaaatgtatttccatccctgaatctcaacgagaaacaattgttattttacaggcacatcactctttgcaagcaattggtactctagtacgaaggttatga

SEQ ID NO: 4888 - DNA, 1083 bp, Candida albicans
aatttagccagtaatcaaatcatgaatattagaggtatagaacaattgattaatcttcgatcattgaatgtatcagataatcaattacatgggaaaatcaattttaaatttttcaattttatgaatttgattgaattggatctttcgaaaaataatttacaagaaataactggattacaatatttacccctgttgagaattttaaatcttgatgataataatttaattaaatttgattgtaaaaattccaaacttgctaaattattaattcgatttaatcatatcaaaaaattggatatttcaaaattacctgaattaagatcattaaaatttgatggtaatcaacttgaacaaatagaagggttagaaaatttacgaggcatggaaaatatttcatgtaaatctcaatatagtagtaaagtggtggaacaaattatgaaatcaattcaagatattcgtcaattggatgtatcagggaatcgacattttaatgccatatcaactttcccatttcttagtaatttaaccatatcagccatgaatttaactactatcccaattgatttttatcttctgtttcctaatgttcaaactttaaatcttagtttcaacactttaaaagatatttctgggttaaacaaattaaaaaatttacgtaaagtatacatggtcaataataaacttcaactgcataatcaaatcatgaaagggttaagaggatcaagagataaattaaaagtattagatgtgagattaaatccatgtacacaaaccatttatccatttttatttacacctagtgaatcagatgattctatagatttagaaaatgccgatgatatagaagcttttttcaaacattatcaagaattagataaatcacaaatttggaccatgagagatgaagaatttcttgaaaatttgaaatatcaagatgaaaaagaaactattgaaactcgtgatattttcgattgttttatggtgattttttttaataaattgatgaaattagatgggattttaattaatgatgatcgtagaaatcatttatttaatatttttaaagaacttcctcaaaaatag

SEQ ID NO: 4889 - DNA, 1512 bp, Candida albicans
ccaaattccttaaaagaggcgacaataacatcagtcaaatttcagcatttacacatgtgcatcgagtacaatgaccaattcaaggctaatttgcaaaaatttataaatttcttgaagaacaatcaaaaaatgatcgatgatattggggacctttcttatcatattcattttgaacctggtaaaaaatggaaagagtacaccaaatcggaagtgaaaaagtatactgagttcttgaaggtgcttcgtgacgccggagccagtaaagtggttcattgttcggtgataaacaagtacgacatggatacagtgtatatcacagagaaagaggacctaactaaacttggtaaggagattcaactggacattgacttttgggaaaatcttgaaatcctagactatggagaaagcagtattcgatttttgccaggggtgaaattaccagactctttgaagattttgaatatcggaggtgggtacgccttggagactttagccggattcaagatgccgccaaaacttgagcagttatctgctggacagggagcaatgccctcaattgatgatattgttttcccacctactttaaagagtttggagattcccgaaaacaagatatatttcctagactatgtgaagttccctccttcgttaaaggatctcgatgtttctcaaaaccgaattgaatccttaaaagatgttaacttcccgagtggcctagagacactcagtctctgtttcaatccaatcgagagcttaaaaggagtcaagtttcctgagtcgctacagttattggacatctccaacattcccaatgaatctatggcaggtgtcaaatttccggagctgttagaagtgttgaacttacagtcgtccatgacaactactagaggtttgaaactaccccagcatttgaagcatttgattttaagtggaaatgggatcaatagcataaatccactaaaattgccaaacactattgaaattttgtacttgaatcaaaaccacatcaaaactttgaacaaggtcgttttccctcccaaattgcgtgaactatatttgggggtcaatcttatcacgactttgaaaaatgtagcgttccctgctacaatcgaagttctagattttgaacaggatccgttcttttatgaaaacgacaagcacatcactacattaaaggatgtaattttgccgccaaatttgaaaacattgaaattatcgtaccacgggataaaaactattgaatcgttcgagtttcctgctagtttgcgataccttagtctagcttacaatgaacttcggttaattagaaatgtcaagtttggaaatcacttgaaaactttagatttgagtggcaatcaggatttgcagagtcttgacaatgtaattatccctgaatcagtcacagagttgagagttccgcctcaattggttgccaatttgccagcctatgttattgaaagagcgaatgaaaatagacttatcatcaagaaagatgatattgagtctgagtag

SEQ ID NO: 4890 - DNA, 2154 bp, Candida albicans
ccgtcccaacggtcaactttacaactactttcatattgccaatcacaaaatataccgatcacaataaccataagttattatttatcaacattatctgacttatgggactttatagagttattgaaaaatcaacagcaaacttcaagtctgatccgatataatttggaattagaaattattcctgggtttctatataattttagcttgaattatgttttcgatcaaatttccgattcaatcggtccattagtcgaaacaattatggtttacaattatagtggatcatttattttcaaaaatgaaaatttcccatatcttaaaaatttatggtttgaagatagtaatattaaattcaattctaatttaccatcaacaataaaattattacatttataccctaatagatttggatggaataataatgaaccaattatcataaaacatcaattaccatatcaacttgaggagttgaatgttggcaattgtacaattaagaatcaagccacgattacccatcttgacaatttatcatcgataacactttatatggtgaaagattcaagtgccaatggtggtggccaatttataaaacagcttgtgactaataatttggttaatgacaaattaaactgtttaaaagttgattttatatgggattcacaaagaaatttacttgattttcaacagttactactacctagcaatgacaacgaaaatgacagagaatttattggtgaaaaattaatgaagaatttgcaaactttatcaattactaactatataccttttgatgtctctaattggaagaatttaaccaggttaaagattctgagaattaataatccgcaaatttttgaaacttgtggtagatttccagatagtttacaaagtttaaagttgactaataataatatcaaggatttagcagtaattgataaattgattggacctaataataataggttgaaatacttaagtttttccgataatcctattgattggaacttatatgtaccaaatttcactcgatttacaaaattgaaatatcttaagttattcaatactcaaattggtaagcatttccataaaataaattatccggattctgtcgaagtattatctttagaagtcaatcaaatatcgagtattcaaggaatcaaatttccagcacatttaaaaaatttaggaattggatcaaattggattaaaaaaatttatcgacccaatctaccacataccattgaaacgattcatttgactgaaaataaacttagtcaagttgatttgagttgtaacaatcaaggacaagaattattaattgaaattttatatttaaattttaatccattgtcaaacttcaaacaagtcaaactacctaatcatttaaaaattttgaatatggataattgtaaatttaaaagcatatcaaatataaaattttgttcatccttagttgaattgagttttaatggttgtgaattatctcaatttgaaaatgtatcatggactgaagaggaagaagaggaagaagataatgacaatagccattcatcatcaccgaatctaaagtatttaaatctatcacaaaatgacttgactcatttaaatgtacagttcccatcaacccttcaagtattgaatttatcaatgaataaattgaccagcttaaacaataccttaacatcaacacttcaaaatttagatcaattacaagtgttgaacttatccagtaatcaatttcaaaaatttcaaatacatttcaattccatcaatttaaaagtattagatttatcatttaattcactcaagtcaattaatttaactttcccgagaagtacaattaccaaccttcaaacgttgaatttatgtctgaacaaattaacatttctaaatgatgttatgattggtcataataagaatttgactcgacatgaaaatcttattgaaattgatttgactaataataaaatcaaatcagtaagtgaaatcaacgataatggggggattagtcatttccctcagtctttaaaatgttttttcattgggcatactggtcaacaagatagatttggttatgatatggcaaaaaatattgtaattgacaaggatggtaacgatgggttatgtaaagccaaaagaatagatattccataa

SEQ ID NO: 4891 - DNA, 1431 bp, Candida albicans
  unsure (1034): Identity of nucleotide sequences at the above locations are unknown.
agtgttgaagaagtaatgttccaattgattgacgatgatgcactatgtagacaaagttttaattccacatcctcatcattatcctcatcatcatttagttctgctggtattagccgtgctaatactatcacagcaaattctactatccctgaaaatgcatcattttatagtaatcataataaatttagacctaaaaaaacttacaccaccaataatggattagaaagaataaattctcgtcatagtaccgggaaaaataaagctacctcatcttcttcatcgacttcacgagacacacgatggtcattattgaaacaattgacaatttcagagacttcaatatcgagtgttaatcgacaatcatttaaaaatttaaccaatttagtgaaattgaatttatcaagtaatttacttgaatcagttcctgaaggtttagaacaattgacaaatcttcgatatttgaatttagcagataataaaataaccaatttaaaaggtgtggaaaatataatttcattaataaaacttgatataaggaaaaatcccattaagaatttacaaccattaattaaacttgcaacaaagactcaatatcaagtatatatatcttcagcatcgacttcatcatcatcatcatcatcatcatctattcctatagattctatgagattattagaattggaaattggattacgtcaaaaagttaaaaaacatcaatcattatcacaaaatgtcatatctactagttcactggaaatgaaactactgtcaattaccacctctaaaccaaatcatgaagccaataacaatacgaccacaaccacaaccacaaccacgaattttgatcctaatcctaatcataatcataacaattccatagataaatcaatcactacaaaacctacaacgacaacaacaaatactaagaatcaaaactcaaccaccaatataaatcatagtccttctttgaaactgatactgatactgacagataacaatatttcttctgataaaggaattgtttccaaacccantactacaacatccagtacgaccacacccagtacgaccagtacgacaacccccactatggcaaaaagtcctagattttcactgcaattcatgcatcatttaaatgattcaaatagttcaattccttcaaataattcaattaaacgatcaactacttcttcaacattaattgatcatgaacataataacaatcatagtgatggtactagtaacagtaacagtaacagtaacaataacggtagcagtaacagtaacagtaatggtaacagtaatggtaacagtaatggtaacagtaatggcaacagtaatggcaacagtaataataataataataataataatggtgctgctccgaatattgttactacagttcaagttactgttcatatgagttcataa

SEQ ID NO: 4892 - DNA, 657 bp, Candida albicans
actcattgctatttactgacattgttttattttaaatttccaaattcattggttgaattggctttaagtgggaatgcaattcaagatttgacctcatataacgatgtcaataagaattggacagatttggttaatttgcaggatctagatttgtattcaaatcgaattgatactcttcaacaatgggttcctccaaatagtttgaggaatcttaatttgggattcaatttaatagatgaacttcccaatagttggccattattcaatgatatgtttaataagcaattacaacttgttgatttacgattaaatgtttgttccattgaaaaaatagctgaagagttaaatctccctccacaaatgaaagtactagatctttcaaacaattcactaactggccccttttatctactgagaagtcttaaacatttatacgtgttaaatttagctgaaaattcaattgatgatatcaagatcattcatgaggatgacgatccttgcagattatatcttttgaatcttagttataatcgtatatgtacaaaaacccgaaataaagaagcaatagaggcattctatgaaaaattagagttgggattaaacatcaaaattaggaataaaaaatttaaagtgaatagcttacaccagcttcaatga

SEQ ID NO: 4893 - DNA, 918 bp, Candida albicans
attgaagctgatcaggacttaaccactgggtatgatcttgacactgattacattgacttagtgcacttgaagatttcatcacttgaggatttacacttggaacgtttcaagaaattggaatctttgtgtttgagacaaaatttgattacttcgatggttggagtcaaagatttgcctgacactttggaagaactcgatttgtacgataatagaataaaccacatatcaagttccattaaacatttggttcatttgacaaatctagatctttcattcaacagaatcaaaaacatcaaaaatattgagacattagttgaacttgaaaacttgtattttgttcaaaacaagattagggaaatcaagaatcttgacacgttgactaaagtgactaatttagaattaggtgggaataagatagaagtgattgagaatcttgataaacttgtaaatataaagcaattgtggttagggaaaaatagaatatacaagctccagaatatggataatttggtgaatttaagagttctttcaatacaatccaatagaatcactaaaattgaggggcttgaaaacttgaaaaacttagaagaattatatttgtcccacaatgggatttcggagattgagaatctcgaaaataacataaacttacaagtgttggatgtcacggcaaataaaatcagtaacttgaaaggattgtcgcatttagtcaaattgacggacttttggtgttcatataatcaagtatccagtttcgaagaaattggtaaggagttgggtaaattgcctgatttggagtgtgtttattttgaaggcaacccggtgcaactccaaaatccaagtgcatatagacgaaaaatgaagttatatttaggtccatcgttaaacaaaattgacgcaacttatgtccactcctga

SEQ ID NO: 4894 - DNA, 2145 bp, Candida albicans
attatccccatggtaattgcaagaccagacgttaacctttttcatgaagtagcaaaacttccttctgaagttgttgctataattcttggttatttaccaaactgtatgttaccagagttattatatttctcacctattaaaaagatcgtagcttcgacaattctatcaaatgtacatataaccgaaattttcgagaaacacgaaggtagtgatgtgccaggtgttggatactccgaatgcgactgcaatatgttcagaatcacacttgaaaatttgaagaaaggcattgacaagtggaacatatatccaaaaaccatcaagacggaattcacagatctgtttgaaattggttgggatgtgttctctaaacttttaacaaaggcactgagtatttatggcttttttgtggggacttcgaactatcctcctgaagaattgtttgaactcttgatggattccaatgttaagtttgaatccctacatttgatgtattttctcactccaatcacattaccccccgtcgctacaagtgttacattacatcaaattaaattggatacttatgtaattcccggtgtaaaacaattgattttgcattctaaatctattaatcaagaaagaactaactttaccttttcccctgacttggaggatttgagaattgaagctggcctgaagatgtatgtgaatttacctccaaatttacaggaactatatatttcatctacaaaaacggtaaatttcagatctgaagaaatgctcaaattaaagcatttagagcttcagttaccaactattcaatcatttgaggaaactgggattagagctccaaatttggaaaagttggttttgagtacttgtgaagagttggattgttttgataatttgaaacagtttcagcatttgaaacatttggttttgaacaattgtacatacccgactaatttgcttaagcaaaaatcctttcctatgctagaaagtttccaatacagtggaacgtattttccgaactcagataagatggacatagtaacattaacttctccttcaactttaaaaatgttgatcgttgccaatcatgggtttctgcatgtttttcttgacactttactgcttccagctacattgacatatttgaaacttgtcaatgtagtctataatgatgatgatggatattttcatttgggtgagaatttgcaatatgttcacattgagtcatttaagcttgcatttgatagaaacttcagaatcccacataaggttgaattctttttggttgaggcttttgatttatactttgacagtctggattttatgtatcatttgccaaatagtcttatatatctaaccttgcttgcccacgagggaggagagatgcaccttaccaatcaaagaattaaatggccctcaatggtagacagtattgttctagatgggtttaatattgattatcgtacattaatatcattgaacttcaacgaatctagacttgaaacgattagaatttgtggaggtaatattaagaaattagatgttgatcttttcccggtcagtgttaaagatcttgctttaatggacatgggaattcaagaattgcctgcttcatttgagaagttagagaacttacacagattgtgtttagcaaaaaatcgattaaaaaaagtgaattctgttaagttaccgatatcgtcattgcgggtcttagttctacgtaaatgtgatcttcgtttgatatcaccatttttagtttcaatggtcgaggaggagaatagggatgcaaagctaaaggtagaagctacaggaaattcgaacattaatgttattgatgtgaggaaactgttgaaagcaataaaagggctctcgttagatataaactgtgttgatgaagccttgaatagaatctctgacaactctactcgtttcagctgctcatctaggttgcctgatccgtattctgaagaatccggattctctgaaacagaagaagtggtggtctctgactatgattcagatggcctttacaatggaagcgtgtttagtccggatgaggacgatagtgatgacgatgatgatgatgacgacgacgatgatgacgatgataatgatgacgatgatgaagatcataaaagacgaagaatctgttga

SEQ ID NO: 4895 - DNA, 540 bp, Candida albicans
catcctatagcacaacaactagagccgtttctcaaacgatttcttgcatcgttagatttactgtacacacagccaacatcacaaccattccccaacgttgaatcgtatgccactcagttaggatcaaacttaaagcggtcaagtgcaattatagtgaacggccagcctattataccgagcccacaagaagactgtaaattacaattccaaaagaaatggttacaaactccgttatcgtcacaccaattgacaagttacgatgggcatttaattccaggcacggggacctttgtcgttcatttttcagcaaaagtaagatttgatcaaagtggaaggaaccggttaggtgaatctgccgacttgtttcaggaaaataattcaattgtttccaaaaccaatcaaagacctatttggggttcgtggtttggagtcgacgtcaatttggttgttgacgaaaacgttatgcaagatggagagattataaatagtatggattatagatttacctatgtacctaacgatagcattataaaagtataa

SEQ ID NO: 4896 - DNA, 1083 bp, Candida albicans
agaaaatctgtcaagccattcaaatatgaaaggagtggtctaagtaagtttaaattcggtgcacatgttggaatgtccggtggaatttcaaacgcggtactcaacgccatggacattggtgccaacagctttgcattgtttctaaaatcaccacgaaaatgggtttctccagatattaaagaggaggagatcaagaaatttcatgaactatgtgaaaaatatggttataattcgagaacagacattttgccacatggctcttactttattaatttaggtaaccctgaccctgaaaaggaagaaaaagcttatggatcatttctagatgatttgaaaagatgtgaaaaattaaacattggaatgtataatttccatcctggttccagtttggatggggatcataaagaatcgttggcacgcttggctaagaatataaataaagcaattgaggaaactgaatttgttaaaattgtcattgaaaacatggcaggtcatgggaacttgattggctctaatttgcaagacatcaaagatgtgattgatatggttgaagagaaatctagagttggtgtgtgtttggatacatgtcactcgtttgctgccggttacgatatctcggataaggagaaatttgaagattttttaaaacaatttgacgagataataggagctgagtacctaagtgctattcatttaaatgattcaaaagcgccactcggtgcaaatcgagacttgcatcaaaaattgggatatggcttcttgggattagaggttttccgagtgattgccaatagtgatagattaaaaaacattccaattattttagaaactccagtgggaaatgatgactcggtttatggagaagagatcaaattattagagtggttagagggtagacctattgacaaccctgaatttatcgccaaaaaggatgaactttcaaaactagggagcaaagaacgtgcagaacatttaaagaaatttgaagcaaagaatgctaaagctgaaaagaaatcggctaaaagaaagaatggtgaagatattatgagtgctcttactaagaaagccaaaaaaaaggaataa

SEQ ID NO: 4897 - DNA, 1104 bp, Candida albicans
  unsure (19): Identity of nucleotide sequences at the above locations are unknown.
aggactaacgcacgtccanatcgaacatcggttccaaactttaaaactcacaaatataacaaatcattaccagccatcccagtgcatagaagcaccactaatggaccaaataaaagccaagtacctaaatctcaaagagaaactaatttgaatatgttgacccatgctagtgatcctgacaaagctccaaaaatccacaagagaagttttagtgatgagtcgcacgtatcatctgttagttcttttagttcggttggtgattttatgcatatagccagattgcaagcaatgtcaccaccagctgaaaagcttcgtttcattaattttaatcatgggaataatcaaaatcaattgaaaatacaacccaaaagcaataatgttaaaccaaatgattcaactgaaaagcttgaaaatcccaaaaaatcagaaacccaagattccagaatgttgtttattccacctcaaaacattcgaaatgtttcttcttcaagtacttcctcattccaatctctggggactagcagtagttgggattccttgcaaaagtccattgacattacttttgggtctagacctgacgaagaaattgtcactaagaaaagtataaaaccaacaacaaaagtgacgaaaatacttggaggcaataaccagagtgatgatggttcttggctggacactagtgaatcagacagtgaagatgaaaacaatagcaataaccaaatcactcaagaatatgaaaacacgaaacctttgaacattcacaaagaagaagtcagtaatgacaagacagtattaaatctcatgaatgtcaataatacagaaattaacagaaacttctattttccaaatacatttgaaaactcaaccaatagccaagaagtcaaagatagagtaccccaggagaataatagaaaagctagacatagtttctactccagtaatggtcaaatagaaattcctgatttgtcagataagaggttctcagatgaatattcttctattgccccatcatcgtataatggaactaccttctcggaaataaggacagaaatttctgtatcagatgttgatgatgaaagcaacactaatttgaaaattggtgtt

SEQ ID NO: 4898 - DNA, 1575 bp, Candida albicans
  unsure (1574): Identity of nucleotide sequences at the above locations are unknown.
aagataattccatcgaaacaacaagacaaagtttttcctaaattgccaacaacagacatcattccacctaaacaagaaactgccacatcggataaaaaactaacaccagttccagatcgaacatcggttccaatttttaaaactcacaaatataacaaatcattaccagccatcccagtgcatagaagtaccactaatggaccaaataaaagccaagtacctaaatctcaaagagaaactaatttgaatatgttgacccatgctagtgatcctgacaaagctccaaaaatccataagagaagttttagtgatgagtcgcacgtatcatctgttagttcttttagttcggttggtgattttatgcatatagccagattgcaagcaatgtcaccaccagctgaaaagcttcgtttcattaattttaatcatgggaataatcaaaatcatttgaaaatacaacccaaaagcaatgatgttaaaccaaatgattcaactgaaaagcttgaaaatcccaaaaaatcagaaacccaagattccaggatgttgtttattccacctcaaaacattcgaaatgtttcttcttcaagtacttcctcattccaatctctgggaactagcagtagttgggattccttgcaaaagtccattgacattactcttgggtctagacctgacgaagaaattgtcactaagaaaagtataaaaccaacaacaaaagtaacgaaaatacttggaggcaataaccagagtgatgatggttcttggctggacactagtgaatcagacagtgaagatgaaaacaatagcaataaccaaatcactcaagaatacgaaaacacgaaacctttgaacattcacaaagaagaagtcagtaatgacaagacagtattaaatctcatgaatgtcaataatacagaaattaacagaaacttctattttccaaatacatttgaaaactcaaccaatagccaagaagtcaaagatagggtaccccaggagaataatagaaaagctagacatagtttctattccagtaatggtcaaatagaaattcctgatttatcagataagaggttctcagatgaatattcttctattgctccatcatcgtataatggaactaccttctcggaaataaggacagaaatttctgtatcagatgttgatgatgaaagcaacactaatttgaaaattggtgttcctggtagagatgcaattaaacatttaaaacaacaatatagtgctcttggagatgattctgatgcagattatgctagcaatattacatcattatacaatactggtgccaattcagacaaaatgcaaatgaaaccagcatccgttcaacctcaattggaatgcaatttgttagtaccgggaagacgttcaccggcaaaacacgcaagacacaaatcaatgttcaacattgattttgatttaggtaaaggcaaaaacaattcaaaccattcaagaaccaaatcagttgatatattgagtgagatgacgactttcggtaaacaacaatctagagctaatacagatagtcgatctgccggtggtgatttggatgaatna

SEQ ID NO: 4899 - DNA, 1566 bp, Candida albicans
actatgtatttatccaaccttggtggacaatctagaaagacgggtatcagacctaaaacaaatttgaaaaccgataaatatggtatggaagacgtggatgactttttcgaagatgacgatgatgataggataaacaagctgaaaggacagaaactgacaatagcattaccgcgaggagaagaagtgtccaactataaatcaaccattagtcaaccatttaataatatcgcacgtaaaatcaatttcaatcaagaagatgacgaaacatttaatttaccatcaacttcatcttcatcagctacggtaaccgcgtcatcagtttcgaataagaaatccccagtgacaactcaacaatcaccgttgcgttctccattaccggagcaagactatgattacaatcagtttgatgtggaggaagattatggtaatataactgaagaagataaacagccatccccacctccaccagtgccaaagacaaagtcaaaagcaaaaacgaaagctaaggcttccactacaaacaataccaataccaaatctactaaagctgcttcttcatttactaaaaaaatggcattaggtaaaaccaaaagactaccgtcgagttttgattcagtaaacacaagtagtgtcaccgaatactatgatgaagacgatgaagataatgatagggattatggtgaatcacaacaggattcaattgaagattcaatggttgattcaactttcaatgattattcacaaccatcaagtaataacaacaagacccgaagaaaaatcattaaagaatcaccattaccatcaccaccaccagataatcctaatggattaaggagatctaaacgtacaagaatcaaaccattagcattttggagaaatgaacgaatcatctattctaaggatttagattatgatgatgaacaagataccacgctagctagagatatacataatatcccattacaactgattaaagaagtggtacacataccagataatgaatctgttgataattcaggatcaccaaatactagaacgggagcagctgggtctactaaaacaagactgaatcgaaaacgaacctataaacaaaccaccactactgcccccactgattatgattatgaatcagatccagaaatatctggttcagaatggtttaaagaagataatctactgttggaagttaacgataatggggaatccaaattacgtaaaattgcctataatcataaaggtgggaattatgtgaaacccactgatgataattatttagtggcatcattatttgatgaagataaaagtttttttgctggtgggatgttacaattaccttcggatggatttaaaccaccagttacagtgacgggtagtacatatatgtttaatgtgatgaaaggattgattcaagtgacgttgaatgaaaatatgtttgttgttactaaaggttgtaaagtacaaatccctgaaggtaatgaatattccttaagaaatattggccaaggtgatgcttatttgtttttcgttcaaatcagaaaaccagaagaaatcgataccaattggtaa

SEQ ID NO: 4900 - DNA, 309 bp, Candida albicans
aggcagttcacgggattcggaattagccagatgatgcccaccttacagtttttttcagaaaatgaaatgtatgatgaggcatctaaatatggtgaggttgtaaatgtcagaattcctagaccatcacgtaatcatacgcctggaattttacagttcaacacttccacaggtttaggcactatatacatcgaatttaaagatgaaaagatcgcattggcggccatgatggagttggcaggtaaactgtacaacgatagaacggtgttggctactttctatgattttgatgattttttgatgggaatatag

SEQ ID NO: 4901 - DNA, 387 bp, Candida albicans
agcgtggagccgtccagtgtcgtggtgaagaacgtcgatgatgcagacgacgacgatgacggtacagtgacaatcccaatcccagaagatttaaatgttacaaaagttaaagttcgtaataatcgatcaaaatcaaatgataaatcagaccctaagaagaaacataaatgtccaatatgtgaatcaaggtttcaaagaccagaacatgttaaacgtcatcttaaaagtcattcctcagaaaaaccatttgaatgtcaaatgccaaattgtggtaaaagatttaatcgtaaagataatttaaaagctcatttaaaaaagattcatggacttgtgaaaggacaagaagagtttacaagagtgttgaatgaaaacaaagaagtttcctaa

SEQ ID NO: 4902 - DNA, 2283 bp, Candida albicans
gcaaatatgtctcaagaattccaacctttatttgaaacaacaccttatttcaattcacagatgttaagtaatatccccatgactaatgggaataccgctggcaatggtaatggaaacaccgccacaacaccttcaacgggtaacaataatccacctaatgttaatgagacaattaatttactttcattcccagagacaagtcatttaagtgatgaaatatttttcaataattatcaattcaataatcagttagggtcagattctaccaacaacaatgctttcttgtcgcaacaacagcaagaacaacaacaatttttatataatcaacagtcgcaattacaaccaccaccaccaccacaacaacgacaagaccagagaattaatcaaataagtagtgctacttctgcacattcatttgataatgaattagctagtaatatatcttctaattcattaaacacgtatttttcaaatccacatgcttcgtcatcaacatcatcatcgtcgtcctcgtcatcttcatcactgtcgttttctgccggttccacaaataacatcaacaacaatattggcaacaacaacaataatcaagcgacatcaaaagtacccactacgccacaacaatttatccatcatggcaggcaaaattcaactacaattccaattgatcaattgacattattatctttgagaactccaggtaccacaaaaccggttaataatcaattaattccacaaaatcaatttaacaatttacaacagccaaattttgatagttattcaccaacatcacaaccaccatcacaacaacaacaacagcagcaaaatcaactaagtcaaggtttccaaccggtatcatcgtcaaatcctgctttagtaaataatattagtgttgatgcaaatactattgctgctgctgtagctgctgcaactgctgccactgaagatattactgttggtccagtacttgaagaaggtacaataaatcctcgtcaacttttcaataataaattaggtacttcaatgagttccccaagtttatctacgctatttgttaataaccgtgctcaacaacaacaaccacaaccacaacaacagcaactaccaccacaacaagaacaaaacattcaatctttaccaacatcggcaataccaccagatcaacaatctatacaacaattggcaatgcaacaacaacaacagcaagtgcccgtaaatcataaacgaagcagttctactccacattttgatttcaaaataaatgatgactttacgaattctatatcatcttggttcaataatcaaaatggtttagatccaaatcaacaaattgatgaggaaaataataaattatttgttaatccaaatggaatacttaaaaatcatactcacattaaaacgagaaatcattcttattctagtggggtaatgcattcaagtcgtggtactagcagaagaaattctgttcaattgttaagtaatggtaatattattggtagtaatggtggtaatgttaatggtggtggggttattcttactactgccactgctactactactaatggattaactacaaattcattacatggatcaccaatcactttaacaacagctcattttgaaaacattaatgaagaaaatgatagtattaatgattcaagtattgatattaccagcaatcccactggtataacaaccaaaccaatcactactagtgttgacgaagatggagatgctaaacatagcagaaagagaagaaaaagttcatcagcaattaatatgggtgaaaccattggcccgttatccgattctccttcaatctcaccaactaatagtaataccaataatgacacaataatggcaactagtactgttgctactaaaaatatcactaaagaagaattaatgaaaaagaaatctcattcaaaatctgcatccaccaacaatactaccacagccacaaaaaatgaacgcaagaaactgaccaccgcccataatatatctcctaatggtaatggtaatggtaattctcaagcatcattcccatgtaatgaatgtgataaacaatttaaacgttcagaacatttaaaaagacatcaaagatctgttcattcaaatgatcgaccatttgcttgtaaatattgtgaaaagaaatttagtcgatccgataatttagctcaacatttgaaaactcatattaaaactgatgctaatggtaatgctatgattgtatatgggaatcctagtaatcacggaagaaaagaaaagaaaaaatcggtttaa

SEQ ID NO: 4903 - DNA, 492 bp, Candida albicans
ttctcctatcccccccccctcgttaccctttatttgaatttctccaaaacaattatatccctgttttttcttaatatagtatcatccttttcactcatcatgtcagcaccagcatattatgaattatatagaagatcaaccattggagtaacattaatggatgcattagatacattaatatctgatgaaaaaattcaacctcaattagctaatagaatattaattaattttgatagaataattgctgaaaatttgaaaaatgaaaatatcgtggggaaatcaaaattaatatttaaaggtgatttagatacttatcgattttgtgatgatgtttggacatttataattaaaaatgtcattattaaattaaatgatgtatcctcaaaagatagtggtggtggtgataaagataaagatagtggtgatttggaattgaatgttgataaatttaaaattgttgcttgtaattctagaaaggctggtgagatgtaa

SEQ ID NO: 4904 - DNA, 2121 bp, Candida albicans
agacaacttcacccttttttttttttttttcctactcttatgacaacaacaacaatagccaatcaaataccatcaattaataccatgctaagtaatgtcaataacaacaacaccccatcagcaaatagttcacaatcaactttaataaatcaagaacaacaacaggcacaacaacaggcacaacaacaagcacaacaactgcagcatcatcggcagcatcaatcaaggagtggtggaactacaaccaacaacaactattcatcttcatctgatccacctcgtaaaagatccaaagtatctcgtgcttgtgatccatgtcgaaagaaaaagattaaatgtaatgctgaatattcagaattggaaaaaaaagtgaccaaaatatgtactagttgtgccaaaaataaagaaatttgtacatttgatagaactcctttaaaacgaggtccttcaaaaggttatattcgagatttagaagaaaaagctggtgatagaatatcctcgttatcttctaaatcaaatcaagcatcaaccaaagctaatataccatttccaccttctcaccaatatccaccaccaccacaacaacaacaaaaacaacaatcaccttcaattgcaattataccgccaaacccttatcctccttcaaatattcaacaattacctttcccacaaaattcaactactcatcgagtaacagggtcaatatcaaatacccctaataataataataataacaataacattaacaacggaaactcgcctacaattaagttaccaccaatagtgaattacccttcgaaaagtttaccttcacccctgttatcaaaatttaattcatcaatatcatcatcacaaacatctaatccatcgagtcctaaatctcaattgtctaatatacccgggttattaaacaatgatagcaataccaataataatgttggcggtggcggtggcggtggtggttcagaacaaactaatagtccaccaattcaaggtccattttggaaagtaccttatgaaatgcctcaatcttcattatcaagacgttcatctattggtagtataaccagtactaatggtggtcaaccaaatattttgagacgaccatcagttgaatctatatcatcagtttcaactaatggatcaagattaccttccattagaccatcaatatcaaatgattataccagtgatgctgaatcagaagatttttattccgtacaatcatttcgacctcgaagtttatcaagaaattcacaatctttatcaccaagaaattcaattagttcaatgtctagtttgaatggtagaatcaatagatcgttagctttcaattcttcaagtgttacatcaccaataatgataggatcaccatcacaacaagcacaggtgcagcagcaacaactgcaactgcaactacaactacaacaaccaccaccacctccaccatcttcaaatatgacaaattttatgcctccacaagttccaatttttgctccgtttgcaacaacaaatcatattccattaaatccattagatttaaatttaaaattatattatgaaagatttcatacgattttccctattttaccatatgattcaagaataatttataatattttaaatgataaatctcaaccaccttgggattggttaattgaagtatttaatcatagtcttaataatttaattaattttcaacaagttgaattacaatcatcaattggaatatttataagattaattcaatcatatccatttcccaatgaaactaccaccactacaattactgataattcattgattttattttttagtagtttgataatattaagttatacaaatttaattaatggtgatcaatataacgcggggattagtttcacatcatcagtatttaatgattataaaatttgtgaaagatttattgatcaaataactaataataaaaaagataatgatattaatgttgatgttaatgttgatgttgataatattgtaaattatttcacaaaattatattattgtttgaatttaattgataatttgaatagtttaactttgggacctaataaaaatttacatctgcaaagaattattaaatttttaaatcatcattaa

SEQ ID NO: 4905 - DNA, 1230 bp, Candida albicans
atactaagagatatcggtctttttaactccaccatagtcatcttcatggacgattcagtcagatcacttattcggtttgttagcagaggattttacagtactccttatgtattaattcttgatgctgtccttcgtcactctgtattatcagaagatgatttgattcatttgttgggaatcaaaagaaaagagatacgttcactttgtaatcgattagttgatgacaggttattaaccaatcatattcaacgagaggataatggccaacagaaatatgtgactcgtacctactttttcattcatataactgaagctattgattcgatcaagtggaaagttcactcgattgtcaatgtattaaaacaggaaatgtcaagctttggtaatccacaggggtatgtatgtcctagatgtggcaataaagtaagtcagttggatgcaatatctatgttgagcgaagataaaactgaattcatatgtgatgtgtgtcaaggtgttttaattgaagacgattcttcacagcaagcaactttaaaacaagaacgacttgaaaaattgatgaaacaacttgatccaatcattaaatttttgaaaattatagatgaaactcaaatacgagacaacgatttcgaatcagctttattacaagctatcccagcacaatcagccaccacagcatcatacacattatccaatcgtgtcagttccaagtcaagatcgaatgctcaagcaatgcaaaatgccgcagccagatcacaagccactttacatgtctctatcaccgcaaatgatgaaaactatgaacgagaacaaatggaaaaggaaaacagaagacagaaattggaacagaatgcattgccttcatggcactcaaacagtactgttggccaatccaatacttttggtaaacttgaagacgaggaagacgatcacatgggtactccatcatctatcaaagaggaaggagagcaaggagaagcaaataccgactctaaagaaatatatggaagtgacagcaaagaaggaactactgagcaatcctcagttatggctacacctgaacctcagagtactgtcaacaataattccaactttaataatgtatccgcagaattgaaagagagagaggcacaagatgcattagctgcatattatgctcaattggcagaacaggacgctgatgaagatgacgacgatgacgacgatgaagagtttgatgatataatttaa

SEQ ID NO: 4906 - DNA, 1401 bp, Candida albicans
  unsure (86): Identity of nucleotide sequences at the above locations are unknown.
ttcctaccaactaggatggaattgataaaattactttccacgacaatatttagatatttaaacccccaggaattctttgtgagtgnaaaaatcctctcagaagaatatgaattatatgacatttgtgatttaatgttgagtcgagctgcttatttatatattctatgtaattttgatgaatgtttgaatttatgtgtacgaattcttaataaagatgaatataattttgatgttttaccacattatttaagttgtctttatgaattgggtgggaaaaataaattatttttaaaagctcatcaattagctgaattacatccaattaatcctatgacttggttagctattggaacttattatttatcaattaataaaatggtggaagcaagaaaatttttcagtaaagcaactttattaaatccaaattttggtaatggatggattgggtttgctcatacatttgctgctgaaggtgaacatgaacaagcaattagtgcctatgcctttgccgcaagattatttcctggaactcatttacctaatttatttttaggaatgcaacatttacaaatgaataatttaaatttactggaagaatatttattagcatcatatcatatttgtaatagtgatccgttattattaaatgaattgggagtaattaattttcataaaaatcaatttgataaagcagaattttttttacaagaagctttaaatgctgctaaaaatttgaattctgattctaaaacttggatttcaattcatgctaatttaggtcatgtatatcgtcgagcaaatcaaccttataaggcattagattgttttaatcaagttttaaaaattagtaacaaaaatgatgctaatatattatcagccattggattaattcatttaagattacaaaatattttccaggctatagaatttttacatgatgcattggcaatttctccattagatcctattgcaagtgatttattgaaaagagcattagaagctaataaagaaaatcaagaaattttctccactaccgaaaaattatttcaattgaatttacctatagaaagaaggaaatatgaaagtagtagactagctaaacaacaacgacagtcaagatgcagtattagtggtggtggtggtggttgtggtggtgaagaaaatactaagaatattgttacaccattaacaacaaaaatacgggatagacatattaatgttggtaatagtagtatagatccagtattatttgttgatgacccaacaggtagaaatgaagatatacaagatgatggtgaacccgaaggtgaaggtgatgatgtaactttattagctcaagaattacaaaatggtgaagcttcaagtgatgatgaagatgtaatggatatagaaagtgattaa

SEQ ID NO: 4907 - DNA, 1443 bp, Candida albicans
  unsure (82): Identity of nucleotide sequences at the above locations are unknown.
atcatgacagatccattaacattcttggatgagtttaatgaattcttttatttcccagaagataatgatacttttgcaccanatgaaattgggaaattgaaatttggatcaaagataaatgcaacaccaaaatctattgaagtgcctagttcttatttggatttttcacctgaaacaatgaataatttaccatatagattgagtatatctggtttaccatctttttctagagtagaaactcaaattaaaatgaatttaacaataaatgctcctttcactaatcattatgttcatataacccctgatcttatatcaaaaaagaaattatgtttagaagaaccatattcaaatcttgatgataatattaaaaaacatattttggaatttgacgcttatattcttactcaaagtaataagtcttgtgctgtttgtccaagatgtattaaacgagaacagaaaagagcatcacgtagtaaagctggtgaagagaaatctgccgtttgggattgtgatgttgaaaggaaagcaatcattataaataataaagaaatcattgctttccaatcgggtgttttggaattatctgcaagaatcatatgttattgccgacaccataaagaactggaaggattcaaacttttaatagtacttaaaaaccatttagggcaagttgttgctaaacaaatatcttcccctattatgattatggacagaaagaaaaatttgaaggattcggcacctagttcatcggcaaatttggttgaattggataagaagaaattgtctatttctgattctgataatgaaaaattaatgaccaaccagtttgttcaactatcaccaaattcattggatgaatcggcatctgaagctttagccactactgattatgaaactagaggagtgaaacgtaagaagttgtctgttgatgattctttcaacaccacatctaacccaatgtacaatgggtttagtggttattctccaatgagtaatagtgatacaaatacatcggctataagtcaaagtttctcgggtccaacaatatcaaagccatctctggctcaattttctattggattttcaccgattagtcaaccacaatttccatcacaattccaatcacaaacacaattgctacaacaacaacaacaacaacaacaacaacaacaacaacagcagcagcaacagcaacaacagcaaactgtaccatcaattcaaaaaattataccagctcaaggtctgattcgaggtggcattgaagtcacaattttgggtttcaattttcgtcctggtttgctgatcaagtttggtgcaaatcaagcattggctactcattgttggtcagaaactactattgttacgtatttaccacctgcagcacaaccaggtcaagtcttggtcacgtttgaaaatcaagataatgataatgtaggaggacca

SEQ ID NO: 4908 - DNA, 1089 bp, Candida albicans
aagcgatttctaatgaacttgtactctggtaaggcagttgaaaacaaacgaatattacgacgcaatactctccaaacaaaaagtcccgatcaggatgaaaatactatcaaaaaagatactgatgatgagacgattctagaaaccatttggttttgcaaaatcttacttatatttgccattggggaaatgtacttggggacagaatccagcacacatgcccgaagacaaaaattggagaatatgaaacgtagcaaagaaaagcgggaaaaacatgcattacctggctcagcatttttctatcaagcttcagaattatttactggtctttttgcttcgggtgctattgataatatcaccaaagatggtggtatcgaagtcatgcttctatatgcattttatttgcaagtggctgattgtacaatagcatcgtatttttattttgggttagccttgagagcagcattgattttgggctggcatgttgatgcagacaaagagaatttgaatcgatttgaattggaacatagaagaaggatatggtggactgtgtacatgtatgaacgaatgctatcatcgaaagccggattacccttgagttttgctgacgattcagtatcaactgaattaccaattgatttcaaaattgatttgacagatttccctagagatgaacacgatgttagagggtattatattttcccaccagcagactatattaacaattgtgtcacgattacccaaataaatgcggttattttgtcatcgttgtataccaaacaaccgtctttcaacattttgccggtggttactgatttggttcaaaggttaatggcatggaaaacatctttacctaaatatcttgatgttgattattcagttgataatcctaaagtatcacgattagtgaccaacttaatgacagaatatttccaagggattaatttagcggtgcgtccattattatttcattttgcaactaagaaattgaaagaattgcaaatgcaaaatactcaaaataagtatattgatttgacaaaatattcaaagatcttcactacgaggaggcagcaccgcgatattatcccgggg

SEQ ID NO: 4909 - DNA, 1524 bp, Candida albicans
aaagcagttttagcatgtttaaattgtcggaaatcacatcgtatatgtattttacaaaccaatggaaattcatgtcaatcatgtatcaccaaatcaattgaatgtcaatggacatctcaagaatcgcaagttacaactaacacaagtgttaggaataaaaaatatgaaagatttagacaagaagaacaaatttattctactgttgttgcctctgaaaatcatcaacaagtaaatggtggttctagtggtggatctattggaggtggtagtgggagtggtaatgggaaatttcaatttatatgttcaactcatcctattgcgtcatttttaagtactgataaattcctatgttttgatggtgataaatttggattatttaatccttggagaagttcccccaatattgaaacagcaacttctaccacctctatagaagttgataatccaaatttaactgaatatttaaatcgtgaaggagcttttatattaccaccaatttctgaacaacgacaattgatggaaattttcattaataaaatatatccatttttccccgttattgaaatatctgataataaagattcattaaataaatttcctccattattattaaatgcaatttttttagtagcatcaagatgtttaccccagaatgataataaagataacaacaacaacaataaccaacctataagagaacgatgtcaagaattatttgaaaggtgtaaattattagaactttgtgaaaataataaaattgctttaattcaatcatttttattaatgtcaattcatgaagaaggtataaatggaagttcattatcaaaagaatatatcactagagcttgtaatttatgtggagatttaggtattactacgttaagtggttcaaatggtacggcggttcaagatactcaacatcgagtttataaaaaactttattatgataaatcaatattaataagattattttggatttcttatgcttgtgatatattaagtgcttctactcatgcaagagaagtatattataatatgaatgatgtatttattgatgatgtacctaaagaattccctgaattgatcaaatttgttgaattactgacattactttatcgtactttgggtagtcattatcgacctcataaaggacgaatcattgatgaaaaattatttaccgatatacaaaattggaattctttggttgatcatccatggttaaaattgttatattcatatatttgtatgataaatttacgttgtgaagtagatccaataacattagatccacaattgataaattcattacaaattcaatttgataatgttgccaatattgatccattttggtttaaattccatattgttggtgtacatagtttattacatgtaacttcattattaaatcttcttggtaataatgatgaaaatttggatactaataataagatcaaaacccggttggaagatttgaaagaaatatggtggcttgcagcttcaggtctcaaattatttggcaaatag

SEQ ID NO: 4910 - DNA, 627 bp, Candida albicans
tccgattcttgtacaatggattcacaagagccttcggaggaaaagaaaattgcaaatgcattaattaattcagatactattccacttgacttacaaccaccatcctcaccatcagtttcgtcgccgatgacgtccaccagaagcaatctagaaaccctgagtccattaaataccaatacatctttaaacccccgtcagaaaagggcgtctttggcttgtataagatgtcgaacacgtcatattcggtgtcctggaggtgacccctgtaggaaatgtcaattggcaaaatcgaaatgtgaatatgttgaagccgacaaaaaaattgttgtatcaatgaagtatctttccaaactacatgacgaaatagcaagattgaaaaaagataatgctggattaagaaataatttaaaagaacaagaattgaaacgggttgacgcacaacagggaagaccccaatttgcaaatacaacaccagccaaccgagtttctcccctatccatggcttcgaatgtaatggggtcccagaacttttctcaaccacattcccaaacacctcaaacaataccttcggtccttaacacaaacaccattagcaaatggagaagtgatccatccgtcgttggataa

SEQ ID NO: 4911 - DNA, 1914 bp, Candida albicans
  unsure (10): Identity of nucleotide sequences at the above locations are unknown.
tgtaagttgnccacccaaacaaaacacccaaccaatagatcaaataccaattctacgaacagcaatgtgaccacacagggtttatcaaacagcaatggaaataacctacgatttctttacgataaagatggaagactaagatacattggagaaagtagcccgctttcattgttttacgaagcaagaaaaattttccgatctatacgtggggtgtctgaatttacagatgatcctgatacagtaaatataattgatggaatatctcatgttaaacaaagtagagttttacaaatgccaaaaagagaacatgccttgttgttgttgaatctttttgaagcaaatatcaatcaaacgtggtatatctataatagagaatggcttagtgatcaatttatcaaagttattgatgatccattgaacatttcacccgaaagaatggctgctttccatttgattttttcattggggttattatttgctgaaaaatcaaaacacggcatagtagagaaaattggtgctcattcaagtcagtattttgaaagtggatttgatttgattagaaatatactcgatgatggtgggttatggatgactgaaaccagtttattaatgtatttttattatcagtcaacagcaagacgatcatcgtcttggatgatgttaggaaacgcaatcaggaatgcccaagcgttaggactacacagaagagctgtgaatgagtctttccctaatccacaatacatcatccatagacgaaaattatggaaaacattatacatttgtgataggatctcatcaataatgctaggtcggccattatctattagcgactacgattgggacgattttctcataccaagagataaagaaattattactaatgacttgaatggtgatatttctacaatatgtttagatgcgaatactcgactttcaaagattcttggacatattgtacaaaacttttaccaagatggcgttgttaatttgatgaaggcagagactatagccatagagttgaaaaagtggtcatttaaattgccaagtactattcaaatagacaagatattgaagacctcccagacccaaatctcttacgaaattgatagttccgtgagaccagctatgtcagacaactatccaatattattaattcatatcatgcaattatatggagtaatgttattagggaaaccaattttcatgtatttattgtttaaaaaagaccaaaacacggacaattctacagatagacagcagaaagtattaaagaatttttgttctgccagcattaaagcatcagtattaactatacaagctattcacatatatacaaaatgccatcctcagagaattgaactgtatattaccgtcaattgttgctgtcatgcagcaataatgttgggattaacaatcttgtatcgtcaaacaaactcagattacgaaaaggacgagtattctattgatgacttgatgcaacaattgaatattgccaaatccatattgaacttttatggatcaactaataccattagttatagattgcacacaatagtgttgcgattgatcaacacgttaactttacaagcacaaccacaagatgaaaatgatgagttgctttcattaccaataccaacaccatttcaagaaagagttgaaaaccagccattacccgaagtgtatcaaacacaatttgattctaaggaaccgacagatcaaggggaatctattttcaatactccgttggaaaacattataaattttcaacaattttttgttccttcggccactaattcagaagacaataatagtagcaggacttcgttaaaagagtctgaaagaagaatggataacgttccacaggttgaggagtttatgtatgatgtcggtatgaatgatttgctattacaatga

SEQ ID NO: 4912 - DNA, 696 bp, Candida albicans
  unsure (208): Identity of nucleotide sequences at the above locations are unknown.
ataatgttccaatggctcctaaggggtgttcatgaagcaaccagagatcatttggatcatgcattgattttgtttacgaaaatgaaaagattgggcaattatcgtgcagctcttagacgtgcacagttgttgaaattaatcaatgtgttggatttcaatggagtcatggcagagttattagaaaagcatgatgatgacaataataatnacaacaacaacactagcagcagaagcagtagcaacaacagcaagacattgccgggatcggcaattacaaatacctccgacaataacgtagagccatttttgaacccaccacctattagaccaggtgatttggactttttgcaatttacaaatgtgcaaggaaacgaaggaactgatggtatggatggtgtttctaatgctaatgttggagtggttggtattggcgatgtttatgccaatcaagatttgactggtattgaaggtcttacgtatctagatgctgaacaaaagttatggagtgatattacgaatgaggctggttggttaaatatgcattctgccgaaaaggataccaatataacggaaagagatccattggatgaaggctttatatttaatactgcatcgcctgatgttggcactagtgtccattcagggtattcaaacttgataaaccatgaatttcaagatttcatggatcaatcttag

SEQ ID NO: 4913 - DNA, 1128 bp, Candida albicans
cccacgagtggggtgaaaggcaatgcgtctaggagttatatgtatgttgggattgccgccagaatggctttgatactaggtttggacgacgaacccaaaccagaagctggtctttcagatacagaaaattttatccgcatggaaatgaaacgacgtgcaatgtggtcagtgtatatgatggaccgttgcaattctagtggacgcagcagtcacacgtgcatttcattagacgaaatcaaagtaaggctaccttgtaacgagaaggaattcatatttggagtcggtaaagaacagccattgagaagtggcgagttggtcgacttgtcattgtgtggatatcaaattgtgttgttcgagacatggagagaaatatctcggtgggtgggcatcaccggtgccaaactagaaaaaataccgccatgggaatctactgctccatactatacgctttccaagaagttagatgactttgaagagaagttgccagcagagctcaagtataatgaatttaatttgcaagcacacattgccggtggctcagcttctgatttcgcatactttagtgggttgctattgctatgcagggtatttctcaacagagaatacttttatgcatctccagaagcgtctccgccaggatggtggaaagaacaggctactatactatttgactcgttggacaagttggaccagataccgaaattgcttaaaccgttgaatttaatggtcattgctccgtttactggtttccatgttttcagtacggctgccacatgtttgtatattgccgcatatcccaaaaaagttatgaaaacacatttcaatggagatgttataaagaaataccagaaaatggctcatgataatttagaaacgttattttcgtggctggactcatggggtttagggaaaagctggatcaacaccttgaaagagatgaaagaagtgtttgccaggtctacagattacgatcagttgcggttcaagatgcgtgactacgggaatatagaaaagaaaccggatattctgaatttattggtattagatgaggctcctattctagactttatgaacaatttggatctaccaaatattttccctgactggaatgatgctatgaacatataa

SEQ ID NO: 4914 - DNA, 2490 bp, Candida albicans
aaaaaacatatcaacatctacaacaaaaatagaaaccaaccaatatattcagaaaatacctttttccttccaaatacgataaactactgtcagagactttacgcctcttatagaatacccaagtttataaaattctattcatctataatcctcactaagaaaatgctggaaaaaattaagagagaaaagcctgtaaaagtaagaaaacatgttagtagtgcttgtttggagtgcagaagacgacactttaaatgtgacggtaaacaaccagtgtgcgatcgatgtcaaaaatcaaacaaaccatgccaatatgttgcaagtcatcgaggcggatccaggaagaaaggtgtgtcaacaaaaaagaaacctgttaccgtaaatgatataaaccaaggtccagaaatgcccatgttcgtcgcagacatagaagactttggtaaatcgaaatcaactgaaaattctgccaatgacggaaacgaaataaagagtaatgatgagatgcttgagaaattaatgactttgccttgtgcacatgatcaaaatcgatgtcaggatctgaattgcccagggaaaagtgctgttaggtatatgaaatctcgaccagaaaaacgtggacaattaaatgagagtgagacacacatgatggaaactttaagaaaaagaataaagttagagagtacaatgagcaacattgattgtctctttagtgataataatccaccaatagatatcaggtcattcaaggaattggaaatgaccactgcagttcatgatccgagcaattatgtggatcttacagtactagacaaagacgtgatactaaagaattactacgagacatttcacaaagcccaccccattttgcccgcaagggaagaaatgttgatatacatgtcaaatctgtctattgaaaaagaactattacctatcctaagtatagtgagtgatggtgagacgacgtctgtttatgctcgagctattgatttggtctcagatagattgatccagtgtgtcgaagttgtgaaaagctttggatatattgatattgtttcactccaggttttgacacttgtttcctttgttgctcatgtttcttcattacacgcattaagcaaaaatttgaggcatttctgtatatatttacttcaagacctccaaatcaatttgttggatgctccttcaaagcacggctctaacgacatgaccccggagtcggaaactaatgctccccttaaggtattcaactcgcctaggttgtcacacgtgtcaagagatagtattgatcaatgtgctcgtagactattttgggaattaaattttgttgatattattaccgggtctgctgatgggaaaacagtttcttcctttgacaaaattgagagttttgttgattttcctactgtgccactgcgggatgaatttgactacaaagggcgctcggaggcaggtacattggttacatacgcaatgaagatgaatatagagattaccaataagagaccatatgatattcttctaacaagattgcaagcttctttatcaagttgggaaatgagactagaggacccgtcgttattcgaagcaccgccattgattgacaagagcggaagagtaaatgaaggagttcaccaagccatcttactatttaactacgcaaagatctttgttcacaggcccttttcttatctttggaagatcaattcaccgcaacatccaaaatgcaacggcgaggcagtagactcgacaaatgttccaccgcaacttcaagcaaattcgcgaacgactattgaaactaggaaaactattgaaggtgcaaactcgattgtccaggttcttatggacactggtgcgtccaaagtttttcaaagaacacatttttttgcttgtgctttggcattatcttcgttggttcatctaagtgcatatatttgggtcgagacgacgttagcagtggataaagctcaagcttttgggttgaatgaagaagatttggatgtttacactgagtatataaaactagctttgactgcaatttatcccatttccaagcattggcaattatctggcaagttggcaaaacatattcgtgactccttgaccacattacggccgaaactatactcaaaattaaaggattttttgccgcaattagaaattggtatggaaaaaatgaagattcgtgaaggtgactctactggtgaagattcaagtagaagtctggcactacccatgaatgcagtgagtagttctactacaaccacaaactacgacggtctacagagccaagataacaataattccaccttgctgaatcgtcaaagtgcacttgatatacatgatggtgcaattcctggtgacaacatcagtggtctgtatgactttgaaaatttgtcatgggagccagtatcaccaatttcgccatcaggttgtgattggattgacaagggtttgttagactttaattttgatccttttccttccactttatag

SEQ ID NO: 4915 - DNA, 1203 bp, Candida albicans
ctccacagcctcgtgaaaagctccataagtattttgatgaatccacctgaacctgttgtaactccgtctccaccagcagtgtctggtaattacgaaatgaaacaaaagtctgtttctccaacttctgggttacctaaaaagggaagcttcaaaccaaaccacgaacgatcacgatcgactcctgaggcaaccatatcaaagctagagttgcatcatcaacaacaacttcagcaactacagaatcaacaaaatcaatctgcgacaccatctcccacaccagcatttcaaagaggtatcgatttgagatctaaggaacgaaataccgaaaatgcagttattgctgctgctgctttaactgctgctgttgacaacccactcccgttaaagactgtcgagcagaaaccagttttagttaaagaaagggctcaagtggttcctgtttcagttgtaccagcggtatcaaaatcagaggaagaccaattaacggagcctgaagaagaggacgaggaggaggaaatggtggaggcaagagtggtgccagtgccagtaccaatgcctgtgtttgttcagatgccgatagatatgaaccactcacaaatcaagcaagaggtggcttctgattctacaagtaagcctgctattccgtctaaagagaagtatgttcctccacctttggaaacttatcaagtcaatcccgactcgggattaataggatgtatttgtggaattgaggatgatgatgggttcacaattcaatgtgatgtctgttttagatggcagcattgtgtgtgtatgggctatgaaaatgcagaagaagttccagaagatatgtacaagtgttattattgtgatgaaagcaaatggggaaagtttgatcccgaggcatctcgtttgagaacaatgcagcgattggagatagacagacgcgaggacagtaaccaagcttcagtcaaaaccttgccacaacaacaaaatcaacaacaggggacaaaaagaaaacagctgaattccgaaaaggccgacaataagaaaaggaaaacagaagacaagataagcacgaacacaaactcaagcaactcggctagtggatctccagcaccaaaatttcaaaatcctcgtcccgatgagatggatgatttgccaaacaaagacaatgaattacttgcggattcttcacctcgggattcgcacgagccgcactag

SEQ ID NO: 4916 - DNA, 888 bp, Candida albicans
gatgcaaaattcttgtgttggaaaagcggttttaaagttgagaaagggagttcttattctaaaaaattggcaatcagtggattcaggaatgaactcgagttgggaataaactctgtacaactaaagtttattattacactaaataaaagaattgatgttgatcacttaaactcaaaattgactatcaatgcaaaactagtggaaaaattgttgcatttgctttataaatctgagtttagtttatccgaggacgacaaatatgaagaatcttcttcgtacttggcaattaaactggatcaggctgatgctttacaggaagatgacgagattaccccccaatattattgtgtatgcagagaatatgagtatggtaccatggttgaatgtgacaagtgtaatgaatggtatcatgttcagtgtgttaaagatgtttcaaatccagatgctgataaatatatttgtccaacgtgtctcgtgataagcatgtcaagtaattacaatcaatttttgcaagaccaaattactcttggtgaattaaaagaaatctatgcgcacggtgaattattaaatgctcagtcaattaatgaaatgattattatgaaggacttgattgatgaattaaccaaacatcatatagggttacaagaccaaatagcacgagtcgttttacagagtgatattaccactaaactagactgtttaagattcatattgcgcaaattgtatggcaacggtgtgctattaaatgacatttgggatcatgttttgaatttgattagggaatatgaaaagattcttgaagatgctaaaaagttgagcagtgaaatcaaaccgattgagaatgttcctaccacggataatgttgaacaagtgactcttttaggatga

SEQ ID NO: 4917 - DNA, 387 bp, Candida albicans
acaaccagagagacaaaaaaaaaaatggaagagccaacaaaacgtgtgactagagtcaatcgtggtcaaaatatgaaaagacacattgaagaattattatccaacgatgtaaaatactttagcagtcaaagtaccgaatctacaaacaaaaaacaaagggtcgagaaagatgtgaaggtgacgaaatcagatacagaagatcatgcagatactagctctcaggatgagtatgacggtgaagtgaggtgtcgaccatgcggtgccacaaaagacaattacgatgaagatgaagatactttaggggatatggtacagtgtgatcaatgcaaaacttggctacatgcaaagtctatgggatatcagtccaaacgtgccttaaccgcagtt

SEQ ID NO: 4918 - DNA, 738 bp, Candida albicans
atattatttcaaagtatgactgaagaatttgtctacaaagtttctataaagaaaaacatatcggaaggaatggcaagggatgtgggtggaaaaatatttacatttggttcctataggttaggggtatatggaccaggttcagatattgacactctagttgttgttcctaaacatgtttccagaaatgatttttttgaagttttctatgaacttcttaagggaaggagcgagttagaggagatagcaccagttcctgatgcatttgtacctatcattaaaattgaatttgcgggaatttcgattgatttaatttttgctcgattagatatacctagagtacctagagatttaactttagatgataagaacttgcttaagaacatagacgaaaaggatttaagagcattaaatggaacaagagtaaccgatgagatattacagttggttccaaaaccgacagtttttaagcatgcgttgaggtgtattaaaatgtgggctcaacagcgtgcagtctacggtaacatctttgggtttccaggtggagttgcctgggcaatgttagttgcccggatttgtcaactatatcctaatgcagtgagtgctgtcatcgttgaaaagttttttcatatttattcgcaatgggcatggccccaaccagtgttgttaaagcaaattgaagatggtccgctacaagtgagagtgtggcacccaaggttgtcttcaacacgacgcggcaag

SEQ ID NO: 4919 - DNA, 1353 bp, Candida albicans
ttcttcttcttgattattctaatagtaaggatgaacacgaagacatacggagtaactgagcctatatcaacaaatggtccaacaccgaaggagaatattctcaatgatgcactcatacaagaattgaaaaatagaggttcgtttgaaagcgaacaagcaactaaaaaaagagttgaagtgttgacattatttcaacgattagttcaagaatttgtgtacacagtatcaaagagcaaaaacatgtccgattcaatggcccaagatgccggaggaaaggtatttacttttggatcctataggttgggagtctatggtccaggatctgatattgacacattggttgttgtgcctaaacatgtaactcgtgatgactttttttcagttttcgcagatataattcgaaaacggccagaattagaagaaattgcgtgtgttccagatgcatacgtaccaattattaagctagaatttgatggtatttcaattgatttaattatggcaagattgaatattcctcgcgttcccttggatttgactttagatgataaaaatttgctcaaaaatcttgatgaaaaggatttaagatcactaaatggaacaagagtgaccgatgagatattacagttggttccaaaaccgacagtttttaagcatgctttgcgttgtataaaactatgggctcaacaacgtgcagtctacggcaacatttttgggtttccaggtggtgttgcctgggccatgttggttgctagaatttgtcaactatatccaaacgctgttagctcggctatcgtggaaaaattttttaatatttacacaaaatggaattggcccgagccagttttacttaaatctattgaagatggtccacttcaggttagagtgtggaatccaagattgtacccacatgatagacttcatcgaatgccagtaataacaccagcatatccttccatgtgtgctactcacaatattacaagttctacccaaaaagtgattttggcagaactctctcgcggctcttctattatgcaagagattcatgctggtaaaaaaacttggtctgatttatttgaaaagcacagtttcttctataaatataaattctacctttgtgttgtagcagcatcaattgattctgctgaagagcataaaaagtggtcaggttttatcgaaagcaaattgagacagttggtattgaaattagaagtcgctgaaggtgttgaaattgctcatccttatgttaaagatttttcaaatacatttattctcgatgataagaatgccgaagatataatcaatagttatggaacatcgagtcttcacctcggggagcgacgtccgcgattagtg

SEQ ID NO: 4920 - DNA, 453 bp, Candida albicans
agtcttttgaaaatgggtactattgcgacaatgctgatagaagcacatgaaattatgaacttatatggtaccctgaaaggacatgacagagtaaagggggttttgcatgcggagaacaatgacaacaataaagaaaatgtggaaaataaagttgaattacatatgaccaagttatttatcggattaaagttagacttgagtaaggaaggtgaaaagaaattagatattcaatatccttgtgcagaatttttcaacatatgtaaaggctggcaagattttgattcagaaaagcactttattcaaattaagaatgtgaagctttatgatttgctggatgatgtttacgtggatggggaaacaagacctataaaaattgcgaaaaggaagagggctgtttctaaaaatgagggtaagaaaaagcccaagagtgtcggaacagtaagtgcagcttaa

SEQ ID NO: 4921 - DNA, 492 bp, Candida albicans
gtaaagccaattatgccaccaaagagaaagttaagtcaatcttcagctgagtcctcgccagtgaaaaaatccactgaagagtctcaaaatgtagctgtcacacattcaccacaagaatacctagactttttcacatcaactttggatatggtgtttaatttgagagatggcgatgaagaattggcacctccatttatcaagctaccatctaagaaattctacccggattactaccatctcataaagcaacctatatcattaaatgaaataggaaagcgaattaaaactagatattctggtacttcatcgagagagtttcttaatgactttgaattgttgttagaaaatgcgagcacctataattctccggattcttggattgttgaaagtgctagaaaaattgtaaattttgttgagggtcaagttgaggaatttgagagcacttcttcaaccaatttatcaacaaataaagcagccgatgacaccaagaaa

SEQ ID NO: 4922 - DNA, 252 bp, Candida albicans
cgcagttcggttaccttccagccgccgtgggctgaagacaaatacactacgccagcaaccatcagtagatgtggtattgtctggtttgacgtatcattgatctccttagatgcccatttacacaaattggtacatcaattaaacacatataaaattaccaatgatgatatgattcgtgacaacatgcttgctgataatttgagaaaatcgtttgtggaagaattaagcaacttactatcttataatgtttag

SEQ ID NO: 4923 - DNA, 1104 bp, Candida albicans
tctggtatttgtgaggttgcaaaacaagctgagcacataatggagttttcatttcaacgagccattggttctcttgaagtttgtataaagacttatttacgtcggttgttgaactttgccaattccaatgataatgaaacagtggaaatcaagaaatatgttcaaaaagcactattactttcaataatgtgggcatttgctggagattcttcttatgaagatagaattgaatttgcaaatgctatgaaagataagaatatcctttggggagtcgagatgccgcatggaaatgtacttgattatgatgtttctttacctgacggcgagtggttagattggaacacttccgttgcatcagtggaacttgagccacatcaagtttcaaacccaaacacaattgtccccactttggacactgtcaagcatgaacagtttatattttctgttctaaatgagcatagtcctttgttgctttgtggtccaccgggttccgggaagactatgacgttgtttgaagcgttgagaaaatcaccacagttggagttgttatccctcaacttttccaaagaaacttcaccggtgtcgttgctaaaggcattggatcaatactgtgaatatagaaaaacaaatagaggcatccaattagctccacgaattaatgggaaatgggtggttgtgttttgtgatgaaattaatttaccccaagtcgacaagtatggaaaccaaaatgttatttccttaataagacaaatggtagagcacggtggattttggcgagtcaaagataaccaatgggtttcattggaaaatatccaatttgttgctgcttgtaactcccccaatgatcctggcagaaacaaattatctgaaagatttttgcgtcatgttcctgttattatggttgattatccaggttatacctcattgacccaaatttatcaaacatttaatatggctatcttgaaatgtgctcctgatttacgaggatttgcaaaagctatcaccgaggcaagtattcaagtatacgaaaaaacaagaaagaaattaaacatccaaatccgaacgcagtactttttttcactgacaatgagcaatacccagtat

SEQ ID NO: 4924 - DNA, 612 bp, Candida albicans
gaattagtcgtacaaagtattggggagacaattttacctaaattgattaaagaagacgaaatcgtttttgaaaaattaagaaacaaatactttgcaaatgttgttggtaaagtgcttgacaaatccaatttaattgcagcacttgaaatgtactttacaaagaatggagttcagtttgatgagaaattcatcaacaaggcattacaattaattgacatccaaaacactcatcatggtataatgttagtaggggaatcaggatccgggaaatctactatccttgatctgattatgtatgccttatcggttgtgaccaacgtggaacacactaaagtccttatagatgccaaagtcttatcgaaagatgagatttacgggaagcttgatttggttacacgagactggacagatggtttatttaccagtgtattaagaaaaatgtcagagaatttacgtggagaattatcgaaaaaactttggatagtatttgatggagatattgatccacaatgggctgaaaatctaaacagtgttttagatgacaacaagatattaacccttcctaacggtgagcgattaagtttaccagagaattcttcaacacgccgctag

SEQ ID NO: 4925 - DNA, 2328 bp, Candida albicans
atgatgggttatatactgaacaattgggaaaataatatttcaatggtacaagttcttgtgcccaaaaaaagtttactcattgaagaaaatcttgaaattgttacttctaaaatcaaggcagaagctttgaaaattaatgattttataaattcattgaatcaaaattggcaatccaaaaaacccatagcaggaaatttgaatccatcggtggcaatgatagatttggataattttcaaatgcatttttcaaaattgacagcttatgttgaatcattgattaatatttctaatcatttagatatacatattgttccatttgaagatatgtcattatcaattgatgaaattaaagatcttaaatcggtttggtcttcagttaatggattatgggaagaacttgaaagattgaaaaaacttaaatggagtgatcttcaacctagacaattacgtcaccaattggacgatttattaaattcagcaagaaacttaccaatgaatataagacaatattcagctgttgatgaaatccaagcttcagttaaaacccatttgaaaacccatcaaaaaatatctgatttgaaaaatggttccatgaaacctcgtcattggaaaatattgttaagtcaattaggagtaccagatattaaatttgaagatttaaccgttggtgatgtatggggattgaatatcactttgaatttccaaacaattaatgccatggtcgagcaagccaatagtgaaaaaactattgaagagaatttaaacaatattaacaataattgggctctgataacatttgaattattcaattatgagaataaatgtcgtttagtgaagaattgggaacaattaattgatcaatgtaatactgatattaacgcattgacaagtatgaaaaattcaccgtattttggagcctttgaaagagaaatcagtgaattggagaaaaaacttacacaattgtttattgtcttggatatttggatagatgttcaacgtcaatggttatatttagaaggagttttcgggaatgaaaataatgatctcaaaagtttattaccaatagaaagttcaagatttactaatatcagttacgaatttttaaacttgttgaaaagaatttataaattcaatttagttattgatattgttttaattactgatcttcaaccgatgatgacaaaatgttttgaaagtttggtgaaagtaagaaaatcattaaccgattaccttgaaaagcaaagagaattgttcccaagattttactttattggtaatgaagatttattagagcttgttggtgggtcacatgatatcacaaggatcaataatcatttgaagaaaatgtttagtggggttgagaggttgcaatatgcaaaggaaagctcttgtattgttggtgttgttagtgagcaaggtgaagagctcgtcttgcacaatccagtttctttgataaagcatactagattgcatgaatggttaagtgaattagagcttgagataaagttaactctttctcgtttggtcaaagacaatatcaaacttttgcgggaaactgtgtttaaaaaagatggcttggtatctttaattgaaagtatccctgctcaggttgctactttgttacaacagattacttttacaagtctcattgaaaatccaactaccctgctttcatcacttcacgaaagcttatctaacactattaaaactcttgttcgtgccattggttcagaaatagaggatcttacaagaaagaaaacacaatatttaataatagaaataattcatcagagagatgttgttgaacaattgataaatgctgaaaatgaatccgatagaaaatttattcgaaacattcaacaaaggttttactatgacatatctaatacagatttactcaaaagcttaacaatcaaacaagcaaattccgaatttatttatgggtttgaatacttgggtattccagaaaaattagcttacactccattaaccaatgattgttatttagccatgtgtcaagcattatctatacaacaaggtggttctcctttcggaccagcaggaactggtaagacagaatcaatcaaagccttaggtcacaatttagggaaaatggtgcttgtgttttgttgtgacgattcatttgatttccaatctatgggaagaatatttttggggttatgtaaagttggtatttggggttgttttgatgagtttaatagattagatgataagatattaagtgcaatatcatctcaaattggaagtattgaaaatgggttgaaaaatcctgacctggcaccatctgtgtctatattcgaaaacagc

SEQ ID NO: 4926 - DNA, 1224 bp, Candida albicans
gtgatcaaattattcgattattcttctgaatttaagttgatattggcttccaaagaatctgggttgattttgcatccatcggtagcatcaagagcgtcaattatcaacttcacagttacaagtggcagtcttgaaaacagagcccttgatattgctttgaaagaaacacgacctgatgttgagaaagaaagaaccgatttggttatgcttaatggtgaatggaaattacgtttgcagacattggaggaagagttgttggattctcttagtacaactccaggtgaaattttggataatgataacgtgatgaacactttggagactcttaagagcgagacagatgggttgaatgaaaaattggcacattcgggagaagtcatgaaccgagttgaagagataagaagtaattacagcgacgtggccaagaacttgtcaggaatatataccatttttgaatcacttggtcgtcttaatcatttttacaagttttcattgacgagatttgttaataattttgcacatttattacgtgtgaatattaaattatcaccatctgagtttattatggaattattcaaggattcctttgcacgtatttccacgtcattgcaatataaacacaaaattgttttggctttggttttgtctactgcttattatatggaggatattggtgatctgtacaagactgcatttatgaagatgttaaagttgattgtcactgataaacttccaaacagtattagcgatgtgtttgatgtgtgtctagcaaggagagaatccggatgggatgttgaaaaagtactacagctgaatcaagacaatctggttttgcagatcctttcagacttgcttttaagttttggcagcacaaaaaacaaagaagattttgttgatacttttagtaagattagtgggttcttgtataaagatggagaagccccatattcatctccttacgatttaaactattggataaatgatctgggaattagaactattattttgacgtgtccagaagtttatgatgcttcttacaaagttgaacaaagtgctcgacagtttgggaagaaactagctgttatttcaatgggaacaaaagaaggaattgaaatggcaaataaagaaattgaagcagcttctatgtcggcacgttgggttttgattcaaaacatacacatggcgccatcatggatatcacattttgagagtcagcttagtaat

SEQ ID NO: 4927 - DNA, 1467 bp, Candida albicans
ttcaacacaatggaagaactggtcacacccttattatcagtcaatcaattatatgactgtataataggctttctaccttttaatgaaaatgtgccgaaatttacacagtgtgaagatgtattgaccaagtttatatctaacaacaaccaagatactttgtaccttatcaagtctattgaagagaaaacatccagaatatcaaatgatctttcagacttggatatgggatttaaagatttagatacttttgttattataatcaaatctaaaggtgaacttaggaatgatataccgcttacccaacagctaaatattatgagtattcctataccacaagatgagaaccacgagactaatgatctgtttgaaaaacttcgattagcagttagtttagggttgtcaccatattttgatttcatttccaccaaaaatgaagaatcagcattggcaacaacgaaaaagaaatttaatgaattatcattagcattacaacatttacaacagaggatccatataccagatttattaatcactactcatccaaagatcaagatgttaattgccgagaaaggtagcgaatacccggatgaattaatagatgacactgaatttttaaatgagataacatcaattactaacaattgggttcgacaaattcaatccatcactcgtttgaaccatgagccatcggatggggatagtattatggaagatatccaattttggaaatctatggatttggcgttgatttctttgaaccaacaaattaactccccggaagtgaacctcactcgagaattgttatccaaggccaaaagatttcatattaccttgagttttgaaaatgatattgggctaaaggaaaagttaaatgaaaccaagttgtacaactcctttttaagagaacttcccattaatgatttgctgaccatcactgatgacgatgggtttcagaagtttgacgatgccttggcaaatatcttcagtcatttaaagctaaagttaaacttattaccattggaaagagcaatgaagtctgtcgaagtaattttaaacgatatcaccgaaaaatttcaatcattattgggtacctatgatttaatgtcgttatcactagataagtttgaagaattgatcagtttgtgcaacaaagaattggataccatagaagtaaatattaagtttataatcaatttactaagagaattgttgagaaaacgtcaagagaaattcaaactaatcaaaattgatcaaaccaaacttgaaaatattaaagaaagattattatatcttagacagtttagacataatcatcaagatttgatgactgggattgaaagtgttttaccacaagaagagcaattagatctgattagtaagttgaatgaggcatataacaagcacattatcagtatcaaccctgttgacattcttctaccacaggggctggaaggtcccgcgattggc

SEQ ID NO: 4928 - DNA, 423 bp, Candida albicans
gtggaagaacattttgagagtcagcttagtaatttacatgccgaatcaaaaatattcttgacatgtaaaaatacttcacaagttccaattggggtcatatctcaatgtaaagtattgaattttgaaaatgaagtgggcattcaacgacttgtattggatacttataaatcgagttctatggataagagagaaagaattgagcgacatgttttgttgctattgatttggtaccattctgtcattcttgaaagagtaagatactcacctgtatcgttcaagaagaagtatgatttcaatgactccgattatacctgtggtgttcacattattgaaaaagtgtttgaaagctacgatggtaaaactgaaaccattccttggaatgagattaaatatttaattggaaccataacttatggtggttaa

SEQ ID NO: 4929 - DNA, 396 bp, Candida albicans
ctaggaactaagttcttcctgccggcttgtgtgaagacgcaaatgttcaaggaggtggctgagaataatttccctaacattaatttgaatgctactttcaaagaaccagtttttttcagtaattggatgagtttggattataaatctgtgaatgaacaagaattaagatcttttgtttcactgaggttaagagttttcagtgaagaagaaatggaggttgatttggtgttgcacgatgaaatgctagaccatgctttacgtatcgatagagttcttagacaaccacaaggtcacatgatattagtgggtcccagtgggagtgggaaatcgactcttgccaagtttgttgcttggatcaatggattaaaagttgtgcaactacacgttagaaaggaa

SEQ ID NO: 4930 - DNA, 1665 bp, Candida albicans
aaaaaaatggtggcagaagtgttagaagataaaaaaagaccaatcgaagaccaatgtgatggaaatagctccaaacgtccaagacgaggcaggagatccagattaagaagatacaaaaacaaagacattgatgaaacttctcccttgggtgttttgcagttagaaattaaagaattattggagaaacataacttaaccaaagaggatgtgatgaacgatatgtctgctattctcaatgaccctgaacttcttgaaaaatacaacaatagaattatttcggacgtgaaagtattagcattaacatctaatggagactcgcttgctataatccctctggtagatccagaaagaaaacaagttgtcctcataccatttgctttaccaaatgacgttgtcacaatcaaagtccataaaagtcaccccatgtatgtggaagcagatctactttcgattgaaaaatctacttctatgagaaacaatgaacttataaattgtcgttattttggtaaatgttcagggtgtcaattccaaaatatcgagtatcaacaacaattagcaattaaaaagcaaactatcattaatgcctatgattattttgctccgaaattggtgtcacagaagttattacctgaagttttacctacacaagaatcacctttaacttataactaccgtaccaaattgacacctcatttttatatacctaataagaagacaggtaaagatttgccgtgcccaccaaatttgggaattgcatccaaaggtagacctacttggagaaaatctgattttggtcctgaaggaaccaacattgatattgaagaatgtaatatcggaacaaaaataattaatcaagggttagcaaatgaacgtagaagatttaatactgaatacgttaaatattccaaaggtgctacatttttgttgagagaagatacaaaggtattacaagaagacaccgttattggtccaggatcagttgatgaaaatggtcaggtatcaaaaatagaagttgaacttgaggataatacgaaattggtcaagacttgtgtgacccaaacaagacagattgttcaagagtatattaatgggtacatttttgaattctctgcaggtgaatttttccaaaataacaattcgattttgcctattgtcatagattatgtgcgatccaatttatcgctttctgaagatcaaccaaactatttagttgatgcttactgtgggtcgggcttattttcaatcacctgttcatcaaatgtatccaaagtgattggtgtcgaaatttcggcagattccatcagatttgctaaacgtaatgctgagaaaaacaatatcaagaatgctaatttcattgttggtaaagctgaggagatttttgctagtatggatactccaaataatcaaacatcactgatattggatcccccccgaaaaggttgtgatgatgttatttttgaatcaatttatcaaaatattaccccagcaaaaattgtctatatcagctgtaacgttcattcacaagctagagatatcgagtggtttatcaacagcactgttaatggtaatcagtattacgtagaaagtattaaagggtttgattttttcccacaaacccatcacgttgagactgttgcagtattgtcattgaaagaaaataaataa

SEQ ID NO: 4931 - DNA, 423 bp, Candida albicans
tatgatgatgtattggaatttttgagacgtcaaaccacattcaagggcacttccgtaaaagaattaaaagatggttgggctggttgtgttgccgctatagacgaattagaatcacaaggcaaaattttggtgttgcgtaacaagaaggaaaatgctccaagattagtatgggctaataatggtggtgagttgggttatattgacacagaattcaaggatatgtgggatcaagtgaaattgccggaaccagatgtattgtatcagaaattattggatcaaggattgaaacctacgggagctgatcctaatttgatcaaaaagcaaccacaacaaaaggaaaagaaacaaaagaaagcaagaagaggaaagattacaaatacacatatgaaaggtattttgaaggattattctcaattagtttga

SEQ ID NO: 4932 - DNA, 771 bp, Candida albicans
actaatcccacatatttcatgaaacaacatccacttgtcacggcatataaaggcattgatgacttgcaacaattgaaaaaatggttttacgagtataatgacacaatagaccatagaaaaaaagcaatatcaaaagtaaaaggattgttaaccagagggaaattaccacatggagttgaagccacatcgcttctaacatccatagttttggatgatttgcaaagaaaagacattgactcttgtgtgttacagttatcttacaccatggccttgattagatttgttaatgggttgttagatccctatcagcagtcaaactatgccattcctatgcacctattggcaaaacaattgaacctacctacatattttgtagaattgcgacacatggggactcatgaaaacttgccaagcctagatatattgagaagtacttgttcaaaagcattgacttggctttatgacaattattggtgtcatgtggaagaagcaaatcaggataaacaagtttctattggggggccattgactgatgccgttgaatttcgaagtaatgatctaaggacaagaattgaagattctcagatttacaataatttgaaagcgttcaagcgaatacggaaacaagatctaaacaaggtttacgagaagaatgatacaacgagcgatttagctgcgacatatcataggtgtgttctggacatagtcgaatttgctaaagaaaattgtgatttattagtgaatgttttattgctcaagaattaccttata

SEQ ID NO: 4933 - DNA, 1377 bp, Candida albicans
ggacgcggacttccattccgtggtgaagatgcaatactcggatcagcaaatactagtgggaccaatatacctgtaagaaatcaaagtgtatcgttttctgatatagacaatcaagaacgttcccgtcgatttacaatatcagcaaaaccatcaactgttaatgtaccacaagaagttcaactaccacaatcgtcacgacacccttcctcggctgcaccatcgaggcaatcatcagtaaagactaaaagagttacatctccagttaacagtggtgaagggaatgtgtataatgatgtgttgacttttatgaccaatcatagtcatggcaaattaaacaccgcattaccatcaaatgttcatgtcggcgcaatcagaagtgataactcttcacctataacacctgaaggagctattgatccagggtttaattttgattataacaaaaattcattaaatagaattgctagtcctagtccacctccatttagtcgttcaaacgggagttcttcaacttcatcgccaaaaagaagcaagacaccaaatacacaggaacccgtaccaccacaggaacctataactacaacagagaaattgatatcagaaccttcttcacaatcagcaataaaaccattacctagtagtcaaattgttcaaccaattaagattactggaactggaagtgccaattcctcacgtcgtggatctttaaagaaatccaataaaacaattgtatcatcccccattggtccaccagttccatttcaacaatttttatcaaagcaagatgatgggaaatttcatattttattggcttgtactggttcggtagctacaattaaagttccattgattattgataagttatttcaaattttcactacatcgaagatttcaattcaattagttttaaccaaatcatctagtcattttcttcgtggttgtaaaattcatgaggatgttaaaatatggcgtgatgaagatgaatgggccaatttttctgatgcctataattctgcttctacaacagtttgtagtactatgggtaatgatggtttgaatgttgtcaataaaaagcccaagaatccttttgagaaattgattcttcataatgaattgagaaaatgggcggatattatgttgattgctccattatctgctaatacattggcaaaaattgctaatggtattgctgataatttattaacttcaattgtaagatcatggtgtccatcgactttccaacaagttaaaaaaccaattattgttgctccagcaatgaatacatttatgtatactcatccaatcaccgctaaacaattaaatataatactgtcacctgattttggtcttcaccacggggctggaaggtaccgcgca

SEQ ID NO: 4934 - DNA, 621 bp, Candida albicans
  unsure (296): Identity of nucleotide sequences at the above locations are unknown.
tttgaccaattcccagaaatgtcaatattcaagccacgtactattgttaaacaatcaagtactttacctacagcgactattcatgaacttacaaagaaccaacattattgtgtatcaaaattaccagcattaccttcagtgttcaaatctcaagctgattcattcactaatgcttactcagattcagaatcaaactattcattagtgattaatgaagattcaatatttgtttggtgttacaaatctactgacgcaactccattatctattgaattcccaattgataaatctatatntcaattaccaatggcgattttgacaagaccatcaagcggtactggccaagacccaggaattattatattaaaatccgtatcaggattaataaagttttatgaaagtggtaaacatgcccctacattgggaatgattaatgataaatcattggaaatagatattcccttggaaaaagatgaatacctagctttagcaaaaaacgtggaacccacaggattaatgaatggcatttctttacaaagatgtattttaatttctcttagggaattcaaaagtaaaccacaattaaggtacttggaatcattaaataatgaacgtttctaa

SEQ ID NO: 4935 - DNA, 819 bp, Candida albicans
caatattgtaaagataaccccaagaacacagctaatgtatcatggatcagatatttattggatactgagtttgcagaagcatcgaattctttaattgtggcagctgaagagaacgacagtttagataatcaacacatcaaatactcacttgccaaactatcttctgttgcatctgggaacggcgacaatttgaaagatatcaaccatgaattgttaatcattaaatatcaaaaaattatcaaacatctgattgcagacaatggtagaatagaggccattaaaaaaccaacatttacaaagaattttgtcaaccaagaaatagacaaacaatttattgaaccaattgttgatatttatttcgatagatttgtcggtgggtttgaattaaataacagtgaaattatcaatttattgactacagtaaaaccatcaatttcaaacaaatctggattctcgtatgcctttaaaattgctgaatcaatctacaatgaaagtatagctaattactattctagtatggtattaatgcgtttattagttttgggtgatgaaaaattatatcaagtgaatgacaatgataaaaccactaaaagaaaagctaaagagtcagctttatataaaactttgaaacagaatccaggtgctatttctaaacttgatcaattattaaataatccggaaataaataatgctgagtatgaggatagcattactatcaaggaattcaacgagtcattgttaagtcaattaacaaaacaacttggaaatgctaaattcaagtcctgggttgaagcagtgaaagaacaagccagaatttag

SEQ ID NO: 4936 - DNA, 726 bp, Candida albicans
tcgggccaccctaaagagctaatgaatcatatatggcaagtagagaaatttattatatccgaatcggatcatttaactttattgaatgttttcaatcaatggaatatcaatttaaataaatttaaaggtaattataccaagattaataattggtgtgataagaattttttacaattaaaatcattatatcgagctaaagatattaaacatcaattaatgttaattatgaaaaagaataaattggcaattttgaaatcaaaaaccgatgatgatatacgtaaatgtctttgtgcttcattttatcaacaactggcaaaattaaccaaaatgaatttaaatggacaaccagagtttgttaatttacgtcattcatatatgaaaatgtttttacacccaactagtagtttattggatagtaatttgagtacgaattatgtcatttatcatgaattagtgttgacgaaaaaagagtatatgaactgtgtaactacagttgatccaatttggttattagaatatggttataaattttttggggttgctgattcccatcgtaataaaatcgattcagaagcaattttaaataaacaaaaatttgaaaagcaattattaaaagataaagagatttatgatgatattattaaacaacaatcgaaaagaagatcaaatgaaatatctaccagtaacagagttagttccttattcaagaagcaaagaggaatttaa

SEQ ID NO: 4937 - DNA, 2172 bp, Candida albicans
cggccggctggtgaagacaggaaactgcgtgcgtcgttgtcaccatcgtcatcagtaccatccaagccacaaggtgtctcttctaacttgccatttcgaccggcaacaccaccagtttctgaaccatcgacatatgaagaagaagatctaggcgacataaatttagacaacttttccaacattgaagctgatagagaatggtataacatagatgaagaaagtgcacttgctagaaacaatgagattgatgaagatctaccacaacgacaacgtaagagaattcgcaatactagacatcctaaaaaaacacccaagacatcattcaatgaaagtggggcatcattcaatgaatttggtgaatatatcgattatgatcatcaaaaatctttgaatgaattaaatcgaatacctataactagtcatgttttcatcccaccatttcttgaaaatctgaaacaatatttacaattacaaatttctggatcaagtatacgagggattggacctacagtgaacccagtaaaagatcatacgtctgaattagcatcaatggcaaagcaaggatcatttgtggtacagaataaacgttcaaaacgtgaaagggcgctacaagccaaagaagcagctggcgtggaaaatagcaacattggatctattattgatacagccaataccaccgaggaaattaaacaagaagagaaaaatgctgatgtaaacgaaacaaaacaccaggatatacaacagcaaagacaactgttaccagcttttgctgtcagaaatgatttgttgaccaccataagagataatcaagtaactatagttattggtgaaactggatctgggaaaacaactcaattaacacaatttttatatgaagatgggtttggggctaatattgataagaacggcgagaagagaattattgcgtgtacccagcctagaagagtagctgccatgtcagttgctacaagagtcagtgaggaaatgaattgtaaattaggtgaagaagttgggtattccattagatttgaggataaaactgacaaccaaaagactgttatcaaatacatgacggaaggtattttactacgagaaatctcggctgatcccatgttggttaattatagttgtattataatggatgaagcacatgaaagatcattaaatactgatattcttttaagattattcacaaacttgttagccaagagaaaagatttgaaattaattatcaccagtgctacgatgaatgcaaatagatttacgaaattttttggtgttgctccacaatttcatatacctggaagaactttcccagttgaagtttttttcaaccgagacgtgaatatggattatgttgaaatggctgttaaacaggttttaactattcatttgggtagatggaatgccgataataataatgccaatgatggtgatattcttgtgtttatgactggtcaagaagatattgagattacttgtgatttaattaaagaaaaattgaatttacttgaagatccacctccattagatattttcccaatttattctacaatgccacaggatttacaaaagaaaatatttaacaaaacgaacttgcaacgaagaaaagtggtggtggcaacaaatattgctgaaacttcattgacggttgatggaatcaaatatgttattgattgtggacttgtaaaagttaaagtttataacccgaaactaggtatggatacattacaagtggttcccatctcgttggcaaatgctgatcaacgtagtggtcgtgcaggtagaactggtgcaggtattgcttatcgattatatactgaaaaagccactgaacccgacagtatgtatgtacaaccgatccctgaaatccaacgaagtaatttaagtaatattatgttattattaaaatctttgaaagttaatgatatcaatagtttcccatttttagacccaccacccaaagatcttttaaattgttcattatatgatttatgggctattggagcattagataatcttggtgaattgacaaaattaggacattcaatgacacaattccccatcgagccaacattggcaaaattgattttattatccacacaacctgaattccattgttctgaaataattggtgaatatggttggcatggtattcggtggccaattttt

SEQ ID NO: 4938 - DNA, 2262 bp, Candida albicans
aacattaaaagaaaagaaagtcatatttccataaccaatgagttgacgaaactaccgaaggaaccgttgaatagtttatatgataataagacctacacaaagctaacgtcttttaaacacaccaaaacgaaatcatccaagtataggtcatccacaattgaaacaagtaaacagaactcccaatcaaatgaaagacaacctagttcaaccacatcggaaagcaacgatagaagtggacactttgctgattcgaatcagagaaaatcgttactcgatccatcaactacaacttcggagttgggacctccgatatcattgtcacaaaccccgtcatatgcctctagtgatacatcaattgcagaaagtgaaagtaagttcaatactaaaactgttttgttggatgaaatacaactactggaaaatgataaaaccacaaaaaagaaacaaacttctgaacgaatggttgattttgaatttccaagtaaggaaatatatgaaacacagaacaaaaaagagcaacaccaacagagtttttatgaccaggatgaagacaataaggacgacgacgacaatgatgatgatgatgatgacgataattcatctcaattttcatttgtgcacgatatgaagggtggaagaaacacttctgttaaatactacaaaactaaaaattctaaaaacactaataatgatgaagggttactgaatacattcaacgagcttgatttggggtatgaagtagatgagttttctgattacgattatgaaaataatgggggtgatttggatgatgaatacgatgattttggcggatttgaagacgatgatgaagatgaaaactacaacaagtattttggtagtgatttggaagatacgaatgatgatgaaggaattttttatagaagttctgttgataatcaaagtcctgaacggaatgtgattactcctgatttagaaaacaaaactgcaccagaactgactaacacccgtgaaaaacttggtgaatctttgcctcctatcgatagtgaccgtccaaataaaagaaacaagtttaatggatcttttcatgtatcgattgttggtcccaaaacccaatcaccaaagcccagtccaacgaaatcaggttttgaagaagatattttagaaaactatctcgataaaagtgatagatcttcaacaaactcagacgatagctcattagatcaaggtgattttgatacttgtaattttgagttatttgccttaaatagtccgattataaatggtttgacaattggtaacaatttacgtcatcgaggtggtcgcgatagagattttatcaacacaaatcgattgatcattcacaggaaacctattgatttttatgatgacaactcaaacgtttctgggtttcatttaaacaataaagagagatcaaaattatatttgcatgcatttcatggatcaattgatgatggatttaataaggcagtggatgaaaaagttaaacagtttgatgagttcactacaaaattaacaaatacatcggaacacattaaggagaatattggattagggattaccacggcaacagaagccaaccaggagaaactgagactggcatatgctggaagtatatctacgaatgattcagcgacaagtagattgactgctccaactagtgatatggttagtagcagtactgaaacctctacaattcctataaataacgcctcaaagctgaatattgccgatactgcttctttccgacaatcagttaatgatatgatggcattattgggtagcttggaaagtaaacaagcaaaagctgaagatgaaaacttcctcaaaaaagctaataatagtaatactcagcgaaactcgattattgatatgatgggtattcttgggaaattagaggatgatatagataagcagactggatctaccgagaaagctaaactggaggttcgaaattctatagtagggatgatggatttgttggccaatttagaatcgaaagagctgaacacaggagctggtaaaaccaacgccaaaaacaaagaagaatccaaaaaattgagatcctcggttgctggtatgatggatctattagcaaatttggagaatactaccacaacaaacgataaacctaaacaaagcaatcggaaatcagtagttgatatgatgtcaactttatcggctttgcaagaaccacctgtaattgaaaacaatgcaaacctgaatatgccaagccaacacagcaaaatcattagaacatga

SEQ ID NO: 4939 - DNA, 1248 bp, Candida albicans
acattcaacaaaaaatcaaaccaggaaaagaagccattttttgagagtatggtcgaatatgaaagcattgcaagacattacagaacaaggaatgagctacttcaagtattgcaggaggacaagaaccgaacaaatttaattaaattgtcagttttacaaattgtgactaacaaccatttcaaatatggaacagacattaatacacccagaaaaactcgtagtggaaagctgcggcctgacactcttaccgaaaaggacaataaagggaaaacagtaaataataaaacgcacagtgaacaggtccatgagtatgaagtcactataaacaaattgaaattagaacacacaactacatcaaaattacaagaagcaaagattcaatctctcaaagaggaaaatgcaaagttgaaactacaaataaaaaacaacagttcaaaccacaagactaacattaacacctcatttagtagtatttttacctcatccaagtcccgtccttcaatattaacgtcaagaaatgttaagcgaagctctggtactacgtccaggattggacttaagtcaaggtcaactaccgaaaactccccagtatcatttgcattgaacaaaccaatttttgaacctgtttcgactcctgttaaaaaatccaaattaactttctccaaatcctcgaaatcgataaatgaattttcacctacacaggcccattcagaaacgaccatttctacaggtggtgcacgaagcagcagtgctgtaccgtcttcaccaacaaggcccagtagtttaacaacaagtacaccttctaagtacatgtctacttttgataaatcagataattcatcttctccagaattctcacctaacaggagtcagaacaacacaagaaacctggtgaacgatgtggataattccgagaccggtggttttgttagcgcaaacactaatgttgaaaactctgataatgagaggtctggtgatccgaagaaaaatatcagaaagacaaggaaactacagttggccaagtctgctaaaatagaaagagttcgtaatgctagtctggataaaaaaagcagtggtatacttgctcatggtttggatgatgatgaattgaatccgttgaaatattacgaggactctaatttcaaagacgttggtttaagtccacctacaaaaagaaagcacagtgaacctgacaatacaagaaaacttaaagttagaaagaaaaagaacatatttagtatagagtaa

SEQ ID NO: 4940 - DNA, 3681 bp, Candida albicans
tcaaaacaaatccaaaaagcagtattcataacattctatttaagaattaccactttattgtataatcaacgactccagaattttgattctttaaattatttaaactgttcaaatttgataaatgtatcattatttataatgaatgaaggaaatagagcatccaaagaggatatagatttagaaaatgctattggagatgtatttggacatttcgattttggttctgtagataaagaagaaggcacgaatcaccaactacaacaagaccaattagaagagcaagataaagatcaaccacagcaaccagaatccaaactggaacattatcataccgatacccctcttcaagatttaccacaaccctcccaaaggaaagagattattgcagaaccaaagcaaacactacaacataaagataataaacaagctgaacattcacaaacaaacaccacagaaaactccaagccctctgaggatgaattggatttggaagatgcaattggagatgccctagatacggtgtttggagctaatcacaacaacaacgacaatcacaacaacacagacttaaataacgatcatcaatcctccgaatctgacaaccaaaatgatgtgaaaaatgcaatagaaaacgctttaggtgatatttttacagaagttaaaacagacacaactacagatgatgcagcagattcacatgaaaaagacaaacttactccagagttatctactccaatccagcaagttaaaaattcaccagactctacagacagaccaactacccaactggaagtagaagaaccaaaggataatctactagaaacaaaaacaggtgaagatttagatgatataataggaaaaacaatactggatttagttacggcaccaaaagacaataaaaatgaaaaagatactgataggggtctaaatcaaaaagataaagttgataatctggaaaactccacaatacagcaaagcgttgaaaatgcagataagataccgaccccagataattctaatgaaaaccacctacgtacaccagaaactggtcccccaaagatttcaactgaagatactaacaccactcatgagcccacagacgaaataaaagacaaggaaagtattgacaaaatagataataacaagggtcttacagaaacgaatacttctggtgacaacacgaaaacaaatctggaactgaatgaagaaatggacgaattggacgacgtgatagggaaagcttttcaagatgcaatttcaaagagtcaaccgacacccattgatgcatccaatgtcacagacccgcaagagtcaaaatcccgaacaacaccaaaagaaaaaaccaatatgtcttcttccaaagtggaacaaacagttgcttcttttgaaacagaaagtgaacccacaaatgattcaacagaattggaccaggccataggtgatgtgttcaaacaaattataaatgaggactctagcgatacaaccaaagcatcaccagcaccagaatcagtaggtgacgatgataatatggatttagatgcagtcataggtgatgcatttaagagcgtacttccaactgaactcccatccaaagataaatcacttccattgccacccgatgatgacgataatgatctagagaatgcgattggagaagcatttaagtctatttctgatatcaaaggaaaggatagaaaacaggaagaacaagttaacgatgacgaacttaatgcgatgatagcacaatcatttcagaaagctgttgatatatcgaaatcagattctcatattgataatgatgacatggaaaatgcaatcactcatgcattcaaaacggcaatggctggcactagcgccacatcacaaatgtctgcccgagaagctgctataagaagcttggcagtagaaatatcacatcaagtgcaggatcacttgaaaaacgacaagtttatgccacctttgccctttatacctggattaccccaattggacgataatgttctagctcattttcaaaaagtagcatacactgatgatgatactaatgaacaagataaattgaagaagacagtctctgaatcgacaaattctataacaactcaagataacggaggtgttgctgaattggaaaacttgcaaatgaatgatattttgcaaaatgctttcaaaatggcattggaaaatcctcaagaattactttctgatttagatattgatccgactattcaagtacctactactactactagtaccactaaattcccaagacaagtttcacagccacagccacaacacatacctgcaagtagtctgaaatttattccaccaacttccaaccaaggaatgcaaaactataggaagtacccacaccagcagataccagaagtgcaaagacccagtacgaatacactgatagtgaaacctattgataaattagaatctttagaaaatgattcacacaagaaaccgtcattattgtctaatcctgcagtgacttcacaattaacttccattattagttcattaacatcccgtattaatagtggcgagttatcggacgctaatatattgcaagttattcgacaaatgacagatgtgttggcttccggtggctctttggcgctgttcttaaagaaacctacttcaattcaggatgtgatagtgacgtacagagatggagcgagacaaaaaatgttgaaaagtttatatttgaccaaaaactttcttgaccaaaaactacccatcactgaaaatgaagtgaaacaaaaagccattaaattgatagacaatattgccattgcgtttgatccagttgggtttacaaagattgtcgcagttgaaattaaagacgaagaatttgttggcatatcctcgtttttaaaaaatgtgcttaccacaacattgaaacatgcaaccactactaaatttagtccaactataataaattctattgaatcagttgttgagagaataacacagaacgcattactggatagtgacaatgaagaagcaatgaaacaagtatctcaagatgaagaactagttaaaccaataacagacttgtttagtttactttctggctcatccttgtttgataattcatttccaatggttgttgcaacagcagtttccgtagcagtaacaggatatgtctacaaggaagctactggtgttgcattggataccacaatcaaagctgtttgtctgatattgagtaatcttttcaacactgcaccaggaatgactttcaaagggaatgcaaattccactattggaaatcaagcaactaaaagactttcagacttgattttagttggtgatttaagacgcacaaaaattgatccagatctaggtaaaaccatcaataatgataatggaaaagctgatgcttggaatattgatgcatcatcatctataaaaattccgcaatatcgaagacctagtgctttacatgaaaagtccaatgtgttgcataaaccagcattaacacttcccaggagctcaccattcatttcaaataagattggatcttcacaatccaattctcaaccactacaaagttctaatcataacaataaactcaaaagacctggaagtatccaacggcctatcaatgccaaaccaagggcaacaagtttaggatttcccaaactccattcaacatcatttaaatatcaatag

SEQ ID NO: 4941 - DNA, 2511 bp, Candida albicans
  unsure (11),(161),(222): Identity of nucleotide sequences at the above locations are unknown.
aaccccaacantgagaacaaatttgtgaagagagccaaaacatgttcattagcaagaagagcacgagaattggccgaacaagtacgccaaagaaatgaagctcgagaaaacaaattaaaggcagaagaacttgctcgtaaagtacttgaacaggaaaaganacggattgcagaagagaaaaaacgtttggaacaacaggaaagagaactcgatgaaaagcanaaattacaagaaaagcagaaagcagcccttgagaaattacaaaaacatcaaagtgctcatgattttgaagggttgtttgcaagcaatcgtcgttcagttactgatatggcaccatcttctggtatgtcactgttagatccaagagctcacatggtttcccgagccaatactatagggtcaccaaatttgagtagcagctctgtcaacattgatgaaaatgcatccaaggtattgcacaagttcggaattgatgttgctccttcacctaaacgattttctcgtgcttccaaaacgtcaacatccaaaaacttgtcgtcattcttggctcctactgtgtcacgtaatttatcgtcacagttgaaaacatcaagttcaaaaaatttggctggttatttacatggtacaactgatactaatggttctgctattgctgccaagaagaaggataattctaccaataaagcactcacaattgaggaattcaatgccaaggaaagaaccagcatgtcaccttcaatttctaaagcctcagtaaacaaaaggaatagtaatcaaagcagttattaccggtctatgtttagtgacaatggcaatgatgataatgtaactaaagttcgaactagagagagtcatttgtcggtactggaacaacaagaaatggatatggagaatgcaattgacgaggatatttcattaataccaaatccgagattctcaaggttttcttttggcggattattaggatcaaatactgttgctaatgaggaaggagattggacaataatgaatagcactctcaaccattcgaacacagttgtcaggggaactcataataaatcatctaccatgttaggtttgggtattaaaatgagagacacgacaacgattaaagaggatgaagaatttgaggatgacaaaccattcatttctgtaccttcatctgaagatgatgaagggaatacacacataaataaacgtggaggacttcgtgatagtgggaactatgattttgatgaagaacattcagtcgcaagcacagctaacactgaatattccgatgttgcttctcagggacaacaaatgccaggttctcacaccattcatcaattggaaactgaattatctaactttgatcttgtgagttatagagtagctgatattggtaaagttaacagacataagccaagcatagttgattccaaggaaactttacttaagaatcattcatctgatgaagccactattgaagttaaggaagataacaacgagcatgacttcaatgataaaataaaacaacattatgatgataatggtgacagtgaagaagacgacgaggacgaggacgatgacgacgatgatgctagaagctcatttgaagccagaccacatagtcataattactcattagcagaaataactagtgaaagtccagtaggtggaggttatgagtcaccttcaattgccaatgatttcaagaaatcaagacattcgactggtattttcagtactactcagttcccacgatctccatatgttgtcaataataatggtgattccaataaagatgaaaacagtcagcaacaaaccaaacatatgttgaatgatggtcataagggattgattaccagtccagtacaagacacttttggttccaagaaaccagtagaatccaattcattattcaggagactatcattgaaccctaatagagcggcacctaaagctccagcaccaccaccaccctcagcaccaatatcatctgcagccaaagccaatatttcacaaccactttcatcgcctacaaaaggccataatagattttcacgaatatcaattggatcgaaaaatatgttacaaaaagaagataaaagtaccaagagtaattggttcaaaaaatttttccattcattgactacaccaagcgcaaaggatcaatcaggaaatagttcaagtaaagtagcttctaaagatattaaaatcattgatacttccttgactgctgctcaactaatacgagtgattaaatatcaattagaattgaaaaaaattgaaggttctatttctaaagtagacattgatgaagaatttgggttaatatcaggggtgataccaagtaaatttgcaaatggtagaaaattgaaatttaaaattgaagttattgatttaataaattcatcatcattgcatgtaattaaaatgaaaggtaacgataaagggttccaaagtttggtcaatattgtcacgtttataatcaaaaaagaagaacaagataaaatctgcaggaggtga

SEQ ID NO: 4942 - DNA, 2130 bp, Candida albicans
ttgaacaacaaaataaagatattgaagattataaaacaacaattgatgaaagtgaattcaaataatgttattttaggttgtgaaataatttccaatttacaaatattgcaacaggaacttgaaaagaaagaggataaagatagtaaagtgaatggcaaaattgaagagattaaaagtattgtcaatagtttcacatcaccagttgccccaaataaagtttccaaggaggatattaccgaaaaatcacaaaacgctaaaactatagtagatgaaactaaagatgcaagcactgtaaagaaccaacacaacacaactgaaagctcaacagacgttatctccaacactgattataatgacattgacaattcaacaactgctgaaacaccatttacagaactggaaaaagacactgtatcagaatcactcgatacaacaacagcaccaaaaactagtaccactaatagtgatgatgatgttgctcaattaaacgacaaaaaatcaattgtatcatttggatcatttgatgaacaaattgatgaaaagactgaagaaagtttacgtgaattgaaaagtcttaatagactttctgataaacttgaaatcaagaattctgatacaccaaataaactgaccaatgctgccattaatgatgttcaagaaaaaactaaacctgaaaaagtttccactttattgaatgatgatgatgagcaaaaagtaaagactgaagttaatgtcgaattaaaggacaagacagaggaggaaaagaaatctgaagaaattaataaattgacaccaccagatgttgttattgataaggatgaacctgtcaaaaccttagacgagtcgttgggtgagacaaaggaaatcaaaaaggatactgctgttaaaccatctaccactactaaagaggtaagcaagaatgattcaattgttgaacctaaaacaattaaatttcatacagaagttaaaggagaaaccaagagtgattcaactactgaacctaaagtgaaggaaacgcccaaagacacaaaagaagaaattaagacggatgctattgttgaacctaaagttgccaaaccaatcgatgaatccaaggatgacatcaagaaagattctgttagtgctgaaccaaaagtagttgaaccacttgatgaacacaaagaagataaaacagaaactgcaaagatctgcactgatacatctacaattgcagaacagccacctgttaaaactgaaattgttgatagcaaaaagaaggagccggagcctttggccgacgataaaaccaaagctagtgaagatatcaaagatgtaaataaaatcgaaaagaaatctggaaataaagaaactatggttgatacgaaattggaaactactttggataaagaagtagatactgattctaatattcaagaaaagaaggaattattccaaattaaagagccagtaaaagatgaaaaacaaattaaagaagacttggtcaaagttgaaaccccatccaaagatgaaggaccggcgaaggttgaagttccatccaaagatgaaacaccattcaagattcaaaatattgatagtaccactgataatggcaaagctaaagatgagaaagataatgtttctaaagttgattctaacgttgatactaaagtagttaccaaagacgatcaagatggtattaaaaaagtagaagagaagcctgttgaaaagaaagacgacgacgaaggtaagaaagacaatgaaaaggttactgttcacaaggacaatgaggaagaagataaggataagggtgtcaatgaagccaaagataaggttcagaaagatgatgatgaagaagaagacattgataaagaccttgttattgtaaacaaggaagaagaagacaaagataaagacgttaaagacgataataaagatgttaataaagctgtcgacaatgacaaggaaaatgaaaatgaagaagatgactacaataccgacaatgaaaataacactttgaaaacaccatatgattttgaagctagtccttctcctagtccaagtattagttctcaatcatctcaatctcaaaaatcttcaccactgaaaaaaaataagaagaaaggtaaaaagaagaataaaactacattttaa

SEQ ID NO: 4943 - DNA, 1245 bp, Candida albicans
cagccagaggaaaaagagaccaagattcgtttttgggctcatctctctcttactcacacaaaagaagagctacgattaaagttggcccaaatgggttggaaaaaaaattttttttttaatttcttttttcacctcttaaagagtcaattattacaactactaccaatagcaaagatgagttccaatactcaagatttagttttagcttatattaatgattatgtttccagaaatgaagaattgtcaaagttgaagaaggcattatcgaaattcttagcaggcaaagaattaccaaaattttctaaacagttggaatccattattgatgaagtggaaaatcaagaaaagaaaagcaaaccaagaaactcatcatctgatagtgaagactattcatctgagagtgaaagctccacttcggacagcgaaagctcctcctcagatagcgacagcttttcctcagacagtgaaagttcttcctcagacagtgaaagttcttcatcagacagtgaagacagcgatgacgaggaagacaaggaagacaaggaagcagaaaaagataacaaagacagcgaagacagcgaaaacgaaaaagtggaagaagacaacaaagacaccagctctgattcaagttccagttcagactcaaaatatgattcagactcagactcaagctccagctatgattcaagttatgactatgattcaagttatgattcagactccagatccagctatgattcagactccagctccagatatgattccgattcagactcagattctgatagtgacagtgacgacaattcctcagaaagtagttctgaagacgaagaatcatctagtgattcagaatccaaagaggaacaaaaacaaccagaagacaagaaaagaaagcacacagatgatatcaaagaagaaaaaccagttaaaaagttcaaaaacgagtcagaatcatcagcatcatcttctactgattcaattcctgcaactccagaaccagaattaaagccaggccaaagaaaacatttttctagaatagatagaagtaaagttaactttgaaaattcagtattacaagacaatacttacaagggagctgcaggaacttggggagaaaaggctagtgaaaaattattacaagtcagaggtaaagatttcacaaagaataaaaataaaatgaagagaggaagttataaaggaggtagtatcactttagctagtgggtcctataaattcgaagattag

SEQ ID NO: 4944 - DNA, 1185 bp, Candida albicans
  unsure (1027),(1036): Identity of nucleotide sequences at the above locations are unknown.
ggacaattgtccttcttgcgtcgtgttgggacacaattgccacaacgcaaagttgatgataaggaattaaaaagagaaaccactcttagtcgtgatgctacatttgatgagaaggaattagttgcctccaatgacagaaagatctgggaaaaggatgcagataactataacaaacaacatggctttgtcagtggcaattctaagacaccgtctcatgatagtagtttgaatgcaacaaacagatctgctacttctactgaatcaaattatgacagtggaaaaccatattcttcaagtgccgaaaaacagtcccaaggttcggattcttctgaaaagggctatttggcagctgccggtgcagctattggtggtgctgttggttacgcttttggtggcaaaggttcttccaaagaaaacgaggtggatgattcattgattgaagacgcagaaaaggttgaccctgctatttcaaaattgccaccacacaaagttgataaagaccagttgaagaaagaaaccactcttagtcacgatgcgacatttgatgacaaggaattagttgcttctaatgacagaaaaatttgggagaaagaaactgatgattataacaaaaaacatggtttcaccaatcaaacagattctttaattcaagaagctgcagaagttgatccatcgattactcagttgcctgcgcacaaacttaagaaccaagaaggtaaggaaatgaaacctaaagttgctgaggctaacccagaagaggtggatacttccgccattcagaattttagaaaattggaagacgatgttagtacttataataagaaacacgggcacattggtcctcaggaatccttacttgctgtagctgaagaagcagaccctaaaattctgaaattaccaactcataaaggtgacttcaatgagacgaagctggtaaatccagttggtgttgctgaaccaggtggagttcagaaattgccagctaaccatccaactgcgatgcatcgcgaagtgagtgagaatatcnagtccgacnaaacagtagatgctggcactatcccagatagccaccagatacttgatcatcaccccctccactgctgttggtacaggtgctgccttaagtgctggttgctgtgccgggctgggccgccgggaatttctgcccatcctcccccccgctga

SEQ ID NO: 4945 - DNA, 378 bp, Candida albicans
cagaagaaattatataataacgataaaaataccattaatttgattcatgcattagtgaaaatcattgataaacaacgatctcaacaacgggttttcaacgaaaatatcttatccaaagataataagattcaaacgttagaaaaacaagttcaagaattatctcgaaaactacatacattagagaaggggaatcaaaataaagttgttaaatacaattcattactgaaagaaatcaatcaattgactaaacaaaataaaatctatagtgaagatttacaaaaagtgaaaaattggactttggatactaagaataaatacaagattgaaatgaaacggaaaaatttggaaattgaaaatcggagaaatattaaagactaa

SEQ ID NO: 4946 - DNA, 855 bp, Candida albicans
  unsure (844): Identity of nucleotide sequences at the above locations are unknown.
agacattttaataaacgtacgccacgtgttccatttgatgctgatgattttagaatatctacaaactcccagggtgtcatagatgaagaggcgtacctcaagttatctttaaaacaagaagaattgaaaaactccattaaatcattacaaagtgatgttttgaatttgtcggaattaagtgctactagtgctggttcatttcttagacataaatacgaaaaagatttacaagctagtcaattgggtctgagtcatatttcggtggaagaacgtcatgaagaggaaccagacaaaacatcagatgttatggaaactgttttccaagacaaaaaacccaaacagtctaatatatttaaaaaattgttgaggaaaaaccatgatgatgtccatccaatagaaagaaccattcaaaaacaagaacaaattgattgggctacgttcaaatcggatatcaataggatgaactcactaacatcgcatgacaaacaaagtaggactaaaagagtagtaagacaagatggatctataattgttaagccattggattttatatctgagatcaacactaatgagactgtgggtcctgaagatgatgatatcgacttggaaaacgtgcaatatagtaaaatcgaaacatttatgctgaattacgatttgagctacgatttgaatgaattgatttctgacatttcaatcaaatttcattcttcagtgatcaatcaggtccgatgcattttggtgcatttatgcaagtttgacattattgaagaaacatcgaaaattctgcaacaaaagccaaaattatctgaagctcaacatagtggcactcttaacgccgaactgngtatccgctcg

SEQ ID NO: 4947 - DNA, 1062 bp, Candida albicans
  unsure (187): Identity of nucleotide sequences at the above locations are unknown.
cagttggaaaaggtgaaggagtggtatatgaaaattagaagagttggattgattttttggaaaacccataagtttaaaaccatagatccaagtggtcaaccaagtaggaagaggtgtttaagggattgggagttagcaaaagttggtctagaaaactcacatacttgggagacaaagaacaacgaantagtagtttctcatgaagaagccaatgccgccaaaaaggaactacttaaagaaaccaacgaagttaagatagaattgaacatgcttaagcgacagcacaaacttgaaattgaatccaaaaatgctactataaaagaattgaagtcacaaatgtctgcctccaaacagagttttgcacaagagatttcccgtcttgaagataagatcgagactctcaggttggaaaatgaatcgaacgaaaccgtttctgaaaatgtgaatgaagatggcaaagttgattttgacgagtttagtaaactttctgaagcacaccgtattcttcaaaaacagtatttgtcttcacaggaaaattggaaggctattgaatcgaatttatccctcaaagttgacaatttatcatcttctgtggagtcattaaagaaatccaaacacaaattgacacaagacttggccaaagtgaataattccatgcacttgcaattaaaggagatggagaaacttgaacaggataaaattaagttgcaagaagaaaggaatcagcttcagttgacggtggagatgaaagaaaatgaaattgtcgagatcaccgaaaagtttgaaaagttcaaaggcatatacaatcaagagagagctgcactcaattccaagattcagagtttgaatgacaaaataaaggaggagaagcgaccagagcgattaaatctaattcgagacaactcagttagttcagggtttagttgggataacgaaatcaaattgggcgagtcttcaaccacacctgcaataaatagagacttttctacattcctcgacaggaacatttcgctgagttcgttcactgagctatcttcaacgagccgctggaaggacaagcgc

SEQ ID NO: 4948 - DNA, 738 bp, Candida albicans
  unsure (653): Identity of nucleotide sequences at the above locations are unknown.
tctcaaagaaaattactgggtcgatcatttgatttagaaaaaaattttgataatttagaaaatttaactaatcaatataatgaaattaccaataagtttaattattattactacgaacaaattcagcagaaccaacaacaagatcaacaacagcaagaagaagaagaagaagaagaagaagaagaagagcatcaattgataccacaatttggattaaaattagatgaaaatattaaaaccaccaatgaacgacgacaatttactcgagatgaaatatttctaaacattaatgttaaacaagaacgacaaaatttattaaatttccgtaatgaattagatcatcaaatattaaatgatcgatcacaagccatgaaattcaatgaaaaatgtgatattgaacaagataaaattaaagatcaacaatcaattattgaagaattaaaaattcaagattctttaatgaaacggaaactggatgatttaaaacaaacaatttttcaaatacaaaatgaatttaatagtcaaattgaatcattagatcaacaaattagagaaactaaatcaaatattcaatcggatatgttacaattggaaagaaaattacgtgatgtcaatttgaataaaagtgtgattcaagaacaattgattggtanacgacaaaaaatggatgaagatgttcataatttaacgtcatttatattgaaatttaaaactaatattcaagaaaaaattgattaa

SEQ ID NO: 4949 - DNA, 1110 bp, Candida albicans
acgcggatttaccacccctgtgggcaagatgttgacgaatgtaaggaatgcttaaagcttgttgcttcttcctcacaattggagacttcatttttctttgacgtgtggaagcacttgcgtttgcagaccaacaatgcagacccaactataactgcacttataaaagagggtgacgataatttggcaaggattaaggggcaggtagaggcattaaaggacatcagccatgtggaagaagggcatgatgttacattttcatcagccatgcctgattttaaggagatggtcagtcaaattggtatccttgtgaagttatatgatcttgtgaaatctgacggcttagatattaatgtagattcattgaacaaaatgattgagttaactcaagtggttgaatcgttgtataatttggataccgaggtccattcatttgaaataactgtaccatctatatatgagtacaaatctgagtctatattgcaacagccaagtatagatgatggaggtctacagaataagttagctcaacgagaacgtgaagttaccgatttgaaactaaacatagccctattggaacaaaacatgctgtctttggcttcgcagaatacacaatacattactgagctaactcaaaaattgcagtctttaaaaaaagaggaagaggatagttcaagagtcatatctcagttggagcaggacaagaaggatttagttagtgagttaaatgctgtgaaccgaaacactgtgagtacaacactgtttgccaacttgaaatctcaacaagactacaataattcattgactattatggaaaaaattgttcatttgaaacgacttactaaaacgattgataaagagcaagtagatgattttgcttggttacaaccccaatctaagcgacaattttggacggaagccagctctgttcacaacttgtccaagagcttgcaatcattggctttgaatgctaaacctgtatcaattaacgatggtaatagtcataaatggactaaaaagaaagatctgctgaaatttgctgctcttgttcttgaagaaaattacaataaatacaaaactatgagaactaatttactttgttcggaaaaataa

SEQ ID NO: 4950 - DNA, 2229 bp, Candida albicans
gtggatccttccagccgcgtggtgaagatattgagtcaattacaaacagagtcacaacaattgactgatgatattgagaacctacactataaaaatatggatgaaatatatcgtttacacagagataagctctctatttcaatttacaataacgccaaggatatttacaaaaatttgaatgacttgcaacagtttaagaacaaacttacaaaagctagtttaaaggcatttaatactattgccaatttgcaaatgaaaatggtaggtgttaagactgagatgaagaaaataacaactgaagatgaaaccgccaccgaagattcaaaagtgggagatgtgaattataaaacaattagtaatgtcaagaagtatgaagactatttgtcgttgactattgatttacctttgatatttggattttcgcttattgaaaaaagaagacaatttgaatggtatgatttttactccaaagggattgtaaacaatgttagtgaacagttatcaacaattatagaacacgaaaaagtgtttcgtggaatatggttaaagaaatttggtactttattgtcactaataaatgatgatcctttgactccttctcttccaaacattgatgtcacacttgttggtaataggcagaataatttcagtatactttatgatttaaaaattgaaagagatgacattatcaattacatttctttgattgaagctaccaatatgtccaaaaactttgtcactttgttaaacaagaattttaaggatttgatagcatctaccaataatatgaaaaaagtcaccaaagtcatatcatctcttagcacgtataccacgaattcagccgatgataaactgaaatcatcacacgaagagggaactgaagaagaaattgattttgacttaaacttgataaagggattaaagtcaagaataaaaaagctagaaaatttattacaccaacaacagttcaagaatttaaacaactggccagttattaggaatgttcctagcatgactaatgataaccgacaaagtacaattattcaaccaacagtagtatcaccagccagaacaaaccctactcaattattgctgaggaatccatccaccaccaaggaaaatacaaccacaaatattcataataaccatcaacaatctgaagtattagattcatctgtcattgacaagcatcttgataatattagattgaaaaagttgaataatgaattgcaaacgaaaaataccgagctcacaaatcagatcaatagtaagaatgaaacgattacacaacaacagaaagagatggaacacatgaaattgaagactgaaaagagagttgatgaattaatgaaaaaattacaagaaaaagatgaggaatgtcagctgctaaaacaagaaaataagataaagtgtgatgaagttgagaatctcaccaagaaacttgaactcagtgataatcataataaggaattagaagcaaaaataactgaatacactcagaaagccacttcaaaaaccaaagaaattgctgatttaaacaagacagtttcgaatttgcgttctgagctaggtgatgctatgcatatgaaaaatgatcttttatcgaatctatcttccaaagaagccgagtttactaaagaacgcaatcaatttaacaatgatttgaaagctttgcaattgaaattggatgaaattaatgaagattatgaaaatcttatggaattgactcaagcaaaacaaaagaaacatgatttgataataaatgatttgaataatgtgattatcaatctaatgaatgatattaagaaaacattattgagtgtttttgaatattttttggaatactgtttggttttagaatctatggggttgttactagtcaaagaagatgaaatctacaaaatcaaacgtgtgaaaggattaaaatccaagaaatcaattggtgatggagatatgctgataatctccaacggcactccaagctctaaagttattgaggagattgagaatgaaataaacattgttaataatataccacctataagttctattttgccagatagttattcgtctggaaccgagagtgattcagtggttgataggtataatgaccaatcgatgaaattaatttctacattcaaccaattattcaagttcaacaatgaaaatgaaaatgaaaatagaattgatcatattttaaatacattggcattcaaaaacaatgtttaa

SEQ ID NO: 4951 - DNA, 792 bp, Candida albicans
tgctacgagttttttttttctttggttgttttggttttgttgttaccacttcatcaacaacgacatctaatcatggacacggcagaacgagcctacgaaaagtttcaaaatcaaatgattgcatttgacaacttgaagattgaaatgaacgagctagcagtggatctagaccaacaactatctgacaaacaatcgttaattctacaacaggaacaagatcataaacaaaaagtcaatgacttgactaatcaagaatacaagttaaagctccaggccaaatcattaaaggaaaaagaaaatgcaacaagagacaagttgaacttggcaatgcgctctttggaacaacagaagctgaaagtggaagatttagtgaagaagaaacaaagtttagttgacacaaagcaggacttggaatcacagataaaacaacttgaaacagccattgatcagggaacgagggagcttaataagtcaaatgacaatatgctgttgcaaatgaacaagaatctagtggagctaaacaaatatgaaatatacacaggtctaaaaattgaggtacagagtaatgaactaatgtgtttcaaattcttcaacttggatcccaatgattacgacagagagtttgctattactttgaatattggtggtagcacgtacagtatagagaacacaagtcccaagttatctgatgaaactgttgagcagatacaaggtaaattaaaccaaggtagacagcttagtaaatttttgaaagaagttagaactctctttaaagattttgtgcagtattaa

SEQ ID NO: 4952 - DNA, 2574 bp, Candida albicans
  unsure (2552): Identity of nucleotide sequences at the above locations are unknown.
taccttgaaagctttttattttccatgtcaaatttatcaattaatgaatcaaatgataattcaaatgtatccattttactgaataaaagtggtgctcaaagtagtactaatagtagtcctaatcttattgtttttaaacaacctgaagatttatcaattcaattacaacaacaacaacaaggaactcaagaagatacaccagaagaagaagaagaagaagaagaagagatggaacaaataacgcaattggaagttcaacaagaaaaccaaccagacactttatcttctagtccatttatttcacgtccgaattcaccccttgatgatataattagaccccaaggcacatcttcaccatcattgactattagagattcttattcttctcaagtagatatcaatatatctaatttacacaagagtttgaatgagatgagattatcaactgatccagttgacaacaacaacaataacaacaaagtcaacaaaaacaaccctaccaatagtgatatatctaatgatgatatcataaccatcgataatttgactccaagtagaatacaaccaaaaaacatatcgccatggagacaattccgccctacgttacgtggtagtccagaatcaacgccacggctgttgtttcaaaataaacccaatttgaaatttaataatggtcttagtcctactaatggtagtagagatatggttacaaataatattgctacaacaaccaaatcaagagaagaagaattgaataaacgaatagttaattataaaatccaattaaaattgatgaagaattttttacaagaattgattgatagaaataatcttgatcctcatgaatttcacacattattaagaagaaacaataacaacatcatgaataacgaaaacaacccattatcaacctcattgtcgcaaacttcaactttagaaattcaacatcaaaatttacaaattgaactagatgaagcacttgaattaaataaacaattgtacaacaaaatagaaactgcaaataaggaaatcagtgataaggatttgcaaatttctaattatgaatcaagaatcaatttaattaattattctgttgatgaattaatttatattttgatcaatgaatatgataaaaataattattcccacggcggcagcaacaccactagcccgggtaaagaaactttacaacaatccatatcggcacaattagaagttaaattgaatgttttgaaattagaattgatgactagattggatcaactgcatcaatataataataaaccacatgatttatttactccaccatacacatcatctgaatatggtgttagcaccaacaatgtcgctaataagaatgatttggaaggatatattcatattatcgaagatttgattaaaacggttgatgaattggaattaacttgtgaaaattacaaggcaaataagaatgaattacaaaatcaattagttgaacaaataaatgaatcgattcgaattaaaaataatttccaaattatgtccaataaatttaatcaattacgtcaatcattgagtgagaaagaaaatgacaagaatctagatgaatttagtaaaaacaatcaccagcaacaacaacaacaacaaatacaacaacttgagcaaaaattgattgagtatgaaaaatgtattacaatattacaagatgaattagatcaatacaagcaaccttccgataccaccaatactacgaacaacaacaacaataacaataacaataataacagatcgtcatattcatcgtacaataatcatcgcaatagttcattgaatgaattgaatttagtgaatgattatttacaattacaaacatcgtatagtagaatcaatgatgaattgaatcaggtaaacaatgattataagcttttgaatagttcaacactggagaaaatcaacaatttaacatcaaaattacaagaaaaatcaattgaattaagaaatcaaatggggttgaataataaattacaaacagaattgaatttatcattagataaacaacggaaatataatactgaaaggatacaaatgtcgtacactgttgattcattgcggaaagacaatgaggcattacaattgaaagttaataaattgactgatctaatgacaattgatagaactagagcagagagtaattcccaatctacagccacatcaacatcaacaccaactccacaaacggctccaactccagccccatcagcactagcaaccgtagcacgaactgcctcaacgacatcatcttcaacaacaacggtaaatactaataccaagacaacaaacgaaaacaacaatagcagtgctaatattgaattgggagtgaagaaaatctctattttagaatatcaatacaaagatttattattatatgatactaatcaattcaaaagattaattgaaagttataataaaatagctgatgataaatctttatatgatccgaaaatgaaatatgaaaaattattaaatcatataactgatattcataatagtaataggggtcttacacgacgggncaagaaggatcatcgggtgcgg

SEQ ID NO: 4953 - DNA, 516 bp, Candida albicans
cgtgaagaggaaaacaacaatttggaaagtgtggcaattgaagaagctaaagatgccattttaactctagagagtgaattggatagtttgaatattaaattggatgccgtgacaaaagaacgagatgcccttcgttcgataaatgttaaaaatccaacatcttcaaaggattcagattatctctcacaagcaaatgcagatttgagaaagagacttggtgattctgaacgaatcattagtgaaataagagagcaatcggcaaaatcggtgtatgaattaaatgaaaaaataagacaaatcactgataaaaagaatgagttggctttacaagtttctgtttctagtaaatatactgaattagcagaaacacgattatcaatctcacagaaatcactcagtgattgtcgtgaagaattggccctggttagaaaagaaattgaattttggagagaacaaaccagtaaatttgaatcacacttgtgtcttcaccacggccctggacgaaccgacgcttaa

SEQ ID NO: 4954 - DNA, 819 bp, Candida albicans
  unsure (41),(83),(249): Identity of nucleotide sequences at the above locations are unknown.
gcaaccagattaccaaagctttttaaaactgaaactgaatntgaattggagaaatcacgtttctttaaagagattgattctanacaggaattgatcgagttaactaaatttcaagctcaacaaagggccaccagaattgaacaattggaatcatatagtgaagatatcaagcaatccatgtctgaaactatcacttctcttgaaacagcattgtcagagaaaaatgaaaaattattagaaacacaaganagattaaagagaactgaagaggcattagacgctgaattacataaggaaaccgatttaccaaaattaagtgactcctcggctatgatagctgctaatggtagtggtatttctttatcaacgttatattcagagtataaccatttgaagaaacaattggtggtagaaagatctcaaaaacaaaaaatggaaatgcaacttgagtcatttattaatgaattggatgctagaaagccagttattgccaattaccgtgaacaaattcaattttatgaaaattccatgaaagagatgcttggtaaagttgaaaccataagatcagaaaaaggtgaagttgaaaaagatgccaagagattaaggtcaagagtagcagagaatgaaaatgaattggtcagtatgaaaagattacttaaagatttgggtcgtcaattatgtttctatttgattcattccaagattcgtgacaatagtgaaaacccattaactgcagccgaaaagaaatcaattgaaaaaatattgagtcaaactggtaattttgatgaatcttcaccacgggctagaagatccgcgtcc

SEQ ID NO: 4955 - DNA, 690 bp, Candida albicans
attgatgaccatgggttaatgattggtgatgaaatcaaaatggatgttgaaacggaagtaaagaatgataaccaggtcaaaccaaaccacatccgtgaatcgttaatggaaagagcacaaagattgagaaaggaagctatagattcagaaagacaaaacttgaagaatcaagattcaaacacctacagccagttagacttgatcctttctaagttgaactatttagaggtctcgttaactgggcttaacgggggagaagacgactcgcaaatactttcaattaacaaagaaataacaggattgaacaacgtgtttgctgaattgaaatcaacagttacagacacaaagcaagcagtagttgacttacaaaacgttttagtcaaacagtactcacaaatgttggattcaatagcacaattaaatcaaaaagtcattggtgaagttcgagaacaacattatggaatggaggagctaagcagaaaagttgatctattaatgaacaaccataaggaaattgcctaccaatatgaaaagactcgacaagacacacaaggagaagcatctaagctgggcaatgtcattgacaagttgttgaaatggattttattcccgttggtattgattttattggtattggtgatatttgtttaccgcctaagacatgacatcaaacattcaaaacttttgtga

SEQ ID NO: 4956 - DNA, 789 bp, Candida albicans
  unsure (757),(760): Identity of nucleotide sequences at the above locations are unknown.
gagatttcacccagaagaaatttgttgggaaaattttcagctttccattgggaaattttcaaaatttgcaccagaaacttttcagaaaaggaagaacgtatatttatattttcgaatcaatcagaattatcattcagggctcaaaataccaaattggcacaagtcaatgaaataagtagacaattacttgaaacaaagaacaaatttatagaaaaggaaaatgttgttgaagagttaaagagaaaattagcaacaacaagaagagaatgtattttacaacctaccatagctgctggttctggtggtggtgctacttcaactggtgccacttctaccacagattcaaacaattttgaaatccaacaattgaaagaagatttgagaattgctgaatctcaagttgaagaattatcaaatcttgccaaagctagtgaggctacattaattgattcaacaaattcatttgaacaatataaagctgattctgaaagtaaatatcaagctttacttaaagagaaggaacttgtggatgatgaagtgaagaggttgactgatttatacaatataacttcccaagatttgcaaagtgccaaaaccttacatattgaagaagtcaatgaattgaaactgaaattgaatgaatttaaatataaagcagatcaatatgatactatggagtttgattatcaagagaaaattgaatcaattcgtcgtgatcttgatgatcaaactaaactttttaatgatcggcacaccnatnttcttattcaccagccccagcaaatcata

SEQ ID NO: 4957 - DNA, 951 bp, Candida albicans
ataaacaatatcaatatactagacaacaagatgagctcgcctctgaatgaagcttcagacacatcaaattcatcagttcgaaaacgggtagttcatattgacccactagaaatcacacaatcactaggattccaaacgtttagaaaaggggcaagaaagccatggacgaaggaagaagattccaagttgtcgtctttagtagcaacagagtatcctaaacctattgatgtggaaaaagtaaactgggattccattgcagagactttgtttccggataactttagaaagggcaaggaatgtcggaagagatggtgtaattcattgaatccaactttacggaggggaaaatggagcaaggaagaagacgagaaattggtgagagcatttgaaaaatatggagcctcatggttaaaagtatcgcaagaaattgaaggacgcacagatgaccaatgtgcgaaacgatatatggaagttttggaccccagtacaaagaaccgtttaaagccatggtccatggaagaggatttgaggttgatccagcagataaaaattcatggcacgaaatggaggaccataagcaatggatttgaaggaaggccgtccttgacttgtcggaatagatggagaaagctcgtgacagatgtggttagaggaaaagccgatccattgatcaaactgcaagtagaaaatgtaacgcagaaaaatatggatgatgaatctaacgaagataatattttagaagttttgtcaaagaaacaacaggaattgacagaaagcaataaggaaactgaacccaaaaatagtaaacgccctaaaaaattaaaaagagaccccgatttactgctgaacacgccaagaccgacaagtgttaatactcctgccaacgagcacagtcgcactgaagtagagtggagatacacagtgccgcccgatgtcttcacaaccgcctag

SEQ ID NO: 4958 - DNA, 273 bp, Candida albicans
aaccattcatcgaccgccaccttattatatattttcaagatgcagatcaaagtcaagactttaactggacgtgacatgccacttgatgttgagcctcaagataaaattataagaattaaagaaatgatggaagagaaagaaggtatttcaccagcacaacagagattaattttcaatggttcacagttaaatgatgatcagactgttcaggaggcaggtatccaagcaggagcttctttacatttggttttaactttaagaggaggtaactag

SEQ ID NO: 4959 - DNA, 714 bp, Candida albicans
catatatatacaaatctacaagcaatgcaaattttcgttaaaactttgactggtaaaaccattaccttagaagtcgaatcttctgacaccatcgataacgtcaaatccaagatccaagacaaagaaggtattccaccagaccaacaaagattgattttcgccggtaaacaattagaagatggcagaaccttgtctgactacaacatccaaaaagaatctactttacatttggttttaagattgagaggtggtatgcaaatctttgttaaaactttaactggtaagactatcactttggaagtcgaatcttctgacaccatcgataacgtcaaatccaagatccaagacaaagaaggtattccaccagaccaacaaagattgattttcgccggtaaacaattggaagacggtagaaccttgtctgactacaacatccaaaaagaatctactttacatttggttttaagattgagaggtggtatgcaaatctttgttaaaactttaactggtaagactatcactttggaagtcgaatcttctgacaccatcgataacgtcaaatccaagatccaagacaaagaaggtattccaccagatcaacaaagattgatttttgctggtaaacaattagaagatggcagaaccttgtctgactacaacatccaaaaagaatctaccttgcacttggtcttgagattgagaggtggtttctaa

SEQ ID NO: 4960 - DNA, 891 bp, Candida albicans
tcgaattttatccaccatcacctacactattatctactctcttcaaatatgatatgttcaatatctggtgaaatagccactgatccagtggtatcaccaaaaagtggtgctatatttcagaggaagcatattgttaactacatagctaccagtggaacggacccaataactgatgagcctttgacagaaagtgaattgatatcattaaaagttaatgaaaaatccacagcaatagcacaaccttcaccgccagatccatcaaactcgtctatcccttcattgctttatacgtttcaaaatgagtgggatgcaatagttttggaagtgtttactttgaagaaacaattacagagtgctaaacaagaacttagtattgcattgtatagacaggatgcagctgtcaatgtagcagccaaggcaattagggaaagagatgaagcaagagaagcattagaaaagttgtcactgtcgataaatttatcagatgtaccagatacgaacactccacctgaagaggcggaacctaaaccaaagaaatcaaaaaaatctctgtcgaaaggaacgctggcaaaacattcaaacgataaagatagtgaaacaattgattctgagcaaattgagaatatagtacgggcaagagatgaattgttcagattgcacaaatcccagaaaatcaaattaccattcgacgtagacactttcttgaaacaaaaaggagttgatatccagtctatttttgaaggtgaaaaaatctcgaattatgtgtataataaagaaatagatacaatcgttggggtaagtcaagataaagtcatcaaacatttttcttgtggatggagcatccacaaagttgaatctcaagaatgtcaagttggtggaaataaacaataa

SEQ ID NO: 4961 - DNA, 444 bp, Candida albicans
agtaacgcggattgccactcgtggcgaatacttacatcttgttcaatttctcataatggtaaatatttattaataagttctgccccagaagaattacaagtatgggatttgtcaccattacttgtcaatgaaagtaatcgaccaattttgtatcgtaaatatcttggacatactcaaagttcatatattgttcgatcaacattgggttatttgaatgaagataatgatcaagaagaattggtattaactggaagtgatcatggatacatttatttttggaagtttactactggtcaattgattacaagaatcaaaggacacgtagggttatgtaatggggttgattggaatagaaatggaatggttattaaaggtaaagattatgggaaaatctgggccagtgttggtgatgataaattggtgaaaatttggggttccaaatga

SEQ ID NO: 4962 - DNA, 741 bp, Candida albicans
caactaatcaacgattcattcattcagtattccaaagtacccacaatgaaagttaaaactataagcaggtcttccgacacatatatacctgtgaaaaacactcaagaatcagcattacctcgtaacttgaatccagcattgcatccgtttgaacgtgccagagagtatactcgagcattacaagcaactaaattagaacggatgtttgctcaaccatttattggacaattaggcgatggtcatagagacggagtatattttatagccaagaattaccaagctactaatcaaattgctagtggttcgggtgatggtataatcaaatattggaatttgactgatcgtttagagactgctagttttaaagcccattatggaatggtgagtgggatttgcatatatgctaacaaaatgtatagttgtggggatgataaaacaatcaaaatatggtcagtcaatagtgatgattttgacattaaagtcaatgatgatgttgatgggatatatcgtaatcaacttggtggtgccggtggtggtgatgggaaaaccagtggtggattattgaaaacatttattggcgaacattcattcaaaggtattgatcatcatcgtgatgacgatttgtttgtcactggaggtgccacgatacaattatgggatgtgaatcgatccaaacacatttccgatttatcatgggtgcagtattcagcccggggctggaaccaaccgcgctgcaggaac

SEQ ID NO: 4963 - DNA, 1719 bp, Candida albicans
aggaatttgatttccagagaaaataaagtcaaagaagtcgatttagatgaaattattaaaaaaaagggcggattaaaagaagaaagtgatgatgaagaattagctcttgacgggtttggaatgggcgcaagcaaacaagaagaagaagaggaagaagaggaagaagaagtagaagtgccggaagtcaaagaggtagtagagccagaggactcagctgaagctattgcagacttctacgaagaatcttccccacaacaaactcacacttctttccagaccttacagttgtcacgtccagtattaaaaggtattgccgagctcaaattcactaaaccaacccctattcaatctgcaagtatccccattgcgttactcggaaaagatattgttgctggtgctcaaaccgggtctggtaaaaccggtgcttacatgatcccaattattgaaagattgttatacaaaccctcaacttccaccaaagtcatcatcttgacccctacaagagagttggcgttacaagtttacgagtttggcaaaaagctttcgcaccacgtcaacaacctcaacatcggtttggcggtcggtgggttgaatttacgtcaacaagaagaacaattgaaaacacgcccagatatcgtcatcgcaacaccaggtagacttattgaccatattcgtaacagtccctcattcagtgtacaggatatccaagtattagtcattgatgaagccgatagaatgttggaagaagggttccaagacgaattgacagaaattttgtcgttaatcccaaaacacaaacgtcaaactgttttattctcagccacaatgaataccagaatccaggatttgatccaattgtcattacaaaaaccagtgcgtatcatgattgacccaccaaaatcagtggcttcaaagttattgcagcagtttgttcgtatcagaaaaagagaccagctaaaaccagcattgttataccagttattaaaaggtgtgtccagcagagtggttgttttcgttgcacgaaaggaaacagctcaccgattacgtattgtgcttggacttttgggtctaaaagtatctgaactacatggtgcattaacacaagaacaaagattgcagaatgtcaaaaacttcaagtcgttggaagtaccagttttgatatgtaccgacttggcagcaagagggttggatatccccaaaatcgaattggtcattaattacgatatgccaaaaacatttgaaatctatttgcatagagtgggaaggactgccagagctggaagagacgggacatctatcacatttgttggagaatcaagccaagaaagagctattgtcaaatctgccatcgtcaacggcaaaggtgtagccaaaactgtcgactggaaacaagcggaagaaacaaataaacttctcgaatccaaggaatctgtaatagatgaagtgttagaggaagaaaaagaggcaaaggagttgcttcgtgccgaaatggaactcaccaaggcatccaaccttatcaaacacgaacaagaaatacattcacgtccaaaaagaacttggtttaaaggtgaagtcatggaacagctcactaaacatggtaagaaagtgaactccaaaaagagaaaggccaatgaagtgaggaaagatgaaggcagaagctacaaaaaaactaaaaccgatagaatgaaaatctctaacaagaaaaaaagtaaaaagtga

SEQ ID NO: 4964 - DNA, 1758 bp, Candida albicans
ctaatattatccaacactcttatgacacagagaaaaagatcatctcctgaagatgaccttagtaactcatcagattcagagcttgaatcacctcagttagaaaatgacgatgatttaaagacacactattacataacccccaaaacaaacagcaccgactcgtcatttgaaaatgtttactgcagagtaactagtcaaccaaagcaaccacagaaaaataccacgccattcttgagcttgttggacggaaatgagtctagtgaaaatgtgctgcgcagatttgagttgtacaatcaggtatgggcaaatcaatcggacaaaattcagtcaattttaaataatgccaacgatgaactattcaaggatttgatccaatttgtaaatctagaaaacttacaacaactatcagttggatatgtgcaattgacaacaaacactgccaataacttgagaatcttgcaggagttttatcaatacattcagagaaagtcagactacgactataaattaattactcttaattccaagcattttacatacaatataaaggcaacgttgcgagaagttgtcaaacagttttatgacacctgccagatagttgaggaaatgcacaggctaaactatgatcttgatgctattgatgattggttcgatgaagaaagattgtacaactcgaggttagttttggttttagaagataccaatttgattaacaatcaacttttaaatcaattactcaaaatattgctgtcatatgttggaaaatggcctctcaaaattgttatgggactatcatgtgaaacagtcagctcatggataaatggtaacttgactaatgaactaagaattgggattgaaggtcacaagtttaaaagtaatgacaataagagtttgggatatatcattttaaacaacttattcttgacaccagaattgacaccagagaatccattgttgattaatagtacattgagtacaattattttgaataggtttgaaaactcaaataattctatcgatgccttgattgccgagataaaattatgttatatgatttatttttaccgactgcccttgtctattcttattgcggaagagaaccctcaacctcaagaattgtatgcagatggattaaggaaactctcttcatttaaaaagtacattgaattaaagctacaccaaggtgaccgcagtgtcaaggatttgttaaataatgacaagtcagtgataaaactattcaacgaatcacgaagtaatttccggaaattcaaattagctgttatgaatgccatcaatatcatttaccaattacatcctaataaaccgaaacagaaatttgagctttataaattattaatcaatcataaattgctaaattcaaaatacttgtacgaactggtgaaaaacttgtccaaactatcagattcagttcttgggaaagtgcttattgggttgacagacaattgcacggagatacttgatggaataagtgacaaccatttaattcaactaataaaaggcttaggtgaattgtcagatttgagaggcgtcagcgataaacttcaaaattattttgataacagtatattaactacacctttggaatacatggtatttcatgaagtgttttccatggacggaggtctaatccaagagaaattcacgaagccaccattgtttgaagaaaattacgaaaacttgatgatcaacttgttgggaccaattctcagagctaccatagagggttggcttggataa

SEQ ID NO: 4965 - DNA, 330 bp, Candida albicans
agggttggcttggataattatgaaacctatttggccaatccgttgattgaaaatagtgtagaacaacctttgatgccaccaacattgactcatttgtttaaattgtacaaggaagcaccaacaactatcaatttatacgacttttatcaggcgttcaagtctactctagatgaaaaagaactctcattgcagttgtcaacaaatgaggattgggagaaattaacttatgcgtggtttgtccaaaattgccacgagttgatgcttatgggaattttacaacaaaaaccaaagggtgattttttggaaaaggcaatatggaaaggtatctaa

SEQ ID NO: 4966 - DNA, 2445 bp, Candida albicans
tactctctctacttttcttatcattacttcagaaaatcattcctcttttgcatatacacatacatgtctgaatcaccatcacaaccaccacaaaagaaacataaaccaacaactactggtccatcatcatcatcttcatccaaattaacacgagcgatatcagcatgtaaacgatgtcgaactaagaaaatcaaatgtgatcaaaaattccctcaatgtgggaaatgtgaagttaatggagttgaatgtattggagttgatctggttactggtagagaaatcccaagatcttatattgttcatttagaagaacgagtgaaatttttagaagaaaaactacgattacaagatagatcaggttttgttgatgaaggtgttagtagtacaccacctggcagcagtactattaaaaaaaagagtaatgaaatatcaattaatgaaccattaattaaaaatgaaagtcctttgattaatactaaacttgattcaattgcattttcgaaaatcatgtctacggcagttagagtacagaatagattatctgatccaaatattaaacctggtaatggtaatgttaatctaggacataattcaactaccacaaatgaaaatgggattgacattaataatgatatttctcgagcagtcttaccccctaaatcaacggccatgcaatttctacgagtgtttttccatcaatgtaattctcaattaccattattccatcgtgaagagtttttacgagattattttatccctatatatggagaatttgatgaatcaatatcacttgcctccaacaatactaaaattaataaatcattttttaatagtagtagtagtgatggagataaaaccccttgttggtttgatgtttataaatcaaagattcaacaacttttaaccgaaaatacccaaaatgatattcaaaccattgctaataatataatcccacccttgaagtatcggaaaccattatattttcttaatttagtatttgcggtggcgactctggctaatcatttacgttatcccatccatatttctgaatcatttagattagcagcaatgagattttctcaagatgttgataattcaattgatccattggaacatttacaaggaatattattatatgctggttattcaattatgagaccaacaaatcccggagtatggtatattatgggagaagcattaagaatatgtgttgatttagatttacaaaatgaattgaaaactaaatcgaaacaaaattttaatattgataattttactagagataaacgacgtcgaatattttggtgttgttattcaattgatcgacaaatttgtttttatttggatcgaccatttggtatccctgatgaaagtattaatactccatatcctagtagtttagatgattcaaaaattattcctaatgataattccactgattattattattataaaaaccaccaccaccaccacaatgatgatgatgatgataatgatgatgatgataatgatgatgatgataatgatgatgatgataatgaggacgacatcaatttcagttataaaaatgtttcgttattatttttcaaaattagaaagattcaaagtcaagtaacaaaaatcttgtatactaatgctgaaattcctcgagaatataaagatttaaatcattggaaacaatcaatattaatacaattaactcaatggaaacaagaattacaatcaaaattaattctgaaacaattgaattgtgattttaatgaaatttttttccaattaaattatcatcatacattattatatattcatggattaagtcctaaaaattataaattatctttgattgattatgaaaatttaaccaattcttcaattcaagtgattaattgttatactgaattattgaaaactaaaagcataaattatacttgggcaggagttcataatttatttatggcagggacatcatatttatatgctttatataatagtaaagaaattcgattaattaattcaattgatcaagttcaaaaaattactaatgattgtttattggtattacaatcattaataggtcgttgtgatgctgcaaattattgttgtgaaattttccataatttaaccatgataattataaatttgaaatatgcacccaaagataaaaagcatctaacagaacttaaaccagccaatagcattccttcttcttctttttcgtcttcttcttctttttcgtcttcttcttccacgtcatcatcgaaaatatcacgagaaagtctttatcgaattaataatggtaatgttcattccaatttatttcatttagtcactgaattagatcatttaaatccattaaccaaaaccaaaactatcaataataataatagtgatcattttgatataaccaatgattcttcaccacgcggctcgaaggaccaacgctac

SEQ ID NO: 4967 - DNA, 483 bp, Candida albicans
ggccggtatgttgcgattcccatggtgaacacagagtccgtaatcagtaccaccttcgatcaactaaacaacttggaaaagttgattgggacaattgaatttaagttgattgaaaaagatgttgtgtatggattacaacagggtaacaaggtattgcagaaattaaataatgagatgcaagtcgaaaaaattgatgcattaattgatcaattagaggacgagaaattaaaggtagacgaagttagtgagttattaggaggtgtcgatcaattgaatagatcagaagaagacgaagtggacaaagagtttcaaactttgcaagaagaaatacatggcaaaatcaaacaggtcacagaagaagaagaagaagaaagcaatttacctaaagtaccgaacaccaaacctatgccagaggctccaagtaatgaaatcgaagaacatacaccacaaaaggaaacaaaacatgaaccgattgccatataa

SEQ ID NO: 4968 - DNA, 690 bp, Candida albicans
atagtaaacatgtggggatatttttttggaggaaatagccaacaaaagaaagatttaccaaagaaggcaatagtggaattgcgagaacacatacaaacactaaacaagaagaagaaccatttgcaacagcaaatggatgaccaagatcagttggccagaaaatatgttagttcaaaacaaacaactttagctaaaagtgctttaaaaagaaaaaaggggtatgaatctaatctattaaaagtggaaaaccagattgaaactttggaaacacaattaattagtatcgaaggagcaaacttgaacttggaaactatgaaagctatgaaacaaggagcaaaggccatgaaacaaatacatggggaatacgatgtagacaaagttgaagatactatggatgaaataagagaacaagtagagttagccgatgaaatcagtgaagctatatcgaggcccgttggtaatgaatttgttgatgaagatgaattggacgaagaattgaaagagttggaggcagaagctaaagaacaagaacaagaacatagagtgccagctcaaaaggcaaaaccacaacctgtatcaagagaagaagagttaccacaattcccatctgttaacaagaaagctccagtagtagaagaagatgaagatgaagaagcattgaaagcattgcaagctgaaatgggattatga

SEQ ID NO: 4969 - DNA, 3270 bp, Candida albicans
ggaaccagaaatatcatgaaagttataaagaaaaggttcttcaaacccaaggaagaaacgttgccctcagatgaagtgccagacccacaatcatctgcagaacctttacatagtttgtttgttcccgatgagtctgaagaagaagaaacaaccacttctcccaaaaccaattttgaaaaagatataattgcaatagttggagacatttcccctataataatgaaatatttatatgcaaagtattcacagaaacgtaatggagctaagtttgctgttacagagttattgacaaaccctcctgatgttgaaaagttgcaacaggattcgattgcttcgcagtctgccaaacgaccacacacaatcgtatcataccaggaacctccaaataagaaagtgaatattaacccagatagtgcaagtagtaacaacgaaccgttgatgtggcaaaggctcattggtagtttgaatatacaggcaatggcaacgagaccgaccatgaaaccgttgaaataccaggaaaagctaaaacttaaacgaataacaaccaaaaactctactatggcaaatagtgcaatagtaagagtgtatcacaacgaacgagaaattggtcggattcccgaagattggaccaggattcttagtcctttatttgacttaaacattgctgtatttgaagcatcggtattggaagaaacaaagtctcggctatcaactggagactcgtttgtaatagaaattgaggtctacttgacaaactctagttttgcaaaaaatcttgatgccactgagaatccgattgatttgaagaaatccaattttgactactcaaaggagagtgagagtgaagctgcactaagacttcgacaatttgcaatttcaaacttgtttgataggcttgcaatcaaacccctcaaagttaatgatgacacagaagatgaagaagacatatcaagccaagaaatcaactctggtgacgtagagcacccagttcctgaaattaacctagaccagatgaaagaattttatcaatcgaataaccaacttaaaatattagaaggattgcctgaaactactaccccaccaaaagaaaattttgcccttgatttaagaagttaccaaaagcatggtttgtcgtggatgcttgcacgtgaaaaagaattggatgttttggaaatgcttctgaatgaggataaactatcttcacaatcaagaaaagaattggaaaacttgggcaccatgaatccactttggagaaaatacaaatggccatatgctacagaagcaactcaggatccaacacaaaaccagactgaaaaatacttttatgccaatatgtataatggcgaattgtcgcttgaaaaaccagttataaaatcaagtttaagaggtggaatattagcggacgagatgggattggggaaaacaattgccacattggcattagtaaactccgtgccgtacgataactttcctgaacccaagtcggacaggccatacgcatctcaaactacattaatagttgttccgatgtcgttgctttttcagtggaagagtgagtttgagaaatgcaataataacagtcgccatgtttgtcgtcttcattatggtgaagaccaagaaacaaacctagcgtggtcattgtgtaaccctgacaactccaaaatccctattgttatgataacgacgtatggtacagttttaaacgaatttacaagattatccaaacgccgcaattctaagggcgaattgcccaaggtgggtttatattcagtcaagttcttccgtataattttagatgaaggtcataatattagaaatagaaatactaaaacggccaaatctgtttatgaattacaactgagtcggaaatggattttaacggggactccgattgtcaatagattggatgatttgtattcgctaaccaagtttttagagttggacccatggaataatttttcatactggaaaacgtttgtaaccctacctttcgaacaaaaaaaaatatcgcaaacgttggatgtggtaaagtctattttggagccaatatttttgagacgaaccaagctgcagaaaaagaatggtaaaccattggttgaacttccagcgaaagaagtggtgatagaacaaatcaagtttaatgacgacgaagagaaattatatcagtggttcaaagaccgtgcatatgcttcttttgctgaagggataaagtctggacagttgttgcgtagatacactcagatattgactcatattttacgtttgagacaggtgtgttgccatgttgatttgattgggggtgcacatgaaatggacgatgagataattgaagccgaacaggatgaagatatgagaaagtttttgacatcaattaaagaaaaccaaattcgatttgcaaatgacactgacgtcaaggaaaaaatgtataacttgtacggaaaaatcaaagaagaaaacgaatgttctatatgcacacaagtacctatcccatatagtgagatggttgtcactccttgtgctcatacattctgtttatcgtgtatcttggagcatttggatttccagaaagagttgaaaaaggagaaactttgccccaattgcagactgccgatctcaaagtaccaattattccgaatcagaaaccaacccaccaagggaaacgaaatcaggtttcatacccagaaagacgctcctgattatagttttcaattgtatttgtacgatcctaaccgatcttcttcaaaaatacaggctttggtaagacacttgaaggcactacatagccaatcgcccaatctgaaagtcattgtgttttcgcaatttctgtcgtatttggatattatccaaagcgagctaaaactagccagtgaagaatttatagtgttcaagtttgatggtagacttaatatgaatgatcgtacaaaattgttggaatcttttaatcagcctttggaagatggaaaagtagccatcttgctcttatctttgaaagcaggtggcgtgggtttaaatttaactacagcatcaagggcatacatgatggatccgtggtggtcaccaagtatagaagaccaagcaattgatagaattcatagaattggccaaaacgagactgttaaagttgttcgattcattatggaaaacagtattgaaaccaaaatgttgaaaattcaagaacgcaaaaagcaaattggggaagctgttgccgccgaagaagaagaaagacgaaaacgaagaatcgaagaaatacaaatcctttttgaggaatag

SEQ ID NO: 4970 - DNA, 1671 bp, Candida albicans
gtaattgatagtccaaagccagcaagccagagaattgttgaagaaagaataagaataaattttgggtgtcgcagaatcaacggcccaaaatttgaagttttggtttccgaaaaaaacgagtatctgaacaaaacaaaacaaaccaagcaattgattagcaaatcacaaagaatggcatcaatcgaacaagaagatctttttaatgttcaagacgatgaagaggaagatattgaagaagaagaagaagaagacgaagatgttgaggatcaagtacaaatagaagaaatgggggagaatgtggatgccctgcaacaagaagaacaggaagaagaagacgattctcaaatggatattgataccgaagatcaacaacaacaagaggaggaagatgaggaggaagatgaagatgaggaagataatgaggaggaggagaatgaagaagaagaaggcgatgaagatgaagaaatggcagatgaagatggcgaaaatgaagacgaggaaggtgaggaagaagaagaagatgaagaagatacgagcaataaaaaggataacaaagatattgaagctactacaaaacctagtctagaaaagaaatccaatgatgaagaaaaaactgaaaccaaatcaactcctgaactgcaattgccctcggctgccattgatgaatccaaggacaatgatggtgatattttcttaggtgacgatactacaaaacaatctgacattccaacccccaaagattcaaatgttgacaattctacatctagagaaggagaattaccagacgactcaaacaagaagaataaggataaaccaattgaacaaccaagaaatgaaaagggccaagaatcagaaaataccaaacttgaagaatcaaaagataaagaacctttaatagaagacggccccaaagatcaaatacaggaagatttagatacaaatttatcatttcgagaacaaatcatacgcaaagcccaaagagccaccgaatttgatattatacctcaagttgccataccatatgctaatcaatgtcatactttagcattcacaaagggacccaaatggatattaaccggaggtgaagatggattcatacgtaaatatgatttcattgcttcaattcaagggaaatctccattaacaatggcacaaaaacataatttattttccgattcattaactaatgctggagtaatatgttcatattgggaaaatgaacaaccattaactagaaaacaattaatgaatcaaaattcaaaactaaaagatagtgatttttccacggggtcagttagttatgaaccaaaaattaatccggtatatgctttagatgcggaaaaaaatgggtattggtgtttatcgggattattatcaggtgggatatctttatatactatgagatataatgaaggtgcaattcattattatttccaccaaggtagtaaagaaaataaatcacgaggtcatactgatgctatatcagtgataaaattaaatcaagagcaagataaatttttatctggatcatgggataaaactatcagacaatgggatttaaatactgggagaactgtattggaatatactgggaattctggtcaaatatcaaatattgaatttagacctgacggactcttcacctcggattggcaggccgcgctatatcaa

SEQ ID NO: 4971 - DNA, 4026 bp, Candida albicans
  unsure (14): Identity of nucleotide sequences at the above locations are unknown.
ttccaaaacccaancagaccttggatgccccctttgatgtccacaaatcagagtcggaacatagtattggagaaacaaatgaattcaaaaatgatttcccacaatattcttgaaacatccattaatactcagttagtatccccaaaagacacgaatgatttgaaactgcaaactgatttaaatattgaaaatgaaactgaccgacctgtcgttgatggaagtgatcccgttccctccaaaaaattagatgcgcctacatcagaagccaaaatgtatagttcgcctttatccctcaatacccatgactcgatagcgcaagacactaaaattacacaggagaaaagaaatgagccaagattagtcatagatcgattagtgcttactgatttcaaatcctatgccggcaaaaaagttattggcccgttccattcatctttttctgctgtcgtaggtcctaatggaagtgggaaatcgaatgtgattgattctatgttgtttgtttttgggtttagggcatctaaaatgagacaaggtaaactatccgaattaattcacaattcaggggatcaaagacctgactattgtcaagttgacattcattttcagatggtagtggatgatttggtagtgcctcaaaaggcagatgtggtacctgactcggagttgattatatcgaggaaagcttttagaaacaaccaatcactgtattatattaatggaaagacaagcagttattccgaagtcacaacattacttaaaaataagggtatcgatttagatcacaagaggtttcttattttacaaggtgaagtagaatctattgctcaaatgaaacccaaagcggaaaaagagaatgatgatggattgttggagtacctcgaagacattgttggaacctcaaaatacaaaaagttgattgaagacagtattgtccgtatagatgagttgaatgacatatgtttggaaaaggctaacagatttgacttggttgagaaagacaaagatttattagaagaaaagaaagttgaagcacttcgatttttggaactagaaaagaaattaataaattgcaaaagtgttcagtttcaaattgagattctggcgcaccaaaagagaatagcagccaaacaagcagaagcagatgcaatcgaaaaagaattagaggaaaataaggagtccaacaaagaaattcttgaaggaattgaaagtgaacttagcacccaaaaggaaattgaacgcgatatcaaagttttgtcagcggagattgacagtttagggaagaataggaaagatattagtaagaaaaatgtttctttggaagaaaagtctaagaacaacgccaacaagttgaagaaaatccaaaagagtttagagaacctgaaacataccgtgagcagctctaatcaaaaactttctaattatgctgttactaccgagaaattcaagtctgatatcgatcgtttaaataaggagttagaaactgaagaagctagattaaacgatataaggtcgagcttgactgaaaagacttctgagtttacaaaagaaatacaactgctacagaaaagtttggatccatgggattctaaattgaaagaaaaggaaaatgaaataaagttagctgaatccgcgatagagatcttgcgtagtcaattgaatagcactacaaaccaattggaagaacacaaggaacgtttgattcagataaaaaagttggggaaagacaaagaggttgaatacagagaaaacgagtccaagctcggcaagatagaggaacagattgcgttaggcgaagagcaatgccaaacagctaaaagtgccttgaacaatttcaaatcacagcttatgagcttccgacaaaagacacaggattcggcagcaattgtccacaatacccaaaacaagaacaaagtgttaactgcattactcagattggcaaattctggtagaatccaaggattttacggtagattaggggatcttgggactattgatcaaaagtacgatgtggcgatctctacggcagcaccagggttagactcgatggtcgtggagactgtcgagacagcacaggcgtgtatcgaatatctacggaaaaacaaattggggtatgcaaactttatttgtttgaataaattgagaaagttcaacttggcgcctatccaaactccaggtgatccaagtagtatcaaaagattgtttgatttgatacagccatctagctccaagtttgccccggcattttacagtaaagttttcaatacattagtggcacctaacttgaacgaggccaaaaaagttgcgtatggggccaagagatggaaggttgtaactctagatggtaaagttgttgacacatcaggtacaatgtcaggaggtggtaactatgtatctcgaggagctatgagattaagtgattcttccaactccaacgatcaagccattactgctgatgagttagaaaaaatgaacacaaagctacaagaaatggaaaatgagtttgagcaaatgaattcagactataatgagaaaattgccatgttgaacaaattacaagttcttaaaccagaaacagaatttgcgatatcaaggttaaagttggacatacagtcattagtgtcagaaaagaaagaggttacccagatttgtaaaaacttgatagccgaacagcaaaaattggaagagaacaacccttttgaacaacagttactttcaaaggaaaaagagttggaagaattagtaaatgcaaaaacacaaatcaaagagcaaatgagtgggtttgaacaaaagatttctgttttggaacaaaagattatggatgtaggtggtgtggagctaaaagttcaaagctcgaaagttgattctatcaaacaacaaatatcaattatccacgagaaaacatctggcgatcgtatgactgtgaaaaaattagaaaatgaaattaacagacacaccaaattaattgagtctttaactactgaacaagaagaagctgaggctgaattggagaaaataaatgaacagcagcgctctcttttatcaaaattagaagaagtgaattcaaaactcaaagaactcgaagatgaacgaaacgacaaagaagataacttggaaaaaatgaaacacgaccttgaagaaaaacaggaccaaatcaataagttcaaactggtggagattgaacttttaaacaaattagaaaaatgcaagggaaccctcaagggtttgaagcaagccatcgaacagaataaagaggaattagatgctttggtcataagggatgttgaaccatatattagttggctcgatgaaaccgaacaaaagaaatataatggtgctttgattgacacattatccgaagaggatatagcagatgttgatttagaggctgtaacaagtgagattgaagaattggagaattatatggcaaatgttaaagttgatattgaaatactaaaagagtacggtgccaagattgttgaatacaatgacaagaaaagtgatttgaaccaggcagttgcagaacgtgacagcaagaaaaactactgtgacgacttgaaacgcaagagactagatgagtttatggttgggttcaatacaatctccatgacattaaaggatatgtaccgtatgataaccatgggtgggaatgctgaattggaattggtggatagtttagatccattttcagaaggtatattatttagtgttatgcctcctaaaaaatcttggaagaatatttccaatttgtcgggtggtgaaaagactttaagttcattggcattggtatttgcattgcacaagtacaagcctacaccgctttatgtgatggatgaaattgatgctgcgttggatttccgaaatgtttccattgtggccaattacatcaaggaaagaactaaaaatgcccagtttattgtgatatctttaagaaataacatgtttgaacttgcacagcagttagttggtatttacaaggttaacaacaagactagtagtgtttcactagcaaatatagaaatgcattaa

SEQ ID NO: 4972 - DNA, 885 bp, Candida albicans
catttattagcattggctattttagcatatggaaatagtatactaccaaaagatcatcccctattccaaaacttaaacggatcgaacccacttttgtcaatagttgaaagatcattatttaaactacttcggaaatcgtctcacacaaccactggtaatttaactgatcattcacatatagtttacaccattttgattattacgattttgcatttgggaaattatgatgaatctcaggcttgggtttattcctcaatactttgttctcagattcaacatgttggttggaatgtttcaactgattatccactggaatcgaatgacctatctaaattcagatcaaaactattttggaattgtttagtggtggaaaagatatcggcatcgatgtttggacgtagttcaccaataaatttccgacaacttttaacagatttctacacttcagaaactaaagatatcaatgaacttgttttccaattcaatagtaaactttggtttatatatgataagtttatgggacaggtttattcatttcatttcaacacccagaataaaatgctatataaaaaagtcttaatgacggcaactcaaagtctccaagatttccaacgatttatgaatcaatatttgccattaaatgaaactaaccttgacaaccagaatataatcttactacatttgactttccatgtgtttttattgttaataattcgtccatatatgacaatgccagagattgctgggtccatatttcagaaaagtatatctattaccgaacagtgtcatattcttataaaccaatataatagccaatttggcaatggaatgacaacaagatggtacaattgtcattatggggttttatcgtttcaaatttcagtg

SEQ ID NO: 4973 - DNA, 672 bp, Candida albicans
catttgaaaccagtaacaacgaaatttttaatgggtaaaaaaaacaacaaatttttaaataaaatatatagtcaaccattaccaataacgttaacttctagcaagtataatgtttcactacccaatttgtatccccataatccaatttcatggatttggtatataataaggtattgtcaaataaatatagtttatcaagtgcccgaattacacaatccacctctctctgtgatttatgagaatcaaatttttaaagtcattgatcgtgaatccatgttaaaattatggagacaaggtttctttgggaaaggaatactatccagatctgagccaacatgggaaaaacgtaccatcacaaggttgaatttagataattccaacaatggtaaagatttggcgatggaggatatcaccaaaaagagacgtgaagaacgaaagtttttcaagttggaacgtgctagatttcaagaattggaattgaagaagagacaaggtataattactgatgaggaagtggaagaaatgaacaagttggagattcaattgactgaattacggaagattcaagttcgatttgataaacaggaaaatggtgaagtaaaggagatccatattagagatgaagatgaggacattatcactgaaaatggagaatgtcttcacgacgggtag

SEQ ID NO: 4974 - DNA, 534 bp, Candida albicans
aactcaaagcaaccattacacaaacaaatcaaagaatcatcaccacgacgccgaatcaaaaagacttcattgttaccaccaggtgaattggacaattactggacaggaccggatgaggataagatatatacttgtacttacaaaaactgtgggaaaaaattcactcgtcgatacaatgtgcgaagtcatattcagacacatttaagtgatcgtccatttggttgtcaattctgtccgaaaagatttgtcagacaacatgatttgaatcgtcacgtgaaagggcacattgaagctagatatagcaaatgtccttgtggtaaagagtttgctagattagatgcattaagaaaacatcaggatcgaaatatttgtgttggtgggaataaaaatgttattagtaaacccacaaagaaaaagggaactaataacactcaacaacaattgcttaaaacagatacagtggttgagaggatagaaaaacagttgctacaggaagataagagtgttactgaggagtttttaatgttgcaatag

SEQ ID NO: 4975 - DNA, 327 bp, Candida albicans
tcacagatgtcagcaggtattccagtaagacttctaaatgaagcacaaggtcatataatatcaatagaattgataaatggagatacataccgtgggaagctattagaaaatgaagataatatgaatttatccctatacgaggcaactataacgcaaggcaaatcggggaaagtaagtcatatggatcaagtgtttataagagggtcaatgattagatttatatctgtgcctgatatattaaagaatgctcctatgtttttcatgaaacctggagataaaccaaaaccaccaataaggggtcctccaccaaaaagaaagagagtatga

SEQ ID NO: 4976 - DNA, 576 bp, Candida albicans
agtttattagttggctataaaagagttgttgttaaagattatgctgtaaattctgtatgttatggtgctaaattaatgattccaggtttattaagatatgaagaaggaattgaattatacgatgaagttgttttaatgactactaaaggtgaagccattgctattggtattgctcaaatgtcaaccgttgatttacaatcttgtgatcatggaattgttgctaaagttaaaagatgtattatggaaagagatacttatccaagaagatgggggttaggtccaattgctcaaaagaaaaaacaaatgaaagctgatggtaaattagataaatatggtagagtaaatgaaaatactccagaaaattggaaaaaagattataaagatttagatgaacaacctgctcctccaattcctgaatctaaattagttgctccagaacctcaattaccaaagaaaaaatctttgattgaagaagttgaagttgatattgatgttgaagataagagtgaaaagaaagaaaagaaggataaaaaggaaaagaaggaaaagaaagattccccagagaacaaggaatag

SEQ ID NO: 4977 - DNA, 303 bp, Candida albicans
atcatgtcatcaaaagaagattatatcattaagccagaatcggtatcaccatccaatgatacatctcaatggccattattattgaaaaattatgataaattattagttagatcaggacattatactcctattcctgctggttctgctccattgaatcgtgatattaaatcatatgtatcatcaggggttataaatttagataaaccttcgaatccatcatctcatgaagttgttgcttggattaaaagaattctacgagtagaaaaaactgtagtattgcccacggcggctggaaatcgcgag

SEQ ID NO: 4978 - DNA, 1074 bp, Candida albicans
  unsure (1066): Identity of nucleotide sequences at the above locations are unknown.
tacccgactactagctccagctcattattgtctaccacgggtggtaaacagtttcaacaatcttctgcattattaccatctggtacattgcctccttcgattttaggcacatcatcatcactgcatgtttctgctttacgacaacatcagaaaaacaacttgtccatttcttcccatttaacgttatttagtctaagtgggaacaactcttcacaattgcagtcgcaaggatcttcgtttcaacaatctgaaactggcgtggatgataccaaacgatcttcaaaagaatcaacaaccatcttcaatgatttattgtttcatttaacttctgttgatggttcaaatattaatacattcttgctatctatattgaggaagatcaattcgcctttcactttggatgacttttacaatttattgtacaatgatagacaacgtacattgttggataattcgaattatcagaaccgcattgacaagacaattgttagtccaagtgacacagatatgacggtttccataatcaatcaattgttgaattttttcaaaactcctagcatgttggttgactatttcccaaacatggaagacaaagataacaaattggcaaatataaactaccatgaattacttcgtacattccttgctatcaagattttgcatgacattttaattcaattgccaatcagtgaggatgatgatcctcaaaactacaccattcctagattatcaatctataaaacctactatatcatctgtcagaaattaatagcaagctacccaagtgcatccaataccagaaacgaacaacaaaagttaattcttggtcaatcaaagcttggtaaattgatcaagctagtgtatcccaatctattaatcaaacgattaggtagcagaggtgaatcaaaatacaactatcttggtgtaatgtggaatgcaaatattgttcaagaggaaattaaacaactatgtgatgaacatgaattgaatgacttgaatgagattttcaacagtgataataataatccgttgttttcacacacggcggctggaaggaccattgtcnggccaaat

SEQ ID NO: 4979 - DNA, 2577 bp, Candida albicans
gccagcctcgttgtcaagattctgagctcagatcagacagctcaaaatcgaaatagaggtggcgatgattcatataatccacgactacagcaacagacgtcacaaataccttctactggcccagatcagggacaacaacgagagcgaagccaggaacaagaactggatcacgagcaccaacaggcgcagcagcatctacatcagtttcaacaatcaaacttgacaccttcaacaacggcatttccaagttcaacttcgatacccactttttcaaagcaggatcagggataccataaccaattcagttctccacagagtagttatcgaaagatagggaattttgctcaatcatcaaatgcaccatttcttaacgaaccacatccaatttatgccactaattatcaacaaaatgtacctctgcagtcacagttccaatttgattactcaagtccttatatcggacaatcacagtcacaatcacagtcacaatcacaggcacagcctcaaccgcatccacagccacaaacttatcaacaactacctcattattcacaggcatctgtatccctgctaccccctacctatcaagctttccattcaatgcatgaagcatcatcagcagataatgattctgccaccaatattaccactcctcagaaaaggaagaaacaaaaacgactggaatctgtaacatcaaacacaggcgaaaacgaattgaaacaattagcgctacgatcgtccaatataccactttcagagttggcacagaaggtaaaacaattagaaaatgatagtactactaccagtgtcagtttggaacaatcaaaaatgaaagaaaataaagaaactcaacgacagttgtttggaatggtgtggttattaaattcatgtgacctagctccaaccgctgttatccccagaaatagaatatatgccagatatgtgcaagtgtgtgctgacaacaatttagcaccagtttcacctgccagttttggtaagctagtaaagatattatatccaaacattacaacaagaagattaggtatgcgaggacaatccaaatatcattattgtggtattaaactcacaggtgatgaaaatatgcaactgcaattgttgaactatcaacagaaacagaaacaccaaagtcaagaacagtataatcaacaagcacaagtaggatcaagcacatcactggctggacttgctggtcatcaatcgcccatgtcgtcatgtaactcatcagtttcgtacgaggaatcaccaggacctataatatcgagggcacacacaccgtcattttctccaataaatacaccaacaatatcaatgtcaaaatctttgaatgaccaacttccactgattctgcacatgaagtttatccctaatttattctacttgttaaacagtaatgtggctacgagttccaatccccatgaaccaatacaattgccttcgatatatccctatttatcaaaagatgccgatcatgatattgctgacacattgtattcattatacaaagtccatgttaattcaatttttgaggcacttcgatatatgcaattgaaaaagttattttccagctttagtacatttaataatattttaactgcaccagtcttgaaactttacacaacagagtctttagcggaatgggttatgaagtgtgatttgatcatgtataagaaaatgatccgaatgttgagtaagctacagttgcaactcttgataccacaggaacagttattacaattaaaacaaattgctgatggatatattaaaactttatccacttctttaatcaattctaaagtatcccaaaattttgttatgatgaaattgaaattggccaaacattttgtcaatttgttaaatagattaattaaagttatcgagacaggacaaccagcatccagaatattgaatgacgacaacgaaaaaaataccatgacccaagactggatgaaattggatattcatggaataatttgccgtgagatgccctgtaatgataataatattgacacgttgacctatattttaacaggtgaggttgttaatttgataaaagtaaaactggacaatgaacaagccccaacaatgagtgattttgccaattatatctccaatttaccttcaagattccctgaagtgaacacaagactatttttgttattggcatctaacttgttgaccacttgcttaagggaaatcagtttgctgggtggagaaggatttggggcttggtggattgttagatgctggatagatgaatatttggcgtggtcttttgaagttggtggatttttccaagacgatttacaagaaattgttgctcaacaacaattgaatgttcaattaccaccaccatcattatcatcattaccgcaaactcaacaacagaatccagttatacaagaagagactggtacacaggaagagtcatggggtaacattgacttgttagagacatcatttgattttgacgccaagacatctcaaccatatcaacaaccaagccatactgaatctctcttgaattttgaaacaaatattgataatttattaaattga

SEQ ID NO: 4980 - DNA, 993 bp, Candida albicans
tttagtgagacaataacattacaagtaggtcaatgtggtaatcaagtaggattacaatactggcaacaattggcaacagagcacggcatacaatctgatggatcatcaacaccctatcctaaggacatcaatgatttacaactacaagaacttaacaattccgggtcatcacctcaactgtatccacaacaaaccaaacccaatgggaaatatcgtaatgatcatccagaactttttttcactctttcagattctaatacatataccccaagatctattttgatagatatggaaccatcagtcattgcaaaaagtacatctgctttacccatgtttaatcctcgtaatgttcatttgagtaatcaggggaatggtgctgcaaataattggataaatggatataaatatggtacagaggaagaagaaactttacttaatttaattgatcgagaagtcgataaatgtgataatttatcaaatttccaattatttcatagtgttgccgggggcacagggtctggagtggggtcaaaaatgttagaagtgataagtgatagatatggtcataagaaattattaaatacattttcaatattcccatcaaatgaagatacatcagatgttgttgtacaaccttataatactattttaacattgaaacgattaattgactatagtgatgcaacttttgtcttccataatgattcattgaatagaattgaaaatatattatttaacaacaatagcaatatccaacatgacgataatgacttgtttttaggagcaaataaattgattgccttagtttctgcatccgtgtcaaaccctttaagatttcctgggtatatgtatagttcaatggaatcgattgtttcaaatttaataccgaccccagatttgaaattcttgacaagtttcatagctccgttcaatactcaaaaacacaactatttgaacgaatacgatatgttattggaattgtccaatgattga

SEQ ID NO: 4981 - DNA, 408 bp, Candida albicans
ggggatattgaattcaccaccaagatctcatttgtgccctggggtactcgatccgtattagttgttcatgggaaaaaatctccgtatttgaagaatactaatttggaaggaattcaagtaacaaacaatacttcaatgatagatgttttcacgaaaattctaaaacaatttgatttattaattaaaagaaaagcttatcttaatagatattatagtagtgtggaagaagaaaatgaagtaatggagatgtttaatgaatctcgtgaaagtgtcaaatcgataatagatgaatacaaagcttgtaaagagataacctatttagatgatgatgatgaggatgacctagaagatggtggtggtaatggtaatggttataacaatatagatgatgcagatatgggtatataa

SEQ ID NO: 4982 - DNA, 1497 bp, Candida albicans
aaatacaataggaaccttgggttaaacaatatttggcgagctaggttttcacatcttgaacgaaatcacattattcgagcagcaaaaaatcccgtgaatttggatatgagtgcagtttctgcagtttcttgtcgtatggaaatcgatcttcgagtgggtaccagttttacacgtttgttgactgatcaattgagacaaaaggggataattgaaaagaatgaactagcttcttatggtacatgtcaattcccgacattggggtttgttgttgatcgatacaaacgagtcaagagttttacaccggaaccattctggtatattgagattgaaactaggaaagagaataaaaagacaattttcaattgggttcgaggtcattttttcgacaagatgtatgtggttatgctttatgatcgatgctgcaaaagtggagaatttggaaccatatcaaaaatagaatcaaaacggaaaccaaatttccgtccattcccattgacaaccgtggagttacaaaaagattgtgctagattttttaagatgtctgctaagacggcgttggcagctgctgaaagactttataacctagggtatttgtcgtatcctagaactgaaactgacaggtttgccaaagaaaccgatttcaagagcttactagaggtgcacaaacaagatccgcgatggggaagctatacaacaaagcttttgaacgaaggtttcgaaactcctcgaagcggttctcatgatgataaggcgcatcctccaatccatcctatcaaatatgtttctttggacaccctaaacaccctcgatgaaaagaaagtgtatgaatacgttgtgcgacgctttattgcctgttgctccaaagatgctgttggtacgcaaaccgtggtgactttaaaatggggagatgaattcttcaccgcaagtggattaatggtgcatgaaaaaaattatttggaagtgtatacttacaaaaaatgggaaagctctaaacaactaccgaaatttacagagggagaacaggtcaagttgtcgagtggaatattgaaagacggtaaaacaagtccacccaatcatatgaccgagcccgagctaattgcattgatggatgccaacggtattggaaccgatgctactatcgctgaacatattaacaaaatagagactaggcactatattaataaattgaaaaaggggaaaaatgaatatattcttcctactcctttaggaatggggcttatagaaggccttgaaaaaatggaatttgaagatgtatcactatcgaaaccatttttgcggaagtcgttggaacgatcacttgaggacatagcaaccgggtcccggccaaaagtggatgttttgaatacaacaataggcgtatatgttgacgcttatagtgtttgttctcatcagatacttgttttgtgcaatgaatgtaggagaattatacttggaaatagcagtaacaacaacaacaacaataataataatacgtaa

SEQ ID NO: 4983 - DNA, 1527 bp, Candida albicans
gagtgggaactaatactcaaatcaaacgtaaagatgggtcttatagctgtaaaaatggaaagcagtaatagtttctccaaacaaatcaactcacctaacaaagtccagaaacctaagagacaaagaaatagagtccccgtatcatgtctagcttgtaaaaagagaaaagtgaaatgtgataaaggtaaaccagcatgcgggggttgtgtgagaaatggggtaggccatttatgtcagtatattaatcctccttggatagataacgatgccagtggaggagggtcatcaccattggcttcatgtcaatctcttctgtcaccagtgaaaatagaaaccacaagtgaatataaacaactaaaatcccagaatgaaaagaccatttcgaaccagaaaaaggaaatagaaaacctaaagagacaactacaggtactccaacaactatcgccccgcaatagccaatcagcaaatagtgaaagtcgagatgagagcactttttatttaggcaaagatatcactattctatccaaattaagtccatttgctgttcaaccacgagtcacgatggagatactaagtgagtatactgttttaaattcgcgagtcttgtctttcccagtttgccttgatatatattcttgggtaaatataataaaactcgatccacaattaactactttgtggttcaaaatcacaaacttacaaaaaatgtatcacatgtataaaattaacaaattaaaaaatgacaattcggccaagaaattagcaccgtctcaattaaagaaaacttcatccaaaataaatgaaatcgattttacttattcgtttctgccaagtgattcgcaaaatacagaacaacaaccattaccacttgcatcatcaacatcaaacaatcacaaatgtccagtcatagaatgtgatttcaattttatgggagatgaggcccaatcacaaacgccgagtcctaaaagaaatgtgacgagtagtaccctctcttcaacgactcaaactcaagatgattcagagaaattacaatgtcccgtttttaaacccgatatacataataaatcaaagagtctacaacagaaattgcaatctttatgggaatcaattttaaatttgactcgtggttcaactttaaattatcgacaacttgtatttcttttggatttttatttcaaaagcgaaatatttgaaagtaaaactttattgttgttctataaaacagatattcttaatgtaattcaaaaggggctagatggagaattaatactcaatttacctaaaggattggatgaagatatatattaccagttgaaaatcagtgggatttatgtgtcgatgatcgcggtaatagtagaagaaacgctcacttatttaagaaatgttcttaaatgtgaagttgtcgatgatataactcaaagtttcaatgttatattcccacaagaatatacctatttggggacctggggcccaacaaacaaatattctttaatattaatgaaggattttttaacttccgaagaataa

SEQ ID NO: 4984 - DNA, 897 bp, Candida albicans
tcccaactacttgcagatttactgcttaccaggaagacaccacctaactgccagggccaaggcattacttggaagaagcatacataccgagcccacaatgaaggccacaccatcgaccaactaaaacatgtccttagcctcaacccgaactttagatttgcaggaaactttgctgacccattaacatcgttctttagtctcatccccccagcatgggccaacaaacagttggtggacaccttcttccagcacatctaccccgtgatccccatcatagacgaaactgactttaacacctccatcaatagagtgttgggcccacagatcgacggacattacataaactcgttccctagtatcgggtcagccgacgacctaccgtttttggcattgttcttgttggtgttacgaatctcatacatgtacacacccggtgcatgtcccgtttcctacgacacactccgtgctgcagaaaccatcatgaaagagtttgacattaccaaaacccactcgctcactgccctccaggcagaaatcatgcttaggttctataaaatcgtggcaccagaactgtacacccagagcaactatgtccaagtaagtgtgggtgtccttatccaaaactgctactcgctcgccttacatcgagacccagagtacattggcgaacacaaccccaagcaacagcatttgcgaagaaaaatatggcacctcctactacgcatggaggtgatcgatagcgccattttccaaaaccatcttatcgtcaacccccgacgcaagttaatacaaaatccctcaacttatcgaccaagcaccgccaatggagcaaagtataatgaaaaaaatctggcggcaccaccgacttgttcgtggctgttggcccaaacttgttga

SEQ ID NO: 4985 - DNA, 2961 bp, Candida albicans
ctaaactacctgtatcactgtcccctcatatttaacaaaaccatggaacttgaagctagtgactccaattcgttttctatgtctaccaacgagactggtaaagccaaccctaatgttcaaatcgtacaagatggtaaagttgtcaaaaaggttcaaaaaaccagacaacggagaatcttgtcatgcgtctattgccattcgaaaaagatcaaatgtgataggcaaaaaccatgctctcaatgcaccaaattaggcatggaatgcaagtactttattaatgaaagaatcagccgtggtggtaagaaatctagcagattaactgcagatgagaagaaattgagaggattgatgaactccgccaatgagaacaagaaggcgaaacaggaatctgttgaaacagcaaagagtcaagatacacaatcactgctgtcatcgtcacccacaaactcatcaactacgtcaactgcaaatccacttgccccatcttcaagcattgcaacgagtattgaagaagtcgagcaacaacagtttgacactgctcctaatatcaaggattatactgcaaaccctaaccaaagtcaacaggaacagcttggcattgaagatgaaacgtttaaaacttccctgggattggatatatcagtgagtttgttgggatttctgaataaacctgaagcaagctccaattcaaacagccttcgcagcttcaccgcaaacgtcgaatcacccttttcaggtgctgatccatttgctattggaggtttaattcaatctcctatggtaaatcaagcaacaaatagtatgacaagtagttatttcaatcacaatttcacaacacaggcaactaatcacaataacagcattaatggtgcaaataatcaaatcaatttcaactcaagttcgtttccattggctaatctggatgtctcaattacattttcaagccatgcaaattcacctactatgaacttttcagaaagattacaacaacaacagcagcagcagcagcaacagataccacctcgaccagagtcagcctcaattgtgaaaactcaaccgcagagctcaactttgtacaactcgttaaatggatataccatcaatacagccacttcagttaactacttgtatgggacaaatacttatggtgaaaattcaactatactcaatgatattactgagtatttgccaacagataaagatcggtcatttgaattaatcgatagatacctcaattcagtgcacttgttgttgccaatagtggttaatatgaaagaatttttagtccaacacaaattatattgggagatcaaatctagaagagattcaactacagcagatttaaataacccccgtgttgagtcacctggatcaagtcatcatagtggagatggtggaaatgaaccaatgccatctgactcaaacttcaattacattcaattttataccttatatttgcctattttatatgcctcaactatatcggaatttgaagaatatgacaatttgttattaaatcaggagattcacaaatacctcatggggttcaagatttgtaaaaaatactacaacttccccgagggcataaaaactattcctttgttattgggcaatgtgattattcaaagtacttcacccaatccatcaacaatggaaatggcacaaattattagatatgccaaatttttgcatttccataaagatccatggataacattaagaataaaggatccagaaatcattaaattcagaagattattgtggtgggtcatatttggattagatgctttatcttcccacaatttttgtttgccaccaaactgtcgtagtgatgatttcaatgtattgatgccagacgaagaagaattcattggaggcgagaagaaactaaacgtttcaatcgtttccatgaatatcaagtttggctatgatatactattgagcgaaatcgtttatcacttacacaacggtttgtgtgtcaacatcaattgtcatcagatcaaccaactaaaacaatcaatattaagctatcaagaacaaatcaagaaatatatatcgaaaatggataaatattttcaactgaaacaaattttcgcagatactctcaaccacagccctatccaattactaaatgttgtgaattttgtgaaaattcattcctggagttttctagatagggctttaatgctattgcataaaaaaatccttcttggtactccaaagaaccataatcataatgatgaaattgaaaatgaaattgtccaattggggttaaaggagccggtgatgcaaatcagggcaaatgaaaatccgttatcattatgtaaatttgaagatacttatggtcagatattagaagccaatataattaccaattttaataattcatctatatccctattgaaatttggcgatttcgagaattttagttatggcgatttggccaacaatttgataccatctatcttacacaactttaatgatttcttgctctataatgacttcatcaaatttgggaagttcaactggttcatcaaaagaaccattccaatcgattcggtcattttgttaatgataattattagcgttaaattcaaataccagtttatcacgacggaagaattgagcacttataaaaatctcattaacagtgtcatgtatattatcaacagaaaatggtttaaaaatgaaaaatacaaaaggatgttgagtctcacgaatatgacctgggaatatcttttgaaaaaatttgatgtaaatgatgttattgcttttgacgtaaagaattctgagggtgcaaaagatttagtgtcagtaaatattatggacacactgcaattgaaggagaaaattttgtatgatttgcgacacaattttattgatgttgttgattattgcagtttttattcaagtttggaaaatttattgaatgaattgattaaatatatagagagtaaataa

SEQ ID NO: 4986 - DNA, 762 bp, Candida albicans
agacaatcgatcatggatgagacaaatagtccaggcaaaaaagacaatcggtctagtgcatctcctcaaataccgaaaaaacggtctagagtccgacaaccattgagttgttcagtttgcaggaaaagaaaactgaaatgtgatcgggctcgtccttgtggaacttgtattaaaaagagtattgtacatttatgtcattatgaagatgataatcgacctcccatcaaccattttctaccccctgaacaacaattacacccaacccacattgacaataacggatatataataaccgaccaaccaccgccaatacattatcaagacccatacaacaaccacaaccacaaccaccatttccagcagcagcagcagcagcaccaccacaacactaataatgatagcaattttgacccatcacttctgcatatacaagcaaatggacataatcagtttcagcaccaaccattatcaagtcattcacctcagggtaaccatcaatatttgccaataccgccaccaccaccgccacctccacaactgcaacaatcacaacatcctccttctatttctccagcggggtataactctctgataaagatgtcgcaggcacaaatctccattccaacgccaccaccggccacaaaatcatctacttcaacatcaaatcacagtagtccaaacagaccccctacttcatcagggcaatctagttaccacaccaccactaccaaaaattactctaatttcaaacctagcacagtt

SEQ ID NO: 4987 - DNA, 747 bp, Candida albicans
cagcagcgaatcccagtgtctggtacatacgatgaatttaaagccgcaggagaaaatattgattttcaaagtactatcttgtccagatttgacatgatttttattgtcaaagatgagcacaatgaaggtagggacatatcaattgctcaacacgttatgaatgttcatactggtggaagagcacaagatttgttacaagaaggggaaattccaatagagaaaatgaaaaggtacattcagtatgtcaaattgagatgtgccccacgtcttaccgcagaagcatcagaaagattgtcatcccattttgtgtctattagaagaagattgcaactcaatgaagcagagatgaatgaaagatcttccattccaattaccgttagacaattggaagctatcattcgtataacagaatcattagcaaagttgcgtctttcacctgttgctactgaggaacacgtcgaggaagcaatcagattattcactgcctccacgatggatgctgtcgaccaaggacttggaagctcgaatgatgttaccttgaatgctgaaatcaagaaagttgaacaagagttgagaagaagattaccaattggatggtctactgcttataagacattgcgtaaagagtttgttgattcaggtaaggctagtgcttctgcattagagaaagctctatatataatggaaagacacgaagtgatcaaattcagacaccagagacagaacgttttgagagttggtgtttaa

SEQ ID NO: 4988 - DNA, 1290 bp, Candida albicans
  unsure (1080): Identity of nucleotide sequences at the above locations are unknown.
ctacaagtcatgtcttttgaacgtccggaagtgttttctgcacatgtgttacctggtgaagaaccagctgaaaattcctacaatgagattacaaaagctttccgttcatttattttagaatatagaattgattctcaatttatttacagagatcaattaagagaaaatttgctcattaagaattatttcttaaaggttgaagctgaccatctcattgcattcaatgaagagttgaataaaaaattaagtgatgaccctgctgaaatgattccactttttgaaaatgccattactgatattgctaaaagaattgcttatttgtctaatgacgaaattcctcaagatttcccaacttgtcagttaattttatattctaaagccaatgagacctcaataagacatttggattccgatcatatagcaaaaattgtcagagtaagtggtattattatttctgcttcggttttaagttctagagccacacaagtgcaattgatatgtcgtgcttgtaaacacaccatgaaaattactgtcaaacatgggtttgggcagatccaattaccacctagatgtctagcaccacataactctgatccaaattccacagaagagaaatgtcccaacgattcttatgtcatcgttcacgataaatcgacatttgttgatcaacaggttttgaaattgcaagaagcaccagatatggttccagttggtgaaatgccaagacacattcttttacaggcggatagatatttgactaatcaagttgttcctggtactagagtcaccattgtcggtatttatgctatttaccaatccaaacaaagtgcaagaaataactcaacctcaaatgttgcgattcgtaacccatatttgcgtgtattaggataccaaactgatattgataatggtgcaaatggtcaaggtataatctttagtgaagaagaggaagaagaatttttaagaatgtcaagaatgccaaacttgtacgaaacatttgtcaattcaattgctccgtcaatttacggtaatgaagacattaaaaaggcaatcacttgtttattgatgggtggttctaancaacatttgcctgatggaatgagaataacaagtgatattacggtatcattgttggggaaatcctggtaccgccaaatcccaattgctttaaatttgttggagaaaatcgtccccatttccgtgtatacatccgggttaagaggtcctctgcaacctggtttgaaaagccttcagtttccctccccctcccccaaaaacatccaaaagtag

SEQ ID NO: 4989 - DNA, 444 bp, Candida albicans
atattaatacattacaatcacagacattatgaggtatgtttgattcaatattggctttttctttttttgcatttcaggatactaacaacacgctttttgtttttgtttagtgaacttatagatagaccccgttcagaattaactgaattagaattgaaaactttagaagaatatgaatttaatcatggacccatgtctattttgaataatgcagtcaagaatgatagtcccataataatatcatgtcgtaataatcataaattgataggaaaagtgagagcttttgataggcactgtaacttggtattagaaaacgtcaaagaattgtggactgaagacatcaagaacaacaagggtaaaaaaatcaaaagtatttccaaggagagattcatttccaaaatgtttttaagaggagattcggtgataatcattttaaaggcataa

SEQ ID NO: 4990 - DNA, 939 bp, Candida albicans
actctccacttgttgtttgttagggttattcttctctctgggaataaagtatatgagatgtgtatacaaccagattctctcgaagacgcatacaaaataccgcgtcctgtccacagagaagagttcactcaattatcgccatcttttttccaaacagcgacatttcaattggaaaaaacaaatgaaaaaaataacatagaagaaccaaaaaaaaataaagcgttcttaaacagtaaaatcatatataaagatctttttgaaattagaaagctttcaaataactttgttaatacatcacatccaacgtgtactgaaacaatgaatgaacaaaacgagttttcggatgaagaaaatttcaagttctttggtcttgggggttgtaatgaagtgggaagatcatgtcatattatagaatacaaaaacaaagtgataatgttggattccgggatgcacccagctctaagtggacatgcatcatttccttattttgatgaatacgatatatcaaaagttgatatcttgttgattagtcactttcatgtcgatcactcagcttctttaccgtatgttatgcaacaatctaattttcgagggaaagtatttatgacacatgcaacgaaagctatctaccggtggcttatgcaagattttgttcgagttacatcaataggtaattcacgatccgaaaatggtggcggtggtgaaggtagtaatctatataccgatgatgatatcatgaaatcatttgaccgaattgaaaccatagattatcattccacgatggagattgatggaataaggtttacagcataccacgccggccacgttttaggtgcgtgcatgtattttattgaaataagaagtctaaaagttttgtttactggtgattattccagggaagagaaacgacacttgcatgcagccgaagttcaccattga

SEQ ID NO: 4991 - DNA, 258 bp, Candida albicans
gacgttcatggtgattcagttccaatgggtacattaaaatctgctttattaagtaaatatgcttctcgtaagggaaccgatcaagaggtgaaggtatataatccaaaaaattgtgaggaattgataattgggtttaaaggcttaaagattgctaaagttttgggttcgttggctgaagagcaattacaggtattaaagaaaatcatacaacatgaactaagtgctgagaattctaaaataacagagctcactgaataa

SEQ ID NO: 4992 - DNA, 297 bp, Candida albicans
aaagaagaggccgatgacataaaggaggacaatggtgaaacagatactactcaaaaaccaaacgagtcatctataaacgtgttaaaaactggccaagtggtgtctggtgtattggtgtccaaagattttaatttgaaccttttgcaattacaggatttgcacgaattcactcaattgtctacatcaatagttaaatcaaagatgcatttgataataaatgcggatatttcgtcgatggtttggcatcttgagcaaatgtttggttacataaatgttatcaatgatgacgaacaataa

SEQ ID NO: 4993 - DNA, 708 bp, Candida albicans
tttcttttcttgttcatcgaatctgatcaaaacaacagaccaatcaatcatatatatttaaagatggctcaagaagttcctacattcaaattagttttagttggtgacggtggtaccggtaaaaccacttttgttaaaagacatttaactggtgaattcgaaaaaaaatacattgctactttaggggttgaagtccatccattaggattccacaccaactttggggaattgaaattcgatgtttgggatactgctggtcaagaaaaatttggtggtttaagagacggttactatattaacggtcaatgtggtatcattatgtttgatgtcacttcaagaatcacttataaaaacgttccaaactggcatagagatttagtcagagtttgtgaaaacattccaattgttttatgtggtaacaaagttgatgttaaagaacgtaaagtcaaagctaaaaccatcactttccacagaaagaagaacttgcaatactacgatatctctgctaaatccaactataactttgaaaaaccattcttgtggttggctaaaaaattggttggtaacccacaattagaattcgttgcctctccagctttggctccaccagaagttcaagttgatgccgacttgatgccaaaataccaacaagacatggaacaagctactgctttaccattggctgatgaagatgaagctgaattgtaa

SEQ ID NO: 4994 - DNA, 468 bp, Candida albicans
ccagatctagacatcatgccgaaatattactgtgattattgcaagtcatatttgactcatgatacaatgagtgtgaggaaatcacatttacaggggagaaatcatattaaattctattgtgattattacgaagcaaaggcaaaggaaacaaatatatggaatcctctgagtataccctatgaaatcactctagagaagttgaatcgatatagcgatgcgaagaagtcgaatggttcatctgaagataatatggatatcgataaaaaagagaatagtctggatcacaataaaggaaatgtcgttaatcacagtgatgctggcaatgacaacgatgatgacgatgatgagatgatatttttgccacctccgcctaacttgtctggattgcctttgcctccaccagcggtatataacaatcagaaggaatatcaaaaggctatattaagacaaacactaacgaagagctga

SEQ ID NO: 4995 - DNA, 1314 bp, Candida albicans
  unsure (1110),(1111),(1116),(1146),(1187): Identity of nucleotide sequences at the above locations are unknown.
cacagtgcagtcatggcaaaaagagttgcagatgagcaaataacgaaagatggaatgccaaattattctgatggtgagccagatgccccagccatagcctcatctgatgtcttatcccgaagaaagatcttgaaaccaaaaggaagattaggctcgaacaccactggtgctggctcgaatgcatttggtgcaattaacaagccaccgcaatctatattttcctttggtggtagtggaaacaatgctgcatcgggaataactccttctcaaccagctcaatccagtaacccatttaattttgcaaacaaaccagaatcaaataccgtaaatactgcatccgtagacaaagacaataagatcaaagcattaaatgagaactttattcaagccatcaccaaattgaatgtgcctaatacaatagccgatttcaccccaattgcacagaaatatattgactattacaaaagtatactgaaaaatgagactttcctggaaattgcatctaaagaagtaaaagaaccggttcaaccacccccaacaagttcatttcaattcaagccaagtaatgtaagcgctccatcagcagctgctacagttactccgttttctttcaaaccttctgcccaatcttcagagtctaagtcaaacggtcctgttttttcatttaactccaattcacaacaacaaactaccactaaaccagcattctcgttcaatacaccgtcatcatcaattacgggatctactacaagcgctcctccaacattttcaacagaaccagtttcatcttccgttccaaatgaggcatcaaagtccgaaaccaaaagggaattgatcaacttagattcagattcagaatctgaatccgacaaggaagactctaaaaccaaagaagtcaaagttcaaggtcctaagtttaccctcacatccaaccctactaccaaatcatcaccatttacatttgaccctaaaacattggccaaaaaaaatgcaccagattcagatgatctggaagatgatgtagagatcaagggtccaacttttcaattcaacaagcccattcaagatagtgtttttaaattgacgtccaatagtgccgataatacttcnnaattngatgaaaagaaagaagaagacgaggtgaanagtacaccattatgtggtggaaccactcaagaacaggatcnagcaacaacactgaaaagtctctttgggatttggccaaaacaagggaaggtgaaactaaggttccaattttgtttggaaggtctctttggctcaaaaggggaacccacactaacacaaaaccattga

SEQ ID NO: 4996 - DNA, 1998 bp, Candida albicans
cagaaacaaaaaaagacaaaaaaaagagatcatcatcaccaccaccacagtccatcaatctcatctattcatatcttccatcaatccgccacaagtcaagaagtaatagaagcaccaaaacaatcaatgccagatagaaaaagatcattaagtccaaataccgagacatcttttaataaccaaaactataatcaaaactcaagtgaatcatcaaataaattatccaatggttctttgaagtttaaaccttcaactactgcaacggcaaatgaatcctacaaatccaatcagtcaacaacatactctccacgtggaagaaaacaagaccaaatcgataatgatatagatttagatggaccattattaactaactttgaatcatctgacaaaagaaaacgtttgtccatacaagggcaccctccagcatcaggaataccacgatcatcagtttataactcagaatcgttgccacagaataaattacgatcatacctgataatatgtactgatttaaagactagtgaagaggaattgaacaatgatttagaagttcgagtgacaacaaaggacaattataacagatcaatcggagttagtgatgttgaggattcctcaatgagtcgtgatgtctcaccatttgttaacttgccacatgcaccaaactctgatattattactggtgcggcaaagtacaatgatgagtatgatgatgacaaaattagtgatgggggtagtgttgtatataatgaaggagcactagtaatgcagaaggagtttggatcattgtaccaagatgaagacggaaatcttatacgtcctccgtttatcaatttagatcctcgtgaaagatatcaattgttacagttgaagcgatcaattgaattatctgaatccttacagaagcggataaagtatatgatcaatcccaatgaaactaatggtaaaagaattccaggaaccaataaagtggaaatgtcaactcaaacacatgatcttaattatttgtcgacaaaattaaacttcaagaaaagatcaccttcattatcattcgatcgaactgaagtgtctcgacctattaaaaaaccaaaaagaaaaggatttgctatgaaggagtttttgtatgatgttaacgaagaaaaaccagtttcttcaacatcttctttgaatggtgctttgggtagcatcagcaaaccaaaattcaattctcaaccaaaaacacaagacaaatcaatgacacaaataatatctcgtgaggatgaggaaccaagtttcaaaacttttggcaacaaaactggtcgtgatcgtgaaacttttggggtcattaataatgccaaattaacattagatccagaatacttggaaaagactagctcgagttctatatcggatataataaaactaaaagagccaaccactttggaaagctccaaaccaaataaaccaacgactggtccatcttgtgggtttaagtttgatatcaagaaaaatgattttgaaagtattattaatgatcggaaacaaaaccaagaaatattggcaaaatctaaattggctaatgaaactgttccagagaatgtgaagagcactgacctgaaccaaagtgccaaacctggtttatttggttctaaacccgtaccatcacaagaagctcccaaaaagaaaagaaacttatctgattctgagagtgatgacaaaccaccagtgccttcttttctgtttggatctgctaatacctcaaagtctgccactccttcactttttggtaacaaggaaaagagctcaaccacaacttcattgtttaatataactaatccgaagtctaatgaggacaaagatacagctacgaccacaaaacctttatttgccaaactttcaactgaatctgaaaccattttcgacaagccaaagtttacttttggtgcaccagcttcttcaaataaaccaacttttagttttggtaagaccccattcttaccacgggcctcgaaggaccgcaca

SEQ ID NO: 4997 - DNA, 762 bp, Candida albicans
aagacacgagaggacaaatcagaagctccaaagttcgtgtttggatcgtctaaagcaaatccatttacttttggggcttcaaacaaccaaggcgattctgcaactactccaagctttaattttggatcaaattcatccaacaatgcatttctgtttggttctaaaccaacaggagcatttaactttgcccagaaacaagaagatcaaaagaatgaaacatcatcaacagtaacgacatcttctagctcgtttggtctgacaaaaccagcatttgcatttccatttggtagtgcaaaaccagaagataagccagaggagaagaaaaatgaagaaactgtacctgaagaggaaacaggtggtaagtttgagcctgtggctaagttatcgaatgaacaggttgatagtaagagtggagaagaaaatgaaactgcaaaattcactatacgttcgaagttaatggaatatgactccaaaaattccgagaatccatacacaaataaaggtattggagaattgaaggtgttattcaatgagcaaactaaaaagtcaagaatcttaatacgtgcagacggaagtttgagagttcttttgaatactttaattttgtctagtgtgaagtatgatagtattggcaacggctctttgattcgtgttcctactattgacgccgatgatagctcgaaaatcatcacctatgtgatcaaagtaaaaactcctcaagatggggaacaacttttaaaatgtattaacgaattgaaatag

SEQ ID NO: 4998 - DNA, 1044 bp, Candida albicans
cgcggttccttccagccccgtggggtgaagaattcgaagattacatcaccaagcaactttcccaaaatcaaattttctggtcgtttgagagtggtgttggtgccatatgaaaacatttgctttatcgggagatattcgctcaagacatcagtaaattcaattataaataacgaaaagtcagcggtgcaggaagcgtcagaacaaatacaaattttgaccaagtatcaaaacagctttgaagagttggctttcaaattcactagacagctatccttgcatgatttgacggttgaaaaagatcaattactagagaaactaaaactgagtaaggcctacgtgtgccctaatttcaggcagcattatgttgagtatcttgatagatatttgttgtcacaagaagtggaaaaattggaacgattgatttctgatgaaaacttggaattgttacctgattatgaacaaagattgcaagttttggaagcaatgggttatattgatgaacaacacaacgtagtgttgaaaggacgggttgcctgtgaagtgaattctggatgggaattgattattacagaattggtcttgaacaactttttgggagactttgagcctgcagaaatagtggcgttattgtcgtgctttgtgtacgagggaagaacccaagaagaagaaccacctttaatcacaccaagattggaaaaggggaaggcaaagatcttggaaattgcggaaaagcttttgaaggtatatgtcgaaaaacaagtttctttgacactggaagaggaagatttcgtggagagcaaacgttttgcattggctaatgttgtatacgaatgggccaacgggttgtcatttaatgaaattatgcaaattagtgttgaagcagaaggtacaattgtgagagtaattaccagattggatgaaatctgccgtgaagtgaaaaatgctgccttaattattggagactctacattacacttgaaaatggtcgaggcacaagaaaagattaaacgtgatattgtgttttgtgcatcgttatatttatag

SEQ ID NO: 4999 - DNA, 2208 bp, Candida albicans
gaaatgataattgaagaggtaccgacaaatgatccattggtggtagacccaacaactgttaccacatatgaatgtccagaccttaatgcagaagaaaggagacaaaatttgaaaacagatctattgaacccatcaccagaaattaattgggagatcttggatcttgtcaataaaccattagaaatcaatcgagagaaaatcattgacaaattagtgattaatcctgagcgattgagccgtacgcaatttagattcaagagatctggtattcatggacacatcactgggtaccaggaagaagtcaatttgaacgaattagaaaactccaacacttcgctaagcatcaatcgtgggtacagttctaaaagtgagagtcttcgaggaaacaccagttttttaccatttcaaccaggagggttaatccaacaagcagcaactgaaagagaacccaaagattcaggtttaaatttgcatagaaatgaacatggactatttgatattccaccaggatttgtgcgtgggctagaagtaggtggaggaggaagtggaagtggaagtttggatatagaaccagcttcttccgaagaagaaaaagatagtttggagggggttcacatttctgctgcatctgaggcagcactcaataaatctacaattctagatggcgacgtgtcaaagccgaagccgacagtaccttttgataacaaggaaattgaaggattggtgccatttgattattccaatttcaagtataccgacaagaagaacgcattggataaacgaacttgggctcatgtagtagacttggatcataaaatcgaagactttcaagagttggtccccaatatggcacgaacatggccgtttgaattggatacattccaaaaggaagctgttttccatttggagcaaggtgattctgtgtttgtggctgcacatacttctgcagggaaaaccgtggttgccgaatatgctatagcgatggcacatcgaaacatgacgaaatgtatctacacgtctccaatcaaagccttgtcgaatcaaaagttccgtgatttcaaagagactttcaaagacattgatgtagggttgataaccggggatgtccaaatcaacccagaggctaactgtttaatcatgaccacggagattttaagatcaatgttgtaccgaggagccgatttgatacgtgacgttgagtttgtgatatttgatgaagttcattacgtcaacgatatagacagaggtgtggtgtgggaagaggtcattataatgttgcccgaccacgtcaagtatattttattgtctgccactgtaccaaacacgtttgaatttgctaattgggtcggaagaacgaaacagaaagacatatatgtcatctcaactcccaaaagaccggttcccttggagatatttgtatcagccaaaaaccaactattcaaggttgttgatgccaaccgaagattccaggagaatgagtttagaaagcacaaggatttgctagaaggcggtggcaaaaaaaatgagttgccgtctacaaccatgggttccggaagtagaggcggaccaggtggaactgccagaggtgggaaccgtggcggccgtggcggtcgaggaggtcaaggaaggggaggtaatgccaatagaggtaacttttctgggcccaaaaggtttggccgagatgggccaaagaaaaacacgtggattgatttggttaattatatgaaactgaataacttgttgcctgcagttgtgtttgttttctctaaaaagagatgtgaagaatacgcagactccttgcgtagtgttgatttcaataatgctcgtgaaaagtctgaaatccatatgtttattgaccgggcagtgggaagattgaagaaggaagatcgtgaattgcctcaaattttaaaaatcagagaaatgcttggtagaggtattgctgttcatcatggtgggttgttaccaattgtcaaagagtgtattgaaattctttttgccaaatcgttggtcaaagtattgtttgccactgaaacttttgctatggggttgaacttgcctacaagaacagttatattctcgtcaatgagaaagcacgacggtagaagtttccgtaatttattaccaggggagtttacacaaatgtctggtagagccggtagaagagggttggataagaccggtacggttatggtcatcgcatacgatttt

SEQ ID NO: 5000 - DNA, 498 bp, Candida albicans
aacacaatgtttaataccaagatatttgaaaatacaggctcatcagggtcgacaactgcaatgaatattcctgttcaatcagaaccgtcaaacacaaacagtgcgcaaccacaaccaatagatattacattcaaccaccgtccatcagttttcaataactcacgatttagacgtgactcagtggcacattctcaggggatgggtggtatatcctggggttctgttacaataggttcgtggctaaaggatgaggtgatgatggcgagtggaggaaacaacaatcatcttaatccacactatcacccgactcaatctcataataaccaatctctgtatccgaactattcacaacaacaacagcaacaacaacaacaaagccaacaccaacagaatctaatcaacccaagaacaggctcatttagaacgtctaatcacccaaacttatcgccacatctgcaaacttcttatctacccgagttagaagcccgattattgtaa

SEQ ID NO: 5001 - DNA, 864 bp, Candida albicans
aagcccgattattgtaacgactataactgttgtggacagttgttaccaacattgcatgatttattgagacattatgacgaggcacacatactggcatcaccgcaacccgaccagacccattttattgtaaacgttcgtaacggtaataactatgacaatgcacacaatgtaatggaaaccgtatcaaccaccgatgtgtttttgaataacaaccacaacaaccatcatgccccaagtatgcatcccagcgcgaccaccaccaattacaatggaaataatagttttggtaaccagcaagcccatcagatacttcagcaacatgatcaacaacaacagcagcaacaacaacgacaacagcagcagcaacagaaccaaaaccaactacaccacaactctgataattatcaacatctgctgcaactgacttcgcgacaaccaggacaacaatttggacagggtaatagtcattttgggccccaacaacaatcaccatctagcggctcacaaggaggtggaacaccaatgcaaacggacgaggatgatatgtacattgacgacccagcacgtcacctttacgttatggagaatgaggaaaacaagccgttcaagtgcccggtcatcggatgtgacaagacatacaagaaccaaaacggattgaaataccacagacaacacggacaccaaggacagaatttacgtgagaacccagacggtacgatttctataattgatcctgattccaattgcccatatttagacaatgcggctttggaaaaggataaaccatatagatgtgaggtatgtggtaagagatataagaatctcaatggattgaaataccatcgtgggcataccactcattaa

SEQ ID NO: 5002 - DNA, 819 bp, Candida albicans
gcggcatcatttctttttcagactaggcacttgacgatgtcacatccagtaacaccacagctgggagtagaaacacaaaaaccacccgagtatgacaacctagtaaagttgattaatctatccctctcagaaccaggtaatagtcccacccacgaaacagccataaaacaaactattgaatatttgagaaaatacaagaatgatccacattggttttgtcgcccatacatgtacccaatagcatgttattctttaattttgttttcattcccgaacaatcctgttcttgaagagttgaaggtatacatagggaaatctttgctgacgtgcccctactgccttagggcttttgcgatagcaaaaactcacttgagaaatggtttcatcacaatgaaaaagacacctattgttaatgtgaaccagtttctaaaagcaatcaccacttgggaagctacgttggtgcagccatgtttaaatctagtttacaatagtctcgagactatagaaaaagtgcaaaagcaacttgatcattgtcgagattggtttatgagtaaccctgatcttttaagatactacaaagacaacaaagagaaatttgcacatatagtaaaggttttatgtgccagtggaaaattgccgtcccctggcactctatttgcaggtcttgtatatctactttttgaaggatctggtgaagaaaaactttgggcatgccagtggatggaggaaatgagactacagaagatcagatacaacaagctgtcgttagaggagcctttggttgtggagttttcaattcacctttatcgaatactggat

SEQ ID NO: 5003 - DNA, 2400 bp, Candida albicans
tcttatccgcctcagaaaaaaagttcgatgaatgattattcattccaggattttacagattggatttttttgttcatcaactcgttaagtggctcacaaaagcaaaatgcatcgatgaaaataggtgcttatttattgagacaggggaacggttatgcaagttcgactaatgatttgaggtcacaaagagttaatactttgaaagaattcggtgtaaagatatttgcaggtctatttccctctactgtaattgacatgaacccaaaggatcctaagttgtctgtcgaaatcatgagttttagagatgtaagggctgcccttgaatatgaagccaacaccattcttagttgtgcgatgaattcacctcaaaatgttgacgctatggacttagttcggagatgcttgatatatgatgtcttaattttggtaaagaattcatatttgttgctgaaaggtgaaataccaaatatgtttgacaccttccccatcttttggagctccattttgaaactgaaactatacagcaatgttagtcttgtgaaagtgataatacagtgtttgcgtctaatgcctatggcaatcaagtttaacgagatcaaatataaccaggcaaacaaggacttggaaagtgccaagacacagcataataagagtatgaacaccatatgcgacttacaaaatcagattttttcaagtttcagtctttgtgatccagaaaatattaagcaaattatcaacgattttgattgtgctgagtctgtatggggctgtattttcacccctttgattagtcaagctgctttggattttatgaatgaagtgtacaatgccagtggtagattagaaactttccaggaatgtttctcgaataatttgaaactgtctttagtgtctatcaacatcaatttggctaatttgaccagtttggcatgctacgaaccaactcccaaggctattagaattataatggatataatcaaggctttagcagatccagttgactctctgttatcaacctcagctgccaattgtgaaggcgaggttgtcttgttttggaaaaactgttggacatttttaattatggtgtttaaggagacttttgtgtgggcaaaccagtttcaccttgatgagttgcttgagtttgcaagagatactctagacttgagtcatttgcttttagattcctttaggtttatcgtagatacactcaaggaacagactaacaaggatatgctgtatgaattttttgggagctttatgaatgctttccaacatataattgtttggttgaaactcggggatctttctcttttaaactcctgtgttgaattagtcatcaaaggttttgatttggcatctgaagaagattttaaagttcaagatcagattgttgaacagctatggaaatattccaaaaaggttaaaggccacaacaataagttgtcagagtctcaaagaatgatgttgatgacaaaagccagagaattgaatgaagccttagttgaaacaatggagcgtgaagagagcgaacaaaagtatgctcgggctggagctaaagctgaaccgaaattgagaccagcagacgatgaaattcaagaactccgaccagaggagtttgcaaagaagattaacaaaaagcaacagactttggaagggtttgtttctttcacaaataaagcacccgttgctccagctccaaaagaggtaaagggaacccaaaacctagatctgattcgtcaaaagttacaacaatcaagatcctcaattacgggaccaccaaaaagtcacctcaaccctgcaccacctagaccagctggttttaattcgaagaaatcaccacctccggctccctcagttgctattggaaggccattgcatgcagtgaaaaagaaaacaaccgactcggagtcgtcttctgaagacgaatcggatactgatttgactgacttgtttgttgaaggtaaagccaaaaaaattgcgaaaatcactgaagtggatatgaacttgaaaactattgataggagtaatcttcaaaaaagaagaaagcaaatagacgaagccaaaatggccaaagaaagaatgcggttgagattgaatgtgaatttgaaacctttgtatttgactgtacttagatggaattacaattcgaaaagtgattttcctagcaaggataaatccatataccaagaaatcaaggatacatacaaggatgttaaagattatgtgcaggtgaccgagcctttgctaatgttggaatgttggcaagcaatgcagtcagcaaaattgactgtagacgagaaaccttttgagttattgattggaagcagaacactggtagatggattctttgatgtttttgcgtctatggtcttcactacgagctgccgatccgaatatgtt

SEQ ID NO: 5004 - DNA, 1218 bp, Candida albicans
  unsure (3): Identity of nucleotide sequences at the above locations are unknown.
atntcaaaattcccaagttctgagttttataattccaagttaaaagacggcgatggtatgcttgaattgaacacaaggccatggcataaggatccgccattaacaccgtacaggttttttgatattttgggtaaacacgagaaaaatgaattgacgagatctcttttcaacacagacgaagcaatagttgccttgcaattgactgataaattgatgcaattactaccacaagacaaatttagtgggaaaatagggattatttcaccatataaagaacaaattcgaaaaatcaaagaagtctttgttagaaaatacgggaaaccaattttggacgaaatcgatttcaatacagttgatggatttcaaggtcaagaaaaagagattataattatgtcttgtgttagagccagtgcaacgggaaatgttgggtttttgagtgatgtgcgtcgtatgaatgtggctcttactcgtgcaaaaactactctctggatattaggtaacaaagattctttatctagaaatgaagtgtggaaaaagttattaactgatgctggtgaaagaaattgtattacgcaagcttatcctggatttttaaatccctctaaccctaactcaggattgaagagaaaggaagaaaatgtgtttaccccacaacaaacaaaatttgccaaaaagcagaaggtgtcgaatgaatctgaaagaaatgtacacaagataagaaataatttgaccaagccaacctatcgtcccactaacgctggagttttaccaagtaaatcgaagtcatcgaatggaaataacaaacccgattatctggcaaacaatttgcaactgtctgctaaacaaagtaacaaggataccaagtcaaacacaaccgacgatgctccaaaaccatatataaaccaaccaaaacctcaaggcgatcctaaaaatggccccactcgttctggtacaatttcaaagccatcaacaacttcaacaccagcaccaacatcttcgggaacagttaagcccaataaacctgttgatgctggaaaaagtgcacataaagattgtactactcctcaaaacaaatctgttaactcctctgccccgtcagttaaatcaacagatgcagcaaagaagccaacaaagacagtcgccccttcatcttcaggtgtggtcaaaccgccatctaatttgtttataccaagaaagcgcccatttgcaaagaaataa

SEQ ID NO: 5005 - DNA, 729 bp, Candida albicans
  unsure (29): Identity of nucleotide sequences at the above locations are unknown.
agcgcggaacgtccatccccgacgttaanacaaggaacagtattggccgataggaagataggggattctgatttggttgtgcttgcattgaaagacgaatcacttcaacatgcatcagatataagacgttacatcaaagcagatggcaccatgacttgtttggcaaaagtccaagataccaaatactccaactcagattattgtgacgttgtgttaagagtttaccccagtgggcccatgatgggagcgttgacaccaaagtctgttgtcactgggatgaaagttatgcagatggtcacaattgaaagagagttgtcttctttgaaagggttgcaatattacgatttggctgattccatcattctggcaactccaaacaagcctattgagatcgaagacgaagatgctaaaaagatgcgtaagatttaccatgtaaatgattcacaagctcgtgcaattatgggcactttcaacagtgaagggttttcgttgattcaaggtccacctggtataggtaaaacgaaaactattttggggattgttgggtactcgttgtctcaagagaaaaacaataaagtgattgatatatctggatcgggttctattcccactccatcagacaaagccaatattttgatctgtgcaccaactaatgctgccgtcgatgaattactattaagattaagagacagggttagaaactcctcagggggaacatatgccacttaa

SEQ ID NO: 5006 - DNA, 2970 bp, Candida albicans
ccgctgcaactctacatgaataataacgtcgcaagtagccagaatagtgggaagagctcattggataaccttgttcatattgcgagcaatatgtcacaagaatttcgtctccccaaccgacccagcatcccgcccaaccaatctttgtctcaaacgcctttgaatcaacaaccagcatccgagtataatagtgcaacaagcactccttcaccatcgatggcaactggcctgaaaactaaaaggagtaagaaaatggcgtgtgttgaatgcagacaacagaaatctcgctgcgatgcctttgaaaagcggcctgatccctgcacaaggtgtgcaaaaaaaggactacattgtgacgtcaagtctgattacaaaagaacctataaaagagcacgtatggcacaaattgaaaaagaatttgaggagttgaaaaagactttgacgactacacaggcagctgaattattgacaaagtttccttctttgtcttcggcttcacctgatacaaatccacaagaagaaactctgcagatccaggttaagatcgagcctggtaccctgaatgacacaactcaaggtattgcaggtgtaggggtagctaagactactagtaatgttgatttgccacaacattcaacaaaagcagtcgaaggtgcatacacacaacaaaactccaccaagaatacgcaatttacaccttaccggattctgtcacataattcatcggaaactagtcagtcgattcctaacacgccatcaatcacaagacaagttgagtcaaatactcgtagtcaaataccattagcacagcaagaaaagaaagtagaattattggatagctcgcttatctgtgaggaaaaatctgttgatgacatttcgctcatgccagagacaataaagaaactttatttggagtatttcgagagatatcatccaatattaccggtagtcgacgtatcattaggtccagagagaatctacagattgtgtccagccttattttgggtaattatgtttgtttccttaagaagatttccagataattcatcaaagtcgttgttggtacgtctgtccccgattgtgaaagggatactagcagaaattatgatatctcccattacaagatataaccctatagaagaggatgagccaatttacaatgtgagttcagtctactcagtgcaagcatttttattgtattcatactggccaccgatcacctcgtctttgagtgctgactcttcctataatacagttggaacggccttccttcaggccatcaggattggccttcatacaccaacattagtcaatactagtgagatgaacaaagacgagaaaacaaaacatcaattgacaatgacccatgaacaactcaagacttggatattttgcaacattgcatctcaaactatagcgacagcatttgggtttccagcctgcactcaattcgagtcttcaatgtggttttacaatcagcctggcagctccataataatacccagaaacttacagctaatgatggagattgctcagtttgaagaccaaatggcgaaggcattgaactcgaatcccatggatccttgcggactaatagacgctagcgaaagactaccccttttaaaattgcttctgaaaagattagacaccatagaaataaccttgaaaaacgaaatgttacagccgagtgatagaagatttcgtgtgtttgaaattttgtcggcgagggtgcatttgctcagctactattttatggatacagtaagaatagctcaatttgagctacaaaagggtttaatcaggttatacaatgcagctatagcattaatcaaccacacctcagaatgccaagctgaagacaaaaagtttgtaaagtatttgccaggggtgtatttattaaacctttggcaagccggatgtataattgggaaactaattcattctagcttgaaaaagtttattgacgtgggtacaggaaaacaaagctacgaatcggtgataactttcaccgcaacagcgtcaattttgaagcacgatatggcgtataggtcaagtggaattacgcgaaacatgtggcaacttttcagagagttggatgccaaaaaaatgaattcgttgagcattgatataagaaatagaatgtctgcttcattcttttttgattgtttgaaattattgagagcccaggttggcatcacaaaactaactacgaaaactgatgagagtcaccctgttgatgatgatgaggcaattgaagagtcacaagaagaagtggaagacgaagatgatcaacaactcgcggaaatgggtaacgaaaaggctgcaccttctgaagatgaaaagaatggctcattgcataatgttagccaaaaatctacaccaaacagtactacctcaagcagagttcgcagagcaagaacgttatcaaacaatatggatgctgaatcgaaaactagaaaaatcattcgaacaattcctttggatccagagccaatatccattggtgcatcgaaacgaagctcgatatttaaagttgtgaactcttctacagattcttcaccaattatgaaatcagatgtaagcactccaaattccaacagaattaatgatcatcagacaagaactcaaacatacaacccatcccatgtgggcaaacaatatctgcaacagctgccacatatttcatcaaaacaaacagtccaatcgtcgcaatatcaacatcatcaacaattacaacaaccacaacaattacaacagcaccaatacgagcaaatattgcaactggataatcgtagttatcagccagcacagaacatcagcgaagcacctttgctgcaattctctgcctttgcgttcaatgagtcgcctatacagcttggtttagagaacttggatatcgataattttgatcacgatatgctttggaaagatgttgatagcgtcatgaacgattttggttttcacacaagttga

SEQ ID NO: 5007 - DNA, 3396 bp, Candida albicans
catacacacatctcaaacaattgtattaatcaaattttaccaattaagacgtggaaactagtaaaagggaaaatgtttttatccatatctcaactggataaatcaactagtaaaagcaatactggattgccattaaaaccaatacaaccaacacagtattggacgtttgacaatgcattgtcattattaagaaattgtcaagacccctacttggcagatgcattggatgagtttttgttatccagtaaagaagtcttattgaatccgtccccttttacattgaaaaatgacaaacagagcccaaatctgcaaaccagggacatctcattgagaggcatcttgtacacaaatatatcagtacaagatacaagtgatgggaaacttttatccaatctcttaaatttagatgttttggaaacaattagagtaatatgccagactaacaagaagattccttgtaaaactgctcctccacagttggaagcaatcaaaagtaaattgcatgataaaaaatattacgaaaacaaacgattacgattgtattcctccaagatattaagagagagaagaataattttaaagattgtcactgaactattaaataacaaaagtaactcatatgcatcgtcttctatccagaatttgggtaaggagatatttttgtcaaaccagtatcttgaatcattgattgtatatattggtaacgcatcacatagtttaatgaaaagtagttatattacaggaatcaacaaagaaatcgatgaaactatccataatgagacggttttattttgtatcgaagcatgcaaggtgttaattgaattatcagttcaaaatgcaaatgttgatgcacaagcagttcatctgtggttcaaattgatgagagataccaactattccgttgctttgggaccatacgtgtcatatcacgaagcattttcaatactccagggattatttactgttttgactatacagtatttgaacttgaacaatagttttgattccgtcaatgaaactctgtccagctcatatatggcagatgtacaggtatttaaatacgtgcacgatgctattgcaaacccagcaaacaatatttttgttgtattatacagttgttctattattttattaagaaaattctattttttgcaggaatatcccgaattacccaactcagaaaagtttttaagtcaattcaatttgtcacagttgaaacacacaataaatttggttaatcaaaagtgtgataatttggatgtgttttcaagtttaaaaaagttaaacgagttattaaaatttgacaaactttactcggccatattatccactttgataattgcttcattacctttgattaccctcacttcagaagttacaagttgtattctaagtgttattggtaattgtccaaataatgttattgaatcgtttttcgaaaataatgcaacacagaatgctataattattgcaaggacaaagttcccgttgattttaagtccatacattcaggtagcttctatcaacggaaatttcgcattacacgagtttaatgacttgaaatcttacattcaagttttcaaaaaagaggaattcaacaacatgtaccagatagatgatcaaaatacagaattggttaaaactaccaaattcatcgacgtatatccaccttttgaagcaaataaaaagttatcaatggttttgagtctaggaacaaaagcaaagattttaccttcagcgaacccagatgaagtattggtcacattcctttacaattataatggttgggcatttttgggaagagttttgcaaaatgtatcaaaaattttcaataactcagactctgagacaatggaattggttataaatatactaaattcattgaataatgtggtcattgataatggtgttgatgattctaaaatggttttagaagccatgtctgcttatacagacgattctgatattttggaagtcattttaagacttttggagcaagggttacatttaagaaatgtcaagctcttggtttccgttgtcaacttattgacaaacttgatgccatttctttcttacagaatatggccctacttgtccaaatctgctttgtttgcacagaatggcaaagaaggattggccgctgtaatatttggatctatagaaatggtaaatggtgattataatttcacagtttcattgataaaacttgctgaggcattgatccaaaattgcttatctttagaccaagattatcctgaaaaatccaaatccgtgattatgcttagatttgttggtcatttggtagacttatttgagacatttttatactgccgctataacgaacagtgtcaaaaattagaaattggtgttttgttattagatacattttctacaatcttggctagtgtttacggtattgatgagggagtgcccgccaataccaaggtgacaaaagtatttgccgatgctgctagtcgtattttggactcatttttaatatctgatgaggatagtccaagggcagcaagactgataattacaatgattgagaatttgtcacaagacttggatttatacgaattgacggattcatcttcattctggtatgataattggatacattgtgcgttgtctttttctagattgattattaccattagaacttcagaacatttgaagccgctggcttttgagaaaagcttgtttactaaaacttcagatttggtcttgtcttattccaggtttgaatctgtgcgaaaagatatattagatttgttgacggccttgactagtggagattggccagatggaacagctccatctttactttcccacttggggagtgaaaatgcacaagtattgttgcattcattggctgcagatttagataattcgtttgatgattataaaatgaagatttccttgtatgactttatttgtgctgttatggaaggcaaacaagaaggtttagctgtattgttcattactgggagagatgtttttggtgattacaccagtaaggatgataccgaagccaccaaaaaattgtcattattgcaaatattgaagaaaaacataagagatatgagatactatccaaattcggttagtattcatttggtagatgctatagctttagcatgcaattcttggaccacagctaaagaaagtgaacatgatgatgaatttatccaaacattgattgggcgtgttaaattacaaattttggatccaccagattcttctgaaagctttataagcagatgctatgaattgaaattggtttccaagattgcagaaatcttggctctttatcttttcactgttaggagcgaaaaaactagagataaaatagttcttcaccacagggggtcgaaggacgccgctaagcggtag

SEQ ID NO: 5008 - DNA, 816 bp, Candida albicans
  unsure (809): Identity of nucleotide sequences at the above locations are unknown.
acgcaagttcgtgtccggccagcccgcggtgaagaacttgaaattgtgaagatagcttctactttgttgtcatcaagtagtatgaatttttttaccaacttggccgaatctcgtgggtgttataaaccattattaaaactcatttattgctccctaaaattgattagagatgcttctttggtattggctgaataccttagtttattccgtgatttattcaatgcaattgttattaagggtactcaaatcttattgattgaagtacagaacgatgtttacctcgcacgtactcgaaagaatttcaagtctcccaagatgaatgatcgaattgatgatctaatgataattttgtccgtattaaaagtttttgtcggtgcgcaatttggatcaatcttgcatgaggaaatcgcattatcgataaaggaaaatggaaccatcaactcattgttaaatctttactcctttgcccattccattgaagtaaacgatgagtttatatttgctagattgagtttgatgtatcttttggaattgatgtcagttaacattattgcggaaaaagttattgcttcaggattatttcttgtcttgttagaaagtcctatatcacgtcctattagaacaggaggtgtatcaatcagtcatggcatacattaccataggttgtggaaaaatggaatcttgcctataatcataaccagtttgttcaaatttagagcatctgttgttccagaaatatgtgtggtgttgcaaataattggtaaacaaacacaatattgtataaaaaattggtccacgtatccttccanccattaa

SEQ ID NO: 5009 - DNA, 249 bp, Candida albicans
gccacaaagaaagagagaacttgcatactgaatctaatattgagaaatccaaagaagagtttacaactgatcaaaaattggtgtttatacgtcttgaaattggttttcctaaggcatatccattcttggagcaagtcagttcagagcaattcaaatcagctaaaaagttttccaagctacaaaaacagaaccagattaagttcaatattgaagagacccatgagttatcaacctctaccaagaacataa

SEQ ID NO: 5010 - DNA, 537 bp, Candida albicans
caaataatcgtactagtacacctatatttaccgcatgacatgtcttctaccaaacatccaccattaccctcagtcaccaatcagaaaagaaagagaaagcgtcaaaggttatttgcgaaggatatagaaaatttgttatatgcgatgggtgatcgacctgtgagtacagaggccactgtcaatgcgttggaggatgtattggtcgaatacatttcacaaatatcatactcgatggtaaattttgcaaagagtcaaaatcgaacacgagtcaagttgaatgatttggcatttacattaagaaatgatccgatgaaattagctcgtttccgatacattctagagcagagttataaaatagaaaaggcgaaaaaaatgtttgatgacgataaatatgataacaagaaccatgaagatgacgacgacgacgatgaagaagacgaagatgatcatgaaaatgaacgaaacatgaaggataaatcaactactaaaaatgattcaaaacaactgaaaaagaaaaagaagaaaaaccatacttga

SEQ ID NO: 5011 - DNA, 2253 bp, Candida albicans
  unsure (20): Identity of nucleotide sequences at the above locations are unknown.
cggcctacatatactgggcncgtgtcgcatccaaataataccacgtcacgaacatcaaaggatgacgaaatcaaccaattaaaacagagagtacggtttttggagaccgagttagccaataaacgtttacttgcaaacaaaaaaggttttagcaatgattcgccaacagatttgcaatcaccaccctttgtttcgaaatttgatttggagagtgaaataagcattttggcagaatcttccgctagattaaccgatttaactaatcaattaaatgaagcagcatcaagaagaatccagttagtatctgccaagaaacctgtggacttgatttccaaaggggtaatcactgttgctgaagcggaagagagattaaaactttatcgtgaacagatatatggtcgacatccattaattgcaatacctgataacatgcatgctatagaatttctgcaaagccaaccgtttttattcaacagtatcatgtctgcttgtaatttgataactaaaaatgccgataaagatgttgtattagcaattgacaatgaagcaatgacgtctgttgcagtaaaagtaatggttgttggtacaaaatcagttgagctagtgaaagcttttctggtactatgtttgtattataactcacctgaattattcaaacaacgtcggtatcacatgttgaacacaatatgtgtttctttgttgcatgatgtgggaatctttgccagaccaacttattcatacaatcaagctgacgggacacttaaacaagacgcaaattctaaagacaagggtaatgatgaataccgtgaattggtattaattacttattttgtcacagtgagcacatgtcttgtgttacggagatctatttatgctagatggacaccatacgttgaagaatgttgttctcttcttgaaaactcactgcaagagaaacacagacgtttggcactatttgctcgaatgaataacaaattggataaaatccatcacattgtccatgcacctgaaatgcctggacagaaatcaggagtatcgcaatatgttatccaagaattacaacgtttattatcggacttgaaattgaaaattaaagacaatcaatattcactattatcgtactattattctattgaggcatatttacatgaaccaatattgaccaaagttttcaaaagtgatactgaacttgatgggaaagcaatgaaatcgatacgttactgtacaagctcgtgtttaaatgcattagacgagtatagtaagctaacacctgaccaaattgcattattgccattcccatttggatcgagaattatgtatacagcaggtatgttgcttcgtttgcggtaccttatcttgtcgttgccatctcatattgataaagaattagttcctaaacgagcagtaacgtcaatccaatgtgttagtaaattagtggaacaagcaaatattttgaatcctcataatcattacttgacaaagatgagactagttttacaattgtttattcaaacgtatgctactcaagtacttgagttgttaagtaaaaatgggaatacaccgcagaacttcaaacctgatgaatctgaaacacaacagttgagagcattagctcgtgaatataacgatattcggaaagtcagcaaagtctcgttagtttcagatacaagaagtgctgaaccattggatgtattgtcgtatgcagcaacttttagacgcgaaaacaatgataaacctagtgctgttgccggttctttgagaaagtcattttcagagaatgatcaagctatcaaaacaccatgtcaatgtggacaatttgtatcagcagacgacactccagtgccacaggtaatcaattcccatcccattctgcaaacaaatgtacccgtgcttcatcaatcacagtcaataataaatggcaataatagaaacagtgctccattggcttttaataatactaccaccccttccttacatcaatttggagatgttttacccccttcatccatgccccaaccagactataggcaatttagattaccatcgatatcgaacacggtgcattattcttccaatccaagattgaatgccaatttagcaaaccctgatcaattggagaattcatatcaagtgttaaacgatgagttttggtcaaatttgttaagtacggactctactgatcgtatcaatttcacaagtaataactttaatggtaataccagtaatgatgaagttttcttcatgaacaattaa

SEQ ID NO: 5012 - DNA, 315 bp, Candida albicans
gcttcactattaactactacaacgccccttctcatcacttctgaaaaaaaaaatttattctttctttccttcgttctttccttcgttctttctttcttatttcaacattctccattaagaacaaatttaattatgtctaatttaactccaattgctacttataatttggctttacaaccatttcaaccagttcctgccattgaagatgatttcccaatttctattacaatcactttagcttcattagaccctgaagccgctgatgataaagctgaacctacaagtttaagaattttgaaaaaatcaatttcataa

SEQ ID NO: 5013 - DNA, 699 bp, Candida albicans
caagcgttttcaatggtcaacacagattttgagaaaatatatttgaatcaatcgagagcaggtggacgtatgcgtatagcagagtctggtcttggatggaaagcaagtgcatcaagtggttcaacatcacaaccatttcttttgccacgcgaagagatcttgattgctagttggtcaataggatcgaaaggatatgaattaagagttcaaactaaaaataagggtgttgtgagtttggatgggtttgatcatgatgatttcactcaattgaaacaagaattgacccgtaatttccacattaatttagaacatagagagcattcattaagaggatggaattggggaaagacagatttagcaagaaatgagttaattttcaatgttaacaataaaccagcatttgaaattccttattctgatatcagcaactcgaatttaactggtaaaaatgaagttgctcttgagttcaatttggataataataagaatggtgatgaaattgttgaaatgagattttatgtaccaggtacaattgagaatgagaccacaatagtgaagaatgaaaccaatggtgatgttattgaagaggcagtagtcaacgaaactagtgctgctcaacaattctacgagcaattgaaagataaggctgacattggacaagttgctggggaagccattgtttcatttagtgacgtgtga

SEQ ID NO: 5014 - DNA, 207 bp, Candida albicans
atacagtacgaacagattgaaagaattttcagtttacctaaacccgatgaaacacatcacttgatagtgttccagattgacccaccattaagaacaaggtcaactaaatatccatttttagtattggcatttgttgaggacgaagagacagaattggaattgaatgtccgcgaagaagatttgaaaagaattgcggggatggaatga

SEQ ID NO: 5015 - DNA, 753 bp, Candida albicans
attagattcaataaacgcaaggaaagtgtatcaacaaaagctattaaaccggaaaataagcaggttaaaattgagattgataacgacgttttatctgaccaatttgaagaaaaacaggaagagagtgattataatgaggcggaagatgcaaattctgcgttggagtctgacgaagaaaacatttcacaagaactggaggacctggaagtggaatattcaacaaaaaagaagttgaaaaataagaagttgctgcgtagatcgaaggcagcagccaccccttcacccaaacgaaagctacaaaaaaaggacattgaagacatttactccgttgtcacacccactaaaagaatgaaattgggtaaagatgaccgagactcgttaccagtatttttatcaccgaccaaaagcgttcctagtgaattcaccgaccccaaatcggttgctttcaaagaagtgaaacaaagattgcacacatcacagaagttaaatgctctacctggtagagaagatgaatttgccatgatatatatgaatctagagtcagcagtaaacgaaaaaacaggttgttgtgtgtatgtatgtggagtaccaggtatgggaaagacggcaacaatcaaggacgttgttgaacaaatgacatattcgagtgaaagaggtgaaatggaacaattcagttatttagagttgaatggattgaagttattaagccccactgatggccattttcaacagacggttggaaggtcatctgtg

SEQ ID NO: 5016 - DNA, 990 bp, Candida albicans
ggcgggggaacaaaattcaatgctatcaaaaatgccagcattaatttgttgagaggaattatctccaaacgaggaagatcaaccaggggaaaccttttagtgatacttatggatgaattcgaccagattgctaccaaaaagcaaaatgttatgtataacttcttcaattggccgacatattcaacatccaaattaattgtcatagctgttgccaacactatggatttaccagaacgaatgtcaacaaacaaaatagcatcaagattgggattaagaagaattcaatttagagggtacacctttcaacaattgggagatatcataacacatagattagaaatgatcactaagaataacagaagaaaagttgtgattacatctgacgcaattgggtttgcctctagaaaagttgctagtgtgagtggtgatgctcgtagagcattgacaatatgtcgacgggcagttgagatagctgagaaggaatacttggagaataaaaagggtgaggacgatagtgggccttaccaggtattgatttctcacatatccactgcgataaatgaaacggtgaactcgccattaagtaaatatattgcatcacttccatttgcatccaagttggtattggcatcactattaagaagatcgagaagaactggccttgctgaaaacagcctaggcgatataattgatgaaatgagaaactcatttgccatggccacacattcagaagaacaaggaagtgacgagttgaatatgcaagatgtcttgtacagtgataaaacatttactgccactaatgaaactgcacctattttgaatttgagaatccattttttcaaacaaatagtgacgtctttggtagaagcaggaattataatacagcagaattcaccaggtgaaagatcaagacttgttaaacttgacgtgcctgaggaagaagtcgtatcggtcttcaagaaagataatgctatatcacagtttttatag

SEQ ID NO: 5017 - DNA, 669 bp, Candida albicans
cgcggatcctattacgccgtggtgaggcttgtatcatatgcaggtatacgaatccttcgacaagacccatgggaatgtcttatttcatttatttgttcatcaaacaataatgtcaagagaatttctaaaatgtgtgaaaatttgtgtattaattttggtgattatatcaatgattttgaaggtcatgaatactatactttcccgacaccagaagcattatcaaaacctaacgttgaagcaaaattacgtgatttgggatttggatatcgtgccaaatatatttatcaaacagcatgtaaattcaccgacaataacaaatatcctgacattaccatcgaaaacttaaacttgttaagggaagccaagtatacaactgcgcatgaatttttactacagttgactggtgttggaccaaaagttgctgattgcatttgtcttatgtccttggataaacatgacgttgttccgatagacactcatgtgtatcaaattgccgtgcgtgattataagtttaaggggaataaatccatgaaaacattaaacaaagaaacatatgctgccattagattgtttttcaaagacatctttggtgaatatgccggttgggctcaatcagttttgtttgctgcagatttggctgatttgaataatggaacggaatattactga

SEQ ID NO: 5018 - DNA, 786 bp, Candida albicans
gtttcatttatggaggattcaatatgtattcttacagtattatatttaaaacaattaccacttcaacaactgcaactgcaactccaattagaaaccaaacaatttcaaaccattaaaattggaaaatttttcaataaattcaatcatgaaaaatgttttaaaacttcaattcaattttggaatttttattttcaatttgaattaactcagaatcattggaaaaatttaaaatcattaattaatcatattaaattcaatactcaattaccaaaaattattattgattcatttattgaatggatgtatgaaatttctaatgataatttaataaattttttgaaattaaatgatggtagatcagatgaaactataattatgaaagatttagaaatttcaaattcattatattataataaaactacaattaaacgacatgcaaagaaaaataattatatcatcatcaataataataataataataataataataataataataataataataataataatagcaacaacagttttgataagaaacggaataatattggtggtgaagaagaatttttacgtttgacaagtaaacaaataggtcatccaggaatatttattgatgctgtaccacaaatcacaaatcgattaatgcttgatggtaatgatattgaccttgcacaagagaatttatcaatacctccattacctatgtttaaaaatgtggaaaaagcttctcaaccgataaaatacccttccactactactactactattactcaaactcgttaa

SEQ ID NO: 5019 - DNA, 912 bp, Candida albicans
gaaaaagatgaagggattgctaataataacaacgacgacacgactccaaattgggaatcaaaactgaaacttgaattgacagactcattaattacactggtgataagtttcattaatgatgaatcaatatgtattatgacagtattatatttaagacaattacgacatcaacaactgcaactgcaactgcaactagaagccaaacaatctcaaaccattaaaattcgaagatttttcaataaattcaaccatgaaaaatgttttaaaacttcaattcaattttggaatttttattttcaatttgaattaactcagaatcattggaaaaatttaaaatcattaattaatcatattaaattcaatactcaattaccaaaaattattattgattcatttattgaatggatgtatgaaatttataatgataatttaataaattttttgaaattaaatgatggtagatcagatgaaactataattatgaaagatttagaaatttcaaattcattatattataataaaagtacaattaaacgacatgcaatgaaaaataattatatcatcatcaataataataataataataataataataataataataataataataataataataataataataataataataataatagcaacaacagttttgataagaaacggaataatattggtggtgaagaagaatttttacgtttgacaagtaaacaaataggtcatccaggaatatttgttgatgctgtaccacaaatcacaaatcgattaatgcttgatggtaatgatattgaccttacacaagagaatttatcaatacctccattacctatgtttaaaaatgtggaaaaagcttctcaaccgataaaatacccttccactactactactattactcaaactcgttaa

SEQ ID NO: 5020 - DNA, 1710 bp, Candida albicans
tctacgatgtttgaagatataacatttcgaaataatgaacatagacgagcgactagaacatcacatcgattaattaataaatatcaagaattgaaaaaattcactgaaatttataaatcttcatcaaaaattaaagccaaaactaaaaggaaatcacaacatagaccatcgcagaagaagaaaattttacaattaattcatcaagaattcgataaacgatcattattaaaacctgaagaaacttatgaaatatggcatgaattatctgattcaataaataaaaatgttgctaaaaataattccaagaaaaaactggatcgaaaacacaagaagggatcaaaaggtgagttcgggattgatactgaacccgaacctgaaactggaggtgaactatcaatagatcaaggagatgaattattacggaaaaaggtaaatgatattatagaaggtaataatgaggaagaggaacaggaagaagatgaaaaggaagacgaggaaccagatgaagatgaaaatttaatgacacataaattgaatcaatttgttaataatttcgatacctccaatcgattatcaaaatttaaatttataattgaatcaaatggtttagaaatattaccaagaataaatgaagaagataatactactactaataataataacaataataatgataccgatccaattgaaatgattcataaatcaaaatcagcattccgtcaacatattaataatttaactacattattacatttacaaataatgaaacaaaattggtcaatagcatataaaatatttgcattattaataagattccctcaagttgatataagaacaatttggccattaggtatagaaatattaatgcaactatccaacaaaaacggtagtaattcattaaaagtgaagaaatttttcaattatttatcatcattttatatgataaccgatactaatcctgctacaagattcatatcaacaaatcataaatatcgtaataatgtggcaccagtttggagatcaggttctaaaactttaaccccattatatgtcattacttcattatggtatatttttgttcttggtgattatgaacaagttttaaataaaattaatgaattaattcttgaacctccttataattctgaaggagtattgtattttatatcaagtttatgtcatttatgtcttggttggaaattagttgatacatatataacaggtgataatgataattttgatgttgttgatgaaagatataatgtggaaaagcaattgaatataattaagaataaaatgaatgaagattttgaaaaatgtgaaaaatatcaatttatttatcctaaagatgaaattgaatctcaattcaaagagttgctcacagtggtatcgaataaaagtaatgaaaaaactcctactctaaataaaaatggtaatgatattactatgaataatgtttcagcttcgtcgtcatcatcactggaagaaaatgatttagattgggatgccattagttctgatgaagatgaagatgaagatgataaggtgcacacaaaagctaattcattaattccaactcaaatagatagtctttatcatcttaagaaccacaatgggaacaagcaacatcatataaaccatgacgacgaaaatctagtggaagtcaatttctctgatgacgaaagcatggatggggaaagtaacattcat

SEQ ID NO: 5021 - DNA, 507 bp, Candida albicans
tcaactctcaattttttatgctcagttttgaacgtttttttttttttgtttatttcaaatcacgttttgtttctctctatacaaacacgtctttttcttcttataaatacaaatattcataattcacaaacccttccacccacacttaaaatacacagttataaaccttgtaatatgaactctagacctgcacctccgcaaccacgaccaccacaacaacaacctcagcaacctcaacccaaccaacagaggcttccctttcgaccagacgagtcacgagctcgtcgtttgaatcaaccacttgaacagcatgcaaatccaatcaatccgtctaattttgctgcaagagagtacacagaacaagaacataaggacataccaacgaaattaaataaatcgttgggtcctgaatttattagttatcgtgatggtccaggtggaactcgtgttcaatacattgaaggttggaaaatactcaatttggctaatgaaatatttgggtttaat

SEQ ID NO: 5022 - DNA, 1839 bp, Candida albicans
acgttttttttttttttgtttatttcaaatcacgttttgtttctctctatacaaacacgtctttttcttcttataaatacaaatattcataattcacaaacccttccacccacacttaaaatacacagttataaaccttgtaatatgaactctagacctgcacctccgcaaccacgaccaccacaacaacaacctcagcaacctcagcaacctcaacccaaccaacagaggcttccctttcgaccagacgagtcacgagctcgtcgtttgaatcaaccacttgaacagcatgcaaatccaatcaatccgtctaattttgctgcaagagagtacacagaacaagaacataaggacatacaaacgaaattaaataaatcgttgggtcctgaatttattagttatcgtgatggtccaggtggaactcgtgttcaatacattgaaggttggaaaatactcaatttggctaatgaaatatttgggtttaatggatggaactcacaaattgtgtcatgtcaagttgattttttagatactcatggtggtagcggcaaattttcagtagggatttctatggttgttcgtatcacaattagagatggaacttttcatgaagatgttggctatggatctattgagaattgtagaagcaaaattttagcacttgaaagatgtaaaaaggaagcactcacagatggattaaaacgatgtcttagatgttttggtaatgttttgggtaattgtttatacgacaagaccattgttgctcaaatgaagaaattaaagaaatttccgatcgagtttgatccaaatgattattatcgtgatccattattggttgaaagagaaagaaagaagaatataattgaaaaacaacatgaagaacaaaagagacaacaagaagacgcgtcaaggttggataattcaggtcaacaggtgcagcaccagcaacaaaataactcaaacgtagtttcaaacggatcaattccagtaaatgggcaacaaaatcatcaaaacaaaggatctgatattgtcgaacctctagaagcaaatcaaggtaatactcgtgcaggacaagttccacagctttcccaccatgcagcagcttttgttacaccaaaactgccaaccaaagtggtcagctatgttccaacaagtaaagaagctgaagagttggatgattcatttatgttcagtgatgatatttttgatggggaatcgcagagtatttactatcctccagaagttcgggaacatgaacaaaatcaacaacaacaaaaagaagaaaaccagggagtagctagaaatggtgcaaccaaagaaacgacaaacaatggacgatctgaaaatcgacctcaaaacgagtgtatggcagttgatcaaaatccaccggtgctcatgaatgcttttgtgactgcaaaatcagctgaggtattacaacaatcgccaacagttgaagcagctgccaaaaacattgtccaatttgatcctaaatttgtatctcccaatatgagaagaactgttgatcctaccaaatcagtaccaattaaacgaagtgatattaaaaatagtgtcgctacgacaccgtcaccattgtgtgtaatcacatctagtaatcgaattaataaacccatgataacatcaaacaataataataatatcaacaatatgggtaagaggattggaatgcctcctcaaccaagaacaaacaaactagttaattcgggaaataatccttcttcgggtataccgcacactgtttctacttctgttaatggtgcaagtggtaatgagaatgttgaaaataattctacaatagctaatacgactgttaaccaataa

SEQ ID NO: 5023 - DNA, 1029 bp, Candida albicans
atattgcatagtcatttaaacatgacaacgtttagtagggagttcacaaaggtgtatgattaccaagcacttttcaacaaagttttgaacaaacgtttgagatttgtgcttaatatcaatctaatattgtccttcattctagcattagtgtacgaatttatgcccacggcgaattcaaattcagatacaaatcattcgatttggcaaagcattcctgtattaatatgtgtcaaagttccaaccattttttttactctaagtgtaattcgtcaagtccgtaaacagtttttgattgttgaatattctcatcataaaacattgggagcacaaatttattattcaattttatccttccaatttttgatcaattggttggggtatttgatatctagctggctaatattcggagtggtgatagttttcaccctgaaattgaaatttaacttgtcagattactatatattatctaaagagtatcgtcaacatccaataattaatgatcaatgggtttactattggtataatcctgttttcatttcatttttttacacttgcaatcaattgattttccaaagacaacgtttaaattttgaaattggtaatatcagaaataaacctcaaaattatttatttaagcacctccctattttgttgggtaattctttgggtttgaatttatttgtgatatcgttgactcctataacttattggttagttaagtattatatttataagagtttcattttgatcatattgattttcagattggatagtgatattattcctaataataacactagttggataacatatttacagttgagttatttgtcgtttttcattattttaagctgggaagttgtcaatcatgttttcaatgtatatgcgactattgggtgtcttgatggcaacaaaccaatttcgagctacagtactgatccactcaattgtttattatctgggttacgtgacgtggaccctaactatccattgagtcttcacaacgccctggcaggatccattaatcag

SEQ ID NO: 5024 - DNA, 651 bp, Candida albicans
cttttgtcctccatgatgatgcacttacaacaaacaccaactaaaagatcaatcttaccaccaatcactccattaactaattccaacaatggttcaaaactaagtttaccacctttatcttctattttaccaactgctccaagtagtcattatagagatcatccattgactactagtaccccatacaaggcaccattgccatcaataaatacttcagctgcttatcaaagtccatcaatgacttatggtagttatattccaactccagaatcagccacttcactggtaactagttccaataagagaagcttttctgtgctcgatgattcatcaataatggatactagtatactagaagaaagaaaattaaaggcatccaccagttcatcagttgcttccacatcttcttcatctccaacactttcttcacctgcctctactcctactgacaacaaggcttatgcatttatttcacattcactagctactttcccactgcaagaaccatcaattgataatgctccattagcaagacgtaaaagaagaagaacttcacctcatgaattaaatatattgaatcaagaatttgctttaggaacaacccctaataaatcaagaagaattcacattgctaacaaagtttccaagtag

SEQ ID NO: 5025 - DNA, 2799 bp, Candida albicans
ttctgtattttttttttttcctcccagtcgttgttcaacaaatgctacattgaaaaaaaaaacagagatctctggtcattaatattcacagcaatttacacatcatctcaactatatcaaatgtcagacagtgatctaccagttcaagttaaaaaggaaccatcttttgcaaacgatgatgatttgacttttgatgaagagttcagaagagccggtgatcaagagaataaagaagttgagaatccagatgatggtagatcgttaaaacgtacccgtgaagagctggaacaggaggagaacaatgagaaagagcaagatcaagaagctggacaagacgaggaagagcaagatgaagacgaggaagaagaagaagatgatgaggaggaagacgaggaagacgaagtttctagcagaagaaaacggagaagaggggctaatcaattctttgatatagaagcagaagtcgatgatgaagaagaagatgaggaagacgaagatgaagaagcagagttgatgagagaggaatttatcactgatgaccatgctccagtagaaacagtggaaaaaatgccacaggatgatagattacacagacaatacgacaatcgtcgtcagcaagcagaagatcaagatgcagaacaattggcagaaactttaaagcaaagatatagaaaaacccattcagtatacaggggtgagaccgcggccagtggtactgtatcgcaaaaattattaatgccatccatcaacgatccatcaatatatgctattaggtgtacgccaggtagagagaaggaattagttcgtaaattatatgagaaaaagagaacactcgagagacaaggaaacccgttggatatattgactgtgtttcaaagagatgcatttaccggatatatatatatcgaagcaaaaagacctgatgcaattgataaagctctagtcggtatggtaaatgtttttgtcagagacaaattattagttccagtgaaagagtatcctgatttattgaagcaagtaaaatcatctgatgttgaaatacgtcctggtatttacgtaagaatcaagagggggatttatagaggagatttggcaattgttgataacttgtccgagaatggtttggatgtgcgttgtcaagttgttccaagacttgattatggtcagaatgatgaaattgggcccgacggtaaggttataaaactgaaaatcaagccattaccagcattatttagtgaacaaaaggcaagaatgtatgacccatataaactccagatgggaagagttccaaacagttttatatatcgtggtaatgagtactacgatggatatttgtataaagattttaaattacagttcattcaaaccaaagatgttaatcctactcttgaagagttggacaggttccaaaatcaaaatgatgaagatgggttaaacttgcaagctatagccgctacattaaagggaaataatgcgggcgagggtaaatcatcgacagctttccaacctggagacaaagttgaaattcgtcgtggtgaacaagccaaaactattggtattgttgttgaaactgctttgaacgagatcacaataaaggtcacagacagtggtgatcctagatttgtggaccaaagattgacagttcctgccaatgatttaaggaaaattttctatgaaggtgaccacgtaagaatagttgaaggtaaacactttgacgagactgggttagtcataaaaattgatggtgattctgtcgttattgtcagtgaccaaacaaaagaggatgtgagagtatttgccaattatcttgtgaaagcaactgatgcttcctccaatttcgatttgttgaacagcaagtatgatattaaggatttggttgaattgagtggtttaaccgtgggggtcatcatcaaggccgaaaagaacatatttgatgtgcttactacagatggacgtttaatcagtgtcagacaatctggtattgcctccaaactcaaacaaagtcgccgtgaacaggtagctacagatcgaaatggtacgactataagagtaggtgacactgtcaaagagttgttaggtgaaaaatccagagaaggtgctattttgcacatttacaagaatgcattgtttataaagtccaatgagattgtggaaaacttaggtatatttgttgctaaccgtatgaatgttacaactgttgctactaaagattcaacggtgtctaaaagcctaggtccggatttgacaagtatgaatccaaacttgagattacctaatcctgttgctgtcgctggattaaaaactagagttggcggcagagacaaattgttgtacaaagatgtagctgttactagtggtagttacaagggattgaaaggtaaggttaccgaagctgacgacttgtatgccagaattgaattacacacaaagagcaagaagatcaaggttctcaaaaataacttgaatgtcattgttcatggtcagccagtgccctatttaagatttatcggtgcggcaccagaattctcacaaccaactccaccaacgtatggttcttccagtggaggcaggtctgcttggaacggaggtatgacaccttctgtatctgctggtaatggtggtgtctcagcttggggtggaagtagaggtggttttggcggaaacggtggtaaaactccagcatatggtgctggtggtgcctcaacctggggtggtgcttctgcttggggtggcggggcaggaggaagctctgcttggggtggtattaaaggtgcaggttccgtttgggataagaagtaa

SEQ ID NO: 5026 - DNA, 1056 bp, Candida albicans
aaaatgacagatattaaaagaaatttttcagatattgcctcaccagcaaatctagatgataccaagaaacttcacgtagattctactgcaacaacaaaagtgggcagaaaaccaatcgataccgaacctaaatcaaagagaactgctcaaaatagagctgctcaaagggcataccgtgaacgtaaagaacgtaaaatgaaagagttggaagataaggtaagattattagaagatgcaaatgtcagagccctaactgaaaccgattttttacgagctcaagtagatgtgttaaaaaatgagttggctaaatatactggtggtagcgattttctggatttgaatttacctactaaagttggtcatttatcacatccaaataatcatcacagtaatgtttctaccggtacacctcatggttcaatatcatcttctaattctgttgcaagtttagataatgacaaaccttctagtgcttcatcggtatcaaacaattcacctggttttgcttttgataatccttggtctaaagataacatacaaaagttaaagcaccaacatcaacaacaacaacaaaaggttccccaaggtgtgccggatttggtgctgggttcatcttcatcgtctacacctttaaatgacaatttattggtcactcctgaatcgttgactggtttatctacatctagtaaatatactggccagaataatgtaccaaccaatttggatttcaccaatcagtttgatgaacaagttgatccattttgtgttaaattgaatgaagcatgcggaaccaaaagtaacccagtgcccaaatttaaacgttcaggttctaaagcaaatacttcagtaacaaataattccccacttgcccacttggtatcaccggaatctcaacaatataccaattcttctaatatcgactttatgaatgatccatttttcaatggtgtgggaactgattataactttaatttcgatagcaagaatggttccattcaagatcctttatcgtgtcttcaggatgacaactttgatcttgcatggggcattgggtga

SEQ ID NO: 5027 - DNA, 258 bp, Candida albicans
atccacatccacccggcggatgccaaattacaaataataatggaccaagaggataaagatgaagttgtgctggcacctccacaaacactcaaatgtagtgaaatttgggatagaataacatcacatccaaaatatactgaacttgatattgatgggttgtgtaatgagttgaaaagtaaagctaaatgttctgaaaagggagtagtgataaatactgctgatgtgaatcaattactagagcgaagtataaaacattaa

SEQ ID NO: 5028 - DNA, 543 bp, Candida albicans
atcttttacagtatgaatgtttttacatcatggacaaaaagtaataaagcggagagtgttaacagtcacgagacacctcaatttgctagtgcagtgacacaatcaaataccactaattcacgtcccaaaggcacagaaagtataggcccaggctatggtagggtacaagatttatcagcacatgcaatagcttcacaaacacaaggaagtccatcggccagctcccttgaagtgaaagtcgatccagagttacctaaaacacatggtcaccgaatagtttccacgactaaacgagctgagcagaatcgtaacgctcaacgtgctttccgcattcgtaaagcaaaccagttcaaagagttggagagcaaggccaaagaggtcgatcagctaaaacagaagattgagagtttagaagcacggaatcgatcgatggccaattatatatgtgaattgcaacggcaaataattgaatttaatagtaataaacctcccaccaagagtgacaaaaatgggagagaaaataatgcatcaacggacaattga

SEQ ID NO: 5029 - DNA, 1002 bp, Candida albicans
tctaacgttagcggggcaccttgccgccccgtggtgaagaacaatggatctaatcgtaattacacaagtgctcctagtggtgcccccataccttccaattctaccagtggaccttcacaacagccaccactaccaggtcaacaagcagtacctatcccaccacatgtatcgacaatgcaacaaccaactcctgttcaggatacgttgaacgcctcgagcacttccactgtggggcaattccaaccaccaggaatcagaccacgagtaacaactaccatgtgggaagatgaaaaaactttgtgctatcaagttgatgccaataatgtgtcggttgtcagaagagcagataataatatgattaacggaaccaaattgctcaatgtggcccaaatgacacgtggtagaagagatgggattttgaaatcagaaaaggtgagacacgttgtgaaaatcggatcaatgcatttgaaaggagtctggattccatttgaaagagcattggccatggctcaacgtgaacaaattgtggatatgttgtatcctttgtttgtcagagatattaaacgagtgattcaaaccggagtaactcctaatgcagctgctgcaacggccgccgccgctgccactgccacttctgcttcggctcctccacctccacctccacccgttgctgctgctactactactgctgctactgctatttccaaaagttctagcggtaatgggaacagtatatctgctaccagtggtggcagtaatgtgtctggtgcttctggtgcaggttccaccactagtccggtaaataccaaggctgccactgctgctggtatccctcaaggtaattattatcaaacttacaaccaacagcagtatcctcaacagtatggtcagtataatgctcctggtaagaaccaaaatacacctgcatcacaaccaggttctacaaccaatgatcaatatttacaacaacaacagtattcaacacggggtggaagatccgcg

SEQ ID NO: 5030 - DNA, 480 bp, Candida albicans
agactctccgtttttcttatcaacatcttaacattcattatggcattcaaaagaggagcaccagcatccaattcaaatgaagtagagattttgttggatctgaagaaacaggttactgttcgtaaatacaacaacgtcaatttagtagatattagagagttttataccgatagggatggcgtcaagagaccaggtaaaaagggaatatcattgactgaagacacttactataagttgttggaagctactaacaagattcaaaacgccttagacgatttaaatggcggagccctgaacaaaagagtgaaattagataaaaaagaggaaagacatgaaaaaccacagaaaaaggagcctgaaaggaaagctgtcattgagaaggagcaggaaagtgaacagaaagaagtggcagagactaaaaaacaagcttccgaaccacaagcagaaggggaagaagaaattagtgatgctgatgagtag

SEQ ID NO: 5031 - DNA, 1914 bp, Candida albicans
  unsure (1014): Identity of nucleotide sequences at the above locations are unknown.
tttttttccaaaaaggggggggggggtttatttgggaattgggaattgttaaacattttgtttcaaatactgggggaattaattttgggttcaaacaatacgggatttggagctggtggtaatgctttcggtccaacagggaattaccggtttggtgttaaccaaccagtaattacaggatttggatcatgtacatcaggaggtttatttggacaacaaagtcaacaacagcaaccaggcgatacaggaggtttatttggacaaaatcagcagcaacagcaaaatgcaggaggtggattgttcggtgctaagcctgctggtggttcagtgtttggacaaagtaataccaacgcgtcaggtggaggtttattcggtggtcaacagaacaccccaactactggtggggggttatttgggtcaaaacctgccgcttcgggtgggttatttggtggtcaacaatcaggacaagcacaacaaggaggagggttgtttggtcaacaaaatcaacaaaatacatcgggaggtggattgtttggaaacaagcctactggtccaaccacgacaaatggtggtgggttgtttggtaataaaccggcaacagggggcggattgtttggtggtcaacaacaacaaacccagcaacaacaacaaccgcaaccatctcaattagggggcggcttatttggagccaaacctggaacaactgcttcactgggtggtgggttatttggtggccaacaacaaacttctaatgttggaggtggcttgtttggaggtggtgcagcatcgacaggtgggttatttggagccaagacaaatgccaacgcaacctctaattccacttcgacgggaggattatttggaggtgcaacaacagtacaacaacagccacaacaagctcaacaagcattggctagcatcaattctcaaaatccttatggtaacaacccacttttccaatccataacaggaacatcatcacaacaacaacagcagcagcaacaacaacaacanacaaacaatctcccacagttttcgttggttaaatctgcggcacctattaagaaggcagttactctaggaagtacttcgcaaaaggttactccgttgttcaaggtgagttcattaccaacaaaaacctcgacagaattggtaaaggaagatacagtcaagaataagaaaacagatgatttgttttcagccgctactgaccaggcaatcatatcttctgatattttcagaccaaaggaaagttttaaaagtttggttttggataaatcgaaggcttctaatgcgttattaacagagctgtcatcaggaccaacgaaacaggtaacatttgttttagataaatcagaatcgaaagaattatctgcatctacaccagaacctttagataaagacgagaaaagtaaattggaattgcaaggagagcaacaaaaacagcagcaaggtcaagatcaagattctgatgttgacagtgaagggtattggatgtcaccttcgcttcaggaattgaaaaagaaatcactccttgaattgaaatctattcctaaatttaagattggtagaaaacattatggtgaattagaatttcttgaaccggtagatttaacttctattgtcaatttagatgacattgctggaaatttggttacgttttccaacaagacttgtgttgtataccccgacgataataagcctaagccaggagaaggattgaatttaccagcacgaatcacattagaaggatgttatccaataaataaagctgataaattgccaatattagatcctaaaagtgaaattgttaaacgtcatattgagaatttaaaaacgataccagagatgaaatttattagctacgatcctacaaatggtcattggacgtttgaagtacaggaaatggattaa

SEQ ID NO: 5032 - DNA, 1344 bp, Candida albicans
  unsure (1338): Identity of nucleotide sequences at the above locations are unknown.
tggtccatgaggcgagcaaaatgtaaagaaagagaaaagctgagagaagaaaaaaaaaaccataacataaggatactacattttaacaccaatcaactttcccttcattcgcaaagtcaattgaatatcgaaatgtttggaggaggagcatcatcaggttttggaggatttggttctagtactacaaccaacaattcaccatttggaggcggagccggagccggagccgctacaactaacactggggcatcaccatttggatcaactaatacaaacacaacaggtggtggtatctttggtagcaacgccaattcctcaacagggtttggttcatccaatgcatttggtgctagctctaatacaaatactacaccggcatttggaggtaatactggaggtggactctttggttccacggccaacgggaccggttcatctccgtttggtcagcaacaacaacaacaacaacaaccacagcaaactacatctgcgtttgggtcttccaacaattcaggatctgtttttgggtcatcagctactggaggtggtttatttggtagcaagccagctacgtcaacttttggtggtttcgggtccactactgcaaatgcatcttcaccttttggagcatctaccacaaatgcttttggtggtggcgcaagtgtcgacccaaatgtcaataatggtacagctgcaaagcaatttactccattcacagaaaaggattcggctaacatgactaacgttttccaaaacatttgttgcatgccggaatataaaaatttctcttttgaagaattgagattgaaagattacgaacaaggaagaaggttcccaccagcaggtgctactgctaatgccggctttggtggcgctgcaggcactaatgctacaggaggggggtttgggtttagtggtgctgctactggtgcctcaccttttggaagtggcactgctggagcagcaaacccttcaggctcagcttttgggtctgcttttggatcaacttttggcaacaagccagctgggacctctccatttggggctgcttctacaacaggtgcatttggaggtacaaatcagaaccagtcaccttttggttccaatacagcaggaacttttggttcgggtgcatccaatacttttggaggtggtgctaacagcacttttggtaaaccagctacaggatttggttcttctggtggggcatttggtggcaatacgaacactggaggagcaggtggtggtttatttgggtcgagcggtaatgcttttggtggtcaaagctcatcgcgttgttttcaccccgggagtgacgatccgcattaccttaccgcnaaattt

SEQ ID NO: 5033 - DNA, 2076 bp, Candida albicans
gttcatcatcatcatcatcatcattttcattttcatttcaacaacaaatctaatacaacacgtttcattactcatcaactactactaccattttcctacaaatacttgattcttatgtttatccctcagaataagtctaaacgactttctcttgataaaattggtcaattagaagaagatttagaattaaatccattagattataataaatggcaaaaattaattgatcaattaatcattaaagataatcaagaacaagttcgaaacacatttgataaatatttgaaaatttttaaatttgatggtgcttcatggtgtaaatatattaaatatgaattaaatcgtgatgaaaaagaaaaagttgaaaatttatttcaacaatgtttaggaatcaccgataatgttgaattatgtcgattatacgttgattatgttcgtggtgttactgattttgtcactggaggagaaaaagctcgtggtgtggtggtccaagcatttgaatttgccattaataaagttggcatagatataactagtgaaagtttatggcaagattatattcaatttttacaaagttggaacccaaatgccaattgggaacaacaacaaaaaatcgatttaattagaaaagtttataaaaaattcttgaccatacctacagaaaatattgaagttagttggtctcaatacaccaaatgggaaaatgaattaaatccagctacagcatcgaaattcatatcagaaaaatctggtgaatttatgttggctcgttcttggaatacagaatttaatcgtataactgataagagtttaaaacgtaatttaaaccctggtgaccataatgatgaagatgttgttaaacaattgaaatattggcttaggtggttagaattagaaaaagaaaataaactagaattaaaagatgaaactgtaaatgataaacgtattcaatacgtatataaacaagctacttatgctctaccttttgttccggaaatttggtttcaatacgtcaaatatttattagtacagaatgaagaaggtaatttacaagaaagtatacgacttttaaaagaaggtgggcttgctttaaatccgaaaagtatgcttcttacttttcaacttgctgaattatatgaaagagataattcatttaataatgccaaaattgtgtttaaaaatttacttgatgctttacaaaaagattataattctgtggccaatcaaattgctgaattaaaagaacgtattgatcctgcaacagataaagataatattcaggaagatgacgacgacaacgaagaagaagaagaagaagaagaaaacgataacgataacgataacggtggagacctgaaacaacaaccaccctcaaaaaaacttaaacttaaccccaatggtggtcaaaatggatctaatagtgaaaataacggagaagcagtatcagcaccatcatcatcagtcaagcttccccaagtttatagaatctcattagccgattccaaacaattattgtcatttgaaaatgaacaaaagcgtttatcagatgcaattactctaacttatgttaaatttatgatagctagtaaacgttccgaaggaattaaagaagctcgtaatgttttcaaacaagcaagaaaattcactgatattggatatcaaatatttattgaaagtgcccttttggaacattattctgataaaaaatctacggcattaaaaatatttgatcttggtaaaaaaaattttgctactaatgggaaattcttattgaattatttagattatttaattatgattaatgatgttgatacaatgagaacggttatacaatcatccgatgctaatttcactaaagaaattggtaatttacaagaagaattgaaattaactaatttagaccctataactaggaaaaaacttgaaaaacaaatcactaatttaaaaaaatttttaaaacaattgtataaaaaatatatttcatttgctgctacatttttatcattggatgttactcatagttttgctaaaaaatgtgaacaattgtttcctaaggatgatccaattgatttattc

SEQ ID NO: 5034 - DNA, 2346 bp, Candida albicans
tccaacacagacacattcacaactcatcaaatgatacaatcagaggatcataatcaacagccaatgccttcaagtaccgaatttagcatgaaggattcatgtttgtttactcaaccagaaacgaatatggaaactggaggaaatgctttcaatatgtcagaatcattattattcaaggatgtgatacatgactacgaaactaacgaattttctaaagcaaatcagactaatttacatgatctaatagcacctcaagaggatttggaacctaatcaagaaagcttaaaacaagattcacaagaacttgttgttgttgattttgatgacatggaccaagatttttcaccagcatctaaaccatcaaagacagtaaaactattttcaggtaaacaaattaagttagctccaagatctaccgagagagtaaatatcgatgagaagcaactttcaggaatatttctagatatggattctttaacgaacaaggccaacttgagaaattcatttaaagaaaatagaaagaaattatcagaccccccatcattgtcatccattaagcatgactctacttcgtctcaaatctggactgaaaaatataaaccaaatagttttatccaattatgctctgcaggtaatgatagacagtatagattgattttgcaatggttgaagaaatggtcacccgtggtgtttggtgacgatattttaaacacggaaaattcagatctcttgggaagaccttataagaaaatattgttaatccatggacctactggtattgggaaaaccactatttcacacattttggcaaagcatatgggctacaccgttcaagagttgaatgcagcaaatagtatggataccctaccacaggcttctggcggtgggtctactgcttacaccaatgcagcttctgcattaaaactcaaaatcgtcaatgccttgacatcaaattctattcactcacaaggtaagccgtcttgtttaataatagacgaaattgactccttggcaaatatcaatgacgttgtcaaagtgttgaatgatttggtccaagcagatcaccgcgccctcaacaaaaaactaaaaagactgtcgactgaggaaatcgaagccaagaagaaatcgaaaaagaaagacatcttcttaaatcgtcccattatttgtattgccaatgacatttattcccaacaatcaaatagatttggacccaatcctatggagaaattgagaccaatctcagaaattatccaatttagaaaaccaactacttctaaaacatcatccggtgcaaaaacgggagggaatgccatcaaatcagtcaaagattatttgatgcaaattaacaaacaagaaaatatgggacttgatcatcaagaaattggtgatattgtggaaatttgtgaaggtgacatcagagcatgcatcaatcatatgcaatttaatagtagaattgtagacactattgaaagaagaatttcgaaggatactcatttaattgatcgacagctttcttggtttacaatgactgatcaacttttcaaaagagaccctcagttgtctaaggaagagaatcttgctcgcttgtttgatgggtttatgaatggggaaggtagggcattggcaagtaattctggaacatttgacagagtcctcaaaggcatatttgacaaatatttagacactgttcacattcaagacgactcgttaattaaaccttgtgaactcagtgattggataagttaccaatcgcggttcaccagaattaatgagactaatgaatactctccattagttttgttaaaggcctcatctttatttagcgatatccgagtccagccaggaaaccaaacattgattcctaatgccaagaacttagactttgaacacagtcaattattgaaaagtaataaaaatataattcgactgatagaaaatagattgctggtacaaatgagagtagcccttggtatgaacgctgagaatgctgcaagtttagttttaccatgcttggccaaaatattatctcctcatatgtcagctaaagtaaagtctgatttgaatgttacagaaaagaaatgtttagaaaggattgctggattggtgaaagaactcgacttgtccttggaatacctgaaagatttggaaactggcttatcgtcactcaagttgaatccagatttggatctgttgacaatttatgataactacttgacaactattcctgcagcatctgttgtgaagcaaactcaacttcgtcgtcaatcgttgttcccattgattacagcacaattggatagaattgatgtttccaagaaatctgtcaaacgttcattcacaagataa

SEQ ID NO: 5035 - DNA, 312 bp, Candida albicans
ttacagcacaattggatagaattgatgtttccaagaaatctgtcaaacgttcattcacaagataacactaaagaatcaaataacggagataaggctgctaaaagatcgaaaacccttgccactacaagccttaacttctttaaagggagatatgaagaagttaattccaaaactcatactgctaatactgatgaaggatcatctgatggagacaaggagtttaaaacttcaagaatatgggtaaaatacaatgaagggttctcaaatgctgtaagaaagaatatcggttggaatgatctctggatcgtttaa

SEQ ID NO: 5036 - DNA, 1596 bp, Candida albicans
  unsure (1431),(1485),(1521),(1586): Identity of nucleotide sequences at the above locations are unknown.
atcgtagcatgtataaacttatatgttgttgaagaaaacgtctatttcaatcacaatttctttgtagggccgtttttgcaaacttcccataaaaaaaacactgaaaattttcaagatccgtttgacttacacataattgaacggaatgcgagtataaacgcgcgatcaaagaaattaatcttgtacatacagcccgtcctacgtgtgtgtctacttccattccatttccaatactcaactgcctgtcaagcttacattagaatgtccaaggaatttacagtctttgttgttgatgcatccaaatatatgggaatagcagacccaaatgtcacggattcagattttacgcgggcactggaatttgtgattgactttttcaaccaacaattgatgagaaacagaaagtcagatagatattgtttagttgtttactcgggaagtatgatcaaggtaatctatgataataccccgttgtcattagtacaagttaaaacataccgttctaccatgaatgaagtccatgacaatgatacaggcgaagttcacaagtatgatttgatccacgctttgttacaagggctagatcggtttaaagtaaatagtcattataaattcacaagaaatattcgtcttatcacaaatggcgtactttccatggataaaaataaatcgatctcagaatatgtgaacatggtttctaaccttaatataaatataacgtttgtgttaattgataatgaacacaatgaatatactcaaaagagcttacaagttctttccagaacctttaacaatgcaaatttagtgagttttaatgaacttatgaatgcgggtccagctcttcggttgattgccccaaggtgtagtactgagggatacttggggtttggtgaacttggaaatacttcggaaatcaaaaatatgatacatttagatatccaagtgtatccagctattaaggtacaaagccaagtgcatggacacgagtattacgtagatccgaaactgaaagaaagatcaaagattgaaagatctacatattattatacacggacaaaggatgacttggatgaggaagatgacgatgaagagggagtagaaaaaggtgatatactggatagaacgattgttcctcgagcggaatgtactcctggttttaagtattcgcatcgtgatatactagcattaacttctgaattgacagaagtagccactttaccaacatcccccagtatcaacatattgggatttatgaaaaagaacaactttgcttacgcatatttcactgaagaagcaacatatgtgattcctcagcagaatgattctgagcgcaacaggttgacttttaattccatggttgctacaatgattgaattggactatatagctttggtgaggttcgtgccgaaatcagacgacgaggtccaggtntgtgcagctttcccaagaaaagttgctcttggtaaccaaattggcgaggttctnttattggtcagaattgccatgaaagaagatgagaanattggacgtttcccagaacttagtgacacagatgaatattcgggtcgaccagttgatggaaagtnttatatttga

SEQ ID NO: 5037 - DNA, 1236 bp, Candida albicans
  unsure (641): Identity of nucleotide sequences at the above locations are unknown.
caatggatcggcccatggccagtgtgtgaagacaaagaaccgatagcattggatgaaaataaatattcatatctgacatattttagacaattgtcacaagtgggatttcaagttcatcaacgtacaattcacacgtgttatggacacacaaccaaagttccaattttcttcaatgggaacggtccgttttcctttgagtacgactttttggatgttaactctagaaagaagttggttgatacggtaagagttagcaatgtcgagaattatgcaattgacacaccaaaagaattgattggtaaaacatacgatttgaaattgagcaatgcaaaggatagatttggctgtgatgctataatagttgatgcaaactctccagtaagggttgttagcagactggatatccctgaagttgaatttagtcgagctggacagaaattgcaagttgtcgaaggctcatatgttgatataccattgtcgattaaatctaaaattgcagttaatggcaatgacaagattgaggttaaatatttggggccaacttccaaagagcctactattagacgggctcaattggtcggctcttcaatcagattatcagacgaagggaactattggttgcattcttttgaaagtaatgngtgtgctggtcgtataggaaaggcaaaacaatttgtcactattggctactatgcgaaaccgtcattagcaatcagtgctaataacgacatgttacaacatacagatgattcaacaattcatttgaaaccggtttgtaatggttgttccaatgaaattattttgaagttaactggtgaagcaccatttgtggtggattatgaaatagacttacccagtggaaaaatggaaacacattctatgaacattgatactcacgatatcaccatcaaattgccaactagatctaacgggagatttgaacatcagttcaaacgtgtttatgatcgtttatacacaaaaaccagaggaaaacccacaagtttacatgttcctaaagttatttatgacatcaacccattaccaacggcacagtttttgcatgatgatcatttcactcaagtatgtgagaataaattatctgaagactcagttattgctcatgttcctattcaatttagtggtgcatatccatttgacgttttgttaacattgacgaatgaaaaaataggaaagatgcatgatattcttcacccgacggggctggaaggataccgc

SEQ ID NO: 5038 - DNA, 792 bp, Candida albicans
cctgccagctccgtggtgaagattttatggctcttaccagttttgaatatccagtacttgtcattttcgcctttaaaaacattattacttacaataacactatacggattctcaattttcttggtgagtgctatggcattaccgttactatccaatgtatttttaccaatttggagattcttgttgcaaaaaaaggaattgaacataattggtgaatcaattgatagaagccaagtgatagatatggattcacattttaaaggtcaattgaccattcattatttaccagactcgtcagcaaaaatgaatccgttccatttcgaccagacgtgtcttggattggacaacaatcatctcattaacatgcccgttgagttcaataccacatcgggaattgggtatttacaagtacaacacactacccctgacaacgaaatccaatatttaaattatactggacattcccttcggagactctttaaaaaagactatactcacttgtctcagtataaagattataaaaagtctgacaaaagaattttctatttggaatacccaataacaaagccaggaatgtacaggatcaaaaatgttttagataataaaggaaacagcattcgtacatacaaatcagaatttgtgatttcagattgtccactggcaaagtttttttatcctccaaactttgaaagctcaaatgggttcaaatgtgtcacaactttagaagatgatagtttcccattgccatgggtggaagtttccagttaccaccccctcgtctgtaaagcttaa

SEQ ID NO: 5039 - DNA, 273 bp, Candida albicans
ggtgactatttgatagaagatcttcatgaaggggatcaaacagaattgatatttactttccttggggagccaccattccaacttacttatattcgtacaatcgatatcagaaaggggaagaaaacttttaggaagttggttgagaaggaaactataaaggatatatggcaacatgagttggtagtaatggcaagcctcgaaggtacctatgaagcaattgagatacaagataagtattgtagggcggtcaagaaagttgattatatagagtga

SEQ ID NO: 5040 - DNA, 1257 bp, Candida albicans
cattgtggagattttcgagttaatatggaaattttaaatcatccaatattaaggccattcagtttgactcattcaaagaataatttgttacaactgattgataaagtatatttggatactagttatatgtcaccaaaacataatttaccaaaacaagaattagtttgtgaaataatggctaatttatttcaagatttaattcaacaagaaagaaataaagatgaacaaaaaaaaacgaccagtaatttattttcaaattggtttggaaatttcactcaatcaagaataactgatttttgtaccacctcctcaacctcaaaaaatggattaacaaggcctatcaggaagaagaaatttttaatagttattggtacttatataattggcaaagaaaaattagctatatcaattctgaaacgtttaaataattgtttaatttatttactgagtattggttcacgtaaagataaatttgaaatttttaaaacttataaaaatgattatttaaatctggtaatgacaattgaaaaagaatttggtaacatcaacgatacaaacgatagtgattgtatgattcatttagttccaatgacattagtttctaataatgaagaattgagtaaatattttaatcataataaatattatcaatttttcgaacgatgtattggtctttgtccaactggatggagttatagtaagatagccaatacaaaaaaaccaaatcaacaacaacaacaacaaaaagaagaaacagaaaacgatgaaactggtagtggttgtggtgatagaactgatgatttgttaatttctcaattggaacaaactataaccatgatgaaaaatcaaccatcatttaattatatcaatgatatattatcacaaataccaacaacaacaccaaatagcaccaaaagaaagactaagaccaataccaagactaaaaccaagaccaaaaccaagacagatcctgatttatatcgattatattcagttccatatagtgaacattcatcatttagagaattagcttattttataatttttttccaaattaaacaaactattccaacggttaattatgaaaatgaatttcaattgattaaaatgaatcgaattattcaaaattgggaaaaaatccgacaaattatacttaaaagtgatagcaatggtagcggtggtgttgatgatgataataataatattcctgatgatttattacaacgaatacaacgattgtcattgaatgatttttaa

SEQ ID NO: 5041 - DNA, 1677 bp, Candida albicans
  unsure (1115): Identity of nucleotide sequences at the above locations are unknown.
aggaaaaaaaaaaagtaccaaacattctcatgtaaaaaatcatctctattttttctctataccatgcaactgggtaacacatttcaaggggagatacacgagtttcctggtgttgtggttgataaatttagtggaactgcggaagtatacttgctcacacattgtcaccaagatcatttgcaaggactactaaatagttcattttgtggtcgagtatactgttcggcattaactaaaagtactctagagttggacacgaggtatacccgtgtgtctagattcttcaaagccaaagagtacaatgaaacatttacagttgacattttgcttggaaaagtttcgattaccatgatcccgtcctatcattgtccggggtccgcgatgtttttactcgaaagtttttgcaaaaatgtattgattactggtgatgtcagagcagagtcatggtggactctttcgttgatcaagaacccacacttgtttccatatatcacaggactcaaaacacttgatcaaatatatcttgataccacattttcttaccgaggcgaaccatacatttacatcatgcccaatagcgaaggtatatttgcagcaatagaattgttaaagctatacccatttgacagcgatctatctttctcttttgtggatacagtctcgggatccgaagaagcttggttccagatagttcgccactttaatgggaccttagtgtcacatggtatcctacagaaacggcttgatctttgcggcatggatttggtggacggaaaaactccaacatttaaagttggcaatgtaccggatacaacaccaataacaatcgcaatcaaacaaataatcaacttgaatgccatagaatacgccagccagtttcttcccagaaacatttgtgatgtcgacttttctagtgctacaagcttagtgaccaccaaaaaaggccaccacatatatctgttagacggtagaaagtggctacttcctaagggtgggtcagaactactaccaacttgcatcccattaatgttttcaagacattcgtcctaccaggagtccagaaacttggttgcattgtctagccccaaactggtgtatccttgtacggaatcganagtgtcttggctaaatgggtttacagtaacaagagtttttgccgatgtatgttccagtgacgatcatcgctttgatattgacagattccagaaatatgggtaccctttaccggatgtgatcaatagagaagtggcgttcataagcaaatggtctctttcacaacccgagacatccaaaagcgttgttgaaaaacctttccgaggacaactacaaccgcttcactgtaaaagaccccacgagtcccacttcgataacttttcgttgccatatttgatcgctcaaagagatcgagagtcattgaaacaagctgttgagtatcaccagaatttacacgattatgcaaaattcgatcacggatcatcaagtagctatggatcagtatcgagttcaaaagagtctatgtatttttccgaaaccgaactattaaccaatcacgattcaccgttgagtaccaagacgccagacactaacaaaatcgctgaaattgccaaaacattaacaaatgacagacgcaactggacgaaattccatcttaaatgtataggtagtaatgccaactaa

SEQ ID NO: 5042 - DNA, 549 bp, Candida albicans
ttagtaaaagtatctggcgtcatgactaatgctaattataataataaaaagaaaatccaaccaattattttcataaatcatcgacttgtcacctgtgaaccattgaaacgagctataaatgctgtatttctgtattttttacccaagggaagtcattccttttattatcttagtttggaaattaaaccagaaaatcttgatgtcaatgttcatcctacaaaacgtgaagttcgatttcttaacgaagatgaaataattgatactattgttagtgaaatacatacaaagttgtcaagtgttgatacttcaagaaaatttaaaacccaaagtgttatcacaaagagaagaaatagtgatgaagaattagaagaacatcaattaccaaaaacactacagccatctttgaagaaatatcgacaagaaaacaaaatggtaagagtggatgctagtcaatcaaaattgagttcatttatgcaacagcaaccatcacaaaattaccatgatgtgatgaggaaagaatttgaatattattcttcttctgataattga

SEQ ID NO: 5043 - DNA, 1221 bp, Candida albicans
aaaccagaaaatcttgatgtcaatgttcatcctacaaaacgtgaagttcgatttcttaatgaagatgaaataattgatactattgttagtgaaatacatactaagttgtcaagtgttgatacatcgaggaaatttaaaacccaaagtgttatcacaaagagaagaaatagtgatgaagaattagaagaacatcaattaccaaaaacactacagccatctttgaagaaatatcgacaagaaaacaaaatggtaagagtggatgctagtcaatcaaaattgagttcatttatgcaacagcaaccatcacaaaattaccatgatgtgatgaggaaagaatttgaatattattcttctctgataattgaagatgacactatcaatactgaacaagatatactcgaagaaaacgaaaaagaagaagcagagggtgaactccctgttgaatctaattcaattttagagtctccatcaaaactagaaatgaaaatcgaaaccaatcattcacgtaaacaagtacaagtaaatttggattcaatagctctgttgaagaatgatttaactttaataatagataaaccattgacaaatatttttaataatgcagtttatgttgggatagttgatccatggaaaagattatgctgtttccaatatgatgtcaaattatttttatgtgattatgctgccatgttattagagttctattatcaaattggtcttcatgaattttgtaattttggagaaatagaatttgatgaaccaattaaattaatcgatatattacagccattatatgataaaaatgaagatttgatacctatggagaaagttattcatgccattttccatatgaaagatatgtttaaagaatattttcaaattgttatcgatgatgataaacaattaacaactttaccaatgttattagttggagttgaacccgatttcaataaattaccatatttgatttatagattaggtacaaaaatcaattatggagatgaaaaagattgtttaagaggtgtattgagacaaattgcattattttatttaccagaaccaactaatgatgaaattaaaaataatacatttgaaaagcaattagaaagtatcttgttcccggaaataaaacgacaatttttggcaccgaaaaacttgcttcgagatgtgatacaaattgccgatttaccaggattatatagagttttcgaaagatgttag

SEQ ID NO: 5044 - DNA, 735 bp, Candida albicans
aataagatccatattaatacacgtattgttcgcaattcaaaaaccatgagtgaacccacttgtacaatcaaaagactagatgaatcagtaattaacaaaatagcagcaggtgaaatcattatacaaccagcaaacgcgttaaaggaaatgttagaaaattcaattgatgccagggcaaccatgattgaaatacttgttaaagatggcggattgaaattattacaaattaccgacaatggccatggtatatctaagatagatttacccttattatgtgaaagatttgccacttcaaaattgagtaaatttgaagatttggaatctattgccacttatggtttccgtggtgaagcattagatagtatatcccatatatcacgattatcagtgattaccaaacaaccaaattccaaattggcctataaagcttattatatgaatggtcaactatgtagttccaatttcaaatcatcaaacaccaatgtcgaacctaaaccaattgccggcaaagatggaacaccaattattgttgaagatttattttataatatcccgtcgagattacggggattaaaatcgaaaagtgatgagttcgctaatatattggatatcgttggtcgatatgctattcattgtgataatgttcggtctaattgttcaaaatatggagatccattacaccaattaaccaccgtccccagattcccttttgtgaaaagatcccaatttttttag

SEQ ID NO: 5045 - DNA, 654 bp, Candida albicans
ttcctgatacctattgcactttcctatattctacaactacttctaagaaactcattatatttcatgtcggagacactgccatcgattaaaactatcagtaaatttgatatctccaaaataacctcgagccaagttatcattgacctaaaggcaatcattaaagaattaatcgagaattcaattgacgcccatgccgataaaattgacattattttccacaattatggcgttaattccattcaaattcaagataatggtaatggtataaatgtaaccgattttgaaactatttgtctacgtaatcacacatcaaaaattgaaaattttgaagatttggatcagttaacaactttgggatttagaggagaagcgttaaattcgatttgttctttaagtaataaattaacaattacaactaccaaagaagatctttaccctaaatgtcatgttttgaactatgacaatatgggacaattagttgatcaacgtatcaaagttggtgggttaaattataaactggggacttcaattatgattgaacaactatttaagaatttgccagttcgattgaagaatttcgtcaaaaattcgaaaaaggaattagcaaggcaattaattttgtcatcaattatctcatcatatatccacaaataa

SEQ ID NO: 5046 - DNA, 684 bp, Candida albicans
tgcaggtatgttgtactaacacatgcacaaagatatatatatatcataaatactaacaaagatgtttcaactcccatggtcgcttttggtgaatgggatgggtttgaaaactttcttgtattagagcaacgtaagaattatttaaaatcaattgaaggagccaatgaagaagcaagagaagtacttgatcaaatgacaattgaagtgtcgaatttaccttcgaatcaaagatcatcatacaatgctaaaattcgaaactatcgaacagaattagatactgtgacagtgacatataataaacttttagatgctcaagataaagttgaattatttggtagtaatagatataccgatgatagtggcgattcatcagaacaacgtaaacaattattgagtaataattcatcgttagaaagatcatcacaacgattacatgatagtcaaagaattgctatggaaacagaaaatattggtagtaatattttgaatgatttacgatcacaaagagaacaaattaatggtgctagaaatacattactgcaagcagataattatgttgatcgttcagtacaaaccttgaaaactatgggtcgtagattgacggctaataagtttataagttatggaataattgcggtattgatattattaatatttttagttcttttcagtaaattttcttag

SEQ ID NO: 5047 - DNA, 1197 bp, Candida albicans
cacacgatggcctctcatatcagaggtaacttgacggaagaacaattaaagaggatagaagcaaatagaaaaagagcgttggaacgtttgcaacaaaaaaagaaaaaagatgctggtgaacatgtgccttcatcaactccgaaaagcacctccaccaccacgacaaaagagactggttcttacagtccaactaaaacattgagccaaattgtcaattcagattcagtccaggttctgtctaaatttgtggaaattgaaacagacggtagtgtgaagaaacgacgcgtgctaacggaagaacagagacagaagatcgaacagaatagactaagggcaatagaaattcaaaagaatctcaagcaaagggaaaaccagaaagatgatagcaccacaagttctaagccggtagacaatatccggttgaaccagaaccgtcctgattcagtggttagttctaccaaaaagttccaacctcctcctattcgcaaacaagattatattgaattcgattttgccaccatgaaggatacgaaaggtgggttccttcaggacgaaaagacaaacactcaaggagcagatgaacaaacattgcaagattggaaaaataagcagagagaactacaaaaaattagagagttgccacctccaatagatttgcagaatattccccgctgccgtgaatgtcaatccatggaggtggatgcaaacttgatgacaaatttcaatgtgcgagcttgccgaaagtgcatcaaagctcttcctgaaaaatactcgttgcttacaaagactgaatgtaaagaggattatttgctcacggaaccagaacttcaagatacgacactacttcctcgaatagagaaacccaaccctcatggatacagtaggatgcagttatttgttagatttcaggttgaagaatttgcatggaaaaaatggggaggccctgaggaacttgacaaggaatgggagagacgtgaagagaacaaggtcaaacgtaaagaaaagaaataccacgaccaactccgtgaaatgagaaaaagaactagggcagaggagtatacccgaaaattgagagatggcaaatcgttaggggagagacatgtgcatgattggtcttcgcccgtgaatatagacaaacacacaatcaagcggagatgtattgactgtggtattgagacagaagaagtggtgatatga

SEQ ID NO: 5048 - DNA, 810 bp, Candida albicans
gaaggaaggaaggaaagaataacaacaacaacgacaacgacacatcatactgcaaagcaatataattatagacatcaccttctcccaattatgccattggtagaacgtatagaaccaggacctgacacaattagggttctactaactactgacaatcatgtaggagcatttgaaaacgatccaattagaggtgatgatgcatggaaaacatttgatgaaatcaccaccattgccaaagataaagatgttgatatgataattcaaggaggtgatttatttcatattaacaaaccaacgaaaaaatccatgtatcatgttatgaaatcacttcgatccaattgtatgggagatcgtccttgtgaattagaattattgagtgatccggctcaatcattaaataatggatttgatgaaattaattatgaagatccaaatttaaatatatctatcccggtgtttgccattagtgggaatcatgatgatgccactggtgaatcattattactggcattggatgtattagccgtcacgggattaattaataattttggtaaagtgaaaaacactgaggcaataactgtttcaccaatattattacaaaagggacaaacaaaattggcattgtatgggatgtcaaatgtaagagatgaaagattgcatcgattatttcgagatggtggagtcaaatttcaacgtccaaatatacaaactgaagattggttcaatttatttgttattcatcaaaatcatgctgctcatacttatacttccagtatatcttcaccacgcggctggaaggagccgagctgg

SEQ ID NO: 5049 - DNA, 717 bp, Candida albicans
ttgaagaaaatttacatcattaaacacaccactgaattggaacttcaagatattattcgggatttcttacaacaaactcaattatcattagttcctgaaactgaaatgaatcatgccgttaaaaaatttgttgaaaatgatgataaacaagctttaaatcaatttattaatcaagaaattaaacgagaaaccaaaatgttattagatattgatattgatgaaaatgaatttcatggagctgatgaaaaacatgctaaaacggcgtttaaacatgtattactgcaattgaaaaatatcaatgggcctattaatatagattatgaacctgaaattgaaccaactaacaacaacaccaacaaaaagtctgctactacaaagaaaagaacccctaagaaaaataccaccatccctaaaaagataacaacaacagccaccaaaaaacctaaaattgatgatataattataagttcagatgatagtaatgattacggcaatgacgacgatgacgataaagaagaagaagaagaagaaaatgaacatgactctggtcttcgtttgtttgtgactgatacacctgacaccaatagtacacgtcgatctaaaagtaatcgatccaaaagaccaactagttatgttgaagatgagtcaggtatacttagtgatgaagatgattatgttccacccagtcttcaccacgcggatggaaggacaaacgct

SEQ ID NO: 5050 - DNA, 246 bp, Candida albicans
agcaaccatgcaatgccaaatcccattgaaaacccattacccttgattagattgcgagtcgagtataatggtcgatatgaaattgaaaatgtgacgagattttccaatagatttgttggcaaaattgctaattttaatgatgtggttcaattttataagaaaagaacaccaccaaaaagtgataataaattcactcggaaaactaaatatgacgttgatttaattgaagaaaatttacatcattaa

SEQ ID NO: 5051 - DNA, 5262 bp, Candida albicans
  unsure (668): Identity of nucleotide sequences at the above locations are unknown.
gaagagaagaatttttttttttccaactctgccaactattcttctgacaatttatatcctcttttacttacacatctcgccctacttaccaatatgtctgatacttctaaatcagtacttagtaataaggagttttctttccctagaggtggatccaaaccattatcggctttggaagtgaaagagatttctaatgaagccactaaagatgttttatttgaacaagcagaatcaaataaacgatcaaactccaataaatctgaccaaccaaagaagaaacataaaaaatcaagtaaaaacaaatctaagaatgacaagaatgataatgatgaagaaactactcaatcggttactattgaaacattcaatttcaaaaaccttgttagtggatcaacagtattaggtcaaatcaaaactattaataaacttgatattggtttagctctcggtgataatttgacaggttatattcccatcacatctatatgccctcaagttactgaattaattgaaaaatttgaacaagaagaaagcgaagaagaagaggaagaagaagaaagtgacagcgaagaaactaagagtgctactttcaaatccaagactgaaaaggaattcccagatttattcaaaatattcaaattgggatcctggttaaaagccaaaatcantacttcacatgaagattacaaaaataaaaagagatttgaattaaccatagaaccagaatctgtcaatgaaaatttagaggttgatgatttgattgtaaacaatattttacaatgttccgtaaaatctattgaagatcatggtattattttagatactggtaaacaagaatattctggatttataagtaataaagagttgactaatgctcaaattgacgtgaatactattgttccaggtttagttattttatgctcaatagcttcaaaaccatctggtagaactattaatttgaaaccaacgactgctactgtttccgccaagaaaaccacagtttcaacaatttcatcaatcgattctatacaaccaggggtgattgttgatgcattgattaatgatgtcactgaaaacggattggtcaccaaagtatatggtttagtggatggaaccattgccttatcacaaatccaaaattttgaattgaaagaattaaaacataagtatgccattggaagcaccgttaaggcaagagttttagctgtgttattgaaaaatggtaccaaaaaattgattttatcgatattaccacatgttttacaattaggtgatgattcttctcaaactgaagcacttgaagcattcccaattggacatgtttttgatcaagttaaagtaattggtaatgataaacattacgtgtatgtttcctttggatcaagttcattatttggacaaatacatcaatctaaatttgatgataataaatcattacttgattatagtattggatctactcataaatctagagtcattggatttaacgaagttgataatttgttaattttaacttttgaatccaaagtgattgatgctgaatatttgaatgttagagatgttccaataggtagacttcttccaaatgttgaaattttaaaagttttggaagatggtgttggtattaatgttaaatttttcgatgaatttaaggggtttgtacctggaaatcaaatgtccgatatcaaacttgtttacccagaaagaaaattcagagtagggactaaaactaaaggtagattattaaactacaatggtaaacgtgctttggttacatttagaaaagcattggtcaatttagaagatgatgagattttgtctgacattgatcaagcagaaattggatttaaaactaatgccattgtggaaaaatttgttcctaatggttgtattgtatcatttttcggtaatttaaaagcatttttacctaaaactgaaatttcagaaacttttgttcaagatgctagtagttatttgaaaataggacagattgttaaagtcagaattttggatatcaacaaagaacaaaaaagattagtggttacattaaaacaatctagtgaactttcgaatgcacaaaagaatgaaatcagtaaattagtttcaggtaaatcaattgtgaaaaccgttgttgttgaaaaaactaaagattcagtgttggttgaattagaaggatctcatttgcgtggtgtgatatatgatggtcaattatccgatgggaattatgaacaaaatagagctcttgctaaaagacttgccattggagaaactttagaagttttgatcttagataaagacttgaaagctagaacagttattgccactgctaaaaaatctttaattgatgcctctaaatcaaagagtttccctgttgaattcagtgatattgccgtcaatgatgttgttagaggttatgtcaaatctgttactagtttgggtttattcgttacttttactggtagattaaccgggttaattttagcaaaatatgtcaccaaaaatgctaatgaggatttatcgaaaaaatttcacaaatatcaatcaatcaattgtcgtgtgttaagtgttgataaagagaatgagagatttgtgttaaccttaaacaactcgtcttcattcactaaagatgatgaacaattgattaaaccaattgatgctaccaaaaaaattgttgctgattatcaacctggagaaactactaaagttgttattaaagccgtcaaaggtacacaattgaatgttcaattagctgataatcttcaaggaagagttgatattactcaatgtttcaaatctatcaaagacattaagaatttacatcaaccacttgcttcaagtttccaaaaaggtgaaactcttgatgtaaaagttattggaatccatgatgccaaaaatcatacatttttgccaattactcatcgtaaatccaatagaacaacaattttggaattatcattaaataatcctcaaattaacaataaacttttaactgatttaaaacttgcagattttaaacaaggtgatgaagttttagcatttgttaataatattactaatggtatggtatgggtatctatttcaccaactatcaaaggtacaatccccatgcttgatttaactgaagatggttcaattttccaagatattgataataaattaccaattggtaatgccattaatgttaaagtgaaacaagttgatttacaacatcaaatattagtattaaccgcgagaaaaaattttattgaaaaattcgaagatgttagacaagatcaaacatatccagcaagaattattaaaatcaaaccaaatcatgtattagttgaacttggtaataatgttattgcctcttcgtttgttactgatgcattaaatgattattctgacaaattggatcatgttttcaatgttaatgattatgtttctgctaaagttttggatatcgattcaaccaacaagagaatttccgttagtttaagaactgataaggcaggatcagataaagttataaattctatttctgatttgactcgtggacaagtcattaaagggttcgtgaagaacatttctaataatggggtttatgtttctttgggtagatccatttatgcattagtaagagtatcggatttatctgattcttatttaaaagattggcaaaattttttcaaaccaaatcaaccagttattggtaaaattgttaattgtaaacaagaaggtagaattttaatgacattaaaagaatctgaagttaatggtgagttgaaaatcatgaaaacctttgatgatttacaaattggtgacattttcgaaggtactgttacttcaactaccgattttggagtatttgtgaaattagatggtactgtaaatgttagtggattgtgtcatcattccgaaatctctgaaaatgatgttgataatgttaaactgttgtttggaactggtgatagagtcaaagttaagattttaaagattgattctgaaaagagacaattgtcattaggtatgaaagcttcttattttattactgattccggaaaggaagataatgatgatgaagatgttgaaatggaagatgcttctgaagtgggagaagaagaagaagagggtgaggaccacgaagaaagcgaactggaggaagagaaagaagaagaagatgatgatgatgatgacattatggatgttgatgacaatgacgaaaacgactctgaagacgaagaacaatcagctgatgaatcacaagaaaaatccttgtccactggattatcaactaatggatttgattggacagcttctattttagaccaagctgatgaagatgaagaatcatctgatgatgatactgatttcactgaatctctgaaaaagaagtcgaaaaagaaatctaaatctgctgttgaagataaaactggtgatttaaacactcgtgcaccacaatcgactgctgattttgaaagattattaattggtaatcctaactcatcaattttgtggatgaactatatttcattccaattacaattaagtgaagttgataaagctagagaaatcggtgaaagagcattgaaaacaataaattatcgagaagaacaagaaaaattgaatatttggattgcattattgaatttagaaaatacttttggtactgatgaatcattagaagatactttcaaaaaatcaatacaatatatggattcgtttactatgcatgaaaaattggtaaatatttataaaatgtcagaaaaatttgatcaagctaaacaattgtttaatagaatgactaaaaaattcggtaaagttttaaatacatgggtattatatggatcattcttattggatcaaaattctcaagatgaaatgcatgaaattttggctaaagctttaaatattttaccaaaacgtgaacacattgaattagttaaaaaatttgctcaattggaattccagaaaggtgatccagaacaaggtagatcattatttgaaggtttagttgctgatgctcctaaaagaattgatttatggaatgtgtatattgatcaagaaattaaacaagacaacaaaactagtgatgaagatgacactgatattaaatcaaaagtggaagatttatttgaaagagtattatctaaaaaaatcactagaaaacaagctaagttcttctttaataaatggttgaattatgaagaagataaacaagatgaaaatatgattgctagagttaagtcaaaggcagctgagtatgttcaaaataatagttga

SEQ ID NO: 5052 - DNA, 255 bp, Candida albicans
ggaatggtacgattgggactccaaagacccttattaattaattgcaagaaatcccaaccgaatataatcccgttcccatcacattggagttcgaaaaggaattattgttcttcacgtagaggtatagaaaaattaccatatcagttacccaaatatattcaagcaacaggaatttcagaaatgagatcaggtggacgtgatcacaggacattgcgtcaacaacaaagagaaaaagttcaaccccaaaatgggtaa

SEQ ID NO: 5053 - DNA, 804 bp, Candida albicans
gatcaggtggacgtgatcacaggacattgcgtcaacaacaaagagaaaaagttcaaccccaaaatgggtaaactagatatggattatgaaaagttataccaagctttttttaagttccaaataaaaccaagagtttttccctatggtgaattatttgaggaaggtaaacattccaatgatgaacttgttactaaagctgccaaaattaaacctggtattatttcattggaaatgagactggcattaagtatgccacagaatgatgggactattccaccagcttgggttaccatcatgagagatatagggaaacctccctcttacaaggacttggttatacctggactagatattaaatatagtaatgcagggtataaggatagaaatagcgattctagacgggaaaaattgaaacattggggagcactaaatactgctattgagtcttcagatggagaagatgatgaagaagatgacgatgggcaagatgaggaatctagtgttgctactgattctattgaggtaaacaccacattttatccattggaagaagatgaagtgtctgaagagccatcgttgaatgatatacttgcagggttgtcaagtgctaatgataaacctaaagaagagaagaaattgtataaaattattgaagagaggaaagttacagatgatgattcgttgacaggatatacatatgacttgaaaaatgatagcgtcgaggaatattcagaaaatgaggattccaaaaactctgaggacaccaagaattctgaggaagaacctgaagattttaaattctaa

SEQ ID NO: 5054 - DNA, 1824 bp, Candida albicans
  unsure (123): Identity of nucleotide sequences at the above locations are unknown.
tctcaaaaaaatctagcagcacaaaatatagcagaaactgccaacaaagggtttatgagtcacatcaacaactggacatctaccagtcaacaagaagataataaagtaatttcatcaaatctngacgatcctttaagtgtatcagatatagattccgacaccagtatgctgagtaataacagttcgaaaaactatcactcatcgaaaagatcgattcccgctccagtactttctactgttacaaagaagacaaagatcaccgataaatatttgaaagaatttctggcatatcatgaaccggtgtttgataagccgcctccaacaacaataggaattttagatatgaatcagttagagcattctactaaaaccatgcaaaaatgcgtgtccagtatacttgaaaaggcacctaattgcaaccaattacaatatctcattgaatcagacgagatagataatggtattagacttgaattacaggacaatccattgatagacacggcatcaaaattgaaatcattacatgaaattgggaagttaccaattttggaccaaatcatcaatgatgaagtcaaaataagtgacgatgatttgaaaaaattgaaaaaaatacctgctaaatctaattcagtcaaagtaaattcacctcgtgatgttgtaccagaaattgcatctacaggggttcaccatgatatgccaccgttaccaccaataaatgaccctaaattgtttgaacgggtctttattcataaatccacagtcaacaacaagcaatatcttgaagctaaccatttattacatagtcataatgaaagattggaattctacggtgactctattttaaataatttagcgactcttataattttcaaagagtttcctgattctactgaaggtgacttatcgaaaattagatcaaaattagttagcaacaaaacattaattaaaattgcctttcaatatggatttgacaaaaagttacgttccagaataagtgatgatgtattgaaaactggtgataaaaaaatatttgctgatgtatttgaagcatatatcggagcattagcaatggagaggggttttgatttggaagatgtcaaagaatggttagcaaaagtgtatgcaccattgattcatgagttgaaaattgaatacattgaggagccaattgatagagaagccaaatccaaattatatggacttattggccaagatgatttacatccagtatataatactcttcagatgggtgatggtattcataataaatttatagttcaatgcaccatcaatggagaagagttgggtcgtggtacagcaaacaatttgaaagaggcagggttaagagctgccatggcaggattaaataataatgaagttttgaaaaaatactttgtggcacgccaacaaattgaaagaccaattaaattacaacgactcgaaagagaaaatgccaaaaagagggaggtcgcagaaagattagaacaagaaaggaataaccttccttttacaccgctgtcgccaattagaacctcaatgtttcctatttcagttaatgaaaatgaaccattggacattgatgcgaaaaacaaattatatggtatccttggtagaaaaattggtgacaaaccagcttaccttacatctcagataaatggtaatttgttcaaagttgtgttatgtattagaggcattacgatctgtgaaacaactgacccatcgaaaaagaaagccatggccagagcagctcaaacattgttagaaaatgaaagtgcaatgagagaaatctgtaaagatttccgaactaaggactcaccagaataa

SEQ ID NO: 5055 - DNA, 2049 bp, Candida albicans
tatcacgatcaacactgcatattccaaaagatgtcttttgataaatcaaaatcattattaactgtatgtgatgatttgactcaagttaaggggaatgtttctcagttccaagcaatggttaacaatatcattagtaaagcaccaacgagagaagaatatgaaaagctattgaaaactattcgtcttggtgaagcacctggtgaaactaaacaaacaattgagagactagagcaattgataactgtcctgcaaacaaaaattgccgttcgattaaaagaattatttctagctggatatttgccacttttaacatcattatccaaaattaactttaaatccaatattgaagatcaatttgtgtcttattttatggattataatccagtattaccaagtaatgttgttcaagatttgagagtacttcaagggaaaaaggctgatcacctcacggcacctattgatatcatttcctatcctccaacattgccttctattaatagtactatacttttgcttaggatcatgaccgatagatcgtatcgtcaacccctggatttcattgaactggcatctaatgattataataaaagtcataatggaagattggttttaagaggacgagcaatcatgcaactttgtctagttgaagtattggaagagagttactctcggttacttgacgaagatatacaatttattagtcataaattgatggcaccaattattttaaccaagtttgcatttggttataatttggttgatcatttaaagtacaatgtctccgttgatgctgattacgaagaaaaattgcaaatcattggcaatatatttttggcatatatgggtggactcaaaaccgagggatatgacttgagtgatttgaaattatttgtcaaaagattatatgaaccagtaattgccgactacatgaacaagaacgatgttttatcaaaagttgctcttgtggaattggatcttttatttaaactgataactaatttgttgtatcttcctcgagagaatattcgatacgaaattattcaagttgaatctgatcctcatgtggctagaatcttggtggataatgaagaattagggtccggggtatcatcagtaagttttgaagaagccaaatgtcgagccgctcaagatattttgaatgatcacaaccggataagaaaaatatgggagattttgaaaaataatcatacgaagaataataccactgagacgaccacgaccacgacaactattaaaacagagaaaccagaaacaatcatgcaaatccccatacaacaagcacctccaactatgaattctcatataggtacacctgttgttgagcaagctaccgctaatattgccagtgtgaatgcaggatcacctccaatgcaaaatcatacagcagctatatcaccatcgttggcaaatgcaacagtaagacaaacttcacctcaatttacaatgcagccaccgtcccaacaacaacaacaacaaccatttgcatttgcacaaccacaacgttaccctggcgttgcctaccaaacaccatttctacaacaacaacaaccacaaccatacgtaaactcacccacgggatatttccattcaatgcagcaacaaaatccacatgcccagcaagcaacagcacattcgccaccaccacaattatcacaacaaccgcaacctcaatctcaagcacaaccaccttccaatggagggccattatatgaccaaccttctaccagtatgaatagtgaacagatttatgttgatcaatatggtataccacatttagggactgcatgtaagaatgttgatactaatgctagaaatgatttatattccaaattgggtaaagcaaaaattgctacccctgaatatgaggataaaatatcacctgaaaaagtctatcacgttcttgttctggctaaaggtatttatttaggtggtggatatgatttgaataagaaattagctgctcagaaagcggccatgtgtgcattggctaataaagtgaaattatctgaattaggattgtactcataa

SEQ ID NO: 5056 - DNA, 2889 bp, Candida albicans
gtacgaatccaaatttttttttcagaagatgcgcgatgttgtgtatttgataaatgtctcttacaaaccatttggtctttgttattgtctttcccatttccactaaaaactttccatcaagctacaccagcagcatcaattatggaatcaagtgaactgatacaggaaaaccagttgaatcgatatattctcgaagattatgatcgaatgcttaaatctgtcactgagattgataacccgcaaagaaaatgtcatattttgaatgaagtatacaaaatgaaactaaaatattttcgcttaaagcaatcagaattgaatgattggctagaggcaattcatctaatggaagatactcatgaacgagtgttttcagagtttgagttttattcattgatttccccagattacaccaatgctgatgtgacaagcagttttctaaaacattttcaagaattcaaagacttggatgaatcaggtttcgaagcaaaactcctagatgctattaacatttcttgtcatgatttttctagaggtaatctaatatggaagcaattgatcgacgctgctcaagatgaatacttgaaagtaaattctgataccaatttaatgcatttacatcagtattaccttgacagattggccatccctcatgcccagcttgaagaatcctttaatgaatactcttcatttataagcaaatactacggtgatgattacgacaagtacatgaaatatatgaagtccgctaacaagatttactcatctacaaaaatgaaacagatttactacgaacagtttgagatttctatcaaacaatcacctgataaccctcaactatggatagattatatggaaagcgtttatagccaccaaaagaaaaaagatttgaatcctgttcttgccatttttgaaagagcaatactgaaaaatgaatcttggtcacagaattggataaaaatttggttagctcttatttacattatttatggttgcagtagtgatcagcgacctgaatggttacagtttgttttccaaaagtttttaaggacttttccgaattctaaccatgtctatgcggagtctattcgttattgtttgaccatgaatgataatgagatggctactgaagagtttcaaagtatagaatccaggttagaatctaccaaaaaattattgcagtgggatcatcaacaatggaaatcagtgcatttggcttttattcaatttaattatcaaatatcgaaaagatacagtatggacaacaacaaactgattgtggagctgagcagtaactccatatttatgcgtgcattatcggtaatagaacttggcgatccttctcattccgttgaatttctagcagttgatatgctaacacacatgggagcaactgacatggccaaagacctaatagacttgatgttggagaaatttaataacgaggcagaggttttgctttttggtttgaggtattttgtgagttataaaacagactttggtcaaattcgttcatactttaaaaatgcaatccataaactagacctgtttgactttcctgagaaattatgtgacaaatggttggagtttgagcaactatacggagacataaacagttatatggaatcagttgcaaaatgtgaaattgctttaaaaactttgagcaagaaaagaactcgagatattacagtggatgaaaacaatcaaccctccaaaaaacacaaaagagaaccgactaaggacattgacactgaaactaaatcgagagaaacatgcactgtcaaagttaaaaatatcgcagctgacactgacgaacattctattagagatttttttaaagactgtggagaaattggtgatatctcttttgtcgaagctgaaggaattcgctatgcaatattcgactttgaaaatgagcaacaggttttttcagcattgacgaagaattataagtctttggatggaaataaacttgaagtatacagactacagaatgccttgttatttgttaataattacccttctactttcagtcaagccactgtaaaagaaatgtttgaaaaaataggaccggtagctaaaatcagatttcctaatcaaaccctgaaaaaaataaagagattttgttatgttcaaatgatttctaatgaagatgctcaaaagattattgatcagtaccatggccagaaatacgacgatccaaatctaggaggtgaattctcatgggaaattaagttttccaaccctgaagaaaaacacgaaaggtcgtcaccaataagtgcacgcaaagtgaaagttactagtatttcctttaacgtgctgaaagaagcttttgaaaagaaatttaccctgtgtggagaaattgaacaggttgtgtttccaaaagcggtatatgaagaggatgggaaattgaaaagcaatggtggtttggctattgttacttacaagactacagaaggtgtggaaaatgcgttaaagttgaatgattcgaaatggatgggtcgaaaattgtttgtttccaaaaaacaccagcatgttcattatacagcagaagattttgatggtgtgaaaacaattgggctttgtggattggacccttcattaaatttccagcaagtgaagacaatttttgaggaaaggtttgggaaggttgctaaagttttgttgttcccagaagacaaacaagctttggtagagtttgtgaaacctggagatgctggcaagacgagtatgagtaataattttgtgaaactaggcgaaagcgaagcaaaaatagtgaccaaggaagagataacaatgggtaaaagtgctatttcaaatacaactacaacttcatcggcacctcttacaatgattcccaccacagttagacgaaaaaaatctaaaaaatag

SEQ ID NO: 5057 - DNA, 1026 bp, Candida albicans
tcaacaatgtctgaatcaatcactattacaatcaagtcgtcgggtgataaaaaatacgaagtcacatttgatccgctgatcactgtttctcagttaaaagagttggtcgctgaaaagtctgacatacctgctggtagtcaaagattgatttactcaggaaaggtgttgaaggataccgaaactgttacatcttacaaagtgcaaaacggacacactatacacttggttaagagtgctgctgctgctacttccactggtgctgctaccactgcagcagctccacagcagtcaacagctaaccaactgtctagtactccagctaatgcttcagttccatcaaacatagcagcgggccaaggttcattcaaccctctagctgacttgactggagcacgttatgcaggctattcccaattgccatcagcatctatgtttggaccagatgggggcatgaacagcaacataccggaccctgagcaattgaactcgatgatgtcgaatccccttgtccaacaacaaatgcaagcaatgttatcagaccctcaaatgctagattttatgatccaacaaaatccccaattgagagctatgggtcctgaggtcagacaaatgttacaaagtccattctttagacaaatgatgtcgaacccggaaatgctaagaagtatgatgcagatgggaagaggtaatgcggagcaaactaatgccttccctgcgccaggtgctaaccctactactggtgaaagcagcaatagcggggagactacagcaacccctgctaacccatttgccaatttgtttcctaatggaatcccgccaattaaccctctggcattgtttggaggtgctgcacctgctgctgctgctgctccagctgacaacagaccaccagaagaaagatacgaaaaccaattgagacaattgaacgatatgggattttacgattttgatagaaatgtagaagctttgagaagaactggtggtagtgttcaaggtgcaattgagtatttattaggcggtaactag

SEQ ID NO: 5058 - DNA, 2466 bp, Candida albicans
  unsure (2069): Identity of nucleotide sequences at the above locations are unknown.
caaataaagttcttaccaattgactttatcatgagttggcataatcaatccaataagaattctaacaatgatgatgaatatggtaataaaaatttcaaacaatatgaaatcaaaggaggtattgcatttttaattgaaataactccagaattattaattcctcaaccgaatttaaattctcatagtcaattattagaaattttatcaagtattaatgatttaatgcaagaattaattattacttctagaagtactgggattggaatatatttttataattgtgctaaatcaaataaattatcatcaatgaaaaatactaattgtactggatttgaacgattatttcatttaaatgtattaaatttacaaaatatgaaaaaattgaatgatttaattcaagatgatataaataatattaaatcaattgatgaaatttttaaatatcaaccattaaagaaaattgacttgaaagtggggaaacaatcacattctgaaacccaaacccagactcaaacgcaaacacagtcatcacatactatacaagaaactcaattgacagtggttttgaataaaatgattgatgaattcattaataaaagagaattcaataaacgaagaatggtttggattacaacaaacgataaaccatatcatgaagaatcagaacgagaagcactatggagaacaattgatgatttttattattatggatttttcatagaaccattatttctatctaccaatgaacaaaaaccatttgattttgagttgtataaagatattttcatgaatactaattatttgaaaaaaagtcaagaaaatctggaaagtttacgtcatacagctcatgcaaattatgataataatgatggtaacctcggtgacgataacaatattgatgatgataaaaatcttattaaaccaagtggtggtttttctaaagatagtatcattttcaagaaatcagttgttggtgatcaaattaggaaaagtatatttagaatcaaagaagttagacgaatacaatttacttgtgatttaattctaagtgataatggtaaaattggtggtgggtttggttgtactgtcaaaggatacatgttatattctcatgagaaaatcaatcgtaatgaattattactttatacaagatcagaaactcttaaaagagtgttttcaagttctaaattgatgcaaaatggaaaagctattgaaatagcaaaagatacaggcaaactgtatcaagatcgtaaagaggaagcaggaattagaaaaggatttgagattggtggtggacaagatattatcatattaaataaacaacaattggaatttctaaccaattattcatttgatcatagattgaaagatagtgatgatgaggacaatgaggatgggaatgatagtttagaaacagatatatctgatgatgacgacgaagaaggaggagctggtgggactggaggagaaacaaagcccgtatcattttcaaaacctccatatttgaaactaattgggtttagagacatttcccatttcagccctgtctattcatgtggtgccccaatttttgttactcctgatgttgataatggaatgatatcttcggcagttactgggggattcactaactcttttaaaacatttgcttcattgtatcgatcatgtgtgaaattaaatcaatatgccattgttttgggttgcaccagaagtaattctcgaccacgtttatatgccttatatcctactcaaacaacaaactcatccaaaaatcctttaccaaagaatcttgatgatgaagtagataacgatgacaatcaagatgaattcccacaaggttttttattaattaagttaccttggcttgaagatgtgagagccttgcctggagaatatatcaaaaatactcaacgagaagaaatccataatgatgacacattaattgataatttcaaacaattattacctaaatttgaacttctgcattatgatcctcgagaattccccaatgcgtcattaaattatttttataaagttatcaaacatgaaattttacaaatggaacttanaccttcacagagaccattaatggaaaatgatataacgatgcaaaaattagctcaattgaaaaattcaattaataatgatgatacagctattgaattattacaaaagattaattcgcgtatgaatgagattgatgccactgttggtgctgaagttttaaaaagaaaacaaatggaagatatgcaaaacaataatagtaataatggagggaaaagatttaaatcaggtccagtttctgatcaagaaatattagatgcttgggaaaataatcaattggataggttttcagtggatcaattgaaggcatttagaagaaaatatcctgatgtcaaatcagctaataagaaagctgacttgattgaaaatatcagtgagtttataaggactcatagaaaatga

SEQ ID NO: 5059 - DNA, 564 bp, Candida albicans
atgaagtccctaatgatcctgaagattttgggcgatgttgaagaagataccgctatggcaattgacacaaagggaggctccgaaatgagtcgagatgctcaaatacaaccagataatgagttttatgaagatgatgaaaaagataagggcgagaaagctataattgataataaacatgaagatcaagactctatgcaagttgataaaagtgaagaacctgtggttgaacaaaaagataaaccacaagacgagaataacgttaccggtgataatatagaagaagatcaaccgcaagaagtgaacccaattgaagagcaaccttcagtggaaaaactggtagtggtggtggaagacaaactagaagaagtgaaacctgttgaacagaaagtagaggaaccaaaagaagtggttgataaaccagaagacaaacatgaagataaaccagcagaaacccttacagagaccaccacagaactgaaaccagaggatcaaccaatggaagatgctgcaaagttgactgaagaagaattgaaagaaattgaagaactaaataaaagttcataa

SEQ ID NO: 5060 - DNA, 1347 bp, Candida albicans
acaattttcttcaaagacctctcgcaaaaaattgtcaacgaaatttttatcaacaaaaagcctacgctttcatttctccactatacagatacacagacaccaaacaacacaacaactcaaccaaactcgtccaccatgtatactgaacttccatttgatgaattgaaagttgatccaaaccaaaagaaacgtattgcttatttctatgatgctgatattgggaattatgcttatggggctggtcatcccatgaaacctcatcgtataagaatggcccattcattaattatgaattatggattatataaaaaaatggaaatttatcgagctaaaccagcaacaaaacaagaaatgtgtcaatttcatactgatgaatatattgattttattagtcgagttaacccagataatttagatttatttactaaagaacaaattaaatttaatgttggtgatgattgtcccgtttttgatggattatttgagtattgtggtattagtggtggtggatcaatggaaggtgccgccagattgaatcgtggtaaatgtgatattgccatcaattacgctggtgggttacatcatgcgaaaaaatctgaagctagtggattttgttatttgaatgatattgtgttggggatcattgaattattacgttaccatcccagagttttatatattgatattgatgttcatcatggtgatggtgttgaagaagcattttatactactgatagagtaatgacttgttcttttcataaatatggtgagtttttccctggcacaggtgaattaagagatattggggttggaaaggggaaataccattcggttaacgttccattacgtgatgggattgatgatgctacttataaatcagtgtttgaaccagtaatatcgaaaatcattgaatggtatcaaccttcagccattgttttacaatgtggaggtgattccttgagtggtgatagattaggttgttttaatttatcaatgaatggtcatgctaattgtatcaattatgttaaatcatttaatattccaatgatggtagttggtggaggtggttatactatgagaaatgtggctcgtacttgggcgtatgaactgggattattaaataatgtcaaattacccgatgaattgccttataatgaatattatgaatattatggtcctgattataaattggatgttcgatcttctaatatgtttaatcagaattctccagaatttttagataaaattttgactaatattattgccaatttggaaaatacaaagcatgcaccttcagtacaaatgaatgaagtccctaatgatcctgaagattttgggcgatgttga

SEQ ID NO: 5061 - DNA, 1524 bp, Candida albicans
attaaaagaaaagctatttgtcatcaatttacaaagagaaatacccgattattcaaacaaaacaaaccaaccgaagaaaaaatgtatcaagaattaccatttgatgaattaaaagttgacccaagaaaacgaagagtagcttatttttatgatcaagatgttggtaattatttttatggaactggacattgtatgaaacctcatagaatcagaatggcacattcattgattatgaattatgaattatataaaaaaatggaaatttatcgagctcaaccagcaacaaatttagaattaacacaatttcatactgatgaatatatagattttattgatcgagtcacacccgataatctacatttatttgaacgagaacaagttatatttaatgttggtgatgattgtcctgttttcgatggattaggagaattttgtaaaatttcttgtgggggatcaatggaaggtgcagcaagattaaatcgaggtcaagctgatattgccattaattatgctggaggattacatcatgcaaaaaaatcagaagctagtggattttgttatactaatgatattgtattggggattatagaattattacgatatcaccccagagtattatatattgatactgatgttcatcatggtgatggagttgaagaagcattttatactaatgatcgagtaatgacttgttcatttcataaatttggtgaatttttccctggaacagggaatttaactgatattggtattggtaaggggaaatatcatgccattaatattccacttcgagatggtatcgatgatgcctcttataaatcaatatatgaacctataataacgaaaattatggaatggtatcaaccatcacccattgttttacaatgtggaggggattctttaactggtgatcgattaagaccatttaatttatcaatgagaggtcatgccaattgtgtcaattttgttagatctttaggagtgcccatgatggtattaggtggtggtggttataccattagaaatgttgcgagaacatgggcatttgaaactggggtttgtaatggagaaatcttacctaaagaactaccttataatggatattatgaatattatgctcccacatatgaattggatgtacgatcagctaatatgactaatgccaattccaaagaatatttggataaaatattgactcaagtgatatctaatcttgataatacaaaacatacaccatcagtacaaatgaatgaagtgccattagatatggaagatttaggtgatgtagatgaagatatgcctgatgctatagatacaaaaggtggatcacaatttgctaaagataaattagttcaagctgatggagagttttatgatgatgatgaaaaagataagggtgaaaagaatatccaagaaaatgggaacgtgaatactaatgctaatgagaatgggaatgggaatgggaatgtgattataacggaggaagaacaagctgaattagataaattaaataataatgtgtga

SEQ ID NO: 5062 - DNA, 543 bp, Candida albicans
  unsure (506): Identity of nucleotide sequences at the above locations are unknown.
agacagcgtcaaagaacaacgcaagttagacaaagtttgacacctgtaaccatcaaacaaattaatgatgcaacacaaccagtcccagatggcgagttcaaagtaaataatgtcgaattaaatatgatttcatttgttggtgttgtacgtaatgttgaaaatacgaatgcatctattgcagtaactattgaagatggcactgggtctattgatgttcgtaaatgggtggatgagactatcagctcggccgaagaggactttgaaaagtataatgagatgaaaggtaagtatgtttatgtcggtgggtcattgaaacagttcaacaatcgtaaaactgtccataatgcttctatttctttaataactgacagcaatcaaattgtatatcaccatttgagtgcaattgaacatcatttgaaagctcaaggcattacagcagctgatgctgctagtgctggtgctggacaagcaacaaattccactgccagtgctggtagtggattgtntatggataatccaactagtctctcgaaagatacatga

SEQ ID NO: 5063 - DNA, 1098 bp, Candida albicans
agaaaatcttccatggtatgtataaaacccacaaatatcatcgtttatgcttcattgttttatgatactaatccgttattttctagggtggaaaaatatcgtcctgatagccttgaagaagtgaaaggtcaacaagaaattgttgatactgttcgtaaatttgttgaaacggggaaattaccacatttattattttatggtccatcaggaactggtaaaacatccaccattattgctttagccaaagaaatttatggtgccaccaattataaaaatatgattttagaattaaacgcatccgatgatcgtggtattgatgttgttcgtaatcaaattaaaaattttgctagtactcgacaaatcttcaccaaaaacactagccaaactgcatcaaataatcaatttaaattaatcatattggatgaagctgatgctatgactaatgtagctcaaaattcattacgtcgagtcattgaaaaattcaccaaaaattgtcgattttgtattttagccaattattctcataaattgaatccagcgttgatttctagatgtactcgatttagattcactcctattgatatttccgccattaaagatcgattaaatactgtgattattaaagaaaatgttaatatttctccagaggccattgatgcattattgaaattatcaaatggtgatatgagaagagcattaaatgttttacaatcatgtaaagctgccttaggtgatgaagaaaaagaagaagatggacatgccaatgatgagattgatgtggatatgatttatgattgtgttggtgcaccacatcctcaagatgttgaaacttgtttagattcaatattaaaagatgattggactaccgcttatctaacattaaataaatataaaactattaaaggattagcgttaattgatttaattacggggtttattgaaattttgaataattataaattgaaaccgaaaacaagattagaaattttgaaaggtttaagtgatatagaatatggtatttcaaaaggtggtaatgataaaatccaaactagtgctataattggtgtcataaaagatgctatggaatttgaagcatag

SEQ ID NO: 5064 - DNA, 765 bp, Candida albicans
aaaaataaaaaattaaatatgtattgtaatctagagaaatataccgcgcataaaaaaaatatagtagtaaaatctttttgcgatgagagagaccccaagactatgaataaatcaaataaagtcaagaaaccttcggtggccaaagtctcaactaaagctgcttcatcatcactcaagtctcaggaagcaaagagaaaacaagttttccgtccaattctcgataactcatttacacaatcaaaccaatggccatttatagaaccaactattgcaaacgatattgttgatctactagaagtattgctaaaaatgcaagactctacatttaaataccgtgggtttaatccaactgtgtctgctcttgaaaaacaagcagctgctaatcgtggtatacataaaaatgcttgtgtacaaataaagtatgtatttgtgtgcaagtacgatatatccccagcaacgctcacaaatgtgtttcctacgttgtgtttcacggcgtcaaaaagtgctgaagatcgggttaagctaatccagttaccaagaggaagtctagaacggttatcgaaagcacttggggtagatagagttggtatatttggtctaactaaagatactgaaggggcacaaccgttatttgatcttataaatgaaaatgtcaaagatattgaagctccttggctagactgtattttccgtgaggagatggtatttaatcaacctaacacaaagcatgtggcaagtactgtaggtagaaagaaaaacaagtag

SEQ ID NO: 5065 - DNA, 573 bp, Candida albicans
  unsure (77): Identity of nucleotide sequences at the above locations are unknown.
gaaaaacaaggaactcatggaggacatgttcatgatttacctttacattccaaattttttttactcgcatcttattnggcatcatatgggagttatcgaaatgatcttcataataattccaaagtaaaagtagtaaaatttaaaaagagacaaagcactaaagcaacttcagttactaaaggacatatgagtaaaagaagtattgatacacgtttattatcagctaattatgtcgatcttgaaaggattttggctatcttatcagtcatatatagaaattatgcccagtctgtaaatcattctgataaagatgaattactttacatggatgatcgaatcattgaagatgaagagaaaaaggaatcagaaagatctaaattcactttgacaagaaatatcgatttgagtaatcaaattgcaactttattttccttggggttattaagtaagaccaattcatctgatattttaaccgccaaagtaagatggaaatgtaatattgattggaaaacagctgaaggaatagcaaaatcagtggatttccctatttcagatttcatgatggatgattaa

SEQ ID NO: 5066 - DNA, 2073 bp, Candida albicans
caacaagaaatgtcgttatcaggaatggaagaatttgaaactgttcttaaagagatttcaactttaccagcaccaggtgtatctggtactcgtattaaaagattgactgatattgctgtcaaagaaatgaatgcggaaaacgagccaaagttaatttctattttgtattctcaatgtaaagcaaattcatcaactaataagttgggaacattatatgttgttgactccatagtccgaaaatttatcgaggaagccaataagaaaaatgaagctttagtgcctagtgcgcctgaaggaacatacgcatctgctgttttcaaaataaatgaactagtcgaatcgttagttgatgatgcgatggaattactgattaatccttctataaacataaaaattggcaaattgattgacatttgggctagactggaaactttctcgcctgaagtcattcagaacattagaaacaaacattttaaatctactaccccacctggttcgcctccaaaggcaagtattgccctagttaaaccagatgcaacagaaggtacaaaagagtcgagcagtattttgctggcgttggcttctttggcaaaagccagtgggtcaaataatgaaacaccacctagctcccaatcctcttcaaccaacaacaacagcaacaacagcaacagcaacagcaacgaaagtggatccaatgccactaatattttgtctcagttgtctgctcttggtggtaatagtagtaatactggtagtgcttcttcacaaccaccaagtcaacaacaatactcttcttaccctcaaggtggtgggcaagcaggtaatgatgatcttcttaatatgctacaacaaatgcaaggtggtggtacacctacaggagcttcaccagcgtcaccagttgttggttctaacgaagctagaggaggtccaactgctgaatttgatagaagacgtggtcgtgacaatgaatatggctctcaatatggtagaagaaatagatcaagatcacctaagcgtggatcaaacacttgggtgagatcacctccaagttcatcggtgcaagctcttcaacagaatatgcaaaatttgagacaacagaagcaagtaaatcatggatatccacaaaatacaaatggacaagttgatcaagggtttgttccaccaaatgctatgggtggtgaattaaatttaccgggaactccacattatcgtccaagaacagtgcaatttgactccactattccacaaggtactgtaaaagtgttatctagaacattatttttaggaggtgttccaagaaatatggatgaaaggtctttagctcaagtgttacgaccatacgctgaaattcaatcggttattttgaacagtgagaaaaaacacgcttttgttaaagtctattctaggagagaagccgaacaagttattacttcgtttaacaaagatggtgctttgccattgagaacaagatggggagttggtttcggaccaagagattgctgtaattatcaacacggtatatcgattattccaattcaaagattaactgaagctgataaaaactggattgttcatgctcaatggggtggtactgggggtcagccaatactgagtggtatggttgttgatgaaccagatattgaaattggctcagggttatcatccaaggcgatgtcgaaaaagatgccaactaattctgctagaaatggtcctaagtcaaatagaccgggcgaaccagatgaagaatacgtgaagactacattgataccccaaggagatattcaaatgactcacggtgctcaacctcagtttaatacgtatctgcaatcgtcagtcaatcctttgcaagggttatttggaaataatccacaacaacaacaacaaccaccaccaccaccaccacaaccaccacaaccacaacaacctcctatgcaatttcctgcagggttccctcaaatgcctcctcaacaacctggtcagcctggtatgaataataatgaagcaatggcaatgcttgctgcaatgatgcaaactatgcaacagcaacaacagcaacaacacccacctcaataa

SEQ ID NO: 5067 - DNA, 609 bp, Candida albicans
tccgctagcgcggaggcttctacccccgtggtgaagaaagaggaacaaattgaacgtttaaaaacttctattgaaatcttacctgacaatgatgaagagcttttgaataggcaagagaacttttctgcaatcacaacggaaaagattaacagaattgatgatcttcaattacaaagtaccaaattgctggatgaactaaagaataaaactaaacagtacaatgagttaataaggttggatggctcattcaaagctaagaaggcggaatatgactccaattgggagaaattgtccgaaatagttgataaaaatgcaaaagattttaacgtgcaaattagtaatgacagagtacgaaatattgccatgttcaaaactgaattgaataaaagacacaatactttgcttaacgaacaaaaggatcttttggtggataataagagaaaagaatcagagagacagagcgcacttcaagatgttctcaactctatatcaagggaggaacaacaccatgagtatgcaaccaatgtgataaataccaacaacgaaaaacttctggttttaaaaagaaaagttgaagtgggaagtaataatgaaatagaattagaggaa

SEQ ID NO: 5068 - DNA, 723 bp, Candida albicans
ggttctctattttgtttggaaattgatggctacgtttttttttctctctcgcgtaaaagctttatgatccatattgaaaaactattttcctttattcttctctttatagccctaccttccccagcatctttcatcagaatgtctagtatctataagttgtctataaaaggggtgcgtgcatttcatccggaatctgacgagaccattcaatttgggttcccattgacattaatttgtggtcaaaacgggtgtggtaaaacaaccgttattgaatgtttgaaatacgcaacaacagggacattgcctccaaattccaaaggaggagcatttgtgcacgatccaagcttaagctctcgaactgctgtaactggtcagattaaattggcattcaaaaacgtgaatggcaaatcaatgattacaactagatcagttcaagcgagtctgaaatcaactaaaagcgccactggagccactgtcacatttaaaactttggaaggtcaattggcaattattgaaaaaggcgataagataagtgtctcttccaagaatgctgaattagatgcccagattccagtttatttgggcgcgtctccggcgatcttagagaatgttattttttgtcaccaagatgaaagtttatggccattgagtgaaccttcggcattgaagaagaagtttggacatatttttggaaacttccagttcactaaagttttggaataa

SEQ ID NO: 5069 - DNA, 1038 bp, Candida albicans
attgcactttcgagaatgagccattcttatacatatacaaaaaatttcattcaaagccaagttaatatactaaatgaaccttatagaattaattcccgaatcagaaacattctagccgaacaagatgaaataactgaatccgagttgcaaacaattttaaatctactaaataacgagattaaagaatgtaatgatgaattgttcccatcacaaatcaataaccagatagtactgcaaattttaaagttggaaaaacagaaactaaaaatagttaatctgcaattgtttaaaattaactcatttattaaacccatcacattacctgattttgataatttaacaaaccaagatcaaaacaaaaaattggcagagttgagagaacaaattaaagagctccctgatctgaaatatttgtttgtgtccaacacagataccactgacattcaagatgaatatgatttggatgacgatgaccaggggcaggacatggagaatgaaccacgggaagagcaggcagaggacaacgaaactgataaagccaataccgatatagtgcaagacgatcaagaagaggtagcatctaccaagcaaatgaaaaaagagtttatccaggaaattgccgacaaagttaacgattcaaatgcacaaccagatcaagagttgattgaaaaatacgataagttgaggactgatcttatagatataagcgatcgtttgcaatacaagtccgggaaactaggttatttatcgggattgcaacaaacattgtcagagattgttggtgtccgctcaacgaccatcgacactcaactgaaccaaatctacgacagtgatgaagaggtaagcacaccaaacgataatgaaacgagtcttcaacctggtccatatagcacacgaacaaatatacaaagtgaaatcaatcgttttagaatgttagttgagaaaatatcatacaaggtcaatactaagaatcttacttctgataatctccgtgaaaagttgcaagagataaatcacaacccaaacagtgccatatag

SEQ ID NO: 5070 - DNA, 1335 bp, Candida albicans
ccgaagtggaaaaccgattcaaaaaaacagattacagattcagtaattaagaaatcaacttgcggagtgaacggattcaagattatatattcagagccgaagaaattgtgcgtagcttggaagaaaagtgaaaacagaattaaaacctctttggaagaattgcaagttgacaaacaggtaaaactgaatgcattgagagatacccaaaacagtaatcgtgatactgaacagaagatgcaacaagaagtggaaaaatgccaccaattgcttacctcatttacctcactcaatgatgcagtgacctattttgaaacaaacatagcagagaagtatgaagcaaatgctttagaaatgaaggagctttcagaacaatgcacttccttggaaactaaaatagacgatcatgcacaagagattaagctgttggaaaaggaagtaatggatgcatctcggatagagcacaatattcttgccaatattgattatcgaagccaacttagtagattggaggagacagaattacaacttggctcaatggacatagaggatgctcaatcccgtaaggaagaatatcaggtagaatctaaaaaattgcgagatgctttgtcttcattaactgccgagcatgctggtaaaattggagaagtgaaacagattaaagatcaaatagctagtttgaagaaagagttggaaaccgaatacaagaatgtaaatcaatcctaccacgaagagtggattaagcttcaaactaatttgttggtttcaaacgacattcagatttattcaaaggctttagacaatggtatcatgaaataccatagtatgaagatggaggaaatcaacagaattttaaatgaattgtggtcacaaacgtacaagggatcagatatttctacaattgcgattaaaagtgatgtcaatttgcaagctaaaggaaacaggtcctataactatagagtggtaatggtaaaagaatctagcgagttagatatgagaggcagatgctcggccggtcaaaaagtgttagccagtattttgatccggttggcgttagcggaatgttttggtgcaaattgtgggatgattgcgttagatgagcctaccactaacttggatgctgaaaatgccgaggcactagcagcagcattgaacaggatcattgaataccgaaaatcgcaatcaaactttcagttaattgttattacacacgatgagaagtttttaacacacatacagggtgatcggttcacagatcatttttacagaattcaacgagatgaaagtagtaagtcaagaatttatagtttacctattggtagaattcaagaaggctaa

SEQ ID NO: 5071 - DNA, 279 bp, Candida albicans
aaagtacggtcattggaaagtgaattgcaaataaataaaaactcaatcgaatcaattttgaaaaccatagaagaaaacaacctgaaaattgactctttgaaaagcaacataaccaaagtttttggcgaagatgaaattaatgactatgagaatgtagtaaatgacttggaagatagttatagaaatgtcctggaagacgtaaacagtgctgaagtaacacgagatttcaagaactcggccatatcatttgcagaggaaaacaaatgttgtttgctctgt

SEQ ID NO: 5072 - DNA, 1008 bp, Candida albicans
gttaaaaagaagaaaaaaaaaattacgtttttgattctctcttgttttttttcatgcaacccaccaagtcaaccaaagcaaccaagtcataccatggccactcaaactgacaagcaaactattggtagacatcttgaacaagttccaaaagcgtctaatttgatttcgtggtcccgtaatggattcatagcatatatccctccaattatcacgactactaccaccaccccaacaacaacaacaacaacaaataataacaaaagtaatctattattaacttatataaagaattccgatgggaaaaaatggcaattggcatcaccggaacccataaatatcaaattagagaacaactttttacctcaattatctttggtttcttgggggtcgttaaataccgatttagctgtttctgatatttatgggaatttctatatattattggccggagtagggttattagatccaaatcatattccgtcaaccattacaacgacttctactatcaaaactgagggcaataccgaaaaaaataaagatacaaaacaaatcggcaatggaagtgggactaatggccatggagactctccgatcaacacaccaagctttgaattgacatcttataatcatatggaaatgatttatagagatattattaatcccgatatcaattcagcagttaatcctggtgcatcaatagtggctttcaaatggttaaatattgaaaagccgcaaattgttaataaagcggcaactcgacttgctgaaaatcccacgacgacttcatcgaattcatcttcgtcgatttatggatacggaattaatcaatatcagccatatggagtatgtcatccaatcccaacaaagcaagcgtgtgtggcattaagaaagaatggtcaatttatattattttatcaaggtgagcataaagtagaataccacaaaatatgttgtaatttaactgataatatttcaataattgaaaagacaatgtattgggttcaataa

SEQ ID NO: 5073 - DNA, 732 bp, Candida albicans
catttatctatcggtgttggcaaattcaactttatatcattcatactcatcatgtcaaaacatatagaagatagtctaaaaatatgtacagtatgtgcatcgaataacaatagatccatggaatctcacaaacaattgatggatgcaggttatgatgtgcattcgtttggtaccggtactgccgttcgattgcctggaccaagtgtggataaacctaatgtctatgaatttggaacaccttatcaagtaatgtatgatgatttaatcagtcaaaaaagcaggaaattatatgaatcaaatgggttgatacatatgttggaaagaaataaaagtgttaaagaagcacctgaaaagtggcatagaaatgcaccccttggaaaatttgatttggttataacatgtgaagaaagatgttttgatagtgtaattgatgatttaatgcatagaatgtatgatagagatcccagtgataatgatgatgttaaacgacttgtacatgttataaacattgatattaaagatgataatgaaaatgcgataataggagggaaaggtatattgaaattggttaatatgattcatgattttagaaggaaaaaaaaacaggagttgggtcatgacctcgaagatgagctggatataatattagaagatcaaatgatgagtataataacagaatggcaaagagaccacacaaatttacccacattatatagtgtatcttattattag

SEQ ID NO: 5074 - DNA, 897 bp, Candida albicans
tttgttaaactttgggctatatcaatcatgagtaccaattctaaacaattgaataagaaaaagactcgattgtataatagtcgaacgattaagagtcaaatcaatgatcaggcatatgacaaaaaacaacaagttttggatgtgaattcttttatccattcacgaaactttgaaatccgatcatttgagcaatctcaactaaattccaaaaatgcatcatcaacaagagtattccaagatttaccaagagcatttagacgtagagcagcatctcataatgtgaaaagaatccctaaaagattaaggaaaagagccaaacaagagatgagttctaatttaccagtcaagaaaatgcctcgtggaagaagattatataaattacttgtcagaaatagattacttaaagttgcttcaaaaatgaagcaaaacaaatatgatccattggaaaatctcgtcaataagaaaaatcttcgtaaacaattcaaagcaatacgtgacgaaatcaaaaaaatcgaccaagaaaaacccaaactgtcaactgttgaaggttttactaagttgaataattcagttgggtccagggataataccggtatcaatgaattagccccacggccaaagggaagcatcaagtattataaacgtcaaagggaatttgtttggatacctacacatatatggtttgttaaaagatttcatatgagcaagaaatacgggtaccaaattccatacacccctacacagaaatgtttcaaattaatgaatcgttggaatagacaaaaggcagtgtgttttgatatttcttattttcctacgtttattttatatgtaagcgatgggacaatgtttggagatatagctaaagtcttcaccacggggccggaaagtccgcgctga

SEQ ID NO: 5075 - DNA, 723 bp, Candida albicans
acggttgctcctgatatcgaatcgaaattcatcacaccaagagatgcacttccattgaaccccctccaagaacgcataatcgactactttaaaagacaattccagctttgtggtataagcatgatgaactatatgccgtgtgtatcgatctttagaaacacgtttagtttgaatgacgacaatgccattgccatgaataccgacggtgcgtcccagcctgcactagttatggtaaactgccacaagggtgccaaagaaggggtattgatccttttacaagccaataaaactaaccctgcccacatcatatttgggtttaaaaagccaattctagttttcgaagcaagtcaagtgttgcacaccagctatagcaacatcacgcgccaaacatttagcttgaatgtggtggttctaaacaaaaaacaagaacaaagagagttggagtttggcatgattgatgaaaagttttataaagttattgacgactttataaaattacaaggtatcaacgatgctacattcaaccaagaagaaagtggtgacgacctgatagagatcgttcatgtcaacaataacgacgacgacgatgacgaggaagatgatgatttccaatctgaggatagtggcagtgacgttgaagaagagtataatagtgatttgaacgagccgctagctgcacacgaagaggatggggtgtttgaaagaggtattgaaatcgaataa

SEQ ID NO: 5076 - DNA, 1671 bp, Candida albicans
aaccaagttcttctaattataccaataacatacaacatcatggattcagacgccactaacagatttgttcctgaatatcgtcgtactaatttcaaaaacaagggccgtttccagagcgatgagttgagaagaagaagagaaacgcaccaagttgatttgagaaaacaaaagagagaagaagtgttagccaaaagaagaaactatgccaatcaaggcaacgaatctgaagatgaagaagaatataatcccaacgccaataacgatgaaaaccaattctacaacaagttgaaacaagatttgcccaagatgcttgaaatgatccaggcaccagactttgatagccaattagcagcaacagttaaatttcgtcaaatcttgtcgcgtgaacataacccacctattgatttggtcattcagagtggagtgattcccactttggttgagtttatgaaagaagaccaccccgatatgttacaattggaagctgcgtgggcattgaccaatattgcttcgggtgactcgtctcagacccgagttgttgttgaagccaatgccgtgcctttatttgtccagttgttgtactcgcaatcactcgaagtcaaagaacaagcaatctgggctcttggtaatgttgctggtgactcttctgacaatcgagactatgttttgagctgcaatgctatggagccggtcttgcaattgttcaactgcaccaaaatgtcattgatcagaaccgctacctggacgttgtcgaacttgtgtcgtggtaaatcgccacagccagactggaacattgtatcacaagcgatcccaactttggggaagttgatttattctgttgatgctgagactttggttgatgcatgctgggccgtgtcctacttgtctgatggcacctctgaagcaatccaagcagttattgatgcccgaatcccacaccgtcttgttgaattgttggggcatgaatctacattggtgcaaactccagctttgcgagccataggtaatatagttaccggaagcgactaccagacccagattgttatcaatgccggggtgttgccagcattagcgccattgttaaactctacaaaagacacaatcagaaaagaggcatgctggacaatttccaatatcactgctggtactactgaccagatccaagcggttattgatgccaacttgattccacaggtgattagattattgatccacggtgactacaagacgaagaaggaagcatgctgggcaatttcaaacgcttcttcgggtgggttgaccaaacctgaccaaatccggtacttggtaagccagggctgtatcaagccattgtgcgatttgttatcggttgccgactccaagataatcgaggttacattagattcgttagagaacattttgaagatgggagaaatggacaaggaggcccgaaacgccagtgtcaacgagtatgctttgtttatcgaagaagccggtggcatggaaaagatttttgagtgtcaaaacaaccccaacgaaaagatctatcaaaaagcatttggcatcattgaaaagtatttctctgatgacgacggtcaaatcgatgacgaaaacattgttcctgaaagttacggaaactcatttggttttgggatggactcgaatcaacaacaacagaactttcagttttag

SEQ ID NO: 5077 - DNA, 1695 bp, Candida albicans
ttgcatttaattcgagaagaaataagattggattcaacaaaggccaaatgtttaaacaatatcaatttattattatgccaattaactacttggatgggttggccagctccttggatcaagtattattcaatcaagccggagaatatagatccacacactcgattcttactggcattgattcttgaagcacctccaaacttgttgagatctttagcgagtttatttaccaataacatagtaaggtatctaacattctcacaattagttgaagaaacagaaactgttgatttattggtaaccccgagaactttatacgttttgaaactatttgaagtttttgtgtcctcacaatatggaccaagtgcaattgtgagtttgatgttggagtttggcatcaccaaagatttgcttgaaacgtatcccttgggtatatccatacctctaaaggaagccttgctgatatgccaagagagcccagagtttgaatggacatctcagacacttgacttggtgggtcgaaaagacttgaacaaacttcttttagatgcggattttagtgctgatatcaatacggaaccccatacaagcactaaagatttgtcatctttgctcaatgaagttttggaagataacgaaaacttttctccatgggatggacaatcagaagcagagcgtatgaatatcacaaaattgatctttgaggcagacagaagatattttgagataacaacgttggtacatcaaacaaagacccagactgcttatctcaaagtagacgagaatgtgacagaatacgatttggttttacaacaaagagagttggcagtaatagtagctcttcgtacattaactataccattgggtagagctgctttggtatatgctagtcgaaatcccttgttgacagaaaaattccccattccaaaatttaatttgaatacgttaatatcaccaacaatgacaaatattgtttattcggaagatagagttctgaagtctttttcagaatggggtcacttccacaatggtgtttcatctgggctaagcattgggccatttgcaaaggggattagtggtagttggataattttcaataaacccccagaattgaatgcccaacatgctgggtttcttttgggcttggggttgaacggccatttaaaacgtttggaagaatggcacatttataactatctcggtcctaaacatccactcactagtattgggttgttaataggtatggcagctagtttgcgtggcaccatggataacaaattgacaaaagttctctctgttcatgcagtggcgcttttgccgcaaggggcgaatgatttgaacgttccaacaatggttcaaacagcagggttaattggaattggtttgttgtatttagaaagtcagcatcgcagaatgagcgaagttttattgtcacagatcaccgcttcggtattgcagaacgacacagagcaagtccacgaagggtacagattagcagctggtattgctctaggattcgtcaatttaggtaaaggtgatgatttgagaggtttaaatgatacccacgtgattgacaagctaatggctttagctatcgctatgaaggattaccatccagttcaagaatcaggcaagtcatgctgtggggccataatggcattggcattcatatacatgaaaactgtaaattcgaatgtc

SEQ ID NO: 5078 - DNA, 708 bp, Candida albicans
cataaatccaaatttgatttagaacttaatccattcgaaagatcatttgctaccaaagaatcttcgagtgtatcgttaaatgaattagcagcagcatcaaacaatgacgccatttccgatgtcaatagtgttgctactagtggatcatcaataaagaatggtagttccagtaataaacacaacctacatattcccaacatctccagtgtcaaccaacaacaaggtgtgaatggtaaattaccaggtattacgccacctttgttcacacctggaggaagaagattgccacctataggattatctcctgggggcacaaccagtagacaatattcaaacagtaccaatagtgggagtttacaaagtaatactgatacccttgggtccaatatatggggtggattacctactaatcaaacttttcaaccacaaccacaaccacaaccacaacagcagcaacaaccccagcaacagcaacaaactcagcagcctcataatttcaaccagttcatgtccggcatgcgtaaaaccggattaacaccaaatgaatcaaatattagactggggttaacacctggtggtttaactaattttggatttggtagtaatttagttcccggtttatccactccaggtgcattattgaatggaccaattactcctgggttacctgttttcacacgtgccgatgcacagtcatcgcttgattgt

SEQ ID NO: 5079 - DNA, 1611 bp, Candida albicans
gtaaccattttaaaaaatgaatgggtcgaatctcaaaacattgttaattcattaagcaaattcaagtcgttggatcagatttgtaattatctcgcatttcttgatgctttaagagatgagaaaccagaagatatattatcaacatcaacagcgagcttgtctcccggtaagcaaaatttaatgatcaatacggtaaacacagcattgacgttatcacagttaatcgagccttactatgatactttatcggaacaaaccattttaacctacttaccctacacgatgttaggtctggattccaaaatattcaccttcagcaataattatacacgattggagataccgaaagatataaacaacagtttcagctcattgctacgcgaagtttttgagtttgcaatactatataaacaattggcaattgttgttgataggtataaaggaactttagtactggccataaagacagcttacatagcaatactagaggctcaattgaacaaatatgtgaatgatattaacaatatcttcaataataaaccgaattccatattagttgtttacaattccattttcccctggatatctatactacgatttttatatcgagtctcaaacagactaaacagattagatggttatgaatttctcacatttatttatagtttcaccaaccatggagatcccaaaatacggggcattgctgtgactgcattcaccgaggttgtcaaaccgtattataatattgtggaacattggatagtgaaaggggagttgattgataataataacgagtttttcattatctttgatcaagagcagaatgaattcaatagtataattaaattattgcccaaaaaaataccagcctttattaaatcgagtgataaaatatttcagattgggaaaacattaatttttctaaataaatattgtcgtgaactaaaatgggtaaatcagtataacgtgaaatattctgctatattgttcaataaccatcaaggcttggcatccatgacaacaaatgaaatgatcaaattgattgatctgcaatataatgagatattaacgtttctcacccaaataatccaaggaaacaataaattgtttactcatgtttataatttcaagaggttttattttatggagaccaatgattttattgatgcgattatggtgaaagggaaggacgtttttaatgagtcttctgttaatatttcatcaacctatcttaggaaagtcttacaagacgctatacaaatttcgtcggtgaaaaattttgagtatgttgacagactcgattcgagagtgttgaatccccaacacgggaatttgggctgggaatcgttcaccattgaatacaaaattgatgatcttcccatgagttatttatttgaaggtcaccaacatttacaatatttaaaaatgtttcattttctatggaaattaagacaattgaataatttattaaattggcattttgagatgtttaatgagttgaatcataatgtggtgacgaagttgtcaagcagaaatagaagacctttggcgaaatcattgagcataatcaccagtataagattccattttacccatttcttaacgaactaa

SEQ ID NO: 5080 - DNA, 396 bp, Candida albicans
ttgattttttttttcaaaatagatgtcaaaggtattactcacgtcattaattatgatatgccaggaaatattgaagattatgtgcatagaattggtagaactggtagaggaggtgctagtggtactgctatttcatttttcactgaaggtaattccaaattgggaggtgatttatgtaaaatcatgagagaagctaatcaaactgttccaccagaattacaaagatttgatagaagaagttatggaagtcatatgagatttgttcaaggtagaggtggaagaggtggtagaggcggtagaggcggtagaggtggcagaggtggttacggtggtggtggtggctacagatctactggtggtaatagtgctccattaggaggtaaccgtagattttaa

SEQ ID NO: 5081 - DNA, 1377 bp, Candida albicans
tactattcatttaattggaattatatttatatatatatattaatcatgtcatacaataacggaggatataataatagaaacggaggtagttacggtggaggctacggcggtggtggtagcagaggtggaagagatggctacagtggtggtggcagaggcggtggctacggtggtggtgatagagatcaaggtggatacagaggtggaagattcagtggtggtggccgtggtggtggtagatttaatgatgctccaagacaagaattaactgctccacaatgggatttagaacaattgccaaaatttgaaaaaaatttctattcagaacatccagatgttgctgccagatctgatagagacattgaacaatttagaaaagaaaatgaaatgacagttaaaggtcatgatatccctcatccaatcaccacttttgatgaagctggtttcccagattatgttttacaagaagtcaaagatcaaggtttccctaaaccaactcctattcagtgtcaaggttggcctatggctttgagtggtagggatatgattggtattgccgccactggttccggtaaaactttatcttattgtttaccatctattgtccatattaatgctcaaccacaattacaatatggtgatggtccaattgttttggttttagcaccaacaagagaattggcagtgcaaattcaaactgaatgttccaaatttggtaaatcatcaagaattagaaacacttgtgtttatggtggtgcaccaaaaggtcctcaaattagagatttagccagaggggttgaaatttgtattgccactccagggagattaattgatatgttggaagctggtaaaactaatttgaaaagagtcacttatttggttttagatgaagctgatagaatgttagatatgggttttgaaccacaaattagaaaaattgttgatcaaattagacctgatcgtcaaactttgatgtggtctgctacttggccaaaagaagtgcaacaattgactagagattatttgaacgatcctattcaagttaccattggttcattggaattggctgcttctcatactattactcaattggttgaagtcattgatgaattttccaagagagatagattagtacaacatttggaatccgctttaaatgaaaaagataacaaaatattggtttttgcttctactaaaagaacttgtgatgaaatcaccacttatttaagatcagatggttggccagcattagccattcatggtgataaagagcaaaatgaaagagattgggttttagatgaattcagaaagggtaaaacttctattatggttgcaactgacgttgctgctagaggtattggtatgtataatttttaa

SEQ ID NO: 5082 - DNA, 1374 bp, Candida albicans
ttgaatcactcatctacaatgtctgaatcagaatctgattattttactgatgggtcagaagatgattttgttccaacttctaaaaaatccaccaagaaaaacgcgtcttcaaaactgaaacaacctcttggtgatgcaaccaatagcactgtcagttcatcgcgttcatcgacccctaagcctaccaatgcttcagagacatatcaaaagctttcccaattagagcatattttaaaaagacccgatacttatatcggatctgttgagaaaaccaaaacagaaatgtggtgttttgacgcagaaactgaatctatggtgttcaaagaagtcactattgttcctgggttgtataaaatctttgatgaaattctagttaatgctgctgataacaaaatcagagatcccagtatgaagaatatcagagtcaaaatcgatgctgaaaacaacataatagaagtaatgaatgatgggaaaggtataccaattgaaatgcacaccaaagaaaatatgtacattcctgaattgatttttggtaacttgttaacttcttccaactatgatgacgaccagaaaaaagttactggtggtagaaatgggtttggtgctaagttgtgtaatattttctctacccaatttgaagtggaaactgctgatttgaatatggggaaattgtataaacaatcttggacaaataatatgtcaaatgtgtcaaaaccaaaaatcaccactttaagaaccaaaaaggaatataccaagattactttcagacccgacttgagtaaattcgatatggactgtttggataatgatcttttatctgttttaagaagaagagtttatgatttatgtggtactgtgaaaaactgtaacatttatttaaatgataagaggttgaacatctccagttttaaaggttacgtggaaatgtatgtcaaagctatcaaagaaaggtcacctgaacctgaaccacaagatggaaccattaaaaatttcaccaccattgtacatgaagtgtttaatgatagatgggaagttgcatttgctgttagtgatggttcatttaatcaagtcagttttgtcaactccattgccacaacatctggaggtacacatgtcaaatacgtttccgatcaaataatcaataagttagtagagactttatccaagaaggaaaaaggtaagaagaaacttatgattaagcctcaagaagtgagggataatatgtttttatttatcaactgtcttattgaaaaccctgctttcacttcccagactaaagaacaattaacaacaaaagtgtctcaatttggtggtaaagataagtttgttgctaatgataacttaatcaaccgtcttctgaaaaccgttttctaa

SEQ ID NO: 5083 - DNA, 486 bp, Candida albicans
ttgatctacacagaagggctttctcctatgcatttagctgttgctgggctttccgttgttgggagagattattatggatgtttcccgttacgtggtaaattattgaatgttcgtgaagcttcggcagatcaaatttccagaaatgcagagatcaactcattgagacgaattattgggttgcaacatagaaaagtttacacagctgaaaatatcaaatcattgagatctggtcatattatgatcatgacagatcaagatcaggatgggtcgcatatcaaggggttaattattaactttttagaaacatctttccctggattgttagacattcccggattcttacttgagtttattacccctattgtcaaagtcactgttaaagcaagaggtgctggtggtaaacgtgttataccattctacacaatgccggaatttgagcattggagagatactgaagggaaacaatgtcgttggactcagaagtaa

SEQ ID NO: 5084 - DNA, 999 bp, Candida albicans
atttttcaattggaagcaaaagtaagaaaatttttctttatcctgtttttttttagtcatttttttgctaggatttacgattatttacaaatgtcagcacaatttatcacaccgaaaaagcgtccccactcaccactagatagtaatgaattacttccttcttttgaagatccccaggatatgataaatgcagtggtatctacgttactggctccagaggagaaaaccaatgtttctattgcatatgccaatgagaaaaatcaagccacagaaatccaagcctatgctaagattgctggtaaggattggacattttatgtcaagtcattggcagtttcgataggaagaaatattgaattatccgcacccagtaatactaatataactacacctttaatagatattgacttgggcccagctaaagtagtcagtagactgcatgccgctattacttataatctagatttaagatgttgggagttaaaagttcttggaagaaatggtgcaagaatagacggtcaaaaagttaatgtcgattcaccaaatgttaatgcattacattcgggggcaattttggatattggtggtacccaaatgatgtttattttgcctgatgctccagcagttgttgccccgaaaatgttggagaaatgtcttctcagatacaaggagcaacaacaacaacagaacaaacgaatttcaagtggacctggtatcggtggctccacaagttttcaaatgtttgataaagctcatctaactcattccccttcatctatttcagcaaactcgctccaatcaaatttggatcaagacttgtcaaaagaggaagccaaagatatcaagcctccctattcttatgcgacaatgattacgcaagcaatcttatcgaatcctcaaggagtaatgtcattatctgagatttacaattggattgctgatcattacgcatactataaatactcgaaaactggttggcaaaattcgattagacacaat

SEQ ID NO: 5085 - DNA, 1560 bp, Candida albicans
gaattcctttttggtgattcagaggggaagatttggacgatgattgaagttgaaagtgaagaagattttgtttcagatgaaggagagcttgccagacccatgttttcagatgacgaggatgaagatttggaagacttgaatgctgaaaatatggaactttattccaagagattagatgaggaagagagattggaagcagaagaggcagaaaaggaattgctagaagcagaaactaaacaacccagagcgaaagtcttgccaacagctgaagaagaagaagaaatggccaaaggtcctcaggatgtgactatggtaagaacaagaatgcttgaagttgttaaagttttggaaaatttcaaagagttggcagaagaaggaacatcaagaacagattacactaacagattgttaaaagatatatgtgaatattttggatattcggaatttttagctgaaaaattattcaatttattctcaccagcagaagcaatggagttctttgaagctaatgagattgcaagaccaataactataagaacaaacacattaaagacaagaagaagagatttggcccaagctttggtcaataaaggtgtaaacttgcagccaattggatcttggacaaaagttggtttacagatatttgattcccaagtccctattggtgctacccctgagtatttggctgggcagtatatcttgcaagcggcatcctcctttttgcctgttatggcattggaaccacaggaaaacgaacgtatattagatatggcagcagcaccaggtggtaaaactacatatatttcggcattaatgaaaaacactgggtgtgtttttgccaacgatgccaacaaagcacgtacaaaatctttaattgcaaatattcatagattgggatgtaaaaacacgattgtatgtaattatgatgctagagaattccctaaagtgattggtgggtttgatagagttttattagatgccccatgttccggtaccggtgttattgccaaagatgaatcagtcaaagtgagtcgtacagaaaaggatttcatgcaaattcctcatttgcaaaagcagttgttattgtctgctatagattcagttgatgcccactcatctacagggggtgtcattgtgtattctacatgttctatcgctgtagacgaaaatgaggctgttgtcgattatgctttgagaaaaagaccaaatgttaagttggtggacactggattgaccattggtaaagagggtttcacatcttaccgtggaaaacactttaatccgaaaatttcgttgactagacgttattatcctcatacctataatgtcgatggattttacgttgcaaaattcaagaaaattgctccttctccacacgatatttccaaagctggtgctaaggagaaagagaatgccgctagagcagaagctgaagaagagggtattattcatggagacttcgcagagttcgatgatgaagaagataaggaaattatggaaaagtcaaaaaagcatagtttaagaaaaaaaggtattaaccctaacgctactaaaaaatag

SEQ ID NO: 5086 - DNA, 363 bp, Candida albicans
gcacacaattacgtttttttttgttcatcttactctttacaacaacatcttagtttatcgagagcaaattcttttgaaagtttgttattacaagtcatggctccatcaaaagtgaaaccggaacaagaaacatttccgccgcaggagatacatttacttaaagatgcagtttttggatccaaccaagtggaacctttttatcaaaactatcaacaagatgttccaattgccattgatttgggaacctccagtttaagagtcggattaacgaactctccagaaccaaacaatatttttccaggaataatttcacgttatcgagataaggaaagccatgaagacattaacgattataggaaatga

SEQ ID NO: 5087 - DNA, 1797 bp, Candida albicans
aaggcacactcgtctggaaaatcgagtgggttggtcattggcgcaggcaatcaattgacaagtattatacttgtaattaacggcagggggatattatcccaagctaaacgaattgattggggtggcgaacaactgcaacaatatctatcgaaattgttagctctcaagtatccatatttcccaagcaaattgaataactatcatactaccaacttattcaaggattattgttacattctggaagactaccaacaggaaattaaacatatcttggacatggatgttttggaaacaaaagatgtagtggtacaagcaccagtagaaattaatgtgagtaccgagaagaaaaaaacagacgaagaattagccgaacaagctgctaaaagaaaagaacaaggtaaaagactacagaaacaggctcaagaaaaacgattggaaaaattagcacagaagcaagaagaatgggagtatttttctaaattcaaagaagataattcatctttatcaccagaagagtttgaaactaaattgattgaaaatggatttgatgatctagaagattttaaaaagtatatgggttctctagaaagatccttgaaaagggctaaccaaggaggagaagacgaccatgaagaagaggaaattgatccatcgagtgcttggcctttggtcgatataccagacgaccagttgacagcagaacagattaaggaaaaacgaaaacaaaagcttcacaaagcaaattttgaagccagagaacgtaataaagaaataaaaagacaagaagaagaagccagattgcaatttgaaaaagagcaacaggaatggcgtgatcgtgatttggatgactggtgtacaaccaagcgtttaaagttggcagaggctattagcaaatacaaagaaaaacaaaaattattggaatcttttaaagatagaaagtctgctgctgcacaacaaagaatgaaatacattgctgatttagccaatgacgagaatggctcaacttcaactcaatcccgaaaaaggagacgtaatgccaatgcaacaatagacaacgatccaaatgatacttttggagctaacgacgaggactggaacatgtatagagagataacaaattccagtattgaggaagaaatggaacaaatcaacagtgaaattttgaaattagaagaggagcttttgttatacgatccaaatttccatcacgaggacacttttgctgcggcatcaacgtttgattggaagaacctggtacttcacaaattcatacacggtcctcgcccaaatattaccattgaaatgcaagctgaagggttactgccagaagaaattgctacccatcccgaaatgattcgtaaaaatcatcaaatgcacttgaatgtcgaaagaatcagggttccagagatattgtttcagccgagtattggtggtattgatcaagctggaatcagtgagattgctgatgatttgttgaatagtagattggacggaaattttacatcaggtggccagtcctacgaaattttgggggacatatttttgacgggcggattatcacttttacctggattcaaaaatagaataatgtcagattttagatcattccttccagagggagtgccattacatgtgagaacagccaaagaccctattttggatccatggcatggtatgtacaagtgggcaaatagtgaagacagctctgatggctatgtaacaaaagaagaatatgaagaatatggccctgaatatattaaagaacatggacttggtaatgcttgcttaaaagattaa

SEQ ID NO: 5088 - DNA, 1929 bp, Candida albicans
agaaatgatactagtactgttatttttgatacaaaaaacaccagtggagtattagctgcaggcatagaaacgtcaactgcagatgttgaaactagtattgctaccccggcaagcacgcagttaccagattctcccaaaagcaaaccagcctttagaataggtttaaccaaaacatcatcaagtgataaaagtcaaaaggataatgatattgatcccaaagattcttccaaacaatatgcaaatgaaaatgaaaatgaaaatgaaaatgctattgcaagttcctcagaagaagatgacgatgaagacatttttaaacctcctgtggatccgtcgaaaagtcgtagacagtcaataactcagcggagattgtccaatataactgcatctggtttacgaagccgatctgcttccatttcacttcatactgctgattcaaaccatgtaccggctaagattggaatccctgtttccaaaccaacaaaaaggagaagatcgctggcacaagctcgtagttctaaaagagtttctaccacacagccagcaaagccaaaggcagtagttgtgccaacagtgtcaactgaacctacatcttcttctatggataaatctgaatcatctactcgagaagaaaagaaaccacccaaaaaatcagatattaaaggtatcagtgacgactttattgttggtattgatccgaaaactcaaaaattgacaaagttcagacgaaaaggtgcaaccaaggtgaaaaaggagtctgattctgttaaaactgaaaacgagtctgttaaacccgaaggtgatgaagtcaaagttgaggtgttatctgacacggactcaattcctgaagaacccgataatctcattaccaccgtcacacatattcatcagattccgaaaaacatcaatgatgaagatgctgatctttccggtgaagtggacattgatctagaggaagttactatggccgatttgtgtaaaccgactcttcggatagggaaagtgagcacgaactttgaattagtgagagaggctgaacaacagttgaaacagaaaaaggctcaaaggcgaagagacagggaattggctaggcttgaaggaatatcactcgaagatgctatacaaaagaatgaagagcagagacgaggaaatggtgatgatgtagaaaagcaagacgaagaaccaaaaccagattcactctttgatgaagagccgcaacaagcagctacatctttacagttgacattcactgatggtaaaattggattcaatgaggaatctgctattgttgcgaaacccagggctgatataactagtcgatcggtggagaaatcgaatccatttgccaatccaataacttcaaccacctacagtcgaagagtatttaccgataagtggacctcacaggaactaaatcagttttatcaagcactaagcatgtttggtacagacttttctttaatttcccaattatttcctcacagatcaagaaaacagattaaactgaaattcaacttggaagaaagaagatttccagaggttgttgagctagcgttgagaaggaaattgccagttgatttcgaagaatattgtgccaacacaaagaatgacatcaagtctttggaatactacaatgaagagttgcgcaaagtcagaattgaacacgaacaaagtatgaatgccatagctttggaaagagagaaggcgttgaaggaagatgcagaagcaagcagaagaagagaaatagaaatcagaactggttctaaaccaatgagccgagccgagaagttgaaagaattgcgtaaaaatgaaactgtggttggttctattgatgatgtccgaaagaagagagagactaatgtgttgataattagtatattactgttccctggcgtctacgtattgtctaatggatctgttgttatgttttaa

SEQ ID NO: 5089 - DNA, 1431 bp, Candida albicans
attcgccgacatccaatttcaaacccagaactcctttctttttttttttttttacattcaaaacaaaacaagtggacaataattaatagtagtagtagtagtagtagcagtatcgttctaacaacaatgtcagctgattattggaattcatcacaacgtaatcaatggcaattaactcgattttcattattagaagccagaagaagagtattattacttgaacggaaaatgattcaaaatggattaattaaagattatcccaatataatatatgattataatatgaggatttatttacataatttattaattaaattaggtcgaagattaaatattcgacaaatagcattagctactgctgaaatttatttaactcgatttcttacccgagtttcacttaaagaaatcaatgtttatttattaataactacatgtatttatgttgcttgtaaaattgaagaatgtcctcaacatattcgattaatattatcggaagcaagaaatatatggccagaatatattcctcatgatgttaccaaattagctgaatttgaattttatttaattgaagaaatggatctgtatttattattacatcatccttataaatcattaatgcaaatcaatgaatttttatctaataattataatgtatttggttttaaattaacagtggaagaattacaaaatgcttggagtttaattaatgatagttatataactgatcttcatttattattacctcctcatactatagcggtggcagctatatatatcacagttgtattgaaaaaaaatttatctcgagtaagacaaggtaataataatgataataatattaatattaatactatgcatatttctactggaagtagtaccaatccaatcaacatcaacaacaacaacaacactaataccagtaataataatggaactacttctactactactaccaccactgcccaagaaactcaagttcttggtcaagatgataatactgaaatgaatatagatgatttaatgaatttgactaaatcaagtaataatagtcaagataaatcagatgataaaatggatattgataatccactacaactgcaagtaaatttatcacaaattcaaaatcaaactcaacatcaacatcaagaatctacccataataacactagtagcactaatactgggcgaaatggaataaatggacaaatctcacaatcaaatcaagaattgaataattttgatttagatatattagatgaagacaccataaaaattaataaatttatgaattttttagaacattcccatatcaatctcgatgaagttgttgaagccgtacaagatatgatgaatatgtatgtattatggaatcgatataatgaacaaggggttaaaaaggcattacaagtgatgttactcaatcggatttaa

SEQ ID NO: 5090 - DNA, 489 bp, Candida albicans
ttaattatagtgaaaccaattctattttatttcttcgattggctagtgaaaatgaacacatcttccaaagtcaacaaactgaaaaaagtggtaaacaccactggaagagttagtgccaaaaaggcagctagttatttacactcgatgcaaaattcatccacaacaaaaataaatcctgccaaacaagttactgctccaaattggaacccaaaacattttcgattgtttgttgggaacttaggtcctgatggaaacgacgaattactaaaagaggcatttctgaaatatccttctatgagtcaagttcatgttcctatagataggaaaaccagtaagaataagggattcggatttgttgcctttggcaaatctgaagattatttacatgcatttcaagaaatgaatgggaagtatattggccagcatccagtccagttgaagcgtgctgaatctagtgtacccaaaaagactaagaataaaaggaaatag

SEQ ID NO: 5091 - DNA, 1557 bp, Candida albicans
attaatttagtgattcaattcaaaatgtcagaaccaagtcaagatcaacgtcaagagcagcaatttcaagagcaacagcagcaagagcaacaacaacaacaacagcagcagcagcagcaagaacaccaaccagaacaacgacaatccactgaatcatctgaaaatgaatctcaacaagctcaacaaccatcttctcaagatgatgagaaacaagtaaatgctgcttctgccaaagaaggtggacgtgaagtttcaaataagattttgtatgttggaaatttgcccaaatcagctagtgaagaaacaattcaagaattgttttctgttggtgggaatccagttaaaactatcaaaattttaaatgacaaaaacaaggcaggtttcaactatgcttttattgaatacgataccaatgaagttgctgatatggctttgaatactttgaatggaagacttgttgatgatgttgaaattaaagttaattgggctttccaatcagctgcaattgccggtaatccaaataacactgaagaacctttgttcaacatttttgttggagacttgagtcctgaagtaaatgatgaaggtttaagaaatgctttctcgaaatttgaatctttgaagcaagctcatgtcatgtgggatatgcaaacttcaagatcaagaggttatgggtttgtaacttttggtaaccaatctgatgctgaattggctttacaaactatgaatggagaatggctttgtggtagagctattaggtgtaactgggcttctcataaacaacaacagcaacagcaacattataacaaccaacatggaggtggttatagtagaggttatcgtaataacaacggcggcaacaataacaaccgtcaattcagacaattcaataatatcaataatggtaataataatggattttctcaacctttggtaaacaataatcctcaatttattggtcaacaaccacctcaacctgatcaacaccaacaccagcaacagcaacagcaacagcaacaacagcaatcagttaatggagccaatggtgtaccacaacaaatgttgcaaggcttgactaatggtaatcttggaccaggaacccctatcaatggtagtaacaatgctgctggtgggtttaataacaatggaactgctggtaatgttgcaggtgcaccagtggcaggaggtccaggtgctattccagtaatgtcacctcaatcttatgatattgttttaagacaaactccatcttggcaaacaacagtatatttgggtaatattgctcattttactcagcaacaagaattgattccactattacaaaattttgggtttatagttgatttcaaatttcatccagaaagaggttgtgcatttgtcaagtatgatacacatgaaagagctgccttggcgattattcaattagctgggttcaaccttaatggaagaccattgaaatgtggctggggtaaagaaagaccaccacaattccaaaactttccaagaaatggcaatatgcatcaagttccaatgtatggacctggtggaagaccttaa

SEQ ID NO: 5092 - DNA, 1044 bp, Candida albicans
aataattgcataatggttaaagataagaaactttatgatttattaggtgttgatccatctgccaatgatcaagaaattaaaaaagcatatagaaaagctgcattgaaataccatccagataaacctactggtgatactgaaaagtttatagaaatttctgaagcatgtgatatattatccaatgccgataagagagaaatctatgataatcatggtttagaagcagcaagggggaatgcaccagctggagatgcagggaatccatttgttggtgctggaggggcaggaggacctcaattcaatttcaatactggaggaccaggaggattccgttcaagtacattttccaatgctgatgcattcaatatcttttcacaaatgggtggttttggtatgggagatgatcacggattcacatatagttcaagtggtgccggaggtaatccatttggtggagctggattcggtggtggaatgccaggagggtttggtggcggaagagcacgacaaagaccagaaccagatgttgtttccatgcccttaccagttagtttggaagatttgtataaaggtgctactaagaaattaaagattacaagaaagaattctaatggtactaaagaacaaaagatgattgaagtgaatataaaagcaggttggaaatcaggaacaaagattaattttgccaacgaaggtgattatcaaccagaatgtggagcaagacaaactattcaatttgtgattgaagaaaaaccaaacccagttttcaagagagaaggtaataatttgaaaatgaatgtgacattaacattcaaagaatcattgtgtggatttgacaaagatgtgacaacattggatggtagaagaatcccattatccagatcacaaccaatacaaccaggcacaacttcgacttaccctggtttaggtatgccaataagtaagagtcctggacaaagaggtgatttagaaattgtatataaggtggattatcctgtctccttgactccagctcaaaagaaggccatccaagacaatttctaa

SEQ ID NO: 5093 - DNA, 1341 bp, Candida albicans
gttgaacaattcggaatagcaaacaacaacaacaacaataatgcatctcaaaatgaatattataatttaccatcattgcaacaatcaaagaatgacgtattacatcaaaagcaacaatcatttcaaccaccaagaatgaattgggaagatgaacaatttaaacgagctgatcaattaattttacaaaatgatgataagatacatataaatgatgataaggaatatgaatttgtgtttgatcaaacacaatttgtaaattatgatgacattgaagagttacctggaaatggtgaacaagaagaagaacagagtggaataagggatagtgactccactatcggcaataaatacgatgaagttagaaaatcattaccggtatattcatatcgtgaagaatttttaaaaattattaatgaaaatcaaacattaatactacttggagaaacaggatcgggtaaaactacacaattaccacaatatttacatgaagcagggtattctcgaaataatcaagtgattgcatgtacacaacctagacgagtggcagctacaagtgttgccaatagagtcgccaatgaaatgcaagttaaattgggagaacaagtagggtataatattcgatttgatgataattgcaaagatggcgttaccgtgataaaatacgtcactgatggtatgcttttaagagaatttttacaagatccaacccttggcaaatattctgccataatgattgatgaagctcatgaaagaacattatctactgagattttattaagtttattaaaagatgtaatgatgacaactcggaaagatgatttaaaaatcattattgccagtgctactattaatgctgagaaattctcccaattcttcaataatgcaccaattttgaatatcccaggaagaagattcccggttaaaatccattatacaaagcaaccagaagcaaattatattcaagcagcaataaccacgatatttcaaattcatatgactcaacctttgcctggtgatatactcgtgtttttaactggacaagatgaaattgaaactatggaagaaatcttacgtgatctgatacttaaacttggtgatcaaatagatcccatgatagtttgttcaatatatgccaatttacctcaggaattacaacagaaaattttccaaccaacacctagcaacactagaaaaattgttttagcaaccaatattgctgaaacttcaattacaattgatggcatttcctatgtgattgaatccggatatgttaaacaaaatgtatataaccctactaacgggtatggaaagtttaataatggtgccctgttcaagagctaa

SEQ ID NO: 5094 - DNA, 327 bp, Candida albicans
aaaatcggtattgaagtgaatatccgtcaccaacaccgtgatcacctactagagaatacacacaataatactttactaaccaaatgtttaattagtggatctttcaccaatattgttaaattatcaccaatgggggattgttatcaaaaattaactaatggaaaaggtggtaataataccccatgttatattcatccttcttcatgtatatataaattaaaacccaaacccaaatatttgttatattatgaattggtattgactagtaaagaatacatgagaaattgtattatattggatgaaaaattgattaaagagtacctatag

SEQ ID NO: 5095 - DNA, 1314 bp, Candida albicans
  unsure (1294): Identity of nucleotide sequences at the above locations are unknown.
caaaatcaaataaaagacacaagcaagatgcaactgatatcacaacaacaagtaccacatcatcctccacctgccaacaaaccacgaccaaacgctgctgctgtcccaaccatttcctatcaaccaacagatattattattccaactcaattatatgataaaataggcaatttaggagaatataaaagattgcaagaagcagagaaaaagttggatttgcttattgctagaaagtcattggactttcaagctatacaacaaaaatcaattcatccacacgaatacagaccatctacaggagttttgagaattttcatctacaatacctgtgaaaaccaaccatggcaaaagcagttattacaacaaaagggattaccagttccagaccccactttggcggaatcatcttggacattgcgtatagagggtaaattcattagtgatattcctgatgaacaacagcaaattgatgaaacattcaagtttagctcatttttatcagccatctcggttgatttacttccaaacgagaattaccctaacattcaagagtctcaatcccacattatagaatggagagatgatggcccaaatgccaataaaccacctgcaagcgttagttttgatggattggatatcaagaggaacggtattttcaatatcaagtcaaaaattgctttgctagtaaagaatcactcaaacagtcttaaactttcagaggaaatgtctagatttgttggtaaacaagaatgttcgcaacaggaattgttatacattatttggcaatatgttttattcaaaggtctattcaaaaaaagcaacgcctacaccgaggtaccagcggttgaaacttccacattgcctaacccagctgatgataaagattctagtgacgatgatttgacattggttgaagcagatgatcttttgtttgaattgttgaaagtgaagacgtttaaatttctggatctttataaattgacccaagcccattttgtgccacgtgaacctattatcgtagattatgaagtgaacaccagaaaatcgacaactttgggtaatgttgttttggatataccagttgaattgccactcaatcttttgaaggcacagaaggaattactagatgttaacaagacagcatttgaaaacttggctaaggcagactccaccattctgcaattagatcaaagaatatctttagcaataatagctttgcagaatgcaaatctgagggaaaagttctatagagagttaagcgatgatccagtgaaatttatagagaactggttcnaaagtcagccggaacattga

SEQ ID NO: 5096 - DNA, 1281 bp, Candida albicans
acccacattttcaatattaacaacaacagcaacagcagcaacagcaacaacagttgcagccactgcagtctgaatcaatctcaatcaaaccaatcacctcagttttcccaattacaattacaacaattgcagagacaacaattattaaatcaacatttacaacaacaacagctgcaactgcagctgctgcaagtgccaccacaattgacgcaacagctgatggggactccaacatcaactaatccactattggcagtattaaacggaggtgccaattcaaatgccacatctactggtaatggttcattatcatcaaatccagtgttacaacaattacagttacaacaactccaacaacaggttcaacttcaacaattacaagctcaacaacaacaacagcagcaacagcaacaacaggctataccaatcataaaagaagtatggagtagtaatttggaacacgagtttcaagccttaagaacatttatcaatgacaaaacctcaaaagtttttattgccatccatcaagaaattcctggtatagttgctcgaccagtggggacttttaaatcttcttcagattatcattttcaaacattaagagccaattctgatttgttgaatttgattcaattatcattatgtgtcatcaaaatatcgaaaaatgaaactatcagcaccccagtaatttggcaatttaatttcttgtatgatttaactaaagaaatgtataatgaagaacatttagccatgttggcacaaacctcacaaattaatttccaattacttctgacacatggtatcccccattttgaatttgctgaattgatgattgaaagtgggttaattctagatgataatataaattgggtttcattccatgctggttatgatttaggtttctttgttagtttattactgaatgatgatttaccagtagatgaacctgacttttattggtggtgtgccaaatatttcccaaacttttatgacttaaaatacattggaaatcaaatattaaacaaatctacaacaaatggagcaggaggaaccaattcaaatactttagatgaaaaaacaaataaaccttcaatcgaatatttggcagaggaattacatttattgcccatatcaccagcaattcgacaacattttaccaattctactttccattcacaacaattaacttctacattacacgcttatttgtcgatggaatgtttcaaggaattcctaacacgttttcactcactgaggggaacagccatccgcgctatggaa

SEQ ID NO: 5097 - DNA, 1485 bp, Candida albicans
cgaataatgaatgttaacccacatcttcaatatttacaacaacaacaacaacaacaacagcaacagcagcaacagcaacaacagtcgcagccactgcagtcgaatcaatctcaatcaaaccaatcacctcagttttcccaattacaattacaacaattgcagagacaacaattattaaatcaacatttacaacaacaacagctgcaactgcagctgctgcaagtgccaccacaattgacacaacagctgatggggactccaacatcaactaatccactattggcagtattaaacggaggtgccaattcaaatgccacatctactggtaatggttcattatcatcaaatccagtgttacaacaattacagttacaacaactccaacaacaggttcaacttcaacaattacaagctcaacaacaacaacagcagcaacagcaacagcaacaacaggctataccaatcataaaagaagtatggagtagtaatttggaacacgagtttcaagccttaagaacatttatcaatgacaaaacctcaaaagtttttattgccatccatcaagaaattcctggtatagttgctcgaccagtgggaacttttaagtcttcttcagattatcattttcaaacattaagagccaattctgatttgttaaatttgattcaattatcattatgtgtcatcaaaatatcgaaaaatgaaactatcagcaccccagtaatttggcaatttaatttcttgtatgatttaactaaagaaatgtataatgaagaacatttagccatgttggcacaaacctcacaaattaatttccaattacttctgacacatggtataccccattttgaatttgctgaattgatgattgaaagtgggttaattctagatgataatataaattgggtttcattccatgctggttatgatttaggtttctttgttagtttattactgaatgatgatttaccagtagatgaacctgacttttattggtggtgtgccaaatatttcccaaacttttatgacttaaaatacattggaaatcaaatattaaacaaatctgactcaaatggagcaagaagaacaaattcaaatactttagatgaaaaaacaaataaaccttcaatcgaatatttggcagaggaattacatttattgcccatatcaccagcaattcgacaacattttaccaattctactttccattcacaacaattaacttctacattacacgcttatttgtcgatggaatgtttcaaggaattgttaagacggtcaaatatgacattattgagcagctttaaaggtactatttgggggttgggtacttttagtggcggcaccagcattaacaatacaaataataatggggtcactgaagatgaaattgttgcttcaagaattaatggaatttccacaccttccactcctgttgggataatcagcaagagtggtatggttcattttggtggtagagtgtaa

SEQ ID NO: 5098 - DNA, 1599 bp, Candida albicans
  unsure (1491): Identity of nucleotide sequences at the above locations are unknown.
cattacactatgataaaatctgaagttttgagtggatctgcatccaaaactgtgggaaactctatatctaatggtacaacagtactgactcagaatcagggtggaaaacagaatctaatccgtcagcagcagcagcagcagcaacaacaacaacaacaacaacaacagcagcagcagcagcaactcaaacacagaactgctcttcaaaattaccattttgcctcaacttcggaagagatcttaaaaaaatactccaaatatccagcatccatgagtttacatatttttgaaacgcattacagatttaacaattctcaagattcccaagtaattcccaaggattcgcccatgattaaagattttatgaagcatgttttgaaagagcaaattcccgttgaaatgtgtgaattaatcaaagattttgctattagaccgtatgatggatgcataatattacaagtttatgatcacagaaatatggttaaaacagctgttttacagaacagatcaacatcgtctccatccaaagatcaagacaaaaagcaacaaatggttgtttcaaagccccggacatatagaactttgttgagaccaacttccctttctatttattacgatttactttatcatacagactcggcactccatcgattcactgattatttatctttacaaatggagtctgagattttgacagcaacaaatagagagttaaatttatcagttcctttgaatccttataattacgatcaccttagacctgaacctgaaccttctggcgatatgtctcaaaacagtgacgaagagattgaccaagttaaatttcaacacagagatgcagttgaacaacctcgtcgtaaaattcatcaagacgaaatggtgttgcacaaatcttcggaatacgaagaacttatgttgctattatctaacaagcataaacgtccagatgattgtctggataaacgactcgtggttgtaagtacttcggcattgccaggttcttcgctaactggaacctctaatacatcaacaggaacagcggctgcaacacctacacctacaagtacaacagcatcagctgcttctcagtcttcaaaacaaactactgctgacggggcatcgacaacggataccaaaggcaagagaggagacaaagcaaatggcaccagtgcaaatcaagcactggcatcgcccacttctgttcaccctcctattccgaccataccacaaaatctggttagagctactggacagttcatgaggttgagattaatagaggaaataagaaagaaaagagaacttgagaagttgcaacaagaagcaaagattcaggcccaggcaaatgccattcaaagtgatctggtaccacccagtcaacaattggctcctcagaataccataaactcgcctgttgtcactgaaccgacaaagcgttcatctccagctgctcagaatcaacctgcgccaaaaagagcgaagaaagagactttngggccattaccagccaaagcacaagctcaagcaaaagcccaggcacaaaccaaagcaaaagttacaaccgaaactccaggtccgactcctgtccagggacaaaattcc

SEQ ID NO: 5099 - DNA, 1461 bp, Candida albicans
ataatgtcacttgaagacgacgaagcccttttcgaagatttatatggagacgacgagaagcaagaggaaaagcaggatacagtccaaaaagaggtagaatccacagaaaaggaaactactgttgtcgaaacagcttctgctactgaaaatgctagttctgctgaagtggaaaccacaactgaaggtgaatcagaatctgtcccacctccacctccaccgccaattccagctagtggagatgtgaatgctcaatctaatacagctcaagataacgctacatcaactgcaccaggatcagttccagctggaatgcctcaatttcctttcgatcctgctcaattccaacaatatgctgctgcaaatggtctccaatttccaggaaacgctaatcaacaaaattttggtgcagctggaggagtcccaccaccgccaccaccagcacctactgctaacgctacatctgcagagtcggctggaggaccttcaagaaaatgttttattggtggtctttcctgggataccaccgaagaagcattggtatctcatttccaaaaatatggtaatattgtcgattacacgattatgaaagatagtgcaacaggccgttcccgtgggtttggatttttgacatttgaggatgctaaatccgtggatgccttgctcaaggacagacacgttttagatgggaaattgattgaccccaagagagctatttcaaaagaagaccaagaaaaggttggtaagatatttgttggtggtattgatcctatggttactgaagaagaatttgacaatttcttttcacaatttgggaaaattattgattgtcaattgatgattgacaaagatactggaagatcccgtgggtttggatttgtcacctatgattctcctgctgctgttgacaaggtttgtgttaataaatatttaacattaaagggtaaagccatggaagttaaacgtgctgctccaagaggacaacataatcaacaagttatgatgcaacagcaacaacaacagcagcagcaacaagcacaacagcaagcacaacaacaggccatgtatccatatggttcttatggattccaacaaatgaatcctggtgctatgaaccctgctatgagtcaagagtatatgagatactatcaatggtttatgtatcaacaagcccaagctgctcaacaacagcagcaactgggaactctggcatctccagaagcacagccagcacagccattgaatccacaacaacaagctgcagaagaagagtctgaaaaatccgacgaacaagctagacctgccattccaactggtccaaagagagctccaccaaccggcccctcttatagaggtggtggcagaggcggtggaagaggtggttatagaagaggcagaggctaccatccatatagcagaggcggacgcagagtcttcaccacgaggaacgacgaccgcgcatag

SEQ ID NO: 5100 - DNA, 408 bp, Candida albicans
gtaaaccaaccaagaaacaatccagaaaaaaagtctgatattacaggactgaaaggtgagaccgcaggagcgaaatcttcgcctgttcgaaaagtgcatatcacgtttatgcataatcctacaaatgtaagagaaatatatgatgagtttttcaaaggctataaaggacaagagccattatgcgaattggacgaaaagtatggaaaaagcgagtggagaggcgattcaaggtccaaagaatcaaaaagatttcaaagaagaaagaagttgtgtgatgccattcaaagaggtatggtaaaatacggtaaaaatgccgatgaaattattgaataccttgaaagtttccgcaaagacaagtcattgacatggttgatgaatggtcatttacctgaggatctacaatcttaa

SEQ ID NO: 5101 - DNA, 1809 bp, Candida albicans
tcactgttgtcacatataccgctcaactccgttcccaaaatcaaaatgaatgaaacttacaacagtcaagaaccaaacaacgccatgttttacaacaacaactcgacgccgtccaatgatgcacagtcccaaaataataacaattccacaggcaacagctctgttgtcaatgctgctgcttccatgcatgccaataacggcaaccacaataatgataatataaacaccaacgacagcattaacgaaaataataacaacaataacggtaataataatagcaacagcagcggtaataccaatgacaacaacaaaaataaaggtaagaataaaaacaatagtgggaatagcaacaatcacacggtcaatgagttatatggactcatacataatttgcaaagccagtttgctcattatcaaaacactcagttcaatcaattgatgatgaaaatatcgtttctccacgactccatggatcatatgaaactgcaagtgaatgatctaagtcagcaagtgttatttcttgctaaaaatagtggtatgatatcaggtacaaacagtaaccccaattctacttttaacaatcaattcaaggcttttgaagtatttactaaacatctcaacgaattgaacaaagaaattgaagagatttcaagtagctcacaggggatgcaaaatcaactgcaacaacagcaacaacagcagcagcagcagcagcagcagcttcatcaaccacatcaccaggcacagatacctccaccgccttcgcatccgccacaacagactttgcaattacaatcaaaccactcgcagtttcagggaccatcggtacatctcggtgtgcccctgaacagtaatggcccaccagctagtcaatttgatgaagaggtcgatagtatcacaagaaaaggtctatcattgcggtcaccagccaattcgtctccaaacccgacatcacactatgtgtttgatgttggaccgtttgcatcgagaaacatgaatggtaataatgcgaacaatttgtatgataaaggacccaccacttcagtaattcgtcctaacaagaaacgaagaaaacaacagaagaactcccaggaagatactcctgccaatgaaccagaatcgacgctacagctgcaaagaagattacctgtacagcaacagtcaagacagacacttgcacaatcttcgtcaacatatccaaactcatacattcttcctatgcctcctttacttagtgatgataagctagggcaaaatctgggttcttctacaaataatgacccaactcaatttatgttacaacgtgataacggcactgtgatgacatctgcattgagacaacctccaaaccatacgcgcccgccaccaaaccaacaaacagcttcaggattttcctttgatgacgagattgactctatagagcagttagaaaacgacaaacaaaacgagggtagttcatcagaaagtgctaagcgaacttccaagaaacggaaacaatccgaatctggaaaaatgacaatttctgttaatccattaaatataccgcaatataaactagaaagaagtcttaaatcattagcagaaatctggaaggaatacgcccatgggttaaacaacaagcctcctttgaaatctttagaaaccaagtatggaactaaatggagaaacgaaacagagtcgagaacgtttttaagaaggaaaaaaatatatgaagctattgaaatagggatcagtaaagggtatacagaagatgaagtgattcaagaattagaaatgcacaggagctataacaaaaatggagtcatttag

SEQ ID NO: 5102 - DNA, 1818 bp, Candida albicans
acaagaatggggaccaaaagaaagagagaaaatttagttggaaaacctcgatccaaaagacaaaaaaaggatagtttgttgttaaaggtggataatgcatcatttctagagaacaaatttgagactttgcaaaaccatttggacgaagagtctgactctgaattaatttatgactacgatagaaaaaagagtgaagagttgactgatgatcttgttttaattgacagcgaagaagaatccaatgactcgagtgatggttttgacgatattaatctggaatcagagaagaagcaagtactagtaggtaatgataagacaccagaaaatgaattagcaaataacgaagatttcattggttttgggtttctgtctgaagatgacagtgaggaaattctgaactccgataatgacttgtctaatggtgactatgcccatggggagacaccaaactctctgtatccgtgggttaaagatcatgatcattctaagcaaaaggaaatagctgattggctcacattagaaatgaaagattttgtgaattacatatccccttctagtgaagaaattgtcaccagaaacaatgtcatcagtacgttgaagaaagaaataggtaagttctggccaggtactgaaactcatgtttttgggtcgtgtgcaacagatttatatttacctgggtcagatattgatatggtagttgtttcagaaactggggattatgaaaatcgttccaggttgtatcaactttcaacttttctaagaaccaaaaagttggctaaaaatgtcgaggttattgccagtgctaaagtgccgatcatcaaatttgtggacccagtttcagagcttcacattgacgtgtcgtttgaaagaacaaatggactcgatgcagccaagagaataagaagatggctaatatccacaccagggctacgtgaattggtattggtgatcaagcagtttttgcgatcacgtagactaaacaatgtgcatgtaggtggattgggtggttatgctacaattatcatgtgctatcattttttgagattgcatccgaaactatcgactagctcaatggatgccttagataacttgggtgtgttgttgattgagttttttgagctctatggccgcaacttttcttatgacaacttgatactctctttggatagggatactgaagagcctcggtatgaaaagaagggtaatcaccctatactaaacactgcaagaaataccttttccattgtgatccaagatcctgctgataccacgaacaatattacaagatcatcttacaatcttagagatttgaaaaaagcttttggtggagcatatcaattacttgtagaaaaatgttaccaattaaatgctgcttcatataaacaaagattgggtcaactgatactaggggatataataaaatacaacgggaaagagagagattttaacgacgatcgtcataaagtagtcaaccatgcattgatcagccatgaagaagaaattgatgacgaaagtgatgggctcgatggcaatgataagtattacttttctgacatgacagtggagagcaatgaggatgagtatgttcctgaaaaaaaacgtaccacacctgtcactaacaaagcaaaagacactaaaaaattagtggaatctttcttaagtcttgaagacagtagtgatgttgaagagctcctggcaaaagacgtcgctggcaaattcgaggatgagccatatatcccaaagctaaaaaagctgaaatcaaatcttgataaagatatcaaaagagattactggagacaaaaaggtttagatttgtaa

SEQ ID NO: 5103 - DNA, 987 bp, Candida albicans
accagtaaccaaacgatgtctaaaccagttacgttagaactaccatgggtagaaaaatatagacccaagaaacttgaggatattgttgggaacgaagagacggttgaaagattaaaattgattgttcaggatgggaatatgccaaacatgattatatctggattaccagggattggtaaaacaacctcgattcattgtcttgcctatgagttattgggggatgaacattaccatcaagctactatggagttgaatgcatctgacgatagaggaattgatgttgtacgtaataaaatcaaacaatttgctcagacaaagattctgttaccaccaggacgacaaaagatcattattctagatgaagccgattcaatgaccccaggtgcccaacaggctttgagaagaaccatagaaatttattctaatactacaagatttgcatttgcttgtaatcaatcgctgaaaattattgaacctttgcagtcacgttgtgcgattttgagatataacagattgtccgacgaagaggttttggcgaggttgttagaaattatcaagatggaagatgtaaagtataatactgagggtttacaggctttgatatttactgctgagggggatatgagacaagctattaataacttgcagagtactgttgctgggtttgggtttgttaatgatgtcaatgttttcaaaattgttgatcaaccgcatccacttgttatacagctgatcttgctcagctgcctcaaagacaaagatatagacaaagctcttgggttgcttgatgggctttggtacaagggatactctgctattgatattgtgacactgacattcaaagtggccaaaaccatacccaatatcagtgaacaaaagagattggatgtgatcaaagaaattgggtttgcccatatgcgggtgttggagggtgttgctacatatttacaattgtgtggtttgtacgcaaagatatgtgacctttaa

SEQ ID NO: 5104 - DNA, 2604 bp, Candida albicans
atctcaaattcagtgacttggctgatgaaagactgtatttcaagaaatattcccaactttccaccaaaggagagcaccacaattagatttattgatcacaacaaccatgactattttactgcccttgggtctgatgccgatttgattgcagagaaaatctacagaacacagtctgtcattaaacaccacaaccagacaaagtatgtgactatttccccacaaaactttaaggagctgttgaattattgtttgcaaaatcattttaaagtcgaagtttatcatagcaaaacttctcagttgatctcgtctggtaccgcaggaaacttggatagtctttctgaagaattcgatattgattttgattttagagatgggtccagctcatctattgctgctattaagcttggaaacaaagtcggtgtttgtgttattgctgattccattgtgcacttgtctgaattcgaggacaacgaattgtactcaaacttggaaagtttgttgattcaattaggggtcaaggaagttgtcatcccggctaacgtcgacaacaaaaagtttttccaaatgttagagaaattaaacgatttagtggttagtgcagccaaatcattccccaaggacaacgagcaggatataagtaaattattggatactgagaatttagagctttctttagctgcaaaaggtataaactcacttgactatgcattggctttgtcatgctgcggtgctttgattgactacttggatttgttgaacggtgacaaaacttttgaaataaacaagtacaacttgtcgacatttatgaaattggattcctccactatgaaagcgttgaacattttaccaaatggaacacaaaaggctattacgtctatatttgagttgttcaaatgcaagactttaggtggttctagattattgtcacagtggttgaagcaacccttgatcgacttgtcgttgatcgaggaacgtcaagaattggtaaaggcaatgattgatgacactagtttgagggttgaaatccaggagttcttgtcaaaggtgccagacattaatcgattgctcaaaaaaatcggtcttggtgttaaacggtcgggtgctgagaacaaaaaattgaacgaagtggtcaatttgtaccagttggtgctgttgcttcccaatttgactgaaatcctaaccatcgactactatgcgaaacccctcaaaaaggacgaacaagctttgtcaaagttttgcgaattagtcgaaaccactattgaccttgataccctgtttgacaaagactacaaaataaagcccgacttcgacccatccttgtcggaaatttccaataacatggaatcagcattcaaggccatcaacgacctttacttagaagctggtgatgatttgaatctcgacacagcaagtaacaaattaaagttggagcaacatcaaacccatggatggtgcatgagagtaactagaaacgattcaagagtgttaagaggtaaaagccaatataaggaactccaaacagtaaagtccggtgttttctttaccaccatcgaaatgaagagactttcacaagagtacaccaaggcttacgacgagtacaacgtcaagcaatccgaagttatcaaagaaatcttgtcgcttacattgacatatgaaccagtactccaatccctttcttcaactttggcacacttggatgtcattacctgttttgatactactgcaatgctcaactcatacacccaacccaaattgtttccctttgagtctagccgcaagatcaatttgatagagtcgagacaccccctccttgaggtgcaagatgatataaactttatttccaacgacgtaaaaatggacgacaaacactttgccattattacaggtccaaacatgggaggtaaatccacctatattagacaaatcggtaccattgctttgatggcacaggtagggtcatttatacctgccaatgacggtgcagaattaccaattttcgatgctatattatcacgtgtgggtgctggtgactcgcaattaaaaggtttgtccacatttatgattgaaatgttagagacttcgtcgattttggctactgcaactgccaactcattgattataattgacgagttgggtagaggaacatctacttacgacggattcggtctagcatgggcaatatctgaagagttgatcaaaagaaagtgttttgcagtgtttgccacccatttccatgaattgagccagttgtcagaaaagtatgatggagttgaaaatttgaatttaatggcagaacagacgaacgaagatataaccttgatttataaggttgggccaggtatttcaaatacatcttttggtatttctgtcgcagaaaagttacatatgccagagaagattgtcaatatggctaaaagaaaagtcgaagaattaagcgaagagccaccaattaaaaagcaatgttctgaaactgaagtcagagagggtatgagcagattacgagaaattctaaaagaatggagaaacaacccagaaatcaatattgctgactccttggctaaagagcctaacaagtttataaattatatagttgacactttatag

SEQ ID NO: 5105 - DNA, 1698 bp, Candida albicans
tttaatattatggatcctgcttatgatatgcaatcgcacgaaaaacaagtactagtcaatgattccttaatacctgaagacaatgctcaaaacccttcacttcctagtagagggagctcgaacagcacaattacccaatcatcatcgtcatcatccgaagtaaaacctatcctcaaaaagaaacgtacaagaatttcaaaagcctgtgaatattgtcgaaagaaaaaagtgaaatgcaatggttgtcagccttgtcttaattgtctacaatcaaataatggtgattgtgaatatgctgtgaacgatgaaaagaaacccaaaatcctgaaaaagaagaaatcaacatctctgaagagcaagctgaacaaggaccggcaaaacaaagctcttgatgaaagattatccaaaattgaaggcattcttgccgaattagtagctggaattggtaccaatgacaacacgtcgacctcaaaacctgtgtcgagattaaatgtcccaaatggaaaagaagcaaagacagatgaatccagccctctccaatcaccaaaggagattaaggaggagagtgccaatggacacgacgaaaagcatgatcccaaagtggaatctaattttcatggttcacatagtgtaattaacattttctctaagaaatctgttgaatggctattaaggcctgtacttaacaaatgccaccaagacatacatgtattcaaagatattgccatagtacatgatttctatacccaggcgttccttgacaccatttctcaaccaattaaagccaggatcaatcggcgaaatgaccttatggacaacacttttgctaatgcaacaatcccattggagattttatcttgctatgacgatatttttctagttagttacgtatgtaagggagaccacatacgcaaattattccaaacttattttgaagagccagatcaaaatggttcacgcagaagaagttttttatggagtgagttattattaatgactgctgccattggtatttgtatttcagtgttgattgatgaccgtaacaatactaaagataccgataaacccaagtattcttgttcattatcaaaccagcagctaattgagatcaatttcaaatgcttttattccatgattttttatcaccgcagattatgtgttataagtgaaggcttccccactgtaacagcgtttgttttgttgataatgtattttgattttgctgtgcctatactgcacgttacgtttctagccgtttctacggttatgcattatgctcgacagcttggattacacaaaagtgaaacctatagagagatgggtttggaagagcagagaacaagaagaatcctttggtggttttgcgaatatttgcacattgaatattgtttccaaaaaggttacgatttagatattggtgatcaagatatgacgagttttagtggtgatgacgccagtactaaggctctaattaaatcaaattggaatttaattcagtcgacgaaaaattctgatactcctattgatgcattaacaaccaaccaaataaaggagactaaagcctatccttttttgtgcttccttaaccatgccttctctaaccaaaaaaaagggttaaatccctatccatttttattttcctctaacgccccaaacaaaaatttgtgcacttatctaacttcttggggaagaatttaa

SEQ ID NO: 5106 - DNA, 2271 bp, Candida albicans
ataatggacacttcactgtcactgggaactcacccttcaacttttaacaacttgacaaagcaacaagaactcacagggaatgaccctaacgatactaataggaaaagaataagagtggcatgtgatagttgtcggagaaagaaaattaaatgcaatgggtcttatccatgtgggaattgtattcaagctaaaaacactagtaattgtcatttcactgaacgacctgtgagaaagaaattgaaaccaactaaacaagacaataaatcaaccgccaatagcaacggagtttcgaaaaggaaatacaacgatacatttagtgggaatagcattaatatcaagactgaaaaacaagagaatactactttcggcataaatgacaacaaatcaagtgatctagaatcgagattgagtcgtattgaaaattcaatgtcgagaatgatgcatactttagagaacttcctgcaaaactttatgacacaagcaataagaaataaccattccaactcttccatgttcaataataattcactatcgcccactccttcagaagattttaataaaagtgcatttgatagtgaagaacaacaaacttcacatagttacaaaaatttgaaagatcgtgttaaagatgccaacgaattattgaaattgagaaattgggatgaatttgttggtactcattcaattacttgcattttctctcgggaatcattagattggatggaaaaaactttaggttcatacggtgaagaatatttgacccccataaggaatttacctttagtgtttcattcagagttaaaaccatatatcatgaaatggattgatcctcccgtagtggataaattgcaaaggaaaaaattattagaaagtccattccctactgattcaaaattaatttcaaaattgattgatttatattatgaagaaacaagtatgatcaatattttagttgatgaatcaagagtgagaagtttatttgctgcctactataacaattttgctgaaccaattgctaccaagcgaaggagattcaaactatcggaattacttttaatgacatctatattattaatttctttgagttgtttaactgaagatgattttagtgaagaacggattaccacccctgcttcttcaactagtagcaattattctgcagcatcagcaaatcttttgggtgactataacaaaaacagattaatagctttacagaattcgttggagaatagtgccattttttattatcatagaatcagtgttatcagtgaaggtctagaaacagtagaagcattgttgatgtttattatttatgttgaatccaattggttgacgagttttttcaactatacaattattaccgtgacaattagattcgcccaagaaattggtcttcatagagcagaaacttataataatttagatctagaagaggcaacgaaaagacgtaagatttggtggttttgttattttttcgatattgaattttcttttaaatccggtaaacctccagtaatcaataccaacgatgtcactaccaatagtgatgaagacttattacgagttattactcaattaaaacagtatggaccactatcaccaaaggacagaatgtatagtcctgtttgccacacaatatctactagtttgttagatttgagtggatctgactctatttgtttagatattttgaaaatcattcaactgggggatatacttgatgatccattttatttccaattttgtgccttgttacaatcaagaataaggtcaaattcttatcatgatttatttattgcatccgctgaaaaacgcgatttcagttccatatccaatactttagaaaaattgaatgctgacatgtttgagttggcaatgtatttagcagatgaggccaaacctcgattttacaatgatccaaaattcacctcagttcaagcaagtactggcacgtcaattaggcgagacacgattcttgctatgaaattgacttttttctcgcatttaatgattattaatcgatatccattaatgattgctaccgaagattccaaatttgatgatcgagtaataaaatttagaaatctttcattggattcagcaagaactattcttatgttgattaagggttggcatagagaaagtgcctcagcacttttctataattgggcaatatatttcccccgtggcagcatatcttgtattggtggcagcaatcataaaccatcctcaattaccagagtcaggaaccaatttgaatctattgattga

SEQ ID NO: 5107 - DNA, 747 bp, Candida albicans
  unsure (9),(11): Identity of nucleotide sequences at the above locations are unknown.
ggggggggnanatttcattgtccttggcgcgtcgttatgaaaactggaagtccagccttacaagggttggcattgctcattctttactttgaaattaactttgtcactgattttcatgtgaattacagcataaccagtgttttgattaggtatgccaaggagctgggtatacatagagtggaaactctaaacaatgaccatggagttgaaactactttaaaaagaaaattatggtggtttagtgaatataagggggttgatataacgtacaagagtggtaagccaatcttaatcgatatggacgatgtcactacattaactgaagttgatgactatttcatgtcggtgcccacaacattatttcttgatggcaagtatttggaaaatgctaatgacattgttttaaatagtcagattcatggtggtgaatattattttgcttatttcttattgattttatcaagaattaaagctaaaagttatgctaaaatatattcgaaattgccgacgaatatcaatattcaagcaacattgacatttgtcaatgagtttgattacgatttaagaatattgaccaacttgatgctgccaatattggcagcaacaacaacgatatcatcacctaatagcaccactgttaagaaccctttaaacctaagtgaaggctgtttcaattattttaaagttgaattacttttatcacaatatgctcctcaactttccataaaacgagtaccatttgtgaaa

SEQ ID NO: 5108 - DNA, 204 bp, Candida albicans
tttatccactttatcgttgcaatgtcacgtcaaagtttttatgctgacccaagctcagctggtcgtccaatgaaatatagaaaagatttgtttcccttgttggacaccagagagattaccgcgtgtttacttgaatgtgaattcaatgtaactcccgacctaataatccagccaaccgctgattttgttcccaattttttttga

SEQ ID NO: 5109 - DNA, 954 bp, Candida albicans
agcgttgtccttccagccgccgtggtgaagacggcaaatgaatgtgaagcatcagctgacaaagttagtgaagttcaagcggaaaatagtgccaccatgcaaaaaatcagtgctatcaaagagaaattggaaatggattcagaaaatgatgaaagtagtagaaagaatttacaatatatcagttcgtacaatcgaaaattggagactaaactaagagaacttaaagtaatgcaagaaaggttgaccaaagagcacgatgattatagacaagaaaaagctttattggctaaaaaactatacgatatcgatttcctatacaatgaaactcaagaacaagttgcaaatttgaccaaatatgctgaaaccgacttgtcgattttagtgaagataaccgaagatttgagtaatgacttatcatctatgcaaactagttataagaatttggaaaagagttatcaaaatatgggtatcactattgattcaattcaagtcaatgaaatcaatttgaaagatttattgaaattggcagaggatatcactagaaatgtggagaagcgacaaattgatggcaaaattttgaaagataatcaagataatttggatgaattaactacgaaacaaatggaattggaaggacaaatattaattgttcaggaccaattgaataaactgaataggaagtatcaggatttaatagtacaagctgataaaaaggagtctgctgtcaaattaaagttagaggaaacaaagcaagaatttaatgatattttatccgaaaaggaaaaacataatgagggacataaacgaataatggatcaaatcgtaaagattcaacaagagactaccgctattcaagatgcatttgttaaagagtctaaagaagttgaactcaaattgataaatctaatgtcaattatcaagaggtacatgtcggacttgaggaataatatttag

SEQ ID NO: 5110 - DNA, 855 bp, Candida albicans
ctcaaacacacacttgtagtcatatttaaaatgtctcaattcggagagttttatgatacatatctggttgagaataaccaacaatatgataccgacttgaataattctacaaatacaccaattgtacaatcaaaacaacgaaatgataatataattccaagtataaatattaaacaggaagatttcgattcagtattgagtggctcattagatgtgaagaagcagttatcactgtcactaaataccgcaggagtaggaattggtagtagctatggaaatggaggaatatccaaaccacaatccagaagaaactctacctatatcaagtctcacgaaggaagtgacaatgaagatgaggacgatcagaatgataaagatgttggcaacgaaaggaaacgtcgggacaacatcaatgataaaatccaagagttgctaacattgataccctcagagtttttccaaagcaacacagataataatactaaaacgggaactaaagtagttaaagagaacagccccgaagacgatgcggtcaaaaactctggtacaaaagacgggaaaccaaacaagggacaaattttaaccaagtctgtggagtatttgcaatatttacagaaccttattgatgaaaataatagaaaagaggttgaactaatcatgcgattaaagaccttagagctcaaggctgccaatagaccgtcagaaaatattccaatcagaatcggttatacgagtgcagaaaaagcacttggagaaattggggttggcccatgttctgaggaatatttcaagaacgtgttaatcaaaagtgcatccacaagtaaatcaggtagacggggaagtacgagtggataa

SEQ ID NO: 5111 - DNA, 816 bp, Candida albicans
agactgatttctcaacaagccacaggcaatgctaatgtcaacataggtccttccagtacaaatcaacagcagctttcccaaatacccaatcaacaacagcagcagcagcaacaacaacaacaacaggtaccacaatcgcaacctcacgcttcacagcaatctccagttcttcagcagtcacaaccaccacaacaagctcctgtgcagaatgtaccacaagggctgcctggattaggtaatatggccacacctcaaatgaagcaaggtattacatcaaatcctaccaatctttcttctccgttagttccacaacaggtgccagttagcaataacaattctgcttcccaaaataataatatcaaccgtggaaggccggtaactgctccagcaaatatcacgatgtcttctattttacctcctctcactgatgaagttaaacttagattgaggcagttgatagaagaagtatcgcgtaacaatgtagttttgagagatgtcactagtttgctctcaaaccaagacaaaactacggttcgtgattctatgaatcgaattcaagaacagtatggtaacgtggatagtattattagttatttctacttgctcacaaagaatggcgatggtactaaacggttgatccaaatgaagtatatgacaaagaatattttagataacttgcatagaggaatttatttggcaggaccagacttgttggaaaaggtgagaagtcaatacgccaagtatttcgagtatgtcaaggaacagataaatttgagaagacagcaagtgcttcagcaaggtggtgctaatatgatg

SEQ ID NO: 5112 - DNA, 1317 bp, Candida albicans
ccatttattgataccaaagggggttcttgtgtgtccggattgcctattatgaatattcctccaaatcagaattcactccaacaaatggggggaggctcaaatcctaacgcctcatggagagcaatgtatagtggtgaggaaagacaaaaagttgttcaaattatcatcaatactttgacggaattgcatggttccaatccaaattttaatgttcaacggttgagcaaaatggcacaagattttgaaaagcttgtgtatgagagatcagcatctaaagaagattatttgcgggctattaaaatgaaagtacatcaacttagagtccaaaaacaacaaattgctgctaatcaaggtggtcagattaatccacaacaacgacaacaacagcagcagcagcaaatttccaattcaaattccatgaatcctgtgaatgcaccacatgttcaatttttgcgacaacaagcacaagccagaagccagtctcaagcccaaatacaagctcgccaacagcaacttcgtaatatggtcaatcagcagctgcaacaacaacaacaaccacaaccacaacaaactgtccaaccacaatctcaagaacatcaacaggatcaacagaatacttcttctcaatcaactcaacaaaatgttgcgagtggggctggtagtggtggtcgtggcaatgctttttttacacaaggccaattacctcctcagttggttaacttgatgagaacatcacccattcctcctcctttacttaacaaaatgccaaagttgccggccggtgtcaacacttggaatcaaattttcgatttaattagaaagaggttgataccacctgatatggtacctactattagagatatccatggtatgcacttgcaattgttcatacgtcaacaacaacagaagttgagcatgcaaagaaatatgaatgaaggaaacaacggtgataacttagcacagggtccaaatgctaataataataataataatattaatactagtacccacaacaacagtaacccaacccctaataattttaataatttgacacctcagcaaagagagctgttgttgagacaaacaagaatgcagcagcagttggaacaacagaagaagggacaacaaccaatgcaacaagcaacctctctgtcacagcagcagcagcagcaaaaacaacaacaacaacaacctgtttctcaatctggtcagactcctcagttggtgcaacaaccaaataaccagcaacaacaacagcagcaacctcagattacaattacgcatcttcagcccgggcatggcaggatccgaacttaa

SEQ ID NO: 5113 - DNA, 1371 bp, Candida albicans
  unsure (1165): Identity of nucleotide sequences at the above locations are unknown.
ccaaaaaacaattcaagaacaatatcattattactaaatttatcacggaatttgttttgcaaatcaagtaagaacaatttccatcaatttactcatcagtttggttgtaataataaaaacagattatttttcttatcatcaccaccaagagtattccgttatttaaatccattatttgttcgttcatatagcataattcctatgagttcatcagacgaagaagacattgccttgtctagactcgctaaaaaatcatcctcgatcacttcagcttccacttatgaagacgatgaagatgatgatatccctttagctaaaaaatccaggaagaagagagttgaatctgattatgaagaagatgaagacgaagtcccattgaaacagagaaagttatccaatggtagagcaaaaaaacaagttaaaaccgaaactaaagttaaaaaggaacctaaaagtgccagtaaatccaaatctacatctaaaaaggacaccaaagttaagaaagagaaaactacagtcaagaaggaatctaaagccacaagcactaaagtgaaagaagaatccaaaactcaatcagattcacaagcatcggttaaatctgaaactcttgaagaagatcaagggtacaaatggtgggaagtgaatcaagaagaagaaggtgatggttatatcaaatggcaaacactagaacataacggtgttatgttcccaccaccatatgaaccattaccatctcatgtcaaattatattataataataaaccagttaatttacctccagaagcagaagaagttgccggattttatggagccatgttagaaactgatcatgctaaaaacccagttttccaaaagaattttttcaatgattttttggaagttttaaaagaatgtggtggttgtggtgttgaaattaaaaaatttgaggaattagattttaatagaatgtatgcacattttgaaaaattacgtgaagagaaaaaggccatgagtagagaagaaaagaaaagaatcccagaagaaaaagaaaaagaagaagaaccttataggacttgttatcttaatggtagaaaagaattagtggggaatttccgtattgaacctccaggtttattccgtggtcgtggtgcacatcctagaactgggaaattgaaacgtcgagtantgccggaacaagtgactttgaatttaggtaaagatgctaaaatacctgaaccaccagcaagtcatcaatggggagaaattagacttgattatgaagtctcttgggtggccatgtgggaaaaaaaaatttctggatcgttgacatatgttagatttgccaaaaattcatcagttaaaaagttcatcttgattttcaaaaaaatttga

SEQ ID NO: 5114 - DNA, 306 bp, Candida albicans
tgttttcaatattttgaggtttatcctcgtacgattcaaattttggaaactattgccaataaaattgccaatatgacgccggaacaaaaggcaactttcaaattacctcccggcttgggtcataactccagtacaatttacaaaaaaatcattagaaaaatctatgataaagaccgtgggtttgaagtcattgatgctttacacgagaaaccttcaattgctgttccaattgtgttgaaaagattaaagcaaaaagatgaagaatggaaacgtgctcaaagagaatggaataaagtatggagagaa

SEQ ID NO: 5115 - DNA, 564 bp, Candida albicans
tttccaaaatttgaatcgtacgaggataaacctcaaaatattgaaaacatcactttcaaaaaacatcatcttgagctttcgttatgtaaggcctatggtccttcatacagacaattgccaaaagcagaaacatacatgccttgttcaggtagagacgagatgtgttgggaagttttgaatgatgagtgggttggccatcctacgtgggcatcggaagattcaggattcattgcccatcgtaagaatcaatatgaggaaatattattcaagatcgaagaagaaagattagaattcgactattacatggaatccaatttgcgtacgattcaaattttggaaactattgccaatagaattgccaatatgacgccggaacaaaaggcaactttcaaattacctcccggcttgggtcataactccagtacaatttacaaaaaaatcattagaaaaatctatgataaagaccgtgggtttgaagtcattgatgctttacacgagaacccttcaattgctgttccaattgtgttgaaaagattacagcaaaaagatgatgaatggaaacgt

SEQ ID NO: 5116 - DNA, 1086 bp, Candida albicans
gacgaagtcactactgtcaaagtagagcaacaaaacaaaagattgcacccgttgactcctaaacctcaagaacaattaaattatgatttcaaggataatgaagttttatttgatatcttgaaattggcagaagttttcatcaacaaatcctccacttactcagtacatgacagagaaaagttgttacaatttttacaatttttcatgtctttgtttttcagtataccgacagaaaccattgaaacagcattggtggcaagaggcagaattgaaaagtcgtctgaagaagaaaacgaaaaaggtgacgttgagatgagtgaaaatggatcagattcttccaaaaagagatcaagagacacagatttacttaaagatgtcttgaagaaacaatccaaatctaaaaaggatgatcgttcaggatcaccaggcttgcaatctgctgagttagctattcaagaagccaatgaagagcttgaaaaatcgagtgaattatggatcacaactgccaataccaaatttctgttgaacgatgaaaacatacaaacgagacgggacaaatacaacttgttttgtaacacaactatttatgttttcttccgtcacttgcaaactttgtataccagattagccgaaatcaaatccatgaatgaaaaagttggcaaggaaattagaaatcgtaaatttcctaaatttgcaaaagatttgaatttgctcctgcaccaattggaagacatgggtgttgagattgtcggaaccaaagattgttataaacaagtgttagaattatcagaaaagttaattgaaggagagattgaacatcaatggtttgaagaaagtttacgtcaaggttacagaaacagagcctacaagatttatactattgataaagttgtacaagctatgataaagcatatgcattcgatgattactgatgctaaaacctccgaaataatggtattatttgagaatgatagattgaagcctgtttcaagtgccaaagaacaaattttgtatcgtatactggtaaggtcgtttatgtcacctgaagagaatatgtttaaaatatcgttccaaagaaagccatag

SEQ ID NO: 5117 - DNA, 738 bp, Candida albicans
ggtcgtttatgtcacctgaagagaatatgtttaaaatatcgttccaaagaaagccatagtagtgtcaatattcaatttatcactctacatgatttaaccattaatgaccatgacaatgttgaagagaattacaattattatgttaccagttatgtgatgtcacatcctacagaaggcgtaccagcttccaaattgaatatgccatttgcaagatcatttatcgagtcagtggatgaagagtcagtagaaggacgtactggatctggtcttaaagtatctgtcagtgaaaactcatacagtttgttttttgaaagtggttcgcatgatgaatttgtttccaaagctgtttataaaaagcaagactctaattctaaaagagaagataaattggctcatcttaaagatcttatagacggagaaaatggttggaagtctagtcttccagaagatcaaaaccttgaagtaactgaacaaaaagttgctattttatttgataaaggaggtgttgaatttaagaaatttgaggaggtgttgaattcatctgataaactgaaagaatcggaggctaatgaacctacaaagggagccacggagaatgttgaagtcattgaaaacaataatgactacaacacagaaccagacgcaaaatcagcaactactgaaaacaaacaagaagatactattgttgacgaaacaaatgatagtacaattcaacatgacgttgatgacactacagct

SEQ ID NO: 5118 - DNA, 945 bp, Candida albicans
caaacatttacttttaatattagtattgatacacctggagttattgatcgtgtttcgacactatttagaggacatccaaatttaatccaagggtttaacacttttttaccaccaggatataagattgaatgttcattggacccatcagatcctaatccgattcgtgtaacgacgcccactggtacaactacaagacctaacctttcaagtgctacatataaccaacgatggggtggtgaagaaagcctgaccattaatcaacaggaacagtcgtccccacagagtcaactggcccaacaggcgcaacagtttgctgaccaagcttccatggaagcacaaaatggtgctagtggacaagttgggttcaatcatgctatatcttatgttaacaaaattaaaactaggtttgctagtcaaccagacatttacaaacagtttcttgaaattttgcaaacgtatcaaagagaacaaaaacaaattgctgaagtttatgaacaagttactgtattatttgctaactcaccagatcttttggatgattttaaacagtttttgccagacaccagcaatctaaattaccaacagacaccagcacaggatggatattatgttaacaatggaacacagttgccgcctgttggcaatttccaacctgctggacaagccacaaatcaacaatatgcacaattacagcagacagctgctcaacaacaaaacaatttccaaggtgcagccagtcccgaatctgtttatggagctccatctaatgaacaagttgtgggaaagaaaaagtctgtttctgaaccctatcaagataattacaaccaagaaagtcagtactctaacatgaggactggtgcagtaccacaaagagggcaaaaggtatcaaataaagcacaagtccctatcttcaccacagcggggtcggaaggatccaacgcgaag

SEQ ID NO: 5119 - DNA, 585 bp, Candida albicans
tcaccatccgatcaatcaagacagacagcagaattgagaagaccttctaatgtggcattaaatccaccacaaacaactaattcaactcatctcccaccacccagttctttgggacatgttggcaatgaacaaggtgcatatcccccaaccatttcacaaccagctccacaagcatctcctgttattggaggggttcctaatcggtctactactacaaacgtgtacaggccattaaatgtcaaggacgcgttatcctatttagatcaggtcaaagtacaattcagcaaccaagctgaggtatataataactttcttgatattatgaaagatttcaaatcacaaaggtatgttgttgaactttctgggtgcgttttggttttgtcggccattgaaaattgtatggtcctgtatataagcggatccattgtgccgacaagccttgtgtgtttcgcaaacaacccacccgcacacagattttttcttttgttccattttactaacaaacatttacttttaatattagtattgatacacctggagttattgatcgtgtttcgacactatttagaggacatccaaatttaa

SEQ ID NO: 5120 - DNA, 771 bp, Candida albicans
ttatatattgggctctggccatcccgaggtgaagaaccagcaccaatttcgattttttcctatataaatcgtcttacaaaattcaataatttaaaatctagtggattaatcggcatgatatactatatcgacatactttcttatatgtatcctcatttccaattaaattcatggacaattcatcgatttttattagttgccaccatgatatcacaaaaagctatggaagattatttttataccaatgatcattatgcaaaagttggtggggtatctttagaagaattgaattgtttagaattggattttttgaaaagaatcgattggagaactataccgataaataatccaaatgttcaacaattgtataataataaattagtagaaatgacaggaaagatatctaatatggttgataataataatagcggtgatagcgacaacactgatactagatataaacatactaagtttattatggaaaatgaagatcctacagatgatgaagaagaggaagagggagatctggaagacctggaagaagatctagaggatgacgacgacgaggatgatgagttttatgatagtgatgaagatattaatagtgaagataatggtgatattgaaattgatgattacgaaatggaagaagaaaataattccaatgtacctgatttaccaaatataccaatgtataaatatgataataatgggtttagtatggatggaagttcttcacctcatttaaaaagaaggtatagtaaagattaa

SEQ ID NO: 5121 - DNA, 2676 bp, Candida albicans
aaatacttcaactgtatcataatggaggaattcattccattgaagttaatcaagactatatatttttattttcctggtgggacggacaataaaattggtgtttggaatttgaagaaattgatagatttatcaaagttagtactgacacacaattctccagaagttagaataaaattaaaatcactcgaacctaagcaatatattacttgtcataaaagtttagttaatgtggttagatttttcgaaggagacaacaaaaggttcatatctagtgatgttaatgggaatgttttttttcatactttacatgaacaacctgatacaaagcaattattccccttcaaaagtatagaaacatcagaagtaaatcctgtagtggacttgacaatttctgcagataacagattgatagcatggagtacaaataatgggaaagtatacttgtatgatgtggtgaaggacacatttcaagaattgacatcaatatgtcatgaaaaaccaattatacaaagaagtattgcctttgatccttcaaataattacttgataaccgtgggtgatgacactcaaataaatgtattccaatatctgtatgaaaaagatgatactagtactaccacttacaagttcagattaatttataaaatatccaaattgtttagtcaaaatccattgaatgtgagatataaaagaatatcctggtcacctgatgggaacttggtgtctatccccacggcatcgaaaaatcaaaccatgttaatatctttgatttcacgatcggaaaaatggactaatattgaaagtttagtagggcatgattttgcttgtgatgtggttaaattcaaccccaaaattttctcatcaaaagagaatgacaccagcaaagtccattcagttattgcatctggtggttcggatagaactatggctatttggaacacatcaaagtcaaccccaattaccgttttacaagatgctgttcaaggagaaatactcgatattacatggactactgatgggacatctttattattctgtacatcacaaggtaaattgtgcattgggaactttgaacccaatgaattgggatatacatttagtcaagagaccatggagagatttgtacaattgcaaaataatttgatagaaccaatgaattttaggtatccacacgaacagaccgtggggaatatgaagcaattaccaccaatcgaatttttaagtcaaaagaatgcaatatctacaacaacttcactgtcaaatacagttgaaaatgacaaaaagaatgcagaagacaatgttggtgtgtctaatcaaagcaaatcaactactactactactactaccactatcaagggtggagtcataactccagaagtaattccacctccaaaattgcaatcattagatgatgacattgacggtgatggtgatgatgaggaacacaaaagtggtggtatgctagattcagttatgaatgatcgtactcaatcaagcccacgaaaactaaataaaccaaaacccattgctcctgttgtatcagattcaactacacaatcactttcattcaataagcaaaaagtaactacaaaaaatgggaaaagacgtattcagccaatgttaatctctagtgggaattctgctccctccgatttacatagatcaaacagtgtgataaaacctgttgttaatactaccaaatccactatggaatttgaaaaaccatcttattctgtttcggaagagttttataaacaaaacaaaagacctagaactgaagaaactactggaagtaataataacaaaaaactcaagcgtgagatggaaccagtcaaatttattggatcagttatacttaatccaaatacatcattttccaaaattcgtttagcaactcctaaagtaagactttttttccaattgaaaagtaaaaccgatgatgatggggtgtttatacttgacattaaaaatggatcaggtaatgaatccaaaccatcaagattgacttatatgaaaaaggataaagaaatatggtgtgattttattcccaaatatattcaattagctaccgaaggttcgaatttttgggccgtcacaacagtggatggaacgattttgacatattcccatgtttctggtaaacgattattaccatcgattgtattggggtcaccaatatcatttcttgaaagttatgacaagtatttgatggtagttacttgtattggcgagttgtatgtttgggatatggagatcaaaaaaaatgtcctcaaatcttcgataagtccattattggaattgtataataaagaagggttagtaaaatccgacaatatcactttatgtgctgtaacatcatatggtataccattagtcacattatctaatggatcaggatatttatttaacaaagatttaggagtttggcaaacaatcacggaatcttggtggtgttttggttctcattattgggatagcacccaaaccggcaacagcagtggtggtggtggtggtggtggtggcagtggtggtagcaacaataaacgatcactacaaacaatgaatatgtttaatgatgaacaatcgattatagaacttttagaacataaaaccaatgaagaaatattaagaaagactaggactggtcgaggtaaatatttcaataagattcttcgc

SEQ ID NO: 5122 - DNA, 321 bp, Candida albicans
tggggcatattttgggaattccatcccagcaatgttttttccagaatttcccaattacagtgccaatacatgcaaaagaaaacatatgtgccaagagtatttggattcaaattacacgaatactccaaattaaatagatggagagaattacaaagattgaagttggaaaatagattgaaaaaaaatggtatacaaattgataaagtagttggaggattcataacaaatggtgacgaggaggagaaacaagataataataacaataaacaactacaaagtgtttcttcacaattcaagagtctctcgccaaatcaaaagtaa

SEQ ID NO: 5123 - DNA, 450 bp, Candida albicans
caaaagatggctaacgaggaatatgtgacagattcgagttccgatttcactgaatattggatagatttatttttaggtataaaaggtaatgaatatttttgtgatattgatgatgaatatattcgagaccgattcaatttgacggggttaaatctggaagtttccaaattgccaatattaatagatataataactgatgttatagatatagaactgcaacccgaagaacataaagatagtttggaacataatgctcgtatattatatggattgattcatgctagatatattttaactactcgtggattaaataaaatgtttgaaaaatttagaagtggtgattttggttattgtccaagagttcattgtcaattaaaccctttattaccaatcggattaaatgatcaaccaagaatggcatcagttaaattgtatttgtctaaaatgtga

SEQ ID NO: 5124 - DNA, 762 bp, Candida albicans
  unsure (702),(746): Identity of nucleotide sequences at the above locations are unknown.
gtgaaaacatttagatctccagcaaataagaatttttccaaattttcagaaaaattatataaagaaaatgaaaatgaagtgactttcaaatatgcaaagagtggactttctggaaaaatttttaaattgggaacgttcaatcccgaaggggtgtttaattttcccttgaatgaaggttatatgcccaatgtcaataatagtgactatttccaagctatttatcatttccctaaaaccaagacgggtaaatcaatgatattgaatggacatatagcaccattgcccgcattgacaactgcggataagaatgatcttctatatcaattggacaagttcaataatagaagaaatggtggaagatttaattctactctagataatagtgattatatcaacaagggtcctgctggtaaagaattatacaagacttattctatgagaagaggtgggtatagatcatatttacagtacttaactaacggacatcatcctgatcatcaactgcaaaatagtcagtatttgtcgtatggtcaacaaaagccatatggcggacaagggtcatataatcaacagggttattataatcaacaaggtcgttataatcaacaggggaataactacaatcaacaaggtcgttatagtcaacaaagtcaatataatcaatatggatccaacacccaaagattcaacaacaaccaaaantacaatcaatcatcaaacaattcaagatctggttatcttcttcntagaccacaacgttag

SEQ ID NO: 5125 - DNA, 549 bp, Candida albicans
cccacttgggctaatagtgatgctgcagccgaattgaaaaaattgatcgattccaaaaagactcaagtcactgttgttcaagatcaaatagctaccgattcttctgctaattcagaaacaactacttcagaatcagaattggaagaaattcaaagcgacaactctctcaaaagaaaattggaacctgaagaagacaaacagacacaaagtgatgatattaaattatgggaaccaggatacaataaacgttattatgaagccaaatttcactatcaatctgatgaagaaatcgaacaaacaaaaagagatgttgtaagacattatgttgaagggattgcatgggtagcattatattattatcaaggatgtccatcttggaactggtatttcccctatcattatgctccttttgcagcagattttactaacctagaggagttattcccagaaggtgtaaagtttaaattaggtgaaccatttagaccatttgaacaattgatgtctgttttaccagctgcttctggacataccttacctcaagttttccgt

SEQ ID NO: 5126 - DNA, 513 bp, Candida albicans
acaaccaatttgaatgtgattactgatattctaccaaggagctcacctatacaccagacacaatctgctccagtatattccaaactatccaattcattacatagtacacctacgaagcaatctaccatatccccatcattagatcgaccgatgccaatggaccacccaattcaggaagacgaacttggtgatagcacaacagaagtggactcagaagaatcaaatcaaaacaacagtagaaacaaaaaccatcaacaattcgagagcattgcacataacatcaatgaaaccatttcggaattgaatattatatatcaagaaattggatactcgctactagagacgaataacaaaaagtcgaaaatctttaacacaatccaggatacaatcaaaaactttgccaataatttgaatcgggaaaaatcaaatattgagaatgaatgtgaatggttaagacaacagatacgaataatactatcaatgataaatgatccacggggagacaaatcattg

SEQ ID NO: 5127 - DNA, 1869 bp, Candida albicans
catagatatgtaattgacgagtttgaacggatcattcaagcattgaacttctcagatagcaatcaaataccaactgatcatagaaaagaaaagtttactgcatttgtattagcgagtccagttaagaagaatcaagaaagtagtgaatctggtaatgatgggtttgtcaagctacgtgatattaattaccagttggttagaataatcagagggttgagattcaccaagatcactaatgaactcatctcaaatatcaaatatgaaattgagcaatgtcaagcagaaatagaaacccgaaagtccactgttattggaattattgaaaaatgtattcagcttataaatgttctacaattgaatgatgatcagattttacaattacaaaaagaacacaacccacatattgaggcattgttagatatggaaacattgaacttgattctacaagaacctcaacagcttggtttgaatgattcacatattgaatttttgattagtttccaaaacatgttgcaagaaacaattgacactaagcaggctcaatgggaccaatattcagctacatgtaaatccttatgggaaaaactaggtgaaagtgacgaatacatcaccaactttttatctaaaaataactcgttgacagatctttctttattaaatttcaaaatggaacttaatcgattatatatcaaacggtcagaatacatcgagagtgttatatcagatgctcgaacagaaattgaaaaaatgtgggacaagatgtattattctcaagatatgaggatggattttgaatttttcaattattcaggcgaaaatgacgatattgacaaggaagtggttttgagtaaacatgaagaagaattggagaatctaaagcaagaatatgcacaaaagaaaaaccttttccaaatgtatgaggaacttcaagaattattgaaagatcaacaatttcttattgaatcttccaaagattcttcaaggttattaagcaaaaattcatgtaagattctccttaatgaggaaaaaattaggaagagaatcaacaaaactttacccaaacttatagacaatttgaaaaaggaaacaagtcagtacaataatgatgctatccaaatgggtaaacgtactttatttatcaatggagaagattttttcgaaaaaatattattcattgaatcagaacaatttaaaatatcaggtggaagaagtaaatcctcatcacgggttagttcaagacaagtatctcaatcgaaaacagtggcaccgacaaggcaaccatcaaggggttcacatcaacataaatcaccaatcaaagtaatgtcacgacctgcaagcagatcaatcattaataagaatccttcccctgtatcaagaacaactctgagatggaataaggaaaggacattcaataacccaaccacaataaaattgagtaatgcgatcaacagtagattagaaaataaccataatcgtcatcaacaactacatttacaccatcaaaacacttccattttaagtgaagaaagccccgtgcgtgcttcccgtgataattcggtattgggtaaaccaccagcaacaattcagccattgatatctccattgaaaccattaaatgtacatactgttgggaatacaaacttaaatggaactcccctttcaagaacaaaacccgaatccactaatgtttcttatgggaaagaaaattgttcaccgtttgagttatccccagtgaaaatcagacctggttttttcgatcatgatgggtcaagaagggttagtggaatttcaaacgatacatcaacagtaattggagaagattatcttagttggagagacgaaaaaataaaacaactcagagatatatga

SEQ ID NO: 5128 - DNA, 1002 bp, Candida albicans
ttattattagtaatgattagctcaaaatcaagaccatactcaatagccagagtctatgctgacgtgaatgaaaataaacctactgaatattgggattatgagaatcataaaatacaatgggggcttataaagaactatgagattgtcagtaaaataggaagaggtaaatattcagaagttttccaaggtgtcaatgttttaaatgatgaaccatgtgtcatcaaagtattaaaaccagttaaattaaagaaaatatatcgtgaagtcaaaatattacaaaatttaactggaggaccaaatattattggattattggatgttgttagagatgaacaatcgaaaattcctgcatttatatttgaaagagttaacaatgttgattttagagttttgtatcctaaattcaccattaaagatatccaatattatttcacacaacttttgattgcattggattattcacattcgatgggtattattcatagagatgtcaaaccacaaaatattatgattgatccaatgaacaaaaaattacgtttgattgattgggggcttgcagagttttatcatgctgggatggactataatgttagagttgcctccagatatcataagggaccagagttgttaattaatttacaacaatatgattattcacttgatttatggtcagtagggtgtatgttgggtgccataatattcaaaaaggaaccattatttagaggtgattcaaataatgaccaattggtacagattgcaaaagttttaggaacagaaaatttaatgaaatatgtcaacaaatacgggataaaattaagttcagaatatgatgatattttgggtaattatccaagaaaaccatggaaagctttcatcaataatgataacagacatttgattagtgatgaagtacttgatttaatagacagattgttaacatatgatcatcaattgagaccaacagctaaagaggcaatggaacatccatttttcaagatatag

SEQ ID NO: 5129 - DNA, 1974 bp, Candida albicans
atgatccccaaattgtccattagtggtggagtaggaggaaacattagtgggaatggaataaaatctaaaggtaattcaatcgatttcacaaattggaatgagggaaataacaatactggctataataatagtatcacggaattacttcagaatatgatatcgaatggatcgattgatcttaattcgttttctaatatgagtaatcaacaaagaagagattctattttgaaaattataaacgatcaaaattcattgaggagtcaaagaagttcatcagatcaatcaagaaatactaatgctagtttacgagaagatatatttgatagaaggaatccattacaatcacagcaacaacaacaacaatcacttgaaaaaactccacaacaatctgcatcttcattatcgaaacaaaaactgtcgccaagacaaagaaaatcacctcaacaacagcaacagcaacaaagacaacaattatctaatttacaacaaaatcaaagaggacaagtaaatacgttgggagttcctggagacaaagataatgtttcgcctacatcatcatctcatacttcaccaaagtttcaagaggatccacaatcaccaaaggcatcacctgttgcatatggaaatatacatgtgaatgaaccgtttgcttctggtggataccaacaagtttctcaaatgcaacaacaacaacaacgtcaacatcaacaacagcagaatagacagcaacaacaacaacaaccacaacagccacaaagattatttcaaaattattcagtgtcgccacaaaaccaataccaatattctgcttatcctaattataatcaattagggtattccaatgttcaacagtcacttgcaaatgctcgaaataatagttttagtaactatatttatccagtccagacccaacaacagcaacagcaacagcaacaacaacaattttatccaccaccatcacaacagcaacaacaatatataccaccagcagcaactaccaccaaactaccaggttatatgcctcaacaacaacaaccaccaccaccatcacagcaacaactgttaaaatctacagatcaaaagaaaaggaaaccatcggttagacgaacaagaaggacgaaaaaagatcaaaattcaaattcaactccgacaacaaatatgatgacgacgcaaaatttgagttcaccagaaagtcgaaatttagttcctgctcaacaatttgctcaatcagaagatggacgtccattattaggagcaacaaagattgatcaattgatgttagtgattcaagctagagataaaggaataaccaatcctattgaacaaggacctgatggaagtattttagcttcaccagataatttttcattaggtagaagtaaagccgaattagatagtggtatattaccacgaccggttagtcttgttggaggagttgataaaccacataaacgagatgaagatgaaattgaagatagtgatgataatggtgatgggactaatcaaaaccaacatcatcaacatcagcataaaagacggaaacataagaatcaacaatgtccttattgttttaaatttttcactcaatcgacccatttggaagttcatataagatctcatattggatataaaccatttgaatgtacttattgtcataagaaattcactcaaggaggtaatttacgtactcatttacgattacatactggagagaaaccatttacttgtgaaatatgtaaacgatcattcaatagaaaaggtaatcttgatgctcataaattaactcatgataatttgaaaccatttgaatgtaaattagataattgtgataaatcatttactcaattggggaatttaaaatctcatcgaaatcgtttccatttagataaattgaatgaattaaatcatagattagctgaattgagtggaccagctttaaataatttaccaaatgaagaaaaagaattattataa

SEQ ID NO: 5130 - DNA, 2097 bp, Candida albicans
ttcttttgtatttcatccatgattcatttggtactgtcttcacttgtaacgacaacgaatgctactccaacttcaagaagtccacataccaatcatagcaccccctacaatcaaaactctatcacttcaaatagaagctccccagttcctaagaattcagtcaactcaagaattataccacaaacaatgaatccacctatagatatgaagtcgaacaacatattaaatccagaaaaagacgcagatacttctagaggagaccatctggaatcaaaagcttctagtattagtagcgccagcggaacaactaccacaaacaataacaacgttagtaataacaattcaacggggaaaactcaaattgtttttatccacaaattatatgacatgttgcatgacgagtcgatatcccatcttatatggtggtctccaagtttggattcattttatgtaacgccaggagaagagttttctcgagtgttgtcccaatatttcaagcacacgaatattgcatcatttataagacaattaaacatgtatggattccataaagtaaatgagccatttttaaaccaagacgatcaacaacaacaacaacaattacaatcaaatagatgggaatttagacactctaccaaccaatttagaaaaggcgacactgaatcgttaaagaatataaaacgaagaagctccaagacattgaatgcacaaaaggaagttgtcaatataaaatctttaccaccgacttctcatccaatggaatactacactggctactcttatcaaaatgaagatagtgctcattattttgttcaccatcacagtataaccaccatgcaatcacctgctgacatgagacctcgttctccatctactcctataccaatgcaaccattagcacaacagcaacagcaacagcaacagcagcagcagcagcagcagcagcagcagcagcaactcccttcccagcctgtacctaatggcccacctgtttttagcggaccaattccaccaggtgccgtgaatcaatctccacaggagtatcttacgagaccatcaattttaaacaacgtccaaggatcttttgaaaatgctacaaattttaagtttgttgaattgactaatcaaataaactcattgcgaaatgacttttttacaatgaataatcgatatgagatacttcaaaatgagctaaagtaccaaacagcagattctatggcagttttggaaattcttgagaaattgtctaatgacaacagaattgcaactgatatacgagatttgaaaaatgtggtaagccaaagaatgcaaagattaaataatcagtttattcctcaacaatcaaactttgcaccacatataccaggacagcaacaacaacaacagcatggtaactctgtttcttcaaactatcatcttgagtcaactaatgtttccaggaatccgtctacaaccaacctcaacgttgctcctcaaccataccctttgaaccctcactatacaatttatgcaaacaatcgtgcgctgggaagttcagaaattaataatggtgtcttccgtgcacgtgaagacagtaataattcaaagagaaacttgtctgtatatgacccattgcaaccagtaccatctagaaatagctcgagaatcttaattgaagaatcaacaccaactcacccacctacaaattttaaccctcaacaactgcagtcacaactgcaagttcaattgggcccagcaatgccaccccaaggtttccgcaatcgagccgaatcaacttactctccattgagtcacctgagtaataaatcgcaaattttaaataaagccccgacaccagtaaatcattcaccacttgttcaacagcaacaaaaggaggccaagcaagaactaaatgacagttctgttgcaccaccatctcaatcatcccttccagtaacaagaccactttctcgacaacaacaacaacaacagcaaacgttacatcatccatcaactacctcatctagaactaactcaattactaatcccgttgcagaacacccagcccctcaatcgtcatactttatgcaacgttattcattcaattactgtttatga

SEQ ID NO: 5131 - DNA, 1086 bp, Candida albicans
tctacctattcagttttgatttccgataccaaccaaaaagaagagaagttatttcaacatcctcttaaactgtctaacattacatgcacatatacttatattgcaacaatgagtaagaaaaatcctggtgatcctcgtgtgaaaaagaacgcatttgttcataaactatatactatgttgcatgatccagcgttgagtcatttgatttggtggaccaacaggaatggagaacaaaacacgtttgctttatgtccaggaaaagaatttgccgattgtctaacacagtattttaaacacggcaatgttgctagttttgttcgacaacttcacatgtatgggttccataaagtgagtgatcctttgcccattacatatcctccaaatggtaataacaacaacaacaacaacaaagaagtgccaccggtttgggaatttaaacatctgagtggaagattcaaacgtggagatgaaacctcattggtatacatcaagagaagatcaagctctaaccatacttcgggaagtacaatctatgccgaacctatttataatccgttattaactaatccctataatcaaccacaattcatgtatcaggattattctatgggacctccagttgaagttcaacaattctacaattaccaaaatcaaccactcatgtattatcaacaaccaccagggcaagtaccaccaccgccaccgccatcactacctccacaccaacaaccagaaatggctctccaatatcaccagtataacaactatcaacaaccgccgccagcaccaccagcaccaccaccacagcccgggaatgtgttatttggttatcaacaagtagccccacctcaacaacctgggtctactgtccaacaaatacccgctaacgcgccaccaaccttagatcaaactcagccgttactgtataccccctcaattagagtaccaacaacagcagtatcctcaaccaacattaccaccaccaccaccacaactactactaacaaacatcaacctggaaatcccaaaaatttaatgacaatttaccaagaacaacccccaaatggaacaacatttacaatttag

SEQ ID NO: 5132 - DNA, 522 bp, Candida albicans
ggacgcggatttccacccgtggtgaagactactgccagtaattcgggattacctgatggtcagttatcttataacaccactgatagtctaggaatagaaataccatcgatactgcgagagaaagccaatggtacagaagaaaccgataaaaatggtgatggtaatggtgatgataatcatggattaattgttccaaaaattgaacaagctgatggtccaatttttttcgacaataaacaattcaaatccaataaaaaattgagtcaagttgatggtgaatcggaatttgatgaatttgaatccgatggtgatttatctgatgatattaattctgaacttgattctgattctgataaagaagaagaagatgatgatgaggaagaaaccaattttgctctttgtctttttgataaagtacaaagaattaaaaataaatggaagagtacattagttgctgggattgccaatattaatgggaaagattatgtttttcataaagctaatggtgaatcagaatggtaa

SEQ ID NO: 5133 - DNA, 894 bp, Candida albicans
attataaaaacaaaaaaaacattaagcaactatagatttaagtcaataataataacaataataatcatgtccaatactgaaacaagtaaattatatgaaagtgtcattgaagatgtcataaatgattcaagacaagattttgaaaataatggtattgctaaaactacattacaagagttgagaagaatatggtgtgagaaattgacacattccggagttgcaaaattctcatgggatgaagaagaagaggaagaagaaccagttgaacaagtagatgtagatgttgaagttggacaatcagcacaacaagcagcagaacaaccacaagctgcaattaatgacactggagcaactgaaagtaatacatctgctacaactgaaactactgtcaaaaaagaagctactgccagtaattcgggattacctgatgctcagttatcttataacaccactgatagtctaggaatagaaataccatcgatactgcgagagaaagccaatggtacagaaggaaccgataaaaatggtgatggtgatggcggtgataatcatggattaattgttccaaaaattgaacaagctgatggtccaatttttttcgacaataaacaattcaaatccaataaaaaattgagtcaagttgatggtgaatcagaatttgatgaatttgaatccgatggtgatttatctgatgatattaattccgaacttgattctgattctgataaagaagaagaagatgatgatgaggaagaaaccaattttgctctttgtctttttgataaagtacaaagaattaaaaataaatggaagagtacattagttgctgggattgctaatattaatgggaaagattatgttttccataaagctaatggtgaatcagaatggtaa

SEQ ID NO: 5134 - DNA, 222 bp, Candida albicans
ataatgattattccaatacgttgtttctcatgtggtaaagtggtaggtgataagtggcaaacttatttggattatttacaagatgaaaccctcagtgaaggtgatgctttggacaaattgaaattgaaaagatattgctgtagaagaatggtgttgacacatgttgatttaattgaaaagtttttgagatacaatccattagagaagaaagatattaattaa

SEQ ID NO: 5135 - DNA, 1956 bp, Candida albicans
ctaggacaaataaagaaacgtaaggcacaaagtgcaacttcactgaatccgactaaaaaagccaaacttgcagctccccaagcagaaagagaagttattgtcttggatgatgaggatgacgacgatgatgatgtgcaagtaatttctaaacctgcaaagaaggaaacagatagaagacccacaaaaagaaaagcatccgcaatcaatgatgaagatgacgatgatgatgatgatgacacgcgtaacaagctgcatgtccaaagatcaccaaagaaagagacagcgtcttcggtaccgaaagcgtcaccgaaaaagaagacttcttcaacattaaaatccactgcagctaccaaaaaatccaaagtgccagcaggtggtgactcgactgctgacacagctcaagagattttagcaactatccctgatgcagaattaccagaagttgaccctacgaaaaaggttaacttctttgctctaaatgcagcacgtaacgagacaacacaaacttcagtagagcttccagaggcacaaccaaattgtttgacagggttaacaattgttttcactggtcaaatgcctaatttagatcgtggtactgcagagcaaaccgcaaaacagtacggtgctaaagtaaccaaatcaattctgggtaaaacaagtttagttgtacttggagcagatgctggtccttcaaaagttcagaaaatcaagcaacacaaaatcaaagcaattgatgaggcgggatttattaaattgttggaactgatgcctgctgatggaggatcgggtgcagcagcagaagcagccaaattgaaacgtgaacaagaagaagctaagatcattgaacaagcaaaggaggaagagagaaaagaaagagaggctgaaaaagctagagtcgcagaaagagtcaaagcgacagtcaaccccaaaggtgaaacatttggtttccagaagaaagaagttgcccctcaagataaattgtggacagatagacatgctccaaccgatctcaaccaattgtgtggtaataaaggacaaatccaaaagttgaaaagttggttggaaaattggtttgacaatcaggcaagggggttcaagggaaatgcatcggatccagattctttccgagcagttttgatcagtggaccaccagggattggtaagacctctgctgcacatttagttgccaaaagtcttgggtttgacattattgaaagaaacgcgtcagatgttcgttccaaatctttgttaaacgccaatgttaaatcgattttaaacaacacatcagttgttggatactttaaacatcgtggtgatactgagaaaaattcaaacaacaaaagattctgtataattatggatgaagttgacggtatgtcgagtggggatcatggtggagcaggggcattatctcaattctgtaagattacaagcatgccaatgatcttgatttgtaacgacaagtccttgcctaaaatgagaacatttgatagaactacttatgatttgccattcagaagaccaagtgagaacgaggtcaagagcagattaatgactattgcatttagagaaaaagtcaagttggatccaagtgttattggacaattggtacaggcaacttcgaatgatattagacaaatgatcaatttgttatcaactgtttctaaaacacaaaagcaaattggtgcaaactcaatgaaagaagttaaagaaagttggcagaagcaggttgtattgaaaccttttgatattgctggcagattattgaatctgggtatatggtcagatccaagactgtcgttaaatgacaaattaaatttgtattttaatgattttgatttttctccgttaatgattcaagaaaactatttgataactaatccaagattacctggtaaacaaattgaacttcctgctaaggcaggttttcaccaggcgctggacggtccacgtcgg

SEQ ID NO: 5136 - DNA, 183 bp, Candida albicans
atatccagagatctagttgaaaagttgagtgatgaggaacttcaagccatgattgatgaatttgatctagatgaggatggagaaagtatgtattacatttataaagccaacctgtttaggattttagtgctagccatgtttgagtggaaaattactaactttatattattttttagtcaatga

SEQ ID NO: 5137 - DNA, 1044 bp, Candida albicans
  unsure (33): Identity of nucleotide sequences at the above locations are unknown.
cctatcctgcgtaccggcaggtcggcagttaanacatttgggtcattagtaaaagttagaaaagaagaaccattaatcacctttggcaggttggcagaattttgtataaatatattgaatgatgtcataaatcataagttcccaaatcagggagttttgagtggcccctttttggaagaagtcgatacggaggtttacaccgattatttggactatgttaccaaaccaatgtctttcaacacgattttatcgaatttggagaagaaaaaactattgagtcctaaatttccattattagacaacttgaaaaagtttcatgacaccactacattgattttctccaacgcaaaggcttacaacaatgaggattcacaaatttatcaagatgcggttattttggaagagtattttaatgaacaatataacaaattaaaatccagaatcgaactggaagcagataaattgcatccatcgacaccaaaactaaaacttaaccttggtagaattggtccctctgtagcagaacctcaattgaagaaaaagagaaagagatccatcaagcaagaattcccagaagaacaaattcacgaagaagaagaagacatcgacataactcaatcagagcccaccaatgcggatacacaagatattgatgagccagctgattctaaagagctcgacacatctaaatcacgggaagtcgttactgagcgaaacgcccctaataccatgggtaagactttgccgttactccctgaacagaattcaataattcaagaatcagtgatattttcatcaccggctgtgtcaactaatattaccaagtttgtccaacaaaaatcatcacaaccagcaacaattttgtctagggaccaagaaatcaaaaaatcattatttccaactcaacctggaaacccaattgctacccttttttcctataaagttccagcaaatgggtacactgaccaagcccataccatcgctttaccaaacggagccgtgccctttgtattttcaccacgcgtggccgatccgcacttgcaa

SEQ ID NO: 5138 - DNA, 861 bp, Candida albicans
  unsure (37): Identity of nucleotide sequences at the above locations are unknown.
atgatttgtaaatggaaacccaccgagaagaaccagnaagggaagaaggtttggaaaccccgagttgaaaggtttgaagaagaagaagttcaaacggattcgaatttaattttggttaagcgtcaatttcctgaagatgcagatgactttataccaccaaagagacagaaatctgctacaccaggtggcactactacttcgggtagaggcagaggtaggggccgtggtagaggtcgtggacgtggaagaggcagaggcagaggatctttgttgtctcgttatacaccttctgtagaccccttaactgcagacgagagatctactttacaaaatcaaattgaaaacatattggggttgatcattaattataagaatgaacatgatagagtattgagtgaattgtttttggtgaagccacccaagagattttaccctgattactatgttttgataaagcatccaattgcacttgacgtgattaaaaagagaacagcgtcaaaatcttacagcaagattagggaatttttggaggatattcatttgatgttcaccaacgccaagatatataatgaagaaggttcaattgtttatcaagatgcagcattcttggaaagattatcaatggacaaattcaaagaattatcagccaatctttcagaagacgaaatcaataagattttggatttcgctgagtttgacgaaatgtttagtttaaaaccattagttccttcaactgctatcaaacatccaattgaagcaaaattagagaaaatagataaaggtgaagcaattgacagtccattactcaatgcttctaccactgctggaacagaagagtctacaccagcaaattttgattga

SEQ ID NO: 5139 - DNA, 2940 bp, Candida albicans
  unsure (2901): Identity of nucleotide sequences at the above locations are unknown.
gtctattactttcttataatgaatcgtcaacctacaagagaggatattcaaagagcgattcaacgctggcatcaaatgaaacaacaatatggagaccaagttcaacttaatcctgaatttgttaaattaaccaagttcttgaatactttgaaaatgcaacaacaacgttttcagcaacaataccaacaacaacaacaacaacaacaacaacaacaacagcagcagcagcagcagcagcagcaacaacaacaacaacaacaacagcaacaacaaagtctaaaccattcacaacaatcgccattgctacaaaatgcacagggccaaactccacaacaacctccaactcctcaacagttttctaatttcaatcaaaacggttataatggtcaacagttttcttctcaagtacactcacctgctattggtgggtctttatcgacttcaggacatggaaccccattagttacaaatgccaatttgatgacaggaaagaaaaatacaaggacaccaaatgcccaatttggtaaccagacggctgctggaacaccattacaacaacaacaacaacagcctttccctcatggaaacaattcgaatcctatgctaaaccagacggctcagcaaccaccacaatctcaacaacgtcaacaaaaccaaccaccaagtccccaatcagcattcactaatcaacaattccaattattgaaatctcagcttcaagcattcaagtattttgtgagagctcctagtcagggtcaaggtcaaataccacaaaacttgatagcatatgtttcgaatccatcatctgctatggccaatgatatgtacttaccagcagtgaaccggcctcaaactaatggtatggatcgtacaatgcaaatgccacaatcaataccttcacaaccacaacaatatgcccttcaacaacaaaacgatttgctgaacctgaatccaaagtcaactggaggcacccctgaaatcccagaaaagaaaaaaggaaagcgtggacctaaaccaaagaatccgaaaaaacctacaaagaaacagttgagagaagaagaacagagacttgcattggaaaaacaaagacaagaacttgaacaaaatagactcaagagtagtgctcctcaagcattcccgcctcaagcaggtttacaaggacaagctcctttcccaccacaaccaccacagcagtcacaacaacatgtacctcaaccacctccagcatcaacttcatctagtccacccggtgggttgccacagctgcaaccgcaaccgcaacagcaacagcaacagccatctcgtccaattactaagcctgccacacctcaacctttattccctgatccatctcctccagtgaatataaagagtgtagtacccgacaaagcaaacaacaagaaggtaataataccggtaactaaaccaaatattgaagtagacacctttgagttatttgacattatcagtgatgaggtgaaagatataccgtttaatactttatatgctccacagagtagatttcagatcccttcgtttttgcctgatggtataaatatggaagatatttatgtgaacagagaaggatatatgcaaattacaatagaacaagagaaggagagattaagaaaacaaattgacagtttgaatgaaaaagacactgaaaagaaattggaacttgaaacacaattaagtcaattggaattgattccttatcagaaagatttacgtggtaaagttcttatacaatcttggtttgggaaatcattacttcctaattcacatccaaactttttagcaagattcagttcattatctatggacagcgttcatatgacaacagatttataccgactccaattggaatccatgatgagagaacaaaataagaaacatggcaaaactattgaagaaatcataaatttcagtgatcgaagtagcatcaaagccgtcaagaaatcagaccggttgtcaaggtttatgactaaaattaataatttccataatcaaactgccaaggaagaacagaaaaagttggaaaaaatggctaaacaacgtttgcaagcattgaaactgaatgatgaagaagcttatttgaaattgttggatcatacaaaggatacaagaattacccatttattagaacaaacaaatcaatttttggactctttggctcttgcagtgcaaagtcaacaaaaagaggctcaggacaatttagcatattcaggtcgtgccatagaaccagcatcagttgcaccccttgatgatgagaagagagaaaaaattgattattataatgttgctcatagaattaaagaagaagtcaccaagcaaccttcaatattggttgggggtactttgaaggagtatcaattgaaaggtttacaatggatggtttcattgtttaataatcatttgaacggtatcttggcagatgagatgggtttgggtaaaacaattcaaactatttcattactcacatatcttgtggaagtgaaaaaaattcctggtccatttttagtaattgttcccttatcaacagtaaccaattggaatttagaatttgaaaaatgggctccctcaattaaaaaaattacctataaaggtactccaaatcaacgtaaagtgatgcaacacgatatcagaaccgggaatttccaattagtattgacgacatttgaatatgttattaaagataaaggattattgggtagaatcaaatgggtccatatgattattgatgaaggtcatcgtatgaagaatgctaattcgaaattatctgagacattgacacaaaattaccatagtgattatcgtttgattttgactggtactccattgcaaaataacttaccagaattatgggctttgttaaattttgttttacccaacagtcctatnctgtggttatcgacagacggcaggataactcattgttgg

SEQ ID NO: 5140 - DNA, 588 bp, Candida albicans
ttatgggccttgttaaattttgttttacccaaaattttcaactctgtgaaatcatttgatgaatggttcaatacaccatttgccaatactggtggtcaagataagatagaattgacagaagaagaaacattgttggtgattagaagattgcataaagttttaagaccgttccttttaagaagattaaagaaagatgttgaaaaagatttaccaaacaaggtggaaaaagttgtcaaatgtaaatcatcggcattgcaatctaaattatatcaacaaatgttgaggtataatatgttgtatgctggagatcctgccaatggatcagtgcccgttgctataaaaaacgccaacaatcaaataatgcaattgaaaaaaatttgtaatcacccttttgtttatgaagaagttgagaatttgattaatcctaatattgaaaccaacgatcagatttggagagtagctggtaaatttgaattattagacaaattcttacctaaattcaaagctactggtcataaagttttgattttcttccaaatgactcaaattatgaatattcgccacgccgtggaagatccgaagggcggg

SEQ ID NO: 5141 - DNA, 678 bp, Candida albicans
cgtgctggtgggttaggtcttaatttacaaactgccgatacagtcattatttttgatactgattggaatcctcatcaagatttacaagctcaagatagagcccatcgtattggtcaaaagaatgaagttagaatattaagattgattacggaaaactcggtggaagaaatgattttggaaagagctcataaaaagttggagattgatggtaaagtgattcaagccggtaaattcgataacaaatccactgctgaagaacaagaagctatgttaagagcattaatagaaaaagaagatgaacgtagacagaaaggtggtaccgacgaagaagaagaagatttggatgatgatgaattgaatcaaattattgccagaaatgaaaacgagttggtggtgtttaggaaaatggatgaagaaagataccttgctaccaagaatgctccatacccatccagattgtataccgaggaagagttgcctgaaatttataagatagatccagaagaacttttcaagaaagaagacgttgcgctggaggagtatggtcgtggtgctagagaaaggaaaatattacaatatgatgataatttaactgaagagcaatggttgaagaaaattgaaggtatggtatctgacgacgatgtcttcaccacggggctgcaaggacccgcgctgcat

SEQ ID NO: 5142 - DNA, 807 bp, Candida albicans
ccatatatcacgagatacaaaggcaagatgtctataattttcagaaagagactagattctgatagaaatatagacgcatcactatattttggaaatatagatccacaagttacggagttgttaatgtatgagttgttcatccaatttggtcccgtcaaatcaatcaatatgccaaaggatcgtatattgaaaacacaccaggggtatggatttgtcgaatttaaaaactcagcagatgccaaatatactatggaaatactacgaggaataagactttatggaaaagcattgaaattgaaacgaattgatgccaagtctcagtcatcaacaaacaacccaaataatcaaacaataggaacatttgtacaatcagatttgatcaatccaaattacatagatgttggagctaaactatttatcaacaatcttaatccattggtcgatgaatcctttttaatggatacgtttagtaagtttggaacccttataagaaacccaataattagacgtgattcagagggacactctttgggatacggatttcttacgtacgatgactttgaaagtagtgatttatgcatacaaaaaatgaacaacacgattttgatgaataacaaaattgctatcagttatgcattcaaggatctaagtgttgatgggaagaaatcccggcatggagatcaagtggagcggaaattggctgaaagtgccaaaaagaataatttgttggtaacgaaaacttctaaggcaggtacgacgaagggaaataaaaggaagaataaaccacataaagtgaccaaaccatga

SEQ ID NO: 5143 - DNA, 1767 bp, Candida albicans
gctcctcagatattgagaattccatcacgaccatatcaacaacaaacacgacaaaatcttctccggcaatctgacttgccattacactaccctatttcaggcaacacttctggacccaatgcttctaatattactggtagtattgctagtacgattagtggtagtagaaaaagtagtatatcagttgatatatcacgtccaccactgttaccagttttcccaatttcaggacctacattacctactttattacctgaaccactaccaagaaatgattttgatttcgctcctaaatatttccctgcacctggtgggaaatcacatatggcatttggagccacaactgtttatgatgctgatgaatccatggtaatgaatgtaaatcaaattgaagaaagatggggtactggtatcaagttggccaaattgagaaatgttcataatattcaaaatagatcttcttcttcttcttccaccttaattaaagtgaataaaagaactatagaagaagttattaaaatgattacaaattcaaaagctacaaaatattttgcgttagcattcaaatattttgatcgaccaattttatgttatttgattcctagagggaaagtcatcaaattatatgaagaaatatgtgcccacaagaaggatttagcaacagttgaagatattttagggttataccccacgaatcaatttatatcaattgaattaattgctgctttgatagcttctggggctttatatgatgataatattgattgtgttcgagaatatttgacattactgaaaacggaaatgtttataaacaattccggatgtcttgtattcaatgaaagttcttatcgtaaattacaagcgatgttagtatgtgcccttttagaattaggattaggggaattaactactgcatgggaattatctggaattgccctccgaatgggaatagatttgggatttgatagttttatttatgatgattctgataaagaaattgataatttgagaaatttagtattttgggggagttatataattgataaatatgctggattaatatttggtcgtattacaatgttatatgtcgataatagtgttcctttgatatttctcccaaatagacagggtaaattaccttgtttagcccaattaattattgatactcaaccaatgataagttctatttatgaaactatacctgaaactaaaaatgatcctgagatgtcgaaaaaaattttcttagaaagatataatttgttacaaggatataataaaagtttaggagcatggaaaagagggttatctagagagtatttttggaataaatctattttaatcaacacaataactgatgaatcagttgatcatctgttaaagattgcttattatttgatatttttaattatgaataaaccatttttaaaattacctattggttctgatatcgatactttcattgaaatagttgatgaaatggaaatcattatgagatatatccccgatgataaacatttattgaatttagtggtatattatgcattagtattaatgatacaatcattggtggcacaagtatcatatactaatgcaaataattatactcaaaattcaaaatttatgaatcaattgttatttttcattgatagaatgggtgaagttttaagagttgatatatggttgatttgtaagaaagttcatagtaattttcaacagaaagttgaatatttggaaaaattgatgcttgatcttactgaccagatggga

SEQ ID NO: 5144 - DNA, 1383 bp, Candida albicans
atgtcaatcaattcatcaacttctactactaataaacggaaaagaaaaaacccatctacaacaaccccacctcctcctacaactccacatccagcaccaccacgtacggaaaagagaatatcatgtcagagatgtcgaacacggaaaatcaaatgtaattatgaattaccatgtttcaattgtaaacgagatggatctcaatgcattcaacctatcgatatgagatcaaaacgtcttaaagctacagaagttataacattacaaaagaaattggatttaatgattaaatttatcaatgattgtaaaaaattacgtaatgcagaagcaaaacaacaattcatttctcaaactaatttagatgaattgattaatgatggcagtattgttttggataatgttgatagtactgatggttatggtgatgttttacatgttgctaatcatgatgaggatgtaacccataataatagtgccatttatggacccacatctgtctatgatgatagtctaatgcatcatcataaacctaatactaaacataaacaaattacaattgacaaaagtaacagtaatgatgataataacagtaaaggggaaatcaacaaagatgagaatagaaatgtgggtaataatagtagtattaactacaacaacaatattaatactttaaataatagaatcgataacaatagcagcaactttataaatgttattaacaaaatgaataaagatcctgatatcttaaaatgtatacaattatttttcatttggcaatatccagatcataatatgtttatattccgtgaagcatttttaattgattttttcaaccctaagaaaaacatgttatattgttctaaaacattaattcttagtatatgttcacttggagctaaaatgtcaactgaagaaaccatttataatcgttctaaagaattttatcaagaactgaaatatttattattgaattctattcatcagccttcaattacatcattacaaagttttatgttattggcattttatgatatttgtaatggacaaaattcaagtggatggatgttatctggatgtgccatgagaatgggatatgatttaggatttcaattaaatcctgaactttggtttgttaaatcaaagggtgaaaataatactattaataatttaagtaaattagatgtggaaattagatcaagaatttattgggggtgttatatggccgatcattttattagtttattattgggtagaccttcaattttgaaaatatttgatgcatcaatccctgtgactagtgatttaccagatttggaatggattgatgattttacatataatggacacatttttttcacgcacaggggctggaaggtaccgcgattg

SEQ ID NO: 5145 - DNA, 822 bp, Candida albicans
gcaattacaatttcaattatgagttcattccagcaagaaaatcaattgaacgctaacaacaacaacaacaatgtcatgaatgaatatattagctattcggttccattatctcctgtcactacaaacgaaaaccctcaagattattggatgaacggtttgattgcaaattctgttccgatctcgcaaaccacaagcaactccgatatcaattatagccaaccaccaaatcctattaacttcaattcaatttttgaaggtgttaacattttctctaatgatgatttcacttcttcatctaacgacatatcgttagccaatagtccagaaactaatgccacatcagacagtattgcgcaaaacttagatgaggttaaagtcaaattagaaaaccacaatcaagctagactagatgctttggaattcgcttttgaaaccaaatcaatactaaaagaacaaccaaaaatcaaacaagaaccaggtacgaaggcagctactaaaccaaagagaagagcaccaagaaagaagttgaccgaatcacaaaagaaagctcataacaaaattgaaaagaggtatagaatcaacattaatgccaagattgccggcattcagaaaatcattccttgggtggcttttgaaaagactgcttttgaaactggtgaagaaaatgaaactgaagctgaagccaagaataatactagacttaataagtcgatgatcttggagaaagctactgagtatattcttcatttacagaaaaaggaagaagaatacatggctgaaaatcaaaaattaagagaacaagttattaaattgggtggtgaa

SEQ ID NO: 5146 - DNA, 1164 bp, Candida albicans
tacttaaacagcgtagaaaaaaaaaacacaataaaataccctccatggaattcagtaaacaaacattcaattaagacgaagaaatacagaaagaccccccaaaacaatactcaaacaatgaacgaagatccacagtccgaaattatggaaagatacaatgaatcagcttatttgagagacgaacagcttccgcagtttgaccagaataatgatgtgattaaggaagaacaaacacacacacaagatcaccaccaccaacacccgtcagaactgggatcacattcagacgaattacaagatcaagatatacacaatgttatagaagagcatgaagaccatgtgagcactcaaaacatagtggatgaagatgagttactagcagcgcaggcagcagcagaggcggcagcagcagcccaacaacaacaacctggagacgttttcaacaatgtggctcaaggattatcagggaaacaccgagatatgatgatgcaatattggcaagaaactatcaattcgatagaacacgatgaacacgattttaaaaaccatcagttaccattagcaagaataaaaaaagtaatgaagaccgacgaagatgtgcgaatgattagtgctgaagctccgattttgtttgccaagggttgtgatgtgtttatcactgaattgacaatgagagcgtggatacatgctgaagaaaataagagacgaacattgcagaaatcagatatagcagcagctttgaccaagagtgatatgtttgactttctaattgatgttgttcctagagaagaggagaaacctaaaaagtccaataataatctgtcgaggtcagacagttatgtaaataatcaacaatctccaccgataccagaaacagaagaagaggtcccccacatgcttacgcaagatgtcaagcattcacatcaggatgtattgcaacaacaaatgttacaagagcagttattacagcagcagctacaccaagaagttcaacagcagttgcaacaagaagtccaacgtcaattacaggaggacgtaccacaatcagaccaccaacaagcatcacagcgagaagaggatattacaaatggggcggaaaatgcaaatggtcataatgatgaagctacgtatgaaaattttaacggttaccaaaacaattattag

SEQ ID NO: 5147 - DNA, 633 bp, Candida albicans
ttctcgtcaccttatagatacttttttttttattttaaatctttcgccaaactaccaacagccatgtctgaaactaatgaaatcaaattggaaactgaaccaaaacaacctccttacccaattgaacaagcctgcgactcgtgtcgaaagcggaagttaaaatgctcaaaagagtttcctcgttgctcaaaatgtatccaacacgaatggtgttgctcgtatagtcccagaacaattcggtcacctttgacaagagcccatttgactgaagttgaaaatagagtaagtcaattggaaggaatacttcactacttactacctgatcacgatattgatgaaattataaacgaccacgacaaggccatactagcaccaattagacaaaaattacaaccactgccaaaaccatgtgcacccacagaaatgcattcccccattgactcaatcacctaccctttacgccagtcaaagtccaacccaataccagaagagtatcccaaaagtagaatcaagcaagaaataattgacgattttttattaaacaacatcaccaccaccaccaagaacaatgattacatcacaccaacggtgttcaactcatcagtaaattcaacggcacagagctcctcatag

SEQ ID NO: 5148 - DNA, 1464 bp, Candida albicans
  unsure (1421): Identity of nucleotide sequences at the above locations are unknown.
ccactgcttcggatgaaaagcatgcagttgaagccggcgatgaagttaaccaagaaccagcagttgacaatgatggaaacgacaaggataatcagtcagatgatgaacagaatcaagacgaggccgctattgatcctgcacctcaagccgatactactgatgacactgaaaaagacagtgaaaccaagacagaaccgggaagaagtaaaagaaccagtagaaagcaaagaaccagaacaagttgctgctaccgatgagcccgatgtcaagaaatctaccaatgaaattgttcaggagctatttgcagatgcaactccaacagctgacaataaactgtcaagtcccggtaatcttgaaagcgaagactatgacccagaaagtgcttttactgataacaatattgagaaagactctaaatttaatgataattctgaaattcaagagaataaagacaattctgattatgaacctgaactcaaagaggacgcagaacgtaaatcaccagccactgcaaatatttctttaacaaaacctcatggaccagcaggattacctccaaaacctccagtcaatgccacagtcaaaccatctacagcagctattacagaagaaagtagctctcaacaacgattgaaagatgcctatgatgctattataaatagccctattggaagagacccggaatttttaaagttaccagcagaagagcaagtagacgcaattaaagatcagttacaaaaacttggaattgacctatcttctggaagccaccctatcaattttgatcaagtgtattcttacaataagccatttaaaaacttgaaagacccaattcctttagttcctattggtcaattctgtcgtagaccaaatattaccgctccaacgactcccgaagaagaacaggaatatgcagatttcatcgaaagagagaattattacttgaatttacaaaactgggacgaattcccagataagctgagattatttattggtaatttaccggcaaacaccatttccaaacaagatttgtttagaattttttctaaatatggtgaggttattcagattgcaatcaaagcaggatatggttttgcccaatttaggactggagaagcatgtttagagtgcatcaaaggtgaaactaatattccattacataacaagatcttgagattggatgcctcaagaccacaaaagtcaagacgtccaggtcatcctgaaattaataatccaaacatgagtggacgtggcagagaaagagttagagacgaaagtcaagatcaagatgaacaacctagccataagaagagaaagggtaacattgattgtcaagtttacgttaccggaaaatcatcggttttcttcataagaaaagttaaaaaggcttttccaatgtcacaagtgaccaatagatgtgngaagatgttagcccaagtaattatacaccaggttttgagttaa

SEQ ID NO: 5149 - DNA, 1086 bp, Candida albicans
gtcctatctgcaattattctaccccatactacacatatatatacattgactatgaagttagatcaattaattaaccaagcagcaccacaaccagtaccaactgtgacacgattactgtccattggtctcagtagtagttcttccactggtgtcaccaactctggtaatgctccattgcttcctcataatcacaatcaattcaattattatcctaaaacagccactacaagtagtgttcataatcaacgagtcaatttaccaccaatatcagatattttacaacaagctcaacattacttaccaccacctccacagcaacagcaacaaccacaacaaccatcacagtcagtgtcttcatatagacaagctcaagctcagttacctcctttaccgctagctgctactgccaactccaattccaattacaaatattacgattattaccaatcaccaaacagtgatcatcaacaacgttcgtacacttcaagtagtagtactgtaccatcaccacgtataccgcattctgataacacagtaccctcataccaacagccaatgatggttaggaacaactcatatcctccaattcaacaacaacaaatgcaaacacaataccaccaacaaccacaatacttgggcgtgggaggagattcatacttcagaaatcgtactccacaacctccagtgataaatcataaccacaataatggttccaactctactttatcctcatcatctatgtcgtcgccattatcatcgccttatgattctcaaaatcatactagtgactttagtgctactggtacaccaactgacaactttatgaaacatgcttctggtgcttctgctacaaatggtggagttaataataatcgaaaaacgagaaacaatttacctaaagagattacatttattttattacaatggttgaatgatcatttgaatcatccatatccaagctcatttgaaaaaaatcaattgatgataagtactgggttgaaccaacaacaattgagtaattggtttatcaatgctcgtcgaagaaaaatcaagttgttgaaacaacaacagcgtttgaacttttag

SEQ ID NO: 5150 - DNA, 1518 bp, Candida albicans
cgagcgcggttctttccagccgcgtggtcgaataaaacccctagcatttttaaacctaaacaacaaagtatagaatctactttacgtaaagtcaacttggcgacatttttggcagccactttatgtacgatggaaattgggttcttttaccttaatgaatcgttcctacatgttttttgtccgctgaataatttggaccctctgaatgcattatccaatttaggaggttatcaaaatgggttacaaagtactgatagtcccgtatgtgcgagagtcggaaaattgttaaaacctcaagccacgttgtatttagacttgaagacccaagcgtatatctcagccattgaggctggagagagatcaaaggaagaaattttggaggacattttgcccgatgatctccatgtttatttgatgtcaagaaggaatgcaaagttgttgagtccaacggaaactgactttgtgtggagatgcaaacagagaaaggagctcttattaaattacaccgaggaaacacctttgagtgagcaatatgattggtttacatttttgagagacttgtttgattatgtctcgaagaatattgcttatttgatatggggaaaaatgggtaaaacaatgaaaaatagaagggaagacacacctcatactcaggaattgcttgataatactactggttctactcaaatgccaaatcagttgtcttcatcttctggtcaagcttcatcgacaccatctgttgtagatcctaacaaaatgttagtgtcggagatgagagaagcaaatattgcagtgccaaagccctcgcaaagacgggcgtggtctcgagaagaagaaaaggctttaaggcatgcattagaactcaagggtccacattgggcaacaattctagaattatttggtcaaggtggaaagatttcggaagctttgaagaatagaactcaagtgcaattaaaagacaaggcaagaaattggaaaaagttttttcttagaagcggtttggaaattcctagttatttgcggggtgttacaggtggtgtagatgatggtaaacggaaaaaggataacgttactaagaaaactgctgctgcacctgttccaaatatgctggaacaattgcaacaacaacaacagcgacaacaagaaaagcaagaaaagcaacaacaagaagagcaacaagcacaacaactggagccacaacaagagccacaacaagagccacaacaagagcagcaacaagagcagcaacaagagcagcaacaagagcagcaacaagagcagcaacaagagcagcaacaagagcagcaacaagagcagcaacaagagcagcgcgaggagacacaacaaacagagcaagagcagccagatcaaccccaggaggagcaacaacaagagaaagaacaaccggatcaacaacaacaagagaaagaacaaccggatcagcaacaaccagatcaacaacacccagatcgacaacaacaagagcagatccaacaaccagaaaatctggataaatag

SEQ ID NO: 5151 - DNA, 786 bp, Candida albicans
ccatttgttaacaaaaaaaaatgggtagaagaaaagatggaaatagaaccattgacagacgatagaattggtacagtgatttttgtgaagcgtaagccaagattatttaaaaaagctcatgaattagctgtgctctgtcaagtggatttaacggttattatcgttggcaataataataaagtatatgaatattctactgttgaggcaaatgagatttttaatgcctataataaaaccattaaagtcagaaaacaagtacatgaatcgaagtctccagaatattattcgaaatttagaaagaaacgacatttaaatgaaccacttatgaataaatcagggtctgtagttggcactaatacacatttgaacgatgaagactatgatcataatgttcatgaagcgggcgatgaggattcggaatatgaaagcgatgataattctccacaacctaaacggcacaaaagatcagagtcggttaaaaaagagcaaaaccccaaagtgtttaatagtacccaacttccaccaccgcttccaccacttcatatatctttaaataatgttccaacatttaccaacccccaaaattacaaaaaacagattgatgagacaaataacacttcggcaccgcccgctactgggacaaaaaatgaaccaacgatgcaacgaccagtattgagggtacaaataccgaatgatgccaagagcaatacgaataattcccatagtggtgttaataatagtgatggcaaggacattttcaccaggcgtcgaagtaaatcacgtcac

SEQ ID NO: 5152 - DNA, 693 bp, Candida albicans
agaatgtcaagattagatcgattagtagtattattggagacaggatcaacaccattcattagaaacactgcagcagatcaattatctgatctagctaaagcccatccagaagacacaatcaatttattaggaagagtttatccatacttgaaatcgaaaaaatgggaaacgagaatttctgcagccagagcatttggcggtattgttaataatgctcctttatgggaccccaattcagagaaacaaataaaattggaaaaagatgcagaacaagtatttgtcaaagaagaaatagagacagatccaatagttaaaaaagagttccctgaagatgaaattataataaagaaggaacaagacgaagaactacagaaactcactaaaaatttatccaatttaatcaattttgactccttcagtctacacgaattgatcaaatgtggcaccaaacttttagcatcgaaactggatgacaccgatcgcgaagattatatcaatgatgtgacattactcggtagaattaaaagacatagatcaagtataataccgaaagaagagacaaaatcagacttatccaaagaaagctcacctaatgcacacacaaaagaggaaccaataataaagcaagaaaccggcacacaacaacaacatgacaatctagcatcagcaagtacttcaccggctccaccaact

SEQ ID NO: 5153 - DNA, 1887 bp, Candida albicans
aagcgtaaaccagatgaaagtactactgatattcctattgaagatttaaaggttaacattgattctccaatttataaaggtgatgtcatgttagttggttacgataagttaattggtatgagatgtgctgcctcggcagcatttggtaagacattgtcatacatgcaatcagaagagacattattaaaaatttttgaagcaatttcaggatatttgaaatcatgtcatgccacctcagttttattaagtgcatttattgttgaagaatatgccacggctttgaaagaacggggtttgaaaccaaatgaaaaaatcgttacattgttgagtggttcacttaacaaggttttacaagaaccagaaagtttgccacatttccgagaattggttcctacattgaaagcagttagaacatcttgtttgcaattatttgacgtatttgtaacagcagcaaaattatctccatcaagaattccacaaatccccgttgtcgttcaaggtgaagcagaggctgggccaggggcatttggactcgaaactgctgagaaaatctgtaatgaaacattcgtcaagcttaaaaaacatttgtcggcaactcataggttatctgctaatcaagctcttgaagacgctaaacatagaatccttgttgctatggaagaatctcgtttggcttttacatcaagagcaaacagtatatttgcaggatttgcagctgcaagtttagctttggccggtgtgccgaagaaattaaacccaattattaagtcattaatggaaagtgtcaaactggaagagactttagttctccaaaaacggtcagttttttctgttgccaggttagttcaacaacttattgaggttggtaaaaaaggtgcttcagataaaattgtgaaaaatttatgtgcatttttatgtgttgatacttcagaagtacctgagtttcatcataatgttattttcaaagaaaatattttatcattgagaaaagaagaagctcaaatcgaccctacagatgctgctgctcatgaacgagctgttcgtgaagccaaaatcaaacgtaatggtgctttgatgactttagatcaattagtgcatatttatggacctaaattgtttgatcaagttaccaaattgaaagaaatgatgattgaacctttgcgttacttgtcgaaaacagaagaagtatctcaagatgaattgaaaggacaaagtgtcatagatgctcttggtatacttcgtgccttatttccaaaaatggataaggaattgtatcccgaagttattgataacttggatttatttttgccaggtttacaatcagaatactcggtgtttagatattctactgctaaatgtttagccactatttgttctgtggttcctgctaaagcattcattttcattgtaaattcagttttaccaatgttgaagaatgctggggatgtgaaacaaagacagggggcaattgaaactgtttatcacatttccgctgccatgggtgcaagtatcttgccctatgtgatgtttttaattgtgccagtaatggggagaatgagtgattcagatcatgatgtgcgtgtcttggctgctaccacttttgcatcaattattaaattggtaccattagaagctgggattcccgatccagaagatatgccacaagaattgcttgaaggcagagatagggaaagagatttcattcaacaaatgatggatcctactaagattaaatcatttgatttaccagttaccattaaagctactttacgtaaatatcaacaagaaggggttaattggttggcatttttaaacaagtatcatttacatctattccgtgtgactatgtctatcacgcccgagcctggaaataaatgcgatccgggt

SEQ ID NO: 5154 - DNA, 1662 bp, Candida albicans
actcgcggccgcagcgcggtttcttccagcccggggcgaatatgggaacaagaaatcaagggatatgcaccatttatgaaagtacttgtatatgctggaagtccaagtattagaatccctttgcgaggtcaaatacctgatgccgatgttgttgttacttcatatgatgtttgccgaaatgatgttgaatccttgacaaaacatgattacaactactgtgtattggatgaagggcatatcatcaaaaacgccagttccaagttatcaaaatcagtcaaacgagtgaaagctgagcataggttaattttatccggtacaccaattcaaaataatgttttagaattatggtcattatttgatttcttgatgccggggtttttaggtactgaaaaagttttccatgaaaaatttgctaaaccaattgctgctagtagaaatagtaaaacctcttctaaagagcaagaagctggggctttggcaatggaatcattgcataaacaagtattgccatttatgttgcgtcgtcttaaagaggatgttttgtctgatttgccaccaaagatcattcaagattattattgtgaattgagtgatttacaaaagaaattatataaagattttgctaaaactcaaaaggaaactatcaaaactgatgtgcaaggttctgaaaaggaaggtaaaacacatgttttccaagctttgcaatacatgaggaaattatgtaatcatccagcattggtaatgtcagagcaacatcctaaatatgctgaaattaatcaatttttaatttcgagaaacacagatttaagaaatatcgaacatgcaccaaaattactttctttgaaaaacttattattggaatgtggtattgggtcacaagattcagagtataacaacaacgttctgaaaaagaaaagtcttcaacagcaacaacaacaacaacttatttcagccgatggggtgatttcagagcatagagcattaattttctgtcaattgaaagatatgttggatatagttgagaatgaattgttacggaaatacttaccatcggtgacatttatgagattggatggtagtactgatccaagagatcgtcaatcgatagttaggaaatttaatgaggacccctcgatcgatgtattattgttgactacaaaagttggtgggttaggtcttaatttgactggtgctgatacggttatatttgttgaacatgattggaatccaatgaatgatttacaagccatggatcgtgctcatagattgggtcaaaagaaagtggttaatgtttatcgattaatcactaaagatactttagaagagaaaatcatgggattacaaaaattcaagatgaatattgcttcgacaattgtgaatcaacagaatgctggtttacaatcaatggatacaaatcaattgttggacttgtttgacgttgatgatactggaaatggtgccaaagttgaagaaccagttaaagaagaaaccgataccaatggtggtggtggtgcatccactaatggagatataccagatgatattactggtggtcttactggtaaagcagctggagctgttggtgaattggctgatttatgggatgaatcacaatatgaagaagagtataatcttgataattttattaaaacacttaaatag

SEQ ID NO: 5155 - DNA, 813 bp, Candida albicans
  unsure (682),(725),(734): Identity of nucleotide sequences at the above locations are unknown.
ggaagagtttatccatacttgaaatcgaaaaaatgggaaacgagaatttctgcagccagagcatttggcggtattgttaataatgctcctttatgggaccccaattcggaaaagcaaataaaattggaaaaagatgcagaacaagtatttgtcaaagaagaaatagaaaccgatccaatagttaaaaaagagttccccgaagatgaaattataataaagaaagaacaagacgaagaactacagaaacttactaaaaatttatccaatttaatcaattttgactccttcagtctacacgaattgatcaaatgtggcaccaaacttttagcatcgaaactggatgacatcgatccagaagattataccaatgatgttacattactcggtagaattaaaagacatagatcaagtataataccgaaagaagagacaaaatcagacttatccaaagaaagctcacctgatgcacacacaaaagatgaaccaatagtaaagcaagaacccggtacacaacaacaacatgacaacctagcatcagcaagtgcttcaccggctccaccaactggttcaaataaaccagtatcaagtgctagattaaaagctatgcaaaggaagaaagctaaagcaaatgccaaaaacggcgccaataaaatccgtccaagtgatatatctcaaaattctntttcgaagacaaatgataaaaaaatgggaaaggaatggatttnaattccaanggattccacctcaccaatttggatgttacttccccaacaaaggtggggaattaatttaaatgggttgaagaccaaaaat

SEQ ID NO: 5156 - DNA, 633 bp, Candida albicans
gaattaaggcatggtgcggcattgggtttgagagagttggtgaaaaagcacgggaaaggtgctggaagagtaatgaacaaaactgtacaagcaaatgacaccaacaatgccgctactttagaagatttagctgttagaatatgtgtgatatttgtccttgatagatttggcgattatgtgtcagatactgtggttgctccggttcgtgagtctgcagctcagacgttagccgcattgttgatacatttgaacgaagaaactgttatcagaattttccattgcttgaattcaatggttttacaaaaagatatggttgcaaaatgctgggaagccaaacatggtggtatactaggagtgcgttatcttgttagtgttagaactgatatattgctagctaaccctgaaatgtttgacgacgtggttaccatggtactaagtggtttgaaagaaagtgatgatgatgtccaatcagtagcagcattgacacttactccaattgcttcacagtttgtaactacaagaaaaaatgtcattggtacattgttgactgtaatatgggattgtcttgtcaacttacgagacgatttgtctgcatcgactggtctattcgcccgagctgccaatccgcgtata

SEQ ID NO: 5157 - DNA, 2280 bp, Candida albicans
  unsure (2211),(2245): Identity of nucleotide sequences at the above locations are unknown.
acaaatactatcatgtcagaagaagacgttaataaaagcaatgtgatggtggaatcagtagatttgaaacaagaatctgtgaagaatcaagatgatggtttagatcgtaagacattatttgttcgttcaataccgtttgaagctacatcggaagaattatctgaatttttttcacaatttgtgccagttaaacatgctgtcatagttactgataacgaaagaaaaagtagaggttttggatttgtttcattcactttagatgatgattgtttaacagcattagttgagagtagaaagacaaaattcaaagaccgtcttttaagagttgatgttgccaaaagaagggatagaaaaccacaagaaggtaatgaacgacaagaaaagagtcacgtggagccaattgagaaaagaagagcaagattgattatccgtaatttaccttggtcttgtaaaaaacccgatgagttgaaaaaaatctttagtaaatatggtgctgtttttgatgcatatattcctaagaaaaaaggtggacaaatgtgtgggtttgcctttgttattatgaagaaaaactcagctgctgaaaaggcagtcgaaggttgtcaaggattaaagattgatggtagagaagttgcagtggattttgctgttgaaaaatcgaaatgggagcaaatgaaagatgaagaagtagaggaagaagaagacaatgagagcagtgaggaacaagaagaagcagattccacaaacaaagatgagaatgatgaagaagaagaagataaggatgatgaatcagataatgatgatgctagttcagaattcgatgaattgaatgaagtgaactctgacaaagaattagacagctctgacgaagaaatggaagaaccagagaaaaaggaggagtcactgcatcctaaaaagaaaagtaacagacaagaaccattctccatttttgtgcgtaacattccatacgatgctgatgccgaatctttgaaagaacatttcagcacatttggaactgtcaaatatgctttaccagttgtcgacaaaaaaaccggattggccaaaggttctgcgtttgtggtatttgctaaagaagacgcttatttggactgtcttgacaatgctccaactgttgcatctacttctatgttgattgcagacgatgtgtctccatcatatgtataccaaggtagaattttgtcgattgcttcagctgttgatagagattcggctagtaaattggctgatagaaactcattaaagagaaaagaagctttgggtaaagcaccaggtgaaaaagataaaagaaacttgtttttattaaacgaaggtagaatcacagaaaattcaaaacttgctcaatatatctcaaaaactgatttagaattgagagaaaaatcatacaaattgagaacccaacaattgaagaaaaatcctactttacatttatcgttgacgagattggcaataagaaacttgcctagagccatgaatgcaaaggcattgaaagccttggggagaaaagctgttgtccaatttgccactgaggtgaaggaaggcaagagacaaccactttcaaaagaagaagtgaacagatctgttaagttcaaacattcaatttacggagctgatgccgaggaagagattgccaaatcaaagaattcaaaacataaaggtgttgttaaacaagccaaagttattatggaagtcaagggatcaggtgaaacaggtcgtagtagaggttatggttttatagaatttagagatcataaagctgctttgatgggattgagatggttaaacgctcatgaggtgtccataccagaaattttagaaggattgacagacgaagaaaagaaactcgctgagttagagggtttaaacaaaagaagactaattgttgaatttgccattgaaaatgctcaagttgtcaagagaagaagggaaaaggaaatgattgctcgtaatcagaataaagataacagcaaaaagagaaaaagagatgataacgaagaagaagacaatggtgatgcggagtctacctcaaagggtaagaaatttggatcatctgataagaaacaaaagaaagctagaaaaggttctcagaagaaaggtaacatgaataaaggagcaccaaaatcagaagagctgcaaaaagaacctacgaacaaatctggtctctcagaaaacgtgaaaaagatcattggtttgaanagaaagagaagaaagttcaagaagttaggtgaanataaaacaaatatgtatatctatatgggtaaataa

SEQ ID NO: 5158 - DNA, 312 bp, Candida albicans
cagccattttcagctgttaaatatgtacgaagtacaagagatgagccagttgaaagtgaaatcgaattgaatgaacaatcaaatatccaatcaaaaataattctgttgctatatgcattcccgaaacttaagatcatttggtcatcgtcaccatatgagactgcacaaatttttcttgaattaaaagctaaccaagaagagcctgatgtgggaaccgccctagacaaaggggctaatagaaccattgaaaccggtgatggaaatccaccaatgtataatgacgacgccatcgattttattcaccaccagtga

SEQ ID NO: 5159 - DNA, 2595 bp, Candida albicans
aaaagaaacagaactttgaggaacgaagaaaacctcaaagaaaaaacaaaagaagcaaaagaagcaaaagaaagacgagacacggaaaaattgcttgttaactttgaatttacactatcagaccaccactataccattcacatcatgtctttgtttgtacatgatgacgaagagaatgacaaatcaacaattccacttaattttagtgagccagatatagtcccagtataccctgagaaagcaataaactgtattttacctttaaaatatcagcaagaaattgtggaggatacattaactaaagatgggttattaataatgggctgcggtttaggttgggacattataacagcaaatttactatatgcattaagtactccctttgttgattcaagaaccaagaagaaaaaacgggggttgatatttgtgcttaatgctcaagatgatgagttaattagattacaagaagaaatgaatgatctcaattgggaagatgaatctcaacatgaaagattagttattataaatggagactctcaaccattaagaagaaaaaaattatacgcagaaggtggagttattgccatttcttccagagtattggttgtcgatcttctttcacttatagtgagtgcaaatgacataactggacttttcgtatttcacgcggaaagaataaaagagacatcaaacgacgcgtttatcattaatttgtatcgggataataataattggggattcattaaggctttttctgatgatccagaatcctttagtgggtttaccccgttagctaccaagttgaagcttttacgattgtcaaatgtttttttgtggcccaggtttcatgttaccatttcacagtctttcaacataaaaaataaaaaagatattctgcgtaaactggttaccgaaataagtgtcaaactcactcacaatatgaacaagattcagtcagccatacttacatgtattcagtcgtgtttaggggagttgaagcgacataatccaacactagcaactgagtactgggatatagaaaatgtacatgatcgtgactttgttggacgcattcgcggatccatgaattctatctggcacagggtttcggttacttcaaaaaatatcgtgtcagatctatccaccctaacaaatatgttggtgggcttgataaatcttgattgtattggattttatcaaaatgtacaaagaattgtgagtgagagtcagaaagtccaagctgggagtaaataccgttcacaaagcccttggttaaatttagatgaggcagttacagtcatcagctgtgccaaagaaagagcatttggcaaaagagatggtaattacatgtttgaggaactaccaaaatggaatgagttgggaaaattagtccataacatattgcaagaaaaaaggaccagtaatttgaaaaatcaaggtccgatactagtagtttgctccagtaaatgggtagcccgtgatttgacaagacttttggaaactatgcaagaggaaaaaataggagacaagagagtatttagctgtcgtcgtttcatgaaggatcaattgcgagagtatgcacattggagaaaagagattaatccggttgtgagaagaatttgggaagaaatggaggcagaggagcaaaaagaagacgaatcagatattgtcataactaaaactttcacaagaaatggccaaccagtcagtaaaaggagaagaactagaggaggaagcgttgctgctcgagttaatcagttgcgggctccagaaaattttgaagcagttgatattgaccaagaaatgcttttagaattgaacgaagatgaaccgatagatcaagaaagtgattccttagaatttgaaaagacccaagaagagaatcaagaggtattggatttgataaacgaaactgaacaatttcaacatgattttgactttgtgcacatagacaaggaggagcaaataatagtacaagcatataatgacaaatttaatgcatcgattttacaagaattacatccatctcatattataatgtatgagcagaatttgccatttataaggcgagttgaggtgtaccaggctatcaattatgaaaaccctgctcatgcttattttatgtattatggtgattctgtagaggaacagaaatatttacttcgagttaaacgagaaaaggaagcattcacaaaacttattaaagaaaaagctactttgggaaaacatttcgagacaaaagatgataatgcaaaattccaaattaacagaaataatattgtcaacaccagaatagccggaggctctaaattcaaaaccgaaaccgatgaatcaaatgtgattgttgatgctagagagtttggctcgtcaacgccaaatttgctttatcgaattggtattaatgtgattccatgtatgcttacaattggtgattacattctctcacccaagatgtgtgttgaaagaaaatctatttccgatttagttcaaagtttttccagtggtagattgtttcaacagtgcaagcagatgttcagacattatgaattgccggttttattgatcgaatttgatggtacacaatcattttcatag

SEQ ID NO: 5160 - DNA, 1557 bp, Candida albicans
atcatgtctgattggttgaatgaaaatgcatttgcagatagcaacagcaatgacgattttttgaattccatttttgatcagagccaaggagagcaacaagctccacaggttgcgcaggtttctacatcaatgtcaaacccaccacttcaatcacaatcagccctgtctacttcaagaatctcacaagcacacactccaatgtaccaacagtctcctgttactgctcacactataccgcaaaacagtcctcaaagtatgccgaatcaagtagcacagcctcaacaacaaataccaccaccccctctgcaacacttacaacagacaaccgcccaaatgcttcctcaacagcaacagcaacagcaacagcaacaacagcagcaacaaaaacaagagcagctatacagaatgaagcaacagatttaccaacagcagatgctaaaaaagcagcaagaaaacatgtctcgtcagccttctcccatgaattcagctgggcataacacacaacaaaatacgccaatcacccagaatgcaaaaacacctcaaaataattcaaaattgcaatcaatgcaaatggaattgtttttttctgttttgtatgactttttgcagcggagcgggatctccattccccaatcattagctatcaatggtaagagagtcaatttgttcattttgtatatcttgagtcaaagattgggtggatacagggtcatgaaggcttttctacttatgtcaccagagcagcagcgtatgcagcaacagaatccttgggcactaatggccgacaaaatggggtttcatgataaaggggaggaccccatggccaaagaaagaattgctagagaactttgcaattgctatagtaactttattttaccatatgaagagtattatgccacacctgaagggaataaggatattgaagctagcaaacatagattccaacagcaaattgttcagaaatatctgtccaatgtccccacaccggctcctaatcaacaaagtccaatgataagtagcgctccaacaccacaccaacaaaggaagttatctcgtactagcaactcggtgaataactcaccaaatgtcagctctcctttccataacacccctcgacaagttccagcaccagcaccggcaccggtacaaacggccgcgtctatgcctccgccaacacctgttacagccaaatctcaaacaacaaaagcagatgcccatattttgaaaaattatactcctttcaaaaagattgtagaaacgcatggtccattcaatatcaaagagctctcgcaattgtctactgaaatcgaggtgacaaaaccagtttatctttttgctccagaattaggaatcatcaacctccaggctttgacaatgtcagtaaaaagcaatagtgggatccaaagctcagaagttgtgaacgcccttaacacattgttggttgctacatcagacgttaattatgcttttcaaataaaagatatcatggagttattagacgcattatcttctttggggaaagatgttttgaacaaaattgtaagagtcaacacagaa

SEQ ID NO: 5161 - DNA, 1470 bp, Candida albicans
cccccccctatacttagcgcggatgctgcctgcctcgtggtgaagaccagaagaggatgcgtgaatgctgatgtgacaaaattgtctgccaatggtcggattgatgatatttttaatcgttatgttaaaggacaaggcgaagatatactgtatgtggttaattcgcttacaggggaagttgtttctgacgatgaggatatcgaggaacttttttcagtatgtgatgacgggaatctggaatctcctattgacaagctgactgatctgttagatgtgcttgagtttcatttggatgattatcttacagcattgaagaatttcaaatctgaaaacaaacaccattttagcaaacttcaaacacgaagtgccacggatgatcaaatattgttagtcgatgaattgataactataacaatgatcttgagaaacatttcttttgctgaatataataaagaacctatggcaggaaatcgtcttttcaaggatttattgttttcaactgtcaaaagcgttgctttaaacaatgacaaatttgtgtttagccgcaaacggttatgtttactcaaggattgtcttttaatgctagacaatatttctttgtttactcatttgcatactttagaggaagcatttttatcatttgttttagtagcatcctttggacctaagattgaagatcaatacaagatcccacgatgcaatattgaaacccattcgtattttgcctttggtcttgatgccttcaccaagttgatggtcagagagccatacaatagatcattaattcaggcagttttgaatggaactttgaattccagtatgacaggatattctgtcagtttacaggatcaagagtacacaagaaagttaatcaaggcttacaacaaagattataagtctgcatcacttttgagtcaagctttccagatgtatatgagtatattgcctttcgatgccaacacatttgaattgtcaaaattcatcttcatgaggagtccaacaatttcacagatgttatttggggccaaattgttaatagacatggttccagttgatgatttgaacacacatcataacaagttgtctctttattggctattggaaaaccgggagttattattgggtaattttgccaggatagtcgttgctttatctacagaaactggaaaattcccacgcgaatcgcctgagcacaaggttttgtcgctggtattacgcaaggccctcgttgttatcaattcattggtcgacaatgcagttttggctaaggaaataggagacctgcgacacaccgacttgatggagagtttgacagattgtttggctttcccaagaataatacccgatgccattttgacattggacacgtttttggcacctaccattgataccaatttaggtaaagaagttgtcagactacttaggtatttgaaggccaatttcttctcaaaggcttgtgaggggatctag

SEQ ID NO: 5162 - DNA, 813 bp, Candida albicans
ctaaaactaatggtgtctgaatcatgttcaagaaactataaccatccatatactccatatgatattcaaatccagttgatggatgccatatataatactattgagaatggctataaaataggactatttgagagtcccactggaacaggtaaaactttatctataatatgttcatcaatgacatggttacgaactttcaagaggaataatacatttctagagacaaataatgaggttgaagatgtatatgagagtgaaagtgaagaggatgaacctgaatgggtcaaaaaagcttatcaaagttcaattgtaaaccgatcgaaaaacaaactaattgaatatgaacattatttggataaaatagaaaaggaacatgcccagaacaaacgaaaagaagaagaactagagataaaagtacataaaagacgcaaagccatgacagcagcaggaacagatctttcagaagagtcatatttaccaatggattattatagtgattcagaagttggcaaaattgaggatcaaaatctagctatcaccaaagagataaatcgacttttgaaaaaagtggaaaataaagaagaagtatcttatattaacgaatgtccgataaagatatttttctcttctcgtactcattcccagttgaatcaattttccagtcaattaagattaacaaatttccaagcctcatttgaagatctagaagaacgtacaaaatatataccattaggatcaagaaaacaactttgtatcaatgagaaagttagattcttcatctcgggaactgccggatccgcgccatattggggg

SEQ ID NO: 5163 - DNA, 1227 bp, Candida albicans
agacaaagatttgctgatttaagtttggctaaaatcagagatatagaagatttgaatgaattagggattgaattgaatatttgtccttattattcagtacggaaagggatagagatgacagaaattatatcattaccatatcaaatgattttccaagacacaacaagaaaaatattaaatttggatataaaagattcaataattataattgatgaggcacataatattattgatgtaataacgtcaatgtattcgataaaaattactctggatcaattgaataaagtaatcaaatctttgaaaatatatttaaacaagtttcttaaaagattaaatagtgggaatagaatcaatttaatgaaattgatcaaaatatgtcaaattttacttaaatttttaaacaccaatctggaaaaagttaaatctggtgatgaagtacaaatacaagatatattcaaagattccacgggggatttggtcaatatccataaactagatcaatttttaaccaaatctaaaattgcatacaaaattgaatcttacattgaaaaaactgaaatggaaactgataatggggagaaaaaaggaagaatcaccaatagtggtggtagtagtagtagtagtagtagtagttctaatccacttttatttactattataaaatttttaagaactttgacaaatctatctaaagaagggaaatttttctgggataatgaaaatggaacaatttcattaaattatatgttacttgatcctaatgctgtattcaaagaaattgttgatcaagcaaaatgtgtattattatgtggtggaacaatggaaccaatgtcagattatatggattatttattccctagtgtaccaacaaataaaatcaacacttttgcatgtggacatgtaattccaaaggaaaatcttcaagtgttccccattagtcaatggaatgacacaaattttgaatttctgtatcaaaaacgaaatgattctaaacaattaatggcactaggtgaatttcttattgaaattactaaacgagttccctatggagttgtgatatttttcccaagttataaatatttggatcaagttttacaattttggagagacaccaaaatattgacatctattgaatccgaaaaaacgatatttagagaacctaaagatccatctaacgtggaaaaaatattaaatgagtatggttatttaattcaaactggaacgtaa

SEQ ID NO: 5164 - DNA, 231 bp, Candida albicans
ttcaaactggaacgtaaaggagcaattgtattttctgtagttggaggtaagatgtgtgaagggataaatttctctgatgatttacccagagcagtgattatgttaggcttaccatatcatatcgcatattccggagaaatgctgaccaaaagaaagtatattgagacatctgagttgtcccatggtggtaccactactgatgctaaagaaatatcacgtaaattattatga

SEQ ID NO: 5165 - DNA, 216 bp, Candida albicans
cgagcagtcaatcaaagtattggtcgaagtataagacatatcaatgattattctattatttatttagtagacagacgattttcaaccccaagaatacaaaataaactaagtcaatgggtaaaagaaagaatttccatcaccaccaccaataataataataataatagtatatacattatggagtcaactactgatttcttcaatataattagatag

SEQ ID NO: 5166 - DNA, 1212 bp, Candida albicans
cggcagaattgcaaccagagcaatgggagaccttcttcaataggaggattggaaattgtttttcaccaatctggaagcacaatttatttccaactaaatttaacttatccaatatgtggtgatgccgaaacaatctatgggtataaagatttagatatatttttatgttttgatcattatacatttaaaccatttttgaatattaaatatagtgccaaattgactgacgatccagaaattattgatatcaaaaaaaccattgatgaattcttacctaaactgacgattttcaaagatgaagtgaaatgggtcgattcaataaaggaagaaaaagataatgggtataaaatacctggaaaattaattgattcatttagtgagaatgataaagaatacgatatttataaaattgacttgaagtcagacaatggatatgaattacatcaacgattgcaaatcttagtcttattgttcattgaggcagggtcatttattgatgccaaagatgaattatggaacttgtatgttttgtatgaaaaagacaataaatctacatccaataatgaaccttctatagttgggtttaccacggcttataattattggaaatatcctggtgccaaaaaattagattcaactgaacaagaactgagaatcaagatatctcaatttataatattaccaatttaccaaggtcaaggcttaggacaattattttattcccatttatttgacaagtggttagcacaagatgatataattgaagtagtagttgaagaccctaatgaaagttttgatgatttaagggatagagccgatttgaaaagattaaatactagtgagcaatttgatttcaaagctgttactccgaaagtagacaaggagtgggttgaaaaaacaagacgagcattaaaattagaaaagagacagtttgcaagattgttagaaattatattgttatacaagttgaaacatggctatcctggtatcaccaagagagacgtgaggttattcatcaaaaaaagattatatgacaagaataaggaaggattagccaccttagatgataacaccaagaaagataaattacagactgcttatcaagctttggaagatgattattatagaatattgggagacttgaagttgaacattaagcgtgagaatgatgaagaggaaaccgacaccgtttccaaaaagcaaaaagtgtaa

SEQ ID NO: 5167 - DNA, 1125 bp, Candida albicans
  unsure (1113): Identity of nucleotide sequences at the above locations are unknown.
aatcaaataatgagtgaagtaaagaatgaattggagacagagacgactccagcaccagctaagaagcaaagactatcaaatgatgacttgtatcgaaattcaactcaatacgagttatggtcatttacccaagaaacattacaagatgccaaacgagaggcaaatgaaaagggggtcaaaatttcaaaagagagattcaaatctgcctttgagaatgcaaagaaagaacatccagatgcttttgaacaatttccagatgaattgaacgaaaatatggtcagtctattaacactagaagaagaatccacctatcttgatttttacatacaaaacattactacgacatgtaatttttttaaaatgccaactcaagttcgattaacagctgcttcatttttcaagaaattttacctagtcaactccgtaatggaatttcatcctaaaaatgtattatatacatgtatatttctagctgcaaagtcggaaaattatttcatctcgatagagtcatatgttaaggcattaaagggaacagatacatctcatattctagatttggagttcattgtgttgcagagtttgaagtttacattgttggtacatcatccaatacgagcattatatgggtttttcctagattttcaagctgtattattacatccagaacaagtgatgtatgatgtatcagtagatactttggggaacatgtataatcaagcaaaggaatggctcaataagtattttatggtcagcgatgtggcgtttttgtttacgccgccgcagattgcacttgcagcaatgtacgatactgataaaaggattactgataaatacttgagacgaaaatatcttagcaatgaggaaaagttggatccgataaaagaacaggagaatgaaaatgaaaaacaaaatggcgaagataaatctgtagttgcatcagaagaagcttcaaaggatgttagcaaggaaaagactaaatcttccaatagacagcaatatgaaacattggttacattattgagaaagtgtgtaaaacttgcgaaacagtcacgggttgctgatcgtgaagcaagtaaggaacttgataagaagtttcgacgagctacagcaaancatctcccaaag

SEQ ID NO: 5168 - DNA, 276 bp, Candida albicans
ttaattaaaaagtttattacaatggctccaggtgaaagaaagaagtcctctagaaagaagaaggatccagatgctccaaaaagatccttatctgcttatatgtttttcgctaatgaaaacatatatattgttagagctgaaaacccaggtatctcttttggtcaagttggtaaattattaggtgaaaaatggaaggctttaaacagtgaagataaattaccttacgaaaacaaggctgaagctgataaaaagagatatgaaaaagaaaagggctga

SEQ ID NO: 5169 - DNA, 765 bp, Candida albicans
ttttctattttggctctgcttggctttatttatgaagattgttaccaactaaccttcttacaattaaaggcacatatagattcaagaaaaatgattaatgaagatgaagaggaatttgtatatgctcagaaacaggcattgccgatatcatcagaatctgaagatcccatttcacaatatttattagccgtgaggaaagaatctcttgctgggccaccagtcacttttattaccaatcgtcaagcaccacaaattacatcaacacccaaatctacacctcaaaataatcgagatcaaatttcagaccattggtcttctgaattaatgactcaatttgtatttctaaaagaagaattgctcaaaacacaacactcaatcccaatcaaccctcatatcccagaaactacagccaattggagaaagtatttcttagaaccaccgccagaaataagctattttttcactgtaatagatagacaaacagttttcaaactacttgtgtatataacaagatggttaagtatcacatcaagacatacattatcgcaatggatttggaaattgtttttacgcattgataaagttttggatccaaatgaatgttcagtgatacgagatttgggtaaaaaagcacttacaatcaaatcaaaacagttgaaagatgaaaataaagctacagttgattctatttcaaagtataccactgatatgattttagtaatagtaggtaattattatggtcaatcggatttattaaagtggtag

SEQ ID NO: 5170 - DNA, 1857 bp, Candida albicans
acaaagtatttatttgcaaaccatcacaccattaaaaataatcaatttattatgtctactgctatctactattcgactcataataacatgcacacaaatgatgatataactaatggtagtggttctactacatctggtaatccaggtgccaacccatcaaatcctaaccacactaatgctggtgcaactatcaacaacaacagtaatattggtttaaattcagctaataagaaccataccactttattaccttctttggcacacattatgcctagcaatagcaataacactactaatagtggatcttctattgatataagctccacacttatcaatccatattcaagtggggctgccgctgccgctgctgcagttggtggtggtaatggtggatattatcatcctccaccaccacattctcaacaacaacaacaacaacaatttgatacttcttattcgaatcaaactactccaacttcagcttataccaatttcaataatgattctacacattcacctacagatattctgatgcaacagaatatgaataatttagcatcttcatcaggaaatatgtctattggtggtggtattgatggtaacttttcccacaataataataataataataacaacaacaacaataacaataataaatgtatttgtaaatcaaaagtcaataaaattcctcgaccaagaaatgcatttattttattccgacaaaaatatcatcaaatggtattagatgaaggtactgttattagaaccaaccctgaagtttcccgagaattgggtagacgatggagaggattatcacctcaagaaaaggaacattggaataatcttgctgaagaagaaaagaagaatcatgccaaaaaatatcctgggtatagatatactccaagaagaaatggtagaaacaaaaattgtcctgtttgtaaaaataaaccccttcctaataataaatctaattctattagtggaatgagtggtagtggtggtggtggtggtagtatatcaggtgctagtagtctcagtggtggattaacttctcgtgataattcaattactaatgcaaatgctattgattatcaacaacaacaactacaacaacaacagcaacagcagcaacaacaagctatacaatttcaatcattaccaccagatcaatatcaacaattaattaagcaacaacagcaacaattacaattgcaagctcaacttaatggaggtggaggtggaggtggtataactagcaacccacaaactataccacaatacattactaatgggaattatccatcatacataatttctccaaatccttactccactactagtacaactgctcctacaacaacaactactacaaccaccaatgcatcatcaataggtttatcagtaccacccacagctacaactacatcaacatcatcacaacctacatcagcaaattcccaattacatttctatgaagctgagaaattatctccagtatcatcaactcatcatcaaagtagtataagtgagatagcagctcaacagcaacaacaacaacaacaacaacaatttatgtataatactaattatagtactataccacctaataatactactacgatgcaacaacattccgcaggtacaggaaatgattatagtctcaatggtaataatagtggaaacactggttatgataatagatatggttatggtcaacctatgataattactggtcaatcacaacaaggtttacaagttcaacaacaaggtcaacattataatagtggtttacatgctgctcaacattatcaacaacaacaacaacaacatcatcatcaacaacaacctccacaataa

SEQ ID NO: 5171 - DNA, 426 bp, Candida albicans
  unsure (393): Identity of nucleotide sequences at the above locations are unknown.
atgtcaaattccaatattaataacaagaaatttacagggccaaacttgaatgtcacattaatttgtcctgattgcaagcagttcccaccagatttaatagaaagattcagcgaaggtgatataatatgcggtcaatgtggactagtcctaagtgatcgaatagttgataccaggtcagaatggagaacttttcaaaatgacgataagaatacagacgatccgtctcgtgtcggtgatgccagtaattcattatacgataccgaagatttgacgactatgatttcatatgctcctaattctaattccggcagctccaagaatagcttgaataaaatccaacagaaaagccttgtcgacaaaaagaattatgcattacagaccggttctcccttnttcacctcggaccagccggacccgaattatagg

SEQ ID NO: 5172 - DNA, 564 bp, Candida albicans
atttttgaaagggaaaaattcaagatttcattcatggttgccatattcttgttgggatgtacacgagctgatgttcccagaactttagaggaaatcagagcattaacaaatgtcccaacaaaacaaattgccaaagttactgggttgataaaaaaaataattcgttcacatctcaacaacgatgatgcatcaacatcgatagtggatgaaacaagtagtttgactacccattctgcagaggatttaatcagaagattttgttctcatttggggttaagtttggctataaccagtgcatctgagtatgtcgctagaaagtgccacgatcttggagtattagcaggtaggtcaccaacaacaatagctgcaacatcaattttccttgctgcaaaactgcttggtgatactaaattgacacaacagcaaataagagataaaacaggtgtcagtattggaacaattaaaaactcgtacaaaatattacaagaaaatgcaaaagatttaatagatcccgcctgggaagccaacagcaaagtaaaaagggagaatacccccaaaagctaa

SEQ ID NO: 5173 - DNA, 1056 bp, Candida albicans
gcttgtattactaagcatattatgtcgccatcaacatctacggcagtacaggagtatattggaccaaacttgaatgttacattaacatgtcctgagtgtaagatatttccacctgatttggtagagaggttcagcgaaggtgacattgtctgtggcagttgtgggctagtattgagtgatcgtgttgtggatacgagatcagaatggagaactttcagtaacgatgaccaaaatggtgatgatccttctcgtgttggtgatgcaggtaaccctttattagacacagaagacttgtccacaatgatttcttatgctcctgatagtaccaaagcaggaagagagttaagccgagcccaatctaaatctctagtcgataaaaaagacaatgcattggctgcagcatatatcaagatttctcaaatgtgcgatggttatcaattgcctaaaatagttctggatggggccaaggaagtctacaaaatggtttatgacgagaaaccattgcgaggaaaatcacaagagagtatcatggcagcttctatctttattggttgcagaaaggccaatgttgctcgttcattcaaagagatatgggctttgactaatgtgcctcgtaaggaaattggtaaagtgttcaaaatcatggacaagatcattcgtgaaaagaatgcagccaaccctaatgctgcatactacggtcaagacagcattcaaaccacccaaacttcggccgaggatttgattagaagattctgttctcacttgggtgttaacacacaagttacaaatggtgcggaatacatagccagaagatgtaaggaagtcggggttttagcaggtagatcgccaactacaattgctgcaactgtaatttacatggcttcactagtgtttggatttgacttacctccatccaagatatctgataaaactggtgtcagtgatggtactatcaaaacttcatacaagtacatgtacgaggagaaagaacaattgattgatccatcttggatagaaagtggtaaagtaaaattggagaaaataccaaaaaactaa

SEQ ID NO: 5174 - DNA, 3018 bp, Candida albicans
  unsure (2990),(3001): Identity of nucleotide sequences at the above locations are unknown.
atagccatgagtcatatagatggtgatgatcatatgaccaaagatcttatagattctctagaatctaaagataatgatttatcactagtcacatcaaatacacaaatccctgatgttgaagttgccaatttgactcatgatgccgatgaaatcaatcaactttttgatactgcaactaacaatgtgcttccagagagtaacaagaaagataagccaatagatacacaagatttacatgaagatgatcctaaagcagtgccgaaaactacttccaatggagaatcaacttctaatagcaattctgtatcacctaaacttcttccaaatgatgggaaatcgactcctaaaattcaaaaagaactaaggcggaaatcaacttttgttcctgtaacatctaattccaaactgttggaaccatcagaagatgataataataataataataataattcaagaatttctgcttatgccagattagattttgaaaattttacatttttcgttcaaacattacaagtagtgttaggaaggaaatctaatgatgaaacattacaacaaaatgtcgatgttcatttatcttctaaaaaagccatttctagacgtcacgcaaaaattttatataattttggaactcaaaggtttgaaatctcaatattgggtagaaatggggccttagttgataatgtttttgttgataaaggtttaactatccctttgacagatggtaataaaattcaaattggtgatatcccattcaaatttgtactaccttcaaatgaaccaaatgaagaaaataacaatcaagattcttcagaaaaacaatttaatccatctgatgctattaacttaagatcgaatttatattcaaagtcatctagtcctcaatcatcgccgaaaagaaaaccccaaccttccaaaaaagtgaaaaaagagcctgtaagcgcgtctaatacttcaaaggatataaagccaactcctccagtacccacaacagcaatatcaccaactgcttctatatctacatcaactaatgcagccactgctgcaacagcaactacccctgccacaaccactgctgccaggaaaaactcaattaatagaagaaactctctactaaaaatcagacgattatcaaatgctcggagaaaatcattagcagcaaatgatgaaatcaacgaattgctaaaagatttaggtgtaacgtccattgatgaaataaatgaagaggactctgaattattagatgcacaaattcaaagtttattagatgaagataatgaaaatttgggtggaatagaagatagtttaatgaaattagctgaatttaatgaatcagctattgacgatgatgatgatgatgaggaagggaacgaaaacagccaagcagacttagatagattggagaaaaccatggagcatgatgctattgatgatgaaattaaagcaattgattcaaacttgactttattagatgatgagatttccaaattgacccctcttataaatgatactaatcaagggttattagaagaaaaggaaactaaaaagaaacaattggaagaagaaaaacgaaagaaacaattacaacaattacaacacaagaattcattggcgaaatttcctcgtcgatcagcaccacttatgggcaaaccagcatcgatacaaccaccagcttcatcttcaatatatagtcgtatcaatggattagataagattggcaaaaccgtatcaccacgtccaccaccaccaaaattaattgcacctgtgttgcgagtcaccgcagaaccatcagctatacgatctcgaccaccacttcgtgccatcacagttagtgattcatcatatattgccactttttcatatcctaaaactattgaggaaccgtcaaaatatcctaaacctaaagtgaaaaaggaacatcataagaaacattctaaaaaagtttattctcttgatgaaataccggaaccttatcgttcgaaaccaaatatttctttccaaattatgattactaatgttttgaaaactgaagcagcaagaaatggtttgataatcaatgaaataactgaagccattaaagaagtatatccatattataaatattgtactgatggttggcagttttccattaatcattgtattaaattcaccaaaatttataaacgacttcaaaaaagaggttcagaatggttatatgccatggatgaactttatataaatgaacgtgaaaacattagaattaaacagagagaaattgctaaagccaaagctaaagcagaagcattgagacaagaagaaattcgacaacgtcaaagattggaagcacaaaagtctttacctcataatattgtcgggagaaattttgctctgccttatgctaacaccagagttccacctaaccaatacaatcaattttcacagtcctcgtcgtcgtcgtcttcatcagcaacaacaacaacaaatggtcagtatggatccacaacaatggtgggaggaacatcacctcaagcaggtagtattagagctcaattggctgctgtaagaggcaatggaaatactcctgcaaccacatcaacaactccttcattgccagcgatgaatgatcctaaaactaaaaaatcattagaatatttacaaaaggaattattcacattatacaaggcaaggaaattaacttatgatactcaaacagcaacatcacttattacaaaagctgtggccaccactattgctcaagttaatagcattggtgctaaagctggagctggtgataatgcattagtatttttagtggaaagagctcctgaaaaagttagtaaaattttggatattgccttgacgaaatcaattaaggaacatgaaggaattgcttcaaaatcaccaagtcaaccagcaactccaggtatgaggccggaacaactcactacaacttcacaatctgcagcaaccccaacaacaacaccacaaataagtaattcgcaatcacttcntgtaaagcctnttgcccacggatcggca

SEQ ID NO: 5175 - DNA, 825 bp, Candida albicans
tcgttccatccgggtggtgaagacaagaattctgcttatgccagattagattttgaaaattttacatttttcgttcaaacattacaagtagtgttaggaaggaaatctaatgatgaaacattacaacaaaatgtcgatgttcatttatcttctaaaaaagccatttctagacgtcacgcaaaaattttctataattttggaactcaaaggtttgaaatctcaatattgggtagaaatggggcctttgttgataatgtttttgttgaaaaaggtttaactatccctttgacagatggtaataaaattcaaattggtgatatcccattcaaattcgtactaccttcaaatgaaccaaatgaagaaaataacaatcaagattcttcagaaaaacaatttaatccatctgatgctattaatttaagatcgaatttatattcaaagtcatctagtcctcaatcatcaccgaaaagaaaatcccaaccttccaaaaaagtgaaaaaagagcctgtaagcgcgtctaatactccaaaggatataaagccaactcctccagtacccacaacagcaatatcaccaactacatcatcgtcgtcaccaactgcttctatatctacatcaactaatgcagccactgctgcaacaacaactacccctgccacaaccactgctgccaggaaaaactcaattaatagaagaaactctctactaaaaatcagacgattatcaaatgctcggagaaaatcattagcagcaaatgatgaaatcaacgaattgctaaaagatttaagtgtaacgtccattgatgaaattaatgaagaagactct

SEQ ID NO: 5176 - DNA, 2430 bp, Candida albicans
aaacaatccattgtgcgaaccaccactgaagggaaattagaacttattgatttatccactaacacatctaaaggtgttttatatagatcagaattaccattacgtgacactgtatttattaatcagggaaaccgagtattatgtggaggagatgagaataaattggttattgttgatttacaaaccactggtgaagaagatagtaacaataaagttagcactatttcattacctgatcaagtagtcaatatttcttataacacatcaggagaattatcagccattagtttatcgaatggtaatgttcaaatctattccgtggtgaatgaacaaccaaatttgatttatactataaacagtgttatccccaccaaaattcacacatcgatggataaagttgattataatgatgaacatcatgatgaattattcagtacaaaaactcaatggtccactaatggacaacttttattggtccccactattgataatcaaattcatgtatatgatagacaagattggactaaggttgttaaagaattcaataatgataatgtcaagataattgatttcaatttactggcacaaggtaatttagccataatgtcattaaattcattcaaagtgtacaatttcagtagtgaaaagttaatcaatgaagacgattttgagtttgatgaagatggatatccgttaaatattatttggaaagataataatttgtttgttggaagtactgttggggagactttgcatttacgtaatgttgtcaagggtaaaactgacgatgtcttgaacagtttatttatcagtgacgctgaagaggaagaggaggaggaggaaagggaagttggaagaaaaaaattgggcgtggaagaagacgaaggtaatgatactgatgcattgttaagggactctgatattgaacaagatattaacgttgaagatcgaattggtcaacgtaagagaaaccgcagaccatataaattacacgaagaagatgatttggttatagatgaagatgataatgaaaacttggggtttgatgatagagtggtatccaatggatatagcactaatggacacaaaaggtataaatctcgttcaccatctgaggcaatacctaaaatatccaaaatcaaaccttattccccagggtctactccttttgaacaccgaggcgcgtctgctgacagaaggtatttgacaatgaataatattgggtacacctgggttgttcagaacaaagacactttagatgatgttacaagtggcagtggcagtggaggtaatagtatcactgtttcatttttcgacagatcactaaatactgaatatcatttcaccgattatcataattttgatttggcatcaatgaaccaacgaggagtgttattagggacaagttccacaggacatatttattaccgatctcataatgaagcaactaatgattcttgggatagaaaattaccattattagtaagtgaatacataaccagcatttgcatcaccaataacgcctcagcaaccaacacgattatagtgggtaccaatttgggatacttgagattcttcaatcaatttggtgtatgcatcaatatactcaagacattaccagtagtcacattgattgcatcagcaactgtcaatgccaaattatttgtcattaatcaagtgaccaccaatgtttattcatacctgatacttgacataaatcaagattacaaatacatccaacacaatgcaccaatgccattgaaagatcacaccccgttaattaaggggatttttttcaacgaatttaatgatccatgtatagttggcggagaagatgatacattattgattttacattcctggagagaatcaaataacgccaaatggattcctattttaaattgtcataaagttttaactgaatacgggactaattcaaacaagaaaaattggaaatgttggccattaggttttattggtgataagttaaattgtttgattttgaaaaataatagtcagtatcctggtttcccattaccattgccaattgaattggaagtggaattaccaatcaaaattaaatttgaagaagatgaagcagaagagaatttcttacgttcattaacacttggtaaattaatatcagattctcttaatgatgaattgcctggagaaattgaagaagatgaagtaatggaaagattaaatcaatatagtatgttgtttgataaatcgttattgaaattgtttggggaatcttgtaaagaaagtaaacttggtaaagcatttagtattgctagattgatcaaaactgacaaagcattattggctgcttctagaatagcagagagaatggaatttttgaaccttgcttccaagattggtcaattaagagaactgttggtagatatagatggggatagtgattaa

SEQ ID NO: 5177 - DNA, 1002 bp, Candida albicans
  unsure (44): Identity of nucleotide sequences at the above locations are unknown.
ggaaaggttgttcatgttcatcgtcgtcgtcgtcttcttcttcnggagatttatttcaatatgaagctccgcaggatattattgatgaatcccaagcaggagctattattcactgttaatatcaacaataatttctccattcttaggtttttgtttgacaagatttttgagcgagaacaatccaacgatttagtgtttgaagagttgtcacagttgattcaatgttctttggatggtactaatgtgtgtgttttcgcttatggtcagacgggttctggtaagacttttacaatgtcacaccccactaatgggatgattcccttgtcgttgaagaaaatattcaatgacatagaagagttgaaagagaaaggttggtcgtacacggtgcgcgggaaatttattgaaatttacaatgaggcaataattgatcttttgaatcccaaaattgatcccaacacaaaatacgaaataaaacacgacgacattgctggtaaaactacagtgacaaatgtttccacaattgacatcaaatctccagagcaagccattacaatattgaaccaggcgaataagaaacgaagtacagccgcaacaaaatccaatgatcattcatctagatcacattcaatttttataattgatttacaaggttataatagtttaaccaaagagtcaagctgcggaactttaaatttgatagaccttgcagggtcagaaaggctcaacaactcacgtgcagagggagacagactcaaggaaactcaagcaatcaataaatccttatcatgtcttggggatgtcatccattcattgaatctcaaggatgggtcgcatgttccctatagaaatagcaagctaacatacctattgaagcacagtcttggtggaaactccaagacattgatgtttgtaaacatatcaccacttaccaaggatttaaatgaaaccataaactctttgaggtttgcaaccaaggttaacaatactagaatcaataaataa

SEQ ID NO: 5178 - DNA, 513 bp, Candida albicans
atgactacaggagctttaccatctacaccagcaaatgaacccttgatcaaatctgcagataatgttgctaatttgattgaatcatttatagaattaggagtattagtccatgataatcaaggaactccacaatccaatcaagcgttaatgaataaattaaatcaattgattctgcaattatctcaaacatcaaccacagccaatgatcctaatgatgctaatacaaatttaaagcaatttcttatacccattgatgtgatttcatatattgaagatggaagaaaccccgatatatatactagggaatttattgaagttaatgctaaaagtaatgctcgattaaaagggaaaatgttggggtttaaaaaactacgtgatgtttttggtgataagttgaaacaagagtttcctcaattggaaaaaggtgttgacgatataattaaccgaaccaatgataatagtagtcacaccgctagtgtgatcacagacactgctaataataacaatagttaa

SEQ ID NO: 5179 - DNA, 687 bp, Candida albicans
cccaccattgataaaatggaaaatcccagagtttggattaactgtggaattaggcatgttgagcaattttactgcaaaaagaacagtcttcttaaaggcatggttgttcgtaattatcacaccgccaaggattatagaaagttcaacaatgcctgtaaagtgcctgtttcaaagttgagtttacatcatacctacattgaggaaagctattttaaattgcgtactaccggtagcaacggggtgcaggatttggtgacttcattatcagatttggaattgcttttggttattgcggccgtaaggtggatagaaaaatttgaacttcaaaccataaattttaacttggcctacacagaatatcaagagatggtcaaaaacttcaacactggtaacgctattgtcagctcgacttcccttgacagcagaattgctgcaaatatcaaagtggatagaaaggttttatcccgaaaggtgtcgctaaatagttggagcacgttgtacaagctaggtatattgttggaccctaaaggtgactatgtcgaaggtcaatctaacaactatagctatcatatcaacaagaatttaattatagaggagaatcaaatggtgttggtagatatcacgctcgatgagttaaatggctttatagaagacaagcatgtgttcaaacgctttgttaggttgtaa

SEQ ID NO: 5180 - DNA, 963 bp, Candida albicans
atagtgcaagatttatcaatttttaaaaaaactccatcaggtttccataatgaaaaaatatcaggattaagttggaacaataatgataatcaattagtatctggaggtaatgaaggaaccatcaatatttggaatgtcaatgaaaacaacaacaacaacaacaacaacaacaacaacaacaacaatgaaaaagaccaaaatggtttattattatcgtcaccaatagtttcaattaaacaagctcataatgatagaatcacaaatacattatttcatccaataaataatttaattatttatacatcattgattcaaacttggaaattatgggatttgcataaattatcaggacaaagagacgatttacaatgtttagttgaacaagaaggtcattcaaaacctatttttacaggagaaattcatcctgatggtggattatttatgagtggtggccttgatggtattgttcatatttgggatttacgatcaggtagatcaattgtaacattacaaaaacatatggcgggagtatattgtttagattggtcacctaatggatatcaatttgtcactggtagtggtgattgtagtttaaaaatttgggatttaaggaaactcgaaaataataattccaataatgaattatattcaattccggctcatactaaattaattactgatgttaaattttatcatcaaagtagagatataatgcagaaacaacaacaacaacaagatcaacaacaagatcaagatcatttattgggatcagagtttaatgatgggaaattcttagtgagttgttcttatgatggtgatgttaacatctggtcaagtgataattggattaaaatcaaaagtttaagaggtcatactgataaagtaatgagttgtgatattaatagtactggtaaatggatagtaagtagtggctgggatagatcaataaaattatggaaataa

SEQ ID NO: 5181 - DNA, 465 bp, Candida albicans
aagaaacaccacatatttattacaatggaagttgacaaactagatcatgaaataagagtgaaggaacaagaagaagaagaagaggaggaggaggaagaagttttttataccccaggaccaaaagaattatatgatgttagattagaagtactaaattattcattgaaacaatcagctattcgattacaaaaactacgtcaactaaaacaatccaccacaaccaccacaccaacaacaacactaacaactggaataccttcacaagatgaaattaatatattaaaatcaagacgtcaattaaattctaacctatcaaaatatgaaatttatggatctcaatttataccaggaactacaagaacaatatcaaatattaaaatttctaataatgataaatatattgcttgtggatcatgggatggatcaataaatttattaaatagtgcaagatttatcaatttttaa

SEQ ID NO: 5182 - DNA, 378 bp, Candida albicans
cagtttcaaccaattaatccaacaccatttttaaaatcattaataggtaaaactattattgttcgattaaaatggaataaaactcaatataaaggtacattagtatcgattgataattatatgaatctacaattagatcaaacttatgaaataatactggaaagtacagacacagatgccactaaagaggaattaattggagaaattttcattagatgtaataatgtattatttattcgtgaatataaggaacaacaacagccggtagattcgaaacctatagaaaatggtgataaaaatggaaagatagacaaagaaagtgtggaagaagaggagaaagttacgaataatgaagatattgagattgataaagaataa

SEQ ID NO: 5183 - DNA, 396 bp, Candida albicans
ctcattatagtgtgtagttgtggtagtgacacgaccaaatatattttgttcttggaaaaaaaaaatatttcgccttctccgaagattacagcaaaccatatccataaccaatcaagtatggccgacaatacagaatttgaaaagacagatccatcaaagtttttgagtggaataatagggtcttctgtgagtgtaaagttacacaatggtgttgaatataaaggaaatttgcagacaattgatgggtttatgaatgtggtattagatgaaggtaaagaaactgtcaatgggaaagtgactaaaaaatatggagatgtgtttattagagggaataatggtatgtataaggaaaactattgggatataaatagcgttttactaacatttcgtttctag

SEQ ID NO: 5184 - DNA, 627 bp, Candida albicans
gttaaaggtttgtgtttgggaaaaaaaggtttatcttcacatatgttaagtcatgatgattttaccatgatcaaaatatggacttgtgattattgtgatgtggggaaatttgcaaagaaaaatgaattagttgaacattataatatcttccatgatggtaatatccccgatgatttattaaaggaaactgaagtgaaaaaattagagaacctattagatcaaggatcgaaattaaataatttgcatgaattagaaacagagaaattaaaagtggaagaagatgaagaagatagtctagatgaaagaagaagtgatgttagatcagattcaatgtcagctcaaagatcaataaaatcatttactgcttctttggaaggttcaaagagtgtttctaaacttattctgaatagtgggaagaagatcaattgtcctaagaataattgtgatagaatgttttctagagaatatgatttacgtcgacatttgaaatggcatgatgataatttacaaagaattgagtcattcttaaatagtatagaaaaagaagaaactccagaaggtgaaccattggttaaaaaagccaggatggatttattgccaaatgaaacatcagtgatttctcgataa

SEQ ID NO: 5185 - DNA, 426 bp, Candida albicans
aagcaacatcatcatcttgttcaacaaatgagtaaaagagtcagagaagaaaaagaggaagaagagcaatcaactagtagcaaaataaccagtgatcaatcaatattatgcaattatcacccatgctttaatcaggcatttgaagactatcaacaatatcatttacatgttgtttccattcatgaacatacatgtgagtcatgcctaaaagtatttcccgataagaaatttctttcattacatatagatgagaaccataacccaatactacaaataaagcaggaaagaggcgataaaatattcaaatgttatacggagtcatgtaaggcagttttttcaaaccccaaagaaaggaaacaccatttaattgaaatacacaattatcctactgattatccctttaatatagtaaatgatggaatataa

SEQ ID NO: 5186 - DNA, 462 bp, Candida albicans
acagcggacctcatctctttttttcaaatccactttttattactttattcaatgagtgaaagtgacgaaaccaaatcgatatcatctttaatatcttcttcttcttcatcacgtcccaaaaagtatatttgtacatatgaagggtgtgataaagcctataatcgaccatcattattggagcaacatttaagaacccacagtaatgatcgaccgtataaatgtacagtggaggattgtgataaagcatttttcagaaaatcacatttggaaacacatattgtatcacattccgaaaaaaaaccattccattgttcagtgtgtggtaaaggggttaattctcgacaacacttgaaaagacatgaaatcacccataccaagtcatttaaatgtacatttgaaaattgtcaagaaacattttataaaacatcaatctttaagacatcatatattatctgttcatga

SEQ ID NO: 5187 - DNA, 1092 bp, Candida albicans
catgactttgaagaagttagaaaacatggccaatctgaagaaaagaacgaggaagagaaagttgtattggacaaaattgagatacctgaactagcaccaattgatcaagtcgactcagaaagtctggaatcaggttcacctctagaaaagttagaaactgccacaaaagatgaaagtccactccaagaagatgaattaaccagattgcttacaccagaattacaatctcaactgatgaatttgcaatatgaacaacaaagcgactcggaagaatcatcggtggaatcggaaactgaatcaactttagaaaccaccagtttggtcaaagaagcagaaatttctgaaagtacagactccaaaaatcatttgatcgaagattcggcaacaccacaatcagaactggattccaaagatattgaagaaaacgtaccagaaaatgaacaatttgaaaatataaaccttgaccgtattttcaagaatagtttaaatgatgcaagcagtgaaagagaagaagaagtgagagaggatacgcctaaagatttggacgaggaagaattaggcggtgcaaaaccaacggtacctaaaaactatgaagaggtggagttagaaattgttaaccaggagaatgtcactgatgaagaagacatggaaccattagttcaggaagtcaaaattgatatgaactttgatgatgatgatcaagatgatgtagaggtggaatcagaatcagaatcagaatcagaatcagaattatacagtgattcatctgttgacaagatacatgatgacatacaagtaccaaaacttgaaaatattgaagattcacaagtatcatcactgagcgaggactctggtgagatttcttcaaaatctgaaaatgatgaagagcaagatgtcgatgaagaagatcttggcaatcaaattacgagtgactataaaacccataatttagtgccagtatctagcgaagacgaagttgatagttcaaatgactcatcagaagaggaagacgttgaacagcttaatgttgaacaagaatccagctcagatgaagagcaaataatattcaccacgcgctggaagatccaactc

SEQ ID NO: 5188 - DNA, 2262 bp, Candida albicans
tattacaaaacaaaagcagtgaatattacttttattgattcaatcattttcccagttatgtcgtcgatcaaaaagtaccttaaatctgctaaagcatctatagaagcaaatgatcctgaatcaacactagattttgccaacgacgctttagaagaagatccaaattgttattttgcatatgtatttaaaggaaaagcatatcaattgcttagagacattccaaaggcaatcaaggcatttcaaaaggcaacagagattgaaccaaataatttattggcctggaaaggatattttcaagtccttaaagtgtctgatgactacaaattgttcttccaagttttgaccaatttagtgagacttttaacagatcaagggatctcaatagcggaaacattgaaagatatgagaaactatttggatcgccaaaagtacaagagtaatgacaatttatatgaattttatttgaggtcaatactaccaggatctgaattgggtgacttgattggaacagccatcgaacctactgatgttacagtgaaaaaattgttagattttaagactagtcaaactgaaaaaactgttgtcaatagagtttccaaagaaagagttaaatttggtagggttataactactgatcaaaaggcaaaacttgataacattgcttggtcttattatgaggacggtgatattctcgagttgtacgaaatgtttctcaatgtgtgtgacgatgaagagttgagacacaagtacgaagagaaattgttaaagttcaagtacgaactcttgaaggtatgtcctgataaacaagcaatgcatcaagatatcaaaaaccaaatggaagatatgattcttatcaatactaaaagcttgttttgttggaatttgtatttcgattggtgtgatgcaaagacaatcaatgatcttgatgaaaataaggtgatatcttacttgcaaatctttcaaaatgagggtttggggttgattttgtttgcctatgtcatgagtgatatttctccatttagtaaagagaaaatcgtgaaaagtttatcggcatacgacatcaacaaacggaagcctgattcatcgcagttgaatcctgaagatgacaaggatgcagaacttttagaagagcttgcggatgatgccactttggaagacgaaacttcttcatctcaatattatttaccccaagatgaagttttgggtttgattttagaaggttatagtaaaacgaaaaattcagtgttggccagcagaataattgttaattactatattcatttgcgagaatataacttggcttcggaaaaatgtcgtgatggtattaaaactttagctgatattcagcggacttttgggatagatttgacaaataccaaggaggactttttgtgttcacttgcaattgtgtacacttattatgaagctcccaaaaactataaccgagcaattcagctttatgagaaaattttagagtcaaatccagataatgttaaagcacaagtgggtaaaggattgatatatgtcgagagaggggaattagaggaagctagaactattttaggagctgttgttaagaaatatcctacgaatattgaggctgaatcagagtattattggtgtttagtcaagttgggagaatactcacaagggcgaaagggtttggaaggctttttgagtaagatcactggtggtgatttacacagtcgtgaaactagagctgttgctcgttggagaattgcaaaaagttattttttggaaaatgccgacaacaatgacaatgttaaagagtgctacaataacttgatcaaatcacttaaggattctgatttgtatgcaccttcatacactttgcttggtattttgtttcaagactattatggcgacactgaaagagcacaaaagtgtttttacaaagcgtttgatctagacacaaacgagattgtggcagcaaggtatttggtccaacaagcgactctgaagaatgaatgggaagttgcgcaagtattagccaaaagagtcgtgagcaacgaaagttcaagaagattgataatgcgtggtgatgtggatacagataaagcatggccttatcgtgtgctaggtagtggtgccttaaattctcaagatgatgcaaaggctgtcgaatggtttcaaaacgcactccgtttagatgctaacgattttgactgttgggtaggcttaggtgaagcatactaccattgtggacggttcgatggtgcagcgtcttcacctcgggactag

SEQ ID NO: 5189 - DNA, 1830 bp, Candida albicans
aatccatccgggtttttcgggaggagcaatcaacgccgaatttggaagccttatctttttaataaaaccgtttattctccccaaaattcaacattcgcaaaaaggcgtggaagtcatttaggtgaggtgttaaaggtgttcaatagaaatcaacaaaatattaatcaagttcctttcaatgatgtgtttgatatttttgaaagtttaggatataatgaaactgtatctctggttgctgatatcgatcttgatgaatcaattaatttgacaaatgctcaagaattgtatgctcaaggtgagaaggctcagtccttgtttgtattgataattgttgctgctgtcgcaggtgtaaaatctttatcgttgaaagctaacaagttgttacgtgcgacagcgtactacaatttgggtttggccttgttagaggcttaccaaaatgacgaccaaatgctggtttacagggacacatctattttgtttttcaaaaaatctattcaacttgaacaaagcaatgctaactattggattgcattaggtaatgcttattttacgtctaatccacaaatatcacaacactgttatatcaaagctactactttggaggtgaaagatgctgaaatatgggtaaatttggcatcattatttttaagatatggagacaccgaattatcgaaggatacgtttttaagagctcaatcggtggcccctcaagatgctcaatcatggttaggacatgcagttgctgcggatatattgggtgaagaaaacaaggcatcgggttattatgttcatgcatttacattatctaaaggtcgtttagcgttagcacaatttctttatggattatcggtggtaaataaaagccaaggtcgggatcctagagatattgaaactgctcaagaatttagcattagtaatcaagcaatgcaacaatatctcaaatattatcctgatgatgaggctggattaagtattgcgttatcgattgctgaaaggtgtaaagatttcgagctggcaatcgctttaggaactaaattaagtgaactttatgagaggcaatatgaggcaaatgaaagtgaggttgttttacaaaaatttgcaactgtgaaatctcaattagctagaattcacttgggtttgggtgattatgaacaagctttagacaatgcacaaatggctttacaattgaatgaaacttcagagatcttgttatcttcgaaaattactatggggctcagctatttcttcctaaatgatttcctgagcgctctagaagaattgaaagttgttcttggagaatacagtgattcttcgagaattgttagtttgattgctcaagtcttgcatgcgcatggaactgaggagactaaacaggccgctgttgatcaattgtttgccttcattgaagaatatggatcttcattattagttgtcctcactttgggtgcaatttctcttgtggatcaattggatgattatttgccggcgattaaggaagagttgtcaactcttggattaaatgaaattgtttgtgacacccacagagaagttcctcgattattgaatgaaataaatactagacttgatgatggtaataatgaaaatgcttggcttagatatgcatttttgttcccatttgattataacatctggaagaacattaatagtacaatggctaaacaagtgatttctttgcatgatgtcaaggttaatggggtacagtattccgatgcattattaaagactggtcaattgagagatattcaacgtagcttactattcaatcctggtaacaatgaagctataaaggcgttgcatgggtgtttatga

SEQ ID NO: 5190 - DNA, 1557 bp, Candida albicans
  unsure (11): Identity of nucleotide sequences at the above locations are unknown.
tttaacattcnggagaccccctttactaaattggtattaaaatttcatagtctggtttctattcaaagagctatatgttctttaaaaattgatattacccataggacttgggggatgaataaccataatttatttcttaatagtagtggggataataacaaccacaataatgacgacaataactattactcccacaccaataacagtgacaatcttctagcacttggtcaaggagattcaatgtcaacattcaactcagcatctcccacatcttccatatctccatccagtaacaatccaggtttgagcaataactctaatcaagcaccttccgaatcagtactatcgaattttttccacacgacaaataattcaaatccttcgcttaaaaaactaaccaatcgtcatacaacttcgaaaaagcccaaaagaaagcgagcaacaaacatcagagcttgtgacacttgtgctgccaaaaaagtaaagtgtgatgcaaacagaccatgtggccaatgccggacaaacaatctagaatgtactcataccagagaacgtaaaaaaacaggaccaaagactcccacccaaaaagctctagaatctattaataatctaactgaagttattgaaataaatgctaatgggaaaagaaagaatttatccagaactggttcaaacaattctgctgttacccaatgttcgtctaatgaactaactcacgatcgtacagaaacagaaaattctaaccaacctttatcttccagaaattctgcatcgccaccaatatcaaccggaagctcgattaagcagtgcgatacattaaaacaaattgttggggataatggcaatggagacggcaatggcacaacggataacaatagcgtccaccaacaaaacttagaacaactacaaggaaaattgtctctaaatgataccagcacttcaaaaactaaagaatttgcaacttctcctatggcagtaccttcggccacaactattgaagattatattgttactccttttcatcttatggaaaacataaatttaattggtgaagaaccatcaattctcgaactagtgagacctttgacagttgattctgttatattgaattatgttcgattagttgaatttttagtttccaattatccagattcaagagacggaaattatcaaaacaatccacgttatcaagaattaaacctcattgatcatcatgataattcgttatatctatctacattattaataattctaactttaaatcaaattattgctgaagttcttattaaattgaagaaacaaaaattcaagaaatttgttcgatatcctaaaaaatatttattgtcacgaccatttaagaactttaaaaatttgtgtcattttaaagtattagaaatattcacattgattgagaaaaacttcattgttccacctgtaattccccaaaacagggcccatagatctagttttaccagtagcagtactgaagtgcatacctcatccagcatagccagtaccaataatcaccaccacaacaacaacaataacaataacaat

SEQ ID NO: 5191 - DNA, 2370 bp, Candida albicans
ggaaggcttggggattctggaccagtcagtcgaatgtggctggaacaaacattaattttttcaacaatttatcttcaatcatctttacatatattgagattagcattgtttaatttgcttgaatgttcacggttcccattttttatatcttatttggaaatatgtttgaaagagttttgcatgattatgaagctagataatgccaacaaattattcaaaattttcaaatttgagattttaagaaactggtggaagtacgactcaattgatgcatttccatttgtgttgtttctgtacacagacttaagttccttttaccgtgacaattatcgggaattgattgctgttgcattatcgacaaaatctaggagcccagaaatcagtaatgcttttgttgagcagttggctgacttgaaacaatctcatagtgaaactttagttgcagagagtttgtcaattattgttccattatcgtacagcaaagatggagttagaaacgatgtgttccaaatccttcttgattatttaaaaaattcattcaaacaagaatttatagacaagttacctttgattgtattggaaatcattaaattcaccgaaatttcaaatgaaaagtcctttgagagtcttggtacagatggattagttactatgttgttaaatgatactggtttctcatcaaccattcaaacagctggtgaaatggtaatttcatttgattctagtgttcaattattaaagaaattagtcgagaaatatcatcaacctgagcacgaaacgttttggtcctcgagacaaatttactttcttattagaaggttgtcgatctccttgaaattggccactacatttgagcaaaaggttatatttttgaggaagttcaaatttgttttagttttgggtggtaagaaatcaattgactatgctgtttctcgtcttttagttgatactttatgtccattgttactgaatgagccaaaaatgtcagcggatgtattcttaatattacaatcgttaaccgatgtatatctgcatcggtatacctatgataagtccatactgttaataatccaaatcattaattctttgttggaaactgaggctgttgaccgatcaagggctttacttgattgcattgatgattttgttaatactggcgatcaagatagagcaatttgccaacttctcaaatcatcagttgcgattttaaagggtcaagcagtggagatagagtcttctttgattgaattatgtttggaagaaagtggacctgattatataaagcagatgattttgatttcgagaatctttggcaatgtcgtttttgccacaacccatagtggaagtaaattacctgtggttgagaaattattggcactcagtaaaaatcagattcaggaattttctgatggatataaattgtggattgctaattatttgtctgatttttatattgaaggtggttgtaaagagcagataaaagctcttacatttgatgaatatgaaggaattcctgtgaatgattttgaaaacgaggttcgatcttttgattttacattgaaatcaattgaacaatatatttacaaagatgattttgaagctgcagcttgtgctgaatccattatcggtgttttaattcgaaagtatgaaacaagtaaacgggaagtttctaagtttttgaattttgaaaccacgcttgaaaagcattccgatagtatacttccaattgatttccatacatgcgttatattaaatgataaagctgatgtggaatacttgggagatgaattaattgatataattaacaattttgagtcgtttttgctgaatggtactgagttgtggtgcactaaattgtacttggcacttttacaggaattggcagttgagaccagcattgctccacttttaagtacttttgttataatggttcctgaatttgctaaaacttcattaccagttttagtttgtaattatttggctataaaacgtactcacagtcaagacagaattatttcccttttgaatgagtttttacacacttccaaaaaatcagaatcttctattaaggtttttcttcaaatattgattttaattagggttggtgccaagatttttaagaaacctgtgtttggtaatgtgtttgcaaaaattgataagttaaaattccaccagttggcttgcgaagtgaaacaatttaaaactgggttaatgtggtttgaagatgtagcatcagatactaactcagatgtgcatttgcaagaacattatcaaacattggcaaatgtttatgagtccttggatgatgacaaattggtattggaatggcgggaaagaacaacttgggaatactccatttcaatggattaa

SEQ ID NO: 5192 - DNA, 2400 bp, Candida albicans
ggatctccaccgctggtgaaaaccaatatagttggctctttgtcagctgcgggtcttttgggagtgtcaagagcattgagcaaaaataccagttttgcatctaacgatgattcacaatatgaatggagttggaaattgtccaaatgggacttgccaatttcgaaaaatgccaccaaagagaacgaggtgatatacaaaaccttgaagcaaatccatgatttccccatgaatctgcaagatatatgtctgtcttcgcttttgaatgctgtggataataaagtgtcagcaactaatatgagtgttaaagagtttaaacaggagggaataaattggttgaaaaccatttcgactgtagcttccattgcagaaatcgcaaatgccacaggtgataatatcattcccatgacaaaccagttttcagaaaaaacgcaatggtttggggaggttgagtttagcatgtttgagaatttattgttagcaaggcaaacaacgtttggtttaataaatgataggccgatttcaagtttaccttccgatacagcttggatgggtgcattgtgtgacttggttagatataacaatttagcaaggaccaatggagaataccagaaaatggtgacatcgacaatgttggttgatgtggtatctaaaaaacttcaaagcagctctttggatatggttgcgttcaacgcgaataacttggcatcttttcaaacagcacaaactctttggtgtcaggggaataccaatgtaccggtgatgattatgaaagatttgtatgcggcaggcggtattgatatgtcagaaaacattttaaaggtagacaaatgtttgataagagccatgatggttgattggatgtctcaatcacgacaggaagttgcctctagtattatggagaaatatgttatgccaactgaagagttatcgaaccacatgattgaccttcaacaacaatcaaaaatattttcaatacttgcccgtttttgtgaggaacaatacaaattcaagtctttgagtgaaaaaatttccaaattggagaaaagagtacttaataaggaaaatgaaattaaagatcttaaaaagcaatatgaaaaagtcactgttacacatgctgaacagaagcaggtacaacaatactacaatagattgaaaaagcaatttgtttctgaaagtaaagatttggaatcgttacgaaaaagcaaacaattgttttcttccaaagcggttcaatattatatgaagagtatcattgttgatgattttgaagaagagaacttggataaatttttctctttgtggttagaacaatcagggaataatgaattgaatcaatcgcttcaatccgatttattggcattacctagttataaactcgtttcctggtgtactcaattgatatcaagattatcaaacgaaacaaacaactttcaaatattattgaaaaaattgataataaacatgtgtcttgatcatccccatcattcattgtacttgttgttatcattaaagaaacacaagcccaatacaaatgaggtgttaaatccactgttactttctaggtgtgcagctgctcaagcaatttgggatcaactattactacaagaccatcgatatgtactgggtgtgttgttgccaattgatggttttactgatcagtgtatcactctcgctgcatataaggtttccaagggtaaaagcattgatttgactaaattctctgctggtgattattggttaaatgagttgccagcaattccaccgcccacggaaacaatcagggttgatcctagcaaacaatataaaaatgttcccgtattacattcaattgacaagaaaattctgattgcgacatctgggttgagtttgccaaaaattgccaattttatcttatcaaacggtactgagcatcgtgtgttgttgaagcacggtaccgatggtattcgacaagattccatcatggagcaagttttcaataaagtgaacaatatttttgccaaggatcgagaatgtaacaagcgaggattgactattcggacatataatgcggttcccttaggaccgttatcaggtataattgagtttgttcctaattccatggcatttattgatgttattagtggataccatcaaatgcatgataagattagttatgacaaggcaagagagatgatgaaactgtgtcagtcgggtgataaacaaaagcgaatacatagttttgaacaaattgaagcgaaaatcaaacctgtgatgagatatttcttccaagagacgtttttaacttatgacagttggtttgagagtcgagttaagtatactcatggaattgccacttcatccattgttggtcatatattgggacttggcgatagacattgtaataatatattgatagattga

SEQ ID NO: 5193 - DNA, 555 bp, Candida albicans
aaaaccctttatactataatcatttttttagtaaacatccgtactacaatcgtgtttgtagatgtctacgtaatcatgtctacgtcagatattaacaaaactatagcattattacaatcatcgaaaataaaagaaagaaatgacgcgttaaataatttagagaatatagcagcatcgaaatttagattaaatcccaaacaatttagacaattaacccaagcaatattagcattaattaagcatgaatcacaaatatatttcaacaacaaatccactacagtcgactcaagattaagtcaagcatcgtataatctacgactcctcactgaaaaatcaattgaagatacaagaatcgatttcaaataccgcacatatcttgatttgtgcatgggcataaaagatcaatttttcgtacactcggaattgttagagccttgctcgattgattttattaaaactataacaagtatttggaatttgagttatgtcaaggaacatttgattaggaaagaatggagtatactatactttttcttgggtttcattaatcaataa

SEQ ID NO: 5194 - DNA, 2844 bp, Candida albicans
gggtccttctcaaataacggtaataacgaaaaattgttgattgatttatatacggcattacagaatttattacaatgtgaaagtagcgtttcaatcaattatttacaattatatgataatgacaactatttcaagttgttgagaatattggataaaacttcagaattattgaagaaagaaaatgttatcataattattattttccgaataataaacaagttgatcacggtaattgccactgagaaattcaagtttgtcaacaagttaattaaaattggtataagattaatggtttactttcaccattcacattgggagaaattgcaggaacaatttcttatatttattaacttaccgggaactcatgatttaatcaacttacacaatttaccaaaattgattggcgatcgatatattcttagtgaaatcagcactcaagaagatggagattccataaattcacaagcagacaatcaagatgaagtgtttttatacaatctaggagtgcttattcatcatttaatgaagaaattaatgtctgggtcatttgaactaaaaactgaagacattggaatgtgtacaatcaacaacagtatcacatggttcaatttgaaaacgatatactcggactcgcaaaactacaagccgtggttgttgactttaggagtttcacgtcttttgaaatcatattatgacttgaaacagtttataaacaaacagtcaaatgacccacaaaccagtctacttctttactcaaatgggtcacccaataagaacaagcgacagaaactaggctcaattgcagataccatcagtgattcgaatagtgcaattgaactttgcaataaattaattcattccaaagaatcatcagataatcaagtgttgggtttgaaattgttgactttttaccttgaattatacacttttgaaaaaccaaaagaacaatcaactgaatcagatagtatggataccactattggtgaaaacacaacatttgactttgtcatatcaaccactgacaacacattcattgacaaaaatgtggtaatgaagaatattttgattacttttgacgataattcaatgaatttctggagcagtctttgtgcaagatcagttttgttagacgaaatattgcaactgaatcatggtgggtataagttcaaaaaatcattctcaatacagcttttgaaattatctttacttttattaaaagagccagaggttgccaatattgcgtgcaatatcatctttaaattagtgtttgagcagaaaaccaatctaagtgaattgatcgatgattctgttatcattcaattggaaactttaattgatctttcagaaatcaatgggccatacaaaatcactgaagaaagtttccaattttggtatgcaatcaacaaattggcaattgaagtgaatttgtccaagaaaaattttttgggtcgacgaattcaagattggatgttagcaaaatgggatatcactttttcgcctggtgcagattttgttagtgttggctcaagtctagccaatttcatgtactggttgctggggaactcaattagttatagcccagcaacaactcagaaatcgacttatgaaggtgatatttatgaattttattattttgcacaatcttatgatagtttagaaaagtttttgtgtttaaaatctgtatcagatagtagcgagaccatcaagtttgatataatcagcattgctagtagtgacagaattgacgcaatattgaataaagtaaatctgacatttatggtgtttgatagaagtctggttaccagtggtagtttattttgttggattatcgttttactgaatattgttgcaaaagtacgttctatgaaatttgttactcacgaattgactggattacagtttcagttgtcagctggattgaactcatttaaagatatcactttaagttgtgaagaaattattgatgtcatggaaatggttaataaatttttgccaaccgatccagacacgatacagattttcattcaaaatttcccactggaaaaattagttaatattattaaatttgactatccaggacttgcagataaggataatagaaaatcagtcccagaagatggttttgggtgggagttttctagagttagagatgctacaactcctccatctactacttcaaccagcacaatatctcttgcaaaattgaattataaaaagatacaatcccttgaagtatctaaatttattatgtttacagcagatattgaagggaaactacaatcagatatcttgactgcgtttttgaactatgtcgaaacattggaaagtgatgactttcttccgtcacttttgtttgttgtggagaatatctttactgatcatctggctcattttattgatgaaatacaacttgccaaattattgagaattataaatgaaaaactattaagtacccaaaactacgagagaaatgagtttgtcctggtggtgatttctcggttcttgtcagctacagcacaagtttggataaattcttcggataactcattagcaagtgatttctatagtttggtcctgcgactttatctgtctggaagagatgacttgattctaactgaaacttccattgttgaatattgcagatttttagcacactttattactcacaatgatgaaagagtcctttcaaatactgacattaaaaacgaactactcgaaaagttttcaaagtctcccaacaacatcaaagacagattagcaaattcatttggggaacttgtttcgctatctcctgttcttcaccacgggactggacggatccgcgctaaaatatacgcggggcag

SEQ ID NO: 5195 - DNA, 1344 bp, Candida albicans
tcaagtttggacaacaacaagatatcatatgacccgatgtggaataccacagatactatagatttaacaaacgacgggtctgaaaaaataaatgaggtagacaatattcatgaagatacaccagtagaagaatctgctatcgatgagaaaactcaacagaattatcgtgtgtggaagaaaaatgcacctttgttatatgattacttagttacaaactctttgctttggccctctttatcagttcaatttttccctgatataacacatataaacgatttgggtgaaaataagaatgaggaacagataattgctcaaagaatactacttggcacttttactttgggtcaagcaattgaccatatatccatcttacaaatacctagtttcaaaaaccttaatcaaaatataaagataaataaacttgattttaatccagaacgagaagaatttgaattaactacaccatcgttaaacaagaccaaaacattgcaaaagataaaccatttgggggatgtgaacaaagtcagatatatgccccaaaagcctaacatacttgcgagtgccaataacttggggaatttggtaatatacgaaagaactagacataagagctttaagaatactatattagatgatacagacttgagcaaagtgcaagtaagattggtaaataaacatattccttctacaacagatatctttgcaattgattggaacagaaatagcgaaggacttttgttgagtgctgatatgaatggacttgttaacttatacgatttaaagaaatatgagtccgaaactttgaatgaaagccaatattgggaaaataatgccattggagtaaacgatattgaatggtttccaacccacgactctttattttgcactgcagatgataacggatggttgaaactttacgatactagaaatcaaagtgctgctgttcagaatgcaaatattggaaatagtgtcaatagtgttgcttgtaatcctgggtatgccactggtttagctacgggagatagcaatggagtgattaagatgtgggacattaggaactttgacaactcacttagtgaattacatggtcattcggattcagttactcaattgaaatggaatcctaaatgccacaatatactagggtcttcatcctcggatcatctggttaagttgcatgatatgagcaatgattcaactatattcactcacttgggtcatatgcttggggttaatgatttcgattggtcatatgccgacccttggatggttgccagtgtcgcagatgataattctctacatgtctggaaacccacccactctgttacagacaaatttaaatag

SEQ ID NO: 5196 - DNA, 525 bp, Candida albicans
aatctgaagtttaccataccaaatcaaagtatcagcaagaacataatgggtagtaaaaaagaaagtaaatccaaatcatctagtgatgatgtttcaaccgaagataactatgaaaaaagaatgtcagcaattttaccgttcgctaaaccattagcatctaagaaattgaacaagaaaattttgaaaacagttaaaaaggcttccaaagccaaacatgttaaacgtggagttaaagaagttgtgaaatcattaagaaaaggtgaaaaaggtttagtaattattgctggtgatatttctccagcagatgttatatcacatatcccagttttgtgtgaggacaattcagtggcatacattttcattccttcaaaagaagatttgggttctgctggtgctactaaaagaccaacttcttgtgtgatgattgtccccggtggaggtaagtctaaaaagaacgcagataaaactgacgagtatagagatggttttgatgacattgttaaagaaatcaatgcttctgaataa

SEQ ID NO: 5197 - DNA, 882 bp, Candida albicans
atatgttggcggtttttatatactaacaatctttttaaagaggtgagattcaaacaaaaatgtaaagaattacgtaaacgtgtattggaaattgaagaaaataatgaaattgccacaattgctttaagtagaactcaagctactattagaagattaagattagaatatgctatactattggaaagattagaagatagagccactcaattgccagatggtattgttgcctttgaagaaatggcatgtccaccaacacccacaatattagatgattcattagtaaaatcaaagaccggtaataaaaaatccaaatcttcgtcatcatcttcttcttcatcctcaacaacatcatcatcagcaatgaaaatcgctttagcttccggttcatcaaaatcatcaaatggtccatcagatgttgctagtaccacaatgggtaaacaaaaagctagagatccagatttaccaaaacgtccaactaacgcttatctaatattttgtgaaatggaaaaggaaagaatcaaacaagatgatcccaatgcatctgatctttctaaaagtatgactgaagcttggaaaaatttatcagaagaacgtagaagaccatattataaattatatgaagatgatagaattagatatcaacgggaaatggcagaatataatcaaaaaaagggaggaggaggcactggtggtggtggtggtgaacctgatttgaaaaaacaaaaattggcaccacagcctgagcaagaggaagacgatgaagctaatgaaacgagaaattctccaattgttaaacaaactactgaaacggcatcaagtaatgagaataaacaaacaacaaacgtcataaaatctgaagaaaatggtgccatagctgctgaa

SEQ ID NO: 5198 - DNA, 1203 bp, Candida albicans
ccgcccgcctcttatttttcatcaccatcgggtgtaactctaaatttgtttcatgccagattccgcagcttaaaaccaattagcgtcgggcacaaaacaaagatgaaaggcgacaaaaaaaaaaatttctcccttgtttttcttctcctattgtcaatttcttgttgttcgcgtagcctttttttttctcgttccacatttttcgattactcgctcctttcttctctctcctctcccgttgttctcctctcttccttcttcctcgccccccctaaaagtttatcaaataaatttttttttcttttcttcaaaactctgatcattcgctctgtccaccagcctccccccgattttctcaccagattttatttttccaacaaacttttttgttgtcaccacttttttcttccgcccacttctactaccataactacaaccaatcctttggtaccagaacacacccaatacaccctcagtcctttgacacgacacacatataattctcaaaaaaaaaaaacaaacaacacgccaatgtcagacttgaaaacaaccaaagacactcttgtctctactcttttcgaattatccaaagctgctcaagacgctgccaatgccgctattgagttttacaaggtagcttctggtggttctgatcatgtttccgctgaacaattgaaagccgtcagtgaagcattgaatactgttgcaaccttatctagcggtaatggtgccaagatagaggccaccgaaagcaagaagaagagaaagcaagaaaaggacccaaatgctccaaagaaaccattgaccatgtttttccagttttcttacgatctcagaaagaaaattggtattgaaagaaagaaaaaggacttgccttctttatctgctattgacatgaactctatgatcaaagaccgttgggatagtatcagtgaagcagaaaaggctggttacaaaaaaagatacgacgacgctatgattatttacaacatcgaaaagaagaagtacgaagagtctttgaaagatggatctgcttattatcctccaccaagtgttcaaaccccaattgttggtcatggtatcgaacaggattttgatgatgacgccactgatatagtatccagcccagaagaacctaaaaaaaagaagaagaagactgaaaagaaagaaaagaaaaagaagtctggccatggttctccatga

SEQ ID NO: 5199 - DNA, 402 bp, Candida albicans
tctgaactaaattatttacaaatgtctgccccaaatccaaaagctttcccattggctgattctgctttgactcaacaaatcttagatgttgtgcaacaatcccaaaacttgagacaattaaagaaaggtgctaatgaagccaccaagactttgaacagaggtatttcagaattcattatcatggctgctgataccgagccaattgaaattttgttgcatttgccattgttatgtgaagataaaaacgttccatacgtttttgttccttctaaagctgctttaggtagagcctgtggtgtttccagaccagttattgctgcttctgtcacctcaaatgatgcatcttcaatcaagaaccaaatttacggtatcaaagacaagattgaaactttgttgatctaa

SEQ ID NO: 5200 - DNA, 618 bp, Candida albicans
ttttttttttatattggaaaaaatttttttgagttcttaaaattgtttacgtgtacaaaaggccaaaacataattagtttgaacacgacaaatttttttttaacagggcttattttcttcttctttttttatgtatggcatgttcgtgtctttttggataaaatcataaaaacaagaatgtcaaatttacaggatttaataaaccatgatgatgatgaatacctaccatccccatctccaccacaacaaccagaaccacaacatgcaagctcactggaattgaaaacttctactacagaagatttacctgattcagtaactcaagaacatatattgacaagttttgaaaaaataaaaacccatttcccggctgcaagaattaagaaaattatgcaaagtgatgaagaaataggtaaagttgctcaagctacaccagttatagttggaagagcattagaaatatttatggctaatttggttgaagtgtcattattagaagctaaaaaacaaggcgtcaaaagaattactgcttcacatgttaaatcggcaattgaaaacactgaacaatttgatttcttagtggaagcggttgaaaagtatccatctttgagaaattga

SEQ ID NO: 5201 - DNA, 1734 bp, Candida albicans
  unsure (712): Identity of nucleotide sequences at the above locations are unknown.
attaaaatttcaacacaattacatatcatcaacaagagaacacaaacaatgtcagctgaacccgaaataccaaaagttgaagttcccaagttagaagaatctgttactgaagatactccagccccaacaacagatgaccaaaacaaccagacgccgcaagtcattgatgttgaaaagctacaacacgaatttcaggaatcggccaaaagatacttggtggaacaaacagctcaagtgatcgttccatcatttgccaagtggtttgatttgagcaaaatacatgacattgagaaaaaatcgttgccagatttctttgttgaagatggctccggttataaatcatcacaggattacaagtacattcgagattttattgtcaatacttttagattaaaccccaaggaatatttgacaattactgctgttcgtagaaatttgtctggggatgtaaccaatataataagaattcatcaatttttggagcagtgggggttaatcaactaccaaattgaccctaaaaccaaatcatcagttttgggcccacaatatactggccatttccaaatcacattggatgcaccacaaggcttggtaccatttgttccagaaaatgccgaattgacaaaggcaactccatcaaatgttacaaagactgacgacttgaacaacgaaaatatacctaccgcaaaggaaaatgagttgccattgaatntggaaatcagacgtaatgtttatgcaactggggaaaagaagacaaattacaaaactaacaatattgttcattattcgtgcagtatttgtggtaaagatacaactgaggtcaggtatcacaacttgaaaataaaatcctacatgtacaacccaacatcaaccataaacaatgccagtgttttatgtgaaatttgctatgaccaaggcttgtttccactgagctttcattcgtctgattttattcaattgaaaagaaccgaagaaggagagaaatggagcgaacaggaaatcttgttattattagaaggtattgaaatgtttggaacttatgaaccaccatcttctactggcccagtaaatgtcaatgcaaacttgaacaatcaatgggataaaatcagtgaacatgttgctacgaaaaccagagaacagtgtatcatcaagtttatccaattaccaattgaggacaagttcttgacaaagttaataaaagaagaaaacgaaaaagacacaacaaaaagtgtagtatcacaaagcttggtacaggatattgctgccaaattagtttctactactgagggccgtgaatttatcctgcaaaatgctgaagaaaatttaaagcatgcacaattggagcaaacaaatttggtgaaccaagtaattgaattgacattggagaagttcaatttgaaattgaaaaagattgatgaattgcaagctaatttgctcaagtacgaaaatcaattgaacttagagagaaaacagattcttctcgaaagatgggtccaatttgaaaagatatccaagttgaaagaatcaaaccccgaattatccactgttttggatgacttgcttaaaccagtcaagatcaatgaaatacacaagtctgtcaaacagagtaatcaaaccgaaaatggcgacgataaaatggatgttgatgaaagcagtaatgaaaatgatgacaacacttccaagttgcccgtgagtgtcaaagaacccaaggcttaccaattttggtctggctaa

SEQ ID NO: 5202 - DNA, 1365 bp, Candida albicans
atgacgatactgataagtgaaacagatacgtttacaaccgataccaagactcgagaaaacaccccaatatatgatcctaatcatcctggcactaataacaagtacaatgtttcataccattataatcctgaagtgagtcgatttcattatggtgcccttcatccaatgaagccatttcgattaatgttgactgatcatttagttatatcttataaattatatgaaaaaatggatttatatacacctcgaagggcaacaaaagatgaattactagagtttcattctgaagattatattgattttttacaatcgataactcctgaaaaatgtaaaactataagtaatgatacattagcacaattcaatattggagatgagtgtccaatatttgacgggatgtatgattatagtgccatttatgccggggcatcattggatgctacaaggaaattgatatcaggaatgtcagatattgccatcaattggtcaggtggattacatcatgctaaaaaatttgaaccatcggggttttgctatgttaatgatattgtgttgagtataataaatttactaagggtacatccacgagtaatgtatatagatattgatttacatcatggtgatggggttcaagaagcattttataatactgatagagtgatgactgttagtttccataaatataatggtgagtttttcccaggtacagggtcagttgatgaagttggaattgggtcggggaaaaattatgctattaatgtaccattgagagatggtatagatgatgaatcatatattcgattatttaaactgattatggaaccgttaatcacgaaatttcaaccaacgtgtattgttcaacaatgtggagccgattctttagggtatgatcgtttgggttgttttaatttgaatattcgagctcatggtgaatgtgttaaatttattaaatcatttggaataccaatgttggttgttggcggtggtgggtatactccaagaaatgtcagtagattatggtgttatgaaacgagcgtattgaatgatgtcaatctagatcataaaatccctaattatttgccaacgtatgattggtttggtcctgattattcgttgcatccacaactagatggtagaattgataataagaattcgaaaaaatatcttcagagtgtgcaaactactattatggaacaaatacgatatttaaatcatgctccaagtgtgcaaatgtatgaaattcctcctgatctaactggtttaactgaggatgaagataaggcaattcaagaattaaatgaagacatggagcgagatgaaaagattatgaaagatgaaaccaaactaggagaactaatgacttag

SEQ ID NO: 5203 - DNA, 1164 bp, Candida albicans
ttgttattcaaaggagaaaaagattcaagtgggctatataggagttgtttaggatcgttatacagtctggtttgtattattgttaatagattaatgaactctgtttgtctcttatatactatttacccccaaaaagaaaatgtttgtagcgtatgtaaacaaaagaaaaacgccccccagaaaaaaccatgtccaccaccatgcaagtattgtcaaacactgccaatggcaacaaagagaaaagtgtacattacactatcagagtctgcaaccaagatagtagatctactcccgtccaataagggaagacagtcgttagtactaggtttaatcgaggcatataaattgatagacttgtgtgatggaactatagatatttatcccgctcaaactaaagatcttacaacatatcacgacgacgagtttgttaaacatttgatgggacctcgaacatttctagataaaaatttcaacaaaattgataaggcagaaacagatttaacaaatgttgtaatagaggaaaatgatctagatgagaaatatggactaactttcgattgttatccattcccatctttggacttatatgtgcagttaactgcagcttctagtataaatgctgctagaaaaatagttcaacaggtcaaggaaaccaatgatcaaataattgcagtgaattggtatggaggaagacaccattgccacaaatctcatgcagctgggttctgctatgtgaatgatgtggtactatcaattaatattctacgtaaaaatttgggttctgtgttttatcttgatttagatttgcatcatggggatggggttgaaaacgcattcaagttttccaaaaaagttgctacttgttcgatacatagatatgatattggattctatcctggtactgggagtttaaaaagctctagggagaatacatacaatattccaactgagaaggggctaaatgattctagtatgttatggataatcaaagaaattgtagctcccttgatactgaattttggcccaagggctattgtcattcaatgtggttgtgatggattggctctagatacacataaggaatggaatatgactattaaggggtatcgtgacagtatagactggatactaagtcattttagtgaaatttgttccaaaacggcg

SEQ ID NO: 5204 - DNA, 282 bp, Candida albicans
ttacctagtgacaaaaaaagggaaccattgagtggaattctttgtattcatttggaatctcttttacttttatgtactactagagaagctagagaataccttagagaaaagcaagtgtatgcaattatcaaagagttgcataaagctatagaggtagaacaggtggcagatttgtgtgatagagtggtgcaaatgttgaagagagatgaagcaccacagtctgctgatattgaagagatagaaagcgattcagatgatgataaaattgttgaaattgtataa

SEQ ID NO: 5205 - DNA, 540 bp, Candida albicans
atttttgttccatcgcaacatctggaactgcaaaaaagaagaaccaagattcaagaaaaaaatttttataattctttctcttacttaatacccacagtccttaccatgccaactgaattagaagagttagtgtcatttttacattcacctcaacctgctgtttcccaaatagcgttggacaacttggttggttattccactggtccacaccaaaaagtgttcagttacaacaattatgaagccatcaaggatttgaaaaatataagtaaatctaacggtaaaactttggttaaccaatctgtaactattttagcaaacttatgtgatgacttggttatgagaaaattgattgttgaagatgaagagtacttgaaatatttggccatacaaattatcaatatcaaaaacaccaatgccgatttaatgtgtatcttgttgactaatttagctaaaaatgatgccatcaacaaagtattggattttgaagtagaattagatgatgaacataaaaaagttttcttcaccacgggctggaaggtc

SEQ ID NO: 5206 - DNA, 291 bp, Candida albicans
  unsure (16): Identity of nucleotide sequences at the above locations are unknown.
gtgcggctctttccancggcgtggtgcccatcatcggcatttgagaacttaggagaagtgcaattgatcaatttccttaaagtattgacaaccgtttataatgatttattcaaattcaagtcggtattaagagattttttggtgcaattgaaagaatttggtggagatccaactgattatttgtttgctgaagataaacaaatagaaagagaagaacaagatagattacaaagagaacgagacatgcaagttggtgggttaattagaccttctgaaatggatgacgaataa

SEQ ID NO: 5207 - DNA, 1716 bp, Candida albicans
ttacccgttcataatgaaaaaattttaatttattttaaaaacactttggaacaaatttattgtatagtgccactcataactaatttgaaacaaacttataaagttgcttcatatagtgatcaatcatttttacaagatttagccatgttcttgtgtacatttttgacaaataatttagaattattagagaaacataaagaagcaggtgaattattacaaaattcattgttatatttattagaactttcccggattgaagaacgtgaattgttcaaaacttgtttagatttatggtcaacatttgtttatggattatttaaagaaattagagatttaccttccaatgaattaaccccaatgatgcaattagcttatggtaatagtttaagaccaacatcttccggtggtgcacctgacccagctcttttacagaaattcccattgagacaacaccaatatgcggaaatattatcgaaattgagattggttattattgaaaatatggcccgaccagaagaagttttaattgttgaaaatgatgaaggggaaattgttcgtgaatttgttaaagaaagtgataccattcaattatataaatccatgagagaagtgttggtttatcttactcatttgaatgttattgatactgaacaaatcatgattgaaaaattggctagacaaattgatgaaagtgaatggtcatggcaaaatattaatactttatgttgggctataggatctatatctggggccatgaatgaagatatggaaaaaagatttttggtttccgttattaaagatttattatcattaacggaaatgaaacgtggtaaagataataaagctgtggttgcatcaaacattatgtatattgttggtcaatacccaagatttttgaaagctcattggaaatttttgaaaaccgttgtcaataaattgtttgaattcatgcatgaaacacacgagggggttcaagatatggcttgtgacacttttattaagattacccacaagtgtaaaaaacattttgttgccgtgcaagcaaatgaaaccgaacccttcattaatgaaatcattagagaaatccaacagattacggaagatttacagccacaacaagtacacaccttctatgaagcatgtgggattattgttagtgctgaatataataaaactgctcgtgataaattattgagtgaattgatggcattacctaacatggcctggacggcaataatccaacaagcaggtcaagaccccgagttattgagtaatactgaaaccgtcaagattattgccaatatcatcaagactaatgttgctgtttgtaaagctttaggtccaggattttattcacaattgggtggattatacgtggatatgttatcattatataaagctgtttcacaaatgatttctgatgctgttgctaaagacggaataattgctaccaagacccctaaagtgagaggattgagaaccatcaaaaaagagattttgaaaatgattgaaacttatattaatcaagctgataatttacaagaaattgttcgtgatttggtccaaccattatttggagccgttttagaagattatagttccaatgttcctgatgctagagatgctgaagtattgagatgtttgacagcattggtttctaaagccggacatttaatccctgatggtgtggtattaattttacaaaaatgtgtctga

SEQ ID NO: 5208 - DNA, 378 bp, Candida albicans
gtaactatggatgccatattagatttttcaactgatttggatatcaaattattagatcaaacagttgacacgtttttcaaaggatctggtaatgatcaaaataatgctcaattggttttgaacaaatttcaagaacatcctgattcttggaaatttgccgataagattttatccaattcaaataatgctcaatcaaagtatattgccttatcatctttgaacaaattgatacaatatcgttggaaaactatacctgataatgaaagaattggtattagaaatttcattgtcaatatgattattagtctttgcgacaatgtacaagaatttgccactcaactagttatcagccacgcggctggaaaatcaacgtggcgg

SEQ ID NO: 5209 - DNA, 1476 bp, Candida albicans
aaccaaccaacagaattgatgaatattgttttgcttatttattgtttggccatggttattgcccatgatctacagctttttggtgatttcaagtttgaattatcggaaaattggagaaatgattgtgccaaaaaagcattggaaccaataataaatcaatgtgcagaaggtattgaaaaaatcaccccaatccagcaaaaactgattgcaatacagttatcaatttgtgaatttgaaaatgccgaaatatcctatcccagtgaatgcagatctcagaatttagacacttgtatcttactattagaaaaatcacctcagtactggacaactttcagtggctactacagagaaataagaaacatatgccatcaaatcagtttgccatttgcgaaagatcagattttacaagtttatgaaaatattaccaagttttacagaacactaatggaggaaatgaccaattctagcaaatatactgagaatatgcaaaatgaacttaaggcaaaatttgacaaattgataggcgttatagatctcatcctagcggatagagaaaagaatagagaagatcttaaaagctcgttcaatatgtttaagaacaattttgaaaaatcattaaataatgcattggtggtgataaaatattcttatgaagatgcaaactcgaatataaacgagttggagagtcatttgaattattttattaatgatatgctgcaagtttatattcttattaacgaaaaagcttcagagatgatatcagaacaagataaaatcatactgcacaatgctgatattttggaccaaatagacaaaattaaaaacattattgacagtgtgcgtgaagaaacactggaagcacatatatccaataatcaattgactcaagatcttcaaagtagcttagattacagtctttttatggtgtctaaactagattcacatcttcaacttagtatcgataatttagtggaacaaaatgaagatcttcggaaccagaattcaatggtgttcgaagaaatttttgagttgttcttgaagcacttgaatgagtcaggtcaaattgctttgggctcttttgaggctgcacttgacttatcattaaacatgctacatcagaaactaaatcaaacagaaaaatcaattgacaatctcaacaccaaggtttcagaactatttcagtttggagaatcacttaaaaaatatgcttcaagttttgttaatataccaggtactgttaagaatttgttcaatgacaggataaagcaaataaaggcatttggaaacgctgcgtttatggggcttgttttcatttttgtcacgatcattttacttctttcgtctttattaaaatcgcagttcacaaaaatacttagatttacatttattggaataccaatgattactggaattgcattggctctaatcatcttacgaattatgagtacacctaccaaagttgttgatattgattga

SEQ ID NO: 5210 - DNA, 3522 bp, Candida albicans
  unsure (630): Identity of nucleotide sequences at the above locations are unknown.
agctctggtacaggtatgtcagcatatgttgaaatcatatttgataacaccgatggtcgtttcccaataaataagccagaaatcagtattagacgtaccattgggttgaaaaaagatgattattcattagatgggaaatcagctactcgatcagatattatgaatcttttagaaagtgctgggttttctagatcgaacccatattatattgtacctcaaggtagaattaccagtttaaccaattccaaaaatcatgaacgattgaatttattaaaagaagtcagtggtgccaatgtttttgaaaataaattgaaagaatcaatgaaagaaatgaatcaatcaaatttgaaacgagcaagaattgatgagactttggttagtattgaagaaagattaaaagatttacaaattgaaagtgctgatttgaaagatttccaaaaattagataaattgaaaaaaattttagagtttaatatttttgacagggagtataatgaattgaatgaatctttggaagaattagaagaaaagcatcaatcaatattacaagaaagtaaacaagatttaattgaattagaaaaaacgcaaaaattatgtgttgaattacaagattcaatcaatgaattgaanatttctgccaaagtcttgaaattagagaaggagcaatcggatttggattgtgatcaattattgaaagttattgctgaaaaagagattaaattgagagaattatcattgaataatgagttatccaaagaacaaaacattcatattaatgaacaaattggtattcttcaactggaaataaaccaacacaaacaagaaatttctcgttataaaccagaattgaacaaattacaacaacaagaatcgagtttaaaacaacaattactggagataagctcaaagcaaagagcgttgtatgctaaacaaagtagatttctgaaatttgtgaataaaaaagatcgtgattcttggttgaatactgaaatatccaaattgaaacgacaaatcactgataaagatcaagaaatgcgtcatatttcaaatgaagtaaagactagagagtctagtttagaagaattgtctgaatcaataaaaaaattgaatgattcattaaatgatgaggaacatatcaaaacccttgccaatttgaaaacaactatcaatgattcaaagcaacaaatcactcaattggttgatcaaagaaagattttgtggcgtgatgaaattagattgaagagtgttcatgattcattgacaaatgatttgaccaatgctactaacatagtcaaccaaaccatggatagagcacaagctcaaggtattgctgcggtaaagcaaatagctcaaagattgaatctttctgaccgtgtctatgggactgttgctgaattatttaatgttaatgacaagtataaaacagcagcagaagtcattgctggtaattctttgtttcatattgttgttgatactgatgttactgctgctaccataatggaagaattgatccgtaataaagctggtagagtaacatttgttcccttgaatcgtattgataatattgaagttgaatatcctgattctcatgaaaatcaatgtcttccattgattaagaaattgaaatacaatgaacaagtttacaaggccattaatcaaatttttggtaaaactcttgttgttagtgaattactgaaaggtggtgaattgtctcgtaaatataaattgagttgtattacattagatggtgatagagttgatactagaggggttttatcaggagggtatcgtgattataaaaattcacgtattgatgctcttaaaatccagacaagaaagaaacaagaattagagaaaaccgatagagaattggtgaaagtgacagaagagattgaatcaaccaattctcaattgaataaattgaataatgaattacaattgaatgttcgagatttggatcgtttatctgttagtaaagagccaattaaaattgaattatctcaattgactaacaagaaattcaatttagatcaagaaatctcatctttgaaatctaatttacagaatttacaaaataccaagaattcaattaaagtaaatttgaaacaacatgaactggaattgaatagtgaattcacacaagttttaactcaagacgaacaaaatgaattagatgaattgtctaaactggcgattgaattggaatctaaattagatcatattgttactagatcatcagaattggataccaagatttctggaatcgaaagtgaagtgattaataatttacaaccaaaattaaacaaatatcgtcaagaacaacaaaagcaacaccaacagcaactacaactacaacaagaaagttcaaaaagttctgataccaagtcaaatctagaatatgaggaattgcaacaagaattggaaaatttacatattcaattagatactagtcaactgcgtaattcacaagttgttgagaatttgaccaaaataaatgaagaaatcaataactgtgaacaagaattagctcaagctaataagcaacaaattaaaatcattaaaaatattgaaaaattcctgaaacaaactaataatcttttgaatcaaaaactgattaaatcacaaatgagagatgatgctaatcaaaaaattcgagaattaggggtattacctgaagaagcatttcaatctgagaaatatgatcaatatagttcggatcaattactttcgaaattaaatggtattaatcaagaattgacaaaatattctcatataaataaaaaagctattgaacaattcaatttatttaatcgacaaaaggaggatttaatggccagaagaattgatttaaataattccaaagcatcaattgaaaatttaattactaatttacaacaacaaaaaaatgatgcaattaaaaaatcatttaatcaagttgctaaatcatttaaacaaatatttgaaaaattagtacctcgaggtactggtaatttaatcatgcaaaagaaaaatgacaacaacaataatgtcaatgcaaccgatgattttaattctgacaatgatgatgatgatgatgatgatgatatagataattattcaggagttgctatatctgtatcatttaattcgaaaaacgatgaacaacaaagaattgaacaattatcaggtggtcaaaaatcattatgtgccattgcattaatctttgctatacaaaattgtgatcctgctccattctatttatttgatgaaattgattcaaatcttgatactcaatatcgtattagtgttgctagattgattcatgaattatcaagaaataatgaagacaacaataataatgaaggaagaagtcgaggggcacaatttatctgtactactttcagacctgaattattacaattgagtggtgataaattttatggagtgacatttagtaataaagttagttcagttaatgagatcaataaagaggaagcaatgtcatttgttgaaggtcaacaacaacaacagcaacaactgtag

SEQ ID NO: 5211 - DNA, 603 bp, Candida albicans
tcaagaacacaacccatattaactatgactgaacaaccaatcaacaccaaaaagaagaatggggatatttctaaagcccctacgccacagaacactcctgctagtgtcaccaactcctatatgagatccaaaccaccgacggtgtccaccattcaagaatcaaacaatgaagatggtactggtgctgctgctgctgctggaggtttagcaaataatccagtattattaagtatgattcaaggtaaattaggagatttagttggtaaacaatctggatatattgataatttatctaaaccagtcaagaatcgtgtttatggattgaaatcattacaattaaatcaaatgaaattggaagcacaatttcaaaaagaattattggaattggaaaagaaatttttcgccaaatatcaaccattatatgttaaaagaaaacaaatcattaatggtgaattggaaccaactgttgaagagattgaagaaggtcaacaattagaagaagaagaaaagggaatagataaagaagatggagaagaagaagaagaggtggtagaagatgatgaagaagaagatgaactttttcaccagacggctggcaggtcc

SEQ ID NO: 5212 - DNA, 1080 bp, Candida albicans
ataagtcttcagatatctagcatggcaacttctcaagaattgacagcagacatacaagctcttgcaactagtttccccaagcgattagctaatgatagtgacaattcattacttattaatgttgcaccaactggtcgacaagccaaaagacatattcaacagattaattactccgaagagtttggagatgaccttgattttgatgaattcccatcttcgacacccggtactagaagcttaaatgaaaataaagctcaaatagaagcacaaagatattctcttgcgaaaaacacaccaacgcccaagagaatcttagaaaaaccggtgttatctgagttggttgaaaaaccagtggtgcttattcctatcaaaataatgattgagaatttgaacacaaaccaaaagttgattgattcctttatgtggaacttgaatgaaagcttgattacaccaactgagtttgcggaaattgtttgcagtgatttagatttaccattcagtatggctgcacaaatagcagactccattaatcaacagattgaagagtattcctatgcatctaatttacaactaccaaataagggcccttacaatgttaccattgatttatcagtaaacttaaataaacaattataccaagatagatttgaatgggatatgaatcaaaatgaagttacaccagaaatttttgctgaaatagttgttgatgatttggggttatcgttagaatttaagaatgccatatcacatgcattgcacgaaataattatcagagtgaaaaaagaagtaatagatggtacttttgacaatgaaatgcacaacttgcatctagtaaaaggtataatgtttgaacaaggaattagaattttcactgaaaacagtgttcaaaatggaaatgaccgttgggaacctttggtcgaagtattgacttctagtgaaatcgaaagaagagaaaatgaaagggttagaaacttgagaagattaaagagagagaatatgagaagagattacgatgatcatagtaggagaaggcaagcaggaaaaagaaggtatgatgagttagaaggagcctgggtatag

SEQ ID NO: 5213 - DNA, 1446 bp, Candida albicans
aacaaatcttcaaatcgttcatttatccacatttccttaaagctagaacaacataagttattaatggaagctacaatactcacggttcattggcacaacgacaatcagccaatctattccgttgattttcagccagaacagtctggtcttgtcaattcgtcaccaaccaagtctgctgagtcaacaagattggcaacaggaggaggtgataacaatattagaatctggaaaataacctcttcaaattcggtggaatatatgagtacattacaaaaacattctcaagctgtcaacgcagttcgattcaatcctcgaggtgacatcttagcatcagcaggtgatgatgggacattactattatggaagaaaagtgaaaatataataaaaaccttagagtcagaagaggatgaagatttgaaggaaagctggcaagttgtcggcacaattcgatcaagcacagcagagatcatggacatctgttggtcgcccaatggggagcagattgtcacaggatcaatggacaatattctccgagtctatcagttggaattttctcctggaaaaattactggtacatttattcgaagcttttctgatcatactcattatatacaaggtgtcttttgggatcctttaaacaagttcattgtcagccagtcagccgatcgtagtgttaacgtataccagatactgccttctgagtcaaacagtattgaaataaatttcaggcataagtttcaaaaatttggaaatttatatttgtattatccagagactttgcagtccttttttagaagattggcattttcaccagatggttctatactagtgacgcctgcgggattagaggaaacatcaagcaatgaaacattgaataatgttctttacatatactcacgtgcgagtctatttacctcgccgatttacaaaataacaggattgagtaagccagcaattgccgtcagtttcaatccagtcaaatacaaactggatggcccttcaacattaaaattgccatataaattggtatttgcagtggcgacacaagatggggtcgttctttattcgacacaagataattttaagcctttgggacttgtttccaatttacattatagctctattactgatttgaaatggactgttgatggttctagagttattataagttcaactgatggtttttgttcaacaatcaacttccctggtagtgcatttggtgaacgatatattggtgtacctcatgataatgacattttaagtggagaaatactacaagccaaaactgaactgaaagctgaacctgtcccctcgtcggaaataccgaacgaaaagctgccaaatctgaaaagtgataattctaagacttccatccctactattgatttattctttgacaagaaccaaaaagttaagaagagaataacgccaacactaatactgtag

SEQ ID NO: 5214 - DNA, 291 bp, Candida albicans
gtaaaaaggacaatcaggataactacggaacagcatgttttaaccgatgttcctctagtagataactttccaatgaggaaatggtcagtacaaatttctatgttggactctcaaggtaaagagcatccagcaaaaattttagacaaagttacatacacattacatccaacgtttgccaacccaataagaacattgaaacaacaaccttttagagttgaagaacaaggttggggtgaatttgatataccaattgcagttcatatcttgggtattctcagggaaagctggtga

SEQ ID NO: 5215 - DNA, 597 bp, Candida albicans
ttattattatccccatacataaaacccagcgaagacgctcagaatattagcaacgagaatgcgttaccatcaagcaaagatatcaccttgtgtattgaagatttgcatgacacattggaaatgtatcctcatttagtcgaatcggaaggtcccaaattgagattatctaacgttatgcttgagaatgacgacatgattaatgatgacttgaattattacttgccacccaaaagtatagagtatcttgcaaaagaacgtcaagcagccactaccaatgacgcttccactgggactaccaagccaggtaataataaaggtagtagtgctggtggttcttccgctggtgctaccactaattcgccagtagtaaacaaaacagattcgacggcggcagtatcagaaaagacagacacgaaccagcctttgcaaacacctactgcaacacagacaccagtacaaacatctgctcaggcaccagcatctgccccagcacaaacacctgcaccagtttctacaccaatcctaagacccgatgctcatattggaaccaccgatgaactaaaatgggtattgcacgatttagtgtcgactatgtaa

SEQ ID NO: 5216 - DNA, 447 bp, Candida albicans
ctaaagattgttgttcttctttctagtcgtcaagctcttaaaaaatacgttcaatcaaacaacgacattaaaactgccaactttgattctttgttcaacactgccttgagaaaaggtgttgaaactggtgatttcttacaaccaaaaggtccatctggtccagttaaattggccaagaaggaaaaaccggcttcatctgctgctgctggaaaagttgccaagaaagctactactaaaaaagctactgctgctgctccaaagaaagctgccaccaaaaaggctgctgctccaaagaaggtcactaaaccagctaagaaagctaccaaagctaaagctgaagcttctaccaaagaaaccaaagctgctccaaaaaagaaggccgctgctgctgctccaaagaaaaaggctgctgctcctaagaaagtaaccaaaaaatcaactaaataa

SEQ ID NO: 5217 - DNA, 504 bp, Candida albicans
tccttcaaagcaattaaaaagaaattcattacgttaacagtgattaacaaatggaacaatgaagaaaacagtcaagatttccaaagttttgctactgttaaattagtagatatagctggatcaatagatcctttccataattattgggctactcaaaatgaaccacaagttcaggaggtgtcaacaactcaggattcaatgaaacctgttgctaatattttaataaacaaaacaactcctactgtgggtacatcttctagtccgaatatattgattgctcaaaagaaaactatcaaagattctctggttttggctaatttaataaaatttgtggaaaataataatgattttactataggtacgttggtggaactatctaagaaagagttcaaagactttactaaggcattgattaaaaatacaatacaagagattgcagtttacgacaaaaagtcaagcaaatgggaaataaaagctgaaatgaaagagaaatattgttcatag

SEQ ID NO: 5218 - DNA, 1266 bp, Candida albicans
aaaaactgtttaagtccatttgttttctttttcttcacaaatcaaataacactatccaagtcatactttatagagaatcactctaatatggcgtcacagctagaaattattgatttgactaatgaaaccactgatttatctgagttatctactactcagactgaaccaattcgtactaaaagagtcgccagtctgacggtggaagtcaacaatgaagaagatttatcaccaacaaaaaagtacaaaacagactccaagtcgaattctgctgaggtaaatcagaataaatcaacagaagagaaatccttgtctaaaaaagaattagaaaaagcagaaaaggaaaaacaaaaacaagaggaaaagcttcgtaaagaacaagaaaagcttgagaagaaaagaaagcaagaagaagaaagggaattaaagagaaaacgactcgaagaagaaaaagaattgaaaaagcaaaaacaagaagaagaaagaagggcaaaagagcttaaaaaggaggaagaaagacttcaaaaggaaaaggaaaagcaagagaaagaaaggctaagattagaaaagaaacaaaagttggaggaacaaagattggccaaggaagcagaaaagaaacgacttgaagaggagaagagaaagatcgaagaagccaaagaaagaagtcaaatgaaaatctctagtttttttcaaattggacagaaacgtaaagagaaaaaagtatcattggactcatctgaaacagatgctactaaagctacccctaaatcgttttatgaaactgagtttttaccattctttgttcaaaagaatgtaagcttgatgagtattgacaaccaggatatcctgggattcaagagtattcttgacgactttataaatggaaaattgcagaaagagctgtctttcaaatcatatcttagtaaattcacaaaatcttctccttcaactaccaacgacatcacacccgaagagatcattaatgccctaaactcacccacaacaactgaaaaccaagtttatcaattaattcaagatctacctcctatcaagtatattagtttttatgaaaactcaaagcctccatatattgggacttattgttcgttggctcatcaaaaatgccatgacgctataattcaaaatccacttgataatgagataactggtctagattatggctatgattcagatttagaatggaataaggaggatgaagaaggtgaagctatagctcttcaccacgggactgcaggagcgcgttatggt

SEQ ID NO: 5219 - DNA, 702 bp, Candida albicans
tttaaatataacaacaacaactactacaacaacccacaacctacagccacaattactcctataatgtcagccgaagatactaaaccaaagactgaagaatcaacttctattccaaaaccaccaacttctaatgtattctccatgtttggtgccaaaaaagagaaaaaaccagaacaagaagattcagacaacaagaaagaatccgataaaaaggaagaaaaagatactagcaaatcaaccggcgatgacaatgaagtagctgaagaagaagaagctgatgtcgaatttactccagttgttcaattggataaaaaagttgacgttaaaaccaatgaagaagatgaggaagtcttgtataaagttagagccaaattatttagattccatggtgattcaaaagaatggaaagaaagaggtactggtgatgttaaatttttaaaacataaaactactggtaaagtcagaattttaatgagaagagataaaactttgaaaatttgtgctaatcatttgatttctgctgattatgaattgaaaccaaatattggttctgatagatcttgggtttatactgttactgctgatgtttctgaaggtgaacctgaagctcaaactttagctattagatttggtaataaagaaaatgctgatcttttcaaagaacactttgataatgctaaaaaggaagctaaaaaagattaa

SEQ ID NO: 5220 - DNA, 258 bp, Candida albicans
tatggatctaataacgaattgattgttaaccaaaccccaaaaattgttgaggtatttgctggtgccttcaaagctgatgccgaaagaattaagttaattaatgaatctactctgggcagagaagaaaacattgattccttgaaccaattttctagtgatgatttgaaaaatagagttgtggaattattgaagtacttggatcaaaaattctcaggggttgtttcatctaatgaaattttgaaatctctcgtcgcttag

SEQ ID NO: 5221 - DNA, 630 bp, Candida albicans
aaactcttatggtatgagagaaggtgctatgagcctgcttattcaaaattacccaaaaccaatgttttgttgctgttccaaggtgaaaactttaaagctccaaaaggtgttccaaaacaatcttatgttgaagccaatattttgcaattgattcaaaatcttagaaaagtctctatttcacttttggaagaagaattcgaatcaactatggtggctagtattttggacggtgttgccaccgcacttttcacttttggaccaatttttgttgttgatgaaccaagtaacacagaacttttggaaaaattatgcacaactttgatgttgcttttgaaacaagaacatcaatgtcaaattgatgatgatgagatgccaaatgaagaagaagactcttctgaaactgaagttatgttgaatgaagctacattagaagttttgattaacttgtcacttgctttgcaatccgatttcgttcaaatctttggttctttcaaagatatcatattagctaaatttaacagtaaatctaaaccattaagagtcggctcaattggtgctattgctgaaatggttgaaggaatgaaagaagctaatccgtactcagaagaacttttgcaaattttcgagtga

SEQ ID NO: 5222 - DNA, 2253 bp, Candida albicans
tcacatatggatgctcaatttgtatcatctttggaggaaactttaaagcaaaccttggttccagactcatcggtaatcaaacaagcttcaagtaaattgactaaagatttttatccaaaccttattgcattaccagctttgcttcaaatttctcaaacaaccaaacaagatgaaataaagcagttatcattggttgaagctagaaaattggctttagaccaatgggaaacagttgatgcttcattgaaacctactcttagagaatctttgttgaaaggtacttttgaagaacaaaataaacgtctcagaaacttatctgcctatgttattgctgccattggagaagttgatttggacaaaaacgaatggcaagaccttttacctactttattcagtgcagttcaaaacactgacgttcacactagagaagttggtacttttgttttgttcgctttgttggaatctcaaatagctactgtgatccctcatatcagtgacttattgtccttgtttggtactttattgaatgattcagaatctaaggaagttagaattaactccataatgtcattggatgttatttctcaaatcattgaagaagatgaagaacgtactgttgaattggctggcaaatttcaatcaactgttccaagcatgattaatattttcaaagacgtcattagtggtgatgatgttgaactggccaagagcgttttcaatgtcttcaacagtttaatccttgttgattctaaattggttggtgaccatttgatcaccatgatccaaattattgctgagatggttacaaaccaacaattggacgaggaattcaagatttttggcttgcaatttttaatttcttgtgtcagttacagaaaatctaagatctcaggaaacaaattgggacctcaaataactttagttgctttgaaagtggcttcaggtgaaattgatatcgaggacgaattaggaaatgaagatgaagaaaacgaaaatgaggaaaatagccctccttctttggctttgcgtttgttggctgttttgagtgctgaattgccaccttctcaagttgtcaatccattatttgatgctttgccacaagtcttgacttcaacaaatcaatttgaaagaagagctggattattggccattggtgtcagttctgccggtgctccagatttcatttctctccaaattcaaaaaattatcccatcaattgttaacggtttgaaagatacagagcttatagtcaaagttgccgctttgagaacattaggtcaattgacttcagaacttcaagacattgttaccgagtaccacgaacaattgttgcctttgataattgaaattattgattccgcttcctcagttgtggcttatagatatgcatgtgttgctttagatggattaattgaattcatgagccacaatgcaatgggcaagtacattgaaccattgactcacaaattattccacatgttacaacaagccaattctgcaactttgaaatctgctattgtttcagctattggttctactgcctttgccagtggtaaagcttatactccatattttgaagcttccgttcagcaattggaaccttttattgcaaactctgcttctgttgaaggtttaactgaagatgatattgaattgagagcagttacctttgaaaacatttctactatggccagagcagtcggttcagaatcattttctgcttatgctaaaccattggttgaagctgcttacaactctttaagctccgaacattccagaataagagaatctggttttgcttttattgctaatatggctaaagtttatggaactgagtttgctggcttcttggaccaaattgttcctaaaattcttgaatgtttgaagcaagaagaattcagtttcaatttaggtgatccagaaggtgatgaaccagaatttgatgaagatgatgaggatgctgatccattaaagattcatactggtattactatcgaaaaagaaatggcatctgttgctttgggagaattggctgttggtactggtaatcaattcttcccatatgttgaatccactattgctgtcttgcaagaccaaattgaaaactcttatggtatgagagaaggtgctatgagcctgcttattcaaaattacccaaaaccaatgttttgttgctgttccaaggtgaaaactttaaagctccaaaaggtgttccaaaacaatcttatgttgaagccaatattttgcaattga

SEQ ID NO: 5223 - DNA, 615 bp, Candida albicans
aacacttttaactttttcacatattataaaagattagacagtttctcaagcatatatccctcacagaacatgatgtccacaaattttcaatggccaggaaccaataagaatgataatacagaagtatctgttgaaacaccatcaagcacagatcctcatgtccctcgctatccatttaccgcaatgtcacatgcgacggcaagcacaactatgaagaaaagaaagcgagacgattttgatggcgacaagtcaacaactatcaccatgaataccacgacgacacgtaaatacatacaatcatctttaggatcttccaagttcaagaaggccaaaacacccaaaatcagtgggcaacctttgccactacctagattgattgaatcattagacaaatccaatttacaaaaacttgtgcaagatttaataactgttcatcctgaattacaatgtacattaattaaaatttcccctagaccttctattcaagattccattcaacttttacaagacaaatttgatatgattatatctcatttaccttacaaatgtgatgttgaaagtgattattcatatttaagtatcaaacttttattggcacgaatggtcctcatcttt

SEQ ID NO: 5224 - DNA, 1062 bp, Candida albicans
aggaaaaacatcacttggcttccactctttacgattacaccagcgtccaatcattgtatttttacgacagaaataatggcatcagtagaagttgaattaggagttactccagaaaccacttattcaatttcaggaaaacaactaaaatttgattctgaatcggatattgctccatatatcaaggaattgacggaaaaagaaaatgtcaaaaaagttgatttttcaggagatactattggtattgaagcatcaaaagcattaagtgaagcattattaagacataaagacactatcgttgaaatcaacttttctgatttatacactggtagattgaatactgaaattcctcaatctttagagtatttgttaccagcattgttgaaattgccaaatttgaaattgatcaacttgagtgacaatgcttttggattgcaaactattgatccaattgaagcttatttggccaaagctgtttccatcgagcatttgattttgtcaaacaatggtatgggtccatttgctgggtcaagaattggaggatctttgtttaagttagctaaggctaagaaagcagaaggaaaggagtctttgaaaacatttatttgtggtagaaacagattggaaaatggttctgttaactatttatctgttgggttaagaaatcacaaggatttggaagtggttagattgtatcaaaatggtattagacctgctggtatttctaaattggttgagcaaggtttatctaacaacaaaaaattaaaagtgcttgatttgcaagacaataccatcactaccagaggagctattcacattgcagaatcattatctaactggccacttttggttgagttgaatcttaacgattccttattgaagaacaaaggttctttgaaattagtcgaagccttccatgctggagatgaaaaaccgcaattaattaccttgaaattacaatataatgagttagaaacagatagtttaagagttttggctgatgcaattgccagtaaattaccacaattgaatcttcaccacggggctggaaggacccgcgctagc

SEQ ID NO: 5225 - DNA, 2217 bp, Candida albicans
  unsure (142): Identity of nucleotide sequences at the above locations are unknown.
aaaaacccaaatttaacggattctgaattcaatcaaagaactcaggaattgatttcggataatgttgaacaatttatgatgattttgaaaaatttgacggaatcaaacaccaataacaatgcatcaatgaattcatccattntagattgtctaaatagttggattaaagaatgtgccgtggaacaagttttacaaataaattctttggtttctttggtatttcaaagtttatcaaatgatcaaacatttgaaaaggctattgaatgtttagtcaccatcattcgtgaaactagagatattgataactatgaaatcattgatgctttgtatcaacaagttttacaattgaataaatacatgcatgaaaacacacctgacaaattagaggatccagagtacgtggatggtttaaccagattatacgttgagtgtggagaatcatggcatgttttgattgggaaaaatcctgcccatttcaaacctttagtgttgattattttagagtgtacaaaatacgatgaagatttggatattgtgaaatatactttccaattttggtatcaattgaaacagttgatcactttgcctaaattccaagagtctaaagctgtatttggtgatatttatttacaattaattaccgtgatcattaaacatttgacatatccaataagtggcaatgataatgatttattcaatggtgacaaagaacaagaagataaattcaaggagtttagatacgaaatgggtgatgtgttgaaagattgttgtgcagttgccggagccaccaaggcgttacaagtgccatttgaacaaattcaaaatataatttccaattcccagggacattggcaatatttggaagcacctttattttcaatgagaactatggctaaagaggtgccattaaaagaaaacactatcttacctaccatcatgtcttatttggttcaattaccagaacatccaaaaatcagatatgcggccactttagttttgggaagatatactgaatggacatctaaacatccagaatttttggaaccacaattgaactacattaccaaagggtttgaagtagccgataaaaacaacgatattataatggctacatctcatgcattgatgtatttctgtcaagattgttctgaatttctcgtcaattatttggaacagttatacatgttatatggacaagtaaaagatcaaatggatttggaatcaaattatgaattagctgatgggttagctcatgttattgctaaagtcccaatagacagtttgtacaagaccacagaaatgtttattgaaccaacaatgaattacttgagtaaagttttagcagaaaatcctaccgatgaatcaaacaaattgattgctgatcagattgaagtcatcagtatatttattgaagttttgaaatgtcctgattctgattgggaaaaacctaaatatccagttgctggtttatttgttgataaaatttggccattgactactcaaattttaagtaaatttggatcatcagttatcgttagtgaaaggtgtatgaaattattgaaaaatgccatcaaatcatttgggttatttttgagtagtattttaccagatttagctaatcttctacatcaaggattacaatctactcaatttggatgttacatatgggtaactggggttttgatcagagaatttggtgatgaatattctcctgaagcaattaaaaatgctgtttacgaatttggtttacaacagtccttgacagtgtttgatttattgttttccaaatctgaagaacaattgaaacaaatccctgatgttattgaagattttttccatatgatcaatgatttattaatgttttatccattccaattgattcccaaatttgacattttgaaaaacgttttcaaagttgtcgatttgacattatcttatgttaatgaatttgaaccaataatatcatgtattcattttatgatagatttgatttcttgggggttaccaaatccaccaatttcattattcgatatgggtgacacgtcacctttgagagaggcggtgcagcaatctttattaattgataatcaacgaggagaattatcacgtgtcactttgaatggtatccttttcaaattccataatgatatccaacaggatgccaatgatttgatgttgaaaatctcaattgttgtgcctaataacgatattgcatta

SEQ ID NO: 5226 - DNA, 564 bp, Candida albicans
tccctacagtctagggcggatccgggctattcccgtagggtgaagacagttagtttcgatattgatgctaatggtatcttgaatgtttctgctttagaaaaaggtactggtaaaactcaaaagattactatcaccaacgataaaggtagattatccaaagaagaaattgataaaatggttagtgaagctgaaaaattcaaagaagaagatgaaaaggaagctgctagagtccaagccaagaatcaattggaatcttatgcttatccattgaaaaacacaatcaatgatggtgaaatgaaagataagattggtgcagatgataaagaaaaattaactaaagccattgatgaaactatttcttggttagatgcatctcaagctgcttctactgaagaatacgaagataaacgtaaagaattagaatcagttgctaatccaatcattagtggtgcttatggtgctgccggtggcgctccaggtggtgcaggcggatttccacgtgctggtggcttcccaggtggtgcccccaggtgccggtggtccaggtggtgctactggtggtga

SEQ ID NO: 5227 - DNA, 1101 bp, Candida albicans
  unsure (281): Identity of nucleotide sequences at the above locations are unknown.
ttttatatgattgtgtgcaaacatttgttgaaaaaaatggggtatgagaatttatcattgaaaccagaatatccacaaacattattaccacctttattaagtaaatgggaacaactagatgatgatgatactgatctttggccattattagaatgtatggcatcaattgctgcatcattaagagaaatttttgccccttatgctgtccctgtatatgaacgggccacgaaaattttatccaactgtatattgttagatcaagaatgtcatactgatcctgntattgacccaccggaaaaagattttatggtgacatcattagatttgattgatggattagtacaagggtttgaatatcattcggttgatttaatcaatcaaaatcataaatctaatttgattgaattaatgttgatttgttttgaagattataatggtgatgttagacaatcagcttatgcattattaggagatttggccattttcaccattgaattgttaaaaccttatttacgacaaattttcatatcgattggtaatgaaatcaataatcgtacttacgaaacttatcctgtttataataatgctatatgggcattaggtgaaatgatcattagattaccaatagaagaaactaaaccatatattgataatttagtggatttattaattcctgttcttaatagtaatgatattcaatctacggtagcagaaaatgccgctatttgtttaggaagaatggggattaatgctgctgaattagtcaatgggaaattaaatcaattcattgaagcatggtgttcgagatttttatatttaattgataataatgaaaaggaaactggtttccaaggtattattaatatgattaatttaaatcccgataatggatttggaggattatcaactcaacatggtaaaaaaaatttagcagcatttttagcttgtattggaaattatcaagaaattccttcaaatgaattacaacatttatttattgatttaattaataattataaatctttattaggaaatgaaaattggaatcaaatattacaatttattgatccagaaattagaaatcgattgaatagtatataa

SEQ ID NO: 5228 - DNA, 1668 bp, Candida albicans
gtttttgagataaacatgtcttggacacctgatccgcaagcattagaacaattgaaacatattttcaaagggactttatcgagtaataatgaagaaagaagattagccaatgaagcgttaattcaagcaaaacaacaacccgaaattgaaaattatttatttactttattaatcgatgacggtaatggtagtagtaatggctctagcaatggatcaactacagcaactactggtactactacaactacaagatcagatgttcgtgcagcagcagggattaatttgaaaaataatatattaaagaataaatctattgatcgaacttatttaataaacaatattatgaaaggattaatgtcacctgattcattagtaagaaatattactgggaatgtcattacttcaatgttttcaatttatggattagataattggtcttctgctttaactgatttgttaaatttgattcaacaacctcctattggtgataataataacaatagttatatcccacaagaggcagccatgagcgctctaagtaaaatatgtgaagattcttatttagaattagatcgtgaattccaaaataatcgtcctttgaattatttaattggagaatttttgaaattgattgaacaacatccaagtggtaaaattaaagctggagccattcattgtataaatcaatttatccctttgaacacacaaagttttttaattgtgttagatgattatcttaataaaatttttaatttagctggtcatgatggtcaacaaaataatgaagttcggaaaaatatttgtacgtcattcttattaaatgttgaaactagaccagataaattattacctcatttagatggagtaatcaattattgtttacatttaatgcaacaagatactagtactgaagtttcattagaagcttgtgaattcatgttggcattagcaactaataaagaattgaatgttttcacacccgagaaattgaaaataattttaccaatattattagataaaatggtatattcagaagaagaaattttccttattgaaattgctgattctaaagatgatgctaatgttgtggataaagatgaagatattaaacccaccaatgccaaatcgaaagaaactagaaatggcaattcacgcaattctggttctggcgatgacaacggaaacgacgatgatgacgacgacgatgatgatgatgacgacgatgatggtgaattggaacaatggagtttaagaaaatgtgctgctgccacattagatgtattgagtgaatctttagctcaagaagtattattggtgactttgcccattttacaagaaaaaatcgtttcaccaaattggccaatacgtgaagcagccatattagcctttggagccatgagcaatagttttatgaaattatcaggtaatgaattacctagtttggtgccatttttagtagaccgtttgcaagataatgaacccagagtacgacaaataacatgtgggacattatcgagatattctacttgggttagtgaagaagctcatgaaggtggtcaatatgccaattatttccaaccaacattccaatctattgttgcttgttgcttggattcgaaaaaaattgtcccaagaagctgcattttcagcattatcatcaattattga

SEQ ID NO: 5229 - DNA, 741 bp, Candida albicans
tcatcaatgtgtcgacatggacctaaaggaatgtgtgaatattgttcaccattaccaccatgggatgaaaattatcgtaaagatcacgctataagacatatatcatttcatgcttatttaaaacaacaattggaaaaattgaaatcatccggtggatcatatttcccccctttagaccccgtggattattctattgatttaacatgtaatcaaggtcataaaccttatcctaatggtatatgttctaaatgtcaaccatctccaataactttacaattacaaaaattcagaatggttgatcatttagaatttgctgattcatttattttaaatgattttattaatgtttggagagttagtggtgtacaaagatttggttatttatatggtagatatgctaaatctgagaaaacacctttaggtataaaagctattgtggaaactataattgaaccaccacaacatgatgaattagatggaattacattattagattgggatcaacaagaagaaaaaatggtggatcaagtggctaataaatttggactttataaagtagggatcattttcactgatttaactgatgctggtactaaaaatggtaaagtattatgtaaaagacataaagatagttattttttaactaatttagaaatcattatggcagctaaatttcaattgaaatatcctaatatatctaactataggtctctcactacgaagcagccggaccgcctattt

SEQ ID NO: 5230 - DNA, 387 bp, Candida albicans
caacgtcttgcttttatagttgattttaacgctgtggccactgaattctgtaacttttactataaccaatttgattctgacagatcacaattaggtaacttatacagaaatgagtcaatgttgacttttgaaacttctcaattgcaaggagctagagatattgttgaaaaattagcatctttaccattccaaaaggttgcacacagaatttccactttggatgctcaacctgcttctgcaaatggtgacattttagtcatggttactggggaattattgattgatgaagagcaaaatgcccaacgttattcacaagttttccatttgatcccagataatggttcctattacgtgtttaatgacatctttagattgaattattcctag

SEQ ID NO: 5231 - DNA, 1128 bp, Candida albicans
tccacaggacttttctccttgttttttttttttagtttagttcaacttatacatttagaaacggaattaaagagctctattataaagaaatactcaatccaaatgcctgacgagagtccaagtaaaagaaaaattgattcagacgaactgacatcagttcaattgaaaagaacaaagtcgattgctcatgatgatttacgacaatctattgtaaaagaaattacaaaaacttttgaagaacgaattctgaaattggaagcaagaattctgaaattggaggaggaatttccaaatgaagaagaagaaaagtcagaagaagagaaggaagaagagaaagaaacaaagaaagaaaacgcagcaagtatagacaatcaacaaccagacaggaggatattaaataaagagccaccaccacttcctaaaagacaagccacttttggatccaactcgttcagcttttctccaggaaagatcacaccattaaactcattcaatgatacaaacactgttcctaacagccctaaaccagtatttggcgccactacgtcttttggaaacatgaataaattaagtgctagctcaacaccagaaccagcaaaatcaacaatcaccaccacatcatcatcatcgaccacattatcaaaaccaacaacatccaccccagctacctttggatctgcatttggctccaacactcgattttccaacgcgtttcaagattcgattaagaaaaagtcattccttgacaaagaggatgacaaacaatcaactgttgataacaacaacaatgacaaagacaaagaaaacgacaataacaccaacaacgtatcgaaaccacaagaattcaaacaagttgacttggtaccagtggagcaaacaaccggtgaagaagatgaaatatcacattttaactgtacagccaagatattcgagttgaacttatcaaaaatcagcgaaggttggaaagagagaggtgtgggaccattgcatctagatcaatcgaaagcagataaacgacaaattagactagtcatgaggtcacaagggttattgagagtagtattgaactataaaataaccgcagatactgtcttcaccacgggtggaagatccgcgtgcctctcgaat

SEQ ID NO: 5232 - DNA, 243 bp, Candida albicans
gttacccttgatcctcaaatgtcaagtagtgaatcggttgcacgttccgctgctggtcttttgggtgacattgctgcaatgtatccaaatggtgaatttaaacaagtatttactgaagaatgggtcactgattttattaaaagaactagatcaaatccattgtttgataataaaacaaaggatgcagcaaggtgggctagagatcaacaaaaaagacaacaacaacaagtttttggtcaataa

SEQ ID NO: 5233 - DNA, 261 bp, Candida albicans
  unsure (56): Identity of nucleotide sequences at the above locations are unknown.
aagcccgcggtggtatctgcattgggggatattgccactgccatgggtcctgattntgctccttatcttgaatttgtggggagaacatgtactgaagcgggtaatattcaacctcaagatggatcaattgatacgttggattttgttttcaatgtaagggaatcagtattagattgttttgttggtattgttggaggattcataaatcaacctcaagctttagcaccagcaattgtcaccatattacaatatttacaataa

SEQ ID NO: 5234 - DNA, 1239 bp, Candida albicans
tttttaattttattttattttaaaacgatggatattcttcaaatattagaagctgctttgggtacagcagatccaaatcaacgaactcaagcagaaatacaattgaatgaagcagcaaataatcatttccccgaatatcttcaattattaattgaagctttagtcaatgaagatgctaaaactgaagtgagaatgttggctggtcttgccttaaaaaatcaattagttgccaaagataataaaacaaaattggctcaacaagaaagatggttaaaattagatggagaattgaaatctaaaattaaacaaacggctcttcaaggtttaaatataactgatcaaaaagttgccaatactgctgctcaattagttgctgctattgccgatattgaattacctagagcagaatggtcagaattaatacctacaattatggaaaataccaagactgataatccagaaaatgtgaaaagaagttcacttttggccattggatatatttgtgaaagtgctgaccctaatgatcccaacattttaagtcaagctagtggtattttgattgctgttgttcaaggagctcaaagtagtgaaccttctaaacaagtaagattaaccgcattgaatgctttagtaaattctttggaatttataaaatttaattttgaaaatgaaggtgaaagaaattatattatgcaagttgtttgtgaagctactcaagctgatgattcagaattacaagctagtgcttttggttgtttagcaagaatcatgtcattatattatcggtttatgtcactttatatggaaaaggcattatatggattaaccatttctggtatgcaaagtgctgatgaaaaagtttcatgcatggccgttgaattttggtctacagtttgtgaagaagaattagaaattgccttacaaaaacatgaattaggtttagattctttacaagcagctcaaaaccccgatttaataacttttaattttgcccttattgcatcaggtgaagtattacctacattattaacgttattaaccagacaaaatgaagatcctgaagatgatgattggtcggttgccatggctgctggtgcctgtttacaattatttgctcaaaacattggtaattatgttgttgaaccaaccatacattttgttggatccaatttagccaataaagagaattggagagctagagtaagcgccgttatggcttttggatcaattttggatgga

SEQ ID NO: 5235 - DNA, 1314 bp, Candida albicans
tctgaaagtatcatatatgaaaccctgaggtcagctatcgccatgtcatttgaaataggtcaatcagttgttgtcaagaatgatataggtagtataaagtacattggcacaacaaaatttgctccaggtgtgtggtatgggattgaattgttacaaccgaaaggtaaaaataatggcagtgtacaaggtgtgaaatactttgactgtaaggaagatgataacggtttttacggaatatttgtgaaagggagtatgctaaatgctttggaagataataagaatagcaagtcagaggatgttgctcaatacaataagactattgaaaaattaaaactgaagttgaaggcagtaactgatgaatctataagacaccgtgagaaattaattgcaatacaactggagttacaaactaaaatagagataatgaagagtatggaatcaaagttggaaatgcaaactgtggaaaatgagtatttaaagctgatcaaattggatctagaagaaaaactacgccaattatcagttgagcatcaagaattgaagaatgaattcgagttaatccaagaggaattggagatcaatcgtgagatagaaagagaaatggaactgctagactctgatcattattctcctggtgatgtgagaatgatttttgagaagaacaggcgtttagaggatactttggcgttattaactcgcaactcaaaggaaaccgaaattaaattaaaacatgagttggaacatttgcaaagtgaacagctcaatatgaatgagttacaaaagaaattggatcaagctgagtctgtggttaggatgttgcaggaacgtatagaaaccactgaggatatggataaaatgatggaacgcttaactgttgaaaatgaggacttgacaaacaaaatccatactttgatgatgactatagatgatttaaacgaaatacatgaattggacaagaaactcgaagaagatcaaaagcaggtggaactcgatcttcgacaagaaatagacagtcttcagcaaattattcgacaggataaattgaagatcaacgagttagaaagtaacaggcttgctcaattgccgcataccgataagtccttggaatcaccttctagaagcgatcaggaatcagaattgcaggtcttaaggcaaactatctctgatttgagattaaaatctaggtctgattcggttcaattaaaattggtaaaagcgagatacgaaattctacagcaaaggattgtttactctcaagccagcatgaagtttccaggattgattgatttaatttttatgttaaagttggggtgt

SEQ ID NO: 5236 - DNA, 2472 bp, Candida albicans
aaatttgttaatataaacccaaagtttctaacaggctctgtttgctcgactaaaaaagaattttgtcaaacgcgtatcagaatgtttaccctttttttttttaccacagatcaaatgaatgttcgacctaatgctccgtttcggcctcctagaccaataaaggggggtgttgcggtggtgcagaaagtagtaaaacgaaaattgcccactaccaccaatcctaaacctgcaaagattttgactaccgatcccggctcaacaaaatacgtgatccaatggagaaagaaaacttcaaagaagaacaaaacatgggacggtgatgggtatgccgtgattaaacagcttgagaatggggcatgcgagatatctatcaagaactctgatggcaaacctatggggaaaagagtgtttactgcgacacctaaccttgacgacgtgattagtgtgggaccctatgaattagaattagacgaaaaagtagggtctaactcaacttcccagacagtgacacgtgttacccaccagttcaaaaaggttgctcctcccacagctagtagtcggaaaccgctttatgacgattgtgccgatgccattgcgttgcctcctcctccaaaagccaaagattatgtcaaagtaaatatcgatccacatttggcaaaagtgtttcgtccgcatcaggttgaaggtgtgaagtttatgtatgagtgtttaatggggtaccgtgggtttggcgggcacgggtgtttgttagcagatgaaatggggttggggaaaacgttgatgacaatcactacaatctggacgttgctcaaacaaaacccgtttatggaaaaaggtgcagtggtaaataaggtattggtggtgtgtcctgtcacgcttatttccaattggagacaggagtttaggaaatggttaggtgctaataagctaaacgtgttgacgctcaacaacccaatgtcaaacgagaaacaggatatactcaattttggaaagttgaatgtgtaccaagtgttagtggtgaattatgaaaaacttgtggcacattttgatgaactctcagcggtcaagtttgatttgttagtgtgtgacgagggccatcgtttgaagaatagtgcaaataaagtattgaataatcttatcaagctcaatattccgaagaaaattgttttgacgggtacgccgattcaaaacgagttggtagagtttcacacgttgatctcgtttctcaacccgggtgtgcttcccgagctaaaattgtttcagcgaaactttataacacctatatctagggcccgagatatcaactgttttgaccctgaagtgaagaaacgcggtgaagagatatcgcagcagttgattgaattgactcagagttttattcttagacgtacacaagcgattttggctaattacttgacacagaaaactgacattttgttgtttgttccacctacatcgttgcagctcaagttgttcgactatataaccaacttgaagaaatttaatcagtttgaggcatttaccatgatcaatttgtttaaaaagatttgcaattccccttcgttgttggccgacgacgagttatttaaaaagattgttgaagaaaagtttaatttggggatggcatccggtaaaataaacattcttgtgccgttgctattggaaattgcttcgcttggggaaaagattgtcttaatttccaactacaccaagactttggacttgttggaacaggttttgcgcaaggtcagcctaacattttcgagattagatgggtcgacccccaacaatgtgcgtagcaagttggttaatcagtttaacacgaaccccgacataaacgtatttttattgtcgtcgaaatctggcgggatggggatcaacttggtcggggcttcgaggttgattttgtttgacaatgactggaacccagcgaccgatttgcaatcgatgtcgcgaattcacagagacggacaattgaaaccgtgtttcatttataggctattcaccacggggtgtattgacgagaaaatctttcagcgacagctcgtgaagaacaaattgagttccaagtttttggacaatgacgccacgtccaaatctgatgtgtttgacaatgatgatttgaagaatatttttgagatagatacatcgacaatatccaatactcatgatttattagagtgtgtgtgtgagggcgacgggtcgatgttgagtcagccaaccatagaggaaagcgaaccacccccaaaacaagcatgggttactgcattagagcttaagaagaagattgacgatggtgaggcgctaaagaggacggctgttaaatttgccttgaacgattatcgacactacaatccagaggtgaaccgtaatttggattttgattctgcgctacaccgaattgctaacaattcaagctatgaaaataagcaattgccaattacatttataatgctgagagtaactaattaa

SEQ ID NO: 5237 - DNA, 1782 bp, Candida albicans
aaaatgtctacattatttggaggtcagcaactgactcaacctagtttgttcaatacctcattcaattcagcatttatacaacagcaacaacagcaacaacaacagaatcaacaaaatcaacaaccgcaacaaccgcaacaaccacagcaacagcaaacccaacaaattcagcaacaacaaccacagctatttaatacacaacaatactatcaacaaccacaacaacaacaacaacctctttggttacaaaatcagaaaaagagaacaatacctaatcatttagttcctaaaaagaaacaaagtttccaactaggcaccactaataacaacaatcataataataaactcaattctaagaataaaaataaaactggtaaaaatagatccaataatggtgatttgaatggtggagatttaattatatctaatgatgataatgataatggacaattcaatttattatcatttggatcaaatttaaatcgtcgagtaaccagtggcagtggtagtggcactagtggatcattattagatagaaacactagtattgctagtttatttgataattcaataggtgatttatcaagaattgatgatagctttattggtggtgataatactattgatgatattaatgatgatggtaatgggaataataatggtgatggatttggaaatgatttaccaccaaagaattcaatgtatgatttgagtaatattaatggtagtggcaagggaacaagagataaaaatggaattaattctgatagtaaatttgaatcatttataaataaagatccaaaaacatttgatagtgttttcaataaatttcaagaatttactccaattcttgaccctaataatgttaatgtcaatactaatggttttggtggtacaagtggtgttgatgagaaaccaaataccacaaacaataatgatattcttcaaaatcagaaacattataatctggcaattattgtatttggatatcctgaaaatttatcaattgaaatcattaaattttttcaaagttttggtagaattttagaaaaatttgatactacatcaaccattggttcaagtgggagtactaacaataataataacattaaagaaattttaataaatttggctgccaacagcaataacaacaacaacaacaacaatactatcactaacaagattgttcctatatttagtggtaaacattggattaaattaacctttgataatcctaattctgcattacaagcattacaagaaaatggaaatgttttcaatggttcaataattggagttgtaccttatcataaaagtattattgaaaaattagaaaatcggaaaattttcatcaacgataatgatagtactattatgggagaaggaaatttagatattccattagataaagtgaatcaaattattaatcaacaatcaaaacttgttagtacacctggtggtacccttaacaaaaacaacaacaacagtaacaacaacattattggtgagactattcctacaagttcaactactacaacaacaacaacaacaactggtggaggatcattatataatcgattagatataaaaccaatttctaaagatcaaatatttttaaaagataatcttaatagtagtagtactactactaatactaatggtggagattctcaaaatggaggaaataatgatggtaataaaaccattaacaataataataaagaaaaattaggagtttggggtaatttatcaaaatatatttttggtttccatgatttatag

SEQ ID NO: 5238 - DNA, 576 bp, Candida albicans
aaacctcaatcatggaaatcggtgattaaagtgaatggtatattaaggaaaactggatcaggagttacatttttcgatatcaataacaaaataggtatttcatcccctgaattgcatgcattggttcctcaacacaataaaactatgaaagatattatttataatggattagttaaaaatgtgggtaattccaatttttatttcaaaggtgatcctaataatatcactgcaagaggacaaaagtatctacaatattttgcggacagaattgataaatacggagataccatatttaacgaattgagtttaacggatcagaaattagcattgtttttaagagcaattattaaagaaccagaattgttgattttggatgaagcattttcttgtatggacgatgaaaatgtaatgatcaaatgtcatgaattgatagaaaaagaattaaacgatactacagtgatatctattggtcatttagaatgggaattgtgcaaatacgattatatgatccaattgattaacgataataatggtagagattacaaaacattcaaaatcaattgggagatggcttag

SEQ ID NO: 5239 - DNA, 918 bp, Candida albicans
agagaatcaattcaagtaatcggaatcatgagtaagacctcaactttaaaaaaatgtttggtgtcttttcaaaatgccaaatttaaaaaggatactttactgaaaactccttacatttaccccaatccaatatcaaatataaacatttatccagctaatgtccaaaatggctcgtcaatgtgggccgttactggtaactctaaaaccacaatgttaaaaattatagctggtgaatatattctgtacccaccattatcaaggcaatatccattaattaacgatcgaccaacacaattacagtttctcaattttagagatggatctgggttggataaagtgcatatgtcggcgagatacgaaacgtattcgtataaaggtgtattggaaatgctggatgatgtgaactcagtgtataattatgtcacagggttgaacaattataacactcagcacacatcaatatcccaggaatttgtcaatgaattgttggattatttcaagttacaacacttgaaacacaaatggattaacagtttgagtaatggacaattaagacgtgcaagaattgccaaatcgttgattaataaacccaagttgttaatcattgatgatccgtttttaggcttagatcccattaacactcaaggagttagtgaagcattgaagacagtgagtgaagaattggatacaagtattgttttaggattacgagtacaggacgatatacctgattggatcaatagtttatgttatgttgatgaatcaggggttaaattatctgggaataaactggaaattttaaatgagtataacgaattagtgagtcaaattacgacaacccataaatcacacgttagtcgtcacaataaacaacaacaacaacaacaatcaaaaccaattgaaatttcatggaaccaa

SEQ ID NO: 5240 - DNA, 633 bp, Candida albicans
ttgaaaaagaaattgatattaggaaaaaagtatcagcaatatataataaaactgaagaagatttcccctggagatttacaaggatataatcgatatcttgaaaatattgaggatataatatttaaattaagttatagtgatgataaacaagaaattgaaactgtggaaactgaattaaataaatatgaacaagaacataaattagaaattttggaaagaaatatgagagaatcacaacgtaatgatgatttaatgaaatataaagaagctcgagaacgattaaaacaagaaaaattaaagattcaaaaacaaatggaattagaagatttagaatatcaacgagaacaacaacaagaattattagataaattaactaatagttcaactactagtgaagaattaattaaacaacaacaaaatcaaatgttaaaacgatcaaatcttcggaggaaacaattacaaactataaataatcaattggatcaacaatttaataaaattaatccatttgcaaaaaataatggggttgatagtgatgatgaacagaatggtggtggtggtggtgtaaatggttcatcaaaaattccatttacacccctccaatcttcactacggagtgcaggaccgcgataa

SEQ ID NO: 5241 - DNA, 387 bp, Candida albicans
aaaatgttacaaacaggtgaaggtatgtcaacagtttacccactcgtagcaagttataacagtctgactaaccacattatagatgaccaattaaaagatatgtgtccgatttgtaagacggataaatatttgtcaccaaatatgaaattattaattaatcctgaatgttatcataaaatatgtgaatcatgtgttgatagaatattttcattaggtccagcacagtgtccatatcataaatgtgggaaaatattgagaaagaataaatttatacaacaaatatttgaagatttaataattgaaaaagaaattgatattaggaaaaaagtatcagcaatatataataaaactgaagaagatttcccctggagatttacaaggatataa

SEQ ID NO: 5242 - DNA, 852 bp, Candida albicans
cacgggaaacaaaacaaaacaaaacggaaaactatgtctcaaactctagatgatgctccagatgaggtattaccatctaatttatcgctacctgcttcgattcctttaaaaagagaattgcttcgagaatatgaagatcaattcagagataccacaacagatagtcttttccgggatcagatattacaaacaaagcaaatggcagaatattatattgattatattctagaaaatgatcatttaaatttctcagaaaaaatattgcaacaatacttgaatgcttttgaaaattttatgaagttagaaggaaaattgaacaaactaaaacaagttcgtaatctaccaaccattgaaggctattcatcaaatttaacatctttgacattggataatcttgacaatcagcatactcttaaccaagtttattttcctgaagccattaaagaagaatatgcaaagttgggagttccaaccatttctgattcaacaataacgaaacaagggtatcaatttttgaaacaggttttgtttctgtttaaaaaccctgaagatgctatacccgatgaaacagaagacgacgaattgaatgtttcaggaggtaaaatttttcttaaggatccacttaccttgaattattttgtgaaacctgtaaaatccaaacgatgcaatcatgtttatgaagaactgagtattcttcttcatttgaatactcaaagagtatgtcctatttctggatgcagtgcagtattaacaagaaatgacttgatacttgacaaattgatgcttatacgaatccgatcagtgaatagagtggaaagacacgacgatggaaatatggagactgttgtttga

SEQ ID NO: 5243 - DNA, 618 bp, Candida albicans
cacaaacattttcttttctataaagactcaagagccatcgcaaacagaaactatatgactagtgaaaagtatacctgtttgacatgttctgaacaattttcagaagctggccaaattcagaaacatctctcgacaactcgacacaagtcagtgcgattagaaagtttggatgagactttagaatgtgaagaatgttccgacagtaatattcatcagttgtccattgttagatatgggtttaacgatatgtctttattgtgtcaaatttgtcttgagaaagataataagaaaacaggtgaaacacccagtgctagttacacgctatcaaatggggcatttttcaataaacttccgcagtacttgaaatttagggacattgaatgtatggaatgtggagatgatacccatttgtctgttgccaacacgtcttctgggcaattagtgatttgtcgtaaatgtttaccgaaatatgaaagtgataatgtgaaatttataagtgaagatagcgatgattttctttctgagttgttggggattaaggaagtgataatcaagaaatcttcaagaaagagaaaatccgggaagaatggtggtggcaagagaggggggaaagcatga

SEQ ID NO: 5244 - DNA, 2754 bp, Candida albicans
agacgaacaagaaagccagaccctgatgcagaagctagaaaagcacattatttacaatctaagcaaacggcaaaagatattaaatctggtactactgtcaaagctatagggtcaaacggtgctgctaacaataaaacatcaacaacaggaacaaaaaacaacacaaagccaacatcaaggtatggtaaaagcccgagtgttagtggcaaatcaactcctaaacctggtaagagtccagcaaccagtggcaagtcaactccacattttggtaagagtccatctgtgagtggtactactacgccaaaggatagatggtcaactcctgtaaacgaccccaaaaataaaccaaaaccagatagtaaacccaagaacaaagctgttaatgagaaattggaaaatgcgtcaaatactaagccaaaaccaaaaattgataaaaaaactcctacagaaaaagcagagaataagtctaaactgaaagaaaacaatacactgtctccaaaagaaccaaaaggacaggctcctactaagctaggatctaagaaatctcctgaaaaagataaaacaaaggaaagttcatcaaagacaggcaaaaaaccagagtcagcagtaaaatccgataaaaaacagaaatctaatgtcccacaactgtatagcaagacaaaatctggatctaaagcacaacaaactgctaatgacaacaaaaaatcaggagcaaatttaccgtcttccaaagaaagttcacttgtacttcctccgtatatcacaaaattccatccatcagaaaaaccaaaacttacctacgattcaatgaatgaatatttcaaagagataagttttaatgtatttttagaggatcaattaaacaatgaactgaatattattgattccagtaatttcactatttcttggtatgaagatctagataaaaagaataatcaatttcaattacatattcctatgcgtccagaaatcattgataaatttttatcgcaaaaattgaaaaaatttaaaaagaatccatttctggtagatcaagcaatttttttaattttagatgatgaaatcatgtggtcaggttatatagcaactgttgatgaaattgctagtaaaaagggtagaagagttaaaaaagatgttattgaactaattattatgttacatccttggtcacaagcattaccaagaactgtccatgtttctaatttgaaaatattaccagcttcacaaccagttagtcgagtattgaatgctatgaaaactattaataatgcaagttttacaagaatgttattgggtaaagaaccaatcaaacaaattgatttcaagaattttttgaaattccaaggacaaaatttgaatgaatctcagaaaaagggggtacaatcagttcttaataattctattactgtgttacaagggccaccaggtactggtaaaacatctacaatttatgaaattatattacaattacttgattcattaaacacttatcctattcttgtggttgcagcatctaacattgctattgacaatatagctgaaaagttaatgacaaaacatggcaaagatattttgagaattactgcagcagaaaaggaacgtgactataatagatcacatccattagcgtcaatttgtttacatcataaaatgtatgatgctatgcccatgaaatatcaacaagttatggatgaaatgaaacgaggcatggcaccatcaattggaactactgcttataagaaatatgctcaagaaagattttttttgtcgaatcagattgttactcaagcaaaagttgtattggcaacacctgtagtagcaggtggaatcaaatcgttaaataatgtcagggtagtgattatcgatgaagcaactcaatcatctgaaccaacaactttaattccattagcgttaccatcagtagaaaaattggtattagtgggagatcaaaaacaattaagttgtttttcattgattcctaatttatcattgtccttgtttgaaagagttttattaaatggtacttataagacaccacatatgttggatacacaatatcgtatgcatccagagatcagtgagttcccacggacaaaattctatggtgggttattgaaagatggcattgatgccaatgcaagacaactggaaggggttatttccagtccactttatttttgggataccaaggggaatgcaagagaacaatctgttagaaacttccttcgtgaagatggaggttacacttatacgaatcgtgatgagattggttatattcaacaggtgttacgaacattaattataacaaagggggttaaaccagaacaaataggtataataacaccatattctggacaacgtgatttgatttcagcaacgttggtgaaagatgatgtcatcaatcctagtaatgaacaaatgaaaaccgaagttgatattgatgatttgaaaaatgattccaaaccagttacaattcatatagtttctggtattatgattgcatctattgatgccttccaaggtagagaaaaggattatatgattatgtcatgtgttagatcgaatactaaaggggtgattggatttttaagagatgaaagaagattgaatgtggcacttactagagccaaatatggtttaataatggtaggagataagaaatgtttgcaaaatggagataaattatggaaggaatacttgcagtatttggattccaaaaaagctatacatgataatgatacttttggcgaatag

SEQ ID NO: 5245 - DNA, 609 bp, Candida albicans
tattggatctcgacgggtggtgaagatggattacaatggttgataacattgtttcaaaatgggcttaatggaatattggccgatgagatgggtttagggaaaactttacaatgtatttcatttttaagtcatctaatagaaaatggaattaatggaccatttttagtggttgtccccgtttccacattatcaaattggtataatgagattagaaaatttgcacctaaaatcaaagtcacaaaatatattggtaccaagcaagaaagaaatgatattgatttattacaacaacaagaaactactaatattattttaacttcttatgaaatctcaattcgtgattttaataaacttgtgaaaattaattggaaatatttaattgttgatgaaggtcatcgtttaaaaaacagtcaatgcttattaattaaaatattgaaaaaattaaatgtttctaatcgattgttattaactgggacacctttacaaaataacttaaatgaattatggtcattattgaatttcatattgcctgatattttccatgatttagaattatttcaacaatggtttaattttgatgaattgactgaattatcacgagaattataa

SEQ ID NO: 5246 - DNA, 1224 bp, Candida albicans
aaattacagaaaaaaatctattatgacgctgtaaatgataagttatttgatagtttggttgacacaaatttaaaagcatttattaaattcaatcatgaagaattgttcaatggatttgatgttgatgaatatttaaagactcgtagacaaagggattcatttatggaaacaggaggtttatcgaaattaagaggatctcggtctgatagaaattcattgaaaagatcatacaaggaagctgatagtgatgaagaatttgaaattatggacgccgaagatgattctttgactggtaggggcaataccacaccaagttatgatgaagctcttgttaaaatacgtcatattaaatcaaaaaccaaaatacaatcaatactcattgatgccatatatcaagacattttgaaagaagctaaacatttgaaattacaaaatttgaaaatgattcaacttcgaaatatttgtaattctccctttatttattataattatcctatattggatcaagctgaagttattcgaaattcagctaagtttcaagtacttaatcaattattaccaccacttttatctagtggccataaagtattgatttttgcacaatttactaaagttttagatttattagaagattggttagaagaatcaccattactgcatggtaaaatatgtcgattagatggatcgactaatcatcaaattagagatgaacaaatctctcaatttaataataatcctaaatttaaagtatttttatcatctacacgagctggtggattaggaattaatttagttgctgctgatacagtaattttaatggataatgattggaatccacaaatggatttacaagcaattgatcgagttcatagaattggtcaaattaatcctgtgaaaatatttcgattcgttattaaagattcaattgaagaagtattgatttctcgatcaggatcaaaaagatttcttgaaagattagttattcaaatgggtcaatttaagtttagtaattttaataagaaattaacggcagcaacaacatctaatgagcaaggtgcaattaaaaatgattggagtattaatgacatgatggaattgagtaaattacattttaaatcaacacaaaatggacaaaccagtcaagattcagcagaagaagacgagaaaatattgttatctgatcaagaaattgatgagtcattagatcgctcagtgggaatgtga

SEQ ID NO: 5247 - DNA, 2007 bp, Candida albicans
attctagttgatcctttttgggtgagatttgcaacacattgtgatagcttttccatgatttcggatatttttttccccttcttgtcctttatcattgaaaatttttatttttctttcagaaagccaacaacaacaacaacaacaacaacaagatcaaaaatactccaccaaacacccaaacagatgctggaacacaatatacctatattaattaatcaatacattgctgcttcttcaggtaatgacgaagaagcggtatcaaattacatttttgaattatccaatttgattagtaatgatgaattatcattattacaattcattcaacatttaggtccttcattaacttcagataaagattcaattcgtagtaaaagtattgaatgtttatccaagactattatttcattgtctgattcgaaattgactaaacaagacattaatgttttaattgaatttttgttaaacaaattaattgataatgatcaaatatgtttacaatattcattaatggggattaattcattaatttgtaagaaaaatttccttggtgatacaaatattgaaaaaattttacaacaattgtataaaaattatgatcccaaaaagaatttagcaaaagtacgatacgaaacttttcaaatattattgaatttattgaatcaatttaatcaatatttgaattcttcttctattcaattatcaaatttatatatcaagacgtttattcatattgcatcaggtgaaaaagatccaagaaatttattaatttcatttgaattgaataataaaatcaatgcaaatttccaatttgataataaaaataatgaattacatcaacaatttataactgatttatttgatatttgtttttgttatttcccaatttcatttaaaccaccaagtaatgatccatataaaataacttcagaacaattaaaattggcattaagggaaactattgcctctcagagtaaatttgcgcctgaggcattccccagtttaattgaaaaattaaattcaagtaatccaaccattagaaatgatactttaaaaacaattgaattatgtattaaaaattattccaaaaatgatgcaacagtcattgaagaatattggatgacaatttggaatgccttaaaatttgaaattttgcataatgatatttctagtaattttaacccaactaataataccattgtggcatcagattatgatgaaattgatgataatgatgaatttaaaccattagttttaactttagttatacttaatcgattgattctgacattactgcaaccagaaatcatgttacataccgtggtggaagaattgaaacctaatttagaagtaatgaaagaaaaatcaatcaaatcaagtttaattttaagttcattaggttcaacttctgttgataatttgaattatattgttgatttcttatttcaatatcaaatatgggggaaatttttaaatattgataaaaaagaagaaaacgaagaacagcaagagtttgatacaaatgaagatgtttcattgaatatagcaaaacaacgtgatttgattgatagtattggatttgtattaactgcatatcaagttttgaaaccaacagctcattgtcatttattggattataaagattatattttaatatttttaggacaattattgactattacttccaatttagagaaaacattgaaatgtaaaatcattcaacaattgattaaattaattaaattaccagggtatttaaatactaatgaacttgagttaatcttagggaattattttaaacagttctttttagatactacaaaaacatcaggaaagaaagatgttatattacaagaaattattaatggattaattgaagtttcacaagatagtcaaattacgtcattaacaattgaattcattattaatccaatattaaatcagttattaaccaccgaagataacgatggtggtgatgtcaatattgagactttccaatttcaataa

SEQ ID NO: 5248 - DNA, 1602 bp, Candida albicans
tctagtagagaaaaacaattcagcctttggcatatattgaaatacatccccgaagaaataaaactacacattgtcaagatggatgactcagatgaggaatacatgggctctaaatcgccgtcctctaaacttccttcgactgctccagagaaaagtgcatcacctggaggagcaaagagtggtatgtcagcaagaactcgatcatcacgtcgtggtgaagtgagtgacttgaaaggggccaatgggtatgcctgggaagatgagtaccaaagatcatgggatattgtgaaagatgatgagcaaggaggcaactcatttgaagccatggtgcaatcgattattgaaaatagaaagaagaagataatgaaaaatcccagtacaccgtttcagagaggaattattcgaacattgattatcattatagacggatcactggcgatgagtgaaaaggatttgcgacccacaaggctatctatgacattgaattatctacaagagtttgttgttgaattttttgaccaaaaccctatatcgcgattgggaataatattgatgagaaatggtgtggccaatttagttagtgaggtaagtggcctgccacaatatcacgtcgacaaaataagaaatttgaaagccagacaacataatagatttgaaccaaagggagatccttctctacagaattccttggaaatggctaggtctttattgaagtttaatttcggttctacatccaataattcaaaaaattcaaaggagatattggtgatatttggagctttgtttacaagtgatcctggtgatatccacaaaaccatagacagtttagttaaagatgagataaaggcaagcgttatagggttatctgcccaggtggctatttgtcaagagttagtaaacaggactaataatgagccacgtaactctcaatcaaaacactacggtgtgatcatgaatgaatcacactttaaggaattgttgatggaatcagtgacccctttgccattgactgaaagtgaaaaacaaatacaagaatcggagcaaaacggtgttccagtcttgcgtatggggtttccgaccaaagtacaaccaacattgacatcagctattggtgggtccgactacatagttgagtttccgcacttgaacgcttctttcccaacccaaggctctgaagattccaaggatgttgtggaaattcaaacaaataagccagcagcggcagtagcaacaacatcttcttcagtaattgggtaccaatgtcctcaatgtaagtgtaaagtttgcaacttgcctaccatatgtcctgtgtgtgggctaatgctaatattatccacccatttagcaagatcataccatcatttagtcccacttgctccctacaaagaggtgaaagtgagcccaatatacgacagcacatattgctttgggtgccaattgaagttccctgaaggtgttaagctagggacacacaagggaactttagagtcgatgactagttcacgatataggtgtttaaaatgctcacaagacttttgtatcaactgtgatgtttttgtgcacgaagttcttcataattgtccaggttgtgaaaacaattaa

SEQ ID NO: 5249 - DNA, 696 bp, Candida albicans
gtgaactcttctctgtggacaggacgcggtattttgtatgcgtcttcgagagaatctggttgtatacacatctcatatactttattcccagagagaagaataaccctaacaaacaacaagtggagagtttatcatccaatatttcggaaaatgaagttgaaattgatgacaaaaagttccgaaaagttgaaggagactttaagtttgatatcgcatgtgcgtaaatttgttgttttaaaattcacgccaagtgagcttagtgtgattctgattaatggccaagcggttaaactggaaccgcaagtatggtgtaaactacctgtttctgaactatttcaaagttgtgagatacagagtgtaagggataacacaattctgatggaaattaatatagatttacttgtacaaacattgaaaaattttgataaagcaaacagtgaaggattgaatataagactacaacgtacagatacttctggagcaaagggtacaagcaatacaacaggacgaacggcatctttggctttgttttattctaatttaaatattaatgccaatgttgtcaaccacacattcagaataccagttaaaatactacgagatgcacaggatatgctacatgagcctacacattcggaccttggattgatactgagattgcccaatgaattagtgtgtctcaccgagcacgaaagc

SEQ ID NO: 5250 - DNA, 915 bp, Candida albicans
  unsure (712),(891): Identity of nucleotide sequences at the above locations are unknown.
tcagtcaaaaagattttgatgaaagtgacaaagagagcaatttctgatacatctggctcgagtaagagaatcaaattggaacatattgaagttgagatcgaatctgaaactacagaacttgccccaaatgtattcacaaaagtagatcccgaagacatggccaagtgtaacggtcctccaaaatggtcagaaatctataatcaattagtttggatgagaagtaaattttttgcacccgtggatacccaaggttgtgaacgaatgccaaacactatcaatagaaacattaaaaccagaaacccaaaaatatatcgctttcaacttttaatatcattgatgttatcgtcgcaaacaaaggacgaagtgaattacgaggccatgaaaaacttgcacaatggattgttaaaagtgcacccagatggattgtgcattgaaagtgtactaaaattgtctgaatctgaaattgatgcttatataaaaaaagttggcttccataataggaaagcgcagtacattaggaaaacctgttctatactaatggagaatcatggtggtgatataccaaaaacgatagaagagattgtcgcacttccaggtgtgggaccaaaaatggggtttcttcttttacaaagtggttggggtattaacgccggaattggagttgatgttcatttgcatcgattggcgctcatgtggggctgggtttctccanaagctaatacacctgaaaaggctcgaataaaactacaagaatggttaccaaaggattattggacagatataaatccattggttgttggttttggacaagtgatttgtgttacacgtgctgcaaattgcgatatatgcacattggccacagaacggttatgtaacggtgtaaacaacaanttggctaaaaacccgttgtcttga

SEQ ID NO: 5251 - DNA, 852 bp, Candida albicans
  unsure (110): Identity of nucleotide sequences at the above locations are unknown.
ggatataaaactatatacaactggcaatactgtcattcattggacttttggtccagagttttgtctcaacattgtaatcatgaaaaagagttgcaaaaccataaatccanagaatctccattgaggcaattaatttatccattagtacaagttactttgggtgctattagattgatccataccgctcaattttttccattaagattttatttaattagatccttgatcagattatctcaatctaccggcgtgtttattcctttattcccattgatttcagagattttatcatctacagcaatgaccaaggcaccaaaagcttctactttgcaagctgttgatttcgaacacaatattaaagttaatcaagcatatttgggcactagagtttaccaagatgggttatgtgagcaatttatagagttatctggtgaattttttggtttgtatgcgaagagtattgccttcccagagttggtgaccccagctgtgttagcattgagaagatttgtgaaaaaatcaaaaaatgtaaaattcaacaaacaattgcaacaattgatagaaaaattaaatgcaaatgctgttttcattactggaaaaagatccaatgttgagtatggaccatcaaataaagcagaggtacaacaatttttgagtgactttgaatgggaaaagacacctttgggtcaatatgttagtgtacaaagacagttgaaagcagaaagattaagaatcttgaaagaagcccaagaagaggaagcaaaagcacaagctgaacaaaagaaaaaagaagaagaagaggatgagcaagaagatgaagatattgtaatggaggaggaagatgatgagtag

SEQ ID NO: 5252 - DNA, 915 bp, Candida albicans
ctcttttctacacaaggaaccatggctaaagcatcgaaacaaacaaagaagtttcaaaataagcatttgaaacatacaatagagcaacgtaagaaggttcaggcacagaacaagaaaattgcttccagaaaaaagagtggtagttcatcatctggggaaagcaatgcccccaaacgtgctgatggaaaagccaaggaagtctttgaagatatgtcagtagacgactttttcggaggtgggtttgaagttcctaaagaaaagaataagaacaagaacaagcaagatacaattgaagaaaacgaagaagaagactcgtcttctgaagaggaagatgaagaagcaatgaaggaaaacttgaaaaaattagaggcagacgatccagaattttacaaatacttgaaagataatgacaatgatttattagattttgaagctgtcaatcctttagatgccataagtgatgacgagggtgatgaagatgatgacgaagaaattgaaaaagaagttcctagcgatgatgattctgaggaagaaccaactctaggaaaagtaaaaggatctaaaattgaaataacgaaatcgttggttaaaaaatggaatcaacaattagataagccaacccctaagattacaagaaacatacttattgcttttaaggcagctgtcaatatccacaattcggattctgaagattataagttttccataacagaccctaaagcattttctgaattgatgttattagttttgaaaaaagttcctatttctgtgcaaaagttggttaaatacaaaactaacactcaaggagtaagatcttatcccgcaaaagaatcaatatgccactcaaattgcagctattttgaaatcacatgcaggttcattcatcactttattaaacgatatcaccaatactga

SEQ ID NO: 5253 - DNA, 567 bp, Candida albicans
  unsure (551),(552),(553): Identity of nucleotide sequences at the above locations are unknown.
gatcttatcccgcaaaagaatcaatatgccactcaaattgcagctattttgaaatcacatgcaggttcattcatcactttattaaacgatatcaccaatactgaaactgctgctttaattttggcttctatttatgaggtgttcccattttatttgtcacacagaagattattaaaacaaattttgactgccgttgtaaatgtttggtctagttcttcagatattgatacgcaaatttctacatttgcatttttgaacaatgtatctagagagtatcctaaatcggtcttggaaaccgttttgaaattaacttactcgtctttcttacagaattgcagaaaaacaaatgtccataccatggcccagattaacttttgtaaaaactcagctgtggaattgtttggaatcaatgaaactttgggttatcaagttggttttgagtatgttagacaattggctatacatttacgtaacagtatcaatgctacttcgaacgcaaaagagggatataaaactacatcttcaccaggctctggaagggccaacgctcnnnaaaattcccccccc

SEQ ID NO: 5254 - DNA, 1146 bp, Candida albicans
tggaaaaatgttacattgcgccaagaaattgtatcacctgaaattggacaacacgttcttgccatgttgtttgttgagtcggatagtgagtcggtgaacaacaccgatatttgtcaggttgaggattcgtttacggcgtcgaccacgcagattgcacatttgtcggatattttccagagtttggtcagtattaataaccaggcgataatcaggatcaaggagacggggatcgcgatctactcgagttataatcatacgtttaatgtgaatgtgaatatcgacccgctgttgttcagtatttatagtattactggcgaggagtttacgttgggggttgatttgagtttgattggcgagtgttttacgtctgtggccagtacgttgaagtttgaaaagtcggttacttgttacctcaactaccagggtgaaggatcccccctagttattgagtttgaggatacgtatattttggagaagctcgagttttacacgtatattattgagctggggatggaggatgataatttggggatcgactctgagagggtggagatggaggcgatggtcaggagtgatgtgcttacgaatattttactggatttgtggcagattgataccgagaacttgtttatatacgccgaggcagacacgttgacttttatcagtaatgggcctattggcacgtcgaaacttatattccccaacgacaaggatgtgcttgagaagttggaaattagtggcgacaagaggtacgtggtgtcgcagtttagttatgagacgttctatcgaatattcagggcggtgagactaagctccaagtgcaagcttatcaaagacgcgcatgggtgtttttctatccagttgttgtgcaagaaactaccgttgagtgggtactcggggacactagtcaccatcaacatgatggagctcaaccacgacgagtttatgattgggtggatagaggagcaagagaagccggtgttgtttacgtcgttcaagaaggtagaggtacagtcgagcgtagtcgacaagcgcaatgtaaacggggcagttgagtgccgttatttttataaaatcagtatacaggtatgtagctttcaattgtatttttttggttttgggcaatacactcggcgatccaagtaa

SEQ ID NO: 5255 - DNA, 1524 bp, Candida albicans
ttaccttcattttttttatcaccacaaccaattagaacaatgtcgtctcacttgttcaaggcgacggtaaatgaatatctcgaaggactcccgaaaacagtccaatccaaactatatgaagcaccagctacgtgtttgtcgatattccgattactttcgccaatggccaaattctacatcatgtcaatgatattcaatgaaaaaccaattgcattaagagatttagacaaatggtgtaaaccactggcgaggaaattggaatttgaagcattgaagagattggaatctctacatttaatagaatatgatagtaaaggttctcatgtcagattgcattctattttcaggaaaaactttcgtgattgtttgacgggatcacaaaatccaaatgcatttggaagtataagtaccacagtggataaacataaagttgatataccattcctagatttgtttgcatcgcagaaatgggaaactattttacatttcatggtgggtaccgaatcaacggccactccttctgattcagttttaagtctacttaaattgggtggattaatggaaggccccaacaatgatttaagaattacaaatagtgggttccagtttttgttacaagatgttaatgcacaaatttggacattgctattacaatatttgaacttgacacaggaattgaatatggatccagttgatgtgttgaattttatatttgtattggggtcattggaattgggtaaaagttactctgtattaagcttaagtgaaactcaagtgagtatgttggcagatttaaaagattatgggttggtttatcaacgatcagacacttctggaaggttctacccaacaagattggcaaccacgttaacttctgattcagcagcattgaagacgccatctatggcaatggatgaggaagaacaacaagttgcaacaaaggaatcgattatcatagaaacaaatttcaaaatttatgcatacacaaagtcaccattagaaatagccattctaaatttgtttgtgcattttaaaaccagatttgccaatatggtatgtgggcaaattacaagagaatctataagaaacgctttatataatggtataactgcagatcagattatcaaatttttggaaacccatgcacatccacaaatgaaaatattagcaaaagagaaattggataaaaaaattgaattcgataccagtcacaatatcaatactgctggtggtgctcctcaaagtaaaactgatgggatggtttcacaacataagttggaaatactccctcctaatgttgttgatcagatcaagctatggcagttggaattagatagagttcaaacttttgacggatacttgtttaaagatttctccaatcaacaagaatatgatatattatctaattatgcttctgagctaggggtattgatctgggcagataaagtgaagaagaaattctttgtcactaaagacggcatgactcaagttgctgattttgcaaacagaaaattgaaacgttga

SEQ ID NO: 5256 - DNA, 1128 bp, Candida albicans
aagactttgaacattcttttaacactcaacacaattatggaagccatatccgatagactatttaatgagaatgcaaacacgatagaatcagggaatgatgacccatcattattgactataatactagatctttcaatgaaaggatggtataacatcaaagaaatgatttcaatacaagatatcaccaaatcattactagttttcttgaatgggcatttgtcattaaacaatagtaatcaagtggcatttttagtgagttctactatgggttctaaatttttatatcccgatttaactatggttggaaaccccaacgtgagtgaacattctgaacattttcctgacatgtatcgactgtttaaaatggttgaccaatctgtgctacaacgattgaacgagtatattgaagagattatcaaattcgagacagggaatgaaaaaaagggtttcaattgcttgactggagcaatcagtatggctttaacgtacacaaatagaatgttaacgttggatcaatcaatcaccaccacaactgctgctgcaatgacagcttctacgcttgaaagtacatccaacaacaataatactagtggcactagtggatcatctagtacctcatctagcacatcgatgaaatcaagagttttgattgtgtctgctaatgatgatgacgatcttaggtatattccattgatgaattgtatatttgctgcccagaaaatgaaagtgtctattgacgtagcaaaattgggtcataacaactcatcctatttacaacaagtttctgatgccaccaagggggtttatttacacattgaagatccaaagggaataattcaagtgttgtcaaccgcattttttatagaacccaacctacgaccatacattattttacctacaaattcaaatgtcaattatcgagccagttgtttcattactgggaaatcagtagatttgggatatgtgtgttctgtttgtttatgtattatgtcacaattgcctcaaagtggtaaatgcccagcttgtgattctgaatttgataaaaagatcattcaagatttaaatagagaacctcaagttatttcaaaaaagaaaagaaaacttgaaaatgggagtctgactaaatag

SEQ ID NO: 5257 - DNA, 789 bp, Candida albicans
tccaatatgggtaaacagtatatatctacagtcagtgcatctcaggctcataagctggatattcttggtgtagctattaccaataagttcactgtgtctgtgtccagtgatggatatgcaaaattttgggacaacaagcaagacgaagttcatctgcctaaagaatttgtccaactggtatttatagataaaagcggaatccatgcggtggctgcttacgaaaatgttttgccaagttccacattgaaagtgacattattagcatttgcatgtttcaatggatctatcatcttcagatattatatcaatgatgacttttcaactatcgaaagtctaactgatgatataaaatcatttgaaagcaattgttggacccctggcttttatcgcgatccagaatccaaacaagactattttattacaaccaagaccaatggcactacagaggttcatttattgaatattgttgatgaaaatgagaaggctgtaatcacatttgaaaagtttgggcaattaaaaggaaactcttcttctttcccaaattctttggctatatgtccaacagagaataaaaaatgtgctgtggggtacatcaatggtgatgtcttgttatatgactttgttagcttgaaattgatatacacatttcgttcgagtgatttggtgaccagtagaaattcccaatcgacgtctatacctagggtgttggcattttccccctggtggaaccttgttggctgtggcaagagacaatcaagctgctgggtcaattacattatacgacgttga

SEQ ID NO: 5258 - DNA, 495 bp, Candida albicans
ccagtagaaattcccaatcgacgtctatacctagggtgttggcattttccccctggtggaaccttgttggctgtggcaagagacaatcaagctgctgggtcaattacattatacgacgttgagcatggtgagaatgtggggtctttggccacaccctcacactcggccaaatctgttgttggtgggtttgcgcatcaaggctggattttggggttgagttttgatgaggaaggtaagcacttggctagttgtggatttgacaaatgcataagagtctggaatttagaaacaagcgaaagggaagcaacaattagtatatctatatcagacttagatgatactacacataatgatcaagacgagagtgtcgcttctggtgttgcttttattaaaaagggggttagaggtggctctggtggtgacagcaatgaaggattatgtgtcgtgagtttcgatagaggaataagatggtaccgagaggcaggaggaatatag

SEQ ID NO: 5259 - DNA, 666 bp, Candida albicans
ttcaatccatattctgataatggaggtacagttttaggtattgctggagaagattttgctgttttggccggtgatactagacaagttgaaggttattcaatacaatcacgatatgaaagtaagattcatgatgttggtgatgatattttaatgacggctaatggatttgctgctgatggagtagcattaatagatcgatttaaacaactgttaatttggtataaatttgataataatgggaaaaaattggcaattaaaagtgctgctagatatattcaacaattattatatggtaaaagatttttcccatattatgttagtactttaattgctggattagatgaagaaggtaaaggtgcagtatattcctatgatccagttggttcatatgaaagagaacaatgtagagctggtggagctgctgctagtttgattatgccatttttagataatcaagtcaatttcaaaaatcaatttgttccaggaactgatggtaaagaaaagaaaccattgaaatttttaacgttagaagaagtgattcaattggttagagatgctttcacttcagctggtgaaagacatatatatgttggtgatggattagaaataaaaattgttactaaagatggtattagaacagaatattatccattgaaaagagattaa

SEQ ID NO: 5260 - DNA, 597 bp, Candida albicans
gaaccaagatgtattaaaagtttatatcatactggtaatagtaatgccgaggatgctatgaattggatttttgcccatatggacgatgccgatatagatgatccattcaatccaaacgattctcatggtggtgcctctactactactactgatgattccggtccttcacaagatttgatagacaatgtagctgctatgggattttctacacaattagcaaataaagcgttggtattgaacaataatgatataagtgctgctgttgaatggttatttgctaatccatacgatgatggaattcttgaagacaacaaccagagtggtccagttgtcaatgttaagcaagaaaaatcagagttaataacaaaattaaatgcagatactcaatcaaatggtaaatacgagttacaatcagttatatgtcacaagggtacatccccacatactggtcattatgttgtttttatcaaaaaacttattgataatgaatacaaatgggtattgtttaatgacgaaaaagttgtggtttgtgatgatgccaatttacaagatataaagaataatgcttatgtctatgtatttagaaaggtagagtag

SEQ ID NO: 5261 - DNA, 678 bp, Candida albicans
caagaaagaaattacgctagaatgacattagaattaccttcggatatcccgctgaccattcctgcaaatactaaaatttacaaagatgattgcatgtattcttttgatacaccagagaacaatttgttaggattggatattgatcttaaaacatatcgggcttattctcgaaacaaggatttcaattacaccaaacaaaattatgacaaaacggggaattatttgtatttgaatatcaaaaaaactttaaaaccacaagaagaaagaaataaattattgtatgacgataatggtgaaaaatctcccaaaatacagaaattggaaatcaaaaatgtatctgatgatgattactacaacactgaaatatccatttatgatatcaaagatgataaaagttatagtagagatgaattgagtgatgagttcaacaacttgattgatttaattctttcagcaaactcttctgccacagaagatgaaattaaacaatgggaacaagaaattgttccttgtcctcattcaattgacgttgaacaatttgaaactgataatttggatttgactaaatgtagtcaatgtgatttgcgtgaaaatctttggatatgtttacattgtggtgccttggggtgtggtagacaacaatatggatcgacattgaaaggtaatggacatgcttga

SEQ ID NO: 5262 - DNA, 438 bp, Candida albicans
agcaaatatactaacagttttatttttttttttgatagagatccaccatcatcatgttcagccggtccagttggagatgacttataccactggcaagcatctatcatgggaccaccagactctccatacgctggtggggtatttttcttgagtatccatttcccaacagattatccttttaaaccaccaaagattgcttttacaacaaaaatctatcatccaaatattaatagtaatggtaacatctgtttagatatcttaaaggatcaatggtcacctgcattaacaatttccaaagtgttattgtctatttgttcattattaactgatgccaacccagacgatccattagtgccagaaatcgctcacatttataaacaagatagaaagaagtatgaagctactgccaaagaatggactaagaaatatgctgtttga

SEQ ID NO: 5263 - DNA, 3246 bp, Candida albicans
  unsure (1483): Identity of nucleotide sequences at the above locations are unknown.
agtttaaaaaaggaaaccatgtcgagtgctgatgatgtgagagccaaaagattggccaagttagcaagctctgcaaacaccacaccaaatcggcaacaatctcccactgcagacacgtcaaccaccaacgttgctactactgttgccaccaatgacaacaatacaaaaagtgaaaaaacaacaccaaacacacctaaaccaatactggaaccccctgctaaaccaactgtatctggtcatactcctgtagatcaaacattactgaaagaagatcaaatttcatcatggattaaattggagttggaatacattttccgggcaacaacaacgaaactgtcggatagttctaaaggtttaatttttttacctaacttggcttatgaattaagtgacagtaatgttaaattaaatgaagaccacattgaatcaatttttatggaaattttaactgaattaggtgttccaaaacaatacaaaacaccaatggaatatttgtacacggtttatcacaatgcattcaaaaccaaaagaacacttgctgtgaaatctttattctacgaagataaagtggcaattttaaacaagatcattagtcttgtggctgcttatgggaatatgagtttccaaatgcccgatatgtttgtcaataatgatctacgtaaatcacttgatttgtttattgacagatttggggatttatcgtcatttttgagtgatattattcaagtcagtatagaggaagaatctttacttgaattgttgaatttatttttcccatatttgagtgctcgattatatcaagcaaatttaaatgaaaggaattatttgaattatatctctgttttccaatttttagtttcaattaaacctgttgcagctattttttcacaaataaaagggtttcaacctccagataaaaccaaggctttggattatgaacacaaaacattgttgggtccattattaagaatttctccattgttagataatatggctagtttttattttggacaagaaactaacagtatgtcaccggtacaaatcaacaatctttatggatcgatgcaaacagaatataaagtgatcattgatcatttgtttgttattattgataaactaatcagaggttcaactaaaaccagagaagatttgttgcaatggctaggtaatttaataaacttgagtcatttaagaagaggtagtcatgctgatttcaaaaaattggctagtgatggtataatgtataatatatcggttgttttcatcagattaagtttaccatttttggattatccaacatttggtaaaattgataaaatagatgttgatgatttttttaaaagtgatttaattgatattaaggaggaatcaagagtgaattccactatggaagaatcaaatgaatactatgccaaaagaatacatgaatcatcaagtgataatttaactcctactcctcctcctaattttatttctgattgtntcaacttaacattggcttatttgcatcatggtgttggtggtatatatgtcaaatatgatcgtgtaaaacgtcaacttgaccaaatggaaccaagattagaagctattgaatctgaacatccaatacctggaatgattcccatgatccaacaattgatgagaactgaattgccagatttaaaaaatgccattatcaatatgagagctcaaagacatgttattaaagctatttttgatgatcgtgatcatcaattggaaatttttgattttgttgttggtgctaccacatttatcacaagattaattgatccccaacataaatatcctcaagtgaagctttctataccaattttaaagatttctaatgtttctcaattagatgatcatgaatttttgaaaacgaaaactcccgaaccttggaaatattatcctgaatttatattagaaggtatcattaattattgtaaattttctactagatttattggatgccccttggtttctaatgaaaataaattgaatattttcgttgaatttctgacgattttattaagatgtccagaattaattggtaatcctcatatgaaagcaaatttggttgaattgttatttatgggatccttacctatgcaaaatggggcaccgggttttatttctaatattttcaatggtaatcaattagtaatggataatcttttgtattctttacttgatttttatgtcatggtagaaaaaacgggcgcctcgtcacaattctacgataaatttaatagtcgttattatatttcggtaatattggaagaattatggcagaatcctcgttatcgttttcagttaactgattattctaagaataatgttgattttttcattcgatttattgctcgtatgttgaatgatactacatatttgttggatgaaacatttaatttgttgaattctattcatgattatcaacaagaaattaaaaaaagagaatctggtggtgaagcaaatgaaactatgggtacagatgaagaattggctcaaaatttggaagaggatgaacgtcgagttaaatcttatatgggattatcaaataagacaatggaattatttaaattgtttactaaagaagttcctcgaggatttgttttacctgaaattgttgatcgattagctggtatgttagattacaatttatcgattttggtaggtccaagatgttcaaatttaaaagttgctgaaccagagaaatatcaatttgaacctaagaaaatcttgagtgatttatgtgaaatatatgttagtttatcggcacaaccagaatttgttattgctgttgctagagatggtagatcatttaatattgtttatttccaaaaagccgagaaaatcttgactacaaaaacatttattaaaaatgaaatcattaatggattgattgaatttgcgaataaggccgaaaaagctcgattagacgaagagaatgaagaacttgaattgggtgaaatacctgatgaatttttagatccattgatgtttacattaatggaagatccagttattttaccatcatctagagtcagtattgataggtcgacgattaaagctcatttgttgagtgattcaactgatccatttaatcgtgtaccattaaaacttgaagatgtgattgatgatgtggaattgaaacaaaaaatccaagatttcaaacaacaaaaggaaagctcacaaaagcaaagtaataatgatgaagatgaagatgttgtcatgaaagagtaa

SEQ ID NO: 5264 - DNA, 720 bp, Candida albicans
tcaatgtcatctactcttccaccattcagtgatttaaatgccacttggacattcatccaaccaggacttgaatatattttgggtgctcatggagaacaaggtgttaccgccacagtgtatatgaattgttatactgcagtttacaattattgtgtcaacaaatcaagacgtggaacaaccccggtttctatttccaataattccgataataattcttattcacttgctggtgctgagatttataaaaaattagaagaatatttaactgaattcatcaagaatttgaaaagattacctaatgaatcatttttagaattttatgttcggaaatggacgcgattcaccattggagcagtatacatgaacaatgtttttgattatatgaatcgttattgggttcaaaaggaaagatcagatggacgtaaagatgtttatgatgttaatactttatcatttattaaatggaaggatgaaatgttcaaaccaaattcaaaattattaattgaacaaattttaacttgcattcaacaacaaagagataatatgattgttgacaccaatttaatatctagtgctattaaatcattggtatttttaagtattgatatccaagatttgaaaaaaccaaatttgattatttatgtaaattcatttgaaataccttttttggaagccaccatggaatattatgctaaagaaagtgcagcatttttggcatga

SEQ ID NO: 5265 - DNA, 1866 bp, Candida albicans
tcccaagaatttgtgtctcacaatctaggaacaaaatatttgcaattgacaactcaatttattaaagatgaagataatagagttcgattttatctaccgccttcaacatatcccaaattggtggagttaatgaataacataatgattaaagataaaatagataaaatgattttgtcactgaatcaaggtttggaatattggttgaaacctgttgtgagcaatatttttgaagacactaacattgaaacctatcattacgcagatttgaaaatgttgtacaatttgattggcagattcgatgacgaatatcaactattaagattgcggttgaaagaagccattgttgcccaaggaaattcgttaccagattatgtgcgtagttccattgaaaattcaggtaagaaacagtctaacaattcaccagcatttgctacaaaatggattgagactattttaaagtatcgtgaccaattaatgcaagtttggaaaaactcatttgatgaaaacttgatgatcgaacaaacttttacttttgctatgagagatttcataaatggaagcaataaaaggggccccgcatcagttaatgctcctgaattattatcagtgtacatggattattttataaaacaattaacgaaaggcagttcatcaaataaagatatatcattaaagtctggtgaccagacagaggacttgatttccaattcaatacagttcttgagatttatcaaggacaaagatgcatttgaagcaaactatgctaatcattttgccaagaggtttttaaattccaaaactggtaattctccttcctccaacaaagacattgaagaaataattctagccaagttgagtgaagaaatggggacttcatcattggataaagttatcaaaatgaacagagacgtaaggctgtcaaaggataccactaatgactggaaacgttatttgaataaacaaagcaaatcaacagatttggttgagatggaattgaaaatatgtaatgtgactgattggccaaaatccatgactaaggattacaaatggtttagtaggactgaaaatgaagagaccccattcaaatggccacgtcaattacgtaacaccattaaacaatttgacgagttttggagtaacggtaagaaaaacgataacaagtcgttgtattggtctcccaaatttggatctatggatttgcggataacgtatccttctagaacgtacgaaatcaacttgtctacatttgcagctattattatgctccttttcgctcctcaactgacaaatgcagatggttctacagttctggcatttgatgaaatgaaggagttaacatatgaagagattctagagttgactggtattcctgaaccagagttgaaaagacatctacaatcaattgcagttgctccaaagctgagactacttgttaaagttccaatgagtaaagatgtgaacaagaatgatgttttcaaattgaatgcaaagtttaaatcaccatcagtgaaagtcaaagtgttgacagtttctgcttcttcttcttcttcagcatcttcgtcgtcgtcatcttctaaaaacaccaacaaatctgttgcaaagaccgaacaagaagaggaactagaagaagttaacgccaacatcatggagggacgcaaaattgaagttaatgctgccattgtgcgtattttgaaatcaagacaatcaataaaacataacgatttaattgaagaattacttaaacagttgagtaatagattccagccactgattatattgataaaacaacgaattgaagatttgatagataaagaatatttgaaaagagatacagatgataggaatttgtatcattacatagcataa

SEQ ID NO: 5266 - DNA, 630 bp, Candida albicans
aaattaagtttaaaagatggaatgaatgttttatttgattattcaccaatggtgttagcacgtagtacatggccattccattcttcacaagattataatgatttgacacttgctcatgaattaaaagtgacaattgattcatttaaagcaatgtatttacaacaaggtaaaggtaaacaaattgaatggctttggaatcatggtcgagctgaattaaaagcccatttaactaaaggtaaaggtggtaaaccatttaattttattgtttcacaaatacaactcatggtattattagcttataattattccaaaacttatacattggatgatttagtaaagattgtcgggattaaaaaagaattattacaaaatcatgtgacaccatttgttaaatataaattacttaaagaagaaggtgatcaattagtaattgttgatcattatccatcgaaaaagaataaagttagttttattggtgccatcactaaaactaaagaagaagatgttgaagaaattactaaagaagttcaacaatcaagaacgatatttttggaagcttcaattgttagaatcatgaaactgaaaaaactgatggcactttcttcacccagacgggctggcagatccaac

SEQ ID NO: 5267 - DNA, 342 bp, Candida albicans
gtggaaccaccaagaggagtacttttgtacggccctccgggatgtggtaagacaaccattgccaatgctttggctggcgaattgaaggtgccattcattaatatttctgccccctcggttgtctcaggaatgtcaggtgaatctgagaaaaaactaagagagatatttgaagaagccaaacagattgctccttgtctaatattcatggacgaaattgatgctattacaccaaaacgagatggaggagctcagagggaaatggaaaagagaatagtagcgcaattgttaaccctcctggatgaccagacattttcaccacgccaagaggcacccaattgttta

SEQ ID NO: 5268 - DNA, 2529 bp, Candida albicans
tttatatttttatttctacaccataaatttctacaaataacacaaattatgactggtgaagaagataaaaaacaacattttgatgcttctggtgcttctgctgtagatgataaaacagcaactgcaattttaagaagaaaaaagaaagataatgccttggtcgttgatgacgccaccaacgatgacaattctgtcataaccatgtcgtcaaacacaatggaattgttacaattattccgtggtgatacagtcttggtgaaaggtaagaagagaaaggacacagtgttgatcgttttagctgatgatgatatgcctgatggcgttgctagagttaacagatgtgttcgtaacaatttgcgtgtcagattgggagatatcgttactgtccatccatgtcctgatattaaatatgccaacagaatctcagtattgccaattgctgatactgttgaaggtattaatggttccttattcgacctttacttgaagccatattttgttgaagcctatagaccagtgagaaaaggtgatttattcactgtgaggggtggtatgagacaagtagaattcaaagttgttgaagttgaccctgaagaaattgcaattgttgctcaagataccattattcattgtgaaggagaacctattaatcgtgaagatgaagaaaatagcttgaatgaagtgggttacgacgatattggaggttgtaagaaacaaatggcccaaattagagaattggttgaattgcctttgagacatccacaattattcaaatcgattggtattaagccaccaaagggtattttgatgtatggtccacctggtaccggtaaaaccattatggcaagagcagtggccaatgaaacaggtgccttctttttcttaataaatggtccagaaattatgtctaaaatggctggtgagtctgaatccaatttaagaaaagcttttgaagaggctgaaaagaattctccttccattattttcattgatgagattgactctattgccccaaagagagacaaaactaatggtgaagtagaaagaagagttgtttctcaattgttaacccttatggatggtatgaaggccagatctaatgtagttgttattgctgctactaacagaccaaattctattgatcctgctttgagaagatttggaagattcgacagagaagttgacattggtgttccagatgctgaaggacgtttagagattttgagaatccacacaaagaatatgaaattggctgatgatgttgacttggaagccatcgcttctgaaacacatggtttcgttggtgctgatattgcttcattatgttcagaagctgctatgcaacaaatccgtgaaaagatggatcttatcgacttggaagaagaaaccattgatactgaagtgttgaactctttgggtgtcactcaagacaacttcagatttgctctcggaaactccaacccatctgccttgcgtgaaactgttgttgaaaatgttaatgtcacttgggatgatattggtggtttggacaacattaagaatgaattaaaagaaaccgtggagtatcctgttttacatccagatcaataccaaaaattcggattggcaccaacaaaaggtgttttgttctttggtccaccaggtactggtaagacacttttggccaaggctgttgctactgaagtttctgctaatttcatttctgtcaaaggtccagaattgttgagtatgtggtatggtgaatctgagtctaatatccgtgatatatttgacaaggccagagctgctgctcctactgtggtgtttttggatgaattggactccattgccaaagctagaggtggttctcacggtgatgctggtggtgcctccgacagagtggtcaatcaattgttgactgaaatggacggtatgaatgctaagaagaatgtgtttgtcattggtgccactaacagaccagatcaaattgatcctgcattattgagaccaggtagattggatcaattaatttatgtcccattgccagatgagccagctagattgtctattttacaagctcaattgagaaacactccattagaacctggtttggacttgaacgaaattgccaagatcactcacggtttctcgggtgcagatttgtcttatattgtccaaagatctgctaaatttgctattaaagactctattgaagcccaagtaaagattaacaagattaaagaagaaaaagaaaaggtgaaaactgaagatgttgatatgaaggtagatgaagttgaagaagaagaccctgtgccttacattaccagagctcactttgaaaaggctatgaagaccgcaaaaagatctgtttcagacgctgaattacgtcgttatgagtcttacgctcaacaattgcaagcctcaagaggtcaattttctagctttagattcaatgaaaatgctggtgccactgataatggttcagcagcaggtgccaactcaggtgcagctttcggaaacgttgaagacgaagacgatttgtgcagttga

SEQ ID NO: 5269 - DNA, 918 bp, Candida albicans
tcacataatattgttgaacccaaagatataaatatggatgcgagattaccatttagaaaacaagatgaacatttcatgtcagaaaattcccataaaaatggaccaattggaagaaaatccgatggaaatcttgaacttgaacttgaacttgaacctgtatccccatcttcttcatcaacatcaccaatatcatcaccacattcatcagattcatcaacaagttccactggttttgataaagcaaaatatgaatcagaaacattcacaacaggtactgtcactgtgacaaccgatttatccaataataataataataaaactccacaaaatggattactattaaattcaaaattattatataatttaaaagcagttatatctcattatggaactcataattatggtcattatatttgttatcgtaaatttagagggacatggtggaggattagtgatgaatcggtttatgtggttacagaagaagaagtattgagtggacaaggcacatttatgttattttatgaatatgatgatggatttaaagaagttttacaagatgtaaccgatgaagaagaagaagaaaaagaaaaagaagaaaaagccccagtggtgaaagaaagtaatgaaaataaactcaatagaaataatttagctgggtctttaaatagcaatgaaaatgaacagggagctgaagctgattctgattctgagacagatgccgatgctgatgctgatatcgatgaaaatgatgttgaaaaagaagaagatgatgatcatatagaatcattgaacagctcacttgtgaatatccatgatggcacagaaagcgatcatctacttgataaaaacgatagtgataatgaaaacaataatgccgttgctcaattcaatattgcggaagcacaagtacatttgtga

SEQ ID NO: 5270 - DNA, 696 bp, Candida albicans
ccaatcttgattccaattaatacactcttttgccattttttttttaacttccaacccctccaccttcaatttgcatccttcaggtcattttctgattcaccccatttcatgtttctttctagaagaattattttattcttaattattaactttactttattattacaattattcaaattgactttattcaccaaaaacaaattagttgctactgtttcgacatctttacttttatttatttcattatattatttaaccacctcaacaacatcgacattaggttcaaaattatcatcaacatttaatatcaatatcatcatacccaaatttctccgtaatattatgaattcagcaagatttggtagtagtagaccattttcaagatttagttataataataattccaaaaaatcaaaagaacaaaattttgcaattaaaaatggtggtgaaattggaggaattagtaatgatggtaatacatgttttatgaattctgttattcaatcattagcttcttcaagagaattattaaaatttattgatctgtatttatatactgaaattgaattagataaaaaacctaatggtgaatcaataattatgaaatcaaatcaacctaaatcagaattagttttcacaaatgcattgaaaaaattgttagataatataaatgggaaatatggttcaagaagttaa

SEQ ID NO: 5271 - DNA, 588 bp, Candida albicans
gaatttaatactaaaccattattaaataaaatgccaaatggtcctaaacaaaattttttcagtggttataatcaagaagatgctcaagaattttatcaactagttatgaatttattggaaagagaatataaaaaaatgaattcttcaagattaccaacccctgaacctgaagacatgaacaatgataaactgcaagataattctactgctactagtggtggtagtaaatttattgatgttagaaatatcaaaagtgatgttgttagtggttgtgataaattgggtaaattaggtacagtatatgtaccagcagcccaagttgatcctaatttgagtgatgctgaacataaagtattgccattagaattaataactccggttgatgggatttctgctgaacgtattggatgtttgacatgtggtgaagttggtggtattcgttattcagtgataagtggattgagtttaaatttaccaagtacttcatcttcatcttcatattattctggatatgatttatatcaattattaaatgaatggataaatcctgaagtgattgaacatgtgaattgtaatcgatgtggataa

SEQ ID NO: 5272 - DNA, 666 bp, Candida albicans
tatggaatggaatgtgtgggcgaaaaaaaaaaattttggtcaagaaaaagagagagaaagggaaagaaagaacgaaagaagaaatcgaatggaatgaaaaaaaaatatgctcaccttattcttgaggtggattgtttatctttttcttttttttttttttgggtttgctttctatcaagcacaacactaatgtcactttgtttgattagattacaagaagaaaggaaacagtggaggaaaactcatccatttggatttttcgcaaaaccaaacaaggcttcagatggatccttggacttgaagcattggacggctggaataccaggcaaggaaggaactatatgggaaggtgctgtttatccggtgacacttgaattccctgatgaatatccttctaaaccaccaaaggtcaagttcagaccaaagttttatcatccgaatgtataccctagtgggactgtgtgtttgagtatattgaatgaactgcaagattggaagccggccatcacgttgacacagatacttttaggggtgcaagagttattagacacaccaaacaaagaatcacctgctcaagaagatgcatatagacactttgtgcatgatatgaacacctatgtgaagagagtcaaagcagaagttaaaaaatatatgactcaagaatga

SEQ ID NO: 5273 - DNA, 702 bp, Candida albicans
attttaggggagaaatgggtttcagccttccaaaaggggggaaataatatggggtttccggaacgcgtaagaattttttggcccaagccatttcccaattcaaacaagtgccaattttttggaggattgtcggattcggagttgatccagaaatatctaggtgatggtccaaggttgtgtcgtcaaattttccaaattgctgctgatcacgcaccttcaattgttttcattgatgaaatcgatgccattggtacaaagagatacgagtctacatctggtggtgaacgtgaaatccaaagaaccatgttggagttattgaatcagttagatgggttcgatgatagaggtgacatcaaagttattatggctacaaataagatagagtcacttgatcctgcattaatcagacctggaagaatcgatagaaagattttgtttgaaaaccctgacgccaataccaagaaaaagatcttgactattcacacgtcaaagatgagtttggcagatgacgttaacttggatgaaatagtcactggtaaggatgatttgtcgggtgctgatatcaaagctatatgtacagaagcagggttattagcattaagagaaagacgtatgcaagtcaaagctgaagatttcaaatctgcaaaggaaagagtcttgaaaaataaggttgaagaaaacctcgaaggtttgtatttgtaa

SEQ ID NO: 5274 - DNA, 873 bp, Candida albicans
ccagccaaaactcaactatttgcttctacagccaggacctctaaagttgggggtgtaacgtttggtagcaacagcatcagctttttgagcaacacacacctccttttgggaatttttttttttctctgcgaacttcttatttcttggtggcgagttttccaaatcaaacattatttgtatatcccatactccaagcaagcaatcatgggtcaaggtccttcaggaataccaggtggcgataatctcaacaaaaagaaagatgataagaaaaaggaaaaaccaaagtacgaaccaccagtggaatcaaagtttggtaaaaagaaaagaaggggccccgatacagcagttaaattacctagcgtgtaccccaacaccagatgtaaattgaaattattaaaattagaaagaatcaaggatcatttgttattggaagaagagtttgttaccaaccaagaagcattccaacctacagaagcaagacaagccgaagaaagagaaaaagttgacgaattgagaggatatccgatggcaattgggacattagaagaaataatcgacgatgatcatgcaattgtgtccagcactgctagttcagagtactatgtgtcaatcatgtcgtttgtagacaaggggttattggaaccaggatgttcagttcttttacatcacaaaacagtagcagtggtaggtgtgttacaagatgatgctgatcctatggtttcggtaatgaaactcgacaaatcccctacagaatcatatgccgacattggggggttggaatcacaaattcaagaaatcaaagaatcagtcgaattgccattgacacatcctgaattgtacgaagaaatgggaatcaagcctccagtcttcacc

SEQ ID NO: 5275 - DNA, 1614 bp, Candida albicans
  unsure (1445): Identity of nucleotide sequences at the above locations are unknown.
aggaagtattggggagtttcattgtcggaagaagcattttcagaggtttttaatttgggaacaagttggaacggttggtcttcgataattataactatggcttcgacgtcaaaagagagactttacggaatactagatctactagaaaaggaaaacccattcacttctttgatagggatattattgaataataaatacatcagttcgagattaaagatagctccgctgtttctctcgggtggaattttgaattggtaccatactctcggtgcagattatttagagactagctcgatcaaaaatggagactgtttaaaggaagaaactaggtacttaacttcatttagtgattatctttcgaattcaaaagagagtctgccttcagaagtcacacttgcaaatgagaacaacagtgcttatattagaccagttcaaaagaaagtcgagcaatttgattctataccaccaaaaagtactgctacagtgtactcgtcacccaaagttgagttacccttaactccgacttcatccacccccaattcgccggcgcctcctttgcaacctttgctgtcaaatgggaagctgccaaacaatgttacagctaaagatgttactgtttcgtcgaaaaagtcacaatttctcgaactgtatgccactggtttggtcaatttgggaaattcatgttatatgaactgtgttattcaatgtttggctgcgactccacagcttacttcattttttttccccacgataactgaatcgttttcggaccattcatacaaacgacatataaacgtgaacaataaattagggacaaagggaatgttgacaaccagttttgttgaattgatattgagtatgcttaacaacaatggacgctcattcagtccttctaagtttaagaaaataatgggttcgttgtcaccggctcgacagtttgcttcctttgatcaacaagactgtattgagtttttgaattttcttttggatgcgctccatgaggatctcaatcaagtgaccatagccgacccacaggaaagaaagatgatcactgaattaacccctgagcaggaaaaaaatagagaaatattgcctgtcagattagcttccactatagaatgggagaggtacctcaaactaaatttttctataattgttgactattttcaagggcaatatttatcccaattgaaatgtttagaatgtggatttacttcaacaacttataatgcgttttcgatactttcactacccatcccggagaaactaaacaaactgatgaaagtttctttggatgaatgccttcaagaatttgtgacaacagagttgcttgatgataataacaagtggtattgtcccaattgtaaaaaatttaccaaactgacaaagaaaattgcaattactagattaccccaagtattgataataaattttaagcggttcanaatgaccgccagtggtggatttcacaaattggaaacttttgtgacttaccctgtgaatgaagaattggacatgactccgtattgggcggatgttggctctaccatcagtgccaacaattcaatgtctatagaaaggggaaaaaaaaaatttgagtacttccccatttag

SEQ ID NO: 5276 - DNA, 567 bp, Candida albicans
attcgcccaacattaacaaacacctcctccactccccccatggctagacatccattttataagcgattattaaaagagtatcagcaaataagtttgaataaactaccaggtataaagcttgttactaatgatgataatctaaccgagtttatattccagatcaaagtggcaaataatccgttatacccagatgacgaggactattatctttcgataaaaattactgaaaactaccccgttgattctcctcaagtcaagttcgttattcatgaggaagataacgatgacgattccataatcatccttgacgatgactcgcttgaaattatatcacattcagttatccccattcatcctcacatatattcgaatggccacatttgtcttaatctattaggtgacgattggacaccagcatgttctatagagtcgatattgttgagtattcaaagcatgttaagcacaaacgacaaacgggaaagaccgcctgacgacacttcgtatattaagcacgctccaacaaacccaaagaactctaaatttatttatcacgatgataatgtgtaa

SEQ ID NO: 5277 - DNA, 264 bp, Candida albicans
tataaaaaaaatattgatatcccacaagaatatccatttaaacctccacaaatgaaatttattaccaagatttatcatcctaatatttcatcagttaccggggctatatgtttagatattttaaaagatgcttggacaccaattttaactttgaaatcaagtttgatttctttacaaagtttattacaatcacccgaaccaagtgatccccaagatgcagaagttgctaaacattatttaagtaataaatcgggatttgtttaa

SEQ ID NO: 5278 - DNA, 207 bp, Candida albicans
acaactaaacaaatgtctcgtgtcaaaagaattgctaaagaattagaagaatgtcgtcaagatactcaatcaggtgtatctttaaatttgaataatgaaaatgatttgactcatttgacaggatattttaaaggtccaccaggcacaccatatgaaagtggattatttcaagtagctattgatatcccacaagaaatatccatttaa

SEQ ID NO: 5279 - DNA, 1119 bp, Candida albicans
gagatggaagacccagttctgttagacaacgtaaacagtgtgttatcaaaattgaataacgtttcagctacaaactccaatgaaactgatgtgtatcttaaattgaaaaaattggagaaggagttagatttactattactacaagaagagtacattaaggatgaacaacgtcatttaaagcgtgaattggtgagggcacaagaagaagtcaagaggataaagtctgtgccattagtcattggacaattcttggaaccaatagatgaaaacactggtatagtttcatccaccactggttcaaactatgtcgttaggattttatctacattagatcgtgagttgttaaaggcatcctcttcggttgcattacatcgtcactcaaatgcattggttgacatattgccaccagaagctgactcttctatatcaattgttggagaagaccaaaagccagatgttacttatgccgatgttggtggtctagatatgcaaaagcaagaaatcaaggaagccgtcgagttgccattgactcaaggtgatttgtattctcaaattggtattgatccacctagaggggtgttgttgtatggtccaccaggtactgggaaaaccatgttagtcaaagctgtggcaaattcaaccacggcttctttcatcagaattaatgggtcagaatttgtacaaaaatacttaggagagggtccaagaatggtgagagatgttttcagattggcaagagagaattcaccagcaatcatttttattgatgaaatagatgcaattgctaccaagagatttgatgctcaaactggtgctgatcgtgaagttcaaagaattttgttggagttattgaatcaaatggatgggtttgatcagacatccactgtcaaagttataatggctactaacagagcagatactttagatcctgcattgttgagaccaggtagattagatagaaagattgagtttccttcattgaaagatagaagagaaagaagattgattttttcgacaattgcatcgaagatgtcattagcacctgaagctgatttggactctttaattatcagaaacgatccattgtctttttcacacacggccgctgacggatcgcac

SEQ ID NO: 5280 - DNA, 621 bp, Candida albicans
atcactcttatttcaactaaccaacccacaatggatattattttaggaattaaagtatctgacggcacccttattgcaacatctaaagctgccacaagaggtatttcaattttaaaggatacagatgataaaacaagacatttaaatgcacacaacttaatagcatacactggtgaagctggtgatacggttcagtttgccgagtatgttcaagcaaacattcaattgtactcgatgagagaaaatgacattgagttatctccaaaggcaacagcctcgtttgtgagaaaccaattggccagttcccttagatctagaaaaccgtaccaggtgaactgtttaattggaggatatgatgtaaagaaaaatgagccatcgttgaattggatagattatttgggtacacaagttgaactcccttatggtgctcatggctacgctgcattttacacaacatctttgttagataaacattatagaaaggacatgacggtcgaagatggtttaaagttaatggatatgtgtgtcaaggaattacaaacgagaatgcctattgactttaaaggtgtgtacatcaaggtggtagataaagatggtataagacagattgagtcaaattga

SEQ ID NO: 5281 - DNA, 1290 bp, Candida albicans
agacttgggtccattgagaagaaattggtcaggaatgggaattcagtgttagcaactgtcataaacaacacatacccgcaaactcataactcaaaaacatatttattaaagtatttgaatgaatcgccaacttcagtgggaaacgatgcaatggatgttgataataccacattgattccagaaattgaactttacatacatctcttggttcaagtttatcttttagatactggtaaattggaagaattgaattccttaggagaacatgtggtccaattgatgaaatcattcaatagacgttcattggactttattcaggcaaaggtatggttttatgtatgcagggctaaagagttgattggagatttatattcgattcgtccagagttactgtacagtttgagaacagccaccttgagacatgatatagaaacaacagcatcggtcatcacattactattaagaaattacttattgacccacgacatcagtcaagcttctgatttggtagaaaaagtcgaatttcctgaaaatgctggtaatgcgttagttgctagatactattactatttggcaagaatcaatgccatccagttggactattctactgcaaatgagtgtgttataaccgcgatcagaaaagcaccacaaacatctttagccaacggatttgtccaagcagctactaaattgagcattgttattgaattgttaatgggagatattccggaattgaaagttttcaaaaacaagtctggcaatttggaaccttacttcaatgttactaaggccgtgagattgggtgatattaagttatttggtgaggtattgcacaagtttgaagctgacttcaaaaaggatgacaatttcactttggtttctagattacgtcagaacgttataaagacaggtattagaatcatatcattgtcatactccaaaatatcgttaaaggatatatgcatcaaattgcatttggattctgaggaatcaacagaatacattgtttccaaagctataagagatggtgtcatagaggccagcatcaaccatcaaaagggatacatgcaaagtaaagaattgttggatgtgtactatacaaaattgcctcaagcagagtttgaccaaagaattaagttctgtttgtcattgcataatgagagtgtcaaatccatgagatatccaaatgataatgaaaaagaaaatgccaacaaagaaattgaaccaagtgaggaagttgaattattgaaagctattgaagaaggagatttggatgactttatggattaa

SEQ ID NO: 5282 - DNA, 627 bp, Candida albicans
cacatcatgtcggatccattttcaattaacggaagtgcagcagtagccatgattggtacagaatgtatagcaatagccagtgatttaagattaggacaacaatcgcttggtgtgagtaataattttgaaaaaattttcagtgttggtgataaaaccttcttaggattgactggattagctactgatgtgatttctttgaaagaattatttagatttaaaaccaatttatataaattacgagaagaacgtaatattgaaccatcaacattggcaaatttggttagttcatcattatatgaaagaagatttggaccttggtttgttagtcccattgttgctggattaagtagtaaagataataaaccattcatttgtggatttgattcgattggatgtattgattttagtcacgatttcattgttagtggtactgctagtgatcaattatatgggatgtgtgaaagtttatatgaaccaaacttggaaccagaagatttatttgaaactatcagtcaagccttgttaaatgctgttgatagagatgcattgagtggatggggcgctgttgtatacatagtgactaaagataaagtgattaaaagggtattaaaaactagacaagattga

SEQ ID NO: 5283 - DNA, 942 bp, Candida albicans
tactacaaacagccaaccatggggaacagtgaaaccgacaatctattattcggtgatggatcagataaaatatttgggatggagaattttggaaacacatgctattgcaattctatactacaatgtttatactacacggaaagtttcagattgaaactaatccaacataaccaaacaaagcatgatcctaaacttattgttacaggagtcaaaccccatagtttcacaagcaaatacgaacaacttgtacaaaagaaactacgagaacaaggagggaagctggcatcactgaattcaaacacggctactgaagaaagacccaaacaaggtagtagaaaaggatccatttttggtattaaatttaacaattcagtcaatacctcaactacaacggttcctgtagctattgatgattcaaaaaaactatatatgaaatatatcgacaaagccaaagactgtgaggctctatcgttggaacaacgcataaaaataagcaaatctccagaatttcaaaagttagatatcttggtaacaaggccgtcaatcaatcaaacagctaaaaagcctgttgacgacgacaatagaaatgattattcacaaagctcatctatggtagtcaatgatcaaccacaacaaactatacaagaagggtctattagcaatacttctagtgctataatagttggaataccacttcccgaatctaacttgaacacaccaattaacccattcaattcggatcccagtggcgatcagagaaagagatcagccttgatcaatggaccaattatcaacctagatacatcattgcaacttcccagcgagcaacaagaagatacagccttgctatatgcgttgaaggatttatttgaaagtatggttgaaaacaaatctacccttggagtagtatcaatcttccaccacgggctggaaagatccgcg

SEQ ID NO: 5284 - DNA, 735 bp, Candida albicans
acaaatgaacaagatgttaaactttttgattccataaattaccctttcaagttgcgattgtttaacactactgatgatgaatcgttgacggatttgttgtatgaattgtatgcattagttattcacattggtggtggaccgatgcatggacattatgtttcgttatgcaaaatcaaagctggattatggttattatttgatgacgaaactgttgaattggtggaggattcatatgtaatgaggttttttggtaatggacccggtctagcaagtgcttacattttattctacaggcaggcgaaatacgatcctgaatttggttttaatcctgaggatatttacaatggcaacgacgattactctttcaagcaaacagaggacgaatcaagcacatttgcaacttcggttaacaatgactatcttgataccaaatcagaagcttcttccattgcctctttcaatgtgaatgaggcgactaaaaagacaaacgtattcaaaaatttcaaatttgacaaggatgacaaacccccagctccaatttctcgtagcaatagtatgaatgctaaccttgctccaggtgctcccgttaaagaggttaaagagaagaaatcttgggttggtaatttgaagagaaggaataccgagaccagtaatagtggaaatataccaccgatggaaagaaaaccctccacatcttcaccacgaggtgccgcatccgcgataattatccccccc

SEQ ID NO: 5285 - DNA, 777 bp, Candida albicans
acattaatatcaccatttagcattttccttctttttttttgtatcatggcatcaagacaagcaactaaacgtttaaataaagaatataaatcaatacaagccaatccaccgccatatataattgcccatccatcagaagataatattcttgaatggcattatgttcttactggaccccaagatactccatatgaaggtggacaatatcatggcttactccgatttcctccacaatatccatttcaaccaccatcgatattaatgattactcctagtggacgatttaaacccaatactcgtatttgtttatcaatgtcagattatcatcctgatacttggaatccagcatggtcagttctgacgattttaacagggatgttatcatttttcactggtgaagaatcaactactggatcaattaatacatcagtgaatcatcggaaagtattagcacaaaaatctaaaaaattcaatgttgataatgatagattttgtcgagaattccctgatttggttaaacaatatcatgaagaaattgctgctgaaaaagttaaattggaacaacaagaaaaggaacaacaactaaatggacagcaacaaggtgatcaaaaagaacaattggcaaatttggaagatttagatccagaagatagaattcgagtgatgcaacaactagaacaagaacaaaaacaaaaacaaaaacgaaaacaaaaccaagatgatgaaaatctaaaccaagataatgataattctaatagaatgtgtgttattatgtaa

SEQ ID NO: 5286 - DNA, 1044 bp, Candida albicans
aaaaaaagaccttttccaactgttgagcttatcattccatgttctaatcctatgacatcttcatcatcaaactcagggtcactgcgctttcgtggagacgcagctagcttttcacctagccaatacccaaactaccaccagcaacagtttcacccgcaacaatatatggcacagcagattcctgcgcaacaacagttttactatcagtttcctcagacatatcccatgatgatgaatcagatgtatccggtgtttccctatccgccagatccctttttccaacaacaacaacaccaacgacggcaacaacaacagcaacaacaatttgtaatgcagccgcagtatatgtatcatccaccgccaaaacgtcccaaaagtaataaaccaccaaaagtgaatggcagtgcaccaccaccaccaccaacaccaccaaagatcgaattagtggatctcccgttgtacattaatacttcgaaaaccgaatttcttcaaagatacagcataacccaagagtcacgttctatagacgagcttcaacgagccaatacattagaggaatacaacgaaaacactaatagattaattatcagcactaatgtcatgaaaataatagatgaaaatgatcacaaaactaccattacaaatggacaacccgaagaacccaaacccgctgccaaagctgtagcaccacctgtgcctattagtaattgggccagtttccttcaatcaactgcaccaccaaccccaaaaaaaatagctaaacccaaaccaccaccaactcctccaaccccagtccaggcagtaacaccagttccgcaatttgatatgagcaacgaatctgcacagcctttggggacattattgctcaaaatcatgtttgatagcaactactctgttttcagcagcttgccaacatttgatataaaacctagaggattgactaacaccggcaacatttgttatatgaattctatattacagattttgatccactgtgagccattcaatagattgctaaaacttatagagaacaagtccatatga

SEQ ID NO: 5287 - DNA, 276 bp, Candida albicans
aggaagagactggagtacaaccacgatttaataataccgaaagaagtaatggcaagggatacggggatgccgatcaaataccagttggtgtcggttgtttaccaccacggaagtagtgcagatgctggacattataccagtgacatatacaatgcaggccaatggtggagaatagatgatactgctgtgaagcagatacagaatgaagaggttttgaatgctggcacagaggagaatataaagaatgcgtatatattattgtataggagaatctaa

SEQ ID NO: 5288 - DNA, 864 bp, Candida albicans
aaaacaggaagaaaacaatcacgaaaaatgaatcacgatccatacatttggggtagaccatccaatgacatttatgctccatacaattacaaaattgctcatgccaataacaaccaagttgagcagactacccataatttccctaaaatgaatactcaacaaccaataattactggtacctcagtgattgcttctaaattcaaaaatggggtgataatggccgcagaccatgttggatcgtatggttcattattgcgattcaataacattgaaagattgattaaagtaggtaaggagactgttgttggtatttctggagacatttcagacttgcagtatattgttagattgttggatgaattagaaattgatgaagaggtttatgataatgatggcggtgaatacttgagagcccccaatgtgcatgaatatttgtcacgagttttgtacaatcgaagatctaagatgaatccattatggaatgctatcattgttggtgggtttaacaaggaccgtactccatttttgaaatatgttgatttattgggagttacttaccatgccagtaccatggccacagggtttggttcacatttggctatcccattgttgagaaacttgattccggaagataaggattatgttaaagttgacgagcaacaagttagcaaagccatagaagattccatgagagttttgttttatcgtgatgctagatccggtgagaattattcggtggtgataatcaagattgatgaaaatacaggtgaattaagctttcaatttatcaaggatgccaaagttcaaaatcaaagttggaaatttgccggggatattagaggatatggtagttcacaacaatag

SEQ ID NO: 5289 - DNA, 888 bp, Candida albicans
aatcaacaaaaagtgatatcttcacattcctttcaactctcttattcatcgatcatgtctttacaaaaactcactgcagaaatatactcactatttggaaaaggagattatcaaggttgccaacaattacttgctccgattaaactagaattagtcaaacatgatttgttggttcctttaccatccaacaccaccgataaaaaccaaattaatgatttgagaattgcccaaagaattttggaaattggagcattatcgtcattattaaccaacaactattccggttttgagaattattttgctcagttgagaccattttactctaaccccaaattacataatttacaaaaagtccatatcaataccgatataacaaaaatcatttcattatacttgttatacttgttgagtcagggtttgatttcaaaattccatgttgaactagaagtgatttataattcatcacaatatgatgcccaacaagacaagtatttacaatttccaataaatttagaaagcaatttaatggaaggtaattacataaaaatctggaagttattaaaagaagagaaaaacttaccatgtcaagaatacacccattttgttgatactttgataaatgctttacgttttgaaattgccaaatctttggagaaaacttacgattcgattccaatttctaattgcaagaatttattatatttaccacaagaattgtccgatgctaactttgagaaaactttaaaggaaacttatcaagttgataattggaaattcgaggatggagttatatatttcactaagaatgaaaatgaaaccaatgttgataaccaatcggttataaagaatttattagggtacgctgaacaaatcgaatccatcgtataa

SEQ ID NO: 5290 - DNA, 450 bp, Candida albicans
tttactttttatactaacttctattctttttatttcaatttgaatagtccaagaaatttcaaattattacaaaaattagaaaaaggtgaaaaaggtttaggagcagaatcaattacttatgggttaactaatcaagatgatattactatgacatattggaatggtactattcttggtcctccacatctgaatcatgaaaatagaatatattcattaaatattatttgtgatgaaagttatcctgataaacctccaatagttacatttgtttctaaaatcaatttaccttgtgtagataaaaatggtcatgtattggttgaagaatttgatactttgaaaaattggaaacgatcatatactatggaaactatattattagaattaagaaaaagtatggcatcacctacaaataaaaaattacaacaaccacgtgaaggttctacttattag

SEQ ID NO: 5291 - DNA, 417 bp, Candida albicans
  unsure (381): Identity of nucleotide sequences at the above locations are unknown.
cttcatcaccctatagaagaaatgactacttcaattgataaatcttatgttcatgaaggtggtataagaccatattttgaacaacaaatacaagatacggaaataagaatacagcaaaccacacagaacttgcgtcgtttggaagcccaacgtaacaaattgaataacaaagtcagacaattaaaggatgaattaaaattattacaagaacctggatcatatgtaggtgaagttgttaaagttatgggcttgaaaaaagttttagtgaaaatccatcctgaaggtaaattcattgtcaatgttaccaaagatatcgatgtcaagaaattgactccatcaataagagtgtgtttgaaagcagattctcacgatttgtaccanatattacccacaaagttgatcccttggtttcattga

SEQ ID NO: 5292 - DNA, 957 bp, Candida albicans
cttcatcaccctaaagaagaaatgactacttcaattgataaaccttatgttcatgaaggtggtataagaccatattttgaacaacaaatacaagatacggaaataagaatacagcaaaccacacagaacttgcgtcgtttggaagcccaacgtaacaaattgaataacaaagtcagacaattaaaggatgaattaagattattacaagaacctggatcatatgtaggtgaagttgttaaagttatgggcttgaaaaaagttttagtgaaaatccatcctgaaggtaaattcatcgtcaatgttaccaaagatatcgatgtcaagaaattgactccatcaataagagtgtgtttgaaagcagattctcacgatttgtacaaaatattacccaacaaagttgatcctttggtttcattgatgatggttgaaaaagtcccagactcaacatacgatatggttggtgggttagataaacaaattaaagaaatcaaagaagttattgaattacctgtcaaacatccagaattgtttgaaagtttgggtatagctcaaccaaaaggtgttatattgtatggaccaccgggtacaggtaagaccttattggcaagagcagttgctcaccataccgaatgtaaattcattcgtgtttctggttcagaattagtgcaaaagtatattggggaagggtctcgtatggttagggagttgttcgtgatggcaagagaacatgcaccatcaatcattttcatggatgaaattgattctatcgggtcttcgcgtgttgaaggttcatcaggaggtgattccgaagtgcaaagaacaatgttggaattgttaaatcaattggatgggtttgaaagttcaaaagatatcaaaatcattatggccactaatcgtctagatattttggatccagctttattgagaccaggtagaattgatagaaaaattgaattc

SEQ ID NO: 5293 - DNA, 249 bp, Candida albicans
agaacagatatggtaaagattcattcaagatccatgaatttgacaagaggtattaatttgcgtaaaattgctgagaaaatgaatggatgcagtggtgctgatgtgaaaggggtttgtaccgaagctggtatgtatgcattgagagaaagaagaattcatgtaacacaagaagatttcgaattggcagttgcaaaagtcatgtctaagaatgacgatggtgctgtctccttacagaaattattcaaataa

SEQ ID NO: 5294 - DNA, 732 bp, Candida albicans
acaatgtcctattcagcaggttttgatagacatatcactattttttctcctgaaggtagattataccaagtagaatatgcttttaaagctatcaattcagcaaatatcaccagtttaggaatcacaggtcaagattctgccgttattatatcacaaaagaagatcccagataagttattagatcctaaaaccgtgtcatatatttttaaaatcactcctagtataggaatggttgccactggatcaattgctgatgctagagctcaagccatgagagcaagatctgaagctacagaatttagatataaatatggttacgaaatgccggtggaaagtttatcaagaagaatggcgaatatatctcaattgtatactcaaagagcttatatgagaccattgggtgttgctttaacttttattcaagttgattttgctgatgaaggtagaggtccacaaatttttaaatgtgatcctgctggatatttcactggggtgaaagccgtggccactggtccaaaacaacaagaagcaacgacttatttagagaaaaaattcaaaaaaaccgatgctgttaaaggagattggcaaaaaactgttgaatttgcaataattgccttgagttctgtgattggaactgaattcagaaaaaatgatattgaaattggtgttgccactgaaggagaatttacaattttgacaccagaagaaatagacgaaagatggattcaatag

SEQ ID NO: 5295 - DNA, 1059 bp, Candida albicans
gttagattattttgtagtttctattttctatatgactccctcactcttagcatcataattggttatggatatagagaaactaagttgaatggctgcagtgatatattccaactcaaaagaactagacttagaagtatcattttacgcacaacaagaatatctctcagtgcaaggaaaaaaagagaatcaaaacctacacacaaaagaaattatacgcaattgctacttttgaatataactattttctttctcaatcatcatatattaacaatgttttcgggttttggttcatcaatatatgggtccggatttggatcatcaggatttccaagtaataagtttgaagaatactttcggtgttatccgattgctatgatgcccgacttgattcgaaaagacgatgcaaactatggtggcaagatttttttaccgccatcagctttaaacaagttaactatgttacacataaggtaccctatgttgtttgaaataaagaatgaacagaatgagaagttgacacattccggagttttagaatttattgctgaagaaggaagaacgtatttgccacaatggatgatgaatactttggaactcacccctggatccttgatcaaaataaccaattgtgatttgaatttgggaaaatttgttaaaattgaacctcagagtgttgatttcttggatataagtgatcctaaagcagtgttagagaatgttttgagaaaattttcaactttaaccgtgaatgacattattgaagttaattataacgatgctatatatgggataagagttttagaagttaagcctgacagtacatctaaaggtatatgtgtggtggagacagatttagaaactgattttgcaccgctagtgggatacgtcgaaccagagtacaaaccaaagacagttgaaccactgagcaaacccattgatccatcaaaagtaaacaaaagtgcaggtgctgctactatggccaaatcgataaactatgccaaattagttgctgaagctgggaaaaccacaaagtactctggaagtggtcaaaagttgtct

SEQ ID NO: 5296 - DNA, 234 bp, Candida albicans
agcacacctgttcgatcgtcattacctgagaaccagttattttttggtttcccagtagtattaccaacacaagaggaaatcgatgaggagagcaaagaagaattaaagaagcagcaagcattctcgggatcagggcaatcgttgaggcagagcaaaaagagaaaagataaaaatactaactatccctcgctaaaaaaccatacaagaagtccagatgctattgagattgactaa

SEQ ID NO: 5297 - DNA, 771 bp, Candida albicans
acaagaccatataccatgtcaagaagatacgattcaagaaccactattttttcaccagaaggtagattataccaagtggaatatgctcaagaagccatatccaatgctggtacagccatagggatattatctcctgaaggtgtcgttttagcgtgtgaaaagaaagtcacctccaagttattggacgatgatggatcagctgaaaaattatacattatcaacgatcaaatgatttgcgctgttgctggtatgactgccgatgcatcaattcttgtgaataatgcaagaattcaagcccaacagtatttgaagttgtacgacgaagagattccttgtgaaatgttgatcaatcgtgtttgtgatgtcaaacaaggttatacccaacatggtgggttgagaccatttggtgttagtttcctttatgccgggtatgatgacagatatcaattccaattgtttacatcgaatccttctggtaattacagtggttggaaggcaactagtattggtgctaacaattctgctgctcaaactttattgaagaaagattacaaggacgatttgactttaaaagatgcatgcgaattggctatcaaggttttatcaaaaactatggatgcttcaaacataaatagtgaaaaattagaattcgctaccttaagtttgggcaaagacaacaaagtgttgcataaaatttggaacgataaagatattgacatcctaattaaggcttcgggggttttgaacgaaaaaaatagcgatgatgaatag

SEQ ID NO: 5298 - DNA, 1305 bp, Candida albicans
  unsure (33): Identity of nucleotide sequences at the above locations are unknown.
cccgcgcatgatcttccagccggctggctgatnaccatcgattatgtgttagatgtttccaatttcacgattatgacattgcctcttattcacaccgagcttaatgaacaataccctaaattggacataagagaattatctgattatttatctttacccgaggagtcttacagcggagcttcagatgtaaactctacaaacagatgggctttgattttatggaacgatgaatttcacaatttgacagaggcagtaacagctataaaagctggtactggtgttgatgatagaaatgcttacaagatagcagagaaaatagatattaaagggttttgcgtcttaaaggaagacgacaatccacagaaattaatccaagccaaacggttggtcgaatccaatggattggtagcaacaatagtatcggctcgtgatttgttgagagaaaagatcgccagttctattatagattggataattgctatatcaaattcttcaaactctcaagtccgaaaagctgctcagtcttattttgccgagttgttgttggagccacattttagattttcaaaagttatcccgtcatctgttttccaagaaactttagcctcaaaatccacacaagatcagtttcttgcctattttaaaaatggtcttccatacaatggtgaattgattagctttaattatcatcaattaagagccacagctaatcaaatcagtctatacgagcctatatcttctttattagacctgacaaggtcgactgaaagactcaaaggctcgagattacaatatttgctagcattccaaataagatttcctaagttaactcgtcaaaaattaggtaccttattagttcctcctttggttacaacatcgactttaaaacgagaatttgcgaatcaatttgttgaattattcccagccctcttaaccattatgggtttgacagatagagaagaggatttgaatttgatgtccgacattacttcacaattatttacttgtcctcaaactgtacgttccatactagacaaaggtggagtcaaaaacttgttgggtcctttggcaaagttaattgaagagcacagcacaactcgtgataccaatactgggtatagattgtattgcgagattggcagtgactcacagcaaaagagagctataaaaaaggctatcgtgcacggtatttacaacttgagctacttttctaatcacgggctttcaggagatagtataacaaagtttttgcaacctgatcatttcagtttattagtcttcgccacggggctcgaagatccgcgt

SEQ ID NO: 5299 - DNA, 2454 bp, Candida albicans
accgtgaagcgcgagtccggccagtcccgtggtgaagaattactggccgaagaattcaagttttcccataccaaaatcagaagtatattcaaaattttcaatcagaaataccctagttttataccaactttgaaagcacgtcgttctgaatttgatatttcaaaagtcgatttgtcgtctgatgacgccaatagtgaagatgagcttggtaagaaaaaacgtattgccaaagaacgccaggccaagttgatggccaaatttaaaaagcagcagtcgctgtttcttaaaaaaaatcaatttgagacgattgcatgtggtagtgatacagaaatggaagagttggacgaccacgcggcatggaaattcccagagcatcactgtatgttgtgtcaaaatgcagccgaagatgctggtccatttggaataatagcttatatctcaaagtcctgtgagttccgaaatgttccttttagcgacgaatattggtttttgaaggcattctcagataatgtggatctcaatggtaatgaatacgagctggatataaatcaatctttacacaattctcctcatacccagacatggaactcgtttatgcagcaagcgagtaattcaagtgttatcggtcccggtttcaagttgaatgagtttattgagagtcattttgtcgcgctgagttgtggacatggaatgcattaccaatgctatgtcaactacattagtaatagtcgaaacagacaaaatcagattactagaagcactcctgaaaacatggatagaaaggaatttctttgtcctctctgtaaagctttgaataatatatttgtgccaattttatggtcaagcaataatagaagtttacaggaatttttaaaaccttatgctggtactagtccatttcttgatttggacatgaaaattgccaaggatagaggctggactgaaaggtttcaaagcttttccgagcaggagtttgattcaagatctattttgaccggtattagcaaggaaatgatttcaatggacctgacaaaagaactaacaaaacagcagagagacttccgtttaatgttgagtgacatgttccagactttgacgttatttacatttccacaggttttcaaagcagactcaggttttgttttaattgatacgatcaaatctattgaaatttctttgcgtggcgtttcttctgggggacagttgataatccatcaactttccaataatattttgctaacattgcgaacattaaatgaatttaaaaattcaagtacacttatgaaggtgaaaaactggattgatctgccaaatcttagaaaatctgcttattcaaaaatttttgcctatatttttgcattatctaagaaatctatcaacaattacatgttagaagtggatttttttgagcatttggtaaacacggatacgttcccatcgctcggattttcttttaatagtgttttagaaacatgttttattggtcatttgatacaaagtttaagcatcatggttaatgagatgagtgcaaattgtttgaaaaaaaattgggcatacacggtgtcagatattcccactattgcagacattcctcaaggaatttcagaggctgctatcagttgttttaaaaaattgtctaattccaatgatgttcgatgtattggtaatgatgaaagtagaaagtttggtgaagtgatatattccatgttggtgaaaattgctactccgtttttaagaagggccgccatctatgcatatgtccaatgtgcaaatattgatggtattgattttgcggcatctccagaaacagaaatcgaggctgacagattatgttcgtttttgaatttaaaacccgtttgtgaatatttgcgtttatttaatgaggagagttcttatgaaggaagtgtattttatgactttcttactttctcatcagcattaccaaaggcgaacgatgttcttcgtattaaaaagcaagttgaatatccaggtattgtaaaactagttgatttaccagaaagacttgatttctttttcaccaagtattattacctggatcgacataataacccaaataaaaaagttgaagatccagcaatctgtttgttttgtggtgacgttgttgacattcaaaaacaggcaataggttgcaaagagggacaatgcaccacacattatttaaaggaatgcagtaacgatgtggggatatttttattaccgaaggaccgttctctattattgctacacaagaatggtggtaccttctataatgctccctttttggatgaacacggtgaaattgccgaggaaagcaaaaaggcaaaagcgttgcatctaatgaagccaagatatgatgactttatcaggaatatttggttgctgcataatgttcaaaattgtatagtaagaagtttagaaagcgtattggatcctggaggctgggaaacattatag

SEQ ID NO: 5300 - DNA, 1896 bp, Candida albicans
agcgctgactttccagcccgctggtcaatactgggagttgatatgccgagaaacaaagagatccccactgtagtggctcagttaatcgaactattatcaaagaagaaaaatgaatttattgaacctggagtaatcaagtttcaagtgagtaaagaacctgttgcaatagttaatcctttgaactcattgttatcgtattttttgcaatttcagaatatcgataatttcaaacatttattacaacagaatcaatcagaattagtcaattttaccgatatttctctcagaagcattgttttgggatctcaagtcaaggcaggattttggataagaaacgggtcctcggtttcacgtcaagcaactgcatattttgattcgcttatgacagaatacgcttttatgcgtgatttccatttgaatcaaattgctattttatttgaagaccaagaaaaagtattgatgaactttttagaacgatgggaattacgctcatggttcaaaaatgaagtagatttcgataagacgatttacgaggaaagattcttttctattgtggagagatttattgcttttgcttacaatttgtttgtggatagaagtatgttcataaatgaaactccagaggatgcaacgttaagaaaacttaatcatgcaatagggtatgcgttatgcgaagaggcaatggcattttccgaactacatcagtacatcgatacaaatatcgcaagttcgagtaaattcgaagatgttttatacgaagtagcagattatcagccaccatctgcgttaactgactcagggttatatcgattaaaggaatcgacgtatgaaaaattggatccattgaatatcctcgtcgatcccgggaaatttcaaatcatttcggaaatggtcatcaaaaacagttcgaaacagaagaaaaggaagtcagaaaatttgattgtaactccagtgatagaaaaagctgggaatgattttgtcgatgaaaacataggtaattttgccaaatcattaccatttgtgaaattgatttataaacttatgcaggtttcaattgatacgtcagatgaaacatatttgccacacttgctccatttagtacacgcaattatgttagacgacgaaatgattcatggaaaagagtatttaaataagcattttgttgatattccaattacagatttattgcttacgattctggaatctacaatgtccaaatacgtgtgccaaaaggctgattatttagtagaacaattagtgggtaaggataaacgtattatcgccagtttagttgattgctttggtgaagactatattcaaagatataaaaagaggaaaaacagtttatttgaatcagacgccgaaagaaagaaaagaaaagccgaaaagaggaaaaataatatattcaaaaagttttccaaacaacgggagaagtttttaaaccagaaccaggagttccaactggatatacctcaagatagtaatataccaatggaaggagaggactcgcgaaaattgcgtacttgtgttgcctgtggggaactcgagtcctttgaaaagccactagcaattatggcagcttctactaaagcacctgtgttttggaaggtgccagtacaaacaggagaagtcgtttcgaatgcctttaaaacatgggataagaatatattacttgattacaaggatactgagtatggtgttggctatgacccagtgagtaggctgtcactagatagtaatcgatttgaatcttatgtgctttctacatgtgggcatagcatccatcatagttgcttgaacagacgaatcataggatctgcacaatactcgtgcccattatgccataatttgcatgacatgattattcttacccttttggggaaccagagacagtaa

SEQ ID NO: 5301 - DNA, 1488 bp, Candida albicans
ttattcttacccttttggggaaccagagacagtaacattcccgctgaagttttcaatggatctccaaatcatttgaaatataaccaaattgtagaatcagccgatccgaacagaaaacttggttatttattagatgtgtttttcaaacctgaatattttgacgctccttctaaaactgtgacaatggcatcactcggtgaagctcctttgaacgatttcaaaaatcaaaagtacttgccaccgggaattaatagctcgtatggcataatatttaatcgacttatgaactggacagttgtgttagcggatacaattagaatgaatgagatttccactaggttgaacggtgttgatggatacagtgatttcttgtcgcagatcccaggatcagcaaaaacacttttaatttgtatgtttcaaatgagagtacttaacgcagcatcctcgttgttaccattactggccgatgaaagtaatacatttcaatcggaattcaaactgttttggaactctgatttgatattagatggggtgtttaatgaagttcttgttttgttttttcaaaccgacgaatccttggctacattaacaagagtgggtatgtcaaaactcattgcaattgttattaaatcattaacagcaaggcatgaaaaggacaacctgtatctcaaatgcattgacgttgacaatgggaatcaggtaagtgacgtctcgctcgagaggttccatagactttttactggagttatgcatggaaatgactgtgaaattccggaggttgacaaatccatttctttaataatttattgtgccatagagaggattttaggcatatttttgagacaggttatcatttttaaagacatattaacatgcaagcaaacgggagagaacaattacgaaagcataccagagcttttagacttacagaaaaaaatcaaattacaggatagattgactgacacaaaaccccttaccgatgctcttggtgtgccttcatttgatgagctcattgaaacgttacttgaatcaagtgatgcattagagggaaatgtttttgatatcatatggcttgccaaaattcccaaataccacgacaaagggattttaaccttagaatacccgggaatagttcatttggtcaatttaccggttgattacaattcttgcgttttgaacgcatcacaaattgctacccgtgataatagcaaatgtttgatttgcggacaatggaccaatgcatccagaaatgttgctcacatgcttaactgcagttcgcaaataggaatcttattcatctcaaaatctaatatgttgcggatttgcgtttacattgggactagcccaattactattgaattgcctgcaccttatttgacaaagcatggagaaattaaggtaatagataaaaggggaagagccacattgagcgggttaagatttgcctacttaatattcgccacgaggctgcaaaatccgcgggatggg

SEQ ID NO: 5302 - DNA, 303 bp, Candida albicans
tatcatgcagaaccatcaggtactttttatagatatgaagctaaagccattggttctggtagtgaaggtgctcaagcagaattgaataatgaatatcacaagtctttgacattgaaagaagctgaattattggctttaaaaatattgaaacaagtgatggaagaaaaattggattgcaaaaatgctcaattggccagtgttactaaagatggtgggttccaaatttacagtgatgaaaaaacagatgccataattaaagagttaaatgcacaagctactgatgaagatactgtcataagctag

SEQ ID NO: 5303 - DNA, 315 bp, Candida albicans
accaatatgtttttaacaagaagtgaatatgatcgtggtgtatccactttttcaccagaaggtagattatttcaagttgaatattctcttgaagcaattaaattaggatctactgccataggtatatcaactagtgaaggggtgatattaggagttgaaaaaagagtcacttcatcattattagaatcttcttctattgaaaaaattgttgaaatagatcatcatattggttgtgccatgagtgggttgacagctgatgctagatcaatgattgatcatgctcgtgtatccagtttaactcataatttatactat

SEQ ID NO: 5304 - DNA, 1227 bp, Candida albicans
ctaacaaaaatgggtagaagaggtagacaaagaagagtcattcatgacgaagacgacgatttagatcacacttacgataagttgccttctagaagagctacgaaaacagtttcttacaaagaaacagatgaagatgaagatgtggtagaagagttgggcggtatcaaagatgtacctgatgatgctgcattgaacattaatgaagtggaggctccagatttaaaagatgaagatgctgtgggtggtgttgaatatggtgggaacggtgaagatggtttccctgagctgcgaggacgtaggggccgcagaaaaagatcacatattgagtcggatgacgatgaatttaaagaagatcaagttgaagaatccgaggacgatgatattgttctatctgctgatgatgaggaatttgtagaaaagaaacgaactgacaattttattgtgaaagatgataacgaatggggtaacgatgacgaagaagatgatggcgaatacggtgtgaagccgaaaagacggaaaacaagtagaactcgaaagaataaatccaactcaagttggactggttctaaaagagcaaccagatctggtagagctttagatgatcctgacaacacccttgcggatggtacggtggagtctgaaggagaattagatattcaaaaggaaattgctgaactatacgactcctcccctatccatgaggacgttggacaaccacacaaattgcgtcagcgtgcaaaagtcgactatactattcctccgccaataacagctgattttcaattggaacatgaatatagacaggcaactcccacaactgttagaagcagaagaggaagaaccggtgctcccaaaaacgagtttagaaaaatcttgtatccaacagctggtccttttggtggaagtgatgtgatttcgttgtttggcaagaacattccacctggcgggattcctattcccggtatgacaggcgctccaaatatgactgctataggtcaaaatttcagtgactcagatagttcagaggatgaaattgcaccaataaatggcgtggccacaataagcaaaaagcaaccaaaagataaaaaaccgaacgtgggtgggcccaaattgattactggtggatccgatgacaccagtggtaagaaaaagaaaagcactttaagcgatacagatcctttgggggttgacatgaatattgattttctcggtagttcgtggtcttga

SEQ ID NO: 5305 - DNA, 2760 bp, Candida albicans
atattgattttctcggtagttcgtggtcttgataattatataaatcaattgaaagaaatggttgctttaccattattatatcccgaattgtatcaaaactttgccattacaccaccaacaggtgttcttttccatggtccaccgggtactggtaaaactttaatggcacgtgcattggctgccagttgttctacgtcagaaagaaaaattacattctttatgagaaaaggtgctgattgtttgagtaaatgggtcggtgaagctgaaagacaattgcgattgttgtttgaagaagctaagaatcagcagccttcaatcatttttttcgatgaaattgatggtttggcgccagtaagatcttcgaaacaagagcaaatacatgcaagtatagtgtctacattgttagctctaatggatgggatggacaatagaggtcaagtcatagtgattggggctactaacagacctgatgcaattgatccggctttaagaagaccgggtaggtttgatcgtgagttttatttccctttgccagacttgggctctagaaaagaaattttgaaaattcacacaagaaaatggaatcctgaattaccagacttatttttggaaaggcttgctcaattaacaaaagggtatggaggggcagatttacgtgcattatgtacagaagcagctcttaatagtatacaaaggaaatatcctcagatttacggtaccaatgagaaattgaaggtaaatccatcaaaagtaaaagttattgcaaaggatttcatgaaagcaattgagaaaatagtcccctccagtgcaagatccacatcttcgggatctgcacctttgtctgaacacttgaaaccattgttggaatctgaataccaggagatcattgaaaaattgaatcagctcttgccaaatacggtggggttggatggcaggaagaagtttactgctcttgacgaggccaaataccttgatccaacaatcaatgatgaagacggggggtttgccaagcaacagttgctcaaaaatttagaaaattccaggatttgtcgaccacatttattgataagtggtaacgaaggtaatggacagcaatatcttagtgctgctgtgttaaatcatttggaaggttttcaagtccagtctttggatttaggaactatgtttggagaaccaactagaacaccagagctgaccattgtacaagcatttattgaagccagacgacaccagcctgccattttatttattcctaatattgatatttggtttcacgtattgccagatccagcaagggccacgttaacaagtttattacgtggattgaaaagtaacgaaaaagtgcttttgttgggaatttctgaaacaccaattgaggacttgtcacatgaaataaaattggtgtttgggtttcaaaatgctactaataatgtaatattacacaatccacaacgctcagcccgagctgagttttttgaaaccttgaaaaaaactcttttgatgaaaccttatgagtttgtcaacgatttggaaaatagacccaagagaaaactaaaggaattgaaagtggttcagaatactgctgagatttccaatgatgaattaaacaagaagaaattaaaagagcaagaatataaggatacaaagttgaaaaatgtgttgaaaataaaacttgccggattaatggacttgtttaaagttagatataaaaagtttaggaaacctattatagatgagaatttgttagcccatttgtttgaaccatccattttggaaaataacccattcaacaattacgtggttcagtacgtgagatccgaagacccagcacatcaaaatatgattcaagagttggctaccgggaaatactactacaacatggatttggatttaattgaagagagattatggaatggatactacagtgagccaaagcaattcttaaaagacttgaagatgattgtaaaagattgtattgtttcaggagatagggaaagaatattgaaagctaatgagatgatgaccaatgcccaatttggtgtggatgatttttccacgccggaatttttgcaagcatgtaaagaagttagggagagagatttattgaaacaacaaaaacttttggaagaacataagaaattacaggaagaatggaataaaaagcaagaggaattgcaggctcaacaacaacaacaacaacaacaacaacaagcagcagaagaagaagttccaaacggtgtattaccagttgcagagcttatgaatggcaccactgagaatgcgaatgagactgattccaaggtagttgtcgagaatgaaccagttattgaaaatgagaaaactggaaataatacggaagacataatagaaattgaacaaaatgtaattcctaaagaagtcaatagccctactaaacaagctgaagtggaaatacaagaggttgaaacaaagatatctgaagatagtaatgggaaagatgtttccatgtcagtggacgacgtggatgaatctgaatccgaatctgaggcagaggaagagcttaatattgatttgacgaaagaagttgagattgacttacaagaattagattcgattacaacagaacttcttgacgtaactgaagactacaatgtcgaaagactagaggtgtgtatggccagacttatggatgtcatttggaaagaccgtaataattggaacaagattggtacattggaaaacttgaaacaaacaatcaaatctcttgaaacaactttatag

SEQ ID NO: 5306 - DNA, 660 bp, Candida albicans
agaactaatccacaaatgaaagtttttgaaactttatcacgttattcacatgatccagatttagaagttgcccaaaattccatttattccatgggtcttgttggtgctggtactaataatgctagattggctcaattattaagacaattggcttcttattatattaaatcaccagatactttatttatggtaagaattgctcaaggtattttacatttaggtaaaggtactttaacattgactccatataattccgaaagaactattttatctaaagtttctttggcatcattattaaccattgctattgcacttttggatccaagatcatttatattgaatgattcaacaactgaaactactcatcaattgttgtattatttgactcctgcggtgaaaccgcgtatgttggtaacggttgatgaagaattgaaaccaattaaagtcaatgttagagttggtcaagcagttgatgttgttggacaagcgggtaaaccaaagactattactggttgggtcactcaatctacgcccgtattattaaattatggtgaacgtgctgaactagaaaataccgatgaatggataagtttgagtagttcattagaaggggttgttattttgaaaaagaatccagaatatatggaaattgatagttaa

SEQ ID NO: 5307 - DNA, 468 bp, Candida albicans
agaatggtgaataaattggtgaaattggctttgcaaattgtaccattctttttgaaacataatgcggaagccgatgccgttgatttgttattagaaattgaatgtattgataaattgccacagtttgttgatgaaaatacttttgccagagtatgtctttatgtcacaagttgtgtgccctatttagctccaccagatgatgtttcatttttaaacactgcttattcgatatatttgtctcataatcaattgacccaggccttaacattggctattaaattacacgataatgaattgataaaacaagttttcgattcaactaccgatgaatcacttcataaacaattgggttttattttatctcaacaaaatagcaatttcaaatatccaggtgaaaatccagaagtacaagaatgtatttctaatgtgaaattagctgaatatttccaatatttggttaaagaatag

SEQ ID NO: 5308 - DNA, 249 bp, Candida albicans
  unsure (154): Identity of nucleotide sequences at the above locations are unknown.
gatccaaaagttcctgaagatgtttataaatctcatttagaaaattccaaatttggtttaggtacttcgggttcaatagattcagctaaacaaaatttggctgcatcatttgttaatggatatcttaacttgggttttggtaatgataaattanttcaaactgaagaagataataaatcatggatttatagaacaaaacgttcaggtatggcatctactactgcttctctagggtcgattcatcaatga

SEQ ID NO: 5309 - DNA, 978 bp, Candida albicans
aatatcaatgaaggtttacaagtcttggataaatatacttattctgaagattcagaagtgaaagcaggtgcattattgggaactggtgtagtgtcggctaatgttcatgatgaagtcgatgctgcatttgccttattacaagaatatgttcatgaaccaaataaactttatcaaactgcggctataaatgggttaggtattgcctttgctgggtctgcaaatgaagatgttttaaacttgttgttaccattagtttctgatttggatatctcgttggaaatttcatgtcttgctgctttagctttgggtcatatttttgttggtacatgtcatggtgatgttacgtcaactattttacaaacattattggaaagagattatacccaattgactaataaatttattaaatttatgtccttaggtttaggattattgtatatgggtagaactgaacaagcagaagatgttttggaaaccattgatgctatcgaacaccctattagtaagacattaaaagttttggttaatatttgtgcctttgctggtactgggaatgtattacaaatccaagcattattacaaatgtgtactgctaaacctaaagatcaattggaagaagaaaaaaaattggaacaatctgaggaggaacaacaacaacaacaacaacaaaataaagataccaaatcaaatggagaaggaggagaagaagaagaagatgtggagatggaagatgctgaatcaaaaaatgagacttctgagaacaccactgcaagtgctacttcaactacttcctcctcaaaagaaaagggggatagtagtagtagtgctgctgctgctgctgctgcaggtgacgaaaaggcacaagaaggcggcgatgacaaagaagacgaagaagaaatagacgaagaagaagaattatatcaaggaattgctgtcttgggtttagcatgttcttcaccacggctggaaaaccacctc

SEQ ID NO: 5310 - DNA, 213 bp, Candida albicans
ttgaaaaaaaaaaaaaaaatggcaccatctcaagaacaatcaaaagagcaaatccaatctcagacttctaaagatcaacaaccaactaaatctgataaatcaaaagttcaaaaggaagaagaattatctgaagaagatcaacatttaaaagatgaattggaattattagttgaaagattgaatgaaccaaatcaagaaaggggcattatataa

SEQ ID NO: 5311 - DNA, 741 bp, Candida albicans
aacgtacagtattatattaaagaaacaaaaatggttcttgaggctactatgattgccattgacaactctgagtatatgaggaatggtgactttttgacatctagatatgaagcacaattaactgcaacggaattcatttttcaaaataaaattaattcaaaccctgaaaatacagtcggattattagcctacggtggtagtggtcctcaagtattatctaccttgacaactgattttggtaaaatattggctggtgttcatgaaaccaaaattcaaggtgaaaataacttttcgagcggaatccaagtagcagcattggcattgaaacaccgtcaaaataaggtccaacagcaaagaatcattatatttgttggaagccctataaaggagtccgagaaagaattggaaaaattagctaaaaaaatgaagaagaataatgtggctgtagacatcatatattttggtgaagatagtgtcaacactgccaaattagaaagatttcagtcaactataaataaccacgataattcacatcttgttacaatatccccagtgcccacattattgtttgaagttgttgcttcatctccaatattggtcgaggatggtggattcggtgctggcgtttcgggtggtgatatggacttttttggtggtgctggtggtgctggatatatctttgaatccaaaatggaaccagatttggcaatggcattgacattatctttggaaagaggataa

SEQ ID NO: 5312 - DNA, 2886 bp, Candida albicans
cattttccaagaaatattatctacaacattcgccacatggaacgcataaagcacaagacgagactacctacagcaaatgtgaataaaagtttgcctgagacaccacagcctccttccaagccagcgccacccaatggtatgccaagatctcaacctcaagtttttactacttcaacagttggatcaagcactgtgcgacatcagtttccaaaaaccaatactccaccaactgctgtaatgcagccactaataacagaagatgacatgcaagcatactatagtcggttgatcaactatgagttcagaaacttgcaactagactccgaagtaaaatcgaaatcattatttgatctaatagattattgtgaattgcagtacgaaacggcgaatgtccaacttcaaacgggagcaacagaccctaatgccacattgaagggaatcaaaacttacataaaaggttatcttgtttttaattattttataaacagttttatcatggtgcatttcaaaggctttgatacgtttattgaaagcaacgagcaagattttataatatatttgaatatttttgcattctataactcgaacgagtattttcaaaatggaaattactctattcagtcggaagatttgcgggaatatgtcaagaagtatctcgtggacaaaaacctattaagcttcaacatcgaggaattgtactcttggctcaacgaatatatcacgtatttgaaagaaaaagacaaatcgacagaagaacaagcttccgtatcctcatcaagctcatcattctcgtttgttgaagaagtgtacgctatgccagatcttcgccaatcgacacattctagaaattcatccataacctcagaaaatgagtttaagcagaaatatccctctatcaaaagagttgattcgcctccttcagaatttatatcgaaacagataccaccgccaataccgacacagttgccacctagtttgcttgaatcaataacagacttgaaatctgtgtctccaaatgcatctccaccttcgcctacaccaacacccccgagtcctcctccacatcgtgtttccacatcagaatatcccatttcaagtgacacgttcgtaacaaaagaaagaaatagaacctcttatcctgtccaagacaatattttaggtgcagctgttctctctgaggaacaagcttatttccaaccaaagtcttatagcagacccaagaatgaagttccagatggttatcttcgaccaacagactacacaaaaactcgaatgtaccataaatcaaataatctagtctcttccaacggtaatatgaatggttatgatccgaggcttgcacaaggtcatcagatcgactcaccaatagttcaaggcagtaatgtacattttccaccaccaccaccacaacaacaacctatttatcaccaaccagtacaaccaataccgtaccaaccaaacatgcagctagcgcaaccaatccaccaaccgtattcttattaccaacaaccaaatcaaccgatctatcatgctcgaaatactcaaccccaaatgtaccaaccaccagcacattataacaatacacattcccacgtgcctgcacatgttgtacaacagcaagaacaaataaagcaccagaaaaattcgatattgaaggaatacttcatttgtgggctaaggaattttggttcctcatgctacatcaactccaccattcagttgttgtttggcgtttacccttttaaatccattttcaaccacggatatcagaagtatgtgaaggaccctaagtatttgaaaatacttgccaaacgtaatagccacacaaaagaatctgtgctattaagtgaagctatatctggactcttgaggactttccaacagaacggtggtgtgtcggtttcccccaccaagtttattcgagtgacttcattattaaagccagatttcaatattccacatgagcaacaagacgcacaagagtttttgctatttgttttggatagactacatgaggaattggcagataaacgacaagacaactatgacccggagttgtctgtccagaaatggaggataaatatcaacatggagaataaggacaagtacatggagtggtgcaaatcattacatgaacacgaaggtagctcgccaatcatggatttgttccagggtcacttgcagaacaaattgaaatgcaacaaatgtgggtatgaatcagttagctattctccgttcagtattttatcattacctataccaaacaattacaaaaatgaagtcaacttaagcgattgcttacgatattatatccaagatgaagtgttatcaggagagaatgcatggcactgtcctaaatgtaacggcgaggtccagacattagaaaaccacccagtttttgaaaataaacgatcaggtattttcaggctaggcgggaagaaaaaacacaccaagagccaacagacgcaaaacaacagtacaaataccatctccaccaagagtatcaactttgttaagttaccaacaatcttattcattcatttgtcccgattttccatgtacaatttaacagataaattagatacaatgattaaataccctttgttattaaaattcaacaaccagggccacgagatcgtttataaattaacaggtatgatcaaccattttggtaatgtgaagagtgggcactatacttctttagttaacaagtccacggttcatgaaaagttgcagaactcagataatttgaaacgcccatgttggtgtttatttgacgatgaacatgttcgttcaaatttggcacatggagctttaaatcatccacacgatgaattggtgtctagagatgtttatgttttgtgttatgaaagaatagatgtatag

SEQ ID NO: 5313 - DNA, 543 bp, Candida albicans
tttgtcatgccattccagaatatttccaatatcctccaaaagtggaagaggccaatagagaaacagccagataaattggccacagccgtgttatctacaactgctaaagctaaaactagagccaaaaagaaacaatctcagaaagaaggtggtgatatcaaagctgaagataagatggatgttgacgaagaaacgaaaccgaaagttgatgccaaagaaagtaatgacgatgaaaagaaggaaacgaagaagcaaccagtttcagatgagccagtgactgttcgttacgccagaactccttacaaaatttcaaatttgtctagggtattaccggtgcaatctaattttatttcctttattaaagacgataggtttgttccagtaagaaagtatcgtgggtctagtggtatagtggtattgcaagataacaaaccagaagagaaagtagagtttatcaagacagtcagacaattgaacatcaccgaagcaccagtgcctgaaccatttacattgagtggtgaagatttgcaagatgatgaataa

SEQ ID NO: 5314 - DNA, 2079 bp, Candida albicans
actatggcattggtatctgcagcaccatatttggcattattgggagaacccgattcaactttaaaatggtatgccttatcatctttaaatcaagttgttgatcagttatgggctgaaattgccaataatatcactgaattggaagaattatatgaagatgattcattcgacaggaaagaattggccgctttggtcatatcgaaagtttataacaatttgggagatttcgacgccgccgttaaatatgcattatatgctggcaatgaatttaatttggaagaaaaatctcaatatatggaaaccattgtaagtcaatgtatcaatttgtacaattcattatctcaacagaaattcaacgattcaacaacaaagattgatcctcgtttgacagccattttcgaaaaaatgttgaacaaatgtttgaaagccaatgaagtaaaattatcattaggggttgccttggaaagttaccgattagatttagttgaatcgattttacaagaccaaataaaaaacaatgaagaacaagctttgaatttgatcaactatgtgttagtgtgctcaaataatactgttagcaacactaattttagagtacaagtgttgaactccttgatatctttattattatctttgaaaaagcatcaagattttttcacaatcattaaaatcattgtacaattgaacgattctgaattagctgtcaaattattccaagaattgataaaccaaaatgaagatttaattgcttaccaagcagcctttgatttagttaatgctgcttcacaagaattattggacttggtgatggaaaaattgtctaacgccaaggaatctgaaaatggcaccttgaagaagattttgaatatattgtctggagtgccaacctgtgatttggacaatacatttttattcaaaaacaataatgctgatatcaccattttgaacaaaaccaagaacttattagatggcagaagttcgattttccattcggcagtcacatttgccaatgctttcatgcatgctggtactaccgatgattcattctttagaaagaatttggaatggcttggtagagcaaccaattggtctaaattttctgctactgcagcattgggtgttattcacaaagggaatttatcacaaggacgtaccatattaaaaccatacttgccaggatcatctggttcagccaacaacaaaggtggttccttgtttgcccttggattgatctttgctggacatggtagagaagtcattggaactttgaaatcatttattgacgacaacgggaatgccgcaggatccaacgatattgatattcaattgcatggagcagctttaggtgcaggtgttgccggtatgggctcaaaaagtgaaagtctttacgaatctttgaaagtggttttgtactctgattcagcaatctcgtcacaggctgctgctttgggtatgggattagtaatgttgggttcaggaaatgaggaagccatcaaggatatgttaacttatgccttggaaactcaacacgaaaatattattcgaggattagctattggtattgccttgttgagttatggccgtgaagaaaaagccgatgaaatcattgaccaattgatgaaccaagaatcgtcgattttgagatatgggggtgcatttactatcgccttagcttatgctggtacaggaaacaacaatgctattaagaaattattacattttgcagtttctgatcccagtgatgatgtaagaagagcttctgtcttgagtttgggattcttacttattcgtgattacacagcagcaccacaaattgttaaattattatctcaatcccacaaccctcatgtgagatatggtactgctttagctctaggtatttcttgtgctggaagagcctatcctgctgcaattgaagttttggaaccattgacgaaagatgcagttgactttgtaaggcaaggtgctttaatggccagttcgatgattttaattcaacaaaatgaatttatctatccaaaggttaaagaattcactaaacaatatgctgacactattaaaaacaaacacgaagaattt

SEQ ID NO: 5315 - DNA, 963 bp, Candida albicans
  unsure (30),(41),(57),(620): Identity of nucleotide sequences at the above locations are unknown.
atttgccaatcgaatattttagtgaattanaagatcaactnggtcctattgaatttnactccatacttaatgaaacaaggtaatttatatcccgagaatgaagaaccagtcactttttgtcatgtatcgccagaagtatttcaacatttgggtgaatggtttggaatattgggccaaccaattattagagctattattattaatccagacaccaaagaaaaacagattgaaagattcccgccattattttgggttcatcaattaggtaaaaagacgcaaccaacatacttgcgacaccgtcataatggaagcaaccacaatcatcatcaccatggtcatcacgattcaccaataccagtattgctttccaaaacaagcacttttcatagattaatggatgttatacgttataatgttcttaaagcaccacgaaaatcgacgaaagattttaggatttggtttattgtcccacaagataaaggcttacagtatttgatttcaatacaaacttttatgtttgatatctccaaaaaaactttggtttcaccaaatatgcttgaggatgctttgaaagatcacggtattatggccagttcctatgatataatggtagaagccgnagagaaacatcatacaggatttcctattgatcgatttattttatctcattcttacgcatatgaagaagtatcacagggtggtggacacattggattatcaaacatggggtacacatgttatatgaactcggctttacaatgtttattacacgttcctgaaatcaactattattttttttacaacatttataagaaagaattgaattttgacaaccccttgggatatcatggagatgttgccaatgcatttggttcacttttaaaacaagcatttgatcacgtgaaaaatagttctagtatatctcctcgagaattcaaatcaactattgggagatattcctag

SEQ ID NO: 5316 - DNA, 2142 bp, Candida albicans
aagatgacgaaattgatgacccccaagccatcacccaaacttgccaatacttgctggaatcaacataaggcaagaaacgactcggtgataattgatttatttactgggttgtatcaatctacattaatctgtcctgattgtggtaagaaatccataacttttgatccctttaatgatttaactttacctttacccatcagtaagaaatggtatcacacatttacaattgttgatttgtccaatcaaggcgttataccggaaaggataatgaagttggaagttgagttgaataaaacatccaatttcgatgatttacttagctatttgagtaatttcttgaatgttccatctactgagttgtttgcttatgagatttttcaaaatgcaatctatagtgacttccaattagattacaccaagaacaagtttttacctatcagtgatattatcagagatacagatgatgttatagtgtacattgttccacataaccctgccgttgacatcattgtgccagtgttcaatgccgttgaagatgctgatagttcatatcaaatggttaatttttttggaatcccattatttgtggtgatgaataaagaagtcgatgtcaatagttttggttttattagaaagaaattattagaaacagtttctttattgagtaaaattgatttggttgatgaatatgaaaaaataaaaaggagtaatgaagattacgttgaaaaagtattttacaaaaaactggatttccctgcattgtcacagccattagaaacctccgattgtgaaaaaaacaacaataatactagcgacaacgacgacgatgaggatgctgacaacgatgaaggctatgatagtgaagtgtctttggctaacccataccttggagctaattttgggttcaaaatcatgtatgttcatgactatagccctaaattgaattctaaccttcgtagcaggtacaatcatgaccaaacaaccaaattcaaacaaacagagagagttattaatgttcctacacacaaacctacttttagcgatttcaaacctttatcggaccaattatcagaatcaaaacgcaactattatttttatcctgattataaaaagatggatgatgagatggaccaattggtggaggaagtgaaccaaaatttggcagagcaagaagaagcgagatcatcgggttcagaaaatagtagtagagcactggaagaacaagatggatttgtattaataaataaagaggatactctcaagcaacaatcaactgtacctgctgctgctgaaacggtacctccaccattacctgttagaaataatactggagttcacatcccgtcatccgatgaagaaacagaaagtgaagctaatttgggaagtttgtttgattcaacatcaaacttgccgttgcctccaccatctacatattccgaatcaacaaaaccttcgaatgtaaactcccctatggaaagtaactttgaaagttcatcagcagacttgaattctggtacaacattgatatcgaaggacacagttttgttatgtgattgggataaggaaatttatcaaaaatgctttggtgataaagaattacaagcatgggaaaacatatcgaatttaccgaatccagaattggagaaaaatagagctcattttgaaagacaaagaaaagctaaaattacattatctgattgtcttaagagtttcagtacccctgaaattttaggtgaacatgatttatggtattgtccacgttgtactgaacataaacgtgccgcaaagacaatccagctttggtcaacgggtgatatcctcactattcatttgaaaagatttcatagtgctcgtgcatttagtgataagattgatgttttggttgatttcccaattgaaggtctagatataagttcgtatgttgccaatactgatttgacacctgaagattgtttatacgacttgattgccgttgataatcattatggtgggttaggaggtggtcattatactgcctcggtaaagaatttcagagatgataaatggtattattttaatgatagtcgagtcactgaaattaataatcctcaagaaatcgtggctaattctgcgtaccttttattttaccgtcgaataagttcg

SEQ ID NO: 5317 - DNA, 345 bp, Candida albicans
tcaacaatgaacggtatttcagtagacatcaatcatttgaaaaagggggaagtgaatttaggtacttcaattatggcagttacttttaaagatggagtaatattaggtgccgattctcgtactacaaccggttcatatattgccaatcgagtcactgataaattaactcaaattcatgatactatatattgttgtcgttctggatcagcagcagatactcaagcagttgctgatatggtgaaatattatttacaaatttattcaatcacaattgcctccctggtgaaattccaacaacaaatattgctgctaatgtatttcaaagaaatgtgttattataaataa

SEQ ID NO: 5318 - DNA, 810 bp, Candida albicans
tctttacaatttaaaagtaaactcctattaattatgactaaaggtgattctaaaagagtgattccattagaatcaaatccatttttattcaccgaattagcttatcaattaggattatcaccaatattacaatttcatgatgtttattctttaactgatcctgatttattagcaatgttaccaacaccgatatatgccattatattattattcccattaagtcccaattatgaaaaatatcgtcaacaacaagataacaacaacaacaacaacttcaattctacaaatttgataaaatatgataataataatgatattgaatggtttaaacaaacaattggtaatggatgtggattatatgctttattacatattttaactaatctacctcaagatttaatcatttcaaattctaaattatcacaattaagaaataatttgaccaaagttaaggaattttctattgatgatcgagcaaaaattattgaaaatttagaaaatgatattaaattagatgaaaattttggtgaaaaaggtgatactaaagctcctgatattaatgaatcagttgatttacattttatttcatttattaaaagtacgaaaaatggtcatttatatgaattggatggtagaagaactggtcctattgatttaggtgagtcgaataacaaggacaataataataataataataatattattaatgatcctttattgattgaaaaaattcaattttatattgataatgctgatgaagcaaataaaaataattttgcaattcttcaccacgccgtggaaggagcacgc

SEQ ID NO: 5319 - DNA, 867 bp, Candida albicans
gttacttttatcaacacgtcatttgcttcacttcttcaatgcttttttattgcggtggccgcgactctggaacgaagattcttgaaagttgccactgtattgtgttctactaccaatttattctttttcttttgttctgacaacttaaccttgtttacaattctcttttttcaaaaattcgtcatcaacatgtcttacaaacttagttctactttacttggtcacgaacaggatgtcaaagatgttgccactactgaatatggtggattagtttctgtactgagagatggtacaacaagaatctggtcagatatttatacaactcattctgaggcaaccattgttttccattcaccaaccaactcatttattaattcagtagcatgtatcaatggtttgattgctagtggaggccaagataccatgatttatttaagcgatgaacatggtgaggataaatatcaattaatcggacatgaaggaaatgtgtgctcaatgtcttattctcatggccaattgatttccagttcttgggattgtactgcaattgtatggaatttaaaagaatttgttcctaaatacatattatcaggacacgagtcttcagtatgggattgtcaagtattgggagaagatcactatttaacttgtagtgccgataaaaccatcagattttggcacggaaaatcggaagtaaaacaatttgttggccacctggatgtgattagaaaattgttgattttagaaggtggggaacaatttttgtcttgttcaaacgatggcactatcaaattgtgggacctccaaacagggaagaagttgcaaacattttatggccacgaatcctttgtttacgatttagcatta

SEQ ID NO: 5320 - DNA, 1530 bp, Candida albicans
gtgaagactacttggccatgtatatctgtatggtgtgtgactgcattaccaaatggtgattttgcagtgggtggctctgataatttggtcagagttttcacagctcaccctgaaaaggttgctcctgaagaagagttgttgaagtttaaagaggctgttcagtcatcttcaattgcagagcagtcgctagatgatttgaaaaaaactgacattcctgggtatgaggcattatcacagcctggtaaacaggaagggtccaccattatggttaagaatcctgacaatggaacaattgaagcacaccaatggtctggtggagaatggcacaaaattggtgacgttgttggatcttcgagcagcggcaaaaagcagacttaccaggggaaagaatatgactttgtttttgatgtcgatataaaggatggcgagccaccattgaaattaccatataacgtaaatgataatccatatactgtggcagaaaagttcttaagtgacaacgatttgcctgcatcctacactgatgaagttgttagatttttgcagaaaaatacagaaggggtgagcttacaggaaagcaccaatgactcgaacaacccaagtgctggaagagttattgatccttattctgatgcttataataagcaacaaaagcaacaagggaacttggctttgaaagtgattccttccaagtcttatatttacttcaccgattacaaaagggaactgttagtgaatggactcaaaaaattaaacctgtcccaggattccgagttgcagttatcggatcaagactttttggctgttgagtcttctttactggaattgaattctaagcaagcgctagaattaatcaccaagtattgcagtcatattattagaaaatggacagcttctgcaaaattgattgggtttgatttattgagagtcagtattcccaaggtgacaacagttgatatattaacatcaactgatgctgctgagataattttagatgttgtgaatttaggattggaaaacataaatgtggaaaatccagcacttttgatgatgattctcaaagtgttgaacaatttagttggaaccacgttgttcgttcagttgtacattgacccttgtggcactgacaataaattatacgaatacaatacgtttttccagaacttgttaaagaagttacagaatagcactgccaaattgacacagctggcaaaattatatacatctacgatgacagcattaacaacattggtgtataatttatcggcatatcaattgcaaaccagtgcattgaaaaataacatgggatctgccaagccggttatcgaatttatggataatttaggtaatcagattgttgcttcctcaagcgaggctgcttatcggttagcagttgcgtatggtaatttcaaatatggaaaattatacactaacgaaaccccttcatggttagctgaagcaggaactctttacgcaattaatggcgaacaacgattccttgatatcgcagaagatttaaaaaatatataa

SEQ ID NO: 5321 - DNA, 357 bp, Candida albicans
gttacttttatcaacacgtcatttgcttcacttcttcagtgcttttttattgcggtggccgcgactctggaacgaagattcttgaaagttgccactgtattgtgttctactaccaatttattctttttcttttgttctgacaacttaactttgtttacaattctcttttttcaaacattcgtcatcaacatgtcttacaaacttagttctactttacttggtcacgaacaggatgtcaaagatgttgccactactgaatatggtggattagtttctgtactgagagatggtacaacaagaatctggtcagatatttatacaactcattctgaggcaaccattgttttccattcacca

SEQ ID NO: 5322 - DNA, 1269 bp, Candida albicans
  unsure (63),(1232): Identity of nucleotide sequences at the above locations are unknown.
caagtgctgttccttccaggccctggggtgaagactaccaccttcagaaagaagagacctctngaaaagataacaccattgaccgagggtgacattcaggtattgaaaacttatggaactgcaccatatgcagactctttgaaggagattgaaaaagatttgaagacaatagaagaaagaatcaagactaatcaagggataaaagagagtgatactgggttagctccacctcacctttgggatgttcttggtgacaaacaacgtatgcaagaagagcagagtttacaagttgccagatgtactaaaataattgaggcttctcaaccacaacagccaacaggattacagaatgccgataccaaatcaaaatatgtgattaatattaagcagattgccaagtttgttgtaggattaggtgaaagactttctcctaccgatatcgaagaaggaatgagagttggtgttgatagacacaagtatgaaattcaattaccgttgccacctagaattgatccatcagtgaccatgatgacagtggaggagaaaccagatgttacatacagcgatgttggtgggtgtaaagaacaaattgaaaaattgagagaagttgttgaattgccattgttgagtccagaaagatttgtcaaattgggtattgatccacccaaaggtatattgttgtatggtcctccaggtactgggaaaacattgtgtgcaagagcagttgctaacagaacagacgccacatttattcgagtcattgggtcggaattagtacaaaagtatgttggtgaaggggccaggatggtgcgtgaattgttcgagatggcaagaaccaagaaagcatgtattatattctttgatgaagttgatgccattggaggcgccagatttgatgatggtgctggtggtgataacgaagtgcaaagaaccatgttggagttgattacacaattggatgggtttgacccaagaggtaatatcaaggtgatgtttgccaccaatagaccaaatactttggatcctgcattattaagaccaggtagaattgatcgtaaggttgaattttctttgccggatttggaaggaagagccaacattttccgtattcattcaaagaccatgagtgttgagaaagatatcagatgggaattaatatccagattgtgtccaaatgccacaggtgcagaattgagatcggtgtgtactgaagcaggtatgtatgccatcanggccagaaggaaggttgccaatgaaaaagattttttg

SEQ ID NO: 5323 - DNA, 1002 bp, Candida albicans
tatgaatatgaagagttttctatcctatatagtcgaggtacatctagtattcaaagcagtacatcatcattaccagaagatgtcaataaattgaactcattgatgttattgctaagttcattgaagatcatcaaagttttacttgaaaaagcaccattcacaattattggcttatttgaaaaagaaggtttgatcaatgacgtattaagacttttgaagacattgagtgacaaagctgatctcaacgaaaaagatccaagagcatccatcaatctgatgatgagtgcatactcaaataaatttattgatagtgaattcaccaaggaatatgagtataaattaaccagcagagtaatttattctaatatcgttagtattgctaccgatattaactcgttatatcaacaaagtaaaaatgaaggattacagaatatatctgaaaacatgaaggtgttacaagaagtcaagacaactttatctaatcataaaaatatcaagtcttttagttacaatcaatggcttgaattgtggaataatttgaagcttgcattttgtgggtcatcttcaccggtttctagttttgaattgatttcttctggtgctatagaatcattgaccaaattgtttagtactgatttcggtttagaatcaagtgattgttataaagcattcacagaagctttttggaaagatgattcagctacatttttggttcagaaacttcaagaggcgttaacaagatcagaatcatttgatattgtatcagctaccagcagcacaaataaccaatcatcgtttgctcgagatcaaaaccaagctgcaatcatggcaaaccaaattaaattaaaattgattgctgaagaagagaatagtgatcaaagtaaattacctggaaatatgccaaatatgattttgtcagtccacgccattgctacatttaaatctgtttttgcatttttgaagcaaagattaaattttttgaagaattatgatgttcattaa

SEQ ID NO: 5324 - DNA, 915 bp, Candida albicans
tcttttgagggcaattgtgcggttacgggcggcaatagaaacagcagtaatggtgataccagctccattgtaaacgggtttgtcgatgtaatgcaaagattgatgggaggaggtgttattttcgatggaggatctgctcgtgatagtggcgagatagatgcgttggtcaacaatttaagtcaaagagaggatacctacattgtccttgaatctatgaatgagttgtcagagagattattgatgatgaatggattaaccgcagaaagattgatccctgccaataagttagctagaagcttgattgaaataatggaagatccaaagttggaagaggaattggaactacatttagtggcatgtcgatgtttatataatttcttggaagtgaatcaagatttcatacacgatgctttgaataataatgctattcctgccttgtgtaataaacttttggagatcaaatatatcgatttgactgagcaggcattgcagacacttgaaatgatatcacgagacccaatttctcataatagtattatatcaaataacgggttaactgcatgtctacagtatttggattttttaacaattcatgctcaacgaaaatgcttaactatagttgccaattcatgcagtaatatctccattggaaatttccccaaagtcaaagaagcatttaatggtattgctgaagtcgtaagaaatcataacgataaggtagttgttgaaaatgcatggttaaccatttcaagaatagttatgtgtttcaaaaacaaacctgatctattaaatgaattgtttgcagataaggagttacttttcaaagagttgacaaaagttattcttgtgagttgtaataaatccctgaataccagttcggaatcaaatcaagtaacactcaatcatggatccaac

SEQ ID NO: 5325 - DNA, 411 bp, Candida albicans
tattttcgtcacgttgagttggtggaattatttggtaatgcggaagaggattggtcaatggatactttaacttcaagtattgttgctaatcatggatatactaaagaatcagaagccataaaatcattaattgatattttgatgaatttcagtattgaagagaaacgagagtttttacaatttttaactggggcaccaaaattacctattggtggatttaaagctcttagacctgagttgacagtagttagaaaacatgctgaagacggcctcaaagatgatgattacttgcctagtgttatgacttgtgctaattatttgaaattaccaaactattcaagtaaagaaatgatgaaagagaaattaatacaagccatgaaagagggtgctggtgcctttttgttatcataa

SEQ ID NO: 5326 - DNA, 1323 bp, Candida albicans
aatatcacttaccgtaaagtgagttccgaagttagcaaggaagctccatttactaatttcaaccttcattataatactgatcgtgaattaagtttatatgacgatacaactattaatattttgaaattattaaaaatactattccgaatgaacaataattttagtaatggtggtggtcacaatgtggctactaaggagtttacaaattggaaattgactgtgaagttgaatcgacaattggaggaaccattagttgttgctagtggtacgttaccgggttggagtattcatttaactaaacaatttccatttattttcccatttgaaacgagaatattctttttgcaatcaacttcatttggctattctcgtttaattcatcaatggcaattgcgtacaaaccaaggtggcgatgacaatgttggtagtactagtaccaatcaaggtaacaatcaaagaatgcaattgggtagacctacaagacacaaagttagaatttccagaaaaatgatgttacagagtgcagtgaaagtattgggcatgtatggatctaccccagggattttggaaattgagtattttgatgaagaaggttctggattgggtccaactttagagttttattcaactgtgtctaaagagttttccaagaaaaaactaaggttatggagagatgaggagccaagacaagccagtgatgttgatgttgatgttgatgaatcttatgttgtcaacaaatatggattatttcctaaaccaatggataaaacccaattatctagtgaaaatggtcgtaaagtattgtattttttctcctcattgggtaaatttattgctcgagctttattagattccagaattatagatttcaatttcaaccctgtctttttgctgctaatccaattattaaataaaaccaatggaataaattcaacttccaggaccaatacatcaaagttatcgaagaaaatggctactattagtaacttacgtttggttgatcctactttagctgattccttacaacatttgaacaagtatattgagttatttgaatctaattcagacattcacaatgttactgttgatggtgcaagagttgaagatttggcattattttttgaattacctggtaatcccgattatgaattgattcctaatggtagtgataccctcgttaccgccgataacttggaactttatatcaataaagtgattgaggcaactttatttagtggtattcttactcagactaaagcatttatggatggattttctaaagttttcccaataaattcgttaataatattttcgtcacgttga

SEQ ID NO: 5327 - DNA, 621 bp, Candida albicans
cccgcacaaaacaatttttcaagctcttttttttttctgatgagatacaaatactggtgcgccaccaatatagttttcaaaactttttttcacttcttttttttcactaatcccacttttttggtaagaaagaagcatagctatttgccgacaagccaattcaagatgcaaattttcgtcaaaaccttaactggtaaaaccattaccttggaagttgaatcttctgacactattgacaatgtcaaatctaaaattcaagacaaagaaggtattccaccagaccaacaaagattgatttttgctggtaaacaattggaagacggtagaactttgtctgactacaacatccaaaaggaatccaccttgcacttggtcttgagattgagaggtggtggtaaaaagagaaagaagaaggtctacaccaccccaaagaagatcaagcacaagcacagaaaacacaagttggctgttttgacttactacaaagttgacaacgaaggtaacgtcgaaagattgagaagagaatgtccagctccaacttgtggtgccggtattttcatggccaacatgaaagacagacaatactgtggtaaatgtcacttgaccttaaaggctaactaa

SEQ ID NO: 5328 - DNA, 606 bp, Candida albicans
caaatatctattttgaaaatcatgttaaagatacgccagttgcagaagaaaaaacaagaggaggccgaaagacttgccaaatctcagtttacgacacccaccccaggcgattccacgtctacttctaaccaaagagtttctccagcacaaattcgtgtgcaaaaggatatctcagagttagatttaccttcgtcaataagagtgacatttccaaacccaaatgaccttttcaattttaatttacaattgataccacaagctggatactacaaaaacgggaaattcgaatttaaaattgaaataaactcaaattttcccattgaccctcccaaaatcaaatgcttacaaaagatataccacccaaatatcgacttacaaggaaatatatgccttaatatcttgagagaagattggtcacccgtgttgagtttgactggggtgtttatgggattgaactttttattcttggaccctaatgcaactgacccactaaacaaggatgcagcaaacgttctagttaaaaacaggaaacaatttgaaattaatgttttcaattcgatgcgaggtggctatcttgatctggtttattacgatcgagtcatttag

SEQ ID NO: 5329 - DNA, 1368 bp, Candida albicans
aagattaattcaccacctataatcaagcttcacaaaccgctaaggaaaagctacccatattcttttagcttggagtcagctattgagaaaatgaaagatttacagctagacgttgagctggttaacacagttacttgtatttcatacagctttaaatcggaagtaagtttagcgttgattgaacagttttacaaagctagattgttacactcacctgctgatataacaaggagtggggccaagtccaatgttgcattacaaccaacccccagaggaatagctattgtccaagaattctgtgaaagaattggaatggagagggaagaatttcctgaagttcttttggcacatgatttcaataccatggagttatttaactttgatcgcgatgctaggagcgacaggatcctctattcagaatacttactttatttattattcaatttaatgatggggccagaaccaaatgtttggactctttcaaacacacaggatgcgttaccaagtttgaatttttcagacagtgaaagctttgataagctatacaaagtatttagtaattcccaagacgccaagaatgcgaagcagaacaatgatgactcttcagatgttgagggattcagttttactagttatcgccatttctcaaaaacacaccaaagctctgaaacacattcagttactgatagtaaagaaatggcaactagcccattccaccacaggtactttactaacccggaatcagatgctcattcacaatattatgtatcctctgttggtgttcggttattaaaagacaaaatagttttggttggaccgaataaaagtgttacagttgactattgtatcagtggtaaggcaatataccagtggatactagattgcacggatatcataaacccaaatcatgctcacgaaattgccaggttgcttgtcaaacacaatttaataaagccggtatccttttctagcagccttagtttctctagagacgccttttaccaattgtcaaccctaggattagcactatctctgtgggactttttcgatagaaatttacaggatagttcctctttgcaacctggaacaaaaattttaagattggctagcaatgttacattgcagaatattttgaatgatccgggaatgcggctacagtttcgaaaacatttgattaaggatcattgtgttgaaaatttagaagcttatattcaactaatgcaatttgaggaaacgtacaaagcttgggaggatttaagtgatattatcgacaaccaaaaccacagctgcataccagtaaaaagctcagatgttaacatacatttgaagaatttgcaagtaacatgtatgtcttttgctttccaaata

SEQ ID NO: 5330 - DNA, 1407 bp, Candida albicans
actcattcgcggatcggccggctccccgtggtgaagaccaatgatcatgcattatccaaacacgtcgagttacccccgacaatgggattgtctagatgggaaactgcccatttccctgaaagagcaattaacaaaattaaggattttacgttgttgaacacgtctgttagttacggtgtaatggcgagatttattggtaggaaatctacttgggaagttgattttggtaaaattgatactccctctaacagcaccagaattgtgaactcccaaggggatgaatatattattttgaaggaattgaccaattatttccgtgtggtgaaaaagactccaataccaaccgataatgaaaggttaatgaagttgttagaaaataagttaatgtataataactttattctgagaattaaggaaaaaattgatgcaggcaaaagattgatcgaatctattgaaagctcaaatttcactggaagtattgatattggtaaagagttgacgcaaacagaattggaattggcaaaatgcaaacaattttacaaaccagatagcatccgtgacaccaaattgaacccaaacagaatagagcattatgagacctttttgccattggttaggaaatcattaacaggaaataaacctttgggaacattgagagtatcaacacctaaaaaggaattttgtgtgtcatatattccaccacttagattcagacaacaaagcatagagaatcttgtgtcttcttggaaatttgaaattccagtagatatgtcaattgcttattcatcactaaacaccaaacctagtcaactcccaaatattgtggatgtcaaagctgaattggctgttttgaccataagatcagattccaaacctataccaattgaattcaatcatgatttgattttcaacaaacaatgtaatgggcagtttattgattctgataattttaatgagaacattattaaaccatttagaaaatactcgactgacttgtataagatatacaagaaacttgggtcagagaatttcaaaattgaacaaagtttggttgatgatttaaaatccatttgcaagttggaacacaaaacatttaatttgcgtgtaaaggatataatgattgacggcaagccagggaagccttcaagtaaaggtgtgactcaatggtcaatagatgaaaatggagccaaatcttcatttactgttggtatcaatttggaaaacttggaattgaaaggtgatacaaactcaaataaatcaaaaaagtcttatgataatttcactttggtccctgatttccaatcatgttttatgtgcagattatatcatgtgaagttgactatggccttatccaatgaccgttatgtcaacatcaaagttcctgtaagagttcaaaaagttgtctaa

SEQ ID NO: 5331 - DNA, 1158 bp, Candida albicans
cattgtgaattgtttactttacgtaataaaatgtcgccagataatgaaccacaacctccaaatgaagatgagttgctcaacaatattttgccctcataccatatgtttcaatctacagtatcaaagaatttaaccccaacaaatgaaaactattctatcgacccaccaacatacgagatgacccccatcacttcagagaccccttcgttgttgacttttagtagaatgcaaagtcccgtcgatgaacgactagaaactgataattactttccccagagtgataatgactcggtcacctataaccaagaaagtgaggatatgtggaagaatagtattttagctaatgctgacaaattaccaaatctaactcataagaaaaactcaatgagtgagtgtttacagattgacattcaagtaacagaaaaagtttgtcaaagtggaataaaacctatatttatggatccatcaaatcgagagtttaaacagggtgattatcttcatggttatgttaccattcgcaacacgtcggatcagcccattccctttgatatggtgtatgttgtttttgaaggaacatttactactctagatacactgtctggaacaatttccactgaaatgccagcgttaagatttaagtttttgacgatgttggacctttttgcttcatggtcgtatgctaacattgatcgacttattactgataatggagacccccacgattggtgcaatggagaaactgatccatacgacaatacattattgtctatcgatgtgaaaaggttgtttcagcctaatgtaacgtacaagcgctttttcacatttaaaattccagataaattattagatagcacgtgcgatcagtacaatttgccaacgcatacagaaatacccccaacactaggcattgatagaaacagtttccctccttcgtttttattagcgaaccaacatttaatagttaaagacttgtcgtttctggatagttgtttggcttatcgtattgatgccagagtaattgggaaagcatcagattataaatacaaagttgataaggatcagtatgtggtgtccaaagaagcatcgtgtcctataagagttgtacccacgccctacattggaattgggaatataatttgccaaccatcccaacaataa

SEQ ID NO: 5332 - DNA, 273 bp, Candida albicans
aaagctactgctatttgtaaatcttctatactgcctaaaacaattttggaaaaaagatggaatgataatttacaattggaagatggtattcatgtggcattattggcattaaaagaatgtattgatggagaattaaatggagataatttggatattgctattattagtgatcctcaagaacaattgttaggatttaaaggtactgatattcctggtccaagatttaaaaaattatctcctgaagaaataaatgatactttagactcgttataa

SEQ ID NO: 5333 - DNA, 501 bp, Candida albicans
atgttatcaattgaggagttctgttatatactaacgtttacaaattatagtggtaaattggttcaaattgaatatgcattaaatgcggtcagacaaggggttactgccattggtattaaatgtggcaatggagtagtattagccactgaacgtaaagccaattccccattaattagaaatgacaccaacattaaagttgaatatattacacctaatattggtatgacatatagtgggatgggaccagatttccgagtattagttgatagagcacgtaaattagctcacactaattataaacggatatataatgaatacccaccggtgaaaatcatggtacaagaaattgttaaagtgatgcaagaaagtacacaatcaggagggattcgaccatttggagtatcattattagttggaggatatgatgaatcaaatgaagggaaatttcaattatatcaagttgatcctagtggaagttatttccccttggaaagctactga

SEQ ID NO: 5334 - DNA, 534 bp, Candida albicans
tactaccaccacacagctcatgcaccactcatgcccccacgttctactgctcaaaaacgtttactaaaagagtatcaacaattatcaagggacccaccacctgggataatcgcaggaccagtgagtgaagataatttatacaaatgggaatgtttattagaaggaccatccgatactccatatgaaaatggagtattcccagcagtattgactttccctaaagattacccattatcaccacctacattaaagtttgatccaccattgttacatccaaatatttatgctgatggaaccgtttgtatttcgattttacatcctcctggtgaagatccaaatcaatatgaacgaccagaggaaagatggtcacctgtgcaaagtattgaaaagatcttgttgagtgtcatgtctatgcttgcagaacctaatcctgaaagtggggctaatatcgatgcttgtaaattatggagagataatcgtgctgaatatgaccgacaaattagacaacatgtcaaggagtcattaggattatga

SEQ ID NO: 5335 - DNA, 1212 bp, Candida albicans
aaaaaagatggatcaattataccgattgaaaaattaataaattcaaaaaatttagtattaaaatgtcatcaatgtcatttaaataattttgggaattcaatgatttgtttacaatgtcctcatgttggttgttgttttaatgattataatcattcttattctcattataaatcaactagacatatgttttctattgattcaagttgtggtttattatattgttttaaatgtaatgattttattaatcatccagaattagaaaaaattcgtttacaaattgttttaggtgtacacgacgaggagaagaaaaagaagaagaagaagactacgacgacaacgactgtggatgatgatgatgatgatgatgatgattttattaaacaaaattatgttgatccgggtcaaattgccataaaaggattaaaaggatttgttaatttaggagcaacatgttttatgagttcaatattacaaacattaattcataatccattaattaaatatcaattttttaataatgatttacattattttaattgtgaaaaatttcataatcaatttattaatcaaggtaatattgatgaaaataatgcttgtataacttgtagtattgataatattttccaatcattttatacatcaactactaatgaaggatttggtatgactaatttattaactacggcttggtataaacaaaaatcattggcaggatttgaagaacaagatgctcatgaattttggcaatttttattaaatgaatttcatatggattatcaaagaatcataaataatttgaacctgaacctgaacctgaacctgaacctgaaccaagataataacgagaaaaatactcattcatctaatgatgattcagtggtgaattcttgtggatgtattatgcattcaacattttcatttgaattacaaagttgtattaaatgtgattcttgcgattcaattactgaaaccgttgatccaatgattgatttatcattagaagtcaatttcacaaatttatatcaatctttacaatcattcactatagatgaaaaattatatgattataattgtaaaaattgcaacaactccaacaacaatatgtctacaactactacatcagcaattaaaaaattactattgaaaactttaccacaaatattatcaattcaattaaaaagatttagacatgatattttaggtagtttctaa

SEQ ID NO: 5336 - DNA, 255 bp, Candida albicans
tcaacaaaaattcaatctcatataaatttcccattatttttaaatgttactgaatattctgttattaacgatactgattatatttatcaattatttgctgttgtttgtcatcaaggatcaataaatactggtcattataccgttttcattaaaaataatagtaattggtataaattcgatgatagtgttgtgaccatggtttctcaagatgttgttatcaattccgaagcatatttattatactatatagtttaa

SEQ ID NO: 5337 - DNA, 978 bp, Candida albicans
tatcacaaccaatttttaataataataataataataataataattatattaattaatattaataataacactaataataataattataaatcaatttataaattgaaaaaagatggatcaattataccgattgaaaaattaataaattcaaaaaatttagtattaaaatgtcatcaatgtcatttaaataattttgggaattcaatgatttgtttacaatgtcctcatgttggttgttgttttaatgattataatcattcttattctcattataaatcaactaaacatatgttttctattgattcaagttgtggtttattatattgttttaaatgtaatgattttattaatcatccagaattagaaaaaattcgtttacaaattgttttaggtgaacacgacgaggagaagaagaagaagacaacgacgacaacgactgtggatgatgatgatgatgatgattttattaaacaaaattatgttgatccgggtcaaattgccataaaaggattaaaaggatttgttaatttaggagcaacatgttttatgagttcaatattacaaacattaattcataatccattaattaaatatcaattttttaataatgatttacattattttaattgtgaaaaatttcataatcaatttattaatcaaggtaatattgatgaaaataatgcttgtataacttgtagtattgataatattttccaatcattttatacatcaactactaatgaaggatttggtatgactaatttattaactacggcttggtataaacaaaaatcattggcaggatttgaagaacaagatgctcatgaattttggcaatttttattaaatgaatttcatatggattatcaaagaatcataaataatttgaacctgaacctgaacctgaacctgaaccaagataataacgagaaaaatactcattcattcttcaccacggagccggcaggaccgcgctag

SEQ ID NO: 5338 - DNA, 570 bp, Candida albicans
taccttgacccaagcgcgggacctgccagccccgtggtgaagaatgaaattattaaggatcctgtggaaataacaagaaataatttacaaattttaaaagatcaagtatctaattatatttcatttgttaaagataataaaatttcattaagtcgtgatgcatttttatatttaaaatcaattaaatctttaggtgtgaaaaaagataccataaaggattattttcaaatcgtgaccgataataatttattgaatcgtgaaggtagttggaaagttgaacaattgagtaatagtactagtactagtaatagtaatagtaatactagcaacaacagtaacaacaacaacaacaacaacaatagtaagagtttccgatatactaaaaatttgactattccattgactatattaaataaaaataatgtcaatttattaccaagtttccaaagttgtcttgttggtagattatattgtttacagattatggtacgttataaaggtactaataatgatcaaaatgaatttgctgataatatagttaaactagatgtaccaatattagtaggataa

SEQ ID NO: 5339 - DNA, 1215 bp, Candida albicans
cgcaatcgcggtccttccgcccctgtggtgaagattcacaaacgggaatatttcgatgttttaccatcatttcaaatgtttcaaagtatacttaaacgagatgatcgtcaatttcaagaagatttatccagtttaccaccagggtatggagatgtgacaaattcatcaccgactcctcctcctcttcctcctcctcctgcttgttctgcacctacgttatcaccttcgagttcaaaagatcatactatagatgaagctattcaaagattaaatgaatatggattagctcaagaacgagatgaaatgaataatgatgaatatttatttgaagaacataataatgatcctcataataacactaataacactttgctgccggttggatcaagtgttaatgccaatgtacataatcaaaatattgaagtgactcaagatgatacatatggtcattcaccattagataatattgataaattacataaactacctcattcccccatagatatacaaatttatgtcacaaaacaaatccctcaacccaatgtcaataatgatttagaaacaagattaaaagcatatactagtggagattttgtcaatggttatataaccgtgattaataattctcatgaaccaattgaatttggattatttactgtttcttacgaaggaacaatcaaatctgtggaaagaaatcctcatgccatggggttaacccataaatttctgaaaatattaatgaagaaatttttaaaaatgtatgatttaaatgcttcttatggatatgttcaagttcctaatagtgctgggattcaatatgaaccattttctcatgatacttcggatggttcagtcattggtttacctactgatcgattattacaacccaatataaagtataagaaatttttcacttttaaattccctcatagattattagataatgcttgtataaattcattattaccccatttattaccaccaccatcaatggggatagatcgaacatgtttttataatcgtggtgaagcaatacaactcaataaagcattaggatatgggtttttaaatgttagagggacaccaatgttgactaaagattatagttttgatgatttgagtatttcttatactatagaagcaaaattcattgatagattaaattctgctcaacctatgttttcatcacggaccagcccggatccgcacagtagt

SEQ ID NO: 5340 - DNA, 1173 bp, Candida albicans
gagcgtgatcttccaccggcggttgtagatgaacggaacagattcaagttaaagttgtcatccctttcattaaaaaatacaccttccagacaagcaagtgtatcatcgcgtaaccaaggggatgatgaggccaatgaattgattaatattttaccttcatatcaaatgtatcgatccactataacgaagaacttgactcccagtgttgaagatttgcgaacagctccacctagttatgaagtcactcctgatttgtcgaccgttcaactacacgattactttgcatcggtgccgacatctcctacattggatccaatgctatctgagcctttggatgctgagtctgcagcagttcaacaagatggtgagcaagatgatgaaactattttggaaaacgcacataaattaaagcgattgacatccacaaacaaagagatctccaaactgttggaagtgaaaatacgtctcaccgaacatattgggaaagtgggagagccgtatactttggttgatcccttgactttggaattaaaacaaggagattatatttacgggtttgttttgataactaataagacatctaatgttatcccttttgatatgttttcagttcagttagaaggctgtgctatatttggtaaaaccaataatagtacattggttgaacaaccctcccatattgataggtttctcaacatgtttgatttcaacgccctgtggaacgacgcatttttggaccgtctagtgacagaacataatgacccaacccatatcgggactatttatgatccaattgatggcacatattatcatctagaccataggaagattttagaaccaggaattacctataaaaagtattttacgtttaaaataccggagaaattattagatagtgcatgtgaacacctgttaattaaacatttgcaaatacctcccacatttggagtatgcaaaaatgaggtcattagttcattaagacataaatggaaagatcaacaaaatggggctcctgaagaaacggcatcaaagaaatacaaatatgcttctttaacaaacgattttgcatttaacgacacctcaataagttattgtgtgagtgctcgagttattggacgtgctctcagggtatcaacacttgtttggttcacttgggggtgttcatgccattaa

SEQ ID NO: 5341 - DNA, 1008 bp, Candida albicans
tttgctatgaatgagttcaaactgtctgttactccagatgaggatgtgagtgctattttaccgtcatatttcatgtataaagcaacagtgggtgtaagtgtcatgacagcggaacaaatggaaactcaaaatattgatcctccaacttatatcaatgagaacaatccaggatggagtagttccttgatttcccccatactgtctgaaaatttatctacaagccctgtatatgctcaacaatttgtaccttccagtgaaagtccagtaccaataactaatgagcaccaagaagttggatctgaagaaaaaatactagataatgtgtatcgtcttcccaatctatcattgtatcccaataaagttggtgacagtattcgactacaaattcattttacaaaagaaattggagaacttggtaaaaaaccagaattcataaatccttatgtgtatgagtatcaacaaggtgatgtaataagtggatatattgtaattgaaaatgcatcatcaaaaccaatcccatttgatatgtttgttgtattatttgaaggagtatttatgattactaattcagatcatggcaagagtgcaataccagtcaagattaaaaagtttttggaattatttgatttttcagcaagttggacagaagcaacaatcaatagattacggtcagaatcacgtaacccatatatctggctcgatcttgttgatcccgtggatggtatatcaatatcattgagtaatgaaaaatttcttacaccatataaaaagtataaacgatttttcacttttaaaattccacacaacttgttggattccgaatgcaataatcacaacttgtcgaaacatgttaagttaccccctacaattggtaacatttcagataatgagcaacaaatcaagacatcaactcggtcaaattatttttttgaagatttttcattttcagatacatcgatatcatatggtgttactgctagatttattggacagagtgcatccgaatga

SEQ ID NO: 5342 - DNA, 855 bp, Candida albicans
gctatgtttagaaataattacgataacgattcagtcacatattcacctacaggtagattattccaagtcgagtatgctttagaagctattaaacaaggaagtgcagctgttggtttaacgtcgaatgattatgttgtgttagtagctctaaaaagaaatgcagaggaattgggatcttaccaaaagaagatcataaaaattgatgatcacatgggagtggcattggctggtttggcaccggatgctacagttttatctaattttttaagaaaacaagcaatgcaatgtaaaatggttttcaatcgtccaattcaaacctataaagcagttttgtcaattgctgataaagcccaagaaaatacacaaacttatggatctaggccatatggtgtcgggttgttgattgctggatatgatgaaacaggggcacacctttttgagtttcaacctagtggaagcgtcttggaatattttggagccgccataggagcaagatcccaagcagctcgtacatatttagaaagaaatttagaagaaataaagaaatgtgatgacgttgagaagttggtactccatggattatatgctttgagagatacgttgtctcaagacgttgaattgacatttaaaaacaccagtgtttcaattgttggtaaagatcaaagttttgtatcgtatgacgatgaaaatgtgcaacaatggttggataaattagactctgtctcgaacgctagaaatagagatggcgatgatgatgaggatggtgatgaacaagaagagggtaatgcaacccaagctcaagaaggagaaggtactgaagcaccagcagaagacagaatggaaactgacgagtaa

SEQ ID NO: 5343 - DNA, 1614 bp, Candida albicans
ataggcttgatctttcttattctgaaagctatttttgggtcatttcatttatttttaccaaaattagcaaatattaaccaggttatgggttccaacacatccaaaacaataatgcctgcctccacaaagtcaccattaccagaaacagaagaagaaatctttaatgaaaagccttactcatcgacttctacctttgataatttccgtgaacaatttgagggacttgaattagaaaatgctgagaacgaaatcaacccaatctccgaaaacatcttatctaaatgggaagatgatttcaaatcccagacaaagaatcttttagctcaaaatgctcttgccaagaacgccattgttgatgttattgcaaagaattctgtcggcaaacaatctttaaaagatagatatttgtttaatatcacagttgataccattggatcaccagctcaccttaacaaccagaaactgtctggaagatgctggatttttgcctcatccaacgtattacgaacccacgtcatcaagaattacaatttgaaagaggacgactttcaactttctcaatcctacttgtacttttacgacaagttagaaaaagcaaactttttcttggagaacattgaagacacatccagtgaagacttggattctagattaatcagttatttgtttagcaacccagttaatgatggtggtcaatgggatatgattgtgaatttggttaacaaatatggtgtagtcccaaatgaggtattcccagataatgcccaatcaactaactcatcgaaattgaattatgttgtcacggaaaaattaagggaatatggacttaagcttagaagtttaatagctaaagatgcaccaaagaatgttattagttctttcaaggcaagtgctattaaatctatatataagacaatcgctttagctttaggaacaccacctaagccaactgacgagtttttgtgggaatttatcgacaaagatgggaaatacaagtcttttaaaaccaatccattagacttttacaagacttatgtccgctttgatgcttccgaacacttttctttgatccatgatcctagaaacgagtacaacaaattatacactgtcgaaaggttaaataacatatttggtggaaaaccaattgaatatatcaatctcgaaattgacgagattaaacaagttgcaattaaaatgttgaaagataatgagcctgtgttttttggttcagatgttggcaagttttccgattcaaaatctggaattttggacacaactgcctatgactattcaactgcttttgactttagcttggatatcaccaaactgcagagattgaaggttggttcatcccaaatgacacatgctatggtgatcactggagtgcacatcgacccacaaacaaacaaaccagtaagatggaagattgaaaattcatggggcgaagattctggtcaaaagggttggtttatgatgaccgatgaatggtttgatgaatatgttttccaaattgtgacaaacaagaagtattcaggaaagaaagcatacgatatctggaaaagcaaagaattcaatacattgccatattatgaccctatgggtgctttagcttaa

SEQ ID NO: 5344 - DNA, 735 bp, Candida albicans
ggaaaagagtatactaacagtttttattttaatttagaggttgaatatgcttcagaagctgtcaaaagaggtacttgtgccgttggggtcaaagggaaaaatacagtggtattaggatgtgaaaagagaactgcattgaagttgcaagatccaagaattactccatcgaagatatgtaaagttgatcatcatattcttttagcatttgctggtttgaatgccgatgccagaatattggtcgacaaggcacgagtagaagcccaatcccacaaattgacattagaagatcccgttagtgttgagtatttgaccaaatatgttgctggtgttcagcagaaatatacacagctgggtggtgtaagaccgtttggtattgccaccttgattgctggatttgatgttcgtgacgatgttccaaaattatttcaaactgaaccttcaggtgtgttcaacgcttggaaggctcatgccattggtagatcttcaaaaacagtcaaagaatttttagaaaaacattacgaagaggatttgagtgaggaagaaaccatcaaattaactgtgaaatcacttttggaagtggttcaaacaggtgctaagaacattgaagtttctgttttgaaacctggtgctgttataaaaaaattggatgttgacgaaatcaaaaagtatgtagatgcaattgaggctgaaaaagctgctgaagcagagaagaaaaagcaaaaatcaaaggattag

SEQ ID NO: 5345 - DNA, 969 bp, Candida albicans
gaagagctcgacctctcccaagtacagaatactacaactgtatcaacaatggttaccttagaagatttagaaaacaatcagcaacaagaagaaaatgttatagatcaagaaattttgaattcgtctacttctgatataatcaatagaaccaaattgttggataatgacattaaagttatgagatctgaatcacagaggttgaaccatgaaaagaccgtgatgttggaaagaataaaagacaatcaagaaaagataaacaacaataagcaattaccttacttggtgggaaatgttgtggagttattaaatttggatgctgacaaagaggccagtgagcaaggagccaacattgatatcgacgcagctagagctggtaaatcagcggtaatcaagacatcaactagacagactatatttctaccaatgatagggttagttgacccaagcaagttaaaaccaaatgatttaattggcgtgaacaaggactcttatcttgtgttggatactttgccttcggaatatgattcgagagtgaaagcgatggaagtggatgaaaaaccaactgaagactattctgatattggtggattggacaaacaaattgaggaattgattgaagccgtggtgttgcctatgaaacaagcagacaagttcaaaaacttgggtatcaaacctccaaaaggtgctttaatgtatggtccacctggtacaggtaaaactttattagccagagcttgtgctgcccaatctggtgccacgtttttgaaattggctgctcctcaattggtgcaaatgtttattggggatggtgcaaagttagttcgtgacgcatttgctttggctaaggaaaaggctccaacaattatatttattgatgagttggatgctattggtaccaaaagatttgactccgacaaaagtggtgatagggagtcttcacgacgggatgggccacaacgcttgctctat

SEQ ID NO: 5346 - DNA, 1908 bp, Candida albicans
ctcgatcaattgatccgccgcccgctctgtgtaaaaaaaaaattgatggcggaatccaagaaatcagagatattattaagtttcttgagaactggtaaaatagatacatcattactcccagcacaaaactggcctgctgggttagataatattgggaacacatgctacttaaattcgttattacaatattatttttgtataaaaccattacgagaattgattttaacatttaatgagaacaattttagtgctaatgattaccctgaaacgagaaagataggtgggagaaaagtagaaaatatggagcttcaaagatcaaatcaattcgtttaccagttgcgtcggttatttcaagaaatgatttatagcaacaaaagatgcgttcaacctagtaaagaattggcatatttatcttttcttccattgtcacaaccagttaatttcaaaaatcaaaagaagaccgattatctgggtagaactacaattgaggaaaataaacaagttcaattagctgaaaccaaggacaaccagagtgttggcacagaatttgtgcatggcgaacttgaaggagtattatatcagcaatcagaaaatggactcagtactgataaagatgtaactatgactgatggcgatgatgagatcaatacagaagtaaaggatattatagacatggatagggaagttgaaactggaatggaaattgaaacagatgttgatgaaagcaataaaaattattccatggccgttgaatcacccctgtcgtcaagatctatgattgaggatgaagtagaaacccctgatacttcttcaagtgaggatgacgttgtgggatcgagtcccaaaatattacccatactgagtgatcaaattgaaagcacaattgaagttggtagacagcaagatgtcactgaatgtattgaaaatgtcacatatcaaattgagacagcattaccaccacagttgatagataaagatggcgaacaacacgatttaatcaaacaattattttgcggaaaaactaaacaaaccatcactcccttggataaacctgatgagccacctagagtttctttagaaaggtttttcagtttgattattaatgttagtgatcaccccaagagtatttatgacgcgttggattattactttaatgaagatgtggttaaattggatgaaggattagttaaaaaaagtattaccattctggaattgccacagattttgcaatttcacgtgcaacgagttttatttgatcgtgaaaagttgatggcatataaatcaattgaaccaattccgttcagtgataagatttatttggatagatacttggataccgatgacgaagaaatcttatataaaagaaaccaagtgtttgagtggaaacgtgaaattctgaaattacaacaatataaatttgatttattgaaaatcgaccctgagacatcggtgtcattgattgatagtttgaaaatcacggaaaaatatcttgagaacaaaattatcctggacgattctttgagtattgaattgtctaccatacaaacgattaatgatgagatcagaaaattaacatcgaatttagaagatattgataatcgattgaatgaattgaatcatttaataagtatacagttccaagattataaatcgatcgcatataatatatttgccgttttcattcatcgtggtgaagcaagctatgggcattattgggtatacatcaaagatccacattataataatataatccggaagtataatgatgaaatggtcactgaagtccttgctattgaaatattcaatttcttggaaacaaacaccgctactccttatcatattgtctatatcacagaaaaattagaatcaagttatatagaaacttttaaaagggaaattaaagaataa

SEQ ID NO: 5347 - DNA, 1896 bp, Candida albicans
ttcataatgatggataatgaagcaaccataccttcatctttagcttctacagaagcggaaaatgtcgacacagagacagcaaactcagataaatcactttcccacatcaatcgatctagcaactctcctgaaactacatccaatcaattacaatcaaacaacccgtttcgctcatcaaccctgacagtatcggtaccatcactggagtcagttccaatttctcaactaaggactagaattgcaaatgcagaattggtgagctatccattcaaaactttgaatagaatcttggatgatttgaaatggacaattccagtccaagaaaaatataatttcagcatgttaaacagcaagccaatagattatagtgaggaattgagtaaagttgttaattcgagtgtcacacattttgaaacattgattttaaataatgatttggagtattgcaagtcagtcgaaaaagtcgagtattccaatagtcaacaagtgctttatattatgagaggtattttgctggataagaagcacgggacttatcatttcagattagctgcattagaaaccgactctaacccttttgtaaccaaactcattgataaacatcaatatcatgttatccccaaatccagcatatccgcacatgatttacaaattttgttggagaatactatagatgttgataagattattgatgatgcatttttcaagagtttaaactcaccaaatggtcaaatcctaagggtaacattgttcaaagcagaattcacccaagaagatttagtaccgttgacggacgaggagataatacgagaacggtatttagaaggaattaagagacacccaaatctatccccggaaacaattccaaaccaactccattgtattaaaactttgataaaagtgttacgaggaccagttactttgaaacccgaggacaccatcaaaacaattaacctcaaaaatacagttatggatgcacagatcgacgtcaatttactttttgagaaattgtcatttaccttaaatggggatgaagcagtaccaccagacttgaacaatttgccagacttgaaggaatcgtacataagaaaaatcttggagttgatattctttgcgaaaaatgtaatggtgccaaataacgagttccagactttgtattcattttccgacaatatgtctcaagtgtttcacacgatcgttgaatacgataaaaacgtgagtgtgagacatttcagtagcaattattcaaacagatttccatatttcatcaatcttagcgcaagtgcttatttctccgatgaattgataataaaatgtttcgagcttacagtgcagtctgactcaatcaaccagttatactatgtggattccttaaagcaaatacgaagtttcagaaacaataatgggggttattcagtaaacaataagcttgatatttatttcagacagagaaatttgataggctacagtgattttcttgagtcgatgaagatattgggattagcagttgaaagcaatgaaacagaaacaattgatgatgatgttattattgcaatgtatcggagccaatttaaaaatgatcccaagaattaccagtattataataatcatttgaaaagaattgctggtatcaaaaattccgagaaacttgatgattttattcagaaagagttgttaccaatcgatttagcacttgaagagttgagtattgaagagattacagaggatgatgtcgtgatcactgcatacgagttcaagctggacgagttattggaactgaatggaatcaacggcaatgctaatgaagtcatttttttgaataatgcattactctcagttgcagttcatcgaaagaattacatattattggagtatttggaaaaccaaattacctga

SEQ ID NO: 5348 - DNA, 465 bp, Candida albicans
ctttttgggaggcaaaaatacatcaaccactactcttcccatattcaatctccccaattactatcaatgcctggattaaattttgacaattatcaaagaaatgcattcttgacctccaaggggtttgctacacccaaagcaacatccactggtacaaccattgttggatgtaaattcaaagatggggtggtgatagcagcagataccagagcaacttcgggtccaatagtagcagataaaaattgcgagaaattacatagattagctccaaagatctggtgtgctggtgccggtactgcagcggatactgagatggtcactcaattgattgcatctaatttggaactacatgcattatcgcaaaacagacaaccaagagttattgcagcacttactatgttgaaacaacacttgttcaaataccagggtcacttggggggcgtatttgattgttgctggtgttga

SEQ ID NO: 5349 - DNA, 483 bp, Candida albicans
aacaacacttgttcaaataccagggtcacttggggggcgtatttgattgttgctggtgttgatccaactggagcccatttgatgtcagttcaagcacacggatctaccgatatcggtaaataccagagtttgggttcaggttcattgaatgccatggctgttttggaaaccaattttaaggaagacatgactagagatgaggctataaagttgtgttcagatgctattttggctggtgtttggaatgatttgggatctggttccaatgttgatgtgtgtgtcatggaagttggcaaggatgcagaattgtacagaaactatattacaccaaatgtgagaatcaagaaatgcaaagattacaaattcccaagaggtacaactgctgtgttgaaacaaagcattcgtgatatttgtgatgttgaagagactgtggtgaacttcaatgataatggtgacaatatggaagttgatacacaggcttag

SEQ ID NO: 5350 - DNA, 1197 bp, Candida albicans
atgctgataccaataacaaccaagattccaacaacgcaaatggtggattctacaacaaccagtgcaccagccgagccaattgatccagaaagagaaagagctttatcgaaattcaaggataaattattagagcacagaaagtgggatgccagattgaaagatcttagattaagtatacgagatttggacaaggattatgagaaaactgaaaatgatataaaagctttgcaatctgtgggccagatcattggtgaagtattgaaacaattggacgatgaaagatatattgtaaagacttcttcagggccaagatatattgttggatgtagaaacaccatcaaaaaggaaaatttgaagaatggtgttcgtgtttcattggacatgaccaccttgacaataatgagaattttgccaagagaagttgatccattggtttataatatgactacatttgaaccaggtgaaatttcatttaatggtattggtggtttaactgaacagatcagagaattgcgtgaggtcattgagttaccattaaagaatccagaattattcacaagagttggtattaaaccgcctaagggggtgttgttatatggtccaccagggactggtaagaccttgttagcaaaagcagttgctgccacaattggtgcaaatttcatattttctccagcatcagctatagtcgataagtatattggggaatctgccagattaattagagaaatgtttgcatatgccaaagagcacgaaccttgtattatatttatggatgaagttgatgccattgggggtagaagattcagtgaaggtacttctgcagaccgtgagattcaaagaacattaatggaattgttgaatcaaatggatggatttgatacattgggacagacaaagattataatggcaactaacagacccgatactttagatccagcattgttgagagctggtagattggatagaaaaattgaaattggtttacctaatgaagctggaagattggaaatcttcaaaatccatacatcaaaagttgctaaacaaggtgagtttgattttgaagctgccgttaaaatgagtgatggttttaatggagcagatataagaaatgtagttaccgaggctggtttttttgcaattagagatgatagagattcttcaccacgggcctggaaggaaccgcgattggcgtaa

SEQ ID NO: 5351 - DNA, 1029 bp, Candida albicans
aaaaatacatacagcagcaggatactaccgttaatcatgtcaacaactgcaactagcacaaatgaattggcccttttggataagtctgtagtagtttctccgttggttttactatctgtggtggaccattataatagagttgccaaagattctaagaagagagttgttggggtaatattaggagataactctactgacacgatcaaagttacaaactcgtacgcaattccttttgaagaagacgagaagaaccctggagtatggtttttggaccacaattttatagattcaatgggagaaatgtttaaaaaaattaatgccaaagagaaattgattggctggtaccattcaggacctaaattgaaaccatcagatttgaaaattaatgaggttttcagaagatacaccgacaacccattgttgttaattgttgacgttcaaccaagagaagttggtattccaacagatgcatattttgccgttgatgatattaaaaacgatggctctgctgctgaaaagacatttattcatgtcccttccttgattgaagcagaagaagctgaagaaattggagttgaacatttgttaagagacatcagagaccaagctgctggtaacttgtccttaagagtttctgaaacacatcaatcattattgggtttacatcagaagcttggagaaattgcaaattatttggataaggtttaccaaaagaaattacctatgaatcatactattttggggaaattacagaatgtttttaatttgttgccaaacttgatgcaacaactggggagtgatctcgatggtggctcagactcgtctcatgcattagccactgcatttactgtcaagacaaatgacgaattgatgatcatatacattagtacattagttcgagctattattgcattccatgatttgatcgaaaacaagttagaaaataaaaagttgaacgaaaataaagcacaagcttccgtggctgaactgtcattaaatagcgaaaagaaagattctatagaagattaa

SEQ ID NO: 5352 - DNA, 243 bp, Candida albicans
ctatatatagatgggagaaattttcaagttgaatatgccatgaaagccgttgaaaatggtggtacatcaattggtattaaatgtaaagatgggatagtattggctgtggaaaaaatcattcaatcaaaattattaatccccaagaaaaacaaacgaattcaaactgttgatagaaacattggagtaatttattcgggtttgttacccgatggacatcattttgttaatagatgtcgtgattaa

SEQ ID NO: 5353 - DNA, 516 bp, Candida albicans
tgtcaatcattcaaatcaattttcaaaattatgatgccaatatctaatttaatggatagaatgggtatttatgtacaaaattatacttgttataattcagttcgtccatttggtatagtatctattattggtggagtagataatgaagatggggaaccatacttgtatatgattgaacctagtggtagttattgggggtataatggtgctgccactggtaaaggtcgacaaattgccaaatcagaattagaaaaattgaattatgaagaattgacctgtttagaagcaataaatcatgctgcaagaattattcatttgagtcatgaagataataaagataaagactatgaattggaaatttcttggtgtagtaaagaacacactggaggtaaacatcaatttatttctgatgatttattagaacaagctagaaaacttgctgaagaagaggaagaagaagaagatgatgatgaagaagaagaagctggtgctgatgatgaagaaatggctccataa

SEQ ID NO: 5354 - DNA, 252 bp, Candida albicans
gattataataaattaattgaattgacaaaagggtttagtgggagtgatattacggctttagccaaagattcagcaatgggtccattgaggtcattgggagataaacttctttccacgcccacagagcaaattcgtcctataagcttagaagattttgaaaacagtttgaaatatattcgtccaagtgtatcttctgatggattgaaagagtatgaggattgggctctgaaatttggatcaagtggagcatag

SEQ ID NO: 5355 - DNA, 537 bp, Candida albicans
aacttgattttgactaatgaaaagcatcaagacaaattgattgcatgtattagaggcattgatcctactgcagcaaagcaaatattaaatgatgttgtggttcatggagatgaagtttattgggatgatatagttgggttggaaggagctaagaactcacttaaagaagctgtcgtgtatccatttttacgtccagatttgttcagagggttacgagaaccaactagagggatgctattatttgggccaccaggaactgggaaaactatgttagctagagcagtaggtacagaatccaattgtacatttttcagcattagttcatcctcgttgacatcaaaatatctcggtgaatcagaaaagttggtgaaagcattgtttttgttagcaaagaaattggcacctctgattgtgtttatggatgaaattgattcattattaggagctcgtactgaaggtgagattgaaagtaccagaagaattagaaatgagttttttttcaaccacggcgtctggaaggagccacgctcgggagag

SEQ ID NO: 5356 - DNA, 840 bp, Candida albicans
ttcgtaattttaaaactaaaaaaaaaaaatagagagaaaattagaaattattacaaacaacaaatagagaccaaccaaccaaccaacctttataactattaccatcatcctatacaattactttatatttcaattcttgacagtttgtttatcttccttattttcatttgtttaatagtactttttccacatataaccatgtcaattgataaatcagcaaaatatgatagacaattgagattatgggcctctacaggacaatccaatttagaaaattctcatatttgtttaattaatgctacatctactggttcagaaattttaaaaaatttaatattaccagggataggtcaatttactataattgatgaaaaaaaagttactaaacaagatttatcatcgaatttttttttgaaaaatcaagatttaaatgaagatttagccgtagctattcaaaaaaatttaaatgaattaaataatgatgttaatggacatgctattgttgaatcattatcaacaattttagctcaagaatcgaatttattttgggatcaatttaatgttgttatagtgagtgattatactcctaatttagaaccattaataaatcttctttggtcaaaacaaatcccattatttattgttaatactattggattttatggatcactaaatatcattgctaatgaaaccacggtgattgaaactcatgatccttcaaaattatatgatttaagaattgatcatccatggcctgaacttcaagaatttgctgattcatttgatttagataaattaaatgatgttgaacatgctcatgtcccctatattgtcatatgt

SEQ ID NO: 5357 - DNA, 1047 bp, Candida albicans
ggttatatatactcttcttctagttcactttttttttcattcattaagatcatggcatttgacaacgttagagatatatcatcaatagaacccttaatatccaatattggaccatataatgaattttctgaagaatacaatatagaaaattcatttaaagcactttatgaaagtaaaatattaattattggagcgggaggattaggatgtgaaatattaaaaaatttggcgatggtaggatttaaaaatttatacattatagacatggatactatagaattatctaatttaaatcgacaatttttattccgtatgaaagatattgggaaaagtaaagcggaaatagctgctcaatttgttagagatcgaattgatgatccttcattgcatataaagagttatttcaataagattcaggataaaccaattgaattttatcaacaattcaatcttgttataagtggattagattcaattgaagccagaaggtggatcaacgcgacattgatctctttggttccacaagggtatatgattccattgattgatggtggcactgaaggatttcgaggccaatcaagagttattattcctactgtcacgtcatgttttgaatgttcattagatttactatctacaaaagtaacctacccggtatgtaccattgccaacactccaagattacccgaacattgtattgaatgggctacacaaatagaatggaatgataaattccttgggaaaaaattggatggagacaatcccgaacatattgaatgggtatatcaaacggcattggaaagagctaacgagttcaatattggtggagttactaaacatttaactttaggggtagtgaaaaatattattcctgctatagcgtcaactaatgctataattgctgcaagttgttgtaatgaagcatttatattgattactgattctaatccaatattaaataattatatgatgtatacgggggatgattcgatccatacttatacttttgagcattctaagaaattgatttgtatttgcagttcatag

SEQ ID NO: 5358 - DNA, 942 bp, Candida albicans
attacaaatcaacatatatatacaatcgataacaggaagactcataataacaataataacaacctacatacatatatacacacgatgaatagtattgctcaaagatatagtcatgccagtcaaaatgatattgttaaagaaataaattccgttcatgaatcactttcatcatcatcaaacattcctcaattagaattagctccatcaattgccatcccgccaatttctcaaccaacagattttttaagagctcatactgatgattctgttaatccagattgtaaaatcaaaattgctcatggtacaacaactttagcatttcgtttccaaggtgggattattgttgccgttgattctcgtgccacagcaggtaattggattgcttcacaaaccgtcaataaagtgattagaattaatccatttttattgggtactatggctggtggtgctgctgattgtcaattttgggaaacttggttaggtactcaatgtagattacatgaattaagagaaaaggaaagaatttctgttgctgctgcatcgaaaattttaagtaatttggtgtatcaatataaaggtatgggattaagtatgggtaccatggtttgtggtcatactgctaaagaaggtcctactatatattatgttgatagtgatggtactagattgaaaggtgatgtgttttgtgttggttctggtcaaacttttgcttatggggttttagattcagaatataaatgggatttatcggttgaagatgctttatatttaggtaagagaagtatattggctgctactcatagagatgcttattctggtggttcagttaatttatatcatgtcactgaacaaggttggacttatcatggtaatttcaatgttggtgatctcttttgggaagttaaagaaaaggaacaatcatttgtaaatgtagatggataa

SEQ ID NO: 5359 - DNA, 912 bp, Candida albicans
ttttcaaataaagaaaccaacaataaatttcaaagaagaacagaaggtgatgtcaagaacaaaagagagagagagagtatactcttcccaatacattcaatcacaatgtcagaacaattatcagcagatgaaattgctctttatgatagacaaattagattatggggtacatcaacccaattgaaattacgttcaacaaagatactagttattaatttaggtgccattggaagtgaaattgttaaaaatttagtattaggagggattaatactattgaaatattagataattcaacgattcaacctcaagattttgctgcacaattttttttacccaataatgatgcaaaagttaatgaaaatggtgatggaggtagtggagatgagagttcatatattggacaattaaaattaccattagtcattgaaaaaatacgagaattgaataatcgagtcaatttatcaattaacaccgatatgacaattgatcaattaaatggcgattatttaaaaaaatttgatttaattattgccacggaaattaataataaacaagaaatattccaattgaataaattgactcgagatttaaatattccaatgtatttaacagggatgcatggattatttggttatattattactgatttgattgaacatgaatcaattgttactaaaccaaaaggtaatgtttctcggcaatcaggggttcaattatcacccaataaaactattattaatgtcaccactcatagtagtagtagtagtagcaccaccaccaccacaaccaatgacaatgagggtagtggttctgggaaaaatgaattaataacaataaaagatcaatttgttcctatagaatcgatatttgtttcaaaaaaattaccaactcaattgactaaaaaacaattg

SEQ ID NO: 5360 - DNA, 315 bp, Candida albicans
tcgcttatccggccggctcgccgtggtgaaaacaaaatgaccgagccagacttgccatcgattgatattgaattattgaaacaaaaatctcttgaaatttgtcataaatttgaaatccctcaagagattatcactgaacaatattatgaaatgtttagtcgatgtgcttttactgaatttgccccaatttcagctatagtgggaggaacagtagcacaagatgtgatacaatatttgagtgggaaagaaagtcctattaataatgtattgatattagattcaataaccctggaaatgccaatttatctgctctag

SEQ ID NO: 5361 - DNA, 2112 bp, Candida albicans
gatattaagcggttttttcgtggtcatgagaatggtagtaacaaactagccaatatgtttagtaatataactaaggttggttcgagtttcaacaaaattgaatcattgcttatatcccctacaaaattgattatacttataacgacattaaattccctcgagatatttgaaattgtggggaatcacataaatcagatataccatgttcctgatagtaagaactcattgagtttttatgtcctttataatgatcggagattattttttgtggggacaaagaaaaagttaactatatttcaaatcattaataaatccagaaacatatttcagtttaataaattgaaggaagttgtgatgaaagacaaaatacgatcaatagacaagtttgatgaggattcgataatcattggtcttgtaaataactatgtgatttgtgaatttgctgactttggtgtgtcttcgttggcaattgaaaaaaacgataatatgcttagtcaaggaacctctttcagctactttggtttgtcgtcatccactccggtgatgtggacgatacaaataagtgatgatctatttttgttggtgaaggatacgcaaattgttaaaattgatagacgaaatggaccaagcatgattttgtcatcaatcaaactatctggaatccccattgaagttttatttatttatccgatttatttatttgttgtgtatcctaagaagatagaaattgtggatgttacaagtggagatttaattcaaaagttaggtcatagcataaactctggtcattccagcattattttaacgaattcagtaatcagcatagcttctggagctgacatattacaattcaatatcttgccattccaagctcagatagatcaatttttgagtatttcaggtaagggaacacttgggaatatcaaggatcctcgcaatgacttgaaatatatggggattgaaaaagccataactcttgtttccaatattgatgacgctaattctttgttcaatgatgcgaaaaataaattgatgaaattaaggtatttgtactctttgaaagcaacgttgttatttgaatcgtactcgaaatatcatgaggctttggtggatatatcttcagaatggctagtctcttttgctgatgtattaaacttgtttccagcatttattaatggccaactaagatcaaaagatgtaactagcgatggaaatgaaaataaaaagaattcttctttgaatgtaatcaagcgtattacagttgaagaactcgaactcaataactattcagaatcagaatatgataccgataacacgacaaaaaaaggtatggcgttgaagcaaccacatggacaatcagtaaaagctcaaaatatcagaaaattcattaaagctgtaaataacttgataatatatcttactgatcaacgacggattttgtcaaccttcatggacaaagacgttttaacttggaaaaatattgaaattaatccaagtgatatttatcctgaatttgatggtaatttagagacagtggctactgtgattgacacatcattattcttgtgttatttttattgcaagccgatgttgttgggtccattattaagattaccaaataattactgtgattccaaaatagtgaatgagtgtttattgagcaatatccataaccatgttcaacaacgcaactccaaacagcctaattttatcaaggaattgcttgatttttattatacaagaagcttacatgaagaagccttggaaatgttgtacaaattggctcatgatgaaggtacgattgagcactcaaacgaagatgacaataaatttgatgattttataaaaggacctgatttgactatccagtatttacgaaaattgacggacgacaatttgtatttggtattgaaatattcaagttgggtgattgaccaagacaaaaacgctgcccgcccaattttcatgaatgactcgtatgaatgtgaaagctacgataacactaaagtattacaatttctatgcaaaaaggatcaagatttgggaattatgtatttggagtggttactttttcctagttcttcaccacggactgccgatcagcggctactt

SEQ ID NO: 5362 - DNA, 183 bp, Candida albicans
tatggtaataaacccggattacatatgtcgggtgctggtggtaatgataatgatgatgtttgtcaatattcaccaggcaagagcccattggtcccaattactattggagcattaaatattggtgatgaaaaagctagcttttccaattggggtagttgtgttgatttatttgtcacctggtga

SEQ ID NO: 5363 - DNA, 1068 bp, Candida albicans
aagaaagaaaaaaacctgcttacacttctattgttagacttttttttaaaaaaattcttatcatcccactttatctacattatgagattatctaaagctgttgctatttctattttaacatcccttattggtgttcaaggtttactcattccatctgttggtgatattattgatgtatttggtgattctgttcaaaaacaaatcaccaacaagctagaaccattaaaagatgctgctcatcatgctgctgaacatttaggtatgactttacaagagaaattggcaccaattgttaattctgaatccactagagatattattcctcataaatatattgttgtattcaaacaagatgttggtgctaatgaaattgctttccatcaagaatgggttgccttgactcatactaattctttaaatggattagatgatcaacattctttttttgctgctactaaagatattaaacctgaaggtggtggtatcactgatacttttgatattggtaatttattaaatggttatactgggtttttcttggatgaaactattgatttaattagaaaaaaccctcttgtggcctttgttgaaaaagattcattggttcatgctaatgaatttgacattgaaaaaggtgctccatgggggttagctagagtttctcatagacaaccattaagtttatcatcatttgatcaatatttatatgatagtgaagccggtgctggtgttactgcttatgttattgatactggggtcaatgttaaacatgaagaattctctggtagagctaaatggggtaaaactattccacaaggtgattctgatattgatggtaatggtcatggtactcattgtgctggtacaattggatccaatgattatggtgttgccaaaaaagccgaaattgttgccgttaaagttttaagatcaaatggttctggtaccatgtctgatgttgttaaaggtgtaaaatatgctgctaaatctcatcaagaagctgttaaatccagcaagaaaggttttaaaggttcaactgccaatatgtctttaggtggtggcaaatca

SEQ ID NO: 5364 - DNA, 1041 bp, Candida albicans
tttgggaatataaatatgtactgggtccccattgaaagagggtttttaataatcagaaaagagggagcaaaccctgttttaattgaacttacggaaatgttaataaatttggcatgtgtgtttattgcattaattgacaagtgtttttccaatgacctgtattttgtttcacttaaagcatcagaatcaattgaccactttatggaatatgataaaagatacccaaagcatttgcaagtgcgagatttcattagtaattcaattgcaattggagatttcaagggattttcagggagattctccaaagatattattgataggttgaaaagatgtcctttggttcaagagataactgaagatattatgtttaatgcacttgaatttgaaatccaagaggatgctccgagacatttggccagaataagcagaaggagaagaatgaagccaaataaaccctatccttatatgtacgaaactgaatatctgggacaaggtgtaaatgcgtatgtgatagattctggaattgaagttgaccaccctgagtttgaaggaagagcaagcgcaggctatgattttactgaggaagggtctggagataataatggacatggaactcatgtagcgggattaattggttctgtcacgtatggggttgcaaaaaatgtcagaattgttgaagtaaaagcattgaacagtaaaggtgctggctcacttagcacaattttagcagctatagactttgcagtcaaccatagaatcgaatctgggagaaaaggagttgctaacttatctttgggtgcatataagaatcacattttaaacaaagcaattgagcaagcaaccaatacaggtttggtatttgtggtggcagccgggaattcgaatatcaacgcttgtatgaccagcccagcaagttccaaatatgcaattacagtgggagccattgatgattacaccgattcagtcactgccttctctaactggggtgaatgtgttgacatatttgcatcttcaccacggggctggaaaatccagcgctac

SEQ ID NO: 5365 - DNA, 1209 bp, Candida albicans
ttgatacagatttttgttttgcaaccatttttttttcatatttctcaccttttgtctacaacaaagactatggtgaagttacttctatccatatggatctcgatttactttatggcgggctcatcatttgcaagtagttcttatttagtgtcacttcattcccaagagactatcgatacattcatggcctacgacgcgacatacccgcaggatcttcaagttggcgaactaatcaattcaaaatttaagataggcaatttctcgggattttctggaagtttctccaaggatatcatcaaaaggttagaaaggtgccctttagtagatgaaattgttcctgatattacagttaaagcttatgatgccgtgtttcaagatctggctcctagacacttggcaagaataagcagaagaaaacgaatgaaaccaataaaaaagtattcctatatttacgaatctgacttcattggtaaaaaagtgagtgcttatgtaattgattcaggaattgcaattggtcatccagaatttcaaggtagagccagaactggtaaagatttcactgatgaagggccaggtgataacaatggtcatggaacacatgttgctggtttgattggttctcatacatatggtgttgctaagggtgtgcagattattgacgtcaaagcattaaattcaaagggaacaggctcgttaagtactatccttgttgcaattgaatttgccgtgaatcatatgttgcgttcaggacgaatgggtgttgccaatttgtcattaggtgcgtataaaaacaaactactaaacaaagccattgatcaagctactcaaactggacttgtgtttgtagttgctgccggaaataacaacattaatgcatgtttaaccagtccatcgagctctccttatgcaataactgttggtgctatagacgactacaatgactcaattgccagcttttcaaattggggcgagtgtgttgatttgtttgcaagtggtgcttacgtaaagagtgtaaatattagaagtgattttagaccactggtattactggggacatcaatggcggctcctattgtcacaggcttggtggcaaatttgttaaatgaaggagttgatccagagcttataaaggggcaattgatagaaatgtcaacgaaacaccgaatgtcgaaatcatcgctattcttgaaaaaaagaaatccgaactga

SEQ ID NO: 5366 - DNA, 519 bp, Candida albicans
aaatctacagggaatgtgtcgattggtggaggtatttctgatgcattagatttggcagttaatgctggtactaaagccggattacatatttctgttgctgctggtaatgataatgctgatgcttgtcaatattcaccagcaagagccactggtccaattactattggagcatcaaatattcgtgatgaaaaagctagtttttctaattggggtagttgtgttgatttatttgcacctggtgaagatattgaatcgacatttatttggtccgacaccactgttatgtcagggacttcgatggcttctccacatattgctgggttgttatcgtattatttgtcattacaaccagatgttacttcggaattctacactcaagccattgaaccagctgatttgaaaaataagttgatcaaatatggtactaaaggtgtcttgactggattagattccgttagtccaaatattttggcattcaatggtgctggtggtaacttgaccgatttctggagtttatag

SEQ ID NO: 5367 - DNA, 243 bp, Candida albicans
tcaggtacttctatggcttcacctcatatttgtggattattatcttattttgtttctttacaaccaggtgcagattcagaattctttgttgctgctgatggtatttctccatctcaattgaaaaagaatttgattgcttatggtacttcagatgttttaagtgatatccctgaagatactccaaatattttggcattcaatggtgctggtcacaatttgaccaagttttggggtaacaattaa

SEQ ID NO: 5368 - DNA, 837 bp, Candida albicans
atagtcatgactagtatacgttacgactattttaaggaatctggtgggagtgatggaggtctgccaacaagaacaataatatcctataaacgattcatttatgttggtactttattggctattttgatctatggaagttcatttttaattacaacgatagagaatttcacattaaaatttgaatcacaatcaatatcatcaatagatagtttcaaaggtgaaagaccagattatgccagtccatcactgaaatcaacagattttaagggcaaaatccctttttcgaaagaagtttatgataaacatatcttatctcccaaattacattcaatacaatggattagagctccagaatccatacatgatgatagaggtacttatgtcatcaaagaagataaagacgacaaaagttttagagttgtggtgaaatctatcgctgatgaagaatatgaaaaggaattaattggtaatagtatattcaaatacaagggagaagagcatgaaatcgttgactattttgcctccccagatttacaaaaagtaattttaaaaaccgatgtcactagtctttggagatattcttcaatagcttattattgggtattggatattaataatggagatatcaaaccagttttcaatgatgttgataagatttctacagcatcatggtctcctgattcttctaaaattgcttttatttatgaaaataatttatattacaaatctttacaacacgatgagattgttcaaattacttttgatggttcaaccgaaatattcaatgggaaaccagattgggtctatgaggaagaagttatgggtccgatcatgtat

SEQ ID NO: 5369 - DNA, 1485 bp, Candida albicans
gcaagcgcggatccttccagcccccgtggtcgaagaaatagattaatcactgaagtggtatggattggtgattcattaaaagtgaaaacatcaaatcgtcatagtgatttattagaaattttccttgttgataaacatgaaaaagttaatttgatcagaactttaactgcttctgactcatggtttgaagcaacttcatcaacactttacattcctgctaataaaactttgggtagaaaatacgacggatatttggacattgttgttgaaaatggctacaatcatttatcttatttctctccaccagataattctgaatatgaattattaactaaaggtaattgggaagtaactggtggagttacatttgatttcacttctaatacggtgtattttacaagtacagccaaatcaccaattgaaagacacatacattcaattaacttattagatagatcagataatgggttaccttatattaaagatataactacaaaagaaggttggtatcaatcgtcattttcatcgggggcaagatttttatttttatctgaattggggcctggtgttcctactcaaagagttaatgatttgaaaatgcacaagaatgttaaaactattgaagataattccgagttggttgaaacattgaggaattatgtggttccagaagttaaatattcacaagtagaacttgatgataaagaaaccggtcaaccatttttagttactgctatggaaaccttgccattaaattttgataaaaccaagaaatacccggtgttgttttatatttatggtggaccaggatcacaaacagtaacgaaaaaatgggcactttcattcagttctttgatagctgctgaactagatgctatagttgtcacaattgatggaagaggtactgggtttaacaatttgaattataaattaggatctaaattcaaatttattgtcagagatagattgggtcaatatgaaccaattgatgttatatcggcagctaataaatgggcagaaaaatcatatgttgatcctgaaagaatagcggtttggggttggtcatatggtggatttttaacattgaaaactttggaaactgatattgataatccaatttttaattatgcagtggcaattgcccccgtcacgagatggagattatatgattccatttatacggaaagatatttaaatacacctcaagaaaaccctaaaggatatgaaactggatctattcataatgttactaatttcaaacatgttaagaaatttttcattggtcatggtagtggtgatgataatgttcatgttcaaaattcattacaattattagatgaatttaatcttgctgaagtggaaaattttgaatttatgatattccctgatagtaatcatggaatgaattatcacaatgggtttaatgttgtctatgatagaatattagattttttcaaaagagcatttgattgggaatttgtataa

SEQ ID NO: 5370 - DNA, 876 bp, Candida albicans
  unsure (35): Identity of nucleotide sequences at the above locations are unknown.
ttggtttcttctggtgaaaatgataaagaagaagnacaacctactgaagaagaaaagaatgctccattatatggtacacatccattgaagttgttaagatatattgctaaacttgctaatgtttcagtgggtgatattttacaatgggatttacaactttatgacgttcaaaagggtactaaaggtgggcttaacaaagaatttgtttttgctccaagagttgacgatagagtttgttcatttgctgctcttaatgcattgattgattctaccgtggacaacaatttggccgaggattctttttcaattgttgggttgtttgataatgaagaaattggctctctcactagacaaggtgctagaggtggattaattgaattagttgttgacagagtgttgtcatctaatttctataatccagaagttcttgatattcaagaaagtttgagattgacttatgctaattctattgttttatctgccgatgttaatcatttattcaatccgaacttcccaggtgtttatttggaacatcataaaccattaccaaatatcggtgtcacgttatctttggatcctaatggtcatatggctactgattcaatcggtcttgccttggctgaagaattggccaaaaagaatggagataaagttcaatatttccaaattagaaacgattcaagatcaggtggtactattggtccagcaatttccactagtactggtgcaagaactattgatttgggtattcctcaattgtctatgcattctataagagctactcttggtagtaaagatattggattaggtattaaattcttctatggtttcttcaagaattggagagatgtctatgataattttgctgatttatag

SEQ ID NO: 5371 - DNA, 876 bp, Candida albicans
  unsure (823): Identity of nucleotide sequences at the above locations are unknown.
agaaaaaagggagcccaacttatcaatgcaatttccaattctactttttttccttctttctttcctcccaaattttattgcaacagatatactaatatcaccttcaaaatgtctaacattgacgatattcttttgagtatttccgaatctttaaaacaacttcaaaaagcttctcaagagaaaccaattgaacaaactcaaccagttcaaattcaaaacttggaggtcaattctaccaaaaaattcacagatgattattatagtaaaattgccgatgattatattgaattcacctataaaaacccaaccatctatcacgttgttaattttttcaaaagtcaacttgaactgaaaggttttacttatctcccagaaagtaaatcttgggccgatttgaaagcaggtaaatatttcaccactagaaatggttcatcacttgccgcatttgttgttggtaaggattggcaagcttcaaaaggggttggtgccattgggtcccatattgattctcttaccactgttttgaaaccaaattctacaaaggctaaagttgatggttatgaattattaggtgttgctccttatgctgggacattaggtagtgtttggtgggatagagatttaggaattggtggtagattattagttaaagatggtaagggtaaagtcagtcaacatttggtggattcaaccccacatccaattgctcatattcctactcttgccccacattttggtgctccagctaatggaccttttaatactgaaacgcaagctgtacccagtagttggtttcttctggtgaaaatgataaagaagaagnacaacctactgaagaagaaaagaatgctccattatatggtacacatccattga

SEQ ID NO: 5372 - DNA, 954 bp, Candida albicans
gccttgctgggtctgtccttggtaaaagacaacgatacaggaaaaatatcacggaaattgattaaatctcatcctgatccgattgcattcatccctcagttacccgaagttttccctgagtcgccaaaggaatacaatactcagacccagatggttcctatttgtggatacacaactgaaactttggtccatactgacgaggaaaagaggagtaaattctacacacgtcattcattatcacttttgagatatgtatcaaaattggcagaagttccacttgcttctattgttgaccttgacctagacctagtagacatacagacaagttgccgaggaggtttggacaacgaatttatttatctgggtagtttggatgatagattatgtgcgtttgattcagtgtatggcttgatagagtatagtcagaggttttacttggacaaggatatcaaaacatttgatggcttgaatggtatttatctagccaatcacgaagaaataggaagtggaagtagaactggggcaaaaggtgggtttctaatagatgttttaaagtcaattgtgagtgataaatataaaacacatacaccagaagcagtcgccaatttgactaccaacacaatctttttgtcatcagatgtaacacacgcattgaatccaaattttaaaaatgtgtacttggaaaacaatttccctgtcccaaacactggtccatctattaagtttgattctaattttcatgttttgagtgattcaaaaggtaatgaatttttgacacggataatagacgacttgccggggatcaaacttcaacattttcacataagaaacgactctcgttcaggtggaactattggcccaataatgtctgacagcaggagaggcattaatggagctaaatccatcattgatgttattcggcgacgccgctggcaagtccatgctccccccccc

SEQ ID NO: 5373 - DNA, 852 bp, Candida albicans
ttatctgagtctctcatttttttttgctggttttcatacggcaacaaattgtctcaagtgaatgtcactttctttttcatattaatcattcaattgaacatgaacccggcatataaccccaaccccaaagaaacatttgtactgataacaagggattcagatgacagtttaatatcaactacaccagatatttcagaaactgaattcgaagatggagagaacttatctaccccagatatttcaataatcgatgacgaatacactgataacgaacccatcgacgaatttgagaatgagaaccaaataccagccgatctgatgtttcaatttcaattgccagatatgtcgacaaccatccctcgattaccaagcaatcaagatgttccctcagcaaaggatgatacatttgacaactactatgaaagttacagtgaaaagtatattgagtttatgaacaacaacccaacaacatatcacactatcagtcatttcaaatcattgcttgaaaacaatggtttcatttttctaccagataacaagccaatctcagatttatcaccagggttttatttcacatctaaagacgatcagtgtttggttgcatttattattggcggcaattggaaacctgaaaaaggttcttgttttgttggtagtcattgtgatgccttgagtgttaaaataaatccgcgaggactgttacgagataatgtcaacggatacgagttgttaggagtagcaccttattcaggaagccttaataaattatggttgagcagagacttaggccttgctgggtctgtccttggtaaaagacaacgatacaggaaaaatatcacggaaattgattaa

SEQ ID NO: 5374 - DNA, 1737 bp, Candida albicans
gccccaagaaaaacccaccaaaattgtaactacaaaaaaattccctcccactttctttctttctttctttttttttcccaattaacttcaaggacaactaaaaacatcatgaagttatcaaaatccactttaattgccactttggcattgacagctacttctaccaatgctttggttgttcaaaacccatttagcaacattcaacaagcattgaaattggacttatcttatgataaattgacttcaaaattgactgacacttttgagcaaggtaaggctaatattatcagcaccattgctaaagttatgaatgaaccattagatgggttaaccccagaaattaagaacatctggctggaaatgttgatgaagttcccaaactccatcaccgaattgaatttcaaagcaccaccaaaaaagggtaaaattactactcaacaatttgatttccatgtcactgatgcccaagttccaaaccacaagttaagaattaaatcaaccccaaaggatttaggtatcgataccgttaaacagtattcaggttatttggatgttgttgatgaagataaacactttttctactatttctttgaaagtagaaacgaccctaagaacgacccagttattttgtggttgaatggtggtccaggttgttcctcattgactggtttgttcttcgaattgggtccaagctcaattgataaaaacttgaaaccagtgtacaaccctcattcatggaacgctaatgcctcggttatcttcttagaccaaccaatcaacgttggttactcatactcttctcaatctgtttctaacaccattgctgctggtaaagatgtctatgcctttttacaattattcttcaagaacttcccagaatatgccaatttagatttccatattgctggtgaatcctatgctgggcattatattccagcctttgccagtgaaattttaactcaccccgaacgtaacttcaacttgacctcagttttgattggtaatggattaactgatccattggtccaatacgaatactatgaaccaatggcctgtggtgaaggtggcgaaccaagtgttttggaaccagaagaatgtgacggtatgcttaacctgttaccaagatgtctttctttgattgaatcttgttacgaaagtggctcagtttggtcatgtgttccagccaccatctactgtaacaatggtcaaatgggaccatatcaaaaaaccggtagaaatgtgtatgacattagaactatgtgtgaaggttccagtttgtgttacagtcaattggaatacattgatcaatatttgaatttgccagaagtgaaaaaagcattaggtgctgaagttgatgaatatcaatcatgtaattttgatatcaacagaaactttatgtttgctggtgactggatgaaaccttaccaaaagaatgtcattgacttgttagagaaggaattgccagttttgatttatgctggtgataaagatttcatctgtaactggttaggtaatcaagcttggactaacagattggaatggagtggatctaagggattcagcaaagctcctgtcaagacttggaaagttggaaagaatgctgctggtgaagttaaaaattacaaacattttacatttttgagagtgtttggtggtggtcatatggttccttatgaccaaccagaaaacgctttagacatggtcaatagatggattagtggtgattacaaatattaa

SEQ ID NO: 5375 - DNA, 1599 bp, Candida albicans
cttatcaaaattcccccatcatttatcctcacaactttatctaaaatttggctcttcctggctttaacttttttttcttacctacacaattgtactcgaaacatgaaagctttattactattgtatactgtcattacagttgttttggcgttgctttcgcagactcccttttctttgtctccattgcaacaattaatagatgaacttgctggtaaagtttctcagacacagattcttgatatggagagaatatggattaattatcaacggcaaaacggtttagaaactattttgaaagaatttaaccaattcaagtcacaatttcagtattcattagcctcccaggataaatctgaatcaacttacagtattgaagtatccaaggcatcccctgaattgttagggtttgacacagttaaacaatatactggttatttcaatgtcaatgataaagataaaaactactttttctggttttttgaaagtagaaatgaccccaaaaatgatcctttagttatttggcttaatggtggtcctggatgttccagtttatgtggattggcattagagttgggtccatcaattataaatgccactttacagcctgagtataacccacatgcctggaattctaatgcttctgttttgtttttagatcaaccagcaaatgtcgggttttcatatggtggtaacattcctatcacctccgaccaagcttcacaggactttgttgaatttatcaaattgttttatgaaagatttcccgagtatgtcgatttggacttgcatatttcgggtgagtcatacgctggccattatgttcctagtttcgctaatgctgttcataaagctggtattccattaaactcaatattgattggtaacggtgtgactgatccagtagtacaattgggtgaagtgagtaacatgggatgtggtcaaggtggaattggaaagatttacacagacaaggaatgtacagaataccctgagaaatacgagaaatttgtaccttatggagaattatgttacaagaacccaaatgctttaacttgttttattgctgcattggcctcgccaaaaactccagacacaggtgatttgaatccttatgattcgcgtgtcaaatgtggtaacaactcattgtgttatgatcaaatagattatcttaacgactactttaatttacaatcggttcaagaagctttaggggttgaaaagacttacacaatgtgttcctctaatgttggatccagatttgtttctgattttatgaggccatatcatacttatgttgctgatttgttagatgatggtattccagttttgatatatgttggtgataaagatttagtatgtgattggttgggaaacttggcttgggtcaataaattgaattataccggacatgatcaatttgaaaaaactgagtttaaaccctggtacaccgctgatggcaagttggctggtgaagtgaaaaatcatgaccactttacttatttacgtatttatgaatctggtcatatggtacctatggaccagcctgagaattccttagacatggtaaatagatgggttcgtggtgattttaaattttaa

SEQ ID NO: 5376 - DNA, 1659 bp, Candida albicans
attaaaatgcaattatctacattagtcacttggttggctgctttaactgtcggtgcacaggcagtatcattcggcaacaatttaaaagatcagattatattggattctgaggaaagctccccagatttatatttggagtcagtgttcaaagacttgggttcattgccagttgatttgattactgcttgggcagaaatgcaatctgaattatcacctgaacaaattgccaaattaatcaatcaatatgattctaaaaatgaaaaaccaaagaaaaataagtttaatccaatgtcgacattttcttcaccaagttccaagtttgaaaagctttccaatgataaatttgctggttattcaatgcgtgtaaaagagagtttcccagaaattttgggtcttgatacagtgaaacaatacactgggtatttagatattgactcattagataaacatcttttctattggttttttgaaagtagaaatgatccaaagaatgatcctattattttatggctcaatggtggtccaggttgcagctcttcaacgggattattttttgaattgggaccatcctcgatcaacaaaactttacacccagtttacaacccatattcttggaattccaatgcgtcagttattttcttagatcaacccgttggagttggatattcttatacaggaggagatgaagttaagaatactctcactgctgctaaagacgtttacgtgttcttggaattgtttttccaaaaattcccacaatttttgactaataagtttcacattgctggtgaatcttacgccggtcattatatcccagcatttgcttcagaaatcattaacaatgccgataggtcatttgagttggcctctgtgttgattggtaacggtatcaccgatccattgattcaagatggttcctataaaccaatgggctgtggtgaaggtggttacaaacctgttttgacaactgaacagtgtgatcaaatggaaagggattatcctagatgtgctaaattgactaaattatgttacagtttccaatctgccttgacttgtgttccagctcaatactactgtgattcccgtttatttcaaccttatgctcaaacaggattaaatccttatgatatcagaaaggattgtgccgagcaaggtggtaattgttacgtagaaatggattacttggatgaatacttgaatctcgattatgtgaaagaagctgttggtgcttctaatattgacatttttacttcatgtgatgacaccgtgtttagaaactttattttagatggtgatgaaatgaaacctttccaacaatatgttgctgagttattggacaataatgtacctgtattgatttatgctggtgacaaagattatatttgtaattggttgggtaacttggcatgggtaaacgaattggaatattcagatagtgaacattttgcaccaaaaccattacaattatggaaaccagatggcaagaaagctgctggagaagtcaagaatcacaaacattttacattcttgagaatttatgacgctggtcacatggttccctttgatcaaccagaaaatgctcttagtatggttaatacttgggtacagggagattattcttttggtttagagggtaataaattatctgaagctgattaa

SEQ ID NO: 5377 - DNA, 1008 bp, Candida albicans
tacaatatgtcattaagatctaaattatcatcattacgagaatatcttactcctatcaatcataattccaattttgttactacgggagaaattagtcctgaagaatttgttaaagctggtgattatttagtttataaattcccaacgtggcaatggggtaatgattgtcctaaaaatttacaaaaatcatttttaccaccagataaacaatatcttgtaacgagacatgttcctagttatcaaagagcatctaattatcttactggtgaagataaaaaaggtgcaaacccagaagaagacgatgaggaagaggaagaggaggacgaagaagggtgggtgaaatcaaaaaaaattcataaagtgattgatgatacacatgactcgcaaattaataaaggtgaagaaattaatgacattgatgattttattgatgaaaatgctgaagaacaagaacatgatcaaattggagaccatgaattagatgatgatgaatttgatgatttggatataatcaatgattccaaaaataataaattacgaagatttgatttatatatcacttattcaacttcttatcgagttcctaaattatatttagtagggtttgattctaatggtattccattattaccacaacaaatgtttgaagatataaattctgattataaagataaaaccgccaccattgagaatttaccggttgctcataatacaacttcagtatcaatacatccttgtaaacattcttcagttatgaaagtccttatgaaacattcaaaattgaataagaaaaatttgcaacaaaaggatgagagtctaagtgatgatttgagtaagttatcagtaaatgagaaaaaaacacaggatgaacattcacaaataaataatgatgataaagaagaagaagaagaaggtatcagggttgatcattatttgattatatttttgaaatttattgctagtgtcactccaggtattgaatacgattatacgatggatgccttatga

SEQ ID NO: 5378 - DNA, 1146 bp, Candida albicans
ttggttctttttttttcaatatctcaatcaattaagcaaacagagaataacatgattttcaatattttgtctttcatttctttagcaatttttgttgatgctgttgctttgaaaagcaacccaaaggtcattagttttgattttgagctaagattttccgatcctatcaaaagagataccaactttggtaccggtactgctgccccagtaaaggacactcactggtcgttccctcttaaaattggatcaaaccaagacccagtaacacttgcagccgatactggtagttggttaatacaaatcaatgatgctaatgccacttgtccgaattgccataaacacggtacttataattcatctggctcgctgaccgttgtaaagctgggtaaaacagcaaggtcattttttacacgactggcatactacattggtgagttagtcagtgattctatccaaattggaaatttacaaatccctcaagtaaccttcaatgatgtttataattcaactgcgggtgatggtatttttggtttagcaagaccaccatctgacaaaaatcaaagtattgtttgggctgctaaataccatggcttagttgataaagctgcttattctatctacttacaaaaccttgatggaacgccaggtgctttaactgttggaggttatgatgctgctaaagttgacggtgatatcacttggacaagtattagaaatgctaatgttcaagcacatcttggtcatattgaaattaacgaagaaatcattgatgttaataaaaactacaccatcgataccggtggtaggtacggtttcttaccggaagcagcatataatcaagttattgctaatttgcctgaagatccaaaatttggagccgaccgtggtcaaattacctgttcattacttgaaggtaaaaactttacctataatttgaatggtgttgattacacattccctttaagaactttgtatgttcctactgaaaacaccgatcactgttaccttgctttgcttaaaggtaatgctgctcaattaggtgcatacgtgttcagaaatttatttgttgccgttgattttgaagatgacttaattggacttgctagcttgaaaaatactactgcaacaaatatcagacctttttag

SEQ ID NO: 5379 - DNA, 1011 bp, Candida albicans
tcaccccacaagaagggaggtaaatatgatgctccattaacaaattacttgaatgctcaatatttcacagaaattcaaattggtacaccgggtcaaccatttaaggttatcttggatactggttcctcaaacttatgggttccttcccaagattgtacttcattagcgtgctttttacatgctaaatatgaccatgacgcatcctcgacctacaaagtcaatggtagtgaattctcaattcaatatggttctggttctatggaaggttacatatcccaagacgttttgactattggggatttggttattcctggccaagattttgctgaagctacctccgaaccaggtttagcattcgcatttggtaaattcgatggtattttgggtttggcttatgatactatttcagtcaaccatattgttccaccaatctacaatgccattaaccaaggcttgttagaaaaaccacagtttggtttctatttgggtagtaccgacaaggacgaaaacgatggtgggttggctacatttggtggttacgatgcctccttgttccaaggcaagatcacttggttgccaatcagaagaaaggcttactgggaagtttcgtttgaaggtattggattaggcgatgagtacgctgaattgcacaaaacaggtgctgccatcgatactggtacttccttgattacgttgccatcctcattggctgaaattatcaatgccaaaatcggagcaaccaagtcatggtcaggtcaataccaagtcgattgtgctaaaagagactctttgcctgacttgaccttaacttttgctggttacaacttcactttgactccatatgattacatattggaagtgagtggatcatgtatttcagtgttcactccaatggatttccctcaaccaattggtgacttggccattgttggtgatgccttcttgagaaagtactactccatctacgacttggacaagaatgctgttggtttagcaccatccaaggtttag

SEQ ID NO: 5380 - DNA, 726 bp, Candida albicans
ctttccccgacattagtccttctagccgccgtggttgaaaacgaagaattgaaggtattaaaggatttcaaaaagaaggatcttgaaacaagaggattagagccagaagaatccttttacagttgggattataactactacaacgaaagattattggaacaaaaatataaagttgaccatgtcaaaattgccgagtatttcccattagaatctactgttgctaaaatgttaggattttatgaaaaaatatttgacattaaatttgtcaaggttgtaaagccagattcagcttcagtatggcacgaggacgttcagcaatatgcaatttatcaaaacgtgaaaacaaagggtaaagaattggaatttatgggatggatatattttgacttgcatccaagagaaggcaagtatgggcatgctgccaatttcggcttgggtcctggatacttggaaaaagatggaaaaactagacacacgccgataacagtattagtttgtaatttcacgaaaccaagtaaagacaagccatcattattgaaacatgacgaagtcacaacatttttccatgaattgggccacggaatccataacattttgtccaaaactaaatattccagatttcatggaacacacgttgaacgcgattttgttgagacaccttcacaaatgttagaatattggacttggtctaagaatgagctcaaagaattgttcttcacactatag

SEQ ID NO: 5381 - DNA, 204 bp, Candida albicans
aatattggacttggtctaagaatgagctcaaagaattgttcttcacactataggacaggagaacccattagtgacgaattgattggccagttgattagaactaaacatgtcaacaccggattgtttaacttaagtcaactcttctttggtatttttgatatgaaattaccaccattggccatcaaaaagatttggactctttag

SEQ ID NO: 5382 - DNA, 1455 bp, Candida albicans
acatcatcatcaaatcctgaagacatggaatcaccaactccgggtgtaaatgttcaaaattatcaaccatatataattccctatttaaatctgcttgaagctagtggagaatttgtcactgatgatatatcatttaatttaactactggagatccaattgaatttaaaaacatgacatttcttgatgttaatgatagtaatgctttagttggaggtcttggattagcggggacacctaaaggttcaggatttttatattcattagttgatcaaggtataattgaatcaccaggatattcattatggtttagtaatgatagtaatcctgatactgctatcgctcaattattacctggtgttataaatcaaaaatattatgttgggaatttttatcaatttgatatgatacctcatactggatttagatataatgctagttatcaagaacaaaatcaagatttatttaatttaatattaccagtgatacaaataagtgatatattaatggtgaatttaaattcgggacaaaaattgacgatgaaatcaaatgatgatcaaatacccgttttacttgattccagagcatcgaatttttatttacctttagaagtgattattaatttagctattcaaacgagagcttattattcaagtgaactcacgagatggcttgttacttgtcatccattacttgatgttaaagctgccattgaaatccaaattggtggtttgacggtatcggtaccaatatcgaaatttattggtcgagcagtatataatggaagttcattaaattttgaaaatggggctgaagcatgtgttttaaaagttgtacctagttcagtgactgggtataatatgttgggattaccatttttaaaacaaatttatttggcagttgataatgaaggtataaaaattgctttagccaatctgaataaatatttaaaaaggagtaaacaagatatttttaatgatgtggcaaaccctgatcaacatgtttataataatactgctggcgaattagccgatatcaccaattccaattccagctccagtgatactaccagttctattgaatctggacactctggaatttctggaaattctattgattatattaaatcagggaaaataccttttgccacggtatacagtgaatcaactgaaggtacatttatatattcttcacttagtcaaactagtggagccacggttattttagatattcctgctagatttagtggtgcttctattaaaagtggtttaatttatttaaatggagattcactgacttcagttactacaagtgctattaatagtacatctacaagtaaagcacaagcaaatttgaatggtcaaatgaattatgttgaagttggaacaatgaaatttccaacagcaatattatcacttgttttatcaatatttcttattataataacattattatga

SEQ ID NO: 5383 - DNA, 675 bp, Candida albicans
ctattaaccaagatggcctcaacatcaactagtaaagagttgaaatatgccccagagtttgttgacttcgtcaatgcttctcatactccataccatgctgtaaactcagtgaaatcattattatctgaagcggggtttgaagaaattcacgaaagaaccaattggtttaaatctcatactttacaaaaaggtggtaaatattttgtcaccagaaacggatcctcaataattgcattcacaattggtgaacaatttaaaaatgggaatgggattgccattgttggtgctcatactgattcaccatgtcttcgtatcaaaccaatttccaagaaaacatctgaagggttcattcaaattggagtagaacaatatggtggattaattgctcattcttggtttgatcgtgatttatctattgcggggagagtttatgtcaatgaaaatggacaatttgttcccaaattattgaaaatcgataaaccattattaagaattccaacattggcaattcatttagatcgtgaagtcaacactaaatttgaattcaataaagaaactaaattagttccaattgctggtcaaacatcaatagataaaaatgaaaaggaaagctcagcttcagcttccgaaccagtcttcaccatggggactgctggaccgcattatttccgaatg

SEQ ID NO: 5384 - DNA, 750 bp, Candida albicans
cacaaaattgaagattttgaattgattttatttgatcatcaaaaatctacaattggtgggttaaacgatgaatttattttctcacctagattagataatttaacttcatgttttactgctgctaaagggttagttgaatcaattgaaaacttaccaaaagaggaagggatttctttgatttcattgtttgatcacgaagaaattggaagtgtttcagcacaaggtgctgactccaccttcttacctgatataattcaacgtttaacaaaatttgatttcgataacaccaacagttcagataatgtggattatttccatgaaacaatgtcgaaatctttcttgttatcttctgatatggcgcatggagttcatccaaactatgctgataaatatgaaggacaaaatcgtccacaattgaatttgggtcctgtgattaagattaatgctaatcaaagatatgctacaaattcaccaggtattgtattgttgaagaaagttgcagataaagttcaagttccattacaattatttgttgttagaaatgattcaccctgtggatctaccattggacccatcttagctgccaaattgggaattagaacattagatttaggaaatcctcaattatcaatgcattcaattagagaaactggtggtacttttgatattcttaaattaacagacttatttaaatcatttttcgaaaactacatagaattggatagaaaaattttagttgaccatctttga

SEQ ID NO: 5385 - DNA, 870 bp, Candida albicans
ctttctatggacctagtaataatgaattttgtattcctactatatttaacctcagttgtgaaatgttctatcaagttggacttcaacaaagtcctgacaccatccaaatacacaaaaagagatgccttgccaatgcctcttatcaacgacaagatcttatacactacagaattggagatcggttcgaataaggataaagtttcggtgtcaatagataccggttcttatgacttgtgggtcatgagtaatgatgccgtttgttacaaggtatcagagtttcaaactgaaggtgcaccccaattacctgatattttcaacgatatcgatcaagactattcttgtacattcaatgggacatacaattccaagagttcaaaaacatttaaaaatacgtcagaagacttttccattggttatgtagatggatctgctgctcaaggtgtatggggttatgacagtgttcaatttggacaatatggcgtaactggtttgaaaataggaattgccaatagatcgagtgtatctgatggtattttggggattggaatagcaaatggttatgacaattttcctgtcttattacaaaagcaggggttgattaataagatcgcctattctgtctatttgaactcgtcaaattccaccactggtacaatattatttggtgctatcgatcatgcaaagtacaagggggcattgagtacagtccccgttgattccaaaagtcagctttcagtgaatgtgacgaatttgaagaccaaaaacggaaatgttgcttctggtggtcattcgattctattggataccgggtctactttttcaattttccctgatgatcttcaccagacggggcaaggaccatgtaggggg

SEQ ID NO: 5386 - DNA, 564 bp, Candida albicans
catgatatgatttcaaatactttcaaaattcgatgtcccctaccgttgaaaagaatatcatcaacaagcatacggacatatcgtgttatggccatagaatcgtcgtgtgatgattcttgtgttgccttactcgaaaaatctcatcccaagactccaccaaaaattatagatcaatttaaacggacactacattccgctgatataggtggtatattacccacggcagcatataattatcatatggcaactattgccaacatggttcaagaattttgccataagcatcaaatttcagcattaaacccacctgatttactttgtgttaccagaggtccaggaatggcaggatccctaagtacttcaactgaatttgccaaagggttatctgttgcatgggatgttcccttagttggagtgcatcatatgttgggtcatttgttaactgcaaatttaccaaatctggaacaacccaagttaccacccccaaactatccatttttgagtttgttatgtagtggtggacacactatgcttgtattactgaaatcattaactgaaccatga

SEQ ID NO: 5387 - DNA, 546 bp, Candida albicans
  unsure (528): Identity of nucleotide sequences at the above locations are unknown.
ttgagtgtgaatactagaattgctaatccatataattttagattaactcttccttattcagcacccaaatatggtattccaggagatgtgaaatttgcattctctcatttcttaagtaacattcaagaatataaagcaatgcattataacaaaaataggggtgaaggtgaaagtgagggcgagggtgagatagatttgacattagatgaagaaactaaacaatttattgcatataaaacacaagaatttatatttgatcatattgttgatagaataaatattgcattcaaaaaacatggcattaaaaatagaaatagtgatggtacttttattggggttaaagattttatttgttctgggggagttgcagcaaataatcgacttcgacagaaattacgggaaaagctagattttcaagagattggtaccgacaatgttaatgtgaattttcatttcccagatttatcactttgtacagataatccgatcctgattggtgctttattcgaccacgccgctagaaattcncatgctccccctatgaga

SEQ ID NO: 5388 - DNA, 513 bp, Candida albicans
aacgcaagtgcggaccttgcagcccgtggtgaagacccatacaacactttggagttccattggtattctgcggaagaaggtggattattgggttcgattgatgttttcactagatattcagaaagcaaccaagttgtagtagggatgttacaacaagatatgacaggatacactcaaggatcaattgaccaaggtattgagcctcatttcggtttgattgcagattacactagtgttgaattgaacaatttcttgaaacaaataatcacaaactacaactccattccttatcacgagtctgaatgtggatatgcttgttccgaccatgcaagtgcattggagaatgggtatccatcttcattcttaattgaaagtgaaatgaaatatagcaacaagtacatccattctaccatggatacaatcgacagattggattgggctcatatcaaagagcatgtcaaattaaccgttgcttacgcatacgaattaagtttagctagaaatctttattaa

SEQ ID NO: 5389 - DNA, 1293 bp, Candida albicans
taccatactcatataaatgctattataaccaaaatgaagtcagaaatacccccaataaagaatacaaactacaattgcaaaatacctagaagcactttctttgtcgtttgtgtgttctcattgcttatctattccttatcaacaatctaccggtcaagcggtttggtgttgcccccattatcgtttatagatcagatcccagaaaacttatccagatcagatccatatttgactttacatgttgacatcagtgatgacccattatcagataaaataggacaaccagaattaaatccatcacctaaacatttacacgtaggtagcaaggcaatggtcgcaagtgatgtccccttgtgctctaccatgggcaaagaaatattgcttcgaggtgggaatgctgctgatgccgctgttactgttgctttatgtattgggtcggtaaattcacatagctctgggatacgtggtggaggatttatagtaagcagaaataatggtgatgcaattagtattgatgctcgtgaaatggccccaggatcggcatataaagaaatgtacggaaacctgctcgtgttgtctaaaattggagggttgagtattgcaattccgggagagttaaaaggtttatatgagttatttaagttgcatggatccgggaacttgagttggaagcagttatttgaaccagtaataaaattaaacagaaacggattcaaatgtctgaaaatatttgaaactgttttggccaaagagtacgatttggtgttactgagagtacccgtattgaaggattcatgggactttatattcaaacctaatggagaattgcttcaggaaggagatgtgataacaagaccaaattatgcaaacacattagaattaattgccaataatggcagtagcagtattttctatgatcccaacggtccaatagttcagtctttagtttccactatacaaaaatggggaggaattgccactgtacaggatttttctaattatgaggtaaacttggaaaagccactaatttctaccatcaataattatactttctataccagcaatggcatatcatcgggattaggattgttagcaggcttgaatttttttgatcgagtcttcaacgaatcggatgatgatacccttttcacccataagttagtcgagaacttcaagtggctcagttccattcgtaccaggtttggagacattgacaacagacaagatttaatagacaagtacaccaactccacttggatagatgacgttttagacgaagaaaaagtactctga

SEQ ID NO: 5390 - DNA, 672 bp, Candida albicans
acgaagaaaaagtactctgacgaaaaaactttccattggaaacattatgatcctaaatatgacattgcagaaccacaaggaacatcacatttttcggttgtagatgaaaatgacaattcagtggcaatgactactactgtgaacttgttattcggatcaatgatttatgacagtaaaactgggatcatcttgaatgatgaaatggatgactttgctttaccaaatgttagcaatgcctttaatttaactccttctattttcaattttattcacccagggaaacgaccattgagttctactgcaccaacaataatcataaacgacgccactaactcaacagattttgttattggagccgcaggaggcagtagaattaccagtgccatattacaagcgattgtcaggacatattaccgcaaatacgatttattatcgacaatagcatttcctcgtttgcaccatcaattgatccctgaaagcgtcatgagtgaaaatctcaccgtatgggaccaagaacacactggaatagccagttcaatgaaaaagttgggccacacatttttggaaacgggatccttaacagcaatgaatgggatcaaaagggttaaaggtggtaaattacatggtgtatccgattggtggagaaaaaggggggaactggatggttattaa

SEQ ID NO: 5391 - DNA, 660 bp, Candida albicans
aaaacaaacaatcaattatctacaatggctgatcaagaagttttagttttaagaggtactttagaaggacacaacggttgggttacttcccttgccaccactccagctcacccagacttattattgtctggttcaagaaataaaactttgatcaaatggaaattgaccggtggtgaagataaccaatacggtattccaaagaaatcattcaaaggtcactcccacattgtccaagatgttaccatttctgctgatggtgcttacgctttgtctgcttcttgggacagaactttaagattatgggatttggaaaccggtgaaaccacccaaagattcgtcggtcacaaaggtgatgttttatccgtctccattgctaaaaacttgagacaaattgtttctgcttctagagacaagaccgtcaaagtttggaacaccattggtgaatgtatggccactttaactggtcacaacgattgggtttctgctgtcagaatctccccatctgaccaatcatctactgttatctctgcttcttgggataagactgttaaggtatgttattctttatttgttttgtttttttctttcattgtcatttattattgtgatgattttcttttatatttgctacttcagacgttgcttgccagcttcgaatga

SEQ ID NO: 5392 - DNA, 426 bp, Candida albicans
tcatgggacttagctgactactctgtcaacgctgacttcattggtcacaccggttacatttcatgtatcactttatccccagatggttcattatgcgcctctgctggtaaagatggtgtcatcatcttgtgggatttgaacaaaaacaaaaccttgtacactttggaagccaaggccgaagttcatgctttagctttctctccaaacagatactggttagctgctgctaccacttctggtatcaagatcttcaaattacaagaaagatctttgttggatgaattgaaaccagaatttgctgttggtgctactgctaaagacccagaagctatctctttggcttggtctgccgatggtcaaaacttgtttgctggttacactgataatgtcattaaagtctggcaagttatgactccatctgcttaa

SEQ ID NO: 5393 - DNA, 843 bp, Candida albicans
aggattctgtggattagaggaaatagacggagtagatttccaaatagtataacgggaaaaacagagtttatagtaagtgataacggtaaagtgggaagtagatcaaaaaaaggaggaacaaatgtaaacggcgaaaacaacatggatgttgaagataatgaaacaccagaatttgaagacgagaagccaactgtacaagaagaaggagaagaagaagaagaagaagaagaagaagaagaagaagaagaagaagaagaagaagaattagctggttttgaagatgatgaaaataatcaagaagatgccaatactagtgaaagagtgtccaacaatgataaagacgacaagttagcagaatcaaatgatgaattgaatgctgtatcatttgccaaccttgatttacctttaccagacgataacgagataaacttaccaaattggcaagaaggagatttgggatcatctattagtgcttatacactttatgggttatcccagttggacttcaaaaaaccaacaccaattcaaaaagaaactattccaattgcattactgggaaaagatgtcattggtaaggcaacaactgggtcaggtaaaacattagcatatgggatcccaattttggaaaagtatattcaatctttgaacttgatcaaacaaaataataaagataagaaaattaaccatccgacagggattatctttgctcctacaagagagttggctcaccaagttgttgaccatttaaataaattggcaaaatattcaccattgtccaccaggggaattgtgagtataactggagtctttccatacaaaagcagccccgagggcgagtcatgg

SEQ ID NO: 5394 - DNA, 1098 bp, Candida albicans
acaatggcaaaacaaggaaagaataaggtttcaaaaccaagaaaaccacctactttgaagcaaaaactcaaaaaggaatcaaaagtggtgaaagctaaagatttacaatggaaaccagttgagatcccagacaatttgggtgattatgaaggattctatggattagaggaaatagacggagttgatgtccaaatagttaacgggaaaaccgagtttatagtacgtgataacggtaaagtggaaaataaatcaaaaaaagaagagacaaatgaaaacggcgaaaacaacatggatgttgaagataatgaaacaccagaagttgaagacgagaagccaactgaacaagaagaagaagaagaagaagaatttgctggttttgaagatgatgacaataatcaagaagatgccaatactagtgaaagagtgtccaacaatgataaagacgacaagttagcagaatcaaatgatgaattgaatgctgtatcatttgccaaccttgatttacctttaccagacgataacgagataaacttaccaaattggcaagaaggagatttgggatcatctattagtgcttatacactttatgggttatcccagttggacttcaaaaaaccaacaccaattcaaaaagaaactattccaattgcattactgggaaaagatgtcattggtaaggcaacaactgggtcaggtaaaacattagcatatgggatcccaattttggaaaagtatattcaatctttgaacttgatcaaacaaaataataaagataagaaaattaaccatccgacagggattatctttgctcctacaagagagttggctcaccaagttgttgaccatttaaataaattggcaaaatattcaccattgtccaccaggggaattgtgagtataactggaggtctttccatacaaaagcagcaacgattgttgcgtcatggtcctggaataattgttgcaacaccgggaagaatgttagaattggttcaaggagactccgaattggctaaaagacttgcgtccaccgacataatagtattggatgaagcagatagattgttacaagatggtcattttgatgaattcgagtaa

SEQ ID NO: 5395 - DNA, 1209 bp, Candida albicans
atattagaattgtttggtaagaatagaccgaaaagcaaatccattgaatggaaatggcagactttggtcttcagtgccacattctcgagagatttgtttcgaaaattagatagacatcaaaagggtaaaagtagttcattgatgggaaatgatgagattgtccagttgttaaatgagaagttgaaattcaaagacaaaaaacctactcttgttgatgccaatccaaaggaaattgtttcagggcaaatcacagaggcattggttgaatgtggccctacagagcgtgacttatacttgtactactttttgttaatgtacaagggatcgactctagtatttgctaactcaatagactccgtcaagagattggttccattgctaaacaatcttaacataccagcattctcaatacattcatcaatgattcaaaaacaaagattgagggcattagagaaatttaaggaagcaagccaaaagaacgaagtagctgtattagttgcttcggatgtagctgcaagagggttagatataccaaacatcgaccatgttgtccattaccatttgcctaggtctgctgatgtatacattcatcgatccggaagaactgctagagcaggaaaagaaggtgtatctgctatgttttgttcacctcaggaggcttcaggacctttgagaaagttacgtcgtttaggtactggcaactctaacaaagaatcgagattaaatatgcataacgatgtcaagttgcttccaatagaaatggatttagtgtcacaaatcaaacctagagtggaaatctcatccaagttagcggatgcaagtatttcatctaccgcaacaagaaaagaagattcttgggtaaaacaagcagccgaagatttgggattggacgatttatctgggcttgaggattttgaagacgatatcattaagaagcagcgtaagagaaaagaagggaagatgttgtctaaagacgaaaccaaggcattgaaatatgaattaaagactcttttggctaatccaatcaagaagaatacccgtaaatcttacatcacaagcggtctccagaatttggctcatcaaatggttactggtgctcatcacgatgatgtcttgggtcacgagaaagtcaatgcattaagtgatttaaaaggttcaaagaataaaaacaaaaaaatagaaaagaagagaatttccaaaaagaagtag

SEQ ID NO: 5396 - DNA, 336 bp, Candida albicans
acttttataaaaatggctaacgaggagaaaagatcaaacaagagacagaagttaattgacaactatgaggctgaaaaaattgctgaggcatcagaagaatctctcagaacccatcctcatccttcagacaaaattgaactaatccaccatgatcaaggggaattcaaaggattaattcgtcaccagactactgctgagcaagcacaaaaattagaagatggacctaaaaatccatttactggtcatgatttcaccacaaagtattttgatatattgaaaacaagacgtgatttacccgtacatgctcaacgtgaagaaatctatcttgccccacgg

SEQ ID NO: 5397 - DNA, 765 bp, Candida albicans
atcaagtgcggctccctccagccccgtggtgaagacattttgaaatatatgactgatggtatgttattgagagaagccatggaagatcatgatttgacaagatatccttgtattatattggatgaagcccatgagcgtacgttggctacagatattttaatgggtttattgaaacaagtcagtgtaagaagacccgatttgaaaattatcattatgtctgctactttagatgcagaaaaatttcaaaactattttaataatgcacctttgttggcagttcctggtacaacccatccagtagaaatttattacacaccagaatttcaacgtgattatttggacgcagctattagaaccgtgttacaaatccatgccactgaaggtgaaggggatatattgttgtttttaactggtgaggaagaaattgaagatgcatgtagaaagatttcccttgaaggtgatgaattggttagagaacaaaattgtggtcctcttaaagtctatccattgtatggttcattaccacctcatcaacaacaaaagatttttgaacctgctccaaccaacccaaatcctaatgggagaccaggacgtaaagtcattatatctacaaacattgccgaaacttctttgactattgatgggatagtatatgtagtcgatccaggattttcaaaacaaaaagtttacaatccaagagtaagagttgaatcacttttggtatctcctatatcccaagcttcagcacaacaaagagctggttaa

SEQ ID NO: 5398 - DNA, 513 bp, Candida albicans
  unsure (486): Identity of nucleotide sequences at the above locations are unknown.
atgttgagtgtccctaatgtatttgtacgtccagcactggcaagaaagagagcagacgaagccaaattgtcttttgcccaggctgatggtgatcatttaactttaatcaatgtttatgaagcatttatatctcctgaagcgagcgaaataggaactcacaaatggtgtcgtgataatttcctttcatacagatctttgacttcagctaaaaacgtcagaaatcaattacaaaggctcatgcaaaaatatgatttacagttaatttcacaatacaatcaagtgtctgaatttgaatattgggaaaatgttaaaaaggcattagttgcaggatttttcatgcaagttgctaaaaagaaactgggcaataaaggatatctcactgtaaaggataatcaagatgttttaattcatccctctactgtactttctaaagaaggcgagtggttgatttataatgagtttgttttaacttgtcttcacccacgngggctggaaggatccgcgcttaggtaa

SEQ ID NO: 5399 - DNA, 1407 bp, Candida albicans
caaccacctaaatcatctatactcactagtacatttatatatttacacatgtctacatatcaaaattctgggtacagacctagaggatactcctctggctacccgtctcgttcaagaggaggtggcagcggcggcggaaataatcgtggtggaagcagtcgtgggagatttaacaatggctatcaacagacatctcatacaagttacagacaaagacagacaccagcaacatcatcatataaagctagacagaatgtttatcagcaacatagtacacccttgaggaacaacgattttcagatgtggatgggtgatttggatccccaatggacagaagaatcaattgacaacttgtggacaaaattggtatcaaaacctcatcatgtcaagatcatgagagatcgactacaacctctgaagcctagctattgctttgtgactttcagagaccaagaatccattgatttagccatacagagaaacgggcaaaaagtaccagactcaaacagagttttcaagctaaactattctggcagaaactcaacgggaagtcatgatcgcagtacaaacctgtccaatgaatattctatttttatcggggatttagctcctgaagtatctgacgccgcattatataacaagttcaacatgaagtatcccaaccaaatcaaacaagctaaggttatcactgattcttcaactagaaaaagtaaagggttcgggtttgttaaatttcattcacccgatattatgaacagggcactaaaggaaatgcagggctataatattggatccaaagctatcagagttggtttagcagcagggtctcatgtggatacaagttttaagccagtcacaaaactagatcaccacagagttcctgtaccacagctgcaaccagctctaaatcaatttactgatccaaataatacaagctttacaattggtggattgtctggacgcatcactgagagcgaacttgaacaacatttcatagggtttggggatttagtgtattgtcgtgtttctaaggactaccaaactgggtatatcaaattttattcacgatcagctgcagaaagtgctttgctaaacatgtatggctttatgatcaacgattgcaggttacaaataacctggggtagttgtgttcaagtttccggtgccagtgtaaactacttacccaatgtagcaggtgaaatttacgaaaaagctaaaaaatcaccagctatttatcatcaccctaactatccttatttacgatttgataaactaagtagtgacgagattaaaaaacttccacaacgtcttgatggtagtgatgtgcttactacaagtcaaattgatgaattttatttgaataataaaagatatagagaaaagttgttgaatgatgcattatattaa

SEQ ID NO: 5400 - DNA, 1488 bp, Candida albicans
atgccgaattatttagtaatttctttgataatgctcctattttatacattgaaggtaaaatgtttcccatttccaccattctacttagaagctgaatctgaagatattgtggataccatgatcagaagtataattcaaatcaatcttaatgaacccgagggggatattctttgcttcttacctgggcaagaggaaattgataattgtgttaaaagtttagaacaattagcacctcaactacctagggaggcaccattgattgttcctttacctttatatgcagctttatcacctggccaacaatctaaaatattcgaaaaattacccaagggaagaagaaaagtgattttggcgacaaatattgctgaaacatccattactgtttctggtgttaaatatgttatagattccggattaaggaaaattaaagtttggaaacataatttaggactttctacattattgactactcctatttcacaagcatcagcaagacaaagagcaggtagagcaggtagagaatctgaaggtaaagtattcagattatatcctgaatctacttatatggcacttccaaagcaacaagaatcagaaattaaaagaaatgatattattttaccggttttgacattgaaaaaattaggtgttgatgatttacttaattggagttggttagaatatccgggacaagacgccattttgagtgcattaaatacattgtataccttgggtgcattgaatgattcagggaaagtaactacattgggttataaaatgtctattttgccacttcctccacaattatcagtagtattaataactgcggcagaattcggtgttttatcgccagttattgatattgcatcatgtctttcagttgataatttgattacaaatgttaccggtgaagccagagatgaaattaattttaaaagaagacaacattgtcccttggggaatatccatggtgatttgattgccttatatgaatatttccaagcatatcaagcacaaggtaaagaatggtgtaaagaattggcatttagtttcaaaggttttaaaaatgtggaaaaaatcaaatatcaattacaggaatatatgatgactactattaaacaagatgattcattaactaatgctgaaaagaataaacagttggcaaaacttagggcacaattagataatgaagaaactgataaacaattggatgttccttcaattctcaaatcgtttctcaaaggttatattactaacactgcagttggtatgccagatagatcatttagaacattcaatactggtcaattgatttctgtccatccctcatcgactttattcgggaaaccaaatatggatgcaattatgtatatagaatatgtgtttactacaaaaggttatgcccgtaatgtctcaggtattgagttatcatggttacaagaaattgcccctcatgtcattggtggtgttaaagttaatattaatgattaa

SEQ ID NO: 5401 - DNA, 1128 bp, Candida albicans
acatacaaagctcctaaaccaatgacagatcagattaaaggggatgaacataaccaagtaaatggtagtaaaaaaagaaagagaaagagaaataagaacaagaaaaatgacaacaacacaccagtagagacttccgaaccaataccgacacctgtttatgaagatgatatccatcgacaaaataaaaagttcaaattcaatgaggaaggggaaatggagaaacctcaagagtcacctgaagaggaacaactagaattagtggcagatcaaggggaaccttgcactgaagaacctttaccacaacatgaaggtttcgaagagattgaagtaactgacgacatagatgaaacagaagaaccagagaatcttccaacaaggactcaacaagaaaaacatcaacacagtaagaataaatttaaacaaaagcttgaattcaaaagaaaaaccgttgtatataaagatcaagatgatgaagacgatgaggaagaaaataatactttcaatttttcacaaaattcgtttcaacttgcagccaccgcccaacaattgttacaaattagagagaaattgcccatttatcatcataaggataaaatcattgaatacattaataataatcaagtcactatcgtcattggtgaaaccggttcaggtaaatcaacacaaatccctcaatttttaatgccagaaaacccaaaaatgattggcgtgacacaaccaagaagagttgccgctgcttctttagcagcaagagtaagtgaagaatatggatgtaaattaggtcaagatgttgggtatcaagttagatttactaatatgactaacagacaaacaaaattgaaatatttaactgatggtatgcttctacgagaaatcatgcttgatctgaatttgactaaatattcaacaattatcctagatgaagcgcatgaaagaactattttgactgatttaatcatggggtttttgaaacaaattattacttctggtaaaagaaaagatttgaaaatcgtagttatgagtgctactttgaatgccgaattatttagtaatttctttgataatgctcctattttatacattgaaggtaaaatgtttcccatttccaccattctacttagaagctga

SEQ ID NO: 5402 - DNA, 936 bp, Candida albicans
aattcaatgatgctggattctgaattggcagcaatattttatgaatatactgataaattaagagaacaacatgaaaaacttttacaaaccaagaaaaatcaagcattgattgaattatcaacatatttacgacaagttaattcatcattagtggaaaaatctcaaacttgggaatcactttatgaaaatttaattaatgattcacgatttcaaagtaataaaaatttccaaaatttaactaaattgaatattctacaattatatgaaaatgagattttcccacggagaattgatgatattaaatcacaaataaccgtgatatcgaaaataaattatcgtaatgatcgtaaggcacgtgagagttataagaaattgttaggtgaattagaaattgatgctgatactgaatttaaagacattatagataagattgagaataatgatgcttttattgagatttgtggaagaaatggatctagtgcattagaattattttgggatatcgttgatgagaagaaacaaatattaaaagttaaaaagaatttagttgattcggtgatttccactatgaagaatggaaacacttatgatgaaaaaatgtgggaatccttggaaacattttctaatgccttgaaatcaacaagagatgaaagattagcaaatcttgatctaacattaggagatggtggtaaaggaaaagaaataaccatgatttatacactgttgaaggaagaatttgaattgaaaaaacaacaagaacgagaaaaataccttaaaaaaatggatgaagatatagcgaaattagctcgatggatttatgataatgatagaaatttaggagaaaatttcttacgtatggaagggacaagatttgttatttctaatagagtaaattatgaagatgaatatgaaaaattactgaaatttgatcaattt

SEQ ID NO: 5403 - DNA, 594 bp, Candida albicans
  unsure (564): Identity of nucleotide sequences at the above locations are unknown.
cggctgaataacccttctataataatgtcatcagattgggaagaactacgaactgaaacaggagaggtttattattataattataaaaccaatgagaccagttggacttttcctgagacagaagaaactttacctgtttctgaaaaacaggaaaccatcaccacatcaactactacgggtaaatgggaagaatatactacagatgatgggaaaaagtattattataatgcaattactggagaaacaacatgggaaaaaccaaatgagataatagaagaagaattatcaaatgaaaaactagcagaaaaaactgaacttagtgaattggataaaactttaaaatcaaaacctgtagaattgacaggtccaacttctaaaaccgacaatgaagccaaacaatcatttttgaaattattatcagacaacaaggtaaattctacttggtctttccaagcagtaatggaaaatcttgtggataagcccgagtattggtctgttaaagacccagtgacaagaaaacaactttatgaagaatatttggtatcgaaattccaaagtgatatncatgcccgaccgggctggaaaatcaacgct

SEQ ID NO: 5404 - DNA, 864 bp, Candida albicans
aatcaaaactccaaaaaggtattctctttattaacaatggatgacgatgatgaattattgttgaactttgctgcaccagacacttcatcggttgcagcttccaaaaatcaaaacgttaaagttctgggtggtagatggaaagatagaagaaaattgcaacttgcattacaaggtagaaccaaaaagagacaaccagaaaccggcgtaaatcttattccagtcgatgaatccaaacgtaaacgggactctgaagataaggtacaactcgactcaaacaaaaggtcaaagttcactgaaagcaaaggtgaaaatggtgggaagggtgattcatatgtatcatctttatttactaacaatcaaccaacatctcatttagcgccaacgtcgactaccaaagaacttacttatttgccatccaatgcacctatgaaagatgcaactaatttttctggtttagggttgaatgagaaattgtcaattcatctaactgatcatttacgattcatgcatccaacgaaaattcaacagttggtgataccgagtttaatatcaacagaaaacgatttatttgtgaaagcacaaacagggtctggtaaaacattggcatttgtgttgcccatattccataaattaatgagagagaataaattcaaaattaatcgggaatcaggattatttgctataattttaacaccaacccgtgaattggcgacacagatttatggagttttagagacattgacaagatgccatcattggatagttccagggatagtcattggtggtgaaaagaaaaaatcagaaaaggcaagattaagaaaaggttgtaatatattagttgctacaccgggggaaattggctga

SEQ ID NO: 5405 - DNA, 240 bp, Candida albicans
ttgctacaccgggggaaattggctgatcatttggagaatacaaaaacattggatataagtcagttgagatggcttgtattagatgaaggtgataaattgatggagttgggatttgaggatactattgcacaaattactgccaaaatagattcaaattccaaaattgctgataccgccgagaaatggcaagggttaccatcgacgaagaataaatatgttatgttcagctacattgcatag

SEQ ID NO: 5406 - DNA, 681 bp, Candida albicans
attcaaattccaaaattgctgataccgccgagaaatggcaagggttaccatcgacgaagaataaatatgttatgttcagctacattgcatagtaatgtgaaaaaattgggtagtattgtgttgaaagatcctgaaatgatttcagtagaaacagcttctgttgctggaactgtatcatttgatgaaactatagcaactactacaagtacggcaccagatcagttgattcaaaacgttgtagttgttccacccaagttgaggttggtcacattagatgcattattattgaaaattagtaaacactctgctgaaagaacaatagtgtttttctcgtgttcagattcagttgatttccattttgatgtattcactcgagacggtaaaaagtttaaaaaagtgactgatgaagaaacaggtgaagtgaaaactgtgctagttctgcctgaagatgacgaaaatgatggtttgcttaccgcgcctcaattaagcgacaacacaatcatatataagcttcatggttcactttcacaacagacccgtgccagtacattacagtcgtttgttaaagataacaattcatatttcaaaatcttgttttgtcctgaagtcgcctctcctgggttggatttaccaaatgttgccaatgtcctagaatatgatcctcctttcactattgatgat

SEQ ID NO: 5407 - DNA, 462 bp, Candida albicans
gggaaattaagagttgctcatccaagagaaggaaacttgagagttaagaattatgaaaaaatattacaagaaggatttgcccaaggaaacatcaaatcaaaggataataagttgggaaaatgggatattcatgccactacttggcaccttgatgttgaaagatggttattagaggatcaagccagtcatgacgaagctgtcagggcttttacttctcatatacgtgcatacgcaactcatttatcgtcggaacgtgagtttttcaatgtgaaattattacatttaggtcatttagcgaaaagttttggattaagagaaacaccaaagaagttaggtaaatcagttggtaataatagcaattactcagaatccaaaaagggtaaaaaagaggacccaagaaagaaaatgttgaggatggccaagatggctgttaaatctgcaagtagcgaatttaattattaa

SEQ ID NO: 5408 - DNA, 819 bp, Candida albicans
ctttctacacttgagagcattgatttatcagagttagatccacggttagttttggataaggcatcgcaaagatggttattcgaggaaggagaccaagaatatgaatatgattacataaaggagcaatgggtaaacacttccaagagatcactatcagaggatgatacgaacaaagaagatattaagcgacaacggaaacaagatatgagtaaattgaaggaagaattgaatagtttgaaacagaagaaaaagaacagcagtatatttatatcaaatttaccagtcgattctgggttttcggaaatcgaggaagcattttcaaagtatggtaaaatatctgttggaaaagatgaaaaacctcgaataaagatgtacactaatgagaaaggttcttttaaaggcgaagctttgattatatattcgaatccagaaagtgcattattggctattgaaatgatggataatgcccaatataatggcaacaccatacgagttgaagaagctaagtttgataacaaaaaggagaatccaaagaaaaaacaagatagcctttctaaagctgtgattattcgaaatatggtcagaaaaaaagagcttgccaatgatatacacatcaagcaagacataattgatgacattaaggaagaatgtaaaaatataggcatatctgatatcgaagatatagtgtttaatgaggaaaatgcaacggttctagtaaagttttccaaagaagagctgttgttgttatgcatcaagaagtttcataatcgatattacgacggtttgacattggatgtccaagaatcaaaagtcatatga

SEQ ID NO: 5409 - DNA, 276 bp, Candida albicans
agtattcctttaataatgtcatcaaaacaaactaagcaaactaatcttcctcctatcaatcttatatttaagtttttacaacaactgtcagtggttactatatggttatacgagcaaacacaatctagaattcaaggcaaaatcagaggatttgatgagtttatgaacattgtcattgatgacgcagtggaatggtcaaatgggaaaaagtccgaacttggtcgaatactattgaagggtgataatattactttgatttcaagcttggatgtatag

SEQ ID NO: 5410 - DNA, 1905 bp, Candida albicans
gaaacagacaaggtggtggtaatcaatcaggttcctcatcagaatcatcagatgttccatttggaggatctcaacgtggtggatttaactcaaatggattcaacaacaacagaagtggattcaacaatggtggctacaacaacaaccgaggtgggatcaacaacggtgggttcaataacagaggtaactggcaaccaatcctttggaggcagaggtggcagaggtggtttcaacaacggtggcggtagataccaaagaccaactccaggtgtcggtaaatggcaagatggtaaacacgaaccagctcctcgtaatgagaaattagaagtggaattatttggtactgctgatgattctcatttccaatcttctggtattaactttgacaattatgatgatattccagttgaagctagtggtgacaaagttccagaacctattacttcctttactgctccaccattggacgaattgttggttgaaaacattcagttgtctagattcaccaaaccaaccccagtccaaaaatactccgttccaattgttgctgctggtagagatttgatggcttgtgcccaaactggttccggtaagaccggtgggttccttttcccagttttatctgaatcttacatgaagggaccagctccagttcctgaatcaaatggtgccttctcttcacacaaagtttatccaaccatacttgttatggcaccaaccagagaattggtttctcaaatttacgaagaaagtaaaaaattcagttacagatcatgggttcgtgcttgtgtcgtttatggtggtgccgatattggtcaacaaatgagaaacatggacagaggttgtgatttgttagttgccaccccaggttgttttaaggatttgttggatagaggcaaagtttctttggccaacattagatacttggttttggatgaagctgatagaatgttggatatgggttttgaaccacaaatcagatacattgttgaagagtgtgatatgcctgctgtcaaggatagacaaacattgatgttttctggtactttcccaagagacattcaaatgttggcccgtgatttcttaaaagattatgttttcctttctgttggtagagttggttctacttcagaaaacatcacccaaaagatcttgtacgttgaagatgacgaaaagaagtcagttattttggacttgttatctgccaatgaaaatggattaactatcgttttcactgaaaccaagagaatggccgacaacttggccgattacttgtacgaccaaggattcccagctactgctattcatggtgacagatctcaatatgaaagagaaaaagctcttgctgccttcaaaaatggtgctgctcctattttggttgccactgccgttgctgccagaggtttggatattcctaatgtttcccacgttatcaactacgatttacctagtgatatcgatgactatgttcatagaattggtcgtactggtcgtgccggtaacgttggtattgccactgcttttttcaacagaaacaacaagaatgttgttaaaggattaattgaattattatctgaagccaatcaagaagtcccagactttttaactaaaattgccagagaaggagcttttggtaagatgactcgtggtggtggccgtggcggttccagccgtggaccatccagagatttcagaagaagtggaaattcaggatggggcaactctggtaacagtggctggggtaactccggtaacgccagtagcagtggctggggtggtaattcatcctcatcatactccaacactaacagcaattatggtggtggttacaacaataaccaacgttctaactttagcagcggtggcagttacggtaatcaaactggttccaactcctggtggtaa

SEQ ID NO: 5411 - DNA, 1206 bp, Candida albicans
  unsure (260): Identity of nucleotide sequences at the above locations are unknown.
aaatcaaagccaattccacataagaataaaaattctgattcattcaatgaagtatttattcataaaactttactatcatcaattaaacaacataatgatactgattatgttcgatgttcaatattcaatgccaatggtgatatgattcaacatggtaaagaaatcttgaaaagtcaatttataaaacgatataatttaacaccaagagattttaggaaattcaattggcaaagatcagcaacaggaacaacaacaatttntttttcatcattttcatcagcgggacaaacatcatctgggacatccaaatcatcaagctcatcttcactgtcttcatctccacattctacaatatccgcattatctttaagtaattcttcccttggatcatcaactaacgttgatattgtccccaatattactattcgacgtaacagtatactagtacaattattaaacattcgagctttaattaatcatgatcaactaatcattttcgataattcatcaagtttccaaaattcccatgtttcttcttatacccacctgcaatgtcttaaagatttaagtcaacgattaaaatctacaaatttggatggattaccatttgaattcaaagctcttgaaggaatattgatttacattgtttcgaatttaaatatggaaatgaaagttcataatactgtgttacaaaatattattactggtttagaagatagtattgatcgaaataaattacggtatttgttaattgaactgaaaaaaattcatcaattccatcggaaaattaccttaattaagaattgtttagaagatttattggaaaatgatgatgaattaaatgatttatatattactgaaaaattcaatagtgaaggtgatggacaaccacgacaggggacaaatcatgaagaaattgaaatgttattagaaaattattatcaaaccattgatgaaattgttcaaattgtggaaaatttgaaaaatcaaattaaaactactgaagatttaattaatgtggttttggattctaatagaaatcaattaatgctattaggattcaaatcttctacaggattgttatcgatgggggtagcattatatgtgtccagcatatatggaatgactctagagagtttcattcaagacatagatggtggttttgaaattgtcacagtggtttctacaattgctttgaatgcataa

SEQ ID NO: 5412 - DNA, 393 bp, Candida albicans
cctcgaagaagaaaaaaaaaaataactttgagatgccactaccaacaaaccccagccatgcttacattctgcccgaactgctcaaatatgctacttatatccgctggagatgatggtcttaatcgattttattgctctacgtgtccctatgagttcaagataaatggtctacagatgtatgataggaaaaagttgaatagaaaagaagttgatgatgtgcttggtggagaaggtacctgggataatgtcgatcaaactgcagctcagtgtccgatagactcctgtggtggtgataaggcttactttttccagttgcaaattcggtcagccgatgaaccaatgactacgttctacaaatgtgtcaaatgtgggcatagatggaaagaaaattag

SEQ ID NO: 5413 - DNA, 1185 bp, Candida albicans
agacaaaaccaaaaccaaaaccaaatacaaggagtgcaatctgctggacaaacacctcagcaacagagcttttcgccacagttgcaggctgcacaacaacaacagcagcagcaacaacaacaacttagaaatgcgaataaaagtgcacttcaaggtcaagctccttcacaggcgccaactcctttacctgttcggccaacacctcagagtcaacctacagcacaagcgggtgttgcttcacaggcagctacatcaggatttcgagcttctcaacccacaccatcgcaaacttcgagaactggatcagctctacaacaaagggcaccaagtcgacaggcatcttctacaccgcaatctcaattccaaccaccattaccactggagagtcgacatccttctgcaactacatcagaaaagccacttccccaacaacctggaagcggaacagcgaagagtcctagtgttgctgctactcctgctcagaataatggcactgtaactgcccggtctgcatcacctgttgcaactactacagatagtgctacaactggacgctcaggaactccccaacaacaatcaaggtcacgatctggatcatcgttgaatttggctggcattacacgtcagtctgtcccatcattgccaatttcgagttctattaatgtaaaacagcccacaatcaccacatttaatagtatcaatgatacgagacccagtttgacgggaggagctgccaatcctatgagtattttattagatacaccagcgatcacaaaattgcctacttttgatatcgaaggagacactggtgtcattgattctagtaccagtggacgagttttaaataaacgaaaattaggtgatttgataaatacaataggtgttgatgaaggggatggtaagaccagtattgatgggaatgtggaggaatttttgttggatttggctgatgaatttattcattcagtgacaagttttgcttgtcggttagcaaaacatagaaaggtggatagtatagaggcaagagatgttcaactacatttggataagaattggaatatcaagattcctggttatgcaatggatgagattcgaaacacaagaaaaatacaacctagtaatagttatagtcagaaagtacaaggtgtcgaagtttcgaaagctgtgaatgatgataatgcttaa

SEQ ID NO: 5414 - DNA, 1551 bp, Candida albicans
atcatggattcatcagcagcttcatcacaggagaaaagagtcgggacatctacaccagaagcagagctcaatcctcatagggcgaaagcgttacttgcaaaatttaaggaggaaatggctttagccaaagcagcaacagatcttcaagaacgggagaaacattcagaactagtggaaaagataaaacgaatattaataagatatcaagaacaacaaaaacaagctaaaaataatagccctgctaccaagtcaaatttgacgaaccaagattcaactacaaatacacctagtccattggccacgaacaacaatagcgccactaatgtaatagaaccgaaaacagagaccccagactctacaccaatggagcaaaaacctatacaagcccctacaccgcaacacccaaataatgcatcaacatcatcagcaacaatgctgacaacacaattccaaccccaacctcaacctcaacaacaaacggtcacagttgaaaagtataatcatgtgaagaatactttaaaggatatgtggaaacaagtcaagactttagaggcatcatctataaatgaaacacaaactaaaaaggaagaaattgatcgcaaaatcactgaattgcgtaatcaaatgcaaaagtaccatacagcagcattacgtatgaagagtaaattgattgaacaagggacaataccagctaactcaacaccaattggatcaccaacaccagtctctaatacggatccaaccccaattgccaatactacaaatacatcaaacgggacaccaccaacagagaaagcggagggaaatagtaaaccaaatgtcgaaccaccaagcacgacgaaagcaagaacatctaagtcgaaacccaaaccattatccactacagctaccaactcaaccacaaaaacatctacaccatccaaaggttcaggttcatctaagtcaaacaatcgttcaagtagtcagaatacaccaggtacatcaacttcagcctcagcaacaaaaacagcatcagtatcaacagaaaaagatgctccacttactgcgacaacatcgacctcagctgtggcaccagctgctgctactgttgctgctacaacagcccctactgctgccgctgctgccacatctttatcaactgcgtcggctattaccacaaaaagcacagctgatccaaaagtaacaccaagtaacatacccgacaatgatggcagagtgttgactaagagaaagttagtggagatgataaataatatcagtattgatcaaggagatgccaaaattcctattgataacgatgttgaagatattttccttgatttggctgacgagtttgtgagaaatgtggtacaattttccggccgtttagccaaacatagaaaattggatagaattgacgtaagagatgtgcaattaaatttagaaagaaattgggggttgagaattcctggatattctactgatgaaataagagcagcaagaaaatggcaacctgaaggtgaatacgctgaaaatgtgaagaaaatttccaaattaaataaagatcaatag

SEQ ID NO: 5415 - DNA, 726 bp, Candida albicans
  unsure (107),(117): Identity of nucleotide sequences at the above locations are unknown.
cccataaataagccagaagacgaagagatgaacgttgagtttaataacgttgatgatcagatttccccagatgatttaccagaacaagcacagaaacaggacgaccnacaaccccancaatcccagagccaaacagcggagacaaagatcgacactggtgatagcgcaaaacctcaaaatgatgatatttcatcaactgctcatcctacaggtacagctaacggtaccccaccagcgtcagtaatacccgagttaccagaccttacacgtaaagataaatcgttaaaggaagtgctcgatttgatggatggcgactttgcaccgattattcccgacgcggtaactgactattatttggccaaaaatgggtttgagacatcggatataaagattaaacggttgttggctcttgctacccaaaagttcattagtgatattgcacaggatgcgtacgaatatagcagaattagaagtgcaagtgctgtttacaattcctctaatcctcaggttcgtgcaaaactattactacagggtcaacaatacgcaaatcaacagaccttgactggtaatgctaataataatggagaaggtgatcaacaacaatcactgcaatcacattcgaacgcaggtaaccagcaaggaaagatagtattgacaatggaagatttaagtaatgctttatctgagtatggtatgaacacttcaagaccagatttttacaggtaa

SEQ ID NO: 5416 - DNA, 501 bp, Candida albicans
aaaggtaatatcagtatgtatgatgctgttaataggaaaaccaatttattggatcgattgaaaattgctaaacaacaaggcaatttagaaaaagttcaagaaatcattgagaaattaaaagatattgatgaaattttagaatcacaaacatctaatcaaccaacttcaaaatcattaaatactatgacattagttaatgaaagaaatcggaaattgaattctacaaacattagaaaagcagaaattaaattcaaatcaacagctgctcaacaacaatccgatggtgatccgttttctcgtttgaaaaccgccacaagaatgttttatcaagatttaattaatcaagaaaatgaaaaggcattaaaaaatgttaatatgcaacaaatgatcgatgaaaaaactgagaatgaagccaaaattgctaaatcaacttatcgagatcttggagaaatggataaattaataaaaacaattgattttgattttgaattggcagtataa

SEQ ID NO: 5417 - DNA, 1281 bp, Candida albicans
aacatgtctgatttagaagatgatttacttgctttagcaggtggagaagataacacctatgaatcagatgaagaaatcaccagttccaaaaggaaacccattgttgcagatgattataatgaagatgatgatgaagatacagtattatccaaacgtcgtagagttgaatctggagatgatgatgattatgaaccacaacaaccacaacaaggggaagaagaagaaggagaagaatttcaagagaatgaattgattgatccatatccattagaaggtaaatataaagatgaagctgatcgtgaagctttagataatatggatgaaatggaaagagaacaaattttatttgaaagaatgcaagaaatggataaatatagagaacggaaatatttacaagaaagaatgatacaacaacaacaacaacaaaagaatgttgttggaagaattgaacctactagatcttcaggaagatcaaaaacaggattaaaaccagctaaaaaagataaattgactgaattaagaaaacaacgtgcacaacattctaaaagaaaatcaagaagagaagcagattatgccgaaggttcagaagatgaagaagatgaagatgacaaggaaccagaagaagaagaagaagaggatgacgatgaagaaggattcgaggaagattattatgatgattatgatggaactgttgcttggggaggtccatctaaagttaaaaagaagagatctacagaattagccaaattagaagatattaatcgtataaaagtggggagaactattttgactcaatattgtttccattcaggattcgaagatacgatagtcgatacttttgggaaaatcaatttaggtatggatagatctactcgacaaccaatttatagaatggtcaaaataattgatgtgaaatcacgaccagaacgagcatataaattgggtcattccaattttgatatttttttaactgtgagtcaaaataaggatcaaaaaaaggatttcccgatgtcgattttttctgattcaccaattaatcaagatgaatttgatagatatttaaaagaattgaataaaactgatgaaatgattgaatttttggatgatgtgaattctaaatttgatgaattgacaaaattctatagtaaaggattaactgataaagatattaatgatatgattgctagaaaacaaaaaattcaagaaaaaaaaggtaatatcagtatgtatgatgctgttgtcttcaccagcgcggctggacggacaaccttccagcgtcaa

SEQ ID NO: 5418 - DNA, 1005 bp, Candida albicans
aaactagcttggatgatttctggaagcttgttgttgcacgatataatagtcttgtctatcttcttgtgttcaaagtcgcgctcacaagaaaatcttccacagagaataaggatgtcaacagaaaacgtgagtattagcaataattgttgtttgaggtattttgttagcaacatgctgtctgcaccagaacaagatacaaccattccgccaggtactgagagtccgcacacagagcatgtggttgaaaatgaatatcaagacgatgattatgtgagtttagatgaagaagatgaagaacttatatggagggtttttttccaaaaactagaaaagcacaacaagaagagcaacaacaatgactctgagctggacgaatctgaagaatctgaagacactagcgaggaagaggaggaggaaactggggatgaggattttgacgaagatgatttaagtgatctttcggatattgacgaccctgctctagtggccacatataaggctctaatgtctgagaaagtcaacaagaatcttggcgaagaagaacagagaagactattgatatccaattttactgacgatcaaatggagagatttgaagcctatagacgtatgactgtgaataagcctggtgtgaagaaaatatgtaatggtatagtaggccacacaatcccgcaaataattgcagttgttatggcaggtgtttccaaactgtttcttggggaaattatctcaaaagcatttgaaatacaggaacgcaattctaaaggtagacttctaatggacattgaaacaaagaagaaacagaagagagagattatcagtagtttgcaaaggggagaggaaattgaagtagatgaaagagctttgaaatttgagggagatgagatccacccattgcaaccagaacatatacgtgaggcatggagactataccagcttgagaacagtgtattttctggaagtcggaaaagaaaaatgggagacgatggccctttctatgtttaa

SEQ ID NO: 5419 - DNA, 1320 bp, Candida albicans
tccctttatattgggttgcttacaacatatcaattgcaaaccatcgccacggtatcttatcgtgttctacctcctcatctcaccaaatacacaataatgacaattactacagcatctgtaccagaagaattgaaaactgataaatcggtgacaccattcatcataagatcaattgaattatctcaagccaaccctattgttagttattattgtaaaatatacgttttggaacatattttaactaataaattacatacaacttcaaaagaaattgaattatttacaattgaactattagatgacactgaatcgattaagaataatactgaagatgaagatttccataagattttaaataataaacaattatcacttaatgtagcattatcatttacttataaattatttaattcatgtcttgaaacattactgaatttaacttcatcaaaacaacaacaatcagcattaataagtaaaatgaaggcaactttgaattttttgagtttgttggccgttttcaaatccctggaagatattgattgggagaaaataagtggtggtaaagccaatgattgggatagttttgataaattaaataaggaaaaaattaagattttgaaatatcaattatcgagattgttaaagggggagattcaagttaaggatgaattgaatgatgaagaattggagaaagagttggataaagaattggaagaaataagtggtgaagacgttgaaccagaacaccatgagcaatctggaattgaaaaagaaactactgaagagataaatttaccaggagcacctaatgatatgccgaagtttattgaagaaaaagatgaacacagcccacaattgccacgggcaccatctactttaaatgagtcgaacaaaggagaagaagaagataacgattatgacgattcagtgaaattgcccggtgtaccccatttcccacccgatgaagaagatgacacggttaaattaccaggagcaccgaaatatttaccagacgatgatttatcacatatcaacaaatcgtcaacaattcaagtattcccacctactgatggaactcaaaagaaatcagattcaccaattaaaaaaccatctgctacaaaacatcacccaccattaacaaaagaaggcattaaacaaatattgaatcgagatgacactattactcaagtgcaaaagcatgctaaatttgctcaatcggcattacagtttgaagattttagtgaagcggaaaaacaactaacacaaggattggagttgttgaaaatattaagaaaacaagaagaagaagaaggaaattaa

SEQ ID NO: 5420 - DNA, 1248 bp, Candida albicans
ctgaaatattccaaaacagttgatagaaagaatgttttcaagacattagatatctgtcagattttgttagttttacatgttgttgatccggctaaactaaatatagataccgattttgaagttccccaagaatttctttttaatcatccattttataaatatgtgaagaataatgaaattaaaaagaaacgaatggtgctcaaagatggattattacagccatttcaggatgtgtatcgacgattccgtccaaccaaagtggaccatagagtgattttggacatagaatcaaaagtcgatgaattgatcaaacttgataatgaagcagatgagagtcattttgaattattggatagtaaaacagcacaacaatcacgatttggtaccagtgccacgccatcagctgtcaattcccctgtagcaatgaggatggaagggccagaagttgaacctggaaggtttagcaatgtacaagatcatgaaaatgaagaagatgatgaagaagaagacgaagaagattacgacgatgatgatcttcaagatgatgatatggaacttcatttggaacaagaattggaaaaagttttggatggagagttgtctgaaagtgaagtcacaatcccaacactgatggcaggtatattaacaaatgatgtcggtaatggaatatctataatgactaatggagaacagtcagaggatatcgatggagacgaacaggatgatgaagaagaggaagaggaagaagaggaagacggtgatgacgaagaagaagaggaggaggaggaagaagaagaaaatgaagaaggagatagtgaatctggaaaacaacatgttaaactattagaagaagaaatatttgaacttgagaaagcggttgcccatcatcaaaagaatttatctacagcatcgagtaaaatgttacgaatgaagttccaaaatacctacacgtcattgaaagcctctttggatctgaaaaaacgtgatttggccaaattattagatgaacaagaacaacagcaagaacagaaacaaccgaaaactacagtagatgagaaatcacaagaagcagaacatagtgtagaggcagaggcagagatagaagcacaggtagaagcagatgcagaagatggagatgaagatgaagatattgatcaaggtgacgacatgaaccaggagaataataataataatggtgatctggatattgatgaagacaatgctgatgatcttgatgatttgttttaa

SEQ ID NO: 5421 - DNA, 201 bp, Candida albicans
gtttatccaaaaccaaagagaatggacgtcccaaaggtctgccaccatttagaattaaacctacccgaattcctggccgaaggatacgattctgaagcacctgatttagaagaagatcctttgattgaacaacgtataataatacgttttttaaatgactccaaatctgatttcctacataatgcagtgggatcccggtga

SEQ ID NO: 5422 - DNA, 339 bp, Candida albicans
atacaatcgttcgatacacagttttgtataatacaaatgtcacttttgaatacagaatttgttacattagtttcctcggataacttcaagtttgtgatttcaaaagacgtggcatcgatttcatcggtgttacgtaattcacaaggtttcgaagaaggtaaaacaggcaaaattaaactagatatggatggtgatatattggaatgtattgtggagtatttgtactatcattataaatataaggattcagtgacagaaggtaaggacattcctgaatttaatatcccgacacatttggcccttgaactattggtgaaagctgattatttagatatatga

SEQ ID NO: 5423 - DNA, 1356 bp, Candida albicans
tcccatttgattatgaatttatccctccaagatccattctcggtggctaaagaatttcctgaaacattaaccaatacattaaattatggtcattcagtagcaatccaattcaaccacaaaggcgattatttagcatcgggattatctgatggatcaatagtcatatacgagatggtctccagcggggtgatagctcatttaaaccaatactgtcatataagaccgatcacttcaattacatggtctaaatgtggaaggtatctattgacttcttcacaggattggtgggtcaagttatgggatttgagcaaagtgaatataactgatgcaaaagatattgatgagtcaccagttatcagagaagttaaatttgatggaccaatatggctggcttgtatgcatcccacaaacccgtttgttttcactgcttcattgtttgaagattcacccgtttatgtggattttacagcaaaagatcaaccaccccagattactagattgacaacgacacctctagaaatgaacgaaccaacagaaggcgacgatgaagaggaaattgccagaaaaagaagaaagaagatggaaaaacacatgacattggttctgatttttactcatgagggtaattatatttttacaggtaccagcaaaggatggttaaatatatttgatactacatcgagtaacttaaatttggtccgttcgataaaaataaccaactccaatataaagaatttaatgatatcccagaacggtagaaagctagctgtcaattcatctgatagaataatacgacagattgatctacctgatttaatcaatgtggaagattccaacgattgggattttgaaatcgatcataaataccaagatgtggtgaatcgattacaatggaactcaatatccttcaatcacaatgttgagtttttagttgcatcaacccatggtcagtcctctcatgatctatatctttgggatacatcgatggcatcattagtgaaaatcttagaagggtccaatgaagaattagtagatgtcaaatggaactattctcgttgtacaataggatcaattggactagacagtgggataatatatctttggtcagtacaatttcctcagaaatggagtgccttggccccggactttgttgaaattgaagaaaatatcgaatatttagaaaaggaagatgagtttgatattatcgatgaagatgagctacataagaaacgattggaagaagaggactatgttgctgatgtgctaaagatggacacaactgatgctcgaggctttgatataactcaggattcatttattattcccatcaattatgaaaagaacttctatgaataa

SEQ ID NO: 5424 - DNA, 1026 bp, Candida albicans
  unsure (1015),(1016): Identity of nucleotide sequences at the above locations are unknown.
aatgcatgtttaaatttgacacattttcctttgccttttttttttgctttttacctttctatatataaggtgatattatacttccttataaattttattattcactacttcactaattttcctgtgttagtttacatttttacacacacaaatatacatacacatttttattcaacccaccaacaaagacttatacaagacagctcaactatgatcatgaccactataccagttaagaatcgtttgaaattaataataccacaaccgcctaaaggtggcagaatactaaaaacatgtaccagatgtcgacgtcataaaaccaaatgtgatgcacaagataccaacccttatccatgttcacattgtttcaaaagaaatttggattgcacattggaaaccatatcgaaaactggtggcaaaataacttcattggatgttgtagaaaggttatctgttcaagtgaccgatttaaaagaagttttggataacatcatcaatagaagaaaccaaatggttgaattgttgattcaaagaggtaaactgttggaaaactttgatgatgatataaattcaactaccacatcaataccagaaccaccaaaattggatagccccaaagtatataccccaccagtagctgaaatacagtcatgtatatctacacctgctctttcaccagaagttttcccttccaaagctgattttgaaagtcctgccagtaattcaaaattcattatagcatgtaacaaacaatttaaagcggttacccttacccataaacaagcattaaaacatttcaccaattatgaaaacaatttcaatcattatctacctattttcccacatgaattctttacaagtttagatttggtggcgtttcataaagagaatgaattgttattttggtgtattatgttgacgtcacttttgaatcaaaaacaaatgtatcatgaataccaatgcttggctgaacatgttaaacatctcgttgttagttttaatagacgccgggcgnnggtattagta

SEQ ID NO: 5425 - DNA, 1626 bp, Candida albicans
ttacattgtggtggagaattcattcaagaatttagtcggaatcaagtaagtttaggacctgatgcagaaaggtggaggactcgttcatggttagcagttttcttttgtgaacagttttggtcatcattgttggggttgccaccttcaataaacactactgattatttattagagaatgctcgtgttgataaatcgttgcctaaaaatttccgttgtttgatttcgctatctattttccaatgcaaattagttaatattatgggtattagcgttactagaccagacggtttattggagcctctgaatcgtgctggttcacttagtttattggatagagaattggaaagattaagatttaaacttcaatttgaagaaggggggccaattgaagtatattatttgtatattaaattgatgatctgctgctttgcctttttaccaggtacacctatcgaggatcaagtcaagtatgtcagttttgcatatttatcagcaacaagaattgtgacaatcgtttctaaaatggtgaatgacatttcattgattgaattgccaatatatatcagacaagcagtgacatatagtgttttcatgttgttcaaattacatttatcaagatatttgattgacaagtatgtggatagtgctagacagctgattgttactgtgcatcgtttatttagaaacacgttgagttcctggaaagatttgcaaaacgatatttctcgaacagccaaagttctagaaaatttgaacatggtgttgtataattatcctgaaatatttttaaatgatctggaaaatgaggattcaagtattatcaccagaatgaggtcacatttgacagcatctttattctatgatttggtttggtgtgtacatgaggcaagaagacgatcagtacttgataaggggaaaagacaggctcagcctaacaagaaaatcttgcccttgccattttacaaccaaatcactaaggatgatttcaagacaattaccacgacatcacctaatggaactactattactacattagttccaactgatcaagctatgaatcaagcaaaactgaaatcttttgattccagcaaaccacttgaaataaatggtattcccttacctatgcttgaagctactggttcaacaagagaagttttagattctttaccctcgcaatctttaccatcacaagcaccaactcttcagcagtatccaatgcagcaagatcaacaacagcaagaaccatcacaacaacaacaacaaaagcacctgcagcaactgcagcaataccaacaacagcagcaatcgaatcaacagcaaccacatcttcaacatcaaagacagtttcaacaatcaccaccaccgcaattttcaatgatttcttcaacgccgccccttcagcaaccaccttttattttggcaaactcaccgttaccacaaacttatttgccaaagattgatgaaatgaatatgtcaccagaagtaaaacaagaaaactctgttgctccatttgcatcccaaatcaccaacttttttgatcaacaaacaagtggatggtttaataatgataaccaagatgacgactttttgggttggtttgatgttaatatgatgcaagagaaataa

SEQ ID NO: 5426 - DNA, 531 bp, Candida albicans
  unsure (484),(523),(524): Identity of nucleotide sequences at the above locations are unknown.
acaagtattcaacaaaatgcaccgttgactcacgaaaattccgacaattctccatacgctttaaatacaccagaaaacattgaagaattacaaccaatctcagaatttattttgggtgacgttactttgccattaaacagggccaatgagttacacgacaagtttatgaccacacatttaccatttttgccaataataatatctcgatctgccaccgaattgtatcataaatctcaattgcttttctgggccgtgattcttaccgcaagcttatcagaaccagaacccaaactttatatgtcgttggcatccttaattaaacaattagcaattgaaacatgttggattaaaacaccaagatcaactcatgttatccaagccttgatcatactttcaatatggccgttacctaatgaaaaagttttggatgattgctcttatagatttgttggattggcaaagaacttgtcagtacgatcaggtntacttcgttatcgaccaggcggcaggaaaatcaatgtcnnccccccc

SEQ ID NO: 5427 - DNA, 2202 bp, Candida albicans
ttcattaacaatatccaagacacatttgaatcaatcatggttctgcacctactaaatcaattaaaaattaccaataaccatatttattccaatatagtgccgcaagatttggataaaagaaccattcgagccaagcccaccaatgattattctttgaaaagtatgataaaaaataatactcatcaaaaactgaccataccaataacaaacaccaccaaaataaaatctgttcatgatgatagcaacagcaatatcaaaagagtgaagaggagtttcaaacataacaatatttttgtcaaattaacgaaaaagaaatgtattgttgttattaattatgacaaaacaaaactatcgacaataaccagatcaaagttagatactgtaccattactacccaatagtacatcatttatcctggaaaaccaaaaccaaaatcaggtagatacatctatattgtcagaaatacagttaccttataaaggtatattaaagtacccagattgtattatcaatgacactgaccccacaaaactagatacagaaaggtttaacaaatatctcgatgaagggataaaattgcgaaataaaaccacttgccatttggagacagagacagagacagagacagagacagagacagagacaaagacagagatagagacagaatcacagtcacaagtttcttctaatttactccatccaatactaaatgaatcaaatcaaagtacagaatctactccggtgcctaattattcaaatttaaacaaatcgaaaataaatcgaatagtactaagagactttgaaatcaatacctggtatattgctccatatccagaagaatattcacaatgtgaagtattatacatttgtgaatattgtctcaaatatatgaattcaccaatgtcttatcgacgacatcaattgaaaaattgtaatttttcaaacaatcatcctccaggattagaaatttatcgagatcaaaaaagtaaaattctgatttgggaagttgatggaaggaaaaacattaattattgtcaaaatttatgtttattagccaaattattcctcaattcaaaaacattgtattatgatgtcgaaccattcattttttatgtattgacagaaattgatgagaaaaacccatcaaattatcattttgttggatattttctgaaggagaaattgaatagctcagattataacgtctcatgtattttaactttacccatttatcaaagaaaagggtatggtaatctattgattgatttcagttatttattaagtcggaatgagttcaagtatggaacaccggaaaaaccattaagtgatttgggtttactaagttatagaaattattggaaagtaacaattgcttataaattgaaacaaatttacgataaatacttttcatgcaatgccaatggggatggtgacagtgtcagcgacaatgcaaggctcagtttatctattgatacactttgtaagttgactggcatgataccatctgatgttattgttgggctagaacaattagattcattagcaagaaatccaataactcataattatgccattgtgattaacttggataaaatcaacactgaaattgctaaatgggagaaaaaactctatactaaactagtctatgagaaattattatggaaaccaatgttatttggtccaagtggaggaatcaattctgcaccatcaattcaaccaccacaaccacaatcaacatcagtaacaacgacaacaatgtcagctagagaaggtactacaaattctcacccaaagccagttattcctcaaaatagtatttcattaatcacaaactttttaaaagatgacatcaacaatccttacacatttgaggaagaaggatttaaagaaattgaagctcgcagagaaactgagaatgaagagataaagaatgcaagcttagtagaatatgttacttgttatcctggcatagtagtgaacaatcatttcgtcaatggtggtggtggtggtgatggtgaactgaatggctcaaatgatcaaatcaaaggccacaaaaagatgttgaagaaaaggaaaagaattatagatgatgatgatgatgatgacgatgatgacgatgagattgaaaaaatatttgaaattgatgagatcccgagtaacgacgaaaattttcactacgcagtgccggcccacgcttactaa

SEQ ID NO: 5428 - DNA, 2916 bp, Candida albicans
tgtacttggatgtttatctcacatatgtctgcgcctccaagtatcccaacaataaccactccaggtacatcttccaccaatacacgcagagtcgctagacgagcttgtttgtcgtgtcgtgaaaagaagatcaaatgtaacggagaacccatgactactataacagcagctgacggtaccaatagaatcatacccgagaaaaccagaacatgttccaattgccgatttttgggtataccatgtgtgtttgtacaaagtaatcgtggtgggaaaaggaaaaagcgttcgacagaacaccaactatctgattccgaagcaacaactgcccctgctacacacccaaatcagttaggtcaacatcagcaattaccaccaataaaaaaaaccaaatcaacaccttcaattcacaatctcgacagtggagtggtgataccttcaatcaatcaacaacaagagaggcatcaagatggatatcgcaatgaagaattggcgtctaccgaaagagtcagctcatatattttagacggaaataacagcacaaagttaccatcaccggttttaacacataccacatttgactcacgaagggatgaaggccagagattcaataatcaattacgccgatcttcaactacaacagcaggttttctgttaccaccaccccaagaattattgggaagaagactggtcagttattcccctggaccttcttcaataaagagccaattgcctcacttaacgtcgtcgtcgaccacaacatccagtgtgcaatcacctccaccaccaccaccacctccgcaaccaccccgtggaatgggcatacagtttcatgaagcaagtcaccaaccaggcatatttcctcctcctcctcctccaccaccgccgccgccaccgcatcccgatcacttacatcaccagtattatggctacccaccaccaccgccaccgccaccgccacctcctttgcatcatcaccatcattacccgccctctcatcatccaggatttgggttctcaccaccgccaccaggtccaccaggtccgccaggtccgccacctgtaccaccaaaacctcattatcaccaatcggcacctccagaatctccaccaaaagaatttaaacatcgacatccaaagtattttcataaacaaaataataaaggacatcgacatcgacatcacccacacctacatcatcaccatcctcctcctcctcaccaccaccaccaccatccccgtgatttccagcagcataatggacaggatgacataaaatctaagcatactgatgagaatagtcaaaattcaaaaccgtcactgccacgatggcttgataatatgtcagtttcgtccctggattcatctagatcagtttcatctccccaaagtcagcataatgacaagtcacaatattctaatcacaagtcatctacccagatgagtagttgcactaattctgtaacacaaacactcgatagactaccaaagatagtctctactcaacaaaataatctcaccccaacttcaaaaattctttcaaacagtccatttactgaatcagaattggcaaaatatgatttaccaaaatgggaggtccttaataaaatatttaattactattatatatataatcaacctagccatcaaatattccctgggaaagcaatattacttgaaaacttggcattaaataccgacagttcaattattcacgccattattgctaccacatgtttgataatttccaaatatgattcctccattaatattgtcgctgatgaattgtactggatcaataaaatgcataaattttgggataatttaaacgatttagggatactatgttgctacaaacttttagtgaaatgtacttcaattcgattcaatattaaaaagatgaacgacataaatatcaaactttgggaaatgatcaacaataatcaatatgtcgatattttcaaacagaaaaaatttgattttcaagagtctagaattatacccacattcggcaccaaacgccagaattatgaacgagagttaacattaaagattatatggagtttttatatcaataatattattttattacggtttaatcaaggaagaccatattataagttgtcatcaattatgaatgggtttaagtttgattatgatcgtgatcaatattctaataacattttattgccaatgagtgatattgattatctctcgttgaaatcagctggtaatagagccaattggaatcaattatatgaaaaatcgcatattccaactgacgccactagtttgattttgagtctgaaaagttttgagaattcattatctaaattatctaataaagacattacgtttagcaatttaattagtaaagatgaattccatgttgatttacgcaataaattgaaaacaaagtattatgaaataatccatgatgaaaaattggttgttataaataccaattattggttttcaaatataattttacgattgtcagagttaattcaatacaattatattttatgtgatatcatggttttcaaaatgtgcaaatatgactggaaaaccgatttaggatgtaatagtgatgatcgaggcgacagtaaagataccaacaccacacaaggtgaaaaatgtcgggatgctgatggaaactcgatacaacacaaggaagattacaaggattccgtaagtaatcctggtttattacaacatcctttgataagtgacgaaattcaactggttgaaggtttaactaccaaattgaaaagcttgaataataatgattggaaaatcttaattgaaatgatcaaatcgaccaacgaatacgtcgatttaataaaactaataccactgtccgagtatacagactattctattgttgttgggccaacaacttttgacgaacaattataa

SEQ ID NO: 5429 - DNA, 948 bp, Candida albicans
ttgcacgataattttttttttttctctttttatcatctcatcaaaccaggttgcaagtttataattatggggaaagccagcaaggacaaacgtgacttatactatagacgagctaaagaagaaggttggagagcaagatcggcttttaaactattacaattgaatgaagaattcaatctttttaaagacattactcgagtagttgatctttgtgctgcaccgggatcttggtcacaagtcttatctcaaaaattgggtccagattcaactattgttgctgttgatttacagcctatgactcccatagatggtgttaccaccattcaagcagatattacccatccaaagactttgcaaagaatacgagattgttttggtggtgaacccgctgattttgtttgcagcgatggtgctcctgatgttactggattgcatgatttggacgaatatatccaatctcaattaatcttatctgcattacaattgacaacatgtgtgttgaaaccagcgggtaattttgttgctaaaatttttcgaggtcgtgacattgatttgttgtacagccaattgagctatttatttgacaaagtgatatgtgccaaaccaaggtccagtagaggaacatcactagaagcctttattgtatgccttggatataaaccacgtccaggttggaaaccaacattggatctcactaaatcaaccgaagagtttttcgaaggagctgatattgggaaacaaacgacaacacaaatattagaatactctgaagaggaaagaaagattgctccatttattgcatgtggtgacattaacgatatagattcagacgctacctacagtttagatttaagcactctaacgttagatccggtgcaaaaaccaacagccccaccatataaaaaggcattggaaatgaagcgcagaggagatttgcatagacgataa

SEQ ID NO: 5430 - DNA, 447 bp, Candida albicans
acttgccgaagaaaaatacgctgggggataatgcatcccaaatcgaaatccgcaattgatgtaatggatgatatgattgatgatgaagacgatgacgataatgaagacgatgatgacattatagaaatcgtcgaaaatcaaccaccaccttcaccattaccatctcatcaaatacaacaatcaaagctggcccaaggagccaatgggaatagtggtacgtcgctgaatcaacaacagaaagggaaagaattgactgaagaacaattataccgtcaacatgaagtgaaaatgattagaaaagttggaaaatacgattttgaagacccgtttattgatgatcaagaattacaaatggaagaagagatttcatccacaaaagaaggattctttgtttattggggaccattggtagacgatagaaattccaacaagaaaaagaaaaggtag

SEQ ID NO: 5431 - DNA, 1452 bp, Candida albicans
gggtatcaatggaccccatttgtcatcacacccaagtcaacattggacaattggcaacgtgaatttaatcgttggatacccgatattaagttcttggtattgcaaggggacaaggatgaaagagccgagttgattaagaataaagttatgacatgtgatttagatgtaatcgtctcctcttatgaaattgtcattagagaaaaggcaaccctcaaaaaatttgattggcagtacattataatcgatgaagctcacagaattaaaaatgaggaatcattattgtcccaaatcattagaatgttccattcgagaaacagactattgatcaccggtactcccttacagaataatttacgtgaattatgggcattacttaattttattgtaccagacgtgtttgccgagaatgaatcatttgatgaatggtttcagaaagatagcaacaacgagaatggaggagaggaccaagtcgtttctcagttacataaggttttaaaaccatttttgttgagaagaatcaaagctgacgttgaaaagtccttgttaccgaaaaaggaattgaatgtttacgttaaaatgtcacccatgcaaaagaatttgtaccaaaaaattttggaaaaagacattgacgcagtcaacggagctaatggtaagaaggaatcgaaaaccagattattaaacattgtcatgcaactaagaaagtgctgcaaccatccttatttgtttgaaggggttgagccagggccaccatacactactgacgaacatttagtgtacaattcccaaaaaatgttgattttagaccaattactaaaaaaatttcaacaagagggttcaagagtattgattttttcacaaatgagtagaatgttggacattttagaggattactgctatttccgtgagtaccaatattgtagaattgatggacaaactgagcattccgacagaatcaatgcaattgatgaatataacaaacctggcagtgagaaattcatatttttattaacaacaagagctggtggattgggtattaatttaacatcagcagacattgtgatcttatttgattcagattggaatccacaagccgatttacaggcaatggatcgtgctcatagaattggtcaaactaaacaagttaaagttttccggttcattactgaacgtgccattgaagaaaaagttttggaaagagccgctcagaaattgagattggatcagttggtgattcagcaaggaagaaacactggtggattagatggacaacagagcagcaaagctgcgtcgaagaatgagttgttagatatgattcagtttggtgctgcagatatgtttcaaaaaactgatggcgagggcgaatcaattgatattgaacaaatattgaaacgttccgaagagaggacccaagagttgaatattcttcaaccaccggggctggaaggaaccgag

SEQ ID NO: 5432 - DNA, 330 bp, Candida albicans
cttcattatcaaaaccagacaccatcattagatttgaacgatgttctaaatgacagaaataaactctcatttcaagacaacgcaagtaaatactttaccaaaactgaaaaacaacaagtcgacattgagaaaacaagtaacagatttaagtacttgttggggttaactggtttattccgtcatttcatcgaggctaaagccaacaaggatccattgtttcggaaaatagtcgacaaccttcatgattccgaattgaaagcaaacaagaagaaatcagattccgccaagaagaggaaaaacggaaaggggggaagatgcttgaattgttaa

SEQ ID NO: 5433 - DNA, 858 bp, Candida albicans
  unsure (29): Identity of nucleotide sequences at the above locations are unknown.
ctggtggaagaacggcattcagacggtcntaattcaggacttaaaccacctaaacagttgaatgtttacgaccatcagtcttatccggccaaagtcctcgaattgtatgaattggaaaagaattactatagaaaacaagttcattataaggttcctttgaaagcaggtactgatgaggcatcacagaaggaaaacgaattggagcaaaaattagaacaagaagaaatcgagaattcgcgtccatggactgatgaggagaagcaattaaaggaagagttgatgcaaaagggatacagcaattggaatcgaagagatttccatcatttcatactgctttccactaagtatggtcgtaattatattcggttgattgccctggaatttgaagataaaactgaagaggaagttcgagaatatgccaaagcattttggcagaattaccaagagattgatggctatgaaagatatataaaccaaattgaacaaggagaggaaaaaataatcaaggtcaagattcaaaaggaagcgttaaggagaaagttgtctcaatatagatatcctttacaagaattggtgttgaagttcccaccagcgtcaaccaataaacgtgtattcagtgaagaagaagaccggtttttgttggtacaattatacaggtttggcattgacctgcccgatgtgtatgatcgtattcgagaagcaatacgacaatctccgttatttcaacttgatttctttttccaaagcagaaatgctggtgagatatctagaaggtgtaacacattattgggatgtatactaaaagaaattagtcccgagcagtcctccatgcctgctaccaatggtagaacgttctaa

SEQ ID NO: 5434 - DNA, 669 bp, Candida albicans
ttatatatctctactttattcttcttatcattgcaatcaatgtcaacaacaactatcgataaacttcttgaactgcaccaagatttatttttgcaatcaatttctcaccccttgacaaatgaattatgtgagggactgttagctgacttcaaattattcacttatttaaatcaagaccttaaattttttcaaattggactcaatttatttggtaaaacattagcttattgtgatgattccaaatcagccattattttgggcaaacaaattggatttatatctactgatgaaaatgattatttcaccagaactttaaaagaacttgaacaaaatgatttgaccaatgtattaaatttgaaaaacaacaaaactttgatcctccccaaagttcaacaatatattgattatttacaatatttaacttttgaatccaattcttatgttgaaatcattacctttatgtatactatggaaaaagtatatcttggttgggcggagtataatgttgctcaaaaaacaattccatctaatttaccttataaatatcaagagtggattaatttacattatgttcctgatttttctaaatggttcaatttttacaaaatgaagtggaaagagtggttaaaactaaagaagattttattatttgtgaaaaatcatttgtaa

SEQ ID NO: 5435 - DNA, 1395 bp, Candida albicans
tttgatacatcgaattctacaataattatacaaccaactatggctagaagaaatagaaataaaactgtgaatgaagaagagattgaacttgatgaagttgactcatttaatgccaatagagaaaagatattattagatgaagctggagaatatggacgtgatgatcaatcggaggaagatgattctgaagaggaagtcatgcaggtagaagaagatagtgagggtgacgaagaagatcaagaagacgaagaagaggaggaggaggaggaagaaggggaagaagaagaagaagaaaaaggatggggaggaagacagaattattatggaggagatgatgtaagtgatgatgaagatgctaaacaaatgacagaagaagcattgagactacagaagaaacatttacaagaattagcaatggatgattataaggaagaagagaagaaggaagaaaggcagaaaaaggccgattcatatgactataaagacacactgtcatcaacccagcagcagcaacaacaacaacttatcattgaaagcaatagttctattgcgaatttggaagatagtgataaattgaaattacttcaacaatcattccctgaatttattccattattaaaagaattgaacagtttgaaagttaaattagaagatttacaaaaattagaggataaaaacaaatgcatagagacaaagattgtagcattatcagcatatttgggagctatatcgtcatattttgccatatttgttgataatttgaacaatgaagaatcgtttgtatcaatgaaagataatccaatcatggaaactatattgagttctagagagatttggagacaagcaaatgaattacctgatgatattaaattggatgatgttaaagtacatgtttccgatgttgtttcttctagtgatattgatgacgaagacaattttgttgacgccaaagaagaacaatctgaagatgaagagatatcagaagaagaagtttctcaagacgaagacgaagatcaatcagatgatcttgacattgatgctaattcagaaagaattatcaagcatgtttccaaaaaacacggtgatgatttcacagaagctgatatcgaagatattgatatggaggataaacaacgtcgtaaaaagacattaagattctacacttccaaaattgataaagctgcagctaaaaaagaccaatcatattctggtgatatagatgttccatataaagaaagattgtttgaaagacaacagcgtctacttgaagaagcaagaaaacgaggattacaaaaacaagatgatgaaaatatatcggataatgacaatgacaaggccggtgtcaaggaccttgaaagatgcctttccacagcgactataagatccacgatatgc

SEQ ID NO: 5436 - DNA, 963 bp, Candida albicans
cataaaatagaatatatatttcgaggggcgggtcccgtaacaaaatcaaaaaagagaaatccatttaagtttgtgttttttttgggaaaacttgtgggagatatttccatctatttttttttagtcacatttgcacgatttcttacgatggtgttaattgtagttgatgtacttaggaaaaaaaactttgatacaggtgttgtcatgaataatattaccacttcccaaatgcagccgtttaaaaacaaagtgggaggtcatacacccatattctcaatatcaaagcaagaaatatgcaaagagctcaacaataccgaacgaaatttctacaagaaaatctccaagaatcatcctttattttattatatgccaaggtataaaggtagtaatggatcccaaataattctagaggatcttacatctcaaatgagaactccttgtatattggatttaaagatggggacaagacaatatgggtgtaatgcaactatcaccaaacaacaatcacatcgagctaaagccagaagcacaacaacaagaaaattgggtgttagaatatgcggacttcaaatctttaattatcaaaacaaatatttctatcaggataaatatcttggaagaaagataactgttggtaaacagtttggcaaaattttagcaaaatttttatataatggccatgacatttattcattattaaatcgtatcccccatttaatcgatcaacttaaagaattatacacaatatttactggattaccagggtatagaatgtatggtagtctgatattattaatgtatgaaggaggtgaagataatctggaaaatcaagtaaaagtgaaaattatagattttgctaatgcagtaatagcaggcgcagaacatatagataatgtgactgttgcaccacaacaccctgattcccccaaactggggttatttaccaaaggtaaaattccgtaa

SEQ ID NO: 5437 - DNA, 1476 bp, Candida albicans
  unsure (1352): Identity of nucleotide sequences at the above locations are unknown.
agaactatcatactatacaaagaaaaaatagctgcaaatacttgtaaggacctcttacctacaatatttaccatgaaagaaaatcaacatgagagtggggcacatgctttattaaagttgggcactaaacgagaaaatgacaatgataatgaggctgcccaaaataaccatatcaacgatgcagttgaagcagcagtgatgaaatatgtgggagggaccttgggtagtcatgattctaaaaagaagagaaaacatgatgctgacgattatgcatttgctcaatggacaggttttcttgatgataactttatgaatgaagcatcatctgatgctgttgttccttcatcaacaccaccgaaaaagaagaaaaagaaagataaaaagaaagacaaggaaaaagacaaagagaagaagaaagacaaggaaaagaagaaagaaaagaaaaagaagaaagaaaagaaaaaggataaaaaggataaaaagaagaagaagaaacaccgccatcgcgatcacgacgagcatgctaagaatgaagagggaccagaacaaggagacgaattaacaaggcatattgaggttgaagataatgctgtcaaagaaaatgcagatacaggatatgcggctgacagaaatacagttgaaaagagtacagaggaaaggaatataaaagccagaaatgtagatcaagggaacacacgtgccgggcccacagttgaggaaaagaatcaatttcatgatatcgatgaagcacaaagtaaattgattgaagctgccattcagaatgctcatggattaactcatgaattgaatgaagctcaagaacagagaatattagaagctgccaatgacgttgttgcctcagaatcatttttaaacaatgatattactttgccaaatatgggatctcaatcgaatttctcctttacattaaacactttcccagtcccagtaacagcaacccaagatgagacgaaaactagaaaaagagatatacccaaagaaccacacaagttacctgaatatgatttcagcacattatcagatgttcaaactttgacaaaagatatatacaaaaagacattagagtggtataatcagaatgtaaaaccagaagatagaaagaaaccacgtgcgttttcacccgaagaagaatcatatttagattattatcttgctgggtattgtcatttaaccaaaatgaatagagaagacctttgtcaaagagtgtgggcatcaggggtaatcaaagatggattttggagaaacatatataaagtattttcttatcgttcggtttcatcagtttataaacatgttcgaagaaaattccacattttcgatgttcgagcaanatggactaaatccgatgatgaacaattgaaacaattgacattgacatatccaagtaaatggaaacacattgggaagtcctgggaagaatgcggccagataagtcgtcaaacacgcggctggtaa

SEQ ID NO: 5438 - DNA, 705 bp, Candida albicans
tttcccccccatttagggccggttccgggacattcccgtggtggaggacgactgggaaaattcaatcgagatccaaaaatcccagtattcatcttatctacaagatcgggtgggttggggatcaatttaactggtgcagataccgtgattttttatgactctgattggaatccggcaatggacaagcaatgtcaagatcgttgtcatagaattggtcaagttcgagatgttcacatttatagatttgtttctgaatacaccattgagtccaatattatcaagaaggcgaaccagaaaagacagttggataacgttgttattcaagagggagagtttactacagattactttggtaagttctcggttcgtgatttggtcagtgatagcaatattgggaaggaaataacagatagaactattgatttttcaggcgatgccaagatgggtaacgtattagctcaggctgaagacgaagaggatagagtcgctgctggagctgcattaaaagaggttgccattgacgacgatgatttcaaagaagagactagatcagctactacaggagccactcctgctccaacagaaactaatgcattaagtacaacggatggcgacgctggatttattgatgtggattatgaggatggcattggtcacattgatgagtatatgttacggtttatttcggatggatattatttatag

SEQ ID NO: 5439 - DNA, 2697 bp, Candida albicans
acgggcgggttaaattcaattaaaaaattcagtccccgtagtagtaaaattatcaatttcgatccaacaccactagaaataatacaattaaaagacgaagttattgatgcaccaaaactcactgaaaaattacaaaattttcttaacaatgattttaagactcccattatcgacgaatcgaatgttccagattacaatttcactagagatgagtataatacaatcatgtctcaacaagagaaattattacgaaagttatatcacaaggtcaatattgaaaatagccttgaattgaatggtgacaagatagagcggcgcaaagttattctccctcaatcgaatataaaacttacagatcctttcagaaataccttctcagtcaaacccaaattgcatggtgctgcaaataacgccacccatcaagattatttgctagctcaaggtatggcattttccaaggttcatcaacaaatgaggaaacaacaccacttacgaaccagaaagattgccgcaatgatagatcagcattttaaaaagaagaaaggagagaaggaaagactagctaaagaaagagagcagaatctcaaaaaaatgagtcgattgacaatgcaagccgtgaagaaaagatggaatcaggcacagaaagtgtatcaaattatacaaaatgagaaagaggaggagttgaagaagatcaaaggtagacaacatttgagtgaaatgctagaacactccactcagttattggaagctcaacttacttcttcgagagagcccacagttgaagccgaaagtgatgacaatagcacgacctttgacgacaataccaatgattctgacaatttcctgtcatcagaagaagaggaaaacgaagaagacaacacacaacagcaaataaatgggaataaaaagtatgatgtaaatggaaaaagtaacgatgagaacgatatgagtttatcggttgaagaattaagaaagaagtatgcagatttagagacttcagtagaaccgttatcgtctaacgtaacttctgacaaggaaagagaatctgaaacttcaagtgaggatgctgaactgagtgatgacgatgatacagatgttacaagaggtcttgcgtcgttgtaccagaatgatgaagttgcggactttgccactacaacttttgagtatagtgcagaggagaaaaagcttattgaagatcttaaccaagaaagtgattcgagaatgaattcattattagactcagactctgttagctccatttcggatagtgagtcactggaagaaagttcatctgatactgaaatggatcagctgactgtttcagagcctcctcgtctgtcggaaactgggagcaatactggacttgcaagtttatttaccaatggcacaattgtgctggatgaagaagatgacgcttcaatttccagcaattttgaaaatgagagtgatgaaagtatgaacctgtctgatagagagcttgaagtcaatgggaacggtaagatagataaaattgcatctactgatgaagatgacagcaatgttgaaattgtgaatgggtcaaaagttaaagatgtacctatcccactgctcttacggggtacattaagaccgtaccaaaaacaaggtttaaattggttggctagtttatataataacaacactaatggaattcttgccgatgagatggggttgggtaagactatacaaacaatatcgttattggcatatttagcttgcgaacatcataaatggggcccacatttgatcatagttcctacttctgttatgttgaattgggaaatggagttcaaaaagtttgctcctggatttaaagtgttgacttattatggttctccccaacaaagagcccaaaaaagaaaaggatggaacaagccagatgctttccacgtgtgcatcacatcctatcaattggtggttcaagatcagcaatcatttaaaagaagacggtggacatacatgatattagatgaggctcacaatattaaaaactttaggtctacgcgatggagagcattgttgaattttaatactgaaaatagattacttttaactggtacgccgttgcaaaacaatttaatggaattgtggtcgttgctttattttttaatgccatcatctaaagtgaaccaagcaatgccagaagggtttgccaatttggacgattttcagcaatggtttggaaagccagtgaataggatactagagcagacatcagcggggaactctgatttgatcgatgaaaatgaacgaactacacagaaaatggatgaagagactagaaatacagtggccagattgcaccaggttttgcgtccttatttacttcgtagattgaagaaagacgtggaaaaacaaatgcctggaaaatatgagcatatagtgtactgtcgattgtcgaagagacaaagattcctttatgatgatttcatgtcacgcgcaaaaactaaggaaacgttggcgtcgggtaatttcttatccattatcaactgtttaatgcaattgagaaaagtttgtaaccatcccgatttatttgaagttagaccaattgttacatctttcgccatgccaagatcaattccctcatattaccagagtaccaatgaattggtgaagagacagttcaacaaggatgaaaaagtttcgtttcaagctttgaatcttgatgttactggatgt

SEQ ID NO: 5440 - DNA, 3969 bp, Candida albicans
aatttaccaatcatggatgcaggcacaggggctttaacatcgaaagctcgtttaagacaacacctattacacggagagcaagacattgatacactaagtgaatctttgcaacagcatcagtaccaacaacaacaacagaatccaaaatataaccgatttcaaccggcttatatgcaacaacaacaacagcaatttatgaatgtaccaggcgcagtatcccatacaaatctgataacttccgcatcaacaacaaattacgatattatgacaccgttacctacttctggatcaccgtttacttccaatagtaacccaagctatacaaacattaatacgaactcatcaagaaaatcatctatgacttcccaaactgccgcaggagtaaatcgattttttcgaagaaacaaaggtgccgacttgaatttcaatgaagattcaggagcagatattatggatcttactaatggtagtagcgtttcttttgatgatatcacccatatgagaaacagagggccatatgctatgaactctcataaggcccttgatactgcaccaataatccctacattgggagctggtggaactctatgtggactagggccagcttcgggctcaaaagttaacaacgttcaatacaggaaacagatgaaccaacagaagaaactagcgatgattaatggcgccagagcaaactcattggcaactggtaatcccatgatggggcaacagtcacaatatatgggcggtgggccaaatgacccacgtacgatgtcaatggtaaactccaacccaagaacgatgtcattaaattcccagggaccaagaaccatgtccatgaggtcaggaccattcccgcaaagattaccttataacccgcaattacaacaacaacagcagccaccaccaccaccgcaacagcaagtatatggaccaggaggagcagcacctagaacacagtctttaagaacaggcccatatcctccacaacaaatgcccatgggtaatggtgtgccaccaaatggcccacgaactatgtcattgatgaacggtggaatgccaaacaacggtccaagaagcatgtctttaatgaatggtggtatgcctcaaaactatcctcgaaccaagtccttgggtacactgggtccgccattaggataccaaggaccaccattaagaagtcagaatttggttcccgctaatccttcacaacaacaacaacaacaaatggatcatggatatggggtgcctccacaagaacaacaatattctcagccgactcagcaagcattcgctccaggtcaacaaccatttatacctagaaatgctccacaattacgacaacaacaacagaaacaacagccaccacaacagcaacagtatagtcaatggcaaaacttgcaaccgcaaccacaacagttatctcaaaactctagtgactctttacaagaagccattgttgaagaagaagaggaagaagaaccacaactgttacgggccaataattttagtgtagatcctgcttcccaaaacaaatctgaaaagcgtgacgaggagaatatgatttacaatttcgagaatgaagacccagatgctgcattgtctcgtaaatcaacattaaagaagaataattcaatgagagttcgaaaactaaacttattcaatgatgagaaaccgcaaactggcaagaaagctctctccagaaagaaacctcctgttagtcctgctgatgccaattttggtcctgtgagttctaacgatagtgtacagaattcggtaaaggacctacctagaataccagatacttcaaacgaggatttacaccaaaaatctccaacaccaaatgaagaagaagaggatcttaacgaagttcctggctcgcccacttttaatgtcagtgctcctcctactagagagtcctatcttgatgatgaagacgccaatccaagtaatgatggttataaagctttaggtgccaatgcaagagcttctacacacgacatatttgtcacggctttggatttcaactctcctcaaaaaagtaatagatccatgaaaataggatcacctcatacatcgccacagaaatctcgcatactgggaacttctgatttcccttcaccaaatgttgaaaaagatcaaagtgacgagcaatctacaatacaagaagatactgtgggcgctgacacctcagtagaagatacggtttcaaaaacatctccaccacttaataattcatcgatcaatcgcaccattctggattctaatctgaaatttcgaaatattgtggccaatactgttttcagtaagtttagatctccatcagctgagtctactccaaaattttcaagtccagcaattgctaaccgttttgctgatggcgatgaacgacaacaacaaggatcagagacatcttctgtttatgaaagtaatacacctagaaaaatgctgaaatatgatttgaacaattcggacactgacgatagtgaaataagaagaagagatcaaaatggttttttcgaacaaagtacaaatggtgagactactccaccaacttcatcaacgtctaatatttcacataaagtgggagaaaagtatacgtacatgggtgaagaacaggagggaaataataccaacagttttgatcaattcagttctctgttgcaacattcacaacaagaagagaaacaacagggaagatctaattcacattctagcaacgcaaattcatatgatggtagtttctatcaaaattttagcgaacctattcatgatatacctgaagaacaaagaagatctcaagacaagacccctgatttcacccaatttaacaacaacaacaataatagtaaacttggaaatgttgaattggaacaggattcgttgccgaaatcaattctggcacgtcgttcctctagtggagagtcgatgaagatgcttttgacatctcatggtagtgcaactaaattatcgtcagcagcagcagcagctccagcatctggacaagctattaataaacgatcatcattttcgctcaatggtacaaagaatatctttaaaagattctcgaaatcaggcagaagaactagttctattgacgaaaatgattcaacattgaatcctattttgtcaagaaattcttcaatgacacaagcttcaaaacaacctttgtttaacaaacgagtatcatcttctggaaacatgagtttatcagatctgtcggtgattaagactgccacgaaccagaaacagccattgacattcactaaagaagagatgagtataatgaattgtaacaatgatttattaaatgaattagaattggtcactacagaattagcttcttcgattaaacgagaattggcattagaaagtaaattgagaaacagtccccaacaacaacaaaattctcctaaattggatgaagaattaaaatccgaaatcacagaaaaatctcgagttattgctgatttacaagaaaaattgagcaaagaaagaagattgaggtttattagtgaagaacatgcattgttgggtgaacatggtcaagcaccttctgcattgaaattaaattatgaaaagactgaattatacaagcaattgttaattaaaaatgatttagttcatcaattagaagataaattatctgagtatgagagaagaaacagtggattatttcaacatgaaagaccatctcatgatattgatttacttgaaaaatataatgagttgttgaaagaaaacactaacttgaaagtacatgtcatacctgatttagaaagaaaattaacagaaaagaatcaagttgatgattatgatgaatctcaattagaaattcaaacattaaagatgcaaagagatgaattaagagaagttgttaataaattgacatcgctgaataatgccgaattgaaacttgctcaagacaaaatcaaacatttacaattattcgcaaccgctgaagtaccaact

SEQ ID NO: 5441 - DNA, 1215 bp, Candida albicans
gcgctttactttccagcccgccggtcaagagttggttgtcactttttcttttcaacaccagccatgtccgaacaacctacagaaccactttccatcaaagaagagtatcaactatggagaaagaattgtcgatatatgtatgagtttgtcagtgagacggcattgatgtggccatcacttacaatccaatggcttccaaactacaccaccaccaatggccttatcgatgccaaacttctattgggaacccatacatccaatcaaagtgcaaaccagttaaaagtggcatcaacacaattactggcagaccccaatgtcaaggctaattcgaaaattaaaaccgtacaaaaactcgaaaataatgccgaaatctgccgtgcaagatacatgccacaagacgcaaatatcgtagcaactatcaatgggttgggtgaggtagacttgtacaacttagacactgaaaccaggtactcacattttgccccacacactaaaaacgggtacggtctttcatggaacccaaaacaaaagggattgctagttaccggcgctgatgacaattttgtttgtgttactgataccaccaccaacaaaactactttcaaaagcgacatccaaaaggatattgtcaatgatgtgaagtggcaccaattcaacggcaacttgtttgcgtctgtgtcagaggatagtcatgtctacttgtttgatgctagagataacaaagtggttagccaatactatgccgagtcctccaacggtatcaactccttggcattctctccgtttgccgaaaacttggtggcaatcggcaatacaagttcaaatatcaatttactcgacttgagaaaattgggcgagaactcaggattgttacacaccatgatgggccattcggaaggaataacttgtatggaattctcaccccaccacgacggtatactcgccaccggctcacaagatagaagaataattatttgggacttgttcaaagtcggcgaagagcaacaacaagaagacgccgaacacgggtgtcccgaactattcatgatgcatgctggtcatactgcgggagtgagtgatttaagttggtgttcctttcaaagactggatgatccggctcaattgctgaccaataatattgtccatctctgggaaggtactaaaaagttgattacaaacgaggaaactgaagtagatgtgtcgattttagagtaa

SEQ ID NO: 5442 - DNA, 1497 bp, Candida albicans
aaatattctactttaagtaaaggcaaatataccgatccaatgttttcgagaccattagaggaaatgagcaaagagcaagatatgacaaaagaaaaaaaaatggactacaaaacaaataattttcgcaaaactatatctcaacatcttcttctgttccgttaccaacaacttcacatcatgccatcatcaactaacgagtttgccaaagccgaaagggaattggtagaggagcagcaattacaagaaaaaatcgtaaatgaagagtttaagatttggaaaaaaactgtgcctttgctttacgactttatacacacatttgcgttggataacccttctttggtgtttcaatggttgccaactaccagcgtatctcaatcagatttggagctcaaatttttaatagggacaaatgcaatcaataaatctgaaaattatttgaaactaacttcaataagcttgccttcgactttggtgggcgcaaccgatagtattcctgttccaagtgatggtatagatacttcaaactttaaagttgttactcagtggaagcaaactcaggaaataaacaaattgaaagtttcacctaatggaagtctagctgtggggttcagtgccgatggtgttattcgtagttataatttggacaactttgattctgttgattataagtatcacaagcaaggtggtatagcattagactgggtggataataatggattcttatctgggtccaatgatgcacagattgcgttatggcaagttgacaaatcatctactccattgcaattgttcaagggacaccatggtgctattaatgatatctcttctatcaaagaaaaacacttgtttggatctgttagtgatgattctactacccagtttcacgatacaagagttaatgccacggatatcaatcctgtgataacggttgaaaacagtcacattcaaaattgtattcagtttcatcctgatatacaaacattgtacgcaactggtggtaaagataatgtggtttcgttgtatgatataagaaactatagcactcctttcagaaagttttatggtcataatgacagtgtcagacaattgcaatgggactggaacaaccctgatattcttgtatcttgtggattggataagagaattatattttgggatttgaaaaatctcgatgaggatttcacttatcctgatgcaacgtctaatgggaaagatacgaactcaaagagaaaacaagcggtcaagactgatccatgcttgaaatatgttcacggtggtcataccagaagaacaaacgatttcgatattcatccaaaagtcaagaatatttttggtagtgttggtgatgataaattattggaaatctggaaaccaaagtctttaccaggtgatgagccagaacaagaatctacagaagtacaggaggatgaagagatgaaagatgctgaaaccaaaggtgtcaaggacggagaagaggatacaaaaatgaaagattag

SEQ ID NO: 5443 - DNA, 1278 bp, Candida albicans
tttttattaacttactactttggagatatcgatattgccatgctcagtccaaaatctacaaatcaggaggcgccagcaactgcacctttggatgatataaatactactaaagatgtgtccatggttgatgtgagtaaagcagaaggagaaaatcaacaacctccgagaagaaaatctacaataatattgaccgatgaaattgatttagatagaatgaatattgataataaggaatcggataagagtaatgagcagggggataaaatgcatattgaccgatccttatcgaacttgaatcagcaacagcattcacaatcttcccagtcagaaccctcccaaccagaacagcaacagcagcagcagcagcaacaacaacaacaacaacaacaacctgttgcaccagatgccaatattgctgttcccgtggatatcaaatgggtccaaggtggtcaaaaagtctatgtaactggttcattcacgggatggagaaaaatgattgggttagtaaaacaacccgatgataattttatgattactttagggttaccagttggaacacatcgtttcagatttgtggttgataatgagttgaggttttccgactttttacctacagccacagatcaaatgggcaattttgtgaattatattgaaatcactcccgaaaatgttcaacaacacctattacaagaaaaagaggaaagcaacaatgagtcacaacagcaagagcttgagaaacagcaagcaaaaacgggcgataagacatccagccaacaagcttcgcgtagatattcggtatctcgatcaagaagtaattccatgtgggggttgactaatgacgatgatgatatgggtgacggttattcaagataccatgatgatgaaagcaatgcattggatgaaaaaacctatcagtatatcaaagatatcccaccaattttcactgatccaaaggtgatggagcagtattatgtggccattgataagcaatcgaggaataataatggacaacagcaagcatggttacatccaccacaattaccacctcatttagaaagtgttattttaaataatttcaataatactgagaataatagtggtgcattgcccattccaaaccacgttgtgttgaatcatttggccacgacatcgatcaagcacaatacacttgctgtggcctctatcgtgagatacaatagaaagtatttgacacaagttttatacgcaccactacaacaagcttcactgtcttccacaacacaagagcagcaactgtga

SEQ ID NO: 5444 - DNA, 1332 bp, Candida albicans
  unsure (1329): Identity of nucleotide sequences at the above locations are unknown.
catttacacaatacttgggaaaagtatcaagatttgaaactgtttaaaggtttcagaaaattggataattatataaagcagttcataatctatgacgatgaaattagaaatgatccactaactactaaagaagatctagaagccatggacatagaaagggaacgcaagcgagatgagcaagacgaatatacacatgtcgagcgaattgttgatagcaagagggttgaaactgatgatggggaaaccaagcttcaatattttgtcaaatggaaaagactttattatgatgaatgctcttgggaagatgccgaagaaatagcaaagatcgcacctgaacaagtaacgaaataccagcaaagattgaactcaaagattttacccagtctttccgccaactatcctctttctcagagaccaaggtttgagaagttgttcaaacaacctgttttcattaagaatggtgaattgagagatttccagttgacaggtttgaactggatggcatttttatggtccagaaatgaaaacggtattttggcagacgaaatgggtttaggtaagactgtgcaaacggttgcatttttatcctggctaatttatgcaagaagacagaacggtcctcatttggttgttgtgccgttatccactgtaccggcatggcaagaaacatttgagaaatgggcccctgatgttaattgtgtttactatttgggtaatggagaagctaggaaaactataagggagtatgagttgtacaaccagaatataaaaccaaagttcaatgtcttgttgacaacatatgaatacattttgaaagacaaaaatgagctcggggcattcaaatggcagtttttagctgttgacgaggcacataggttgaaagatgcagaatcatcattgtatgaagctttgaaaggtttcaaagttagcaacagattgttgattactggtaccccattgctaaacaatgtcaaggaattggcagcattgtgtaattttttgatgccaggcaagtttacaatagaccaggaaatcgattttgaaactattgattccgaacaggaacagtacattaaagacttgcagaagaaaataagtccattcattttgagacgtttgaagaaggatgttgagaaatctttgccatcgaaatcagagcgtattttgagagtggaattatccgatatacagattgagtactacaaaaacattattactaagaactacgctgcgttgaatgcgggtaataggggatctcaaatatcgttattgaacatcatgagtgagttaaaaaaggtatcctttcatcggtcaggactgatgttcttntga

SEQ ID NO: 5445 - DNA, 642 bp, Candida albicans
gactatatgtttataaaaggctatcaatttcaaaggttggatggtactgtaccgtcatcgaaaagaaagatcgccattgatcattttaatgcacctggatccaaggactttgcatttttattatccaccagagcaggtggattgggtattaacttgatgactgctgacacggttatcatttttgattctgattggaatccccaggcagacttgcaagccatggctcgtgcacacagaattggtcaaaagaatcatgtctcggtatatcgtttcgttagtaaggatactgttgaagaacaaatattagaaagagcaagaaaaaagatggttcttgaatatgccattatttcattaggtataaccgaccccagtgccaaaaacggtagcaaaactgaaccgtcaactaacgaattgagtcagattttgaaatttggtgctggtactatgttcaaagagaacaataatcaacaaaaattggaaaatttgaacttagatgacgttttgagtcacgcagaagaccatgtaactactcctgaattaggtgaatccaatttgggttctgaagaattcttgaaacaatttgaagttactgattacaaggctgacgttgagtgggtcttcaccaccgggctggaaggaaca

SEQ ID NO: 5446 - DNA, 1254 bp, Candida albicans
agatctattttaaaatggggagatttgagtggtaaatgggagcagttagttgaagaagggagcatcacaaacgagaatccggtattagttaaacatgcgtataatgaaattatcagtacttcaaaacaattggtgaaggaagaagaagcaagacgcgctgttgttcttgctgaactagaaagaaaggctgaagaacaaaagaggcgaccaccagttccgggtgaaccaaatcaaactgctttatggattgctaagaagaaagaaaaaaaggccgtgttatttgagtatcaaggtgtgaaaaacataaatgctgagatcgtattgaatagaccagtggatatgaaattgttggaaaaaattgtaacaaaaactgattccacgaattttgtattaccaagacatccaaaactggttcaagcttggtcttgtgagtggacagccaaagatgatgcgatgctattggtgggtgtttacaagttcggttatggatcttgggtacagatcagagacgatccgttgttaggcttacagaacaaactatttttggaaaaccctgccgcaggaaaagatgctactgccaatcaagatggtaaagaaagcgtgaagaaagttcctggctcagtacacttgggaaggcgagttgactatttgtttactttgttaagagatgaagaatctgatagttcagtgggcggatcgacgcctgtcggaagtgttagaaagagaattaggaaatcaacaccagttccgcacaacagtggtagcagcaacggcagccataatactctctctggtaatagtaatggcggcactgccaacaacacgggcaaacacaggaaacctgttaagttagagagttctgaaaaacttgccaaacaaaaaaggatgaatcaacaaagaagctctgcatcagcatctccagcacttgggcatgccaagtttaaagaagaaaagcgagacctcgagtacgaaagcatggacgaaggctcatgcaaatcaattatgcaaccagtaaccagctcattgcacaagttgcataagggaagtaaaggcttagataaacatgagtgggcaaaaattttaaaatcagaattgcttaacattggtgattttattgaatcagaggttagcaaagttcaaaacaaggataagctaagaaagcacttgtggtcttttacgggtctttattggccatcaaaggtaccaagtaacaaaattggtgccatgtataataggctaaaacagtccaattaa

SEQ ID NO: 5447 - DNA, 1053 bp, Candida albicans
tggttgatttattccaccgatgagttcacacagtgtagtgagtttctccgacaccagacgtttatggtgtcgcccgcgtaccttgaaaaacacggcattagagtgaaccacacgatacaccgagagggtgagtttattatcacatacccatacggataccatgcggggttcaactacgactacaacttggcagagtcggtgaactttgcgttggacgactggtttgagtttgggaaacgcaccaaaaagtgtgagtgcattagtgattctgttgggatcaatattaagcatttatgggaaaagtattacggtacgaagtacgaggcagtgaaagaggaagatggtcgggatggcggacttgaagctgactcggatggctcaatagaagtggtcaaggtagagaagatccaacgcaagtgtcgcaagagaaaacaagacaatgtccacactacaaatacacatgagagggtgtccacaaagagaccacacaaacaaccagacatccctcatgaatgtgctctttgtcccaacacacttcaacacactaaatactcccattccgctttatttgagttgctacaagctgatacgtatggcacaacacctgagagaccccgtcgagtgcacaagatatgtgctagtatgttccctcatcaacttaaatgcgactttaaaactaacacagtacacgggctagacgatattaccaagaaccaaaagaaactacgctgtggtgtttgtcgtcagagtgagatgggagcatgtttccaatgcagttataagaaatgcactcgagcattccatggcacttgcgggttggttgatggagttcagtatgattttgattctggagaagcattctgtaaattccaccgccagggccccacctcagcagagttcaaagttggaatgtatgtgcagtttttgttcaaccacggagtatattttggacaattagtcaatttgggagatggggatgttgaggttgaggtgtatccttctactcgagatgtcattgaaataccaacgacaagcataattaatgttgtataa

SEQ ID NO: 5448 - DNA, 243 bp, Candida albicans
actactaacaaccacccactttcttatttaacagttcaaaaattttatcccactgctttggccgacaaaacctgggataatactggattactagttgattctagttcttttgaagattccgattcagaaaccaatacaaaattacccgtcaaagtattattaacaatagatttaactcaagctgttgctgatgaagcaatttccaaaacgtcaattcattattcgcccgccgccgaaatcaag

SEQ ID NO: 5449 - DNA, 222 bp, Candida albicans
actactaacaaccacccactttcttatttaacagttcaaaaattttatcccactgctttggccgacaaaacctgggataatactggattactagttgattctagttcttttgaagattccgattcagaaaccaatacaaaattacccgtcaaagtattattaacaatagatttaactcaacctgttgctgatgaagctcttaaccgccggctgcgatccaac

SEQ ID NO: 5450 - DNA, 306 bp, Candida albicans
ccaagtagctttattcaaaaagatgggattggaacacgacatttaagacaaattgccatttgtgcctggttctggaaggtgccgtttttaaaaggagttgaagcagatttatattacacaggtgaattatcgcatcatgaagcattgttttcaaagaaatccggatcttcagtgatttgttgcaatcattcacacacagaaagagcattcttaaaagtaattcaagaacaattgaagaatgaattgaacgaggctgatcaagttataatcagtgaaactgacaaagatccatttgaaacttggtaa

SEQ ID NO: 5451 - DNA, 699 bp, Candida albicans
aatattccttacaccacgacaacttacgtaccgacggacccgccattcttgccaatgtttagtataaagcaacaaaaggaaaaagagagacagttgatagaagctgttaacagtagaggtaacgacaacaaatgtggtgaatgtggagcttcacacccaacttgggcttcgtatactttggggatattattgtgtggaagatgtgcttcggtgcataagcgagttcttggtcctcctaaccacaacatatcgaaggtcaaatcattgactttggacaattggacagaagaacaaattaaccaattgcgccgaatcggaaacaagaaggcgaaaagaaaatggaattcgaagagaataccctttccatatgatggggatgacgatgtcagtgccgtcgaacaataccttagagacaagtacattgcgggtaaatttcgcgacgatggtattgataattccgagtatgatgaccggtcgagtaagtttagtgatgcagatcaaggcagctcgtattcacaacgagcactgacaagactgagatcaaacagtgcccgtagtcaaagtgcatcgattccacgacttacacatagaaaacttaccacatttgagtatactcagtattacacacaggcaatgaaaattagactgtatggttatcatgaccgtgagttttcaacagccggcgcgatacaggaaggg

SEQ ID NO: 5452 - DNA, 4185 bp, Candida albicans
tcaatattaatatcaataatgaacatctcttctatgttatcatcagataataatgtgtcgttgaaagagtcgatgacaacggcaactgatcaacaacagcaacaacaacggacggaactggtggatcatgcatcaatcaatggaaatggacaaacatcagtgctggcagtgaataatgttcaagagaaccatctatcagaatttcattcactgaaccaacaacattccagtatacctcctgttggaactactgtggaacacgccaccacaaccaccacaaccgcaactaaccatcaaccagttaatctgtcacctttgaaacattctgttgatgaaaattccaatcctactaccatatcctcattgaaaaaagacacaaactctattattgctagtatactaccagaaagttatcaatttgataattcatatacacctacaatagatcaaaaatacaaatcagtatttgaatccaatataaatgtcattaatcaattagatcaataccaacaaatgggtcatcatttgaaattaatgaaatttgatgaagttaaattgaacaattatcttattaatactggtcaatttgcttcaaattatattgatagagttgttgctgaagatatatcttcaagaaataataaaattagtgaaaccaataaaaataaagaattaattgctattgattattcgaaaccattacatcataatagtactagaggtaaagaatttaaatggggttcaacaaggaaaattcataaagttgaacacaaatcaagaagaagaaaacctgctgctacaaccagtactacagatgattcaaataaagctgttgctgctgctgcaaatggtacaaaagatcatagtgctacagcaggaaccactgcctctgccaatggttctgatacacctgatcgtcgtcatcaacggcaatcttcaaaaccttcaactcctattttgataaaaccaaagactgaacctggtaaaggactgcctgaaatacaaccaagaagaagtagtcgtcctaaagtgaaaagaaaggcatttgaagatgaattagaaactgctgacaagcaatcatctactcaacaagtaaagaaatcacaagaatcaactggtagagatcataaacgtgtcaagattgagaataaacaggaagaacagcagcagcatcaacagcagcagcaagcagatgaagaagacgaagctgaagcagaagcagaagcagaacaaaagcctaaatctggtgcattatcagaagctgctgctgcaggtatgactgctaaagaatttaaagcctttatgagacaatatgataatacatatattgccatttggaaagatttgtcgagaaaagatggaccgaaaggaagtaggctgatgcaacaagctactcaaggtagacttattaatcttagaaagacggcattattggctgctagagaagctaaaagatggcaattgaaaaataccaagaatcaaaaagatcttactactaaagccagaagagccatgagagaaatgtttaatttctggaaacgaaatgaaaggctcgaacgtgatttgaagaagaaacatgaaaaggaattattagataaagccaaaaaagaggaagaagaaagagaagccaaaagacaactgagaaaattaaatttcttaattactcaaaccgaattatattcacatttcattggtaaaaagattaaaactgatgaacttgaaggtactaatgctgatgataatttgaaatcaaacaccaaagaacatttggataaatatgctgatgttgatggatctgccactcatgatattaatgctgttgattttgataatgatgatgaagaagcattacgcagaatggcagcccaaaatgcacaaaatgctcttattgaagtgcaaaataaggctaaacaatttgataatagtgaagaatcattcaaaaatcctgacaccaatggtgaagaaatgaatttccagaatccaacactattaggagatatcactatacctcaaccaaatatgttgaaatgtactttgaaagaatatcaattgaaaggtttaaattggttagcaaacttgtatgaacaaggtatcaatggtattttggctgatgagatgggtttaggtaaaaccgttcaaagtatatcggtattggcatatttagctgaaacttataatatgtggggtccatttttggtggtgactccagcatcaacattgcataattggcaacaagaaattacgaaatttgttcctgaatttaaagtattaccatattgggggaatgctaaagatcgaaaaattttacgtaaattttgggataggaaaagtcttcgatacgataaggattcaccattccatgttttagttacatcttatcaattaattgttgctgatattgcttatttccaaaaaatgaaatggcaatatatgattttagatgaagctcaagctattaaatcatcgtcttcatcaagatggaaatcccttttgaatttaacttgtcgtaatagattattattgacgggtactccaattcaaaattccatgcaagaattatgggctcttttacatttcattatgccgtcaattttcgattctcatgatgaatttagtgattggtttgctaaagatattgaaagtcatgcacaatccaataccagtttagatgaacaacaattacgaagattacatatgattttgaaaccatttatgttgagaagaatcaagaagaatgtacaaagtgaattaggtgataaagttgaaattgatgtttattgtgatttaacaacaagacaaaagaaactttatcaacaattgagatcacaaatttctatgctggatactgatttacttgaacttgaatctaattctactagttctgatagttcattagctaatttagtgatgcaatttaggaaagtttgtaatcatcctgatttatttgaacgtgctgatgtcaattcaccattttcatttgggaaatttgctgaaacaggttcatttttaagagaaactaatgaattggatgtaaattattcaacggaaaatattgtccaatatgatttgcctcgattaatttatgatgaactattaaccccaaattataacaaactgactcgtgattccatttattccaaatttagtatttataatcccgaaaatatgaatgcaacgggttggttacaaggtataaatgtttctcctaatgaattgaaacattattctcaaatggatatactttcaagagctattgaaatgcaaaataaaccaactgaaactgaaaaactagaaagaataaattatctttatgaaggtgattacattcctaaaaataaaaaattactaatcaccgatcatagtaccagtaccaatagcagttttatttcaaattcgttggtgttttctgatcttgtttctattaaggagaaagttggtgaagatatgtatttgaataaattagaaccagcagtgacacccattgcatctgctccgccaatcactgtgaattgttcatcaatgaattttaccaataagatgaataatacattatttgattccaatataagatcatcattaataccattatcattatctactgaattaaaattaatgaaagatcaaatcccattagaacaatatccaaaatcaaacatgttacccatgccaatatttgattattccaatattcgtatgccatcaatggatagatttatagctgaatcagggaaattagccaaattagatgaattattaattgatttgaaacgaggaggtcatagaattttaatttattttcaaatgacaagaatgatgcaaatttttgaagaatatttagcttataaaagttataaatatattcgattagatggatcaacaacaattgaatcaagaagagaaatggttcaagcatggcaaaccaaccccgaaatatttatatttatgttatcaacaagagctggtggtttaggacttaatttaactagtgccgatacggtgatattttatgatagtgattggaatccaactattgatagtcaagcgatggatagagctcatagaattggtcaaactaaacaagttaaagtatttagattggttactagaaatactattgaacaaaaaattcttgaacgtgctaaagaaaaggaagaaattcaaaaacttgtcgttggtaatatgtaa

SEQ ID NO: 5453 - DNA, 1707 bp, Candida albicans
cccaattttctcttgaaccaaacttccacccggaagatccccccaagaaagaaaaggaacactagaagtcagacaaagatacaccaacaactggaaggagatgaatacaactcaaatgattacaaagatctgatagatttagacaaaccaccagttgttgaaccaagtcctccgttttttgttgaaagtgacactacccctgaatttgtgattccaacacctaccctggaacaacaacagcaacaacatcacaagttaatcgcacaagactaccaacgttccaataattcaaatcaatttggaaacttgacccattatgaaccaaattttcctccattacctcctttatcagagagtatacttccacagacaaacactttccatccattagtgttgccacatgacccaagacacgctattactgctggcccagctaataacagtcaacaacaacaacaacgacaacagcaagactcactgataccatcagatggtatctcttccaagatacaacaacttcatgcaccttcattgtcaaacaatcaatcagcatctcaacgtaaaaagaaagaaagttccgggcccaaaacacgtcctgcatttgttatgaaaatctggtcgatggtgaacgatcctgccaatcatgaatttataagatggaatgacgacgggaagactttccaagtgtttcaccgtgaagattttatgaaggttatattacccaaatatttcaagcataataattttgctagttttgtgagacaattaaatatgtatggatggcacaaagtgcaggatgtcgctaatggtaccttaaatcaaaactcggacaagaatggaccagatgaaatatggcaatttgagaatccaaactttataaaggatcgagaagatttattggataagattgtgagatacaagagtagttcaaaccaagatgacgtttctggagtttcattcaatgggataaacaatagtgcaaatttgtcgttgattttacaagagttggatacaatcaagacgaatcagtatgttatatctgaagatttaagaagagtgcgacaagataacaagatgttatggcaagagaactacctaaatagagaaagaaatcaagtacaaggccgcacattggataaaatattaaagtttttatctgttgtttatggtaataatgctaataaaatattgaatgggcacggatttgctgatttcagtgatagtaacaatatcatgactcaatatagaccatcacccatgggatcaccattaatactgagaccacaaacccaaccaccaccttcaaattctagatttgcaagagataacaatcagactgcacaacctacttatgaatcaccattatcaaccagcgataccaataataataacaacaacagtacctttgaatatcaacaagctgtcaatcgtccacgtctcatgttgactaaccgagcacattcaagacgtccaagtatgtctagaaccaaatctacaccagaagggtccatagaagagataatacgttcttattctaacgataaagctgctgaatctaatgttaatcgaatgtatgagcaattagttggtcatcaaccaggtgcaactacaaataacaataaccattcttccctgacagcaatttcggcaccatcaccacgtcatagtttcttacaagaattggatcctaccaggcacttttcatag

SEQ ID NO: 5454 - DNA, 1491 bp, Candida albicans
tatttagcaaaaggattgcgtgaaaaaaaaaaaaaaagtaaacacacatacttacttcaaagagttgaatacacaactgtaacagtattttggaacgagataaattgtggaatatcaatcccatctatgtcaaccagccaagcaaatataagatcagtgattcatgaatacgaaatactatatactactaggattcaacagaaatcaaaaaattggaatgatggaaaattgacattttatgaattcaataagaaaatagagatacataatgacgatggcatgctacttgccacagatttttatagatccagactgatatctagtgttttaaacagtgttttggtggataacagtgagttccgactacccaatgccaattatcttatccaaattcaagataaaatacgtgttttcgaaagagaggttaatctaagagcaaaaaccagtgatagtcaaaaagttgaaaagcttgctactaaaaatgagtctgttccaaagagggacactattataagtaaatctccaagtctgggccatccttcgatgtcacacaggaaagttacatcaagaaacttagtgaccacagataccaaaaaccaaaacttgtctattaatggaattttgacaaaactgatttatagttctatgggtgccactagaatgaaaaagactcattcacccaaaaacaatagaattcacaatatagcaaaaccatctagctctggatctaatattaacaagggtctaacagcatcaaaaccactacgatatcaaggttctaatgtaacaaagactactcaaaatattagtggaaccaccacaggagctaaaatatctcaatacaaagtgcatagcaatgatttattaaccattgattcaaaggtttctaaaagactcccactcagaatccctcctcgaacttcgacgtgttttcaatatatatatacacctagaaacgatattgagaagtttgatgtagccgcaaatgatatcagtatatataaaccattaataatttctggaaatgaaccatctggagaagagccaattcaagaaaaagagaatggacaagaatatgttggaagcaagggatatgatgaaaatcaaaagaagaatgaaaacatgcacaatagccatgacaaagaaatgaaggtgaattctagacccagtcaaccaaaaattgtggatgaatacactaatactgactcagtaacattttccaataatgaaatttctcggatttcagtgaagaaagaacaaccgttaattgtttcaaacacgacggttgacgatactgatatagtttacgatttatcggattatgaagaaaatgagaaattcaacgccatgattaaaaaaatcaaacagacacagaatttgcaggacaattcctcaacgagtgttgtcaataagaaacctaacatagtaaaaactggcttggaagcggttgaattttgtctttctactgattctgaaatggaagaaatataa

SEQ ID NO: 5455 - DNA, 624 bp, Candida albicans
tatttattattaatgtttcgtttatttgcaagacgtaattatagtatacactggcgattcaaagatgtttgtccatcaccgagatatgatacaggttgcacgtattgtcaaccagaattcccaacaaacctagccattgattttgataagaatttgaacaaaacaggagcaataccgaccaaacatgtaatggtattgacaaatccgattaatcagatatcagagctacattccaaaactgagtttattcccaatagtataccgagtgaaataacaaagtatcgaacaatgattcaaaccgatgatcaacgagtgaccatttccgtgatccatcttaacaacaatcgtcaccaacagatattagatcaatataatataaaaccaggctcgtcgcaacagttggtgtttttgtatccgtctatgaaaatcatcagatttgacctaagtgtactggaccaatttgttaaaaagtacttgtactcgaagcctacagccccagtttataatccatttgttcaaaccaaaccctcggcaccaaataatgacttgtttgattccataattgtagatgagtcaaattttattgaggatgaagcgtcttcaccacggaatgaagtccgcgtc

SEQ ID NO: 5456 - DNA, 1149 bp, Candida albicans
ctaaaggatcaggatccagctatatggattttaaagcattttttgaaatctatgtcggaaatatgtgactgggtacaatttgttgatcctaaagatgagactaatgaaaggcattttttgcgtcgtttatacaataattgggatagtgaacagcaaggtgtcttgactttttcagatttggttgttgggttaaattcgttagtagacccagatttaatggcatctatgtcgaattattttgaattgtacgacactaaccataatggaaaattaaatagtgaagctatactacaaatatccgaggatttattgtacataacaagtccatggaaagagggttatttgttagatgaaattactagattagcagttgaaaatgaagtagcagaagaggtgttcaaaaatcaagttgccaatggtgatggattaaccattgatttgccacaacatgttgaagttaatcgtgagaaaattgaacaacaacagattgaacggtatttacgagctgcaagtacatttattcaacgtgcatttgagtatgctcaaccagaagatcaagaattgttaattaaagatttggcaattgatgaaaaactttctcacaatgcggcattaaatccaaatacaccagtgtatttgaatctaccaacttttagaatggttatactagctgatgaaacttatgaattattattcagccataccttaagagaagcaactcacctcaatagaccattagactcgagtttcaacccaatgcgtaatttgcgtgatatgtttgatgggttgttggctgatggaaggaaagttgccaataaagttagattgcgtatggattcacgtgcttcaaatcctggtggttcaagcagtgccctggttaaatcaaataagagtactagcaaaactggtgctggtgatgaagatgatgaacgagatgatgattttggtatgatttcaattgatgaacaagataaagacttgttgcttggtgcagaggcacaatccctcgttgacccaattaagagtgaagttgcaactgctaatactcttgagagatttcacagagcagcactggaagctagaaaccatatacacaaggatggtgctaacggtaatcatactgagaatttaattgagtttgagcaataa

SEQ ID NO: 5457 - DNA, 1083 bp, Candida albicans
  unsure (37): Identity of nucleotide sequences at the above locations are unknown.
ggacgcgggtctgacgcgcgcattggggaacacgaantgccaacaaaattgaaaatgtggtttgatttatttcaaaccgatggacgaaatttatctttggttagaaaacctttattttataaacttattcgagtaggattaccaaatagattaagaggagaaatatgggaattgacttgtgggtcgatgtatttacgattagaacaccagggtgaatatattcaactattagaagaacataaagacaagaaatcgtttgctattgaagagattgaaaaagatttgaatagatcattacccgagtatgctgcatatcaatcacctgagggaattgagaggttaagaagagtattgacagcctattcttggaaaaatcctgatgttggttattgtcaagctatgaatatagtggtggcagcattacttatatacatgtctgaagaacaagcattttgggcgttgaatgttttatgtgacagaatagtacctgggtattattcaaaaaccatgtatggaactttattggaccaaaaagtatttgaatctttggttcagaataccatgcctatgctttgggaacatatcaccaaaaatgatattcaattatcagttgtttcattaccgtggtttttatcattatacttgtcttcaatgccattagtttttgcattccgaatccttgatatatttttcatgcaaggaccaaaaaccttatttcaagttgcattggctattttaaagcaaaatggagaagaacttttgcagactgaagatgatggaacattcatatctataattaaagattattttcatactttagaccagtctgctcaccctaattctcccaaccccaaatatagaagtgtcacaaaatttcaagaactcttagttactgcatttaaagagttttccacagttaacgaagatatgatcaatactcatcgtaataaacaccgggattcgatttatcaaaatatttcaacatttgtgaaaagaacggaaattagaaatttgccacgaaccagcaatatcccaccagacactttagatatattgtacgacacgttttattcccaagtataa

SEQ ID NO: 5458 - DNA, 297 bp, Candida albicans
accactaccatcacctccaccaacacaaccaacatcctcatcatggcattttttgattcacttaaagacaaggctcttaatactttgaatcaagtactatccactaacaacaagaaccaaatggtgttgaccaaagatcagttgttctgtcaacagtacaatttacccgataacgaagttgttatttatgaatcagcggccgaaatcaacattgtttcagcatattctcacgatagttataaaaacaacaatgatccattttcacagggaagactatatttgacaccacatttttct

SEQ ID NO: 5459 - DNA, 1908 bp, Candida albicans
  unsure (1743),(1805),(1812): Identity of nucleotide sequences at the above locations are unknown.
tcatacggtgttccctacaacctttgctcagcgccaaaaacacacatgagaccaatagactccatagtttccaagttcagagtgcaaaagcatacatcaaaccttgctgataatccggctgttctaaaacacccagaggatatgccaaaattaacaagttgtctaaggtgtaggaaattaaagaaaaaatgtgacaagagtaccccacattgtttgaattgtgaaaatgcaaatgaagagtgtacctatgtgaaacggaaaccaaggcaaagtaagaacggtaagacaacgaccctggaatcttctctagatcctccttcaccaatggtgaatgaaacttttacaggtttttcgtatcttaaccaatcccaacctaatgatttgtttagacatataccatcagctaccaccaacacaagcacaactacatctaccgtagcagcagcagtaccaccaactacaaatacaagcgaatctgtatcatcatctcgatctcacacaccaccgatattaaattcaatcgatgctacagctcccaatttccattcgtacccgaaacaaatttctaaagtgctaattagtgctgtgggtattaagaccaattcaaatgtgagtatcattccaccaatagtagataaagatttgttaacatcaataatcggtctgtttatgcaacacaattatcgaatttgtccagtgatacacaagaaagaatttttggagaattttcaaaaattatttaaagaagatggaatcgtagatttagattctcatcatgatccctatgaattgtacatggttttggcagttggaagtactggtttagaacgtacaggaattattagcagagacaaaaaattatctgaatactttgtatcgatggccctatcgcatgttcataataatttatctaccaatagtctaactaatgtgagaaatttgacattgcttgcactatactcattttttaacccagcagaatatacatcttgggaaatcatgggtaagttgacaagactagctattcatttaggaatgaatcacaagattctggatcaagatgcaagaaacttgtcttccaaagaaattgaaatgagatcaagattattctggtcagtctataatatagatcgtttgagttctgtttcacttggaagaccagtggcacttcaagatgatgatataaatgtccccttcccacaagttttagaagaagatgagacagaggatattgctgtaaaccggttagtgatcaatttgcgtagattggaaggtaaaatcttgagaagagtccattctgtcaacatttacaagaattttattaacaaagataaactgcaagaagaagtttgtcaggaaatattatcagatttacgtaaagagattgaagattggtattaccaggtcaaatctgttgataatgccaacacatccgtcagacagtcagtttctttccatttactggttccttggtatactgcaagatataaccacttgttaatccttttgtatcgtccttcttatttaaatccaagaccatcacaagaccttcttgatattcttggcaagtcatgtgtagagacattgtcatatacttataaattgttcaaggccaaactcttaccgttaaattggaccactttgtatcgttttttgatggtatgcaccacaatcctttattgtgtgtgtaaatgggccatagatctcatggagtcgaaaacagaaatttgttactgtattganattttccaagcatgtggaagtgactggatagttgcaaagaaatgtgctgaggtgtttagaanaattganaacaaattggtagaaattactttatcagacggtcatgttagcgacatggacaattggtccaaaaaaactataaggtgcaagctcatcatatcatga

SEQ ID NO: 5460 - DNA, 2016 bp, Candida albicans
  unsure (2009): Identity of nucleotide sequences at the above locations are unknown.
agaaattcttccttcctttttccctgtcaaactacattcaaccttaattttcattcaaatatggaaagtaatctatctaatactgaatcaccttcgccttcaccatcttcaccttcatcgagtgctaccccaacaactaccaatatatctacaaacaccaccaataatgagaaccctggcatccacacgtcggcaacaacaaatacaactccatcgtctgcagacactacaacaaaacctaaacgtcaaagaagaagttatagttgtggtccatgtaaattattaaaaattaaatgtgatttacaaatcccttgtactgcttgtaaaaaattcaatcgagttaatcgatgtttattacaaccgcctcaacctccttcacaacaagaattgagtaaaattcaagaacggaaaaagagaaccacaattaagaaaatgaaattgtccaatgaattcgttcaagcatataatgttaaccctaatgcattaccctcaatgatttctacaatggaaactacttcgaagaattatgaaaagaaaactcagaaacataaaatgaatcaaatactgttagacaaggattcatctcctaaagaaaataccagcaaaactttaaagcaattgaataatttcaatggtaataggaaagatactcaattgacaaaaaattccaactcaatgtcaccccattcccttattgaaattcaacggcatcacttgagttttcaacaaccacaaatgaataaacaacaattacatccaatttcttatatcacctctgtatcatcgccatcttcagcattgacatcaacaagtcttaatttccctcaaggttctcaacaagaagatgtgattcaatatttacttactatggattcacaaaaaacgattgatttaactatggttgatattaaaagaataaaacgactattaccaaatgattttgggttattcaaaagcatgtttgattgttatttaaacaccgttaatcccattgccatcgatatgcaagatttttcagaaattttcaaacaaagtaatctagtgtataataagcttttatcaattgatgatgaaaatcccaaaaatttaagtattaatgtcctgttcactttaattgaattacgaaacttgtcattatttttccttattcttgtcaatggattattatttgattttaggggtgaaaagccgccacttgatagtacacgacaaacccacaacaatcgttataccaatttcttacttgaaagaagtatatataaatcaaaacatgacgtgattgaagattggattaaaatatcgaaatttattaaattaaaagttttagcttacgaaagtttaactgatattattttcttaatagattggtatatgattcttaagaattattatgattatgaaaacatggtagtggaaaattatcttgaatttaataatttattaaattatcttgtgttgaataatgattttattaataccattgaagatccttataacgaagtgggtcgaaattcaaatgaagaagaagaagaagaagatgcagcaactacttcagtagacgaaaatgaagtggtatatcctgataccagacaattcaaggttttatcaaaatattggattcaacttcgtttaatcgaaattgattatacatttttccaattcaaaggatcattattatttgccaatcaattgaaaggtacagttgttcctcacaaaaaaatcttgaaaactctttataaagatgttgaattggatccaattactactcatttaatgaaaatatgggggttatattataaacgatcgaaaaataccacttcagtacgagaaatcattaaagattatttattattatattgtaatatgatgggtactttaaaagatgaactaaatgaatttgaaaccaataaaccattagaattacccaatctgagatcaattaatttaaaagatatcgaattacttattaaaaatcaaagacttttacatttatttgcgagcggttattnttcataa

SEQ ID NO: 5461 - DNA, 711 bp, Candida albicans
accatgtctaccgatacaactgcaaatgatgaagggaaaaatgagttttcaaaacaatggcgtcaactgagagcttgtacaagatgcagaaggtttaaaaagaaatgttcgtttgaaaatccaagtttcaagtcttgtgctaggtgttttaaaaatggatacgagtgttcatttaatgaagatccagcgatgcaaccttcacgaaagaaaaaaagaaagattcagatagatgataatacacactcttccattgctaaccagttgttactgacatctgaaaatactttgaaattattaccggagaagttaaacgatttatctgaagattcgattcaacatcttatatccaattatgaatcgataatggacaaattgaaactgaaaattaaacctgatacatctaatgaatttccttatatcccttacagtaaaaatctagcaaaagagttgatttatcggtataattatcttactttagctgaagttaaaactagacttgacttcttcttgaatgaaatattaccctattatcccacaatcccattgtctcgaaaattaaaaaatttcgactatatgcttgagaaattcccattattgttgattgcatctattttcgttactgtgttgaatgataataatcttggaacaacaccaatactgaaagataatctaaagctatgtaacctattgagttattatctttattcgtag

SEQ ID NO: 5462 - DNA, 1227 bp, Candida albicans
tcttcgttgagtggtcgtatcccttatctatcatatgcccttcaccctatcccgcgttcctttagtcgcttcctcaacctttcctatgttttgatacgttctcttcctcttctctccctcttgcccacttcacggcgaacgtattgcaagctcgcgtcctgccagccgcccggtgaagatagtaaatatgtattgaatgatgaaagatttcaatatcatcgtgaaaagaccaagaaattggcagaattacaagaaaatttaactgataaagaatctctaaatacattagaattagaattggaacaaattttaaatgattataaaacaagattcaataaaaactataaggaaacaccttccatttatcaatattcaatttcaattgataaaattgatccactggtggaagtaaattcagcacctgagaactataatcccaaactgattaattcatttattaatataggaggtgatacaaattccagccaaaacaatattaatggaaatatgccaagccaaaacaataatggagcagtttcggaaatggggaattttaataatattgataatggtgttgatgatgatgctttaggaggattccaattttctaataatatagatacatctaaatttaatgggattaatgggatggccataaatcaatttggtaataattttgaagtacctatgaataataagcccgacgccattaatatcaacaacaacaacaagatattgataaataaatctgattcagatggcaatattgagaataataatagtaatagcagatccaacacgccgtccaatattaacaccaataacattaactcacaggggccttctgaaaatataagttcaatcaaccataacacgtcaaatagtataccaaattacagtaccaatggtagtgataatgataatatagagcaagacgatattaatatcgatgatgagggggataatataataaataatgatgatgataataataatattgctagccccaatagaattgataatgatgaaaatgacaataacaatgattctaatggattagatatgaatcaattatttgaagataatgcacatgctgatttagatcatctggaaatggttaatgatgatattggagatctttataattttgaaactggaggtggtggtgatgatgatgataatggattaatggatggattagaatttgaacaagattttttaaactga

SEQ ID NO: 5463 - DNA, 588 bp, Candida albicans
aaaatcaatttccctgggaagatttcaagggaccaactgaacccaaacgtacaccgttacctcctcaaaccatggttgccagacataaagatgattcctatggacggtcagaaagtagacgtgctccttttacctccacaacatgaaatcaaaaaacaatcattaggtggtacagattcatctaataaagttggctcttcacgtccaccattagggcaatcgaatgccaatgggtttaggaatgatatgagaacgaataaaggtaatagttcaagtaatcaacaaaactcaagacaacaaccacctgcctcaatcccgccatcaccgccaccaccattaccacctatacagcatcatagaggaagaaatgactatggaaattctcgaggatatcaatcaaacagagataattatggacgccatagcaattctagaaacgatagcagaccagctagcagtcgaacacctacttacgataatagagccagaaatcaaggtaacagagacaatagaaacacaggaagaaatgaaaagagaaatgctgacagttttggtggacgaggatacgataagagaccgagacattaa

SEQ ID NO: 5464 - DNA, 2190 bp, Candida albicans
attatagtggaatattggatccatttagaaaaaacaaaggccaccaatggcaacaaacaaccaatgccagcagtaccagcagcagcagcagtaacactttccatgtcaacaatgattctagtggttttgaaaatattactaaatggaaacccaagaggctctattcttactgctgattcttcttacaataatagttttccgaataatattattaataataaaccccaaactgttgatggtgaagaaaaagattcaatagcaaaaacatcactaggaatgatttgtcaaagtttacaaacggcattatcaaatgatgataatagtaatgttatatcatttttcaaaaaaaaacaagaccaagaagcaagacaagaacgattatcaaatttagatggtcaacatacaagaattttaactagtgaaactggagtattaagatttttcggtgaaagtagtgcattatctttaattagtgaatgtcgagcgttattttatgaagttttaggtccttctacttttactaatgatccagcacaaaatttcattcacgatgaactgattagttttgaaagaaatactactccagatggtattaatggtgatggtgatgggaaacaaataacaacaacaagtaattcaggtgttgcggtacaattaccattaaaaaaagatgcattaattatgattgaattatttaaatcaaatattaatgatacattttatgttttcaatatgaaatatttcatagaaaatattgttgataaagtttataataatcctataattgccaattcaaaacaattatgtttattaaattttgttttcgccattggaagtttatttattgaatattcatcagacactaataacaatgagattgattatttaccaaattccattgaatttttacaatcaggacaattatatatgagaaataatgtttatgatgggaaattatggatggttgaagccaattttttaaaatatttttattatcaagcatgttgtaatcgatcaaattcttggattaatcttggatccgccattagattagctcaagcgttaggtatgcatcggaaaatcattaacgataaaattgaaaatcaagaaatatcaattcatcgacgccgattatggagatcattatatgtttgtgattgtgttagtagtgtgaatttgggtcgtccattaatgatcaatacttatgattatgatgatataaattatcctgtggaaaaattattacttgatgaaaatgataatgtcgaaagaattcgaattattgctcaaaatgccactagtgattctgcagttttgaatcgaagtattgtacaaaatttatataatggaggttcaattaatattaaagattcaaattctttagcgttacaattaaaattatggagtattgaattaccaaattttttacaattgactagtgatatggaaaatcaattacgtgatccaacaaatcctaacaactacttgtttgttttcgttcatattggtcaattatatggaattatggctttaacgagaccatttttagttcatgtggtgaatcgaaaattacgtcctaatatgtataaacctcaagtcaccgatgaaaaacaattgatgccattttgtaaagcttctattaaagcagcttttttaacaattaaattatttaaattttattgtacatttaataaatcaaggaaagaagtatttacaattcaaagtgctactttttttgctctgattctattagggttcacattattagaacagattaattcgaaaaaacccgatcatcattatatttccgtgattaaagaatctattagagatgcaatttctatattcaaattatttaattttaatgctacttgtaatcgatgggctcaacatttgatttatatgatggaagcattgaataggccgccagcaatcataccttcttctttacaacaaacaacaaaaacatccactactactactactcctgtattatcaactcatccaattaccagtaccaacctaaattatcaacaacaacaacaacaagtaccgccaccaccaccaccaccaccaggaagtggtaacgttaaatttccatttcaaaacaaaaacaatagtagtccttcagcatcatcgattagttcagaaattgatcggttttcacaagacggtggaaggatcatggtc

SEQ ID NO: 5465 - DNA, 1605 bp, Candida albicans
tttctttttccttgcttcaaattttcaaatttcctttcctttttaccaaatatgtctgacgatcattcaatccattctcatacacagggactccaccacatcaaaaagaaacgggtcgggaaagcgtgcgattcgtgccggatcaaaaaaaccaagtgtgacggtaaaaaaccttgcaacagatgtacattagacaacaagatttgtgtattcacggaaaagaagaaaaccaaagagaagaaacatccatctggttatgttgagcttttagaagcaagattagatatattaactagactgttggaaaaactaattgaattatcacgaccacatttacaatttattgacgatataattaccgaagaaaaactggtcaatcaagaaaaatcttctcctgcttcatcaacaccaaattcatcttctagtgaccaccatgacgatgttgaagaacagaattctactggtgtggttgctcctataaacaaagtagtctcatatctaattaaagaacaaggtctattgaaaaatataccccttgaatgggaacaaggaactgagattgctgctaatttcgaccccaatagaaatttaaaactgtcgtcaagattatttgctgaacataaaggtgaagcatttattgggtcaccagtaacgtctcttcaacaaatgccaagtagtaacccttttagaagaacctcaatgtttaaagaagaattggaatcaccttctagtgatcatgacaatgcactgatattttcccaatcagtcgatgaaccttatatcaagaaggagcccaactcggttcagttttcaaaagggacattttctccacaacaacaacaactacagcaacagcagcaaatgttaaatcagttttccctcaatactttccgtgatatatcagacatcgaaagtgattcatcaaacaaggaagatggattgaattctggttcggtatctccaccaacatccaactataggtcattttcattgttctctgatagtaatggtgaaccaatattgggcaaaacctcatcattgacgtcattaactaacaagtatgaaaatcattcactttcttcaccacaaaccgccataaacccagtattcaataattcaaccactggtccaatccttaccacattgagacgcaattcatcttcacattctcaaaagacccttggatctatacaacttcaacaaaaacctagaggaagtgttcataaaccagtgcgtaatcattctagagtttcgtcatttgataaacgaatggagtctacagatacagctgcggatactgtcgctgctgtttccggttcagtccaactactgcaaaatacaactccacagaatgttcctcatttggataatagtcaaaacaataattatttaagagacaatggtatgaataatattggtgctggcagtgttggtggtggtttgacttttggtgcacccagttttacacaaccattaagtccatctgatgatgctattgtttatcgtacaaatcaatttactaatagaccagctacggtgtccacttttggtggtgggttagatgtgttggtggataattcattggatcctttcttcaatatttaa

SEQ ID NO: 5466 - DNA, 792 bp, Candida albicans
  unsure (430): Identity of nucleotide sequences at the above locations are unknown.
ctctctctctctctctttctttcttttgctttcaattctgttttctttttttttttaaactcttttccatctttctattatacaatagaagtattcaattattacacccactattcagttatagaccagtttactactaatatttttttttttgctatgcctaaaagggaaattgaagatacacaatcaccttattccagtaccggacttgttagtactggtgaaagtccaaaaacatctacaagtaccccaacatcttccactaataacagagctgccactaccaccaccaataatacttctactacttctaccagtctactaaaatctaattcaaatttacaacctattgccatgacaccgtctgtttcttcaacatcattggcaattaataaacccaaatctcaagagaataaaagaagaagagtcncacgagcttgtgatacttgtcgtcagaaaaaagtgaaatgtgatggtaaacaaccttgtattcattgtacggtatattcatataaatgcagttatgatcaaactaatattagaaataagaaaaattcaggtataccaattccttcccaaccaagtcctgcaatactacaaatggctgcacaagcagcagttgcctttggttccaacaacaatagtagtaatcaacaactgctacaactgctacaaaaacaacaacaaaatgttggtacacaacattcaaaacagcctttaactgctgatgaacctatttctaatacaaatttaataatttttcaacaaattatcaatggcttattaacctaa

SEQ ID NO: 5467 - DNA, 327 bp, Candida albicans
ttactaaaaaaaatgagtcaagatcaaaccccacctgttaaacgaccaaaaggacgaccaagaatattacccataccaaaacgtacaaaagtttcacgagcttgtgatttatgtaaacgtcataaacgtaaatgtaatggggataatccttgtctgtattgtcaagaaaaatctttacaatgtacttatttaaaattagatggaagatcaaaaaaatcaaaaattcaatcccataataataataatggtgatctggaatctgttgttgttgctaaagaaattgaacctgatcttcaccacgccgctggaaggaaccgcaattggcgt

SEQ ID NO: 5468 - DNA, 792 bp, Candida albicans
gaagagaaacgacttaagaaattgcaacgtcaaaataaattacaactggagaatgatgacgcttatgacgaagatgatatagatgtcgatagaacagaccgaagctttcatggtaataatgatggcatggatcaagacgatgattctaacgcaaatgtacaaaacaatgacaatatcgataatgatgatgaagaagaagatgacgatgaagacgatgagatgaaaaataaatatttggccaatgttttggcattccatgggacaaatatccctgggatttcattgcaatcttatttgggtcgtgttttaaagtattgtcctgttacaaatgaagtctttttatctttattggtttattttgatagaatagcgaaaaaagcaaacaatttgaatcaaaaaaagaagaattccaatagtaatggtaattctactggcggcactggttctgataatcaatcatctgaagctgaacaattatttgtcatggattcttataatattcatagattaatcattagtggaattacagtctcatcaaagttttttctggacattttttataagaatcttcgatatgccaaagttgggggtttaccattagaggaattaaattatttggaattacaatttttactattattagatttcaaattgatgatttctgttgaagatttacaaaattatggtgatttattattaagattctggaaacgagaacagattgctaatgaattagtacccaataataatgataatgaaactaaagaacatcaaacgcaaacacaaagctaa

SEQ ID NO: 5469 - DNA, 321 bp, Candida albicans
  unsure (314): Identity of nucleotide sequences at the above locations are unknown.
atacatatatcttccctccaccccattttcatccagcatatatcttttatagaatcattaactcaagaaccaaactccatctttatttgtatcaacatgtcgatagtatcattaacaggaattgaagtattaaacaatccagcaaaattcaccgatccttatgaatttcaaattacttttgaatgtgtggacccattaaaagaagatttagaatggacattaacttatgttggatcatcacattccttagatcttgatcaagaattagatagtattttaattgggacctgtccccgtagggataaattcctttntatttaa

SEQ ID NO: 5470 - DNA, 1578 bp, Candida albicans
gaaatgagtgattcagaggaagaagaagtttttgaaagtttaatagccacaagatctaggcggtccaatgcggggttaagattgaaacagttaattgcgttagaagaacaatcaaatgagctagcagcaacaacccaatttttaacagaagatgatgaaaacgttaatttattgtttcaagaagatggagaagatgaggagtttatcgatgaagaagttgataatgccaacttagaaggaattgatgaagaaagtggaacggaaaatgaaaatgaaaatacaacgaggaaacggaaacatacttcaagcgatggcgaagaagaagaagaagaagaaaacgacacctccaatataaatgcagatgaaatactatcagattcagagctatctgctactgattcagatgaaagtgaaggtgaaaaagaattactaaaacaggagaaactcaaaaagaaaagattgaagaaacagagtttaattcccaccatcaaacagccactggttaaatcagcaaccctaaagaagaaacaaaaacgaacaccgttagtcacagcagactcattactattggcaaatagaagatcgtcgtctcgagctgcagctgttgaaagtaaacaggctttagtagataaactaaaagaaagcgaagctaggagggcaaaatatgtacacgtcgaaagaaagcaacaggttgagctaactcaggaagaacgtcttgcagaagcagtagaaaccgagaaagcaaatgtggaatcacttcacagatttagagagcaagaaatagtgaagaaggaaagacagcgacagttgttgttactgaaacgaatcaaattacataatgttataaggctagttagcagtgagacatttgtaaagccaattgaagaagtgaatgatgcaagacgccagtacgaacagtatatgaaaataaagaagaaactaggaaaaaagaaaaagaatcagttagcggagatgatggattttcctaccagaatgccctttacaatagattacgactcaccgtatcaaaggaaactattggcagaaaagaaagcacaagaacagcaaaatgaaattaaaaaactcgagtcaatgaacgagaaacttcacgagcttatagaaagtggggactcgaagaaaaatgacaatgatgaagaaaatatacaattggtcccgtcaactaacattaatgcggataatcataacaatattgaatgtgaaccgattaaggttgaagatagtacacaggagattaaggcggatgaaacagataacaaagacgagtcgagcgataaaacaaatactctgatttctgaagttgcaccatcagatgaaacagaaagcacaaaacaagagaaaatttcagatactgaatttaatgaagaactggaaaatacaagccaaacagaggaaaatgggcttactaatgataatcctagcgaggttaaaaaggaagaaaatgaacaaactaacaaaattaaggaaacgcctgtagacaacaacaaaccagatgtgcaaaacctcacgactgacactccattggatgaaaccaaaagtacagaaaccatcaagagttga

SEQ ID NO: 5471 - DNA, 723 bp, Candida albicans
  unsure (71): Identity of nucleotide sequences at the above locations are unknown.
tacaaaggggtttcattgattgcaaatgtatcaacaatatatggagatcaaagaataaacaaacgtatacntggagaaaacttatccgatgacttatctcatcctttcaaattatgtatggccaacaatggtgatgtcaattgcaatggatcccaatttttcataacaacctccaagcaatcacaaatagctggtaaatattctgtttttggtcatgtaattcacgggaaatcaataattagggaaatagaaagagtaaaaaccaataaagatgatgtaccagaatccaacgtagttattgatcaatgtggagtttggaccgatgatatgccagtaccaattttcaacgccagttacgacacgataggaggggatatatatgaagaatatcctgaagatgataattcaaatttcaaccaagaatccactgaagaagcatttagtgtggcatcaaaaatcaaagaaagtggtactttgctatataaaaagggtgataaagaaaatgctcgttttaaatacataaaagcattgagatatattatggaattcataccagatccagatcaagatccagaatggtataaaaaattcatagatttgaaaaagaaaacttatttaaatttgagcttatgttgtttgcaattgaaagattaccatcgttgtatcgattattgttcatatctattggatatggatgactccatacttacgagaccagactag

SEQ ID NO: 5472 - DNA, 1221 bp, Candida albicans
ggtgaattttttttttctccatttcaatttcaatttaactttttcatttttgctacaacaatcttcgtaacatttccaacaaataaattatttacaatgcaaatagaaaaagttcaaccgaaagcatattttgatattaccaatggatctaaaaaattggggagagcagtttttgaattatacgatgatttagctcctaaagctactgaaaattttctcaatttatgtaaaggaatcacattgaatgataaaacttattcataccaagacaccatttttgacaaagttattaagaactttatgatacaaggaggttcattgaatgcaaatgtatcaacaatatatggagatcaaggaataaacaaacctatacctggagaaaacttatctgatgacttatctcatcctttcaaattatgtatggccaacaatggtgatgtcaattgcaatggatcccaatttttcataacaacctccaagcaatcacacatggctggtaaatattctgtttttggtcatgtaatccatgggaaatcaataattagggaaatagaaagagtgaaaaccaataaagatgatgtaccagaatccaacgtagttattgatcaatgtggagtttggaccgatgatatgccagtaccaattttcaacgccagttacgacacaataggaggggatatatatgaagaataccctgaagatgataattcaaatttcaaccaagaatccactgaagaagcatttagtgtggcatcaaaaatcaaagaaagtggtactttggtatttaaaaagggtgataaagaaaatgctcgttttaaatacataaaagcattgagatatattatggaattcataccagatccagatcaagatccagaatggtataaaaaattcatagatttgaaaaagaaaacttatttaaacttgagtttatgttgtttgcaattgaaagattaccatcgttgtattgattattgttcatatttattggatatggatgactcagtacttacgaaacaagacaagacaaagacattgttcagaaaaggttcagctaatgttggtctcaaaaaatataaattgggtttagatgatttgaaattagcaaataaattaacaccagacgatgtcagtatccagaaaagtatagaatcaacagagaaattattgcaacaacaaaagcaaaacgaaaaagctacctattcaaagttttttggttaa

SEQ ID NO: 5473 - DNA, 1524 bp, Candida albicans
gtggaagtggggaaagatattccgaattacataaatggatctgggtttgtgaaaatgggtgatgatttgataaattacaaaaattatttaaatagtgaacatttgaatttgtctcatgctaaactgggacctcataactcgtcaaactctattaaaactggtaatactacagtaaaccagtttgtccaatttgatctgcaaagattcaatgatgatcaatatattaaaaaattattcaagtcagcattgcatccatggaatttacataacttaccaattttgccaaacgctttgttgggtgctctaaataaaactgatgttaacgattatgatttaaatgaatcaagaataaatattgggatgactttttctacggaaaattggacttgtgaagatcatttcactaatttaatcaatttccagttttttggagcagtcaaaaaatggtatttcatcccagaactggaatttgaaaaatttgaaagattacttgaaaacatacagatgaaagaccaactgagatcaaatataaataataaaaaacaggtggatattgataaagtaatgaatcttttgaaaaaactggatgaagatgtggattatgaagttgttttaaaaacgttagataatctaattaatgttgacaaagatgtacgattaaatattggaaatgaaggatttgccaactttattggcgagggtgcaaaattcaattacaatcaagaatttatgattacgccagaattactcgatcgttttggtattagatatactacaacgatacaggaaccaggagaatgcattataaaattccccaaaacattctcttcgacaatatcattcgggtttaatttgagtgaagaagtcaatctagcaacaaaaagttggctaaattatgcattggagagtgaaaagtggttagcaaaacagaatatcatacctggatttctgacatttaaattacttgtaaaccttgcattgatgtatgaaggaggtactaacttactatttgattcagatatattctataaagcagcatcaatgtatgatcaattgtatcaagaggagatcaatcttagaaatgaagtaagaaagtttagaattaaagaagtggtagtcgacgacacagttgatatgttgtcagatgatttctttgctaacctttatccatccagaatagtggtgacagatccaaaatccaagaagtcaataattatatcaatgcaaaagttcatacaatgtcaacaacaagaacaagaagaacaacaaaattctattaaacagtttcaactagaactacagttgtgttattctgatgagaaactaaggtatttttcaagagtattgaatggttattctgttgattttgaatcttgggttactaattatgaacaattgatgagagagaattcggatattttattgaaaacatataaaggaatactaagcgatggtgagaaaatttactcatcaattgtctcatcagctgttaaacaacaagatattgatcaagaaaagtttaaa

SEQ ID NO: 5474 - DNA, 393 bp, Candida albicans
aattttatatacgtcaaagattgccaaacgtttgctgtacaccaaggtatttccaagatgctgtttgataagaggttattaactccatgcccagttttgactccaacagaccaagagtttaatgatcctgttggttatttatcaagtgacaaggtttcgaagctaggtgctacctacggcctagttaagattgtacctcctccaaattggaaaccaagtttccacatcaaccctgactttaagttccatgttcggaaacaggtactcagtgatttggggatcacaacccgatctagagattttttcagagaaaatatcaaccggtttttgaagatgagaagaaagcgccagctaaagttgtattttaatgttcaaggcaccagagtatactaa

SEQ ID NO: 5475 - DNA, 1800 bp, Candida albicans
  unsure (434),(1751): Identity of nucleotide sequences at the above locations are unknown.
tatgatttgtatagagaagttgaaaatcttggtgaaccaatggataaagaaaaatgggaaaagttaggagctcggtttggtgttaaggcatcagcattagaacgtgaatacgattctacaatcaaatattatgctacttatttgcacaccaattgcacatatgattttcctgaaagtgattcagaggacgaatacgatagctgtttggtgtgcggacaacacgaccaccctctggagactttgctttgcgacaactgtgataatccgtatcatatgaaatgtttgaacccacctttggagctgttccttggtactagctggtactgtgataaatgtttgatcgggacgggagagtatggattggacgaagattttgatgttcaagtatacgatcccgtgagtttttacaaaatgtgtcaggattttgatgccanattcattagagactacaatcagaacaaccgttgttctgtagatgacattgaaagaaagttttgttctattgttgatgccgaaaagtccgatttggaggtgaaatatggtgcagatatccataatttgcgaccaggtgaagttagtgggtttcctatggccgacaccccttcattggatacaactgaccctgccatacagtattacatcaaccacccatggaacttgaacaaattgccgttttccaatgggtcattgctcaactttatcaacacctccatatctggaatgaccataccttggatttatattgggtcgttgctatcgacattctgctggcatgttgaagatcactacactttatcggccaattactgtcattttggcgctacaaagaaatggtatggtattccttctctgtttgccgacaaatttgaaaagctaatgagggattcagctccggatttgtttaagcgacagccggacttgctacatcagttggtaacattgatgtcgccgctgaagttggtggaacatggcataccctgtgtatacgcagaccaaaaccctaatgagtttgtgataacatatcctctagtgtaccacgcaggtttcaattgtgggtttaatttcaacgaagcggtgaattttgccattgacgaatggttagagtttggggaaaaatctgttaatgactacaggccaataaagaaagaaaacgtgtttaaccattacgaattgttggagaatattctaagtcgattcaatgcaaaacacgatgtgagcttagatttggtaaagcgaagtttatggagctttgaaagatatgtttccagactagaggaattactagcacagttgaaggacaagtcaactgttgaatacaaaccctctgttgacaacaacgacgaagacgatctttgtgactcatgcaaaacccatattggcttccaatattttgttcttgaaccagaaaactctaaacaattgttgacacccgatgcttctccacaggagattgaaacaaagccaaataagaatgaggaggctaagaaggttgccaattcacaagcatctcatgatcttgccagccttaatgaaagaaaggcaatggtggacgagttcaacagtctaattgaaaaagccaaaaaagacgttgataatgacgagtcgacaaaagtacgaagatcgaaacgtattcatagtttgaaggcaacagagtttccacaacgacctacaaaacgagccaaaaagaatatcataaagaaaaaagcagcccaatcaaaactatgttcagaatgcgtttgccctatggaagngaagctgatacacggcaaactagtacttcggaaaaactctccactttaa

SEQ ID NO: 5476 - DNA, 660 bp, Candida albicans
cggatgttaaaaatattcccagatattgtagagtgtgccggccgagtcattattacaattgtaaagagcgccaactccccccatctccattacagctgcaccaataaacaacacccaccaccaccaccacacttgccagtgcaaggacttttgcctgttccagcacctccggtttcacatttttcttcttcttacaccacaccacaagccccaacattttaccacccaccttcacaacaacaacaacagactccaccaccacaaacgctacatcatcaacaaccacagccacctatttctacacacaaattcattccaatatcacctccatctgctaaaaaatatagatcggatttattgaaatcaccaccaaaacaccatcatcatcacgcaccaagggtatgcatatcgtgtgggtcagaccaatcaccatgctggagaccatcctggtctattaaacaaggacaattgtgtaattcatgtgggttgaggtataaaaagacaaaggctagatgcttaaatgacaaatgtaaaaaaatacctgccaagggtgaatggaccctcatgcaaagcaaaggaaaagagacttttgaagatggtatagagggttatagctgtattgcatgtggctggagagttgaagtacttcctaaatcttga

SEQ ID NO: 5477 - DNA, 984 bp, Candida albicans
agacttggtagctctgatgttccaaaggacccatttgattttgaaaactttatgattgctattgggcagtttcaaagacaatataagttagacaaaacgagaaagctagatatggaaacattgaacaagctattcactgtaacaaacgccaggttgttgccacaaaagaacactaattatttttattctcaagtatctacagggtctgatctcgatccccagagttttgatataatatcgcaatcagggaatccaaaaggtttagactctacctcgcagaagagaagatatgggaaagagcttaaaaagctaacgaatgtcatgaagtcgtcagttctggaccgtattaacgctgctagtgttagagatatagatgatatgctggccccatccaaggcatcatctggaaggataaggaacaaaattgctaagttggcagatacagttagtccattagacgtggaaacattggatttagagttcttggtgaaaaaacatttgaatgggaaaacgttgattcgcttgttttatggaactcaaagtagtaatacatttttatcagtggaaaaatcatctgatccacaaaacaagggccatcgccacaacttggtaaacactcataattcacatcttgcgtttccaaaaagacgagggagaacaatggtggaaaatagcagcacattgcagtacaaatttgaaagtttaagagacaaaatagcccaaactcaagagttagtaatgatcaatgatccttcaaggtactctcgtgggctaaacagaatgaagcttgggttacaaagcaaaaagaacccattgactggtggagaaaagaacagtatgctattaactcctggtggcaattattacagttcaccgatgcagacggcttctttagtggattcatttttgcaaataagtaacgacgatgcctcgggtgttgaaagtgtatgttcaaaacctaattcaatcaacagaagatcgtaa

SEQ ID NO: 5478 - DNA, 444 bp, Candida albicans
ccaactttagctgattccgataacgtcttggtgattttccaatcggctgattcctatataactccaaattactacccaggaaaaccagaaacccacaaatacgtgccaacatgggattttgcttgtgttcacatttacggaagctctaaaataatcgataattttgattttgtgagaagtcaaatcacccacttgactgatcaacaagaagccggtaagcccgatagctggaaagtttcagatgctcctgaaaaatatttgaaagtaatgcaaaaagctattgcgggcctccaaatcgaaataaagtccactcagtgcaagtacaagtttgagcaagatatgaaaagtgcagatattcaaggggttgttgatggtttacaaaaggatggtaaaagtcaaatgtctaattttgttaaagagtctaatcttacaaaaatagggtag

SEQ ID NO: 5479 - DNA, 798 bp, Candida albicans
ttcttaaacatcgaatattacattatgttgtctacaaaattcactctacggtcacataaatcatccgtagcatatatctatcaagatccaagaactcctttcaatcttttcacggcagattcttctgggttaataatcaattgggatttaacaatccgtcgacctaaaaaatcatggcaagctcatactgataccatacttacgatatcaacaattcataatcatttattaacccattctcgagataataccattaagatatgggacgagtcgtatagctgtgttttggaaataccttgcaatgcattgaattttagtaatatttgtattatatatgatttattaattactcctgcaagtatcaattctaataatttggatgtttataaaatcgataaagattggcaaattacaagattaatatcggattttgatgtttataaattagttaataaaggtgaaataatagaagaaattggatcttctggaaccagtcgtaatgattttggtataataatgcaaatgaaaatcatccacactaacaccactaccaccaccagtgagaacaattctgattatatcatttatgtgggctttgaaagtggtgatattgtagggctacagttgatattaccacgggcaagaatattatcaactacaggaaacactaatgataaaacccttattaatcaatcagcgaaatttattcttcaatatcataattcaattcatgtccctaatccattgatttgtctattgaatctagattcattgttagtatctggatcaacaactaat

SEQ ID NO: 5480 - DNA, 648 bp, Candida albicans
tatattatgttgtctacaaaattcactctacggtcgcataaatcatcagtaacatatatctatcaagatccaagaactcctttcaatcttttcacggcagattcttctgggttaataatcaattgggatttagcaatccgtcgacctaaaaaatcatggcaagctcatactgataccatacttacgatatcaacaattcataaccatttattaacccattctcgagataacaccattaagatatgggatgagtcgtatatctgtattttggaaataccttgcaatgcattgaattttagtaatatttgtattatatatgatttattaattactcctgcaagtatcaattctaataatttggatgtttataaaatcgataaagattggctaattacaagattaatatccgatctcgatgtttataaattagttaataaaggtgaaataatagaagaaattggatcttctggaaccagtcgtaatgattttggtataataatgcaaatgaaaatcatcaccactaacaccactaccaccaccagtgagaacgattctgactatatcatttatgtgggctttgaaagtggtgatattgtatggttacaattgatattaccacgggcaagaatattatcaactacaggaaac

SEQ ID NO: 5481 - DNA, 312 bp, Candida albicans
ttcagtatcggaaatgggaatgtttattgtaaattattaaaaaggtcaattgcccacaccccctatggggacaacttgaaagtcctaaaagaacggaacccccaagttgggaaaagaaaaaaagtcagtacagtatgcaccaattgtggaaaaagaaagttaagaggtgatcttcaacatccttgtaataattgtatcaaaagcaaaaaacacaatgcctgtgtatacgatgatggacaagttagtcctgcaggtttcctgaccaatggatcatcacacgggaaacactgtcccagaatcacgtccatatga

SEQ ID NO: 5482 - DNA, 528 bp, Candida albicans
agattcgatgatttattgcctgacttgtggcaaaccagttccaatgagtccgatataaagcatagttcacagagtttatttaatagtcctcatcactacttattccagcagcaacctcaacagaattggtttaacgtgtctgtttcgccagcaaactccgtgtcatctcccttgagatcaacatcaagtttatgggaagatccgccagctgaacagcaacaacaacaaccacagccaatcttctatttaccacaagacgatgacttgtttaactttgagcaagtccaccatccccaacaccacaccaagactcaaatcaatacacaattatacaagaccgagttgtgtgcttcgtttatgaagacgggagtttgtccttatgcaaacaaatgccaatttgcacatggcgagaatgaattgaaacacgttgaaagacctcccaaatggagatcgaaaccttgtgcaaactggacaaagtacggcagttgtcgttatggtaatagatgctgtttcaaacacggcgattaa

SEQ ID NO: 5483 - DNA, 1224 bp, Candida albicans
caaatgtgtaaagtggtgagtgtgttcgagaacattccaccagtattttttccaaatttatataaaaatgagataaaattttcgtttctggtatttttctttttccaccaactcatgactgccacacctgtttattttgatatttcatgcaacggcaaacccaagggccgtgttgttttcaaactctacgatgatgttgttcctaaaacagcagctaatttccgttccttatgtactggtgacaaaggtatatcaccaaaatctggtaaaccactttcctataaagactcaattttccacagagtgatcaaagactttatgtgccaaggtggtgactttaccgctccttccgaccatttgggaactggtggtgagtccatttacggagaaaagtttgaagatgaaaactttaagttgaaccataacaaaccatttttgttgtcaatggctaactctggaccaaacaccaatggctctcaattttttatcacaacagttccaacaccacacttggacggtaaacacgttgtgtttggagaagtcattgaagggaaatcaattgtacgtcaattagagagaagcgaaaagggtgccaatgacagaccagtagaagattggaaaattgctgattgtggtgagcttccagccaactatgagccggttgcactgggtgccgatgatggaactggtgatacgtacgaagagattttaaccgacaacgacactatcgacatcaacaacccgcaatctgttttcgcggctgtcagcaaaatcaaggatattggtaccaaacttttgaaagaagggaaattagaaaaatcatacgaaaagtataccaaggccaatagctacttgaatgattactttcccgaaggtttgtctccagaagacttatcaacattgcatggcctcaaattatcgtgttacttgaacgctgcgttagtggcattgaaattgaaacacggcaaagatgcaattgctgctgcaaacaatgcattagaagtagagcaaatcgacgacaaatccaaaaccaaagcattatacagaaaaggtatgggctatatcctagtcaaagacgaagaacaggctcaaaagattcttgaagaagctctcgaattagaacctaacgatgctgctatccaaaaaggattacaagaagctaaacacaacatcaagttgcgtcgtgacaaacaaaagaaggcaatggccaagttcttctcataa

SEQ ID NO: 5484 - DNA, 759 bp, Candida albicans
agatatagttttcaaccactattactacctttctattttttaaaattttttttttcaacaaaaaagccatttatgatgatgacagtgaaacaagaatcaccaaattcaactttgaatacatctgagttctcgtctgatgaaaatctcaagacaaataactctgagcctcctaagaaagtgtctaaatcttctactgggaaaagaaaataccatcaaaaatcaagaaacggatgctcgacatgcaaaaagagacgcgtcaaatgtgatgaacagagacctgtatgtggcaactgtaccaaattgaaattggattgtggttatcttcacgaacctttggagaatattttaaatacgaaaaaggatattgccaataatgaacccccatcaaagaagagaaaaagaaaagtttccactgtatcagatgcatccgactcggaatctactactcaacaagcaactccatccttgacccctagtcctaatcattctcaagacatcaaaactcagccggtgattcctccaactaatccacttagtgctttgtcttcaggacttttgagtgcaggtaatttgaataacttgaatgtggcccatttagttaataatctttctgggttaggtgacttatctaatttagcaagtcttggaaacttggccagtctatccaatttaccttcattagcacagttgcccatcgacttgataatttggggtccttttggactcccagcagcaagtaatatagctgctagtttttag

SEQ ID NO: 5485 - DNA, 1212 bp, Candida albicans
gttcggaccgtccggcccgtggtgaagacatttggtcgcactagtgataaatcgttacctaacatatcacctaatatgtccattcctgcaaatccactaagtgaccctttaactcaagggatgcggtcaaacctcaatatgcttgacttgaagttgatgtttcattacacatctgtggtggccaatactattacaggagctggtatatctgataccaatatatggaactgcgatattcccaagttggcttttgagcatccatttttgatgcattcaatacttgcctttagtgccacacatttgtcacgaacagagaaaggtctagaccaatgtgttacatgtcatcgtggggatgctttgagattgctacgagaagccgtgttgaatataaatgcagacaatactgatgccttggttgccagtgccttgatattaattatggattcgttagccaatgcctcgtttccttcgtcaacgtctccaaagtctttgccagcttctgcatggatattccatgtcaagggagccgctaccatattgacagcagtttggccattaacagaagcatcgagattctacaagtttatatctgtcgacttgggagatttaggtgacattatcaaccaaggtgtgaacatgaataagtcgaaaggaattgaccgtgaaaattcggcttattatacggatttagaatgtcacgatgcagatattgcagatttgtttccagtgcttttggactctccatatttgataactttggcgtatttgaataaattgcacaaggagagatacaagtctgactttattttacgtatatttgcatttccagcacttttggacaagcaatttatggggttgttaatgtctggagatgtcaaggccatgcggataatgagaagttattataagttgctccgctcgtttacaaccgaaatgaaagacaaagtatggtttttagaaggtgtttcgcaagttttgcctgttaatgtggaagagtacgcaggtggagccggtggtatgcatatgatgatggatttccttggtgggggtccagccattgtagatgataatgaaattgatgccgaaataaccaaattcgatcccagtgggactttaactaataaattaatagatactgataatcttccaagcgtccttaccagtaatttagacttaatgcaaggtgataatgggtttatgaatatgaaatag

SEQ ID NO: 5486 - DNA, 1152 bp, Candida albicans
aaccatattcaagacatttacaagatgaatatgcaaccatcagtttcagtaaactcaccgctatctaccatgtctaatggttcaatactgctggacattatgcctccaatacctaaacaaccaatacccaaaaaatcccaacaaattagaactgacaaacccagacctcatgtttgtaccatttgtaccagggcttttgctcgtttggaacatttaaaacgtcatgaacgagctcacaccaacgaaaaaccctatcaatgtgctgcctgtggtcgatgttttgctcgtcgagatttagtattgagacatcaacaaaaattacatacagatttaccccacgtcatacgaagaggatcttcaaaagatggtgaaataaatgaacatatcaatgtgttacacaataatactaatgccaatgctccattacctgacgggacttgcccagctgcagccttggacaatgaaaaaccagtgtttagaacctcactttttgaaaataatcctactgccggtctgcctcatggtccaacaagctctatcattattgatgatgacgctaattccatgtccaactcaccaagacctagcataacacttcatagtagtcaccaccgtgatagtgtatcttttggaccttcaaatactcctccaacaacagcaagtacagtgcttggcatgccggcacagccaacgcccacaacaacaacggcagcaacagcaaatcaaatagaggcaaaacaaggatcaagaagcaatagtcgagtaaaactgcaacaccaacaacagcagcaaccaactccggattctccacaattgaaaaaattcaaaccttcagcttctccaatgggaaatactagtggcatcccttcacatttgagcaataattatagacacgcatcttattctgctgcatcaggaccgtgctactctagtttcaaggaggctgatttttttggtatttctggtcaagttgaatttgccactcctcaatttgggccccagaatgaagattttggcaaattgttagaatcaaatggcttattagattgggattctatcgaccatttagacttgaacgatgaaggaaacttagtccttaattcaaaaattccttctactattttacatgattttcttcaccgaataacctaa

SEQ ID NO: 5487 - DNA, 2022 bp, Candida albicans
agactgaacgatgaaggaaagttagccatgaaacagaaatccatcaagaatttacatgatttcttcaccgataacctaaaagtttcgtcaatgaatcattcacaatcttctgacgtacgtttgcacaatgatatgaaccacaaaacaatcacacaatcagtgccacaacaaccacaacaacagccaccaataaagcattcactggcatcagatattacacccactttgattccaggatcacagcaggaacaacaacaacagcaacagcaacaacacctgcctccaaactcgcatctgaattctgtctcttcgaaagcaagtatcaatcctcaacatttgaaccaaaccaaaaaagcagaggaacccaatcagaatgattggttcagagatcttgttttcccgccatttgatttgaatataccgttcagcgctcacgctagttctgaagatttgaaaggtttctttggtcctacaagtttattggccgatacaaacgataattaccgtaaacagttgaatcatcaacaacaacaacaacaacagcaacaacaaatgaatggtaattacaatcataagccaaacgttactgcgaaaagtaatgggaatgaaattccactggcattgcgtactcatattaatagtgttgctgatttttcagtagagtaccctactagttttttcttggaagatgctacactcataactgaggaactccgaaataagattcttgcaatgagtaatatcgaggacaaagatttgccttcattatcggatttaaaacgttatttccaattgtatgaatatggttttaacaagtactttccttttattcacttaccttcgttgaagaactccaaaaaccataatcttgaaacagtccccttgttgttagcaattgctgctattggtgcattgtatgcttatcatgataatgatccattgatcttgtttaacttatccaaattccacattcaaaatttctttgaaaaagaaatcacattaaataatttgcatttcaaaaaagtcccaataatggctcatcaatgtcttgtgttgcatattttcatatcacttttcctcaatgaacctaatatggtggatatcacatcgagacaaatcaaatcaatgattggattgatcaagtccactaattttaatgaaccattggaaaagttgattatcccacctcaaccggcaattcctggttcagctggagataaatcattgattcaaaagaatttcgattactttattatggctcaatcaagaatacgtacattgcatgtcttttatttcttgcaagcttttagatctgcttttggtggagtccccattcttttcagcttcaatatgctaaaaagtggatcattttgtaccaatgagaaattatggtggtgtgaaggatctagcaaatggtataatttagtgggacaaacttatcctagtaaatggtcattaattgatgtgagtaatggtgccggcatagatgtgttagtgtcttttttaaatgacccaaccaatgtcaacacaccaatttcttataacaatttacttgtattgttatttaccatccacgaaagaataatcaaagctgttgataatgtacagccattcactcatttacggtggttggaaaagaaaagacctttacaagcattaattatgaattgggaagtcttattccatcaaaaccatggtagttcaaaaataattactagcaccagaggtagtcttagtgccaaacatgaattgaaattgattctccctatgcttgcattggtgaaaatgaaattggaagtaagattaaattttgctgtatcatcggttcttcaaagaaattgggttgccatgaatagtgatttggaccgattagtttatcgagaacgcaagtacaatgttttgactacttcattacctcattgccgtgatattcttgagttgtggatgcataatatggaaacaatcaactatgatgttcgagaaactgctaaacgcacaccaccatttttctgttgcacttaa

SEQ ID NO: 5488 - DNA, 1263 bp, Candida albicans
agggttatgagcaacacccctactactactactacatcacaaacatctagagataatatctcacattcaaccacatcgccagaaacatctaaggacgaaaaagatatgaagaccaaaatcaataccaaagcagaatctgaagaaagttcagcagcagcaacattaggttcaatgggtacagcaagagaacatctccatgcacaatatcaaccgtctccaccaggaccaatcccatcccatttaacttcttcgtttggaggcactgctcaccatactcagcctcaaggtccaccaccatcaacccagtatggatattctcaaccaatacaacaattacacccaattcagcaatacccagttcttaaccaagcctcgtcacagccacaaccacaaccacaaccacaagcatcatcaccatcacccatacacccggcaacacattcaccagttacaacaagtaccactcacacacctgaccaaaatggtgcttcaaaacaacgtatgagggttgttaaagcctgtgaccgttgtcgtagccacaaaatcaaatgttcaggagagtgtccctgtgccacttgtttaaaacaggcaaaagagtgcacttttagtaacaaggtatttcaaaaaagaacaaaaggtattgaattaccagaaccaaaacgtgccaaatatgctgaaccatttggattacccgaagttaaaaaagacgaccaacaggaatacattaatcatttggaaaatagagtacattatcttgaaagtttattaacaaatacctcaacagacactttcaaaactccactttcaaatgaacccgaaagtgaatttgtcactgaaacattgttttgtaccagttcaaaatggagattttccagacggcatcaaaatttacttattgctgaattatgccgatcaatgtattctaatttatctgaagaactgaaacagttagttactcttccccgataccaatattttggttggaacatgtctggtgttaaatatgtttcaagtgaagagttacctcctttgcctgatcttggtgctaaacttgattccaaatttttaactcaatattattttgaagagatcaacccgttgtttgctattcttcatgaaactgtattcaaagagcaaattgtggcatatgaaaaggtacttagagatcaaataatgttgcataaagatgatcatgattcaaaaggtaatcaaacaagattatttagtgccatgctttatcttgtttatgccttagcaataagg

SEQ ID NO: 5489 - DNA, 1110 bp, Candida albicans
ttaaaaatgctggatgttaatgatacactcaatcccggttacactcaagatggtgaaaaacgacttcgtactaaagttgcttgtgattactgccgcaaacggaaatcaaaatgtaatggagaacagccatgttccaaatgtttagataaaaataggaactgtacttatacgtttgttcaaaaagagcggaaacggaagcaacgtaaacctactgctggtgctgaaaacaagaataatggagcaattagaaaagcacggacaacaagtgcagcaacaattcgacagttgacttctcgtattaatgtattggagagtttattaggcagattgattgataaattggatcccaatgtcaaatctgagttatcagaggaattaaaatctagtccgttcactaatgaaaataatgatagtagagaaaaacacaacgggtcttcaagcaattccagtgataacggagacgaggaagagaatgatcttcaagaagcccacgagggtgatgacagtgatgataaaaataatagcgatggcagtatagaatataaccataacgatgaaaatagtaaacagattgatacaaagggctctaatgataatgaggttagaaaattaagagatatgttagcaccagcagagaagagttgtgtttccaatattaaaaatcgattaatgcaatattttggatctcatgcccttttcttttccatatctggccgtgcggttgagtggttaagatcacgagttcaaggaagcaatgccaacaatttaaatgatattttcgctcccttgagacacgttccattatcgctaaatgatgcggtgcagaaatcgacaaaattattaaatggtccagacgtggaaactgataaaaaacgacaatttgacgatttggaaaaatcgttgatatttgaaataatcgataaatattataaggatctctattgggcaccattcttgtgtgatgtgtctacaattagagaattatttcaaatttatttctatggagcacaacgaaatgatgcagccattttaggcaatattacttatagtgatttattgattatgaatattgctcttgtcttcacacacggccgctggcaggtccacgta

SEQ ID NO: 5490 - DNA, 939 bp, Candida albicans
cagctcgaagaacacgcaaattcgaaatcagttctcattatgggtcaaaaaaggaacagaatttcaaaggtttgtgatttttgcaagcgaagaaaagtcaaatgtgatcttggtaatccatgctctatgtgtgttaaatataagaagtccccttgtgtctattcagaacaacctacagaggcacccaagtctaaacagaaaaagccaagagtagttaaatcagagattaccaataataatgatacaagtagtggtgttgctagcaatggtagctcaaatagtgggtatacaaatagttctgcatcaactgcagtatcgattcccagtagcatgacatatgcaaactcttatgcgattgaatcaaataataacaacagcactggtgtcagcataaataatagtcaatcctgtcctacattgttccagagtgctacaactgttggtggaggttctgctatcgtgcacaacgaattatcgtttttgaaggaaaaactcaagtcattagaggactcgatattactgaaacaagatacactgcagggcaataataatgctgttatcagttcaagctgtagtccaaacgattctgtgcatagtcagaagccgtactttattccttcgctcacaaacacgcctattgatctgacttcgttattaggtataaatccggtggcatctgatacggaaacaatcaatttctatcgaggttataatggaactacggataaagagcctcttcagaaacgaaatcatggaccattgagttggatagccttgacaaaatcagataatgccatgagaaccctttgggctcatattcatattgtgaaggaacagatccgtgcacggatgctagctatttccgacaatgctcctcaagtagacaaagaatttacggagtcttcaccagcggtagcgatccatatttgcggttactaa

SEQ ID NO: 5491 - DNA, 789 bp, Candida albicans
  unsure (14),(28): Identity of nucleotide sequences at the above locations are unknown.
cagtcacgtatcanaaggggcgatctangtgggttgttgattacagtttatctaacaatgacacatagacaaacatcatgttctcatgcattgggacaagctatggatatggttaaatctatgggtcttggatttgcccatgacaatgccaaattttattcatcgacagcttatgaacgattaaaggcaaagagaatattttggtgtgtatttacttttgatcgtgtatttgggttgcagacgggacggtattgtggtattagagatgaagattttaataatgaattccctagttatgattttaaacatgaaacagaaaaagatgattggttgactttgccggcattgggattaatccacattgcacgagtctctaattttgttcatactgcagctacagataatcctcatttaatcaaatatcaacaagttaacgcagaattggtcaaattgcacgagtggtttaatgcaaatgggttccgaaacgacttgttttttaacaaaaagaatgattccagttcgttggtcaaagcacaagtgaaattgcattattatgatttggtcctttgtattcatagcaagattttatttaattatattgggagaagaattgcaagtcatggattaaaagttgaaatggtgattgatgcttgtaatggagttattgaagttttagacaaaaccaacaaggcaggattattgtacaccccatggtattctgttttacttttgttgtttaatgttggggtcaatgctatcacgttgattaatggtggtgcttattgttga

SEQ ID NO: 5492 - DNA, 621 bp, Candida albicans
aattcgccgtatagcaggttcaatcaaggcttaaactacaattccagactgtcaaatcaattagtgtatggcgaatcatcttcactcaatgggtcagttgattctaatgtactacgggtgaatctggggagtaattccaatcccaacgattttattacatacataatacctgattttgatgctgtaacgtattttcaaaaagattttcaagcactaaatgaatttcatctatgcgaagaatcagaagcgtctgggtttgaaatatacctcgtggagcagtggatgaatgatcgtaatattagttctgttgtcactactttcacaggtaacgaatcgtcaaaaatatcagtcgttaggtttacaatactaaaaaaaccagcaaagtattaccctttaagatttcaagagtatttaaatgaattgatacagaatcactctagaatgaaaagaatagagaaagaaaaacccacttatcagcacagtcgaaccaacagcaacagtgaaatgttgactctatcaaaactatcaacaacactgattccaaagagagaaagctccagcgactacaccagcgaggtccttttgtgcaaatttattatctgcccaaggaaggcatcgcgt

SEQ ID NO: 5493 - DNA, 1077 bp, Candida albicans
tatcataaaagttcatgcatgctggtaactactacaacaaacattataaaagcctctcccaaacggaaaacgaaaacagacaccaaagatcaagataattcttactatggacagttgaacaaacgaaatatcaataaagtcacatttggtatatacgagtttcctacatggtacggaaacgcagcatatttctatccccatgatctatcgcattcaagcttaggttatgaatatgccaacaaagtagcttctgaaggatcaattgcccgaaaaatccataaaaaagatatatttgatgaaaatttacacgaattttggctagatcatttatttgtttgtgaatattgtttcaagtacacttccaatgagacaattttgaatcaacatgtaactgcatgcacatataatagaaaaagaccaagtaaaggtaaattgttgtaccatgaccaggccaatggctatataattcgagaagtacgagggtttcaggatcctttattttgtcaaaacctatgcttgtttggaaaattgtttcttgacgataaatcggtttattataatatagatcattttgatttttatattgttttcggtaaagacgattcctcctatattcccatggggtttttttccaaggaagtcttatcgtacgacaatgataataacctagcctgtatttgtgtattccccccgtttcaaagaagacatttgggttcattgttgattgaatttctgtatcaattggctgcagttactccaggacaacttaaaagcagtggcccagaattcccactttcaccatatggcaaagtgacatatttgaggttttggtcaaaaagactagcgacgaaaatccacgaactacagggatcatttacattgagccatctttcaaaagaaaccgggttcagaaaagaagatattctactaacacttgaatacatgcagatactagttacagatgatttgggaaatgtgacactttcacttgaacgacttgaaaattggtgctcacaaaacaaggttgttcccggagtcgacataaatatcttaaattcagaatgtttaatactatga

SEQ ID NO: 5494 - DNA, 768 bp, Candida albicans
tccatgtcatcaactcattcaagaagaataaaatttgtatcgatatcagtacctatattatatgggaatcatgctattaaattaactcccgaaaaacggaaaccaacaacaccaccagaacatacacatgaatggacggtttttttcaaaccagtattgggagatattgatttaacaccattaattaaaaaagtgacatttaaattacatgaaacttatgaaaatccagttagaactttggaatcaccaccttatcaagtcacagaaactggatggggggaatttgaaatcattataaaattacattttcaacctggagttgaattaggtataaatgaaaaaaattttcaaatatttcatgctttaaaattgcatccttataatccgcaagcaccacaagctcaacaaccacaagttcaacaatcacaagctcaaccaccgcaacaacaatttggtggtgagggtggaagtgttggaactgtaattagagaaagagaaaatggagaagttcatctggtattatatgatgaattagtatttaatgaaccaactgaaaaaacatttgaaatattaacttcaaaaccagtcaatttaattccttataaattactgaatttagataaacgagatcaagaatatattcgacccgatgaaattgatgaattaaatagaatggatatttatattgacaaagtgaaacaagaaattgaaaatcaacgaaatcaatataaattactcgaacaagaaaaattagccctcctacaataa

SEQ ID NO: 5495 - DNA, 357 bp, Candida albicans
cttttccaattttttttagaagttgaactgaaagaaccaacaacagaaccaacaacagaaccaacatcaaaaccatcatcaaaaccaagatttgaagtgaaaaaatggacagcggtagcgttttggtcatgggatatgcaaattgaaaattgtgccatttgtagaaatcatttaatggaaccatgtattgaatgtcaaccaaatgctatgggtaatattccttcagaagagtgtattcctgcttggggagtatgtaatcatgcatttcatttacattgtattagaagatggttgaaaacaagaaatgcatgtcccttggatagtactaattggacttatcaaaaattgggtaattaa

SEQ ID NO: 5496 - DNA, 1020 bp, Candida albicans
atattaaatcatgcgataataaaagtgaaatcaatacgagaaagaagagaagatataaccaccattaatgatgcccttaaattaattgaaaattcaaaaaatattatggttataactggagctggaatttcaactagtttaggaatccctgatttccgatcatctcaaggattttattcaatgattcaacatttaggactttcggatccacaagaagttttcgatttagatttattcttgaatgatcctaatatattttattcaattgctcatatgatattaccaccaaatcacatttatagtcctttacattcatttattaaattattacaagataaaaatacattattaagaaattatactcaaaatattgataatttagaaagttatgctggaatacataaagaaaatttgattcaatgtcatggatcatttgctactgctagttgtataacttgtggttataaagttgatggagaaattatatttccagaaattaaaaataaggaaattccttattgtcctaaatgtaatgaagttaaacaatcaatactaaaaaagggaaaaaaaactaaatctaaatccaaaaagaaaaagaaaaagaaaaacaaaccctatgatgacgaggaagaggaagagggagaaacttattttcatgaaagttttggagtcatgaaaccagatataacatttttcggagaacaattaccagaaaatttcaaaattgctataaatcaagacattaataaagttgatttagttctagttataggtacatcattaaaagttgcccccgttgctgatatagtagggaaaatacctgaacatatcccacaaattttattaaataaagatcctataaatcattgtcaatttgatgttagtttattgggttattgtgatgatgttgctagttatattgctaatgaattacgtgaatcttgggaattacctcatcctgattataaaaaaatcccgtggagaaaaaaacggagaaaatttactggttcaattacttga

SEQ ID NO: 5497 - DNA, 1644 bp, Candida albicans
aatctgcaattgaataaaagtataatgaccatggaaaccaaaattattcagctaaaagaaccttccctgtcacttttcaaagtagaccttaatgcagtcatgacaattgctggtagcgactcttctggaggcgctgggattgaagctgatttgaaaacatttagtgcgtttggtgtttatggattgacatgtataacagctttgactgctcagaatacaacaggtgttcgaagatttgataaaactggacagaaattggcaaaggaaatcttggctgctaatttagaggatatgttgtatgcatatacaccagatactgcacccttgaaggtaatcaagacaggaatgctcacaaacgaagcaattgccgaattaattgatcaaatgcccaaaataaacgaatataaagtgaagttgattgtcgatcctgtcatgattagcacttcggggtctaaactatcagacgataatggcatgaaattatgtgttgataaattgatgaatcaggcgtttttggtaacacctaattttccagaagctatggcattgtatgagttgactgatgggactgaaagaaaaataaccataaattcaatgaatgactttatcgagtttgtaatatcactacaaaagtctttaggatgcaaaaatatactcgttaaaggtgggcatataccatttactaaaaataataaacctgtaacaaattataaccacagtaatgcccagattagagacatattatatgaaagcgagctggagagagttacggtttttcaatctgcgtatattgattccaacaataatcatggtagtgggtgtactttagcttcggctatttctgctaatgttgccaagggtttgctgttggaagattcaattttaatatcaatcgatttcatccatcgaggaatgatcagtctggcaaataagttaggattcggtaatagcccattaaaccatacagtgactcctgcccatgttgctagttctgttatcaaaacatccaacagtatgccgacaacatttttgaaccagtccggtgaattcttggattatcttattaatcatccagatgtgaacaataattggaaaaactacaccgaacacaaatttgtcaaagatctagctgaaaacaatcttccatttaataagtttttgtattttcttaagcaggattaccattatcttgtaaactatgctcaagtacacggtcttgctgcttcattggctccaacatatcaacaaacacacgcacaagcaacaattattgcggaaattgtggaagaaatagaacgacataaacagaaacttgcaaccacatacaatatcgactatgaaactgacatagatttggacttagaattatcacctggtccagcttgtatggcgtattgcaattacttacttgaagttggtaagagagaggactttttgggtgtcaaagttgctcttgctccttgtttgcatgggtatgccgaagctgctgttatgggtcaaaaaatacgtatacgtatgcaaaatgatggagtcgtcgacaatgaacaagctgcagtgtatcaatcatggttagacgattacacgtcagattggtatactcatgcggaatcagaaggaaggaaggccttaccactgttggtttaa

SEQ ID NO: 5498 - DNA, 1467 bp, Candida albicans
acgatgatactgattgacttacttgacaattcaggcactagtatgccagctgaaacatcgataaagctacatgaggtgatcaaatttatatctaaaagtaagaaaatgactgttcttactggagcaggaatatcatgtaatgcgggaatacccgatttccgttcatcagatggattatataacatggtgaaagccaaacaccccaaagcagtcgtcagaggtcaagacttgtttgatatttctatattccgagatgaaatgtctctttctgtattttgcacttttatggaatcattatacaaatcatcattgaatgctaaaccaacagagactcataaatttattaaaatattaaaagataaaaacaagttattgagatgctatacccaaaacattgattgcatagagcaacatattaatttaaaactaggtataaatttgcaagagtttgataataacaaattcaagcaagtttggaaccaattagatgttgtacagttacatgggaacttacacaaattgtcatgtactaattgtttcagtcaattcaattggaacgaggaattccaaaccttgttagccaatgggctcaatccagaatgctctaaatgcatggacaaataccaacaaagattatacctgggcaaaagactaacaggacaaacaattgggttattaagacctgatattgtattgtatggagaacatcactctcaaatggaaattttgacgcaagggttaaattctgatttgaaaagcagacctgattgtttgattattatggggaccagtttaaaagttgctggtgtcaagtcattggttaaaagtctaagcaaaattatccataacaaaggtgggaaagtgatatatgtgaataaaactaaactaagtgcaagctcatggaagaattatattgattacgaagtggtgtcagattgtgatgagtttgtcagaatgttgaaaacggagattcctgatttgtttttgacgcaagaacagttggattcagagaaattgaaccaagttgctgttaagggcagcagtttgaacaagccaatagtcaaaccagaagctaaagtcaagattgaaccaggaattaaacaagaagacgctatacaatattcacctgagagagaggtaacaattaaacaagaggtaaatatcaagcaagagccaatagtcaaacgagaggttgagagtgtgagtgtcaaagaagagccaattcccacaccgcctacaactccacacaaaccaaaacaagcaactaaactaaaaagaaagctgcctgatgaaatcagtgccaatgaagtccattcaagagttaaaagactacgtccaagaaatgatcaattaagctctcctgcttcttccataaatggaagcgaagaagaagaagaagaggatgaacctgtggctaaagtgctatttgaaaatgctagaaaaggaattactttggatcagcattaa

SEQ ID NO: 5499 - DNA, 1827 bp, Candida albicans
gaaggtaaaacacgacttttgaatattgtgatgcagttacgtaaatgctgtaaccatccgtatttatttgatggtgccgagccgggtccaccgtatactacagatgagcacttggtgtacaattccggtaaaatgataatattggataaaatgctcaaaaaattcaaagcagaaggtagcagggtgctaattttctcacaaatgtcacgagtacttgatattcttgaagattactgttattttcgagattatgaatattgcagaattgatggatcaacatcacacgaagatcgaattgaggccatcgatgaatataatgcacccgattcagaaaagtttattttccttttaacaacgcgtgctggtgggttgggtattaatttaacgagtgctgatattgtaattttatacgattcagactggaaccctcaggcagatttacaagccatggatcgagcacatagaattggtcagaaaaagcaagtcaaagttttccgatttgtcaccgaaaaagctattgaagaaaaagttttagaaagagctgcacaaaaattgagattagatcagttagttattcaacaaggtcgacaaatgaactcaaataataacgttggaaactcaaaggatgacttgattggaatgattcaacacggtgccaaagaagtttttgaaaattccaaaggaacaatgttggatgatgacgttgaggaaattttgaagcgaggagccgaaaaaacagcagaactcaacaacaaattcaataaacttggtcttgatgatatacaaaatttcacttctgatgcttcagcatatgaatggaatggacaagactttacgaaaaagggtaataatgcaagtctaggattgaattggatcaacccatccaaaagagtaagaaaggagttgacgtactccgttgataattattataaagatgtattgaaacaacctgcagtagtcaaagaaaaagttgttaaacaaccagttgtgaaacccaaggccccaaagtcgtacaatgtacaagaccatcaatttttcgccgacgaattggtaaccctacttgaaagagaacagttggcatttaaaaaggaaatcagttatcaatattctgttgatgactttggagatagtgatgaagaattccttgaacaagatgatgaagacgatatgacacgtgacgagaagcgtaaaattgcccaagaaaagattaataatgcagttgctttaactgaagaggaaattgcaacgagagataggctactcgaagagagttttcacaattggtctagaagagattttactaatttcatacacgcaacagcaaagtatggacgcaatgaatataaaaaaattgccaaagctctcggtaataaaaaacgatcggaaattgaacgatattccaagatgttttggcaaaattatcaaaagatagaaggttacgaaaagtatttatctcaaattgaagccgttgagaaaaagcgtgaaaagttgatcaatcaacaaaaactattggctaaaaaaattgaaagtcttcaagatcctttagaagatttgaaaattcaatacccaccaaacaattccaaaagagtttattccaaaacagaagataaatttttgttatactgtgtccataaatatggcttatcgacggagaatttgtatgataaaataaaggatgaaattcttactagtgatatttttaaattcgattggtatataaggtctagaactccacaagaaattggtagaagaatatccacattacttctagcgataactcgtgagaatgaaagggccatacacggaaaaaaagaaagcaatgggtga

SEQ ID NO: 5500 - DNA, 237 bp, Candida albicans
  unsure (91): Identity of nucleotide sequences at the above locations are unknown.
tatcccctacatgaaattaatttatcagggattttagccgatgaaatgggattaggtaaaactttacaaactatgtcatttttgggttatntaagatttattaggggtatcaatggaccccatttgtcatcacacccaagtcaacattggacaattggcaacgtgaatttaatcgttggatacccgatattaagttcttggtattgcaaggggacaaggatgaaagagccgagttga

SEQ ID NO: 5501 - DNA, 276 bp, Candida albicans
  unsure (255): Identity of nucleotide sequences at the above locations are unknown.
gctacaaattccagacgaagaaaaactgaaaaggaagaagatgcagaattgttacaggatgaagagcatctagacgacgaggatcaccaacatacggtaatgacagaatctccatcatatattatagaaggaaaactaagagaataccaaatacaggggttgaattggttaatatcgttgtatgaaaaccgattaagtggaatattagcagatgagatgggattagggaaaactttacaaaccatctcattcttnaggttacttgagatacattaa

SEQ ID NO: 5502 - DNA, 273 bp, Candida albicans
atatatttttttggggcagaaatgacaacaacaagcaccactaccaccaacaccaccaacggtcagttttgcctggatgagagtttagtagaaagaagtaaacggtttttattagaagtagatgcaatacacgaacgggcacacgacaaagatgatgcaaccaaaagatttcaatatttattggggttgagtgcattatttagaaaatttattaatttaaacgcctctaaagatccagcattcaagaaaagaattagggaaatagatagctaa

SEQ ID NO: 5503 - DNA, 852 bp, Candida albicans
  unsure (757),(825): Identity of nucleotide sequences at the above locations are unknown.
acaatgccaagcttagatgacatattgaaaccagtggcaaaagctgtgaaaaacggcaaaaaagttacattttttaatggtgctgggatttcgacaggtgcagggataccagatttcagaagccccgatacgggtctttatgcaaacttggccaagttgaatcttccatttgctgaggcggtgtttgatattgatttttttaaagaaaatccgaaaccgttttacacattagcagaagaattatatcccggtaattttgctccaacaaaatttcatcatttcatcaagttgttacaagaccaagattccttgaaacgtgtctatacccaaaacattgacactttagaaaggttagcaggagttgaagacaaatatattgttgaggcccatgggtcatttgcctctaatcactgtgttgactgtcacaaagaaatgactacagaaactttgaaaacatacatgaaggacaagaagatccccagctgtcaacattgtgaaggttatgtcaaaccagatattgtattttttggagaaggtttaccagtcaaattttttgatttgtgggaggatgactgcgaggatgtaaaggtcgccattgtggcaggtacttctttaactgtgttcccatttgcttcactaccaggtgaagtgaacaagaaatgtttacgggtgttggtgaataaggagaaagttggtactttcaaacatgaacccagaaagtctgacataattgctttacatgattgtgatatcgtanccgaaaggttatgtaccctattaggattggatgacaaattaaatgaagtctacgaaaaggaaaaaatnaaatacagtaaagcagaaacaaacgag

SEQ ID NO: 5504 - DNA, 795 bp, Candida albicans
accatgtcgagtccaccacctttccatttcgaaaaacagtcggtcttaccgtctagtgaccccaaatcccccttcttctgtaacctcccctcctacgaatccaaacccatcgaccatcttattgatttcttcaagtactggaagtactttatcaaagcaatcttatactactttaaggagatcgctcttgtcaaggaattggaagcaaacctaaactaccaactcatcaatgccgtccagttccctgggtttaaagatttgccaaacaagatcttacaagaaataagtgccagcaacaacgccggtgtggtatcccctaaaaacggcacgccaaccaacgaattgaaaaaaactttatcaaacaccagtattgccacaacaacctccgaaaaacgtcctggattgttcaaacaaaaatccaatggcggtaacaacccatttttaaagtctaacccattgcataaacgtaacagctcattaacatctatcaagctgcaaagcggaccaccaacaccgccaccaacacaaccatcgggattcgtattgccgccggcccccaaagctgaaccgaccaacgacgtcaaaatcccagcatcattcttcccggatgactcaatctatacaaacttcccgtcattgcttctcagttcccaccacacattgttcaacaacagttttaagctcaccaaagaactaaactcaaagctcattcccagactacagatgttattgaagcagttgtcacataagaatcaggatatcccaacttcattaaagaacgactcattcgcttaa

SEQ ID NO: 5505 - DNA, 1182 bp, Candida albicans
caagtttggaaaatccacttcaaatccgagtaccaccagttcctaaaaaccaaagtcagcaactggtcaacccacgattggcaatacttcatttcgcacaacccgtgctttatcaacaccgccgagtctaccgaagaaaacccaaaaagagaaaaccggacattcaaggcaatacaattgccctacgacaactccgtccaaaacaagtgtatacgttttgggatgatgtacaagaaatccaaagtcatgaaaagctacactcgttgctactacgtcttgtcatgtaactacctccacgagttcaagttcgacgaggatgtcaacgtcactggcaaaaaatcaaaagataagattggcggattcatcggccacgacaccgaaccaatcaaatcatacaacttgaacgagtacacaatcacccccaagaacgactcgtcatacaaattcgtattatcaaaaaacaacaccaagtccaagagaacgttcaagtgtgctacggaatctgactacaacaactggttcagggatttgtcggagttgttaaagtttggcagcgaccattacgcaaggtactcgtttatccaaaagaaagtacacctctacagagcctcaactgtgccagaaggcaaggccggtctcaaattggatttaggaaacgccctgacaccagcattgaccggtatgttcaccccaagtatcagaacccccaagcaatcgccatctgaagataacccatttgaaaatatgttgtccgatatccctactcactcaccaacaggcacaccaaaggtcttgactccagaacagtcttctaccaaccttgttgctgttgatacccaacaccacgagtacctcaaattgcaaaatgcattcttgcaccaacagcaagagttattggacatgaagatgaaggaaacaagctcgtttgacttgatccagaaaaagttggataaaatccacgaacaccaaagcccatacttgtcaacaaaagggtcatcggattcattaaactcgtttgtcatcccactgcaagctgtgcctgctgctcaacaagtcatcgacgatcatttaaagcaccattccgacaagccaatagtatttaaccttggcgaagcggcagatgccaacgccgaaggcagcacccctcctattcctactgttttgattagtgaaaaccattga

SEQ ID NO: 5506 - DNA, 1476 bp, Candida albicans
atactaattatgagtcaagcacaaacagaagtcaataatatcgagctggtcgagaatcccctgtttacaaccccgcttaaaagagattccatttcaaatggtgatggtgaccttgattcaagtacaaaccaagtagcaaacactaccttgggcagagaatcgccgttgagtgatattactgcatccccagtttcctttgatttgtcattgcgtgaagcagatggtgaaatccaaagcactattgacaatattgagaagtttttggaagaaagagaaccaattgatgaaaaccgtaacaataccaacaccaaaagcaaagagggaagcgaggaagctgacgatgcagttcaagaggttttgaaagaaatagaaacagagtttgcaaaggagttagaccacgacgataaagtacccaaagattcaaatattaccactggggatgacgtgaaaaacagagacagctatgaaagttcggagttgagtgatttagatgaaaaccaatcagaagctgaaactgataaaatggatttcttggatgaaataggaacagtgcaagacgaagatggctctaatggacaaagcaatggattgtctgacttgcaaaatttatcccaattaacagaactagccagactaaaggatgtggactctgattttggcgatgatgaggacgaagacgaacttaataatctgaacttgcattccaatggaaataaattagcaataaacggtgaatctcataagcgaacacttgaaattgacgatgaacatgaacaaaccaccaagaagcttaaggcagcaacccctgtttcagatctcaaagacaaggcacaagaagaggagcaaaaggacacaccaacagttgaaatagttgaaaacgataaaaagaaaaacaagttggacaatgatcagcaaaaaattgaactcattgtccttaaagatgaccaggaaattagcgcagaggacaatggtgctgaggcagagcctgaagatgaaggtgaagacaatgataatggcaacaatactgatgccccaaatgctgaagaggtggcgaatagtgaggctgtgcaacaaaacaaagaagatgcagtcgttattgaaaatgaggaacgagacgatgttgatcttaataaacaaagaaatctagctattcaagagttgatcgcgatagaggcgaaatttgcagaagttcgagacaaacttttcaaagacaaattgtcactattggaaaaagaattacaactatgtcttgatggctcacatccagaactatcgaaaatttatggaaaaatcaatgaattttatcaagatggcctcagattagctaatgctaacttgatgtataaattaaaatgtgtcgataaagagaccattgctactagaacttcaatacaccagaacttcttaaggaatttgatggatacaaagaatgcaatgataattcttctaccacaggggtcgggccatccgcgctaa

SEQ ID NO: 5507 - DNA, 852 bp, Candida albicans
cgttttattatacccaggtttaacaattccttacccacttccattaagtatttttatagtaacaatgatcttactgaagctaatttatctaaatttgaaacatcaagaaatagtcatggattaggtttattaagttctgccgtattatatcaacaacaaacaaacaacttatcattagccactcctccacgttcattaacttcaagaacttcttctatttcttctagttctactccatcatctccatatatgaatgatggaactgttacaaagccatcaattgaacaaccaaccatttccgaacccactccaatcacaaccacaaccacaacaaccagtaccaaatctcaagttcaaaataaaagaagacaaagattgggtccatcatgtgattcatgtcgagttcgtaaagttaaatgtgatgcagaaatccaagtcattaatgaagatgctattactactgaatattcatttgtatcatcgtcagaaattgacgaaattaaatccggtaaaagagtattattatctagtggtagtttattaacttccaacaacagtaacaataatgctaaaccaacgaaaattgaattgatatttagtcatgggaaattcattaaatttaaaagttgtcaaaattgtacttgtaaattaaatgttgattgttgttttaaaaatggttatactaaagaagatattttacttaataaaaaattgaaaaattctcaatccactgctagtggtaccactattacaaccaactgttctagtatcagtaatattactactactcctactactaccactactggtggtgctaaaaaaattatgaaaaagaaattacaaaaacattag

SEQ ID NO: 5508 - DNA, 513 bp, Candida albicans
gaggttccattaatattctttcaactaattatgttcagatcggtgtcaaaaacaataagactcattatttgggttaatgctaccaggttatattcggtatcgaatgcatctactactaccactattactactacaagttcctcaccattgtcaacattaaagttatcatcgaatggttctagagatttgtacgctatattcagattgcacaatttgccatatttagttactaaaggggataaagtttatttaccatacaaactaaaaaatgcatcagttggtgatgtgttaaatttaaatgatgtcgtgactttgggatctccacaatatacattgaatatgaaggaaggtatatctccagaattatttgatttgaaggccagtgttgttgaaatcactaaggaaccaagatatcaagttactagaaagaaacaaagatgcagaacaactaaaacgactcaagtggaaccatttcaaactgttttaatgatcaatgaattgaaattgaaataa

SEQ ID NO: 5509 - DNA, 702 bp, Candida albicans
atatacaagtacatgaatgaaaccaagacagactctacagtcaatcctgatcaatcttctcaagagttagtatttttcaactaccatgaatatttggttccaggatcagatgacacttcactagtgattaaccattttcccaacatacacactgacctttcatctagcacgtttaaagaaaccagaatcattcggattccacgtgtgtatcatacagttcaatttcctgatttgattccacagttttcttgttactacccaggttcagagcctggagcaatcactctgacacaacttatgagtggatcatttgatgataatagtttgaatgaaagctcgtcgatccctagcttggaaaacattatactgaggagtgaatttgaaaacatagtcagtctagtcaatgaatcacttgcggtagcattcaatccaatgagcaaaaggatgttgctcgaaaacttattggatctactatctggtgggttattcctaagtttattgaatttccttggaatttactcatttacaaaaagaaagctaatggaactagaaagccaaattgattccatcaaccaaattaacgaaaagaaaggtgttgattttaagattatatcaccgagagtcactggatatttatctgtatgtataaaaaaaactacaaaacgcttttcttacattgtatggagaacttctctttactaa

SEQ ID NO: 5510 - DNA, 798 bp, Candida albicans
ctagatataaactcttcaattatcattaatattagatataatcaaaaaaatcaaaaagaaaccccgggcaaacacaaattcatatccacacatatacataccatgttgagagaatataaattagttgttgttggaggtggtggtgttggtaaatccgctttaaccattcaattgattcaatcccattttgttgatgaatatgacccaactattgaagattcttatcgtaaacaatgtactattgatgatcaacaagtattattggatgttttagatactgctggacaagaagaatatctggccatgagagaacaatatatgagaactggtgaagggtttttattagtttattatattaattcattaaattctttccaagaattaaattcattttatgatcaaattttacgagtcaaagattctgataatgttccagttttagttgttggtaataaatgtgatttagaaatggaaagacaagttagttatgaagatggattagcattggctaattatttcaattgtccatttttagaaacttctgctaaacaaagaattaatgttgaagaagcattttatggattagtaagaaatattaatcaatataatgataaaattgctgaagctgaaaaacaactactactgctactacaacaactaaatgcaaatcaacaaggtcaagaccaatatggacaacaaaaagataatcaacaatcacaatttaataatcaaataaataataataataataatactactgctgttattgtcttaacagcgcccggagatcatgagggg

SEQ ID NO: 5511 - DNA, 996 bp, Candida albicans
caacgttttatccactatactataaatacaatcatgtcattactactagatagcttacatgcattaacaaagaactacgacatgtgtgtcattggctccagtaatgtcggtaaatcaaccttagtccttcattatgtgtatcatcatttcgacgaaagtttgtatgacttggatgcagtgtacactaaaagaataatcacaccagacacaaatggaaaattccgtgagataactatatttgaaagtgatttccacatagatatgtacactctaactcgagaacgacacgttttaaacgctaataccattgtcttggtgtatgccatcgatgattatcaatcattcactgcattagaagactattatgaaagaataaaccagttgagacccctgattcaaatatcagtgattgcatcaaaattagatttggataccaatagagaagtctcctatcatgaaagagcagaatctgctaaacgaatcggtgccgtttcattcaatgaatgtactcgtgcaaacgtaatgggagttaatcaagcatttgagagcattgccaacgtggctgtgaaaatacaattagacaaagataatacagtgccaacagttgataatgaaatacaacagaaagaaaatgatcaagattcgaatatcactactactcctacttccaccaccacccaatcgcaaacttcaaactacctgccacagcggtcactacaagaactgatacccgtcaacaattttacacaatatgataataacccacatcaagtcaatctgaataaaaaccaatttgatgccgaacaaaacactccattatcaacactaactcgtgaatcaacaatgttgaccagcgatttgaatggttctacacccatagcacaaacaccatctacttcatctcgtcaaagaaaaactcgattaaaacagtcatctggcccactggcaaaatccagtcaaatacatgctgaaaataaatgttgcataataacatag

SEQ ID NO: 5512 - DNA, 567 bp, Candida albicans
cgaataacaataatgctggtcaaagcccgtaagatagcagtggttggatctcgttcagttggaaaatcctccatcaccgttcgatttgttgaagatcattttgtcgaatcatactatccaactattgaaaatcagttcagtaaaagtatcaagttcaataatcaagattatgctatagagattctagacacagctggacaagatgaatttagtttgatgaatgaaaaacatctcattggaatacatggttacttgttaatctattccgtcacttctcaacaatcatttgaaacagttgaatttataagagataaaatattgaattcaatcggtaatgaaagtatacctatggttcttgttggtaacaaaaatgatttaacttatcaacgacaggttgaaactactcaaggacaagaattagcaaagaaatttaattgcaagtttttggaaacttccgtcagagaaaatataaatgttgaaaaggcatttgaaacattgattgatgaaattgaaaaaatacagaatcctccaattcaaaaacaacaagaaaaatgtataataatgtaa

SEQ ID NO: 5513 - DNA, 711 bp, Candida albicans
  unsure (686),(689),(690),(693),(708): Identity of nucleotide sequences at the above locations are unknown.
agcctattcacacacatcaatcttctgtcagatttcaatgagaggtatgtacattcaacaaaagcccgttacacttgtatttcaataaccttatatactcacttttgttttgtcacagattataaagtcgtagtattgggtgctggtggggtaggtaaatcctcaatcaccgtgcaatttgtccagggtgtatacgtcgaaagttacgaccctacaattgaagactcctatagaaaacaaatcgaagtggatggcagggcttgtgatctagagattttagatacagcaggggtggcacaattcacagccatgagagaattgtacattaaaagtggtaaagggttcttattggtgtactctgtcaccgatgaaaattcgcttaaagaattattagcacttcgtgaacaagtgttgagaataaaagatagtgacaatgtccctatggtattggttgggaacaagtgtgatttagaagatgaccgtgttttaagtatagaggatggggtgaaagtgagtcaagattggggattagtaccattctatgaaacaagtgccatgtacaaaacaaatgtggatgaagcgttcattgatgttgtcagacaaatcatgagaaaagaagccgctatcagtgccgaaaagaaacaacaaaaagaattacaaatacaacaacagcgaccgcggccagnacnnttnctaattgcaacgacntaa

SEQ ID NO: 5514 - DNA, 648 bp, Candida albicans
agcaatcacaatttttttgcacgaatcattacaaaaaaaaccaaatctaatcaacataagcaaactgttaatcaaatcatgacttgtttagatgaattggctcattcattggaatcaaaatcagacacgacaaacttcaaaacaaggaatagcaaaataaagacaattgatttatatcaacaaaatgaattactgggaaaacatcttcaagatcaagataaattttatcgattaccagcaatagatcctattgcgagagataaaaaaccttggaaagaagatatcaactatttcaataaatgttatatatcatcattagcattaatgaagatgtgtacacatgcccaaactggaggatcaattgaaattatggggatgttagtagggaaaattctgggacattctataattgtaatggatacttatcgattacctgtagaaggtacagaaactcgagtgaatgctcaaaatgaggcatatacctatatggttgaatatttaactgaacgacaacaattactgaatgggaaaaatgaagaaaatatagttggatggtatcatattcatccaggatatggatgttggttgagtgggattgatgttagtactcaaagtttgaatcttcaccaccggatggaaggaaccgag

SEQ ID NO: 5515 - DNA, 783 bp, Candida albicans
  unsure (84),(378): Identity of nucleotide sequences at the above locations are unknown.
tatagtatttttttttggtggtggattttttacttctggacaggtacttttttcttttgccacaccactatggaaagattaccnagattattaggcccaggtgccggattaggaggagcagcacccacacagagtgatgggcctgcgattgacaattcagagactgtttacatatcgtcgttggcgttgctcaaaatgttgaagcacgggcgtgctggtgtgccaatggaagttatggggttcatgttgggagagtttgttgatgatttcactatacatgttcacgatgtgtttgcgatgccgcagtcgggtactggagtttctgttgaggcggttgatgatgtattccagacaaagatgatggatatgcttagacanacgggcagagaccagatggttgttggatggtaccactcgcaccctgggtttgggtgctggttgagttctgtggatgtcaacacccagcagtcgtttgagcaattgaacaagcgtgctgtggctgtggttattgaccctattcagtcggtcaagggtaaggttgttattgatgcgtttagaacgattgacaccacgacgttaatgatgggccaagagccacgtcagtcgacgtctaatgtgggccacttgaacaagccgtcgatccaggcattgattcatgggttgaaccgccactactactcgttgaacattgattaccacaagacagagtacgagaccaatatgttattgaacttgcacaagaagaactggcagtcttcgccaggcggctggaagatccaagtg

SEQ ID NO: 5516 - DNA, 1893 bp, Candida albicans
gaatcatatttatacacctataataataccttaattaaattttaccaaaagatgtttagattaattgccagtggtgcccaacaagggttgagaccaagtttaatcctgaaagttaagcctcctaccactaccaccacaacatcaacaacatccaaattcacatcaactactcaacatttcccctttgaaaataataatttattgggttatcaagtgagaaataactcgtcacaagcaggagttgcatctgaaccaaaaatatccctcccagaaacagatgtttaccaacaaaagctactcaaatacaacattaaaaaacacgagccatatcatttaaagtttaatcctaagactaaaaaccagagaaacaacgattcagcatcaagctttagtatagatgaatttctgcaattattacaagatgaaacatttagaaaccagcttaatgaaaagcatttgtttgtttatgcctctaatctttatagtggcacaatcaacctgagaagggctagattgaacaagtccaaaaatagagataaagatcaaagatcagcattccgtgaagatatgactttacaaagtgctgttttgaatcttactgaaataatttccactggtgaattgaattctgtgttatctgcaagaactctattcaaagtttttggtactttattgcaatttaaattaaatgatgaaattgtcaacctttgggaaacaggagtcaattctgacgttggtaaattatatttggctcatgaagtgttatctattgttatccaagtgggccatgaaactagaagattcaattatgatgaaattaaacaaatttatgaaatgagtgttaaagaagacaaaacagttcatccatatttaagtgatagaatgggtcaagttgctgtcatggaaggggactatgtgactgcattggacgccttggaatctttgatgaacctttatgaacaaaatccaaatgaaaagtctgttttgggagcattagctcaaatccatttgtcatttattggacatagtaaagacttggctattgccgaaagatttttcgaaaaaggtttacaaaaagagggattgccatattctgttattatgaaggctccttatatgacttcatttttgagcaattgtattgctggtggatactcaatggaagaagttattgacttttggagacgtattagtaaacattatcttgaacaagattttgatttgatttctagtcaatctactttacacgctggatttttcaaatcatttttcgaaaaataccctgaaccatcaaaggaagccattgacttattgaatttagcaatcgaaagtgcccccaaagttaatgaagtgttattaaacacgttgatttcaaacttgccatgggcagataaagaaatttttaacaaacttctcaatttgtaccaagaaaagaatgttaccaagagtattgtctcccatcgtatcatcttgaaacagagtaaacaaattgaatacacgaatgaggaaattttacaactttggaatgaattattaggtaaattagatgaggcaggttatacttatattgctaatgcagattggtctgcattaagagcttcaactatgttctccggaaaattcagttaccaaagaactggattgtatttgtcagtgttgggtaaatataaggattacatgcaaaacaattttgctgctattcaatttttgagaaattgggtcagagatgctaatgcctacagattaattagtaaaattacgttggaagaaaacccacaatttgatggtgccataaaagttgatatccctgaatttgacagtttaagaccaaatatcaattatcgtgaggtcactaaacaagtcactgatgctgatccaagattacttgaataa

SEQ ID NO: 5517 - DNA, 2280 bp, Candida albicans
ttcatggggacatatataccaaatggtaaggatgaatgtcatcctggaaccacaaccacgacctccacctccacctccacctccaccaattatgataacacaaacacaaattcaaattcaaattcaaactcaaactcaaactcaaacccagaccccaattctttgtctacatttacaaccacgtctcctcaacatcaacaacatattcaagaatcagtaactgtaaccactcctacatctaaagtaacaatcaatccccatacaacatcaagtattgctagtcaacaacatcaacaagaacaagaattgctttcagggtatacagtaccaaatccacccatttctacacagcaatcaacggcaattgcagctgatcaagaatcaatttcgggatctgaattggataataaacctcgtactttatggatgggagatttagatccttggcttgatgaaaatgctatacaagatttatggtggagtattttacagaaaaaagtggtggtgaaaatcattaaacctaaaaatatgaaaccagatattaatttccaaggtttaactaattctggttattgttttgttgaatttgaatcatttgaagatgctcaacatgcattaagtttaaatggacaattattacctgatattgctatgccttcacaactgaatttccccaataatcctgataatcaaaaaaaatatttccgattgaattgggctagtggtgccactctttcagctcctatagtgcaaacccctgaatattctttatttgttggggatttatcggcatctactactgaagcacatttattggcatttttccaaaagaatttccccaattcaattaaaaccgttcgagtaatgacagatcctatatcggggaaatctagatgttttggatttgttagatttactgaagaactggaaagacaaagagcattaattgaaatgaatggagcgtggtttgctgggagacctttaagagttgcattagctacgcctagaaatgtggctagaaggttcaataatcgtcggttttccccgcaacaccagcaataccaacaccagcaacaacaacaacaacaacaacatcaacatcaacatcaacatcaacatcaagaacaacaacaacatcaagaacaacaacaacatcatcatcaatcagtattttcaagttatggtggaggacctaatatgcatataggaggaggagaatattttgatggtgatcccaatttatcacctttaccacaaacaggtgcaccaacggtacctccggaattaatgtttatgccacccatgggacccaatggtcaacttggaggtagtcctgtttatgggtattatgggcaaacgtctggtagtggaggaggtggttatggtggtccagaattggaacggtttagtttagatatattacaatcacctaacctagtacaaccaatgttaggacaacaacaatttcagcatcaaccacaatatcagaatcagcttcaacttcaacatcaacatcaacatcaacatcttcaacaaggacaacaatttgttgatcctaataatactactgtatttgttggagggttatcatcagatgtttctgaaccaactttgcatacattatttaaaccatttggattaatacaacaagttaaaatacctccaggtaaaaattgtggatttgtgaaatattccaatagagaagaagcagaagaagccattgcggccatgcaaggatttgttattggtggtaatagagttagattaagttgggggagagtatctgttagtaataaaaaatatcaacaacaacaacaacaacaagtagctcaagtagctcaattacaagttcaagcagcattatctatgggtatggatcctgctagtgcaattgctgctgctgcggccgccgccgccgccgccgctactgcttctggtggtggtggtggtagtggtggatatccaccaaatattccacttcaacatcggcaagttgtcccaccaccaccaacatcatcatcatcagttgtacatcctgctccaccaccaccaccatcaacatctatgagtgcaatgaatttaccaccaccaattcatggtatgaatatgaatatgaatatgaatatacctatacttcctcatattcctcaatatcaaaatattccttatcatagtcattttgtttctgatgatggtagagaatcctctggtggtggtggtagtggacataatggagatctgattccaagttttaacttcaccatcatttttaatcaaaaa

SEQ ID NO: 5518 - DNA, 894 bp, Candida albicans
ttaaatcattcacatctacacgtacacacatacacatcaccgcctcccctgctcccctgctccccttttttttttataaaaaacgacacctttattcactccaatatcatgactgaatctttatttgataccaatttcacttcagaaaacgaatctaaacctgaaccaactcaacaacaacaacaacaacaatcaactcaacaaacatctcaacaacaacaacaacaacagccatcgtcttctacattaacaacatctattgttgatcaatcttcaactttaccttcattacaagataaatccaatattgatgccttgatcaattatcgagtattagtttccgccaaagaagcaggatgtcttattggtactaatggacaagttattgattcaattagaaatgaaaccaatactaaagccgggatttctcgattaattcctggtagtcatgaacgaattttaactgttctggggaaattagatgattgtgctaaagcattaagttattttgctcaagctttaattaatgctaatattgaaagttataattatttcccccttaaacaattatcatcaactccaaatactgaagaaacaacaattttaagattattaatccccaattctcaaatggggactttaattggttctaaaggtgctagaatacaacaattacaaaataattttaatatttctatgattgcttcaaaatcatttttaccaggttcaaatgaaagattagttgaattacaaggtactgttgatgatttatatgatagtttaagaataatttcaagatgtcttattgaagatttttcttcaattgttggtaccacttattatgttcctcgtcgtaactccttcactcacgaagctgcaaggtggcgcgcttag

SEQ ID NO: 5519 - DNA, 966 bp, Candida albicans
aaagcggaacataaactaatactcaccaagtacgatatgtcagacgacggaaacgatacaaataacattcatgtggatactccagatgaaccagttttaacacctccaattgagactgtaaatcataacattacttcaactttaaagaggaaaaatgaagatgcagatgataatgaaggcaatgaacaatcggcaaacagtcattcgggcaatgataccatcaattcatcatcgatcaaaagaatcgcattagatagcgaacaattagatttacaggataaagaggaagaactacaacagacagcccccattattaccaacaacagtacaagtcatgtagagaccgaatctgaagagttggataaacagaatgaagacgccaacaagacacaagaaactcttgaaccagcgtacgcaccatcagagctggatcatgcagacgaccaaaacaccggttcatcttcctcatctaagccagtatctaaccatcgtgatagagatgatcccacatttattcagttgagaatgtattgtccagtcaaagaagctagtacgattgttgggagaaaaggagaaacaatcaatcatctaagagaaaaggcaaatgtaagaattactgttagtgagaatttaaaaggagttcctgaaagaattgttgctgtgaaaggcccagcagagaatgttgctagagcttttggattaatcaccagagtcattttggaagaaccagaggacgagcctgcaagcattaattcacaacaatataatttaaagctattaataccacatcctatgattgggttcattattgggaaacagggattgaaattcagagaaattgaagaaaattcagcagccaagttgaaagcagcagaaaatgctttaccatattctactgatcgtgttttatctgttatgggtgttggagatgctagtgctcaacacgccggtagaaggtccgaatat

SEQ ID NO: 5520 - DNA, 435 bp, Candida albicans
  unsure (353),(411): Identity of nucleotide sequences at the above locations are unknown.
atgttcaaatcttcagcatttagaacttttgtcagaaacatgtccaaatcagattcagaatggagagctattttatcaccagaacaattccgtgtattacgtcagggcggaactgaagctccatacacaggtgaatataccaataccccagcttcagatgtagggtactatgagtgtgctggttgcaagtacccattatacaaggcgaacacaaaattcaaggcacattgtggctggccagctttctacgaagccctccctggagctgtgaaaatttatagagacgaatcacacggtatgattagggaagaaatgagatgctcgaactgtgacggacatctaggtcatgtatntaaaggtgaaggctataaaacacctacagatgaaagaaactgcgttaacagcgtgtcnattaaatttaacccacaagattaa

SEQ ID NO: 5521 - DNA, 477 bp, Candida albicans
attacaattacatttacaatggcacaaggaaaagtagcaattatcatttattcattatatcatcatgtttatgatttagccttagctgaaaaagctggaattgaagctgctggaggtgttgctgatatttatcaagttgccgaaacattatctgatgatgttttagctaaaatgcatgcaccagcaaaaccagatattccaattgcaactcatgaaactttaactcaatatgatgcatttttatttggtattccaaccagatttggtaatttccctgctcaaattaaagctttttgggatagaaccggtggattatgggctaaaaatgctttaagagggaaatatgctggtgttttcgtttctactggtactccaggtggtggtcaagaaactaccattattaatagtttgagtactttggctcatcatgggattatttatgttccatttgggtatggatatcctggtatgactgat

SEQ ID NO: 5522 - DNA, 813 bp, Candida albicans
ctcatggtgcatattgcaatacttgatggagtaaaaatcattcactgttacataaccatctattccaccaccatctcaccgttcgacgactttctcacagtgttttcccacagttttagtttctttcctcttcttcttcttccttcatctttctttctttcttcctttctttcttttgcttttcaattgaaaaatttacaagcaatcatgtctaaaccaagagttgcaattattatctattctttatatcatcacgtttatacattagctgaatcggctaaaattggtattgaagctgctggggttaaaccagatttatttcaagttccagaaactttaactccagaaattttgaaattagttaaagctccaccaaaaccagatatcccaattgctgagccaaaaatattgaataattatgatgcatttttatttggtattcctactagatttggtaatatgccagctcaatggaaaggattttgggatggaactggtggacaatgggctcgtggtgatttaagaggtaaatatgctggtgttttcgtttctactggtactccaggtggtggtcaagaaactactgttattaataccttgagcactttagctcatcatggtattgtttatgttccatttggatatggctctcctcgtttagctgatttaaatgaagttcatggtggatccccatggggtgctggtacttttgctggagctgatggttctagagaagttactgaattggaaaaatcaattgctcaacaacaaggtgaagattttattaaaaccattacccaattcaaacaatga

SEQ ID NO: 5523 - DNA, 681 bp, Candida albicans
cccttctcccacttttttcctctttcatttttgggagtttcctttagttattttgcttactttcttattatttctatacaaacacacatacacacttttaataaaccaaccatgaagatcgccattatccaatattccacctacggtcacattactcaattggccaaagccgttcaaaaaggtgttgcggacgccggctacaaggctgatattttccaagttccagaaactttgccacaagaagtgttggataaaatgcatgctccagcaaaaccaactgatattccaattgctaccaacgatacattgactgagtacgatgctttcttatttggtgtcccaactagatatggtactgctccagctcaattcttcgaattctggggtgccaccggtgggttatgggctaatggttcattagctggtaagccagctggtgttttcgtctccacaagtggccaaggtggtggtcaagaaaccaccgtaagaaactttttgaatttcttagctcatcatggaatgccatacatcccattgggttatgctaatgctttcgcattgcagtctagcatggaagaggtccacggtggttctccatatggtgccggtacttttgcaaacgtcgatggttctagacaaccatccaccttggaatttggcccaccaggcggtgaaagtggt

SEQ ID NO: 5524 - DNA, 768 bp, Candida albicans
tttttgaaatatgtgctggcgacgttgccgcacttttctgtatttttttttttgaaatttcaagtactatttaagcaattcaatttcctaccatcttcttcactagaatcttggctgttgtcaatttttttttcaattcaatcatacacatatacatataaacacacaatggctccaaaagttgcaattattatttactcattataccaccacattgctcaattagctgaagaagaaaagaaaggtattgaagctgccggtggtgttgctgacatctaccaagttccagaaaccttatctgatgatgtcttgaaattgttacatgctccagctaaaccaaactacccaattgctaccaacgatactttaactggttatgatgcttacttgttcggtatcccaaccagattcggtaactacccagcccaattcaaggctttctgggatgccaccggtggtttgtgggcccaaggtgctttaactggtaaacaagctggtatctttgtttctaccagtggtcaaggtggtggtcaagaaactactgctgtcaatgctttatctgtcttggttcaccatggtatcatctttgttccattgggttacactaaagctttcccattacaaaccaacttggaagaaatccacggtggttctccatacggtgccggtacttttgctggtgttgatggttctagacaaccaaccaaattggaaaaagaaattgctttcatccaaggtaaatctttctacgaaactgtttccaaataa

SEQ ID NO: 5525 - DNA, 420 bp, Candida albicans
tcttctccagtaaagatggtttcattctcctgtgaagtttgtaacgataccgttattaaaaagaagttagatcagcatgcccagagatgtcgtggggcatatttcacctgtattgactgttccaccacattccaaggaaccgattatagaaaacacactagttgcatttccgaagctgaaaagtatgaaaaagggttatacaagggaaagaacaaacaacaacaacaacccccaaaaccatccaaacaaccacccgcaaagtctacaaaaccaaagtccactatatttaatgatgttactggatcccaaaacctatacaaagtcctaaagaaggcctcaaaagatgactccaaaaaacttaaagaaattctcaagacattgaaaattaccaaagtagatggcaaaatcgttatagaataa

SEQ ID NO: 5526 - DNA, 843 bp, Candida albicans
gctgaattgaaaacaattttaacttttggtagaatgagacaatatagaccagaagataaagtcatttctgctttaaaagaactgaaaaaattggtgttatcagctaataatgatatgattagaagaaaagatccaattaaagattttaatgaagttaaaaataccagaaaaagaaataccattcatattgagggatttcctaaagatttaagtcaagatgacgttgaaaattgggttaatgaaaaagttattgttcaattacctaaagaaaaagaagtttgttctattcgtagaattaagagtagagcaaagaaagaattctttggtgttgttgatattgaattcaaaactcaagaagatgccgaattcattttaaacaatgttgaattgtcttatcccgaaggtattatttctaaagaagatgctcaatcattagagaaaaaggatttattgaaaaaaatgacattattgactttccaagaaatgagagaaagtagtaaaagatttggtgttaatgaagtcaccaaaagacgtaacagtttcaatgaaaaccataaaggtggtaacaaaaaatttaaaaagggaaacaacaatggtaaaggtaagaataataagaatgaaaatgacaatggcaatggtactgaagataaagaaaccaaacttgaaaaagtagaagaaatagattcaactaaagaaaatacagaagaggttgctgccaaggaaacagcaccagaatccactgaaaaaacagaaactaaggaagcaccagcaccagctactgaaaccgaaactgaaactaaaactgaagttactgaagccactgaagctgctaaagaagaatag

SEQ ID NO: 5527 - DNA, 1146 bp, Candida albicans
  unsure (1091): Identity of nucleotide sequences at the above locations are unknown.
gatgagatacaattatcatctctactccaaacaatgtcagacgacgaagcctttgatattgcaggatcacttgcattgaaagatgaagatgattattctgatagttcttcaaatgaaggagaagatttccaagacgaaataatacccctggatgatgaaaaagagccatctccaccaccgaaaaagaaatctaaaccaaacccacaagctttcccatctttggaactttctgacaacgaaggcaacaatgacgacgatgacgatgatgattctaagattaacagttatttcatcaacaataatccaactgccaaaaaggccaaagcaggttcatttgcctcatttggtttgaccaagtttatattggccaatattgccaaaaaaggttataaacaaccaactccaattcaaaggaaaaccatcccacttattatggaaggaagagatgtggttggtatggcacgtactggttccggtaaaactgcagcatttgtgttacccttgatagaaagattaaaactgcgtcaacctggtggtgtgagagcagtcattttatctccctcaagagaattggcattacaaacttataaacaagtgaaagaattcagtcatggaacgaatttgcagtcaattgttttaattggtggggattctttggaagaagatttttcgaaaatgatgacaaaacctgatatcattgtttgtactccagggagattcttacatttaaaagtagaaatgcagtacgatttaatgacagtacaatacattgtatttgatgaagcagatagattatttgaaatggggtttgctgaacaattaaatgaattattggcatcattaccaagtaatcgtcaatcattgttattttccgctaccttgccaagatcattggtcgattttgccaaagcaggattaaccaacccagttttagtcagattagatgctgaatcaaaaatatcagatcaattacaaatggcatatttcaccaccaagaaaaatgaacgtgaagcaaacttattgtacattttacaagaagttatcaaaatgccattaggatcagaagcactaatcaaaaaatcgagagattnttgcataatggtgctggaaattccgcgctacagcggcggagaatgtttttcttaa

SEQ ID NO: 5528 - DNA, 810 bp, Candida albicans
aagagaattgattcagattctgaagatgacgacgacgatgaagaacgtaaaaaaggtaagaaaagatacaagtttaagaaggaaagattacctccagcaaatcgattaccatcgccacattcgactattgtatttgtaccaactaagcatcatgtcgaatacgtcaccaaattgcttagagatgctggatatttggtgtcatacatttacggtactttggaccaacatgccagaaagaatcaattgtatcaattcagagtaggattaaccaatgtattagtagtcactgatgttgctgctagaggtattgatattcccgtcttggccaatgttataaacttcactttacccgcatcgtcaaagattttcatccatagagttggtagaactgcaagagctggtaacaaaggttgggcttactcgatagtaaatgaaaaggaattaccttatttgttggatttggaattatttttgggtaagaagattttgctcacatcaatgcacgaagcaaaagtggaaatgttgaaaaaatcactgacaggtacattcataccaccagttgtgaattatactgaaagattagttttagggtcggtacctagagtagatctcgaaactttccaagaactttacgaaaatttgttacgaaataattatgaaatcaaagtcttaaaagatgttgctgccaagggggagaaactctatcatcgaacaagacaacctgcatcgcaagaatcgttaaagagaagtaaagaattaattgagagttcttgggatgatcaacatttgttatttggagaaaatttataa

SEQ ID NO: 5529 - DNA, 561 bp, Candida albicans
ataatccggatctgccactccgaggtcaagacatttgtgaatagaagaggacgtcaattagcacctattcaacgtaaggctaaagaacgtaaagagttgttagctaaggaaagattagctgggttaactcacggtattgaagatgaaatattacgtgccgatggagaaaatggttatggtgttgatgaagatgaattacaagaagcttttgaagatgccgataaaaagaaatcatttagagacccacagttcttcctcagtcattatgctccagcttccgttattcaagatcagcaattatcacttagtacttcatttgccaatgaagcacaagctgctacatttgatttggataatgatgataaaatacaaaccaataaacaagtcatgagatgggataaaaagaaaggaaaatatattaattccaaatctactgacaaaaaatacattatttcagaaaatgggacgaaaatccctgcttcgttcaggtcaggtaagtttgatgaatggagaaaacaaagaaaccttaaaccaacaagtactgttgaagacgattctaat

SEQ ID NO: 5530 - DNA, 411 bp, Candida albicans
agaccgattataatcagaccatctccagggctaattactcctacatcgactacttttgatcatgccaaaatacggtcaaactctactggtgatttactggccaactcccttgctttgtcgtcaaacaataacacccaaagcaaagacccaagaagaaaacacgtctgcaaagtgtgttcgagatcgtttactacttcaggacatttagctagacacaatcgtatccatactggagagagaaaacaccaatgtccatggccaacatgtgaagcccgttttgctcgtcaagataattgtaatcaacattacaagactcataccaatgggaaaaacaaacgcaacagacaacaacacaggactttagaagcttcacatgttggaacaaaatacaacaccaagagcctagtatag

SEQ ID NO: 5531 - DNA, 900 bp, Candida albicans
aagatcactaaatctttgtttgaccaacccactacaccacaatctaaaacatccattataatgtccacaggattactcgactcatgggcagatgccggagatgagttttcagctccaccagaagttatagccaacccagacggaaccaaaactgtgattaccttcagaaccaaccaagatggtaaaaaagtcaaaataacccaaaagataaaagaagtaaaagtacaagaaaaagtacatccattaattgctcaacgtaaaaactggaagaagtatggtaaagaaaagaactcgccaccaggaccagataccagtaccacacagttgggggaaaaagtggatttgaagttgggtacatcctggaaacaagacgaaaagaaagaagaggaagacaaagcgcacgaaagagctcaaaaaattgctgtccaaactatcaaatgtagagtgtgtggcggtgaccattacacagccaaatgtccatttaaggatactttgggagctgctgctggtgttactccaagtggcactaccccagaacctactagtgaaggtggcgccggtgcagctggtgcaggtaaatatgttccaagacacttgagagccgacgctaatggaaatgtcccaaccagagaagcaagagacgactctaccacattgaaggtcagtcaattgaactcgtttgttgatgaagatatgttgagaaacgaattgtttgccaaattcggtccattacaaagagtcactattgtgagaaacagagaaactggcgaatccagagggtttgcttatgtttcctttgcaactgaagaaattgctcaaagggccttggatacattcaatggtaaaggttaccattctttgattttgcatttggaatggtcaaagaagaagaaaacctaa

SEQ ID NO: 5532 - DNA, 1002 bp, Candida albicans
tgttatatgttgtcggttttatttgatggtttaaactgtccccaaaaaaaaaattttttttcttactatgagagagaaagaaagaaagaacaaatgaatttgaggaataataatattggttggatttacacgacgttgttgttacaaagacgtgagcaaagtgagagagatcaaaccttcatattcaatctcatctcaatcaaacgctcaatttttttttcttctctctctctttgttgtttaactaagtttgtttccttccatccaagcaagttagaaatggatatttttagaattttaagtcgaggagcttctttgaataaaaagaaaggtataactactgattatgcattaccttcagaaaagcaaactcaaaagcaaaaacacaaacaagaatcattactaaatgaagttgaaagagaaactgattttttccacacaagaaagcataatagtaatagtactactactagtggtaaaggtgataaattaacaaatggggctaatagtaataaagaagaacaaatggagacaaacgaaactaaggcaaaagaagaagaaataccaccacctgaattaactactgaagaagatgctcaaacatttagaaatttacataaatcaaaagttactggtgatgatatacctatccccattggatcatttcaagatatgattggaagattccatattaataaaaaagtattatccaatttaattgataatgaatttgttgaaccaacaccaattcaatgtgaatcgatccctatcacattaaataatcgagatttgattgcatgtgctcctactggttctggtaaaactttagcatttttaataccattagtacaacaaattttatctaaaaatgtatctaaaaatcatggaattagaggattaatcatttctccaactaatgaattggcagtacaaattttccaagaattagaaattataactcgtggatgtaaacaaatcaatgtggccatactttcttcacca

SEQ ID NO: 5533 - DNA, 609 bp, Candida albicans
cgacgcggacttcatcccgtggtgaaggagacgattttttcagccacaattccttctagtgttgaagaaatggctcattctataatgaaagatccacttcgaataattattggacataaagaagctgctagtaatactattgatcaaaaattagtgtttaccggtaatgaacaagggaaattattggctattatacaaatgattcaacaaggagaattcaaaccaccaattataatttttttacaatcaatcactagagctaaagctttattccatgaattattatatgatagattaaatgttgatgtcattcatgctgaaagaacacctaaacaaagagaagaggtcattaaacgatttaaaaatggagatatttgggtcttgatcactactgatgtgttagctcgtggagttgattttaaaggtgtcaatttagttataaattatgatgtgccacaaagtgctcaagcatatgttcatagaattggtataactggtagaggtggtaaagctggtaaagccgtgacttttttcactaaagaagatgataaagctattaaacccatacttaatgtgatgaaacaatcacgatgtaatgatggatatagt

SEQ ID NO: 5534 - DNA, 510 bp, Candida albicans
aaaaaaaaaagcacacacaacaaagtttcacctaaccaacatcattactttcaaacactcaccatacccatgtccgctcaaacagatcaaccaataacggaacaacaaaagaaagaacaggaacaatacacaaatctaataaactcattaccaacaagatgggagatcgagttagaatttgttcaatcgttgagtaatattccctatgtcaactatttagcccaaaacaattatttcaatgatgagaactttatcaattacttgaactatctacagtattggactcaacccgaatactcaaagttcttggtttatcctaattgtttacatattttgaaattattacaagatgagaatttccgtaaaaatataatcaatcaagatttcatgaattctttgatgaatgacatggttaagcgttggcaactgaatgcgaatgaccaagatgaaaataaagagaaggaagaaaataaggaggttccagaagtgagaattaatgggacaaattga

SEQ ID NO: 5535 - DNA, 1170 bp, Candida albicans
  unsure (4),(22): Identity of nucleotide sequences at the above locations are unknown.
cctncgaatctgtctggtgaangacaagtatcaacaccggccccagtagcagtaccagcaccacaacctaaccaaccacaacccccgactatgtggaatccattacattcaccacttgttagattgccatttggtcaacaacaattgcaaacagtatactcaccaacccaatcaacgcaactgccactaccaccacaacagggaccacctcaaccgcaacccgcattcccaatgatgccacaacacaatttccatcaacacaatcaatatcatccacgtccacactatagaaacaataatggtatgatgaatgttcatcgtaaaaatttgcgtagaaaagaagatagtgccaaatattctgatgcaaaattacaagattttacagggtcgatcttaactttatgtaaagatcaacatggttgtcgatttttacaacgagaattgattaatgaaacaaatgcaacgttaatattcaatgaaatttattttaaagctgttgaattaatgatcgatccatttggtaattatttgattcaaaaattgtttaccatgattaatcttgaacaacggttagttttgattaatcaatgcagtaatgaattatttcgtattgccttagatcctcatggtacaagatcattacaaaagttaattgatgtgattgaaaccaatgaagaaattgagattattactcgtaatttgtattcaaatatcgttgtattatcaagagatttgaatgggaatcatgtggtacaaaagattttaactaaattcaataccattagctctgattccaattcttcagattccaacagagatggagtccagcatcaaaaccaaaatcaattcatttttgatattattcaagccaatcttttatatattgcttgtcatagacatgggtgttgtgtattacagaggtgtttggattatgggaacaaacaacaatgtcaacaattgtcacaagagattgccaagcatactatcaaattatctttggatccatatggtaattacgttgtacagtatgttttgaacaagtatagtgttggcggtgacgctcaaaataccgataatcaagtaattgatatcattatccaagagattaaatctaatttcattcaatttcccttatccttcacctcggtagagcagagccggattattcca

SEQ ID NO: 5536 - DNA, 1749 bp, Candida albicans
ttgcatatcatgtcctttcaacaacaacaatacttacaactgaacaatttctatcacccacctcgtcattcccaaaatcactcaattaattctttgtcgtcaattatagaaccaactaccccacctaatcattcttctgccactaatggtggtaatttccaacaacagcaacaacagggtgattcccttcaaggacaactgtcgctgttaaatcagcaatctggtcttgttatcacgcctgcaactactgctacacctgcttcgacatcatcggcgtccaaatcgtcgtcattgcatgcacgtagtttgtcaaatggtgccactggttcattttatggaaataataaattgggcaatacatctactggtaacaagtcgattctttgggactcgtctaataaattgaatcaaaatttgaacttgccaaatttttcaattgacaatgaagtgttgtctactcctttagttgtaccaaatgctcaacaacaatttttgccaggtaataataataaaggtggtaacaatttgacttcatttgatgacaaggaaaatattatggtgaataagtcggtggtttcacaaaactgtccattggcttctggtgttagtactgataggtctgttactgttgctgtcgctgctgctcctatgaaaggtgaaaatgaaattgccgctagcactggatcaggtgtgtctgttgttggaacgaactctgtaactcgtggttgcacaccaacttcgtcgtcgtcaacatcatctgattttgctggcactgtgactcaaccaatcaggttcccacaaaagattgacaaggaatatcttgcgtctatcaacaagttaccattgacacaattgaagctggaaattttgaaacttgccaaggatcaatatggttgtcgtttcttacaaaagaagattgatgagagtttggttcccaactatcaagttagattggctaattttgaaatcattttcaaccaaatttattctcatgtatacgaattgatagttgatccatttggtaactatttgatccaaaaattgattgtttactgtaatgaatccaatttggatttattaatggaaatattacaatacaatttgtttcaaatttccataaatcaacatggtacaagagctttgcagaaaattattgacagtttaaataactcacatcaattagggttattaataaaaggtttaaaaccatatattattgaattgatcaaagatcttaatggtaaccatgtgattcaaaaaatattgaacaaatatgaacctccagattgtcaatttatttatgattccatcattgacgatttatatattgttgctactcataaacatggttgttgtgttttacagaaatgtcttaatcatgttacgttacaacaattgggtgaattttcaagagctattttgaaatttgaaaattttaaattgttgattaacgaccaatttgggaattatgtgttgcaatatttgatttcaatcaattcattggatattaatttccaaattttccaaaactttgtcaattttggtatttccaatttatgcaatttgaaatttagttccaatgtggttgaaaaatttttaaagaactgttatgcaaatgaatcagtcaatgtatcattttccaacttgaagtttgaattgatttacattatcttggtgagtgatttgaatgtgttaatcaatgatccccatgggaattgtcttacacgacgcgccatagacggactatag

SEQ ID NO: 5537 - DNA, 1311 bp, Candida albicans
tccactatggctgcacaaaagaaatacatttgtgccttttgtgctagggcttttactcgatcagaacataaacaacgacatgaaagatcacataccaatgagaaaccattccattgtttacattgtactagttcatttgtaagaagagacttgttacaacgacattgtcgaactgttcaccacactaacctaaaccctagtacgttgccatccaacaagtctttgaaaaatccaaccacaaaccctcttgatttatcaaataacgaaggtacaacaacaacaactaaaacaggcaacaggaaaaacaacagcaacaaaaacggtgctaagaatgacaaaagtacaaacccgaaccctgctgtaagcaatgatgataaccggtcaagtgttggtgacataactactcagcttccgtttcaagttcagttcaatactcaacttccatatcagcaacagcagcagcagcaacaacaacaacaatatccaatacttcaaaaccagggtatacctatgaagcaatcattttctatggaaagcgatcaacattcattgactacttttgattctcccacctcttctttaggtgtttcaatgacacctagtggcagtaccaacagtgagatagttctccaacaacaacaacagaccaccaaacggaggaaacggtctcaagagaataacagcaacaacaatactaaattaattgctaaagaactcaatcatgatttagtccatctactttccattaccaaaaagttaactactttattacagcattacgataatgtcaaagtgaacattactgactcatttctcattggatatgttcatatacagcaacaagctaaaaatttcaccatatttgaaaaaatattgaaagatttggtatactatttgaatacatatcatatcaataatgtacaacaacaaaatcaattcccaccaagtcaacaacagaatcattacactataaatcattttaagattggtataagttactgtgtaatcgctcttggatttttaatcgatcataaacccaatagggctattcaatttttcaaaaaatcatggaatttgttaatcaaaacattaattcctcaatataacagcaacaacaatttattagaccagattgagattttgtataatttattcttgttatgttatatctatttacaatttaatctagaaacatttgacatcaatgagaaacaacatgaacatcatagttatgaacaaggagacgagcacgaagatcatcatcaagtcttcaccacggggtcgggcatccgcgctagcgataagcgcggg

SEQ ID NO: 5538 - DNA, 1104 bp, Candida albicans
attagacaccaacaacgtgaattgacattacaaatagtggaacagtttgcggcatgggcagcaaatatgaatattaaagtggctgttgttgtcgggggtgaagatttcgttcaacaaactttggcattgcaaagaaaaccccattttgtcattgccacacccggtagattggctgaccatatcttgaacagtggagaagaaaccattagtggattaagaagagttaaatatttggtgttggatgaggctgatcgattattgagtaatagttttggcagtgatttacaacgatgctttgacgtattacctaccagtgataaacgacaaacattgttatttactgccactataacagatgctgtgagggcattgaaggagaaaccaccgactccaggtaaacctcccgtgtttatgcacgaagttgaaacagttgataaggtggctataccgtcaacattacaaatatcgtatgtgtttgttccttcttacgtcaaagaagcatatttgaatagtatattacatcttgaacagtttaaggattcaacagcagtgatatttgttaatagaacaacaacagccgaagttttacgaagaatgttgaggaaattggatttccgagtcgcctcattgcattcggaaatgccccaatctgaaagaacaaattcattgcatagattcaaagctggcgcggcaagaatattaatagccactgatgttgcctcgagaggtttggatatacccaccgtggagcttgggattaatttgatattcccagctgatcttgatgatttcattcatagagtcggtagaactgccagagcagggagaaagggtgatgccgtgtctattattggagaaaaagatattgatagaattcaaagtattgaagaaagaatcaataagaaaatggagttgttggaagacgttaatgacgataatgtgattaaagaatcattgagtgccacatcagtggctaaacgtgaatcattgatggaaatggataaagaaaatttcggtgaacgtaagaaaatcaacagaaagaaacatggactcgataaagtgaaaccagaaagagtaacaaagccaaagaaatctaagaaataa

SEQ ID NO: 5539 - DNA, 228 bp, Candida albicans
cagaatcagaccaaccttatacaacatacacaatacatttctatcacaatgtcttttaacgatttaagggtagccaagtggcttagtgaatctcttgatgctatgaagatatataaaccaacagctattcaatcagcatgtattccagcaattttgaaggccacgaatgttatgggtggtgcccaaactggttatggtaaaaccaatgcatttgcagccccaatgtaa

SEQ ID NO: 5540 - DNA, 1665 bp, Candida albicans
ccacaaaaaagatttcataccaatttgtcatctttgaatacttatttattgtgctttgttatttttcttttaaggtctacatttctaaataacttactagtaatgtcaaattatactcaaatggaccccgctaaccagcctggtggtgctcaagtggcaacagtattatgttgtaattgtggtgttccaatggatggatccctgggattagtaatgtgttatgactgtattaaattaaatgttgatataacagaaggtatccctagagaggcaaatgtgtcattctgtagaaattgtgaaagatttttacaaccacctggacaatggataagagcagaattagaatcccgtgagttgctagccttgtgtcttagacgtttgaaaggtttaaacaaagtgaggttagttgacgccagtttcatctggaccgaacctcattccagaagaatcagaattaagatcactgttcaaggtgaagccatggcaaatactattgttcaacaaacattcgaagtcgaatacgttgtgattgccatgcaatgtccagattgtgccaaatcttataccaccaacacctggagagctaccgttcaaataagacaaaaagtcccacataagagaacctttttgtatttggaacaattgattttgaagcataatgcccacgttgatactgtttcaattcaagaaaccaaagatgggttagatttcttttatgcacaaaaaaaccatgccgctaagatggttgactttttgcaagctgtcgctcctatcaaagttaagaaatgtgaagaattggtgagtatggatatacattcgggatcttcaagttataaattctcctattcggtagaaattgctccaatttgtcgtgacgatttggttgttttgcctaaaaaattggcccactccatgggtaacatttcacgtttggttttatgtaacaagatcaccaatgctattcagtttatggatcctaatactttgcagacagccgatttatcagctccagtgttttggagatctcctttcccatcgttattggatgctacacaaatggtcgagtttattgtattagatattgaaccaacaggtgacattagaggtaaatatgtgttggcagatattgaagtgagccgtgctagtgatttggggtctaatgatcaaactttctatgtccgaactcatctcggtggtattttacatccaggtgattcttgtttgggttactatttgacaaatacaaatataaattctgaattgtgggatactttggatactgataatactcctgaagttgtgatagtgaagaaacattatgcaagaaaatctaagaaatctaagaacagaaaatggaagttgaagagaatggcaagagaacacaacgatatcgttgccaatgatgatagtagacaagcaagacaagaacaagagagagccgaaagagattacgagttgttcttgcaagaattagaagaagatgatgaattaagacaaacaatcaacttgtataaggcaggtgaaaatcaaccacaagtgtccagaaaccatgacgacatgaatgacgaagatgaggatgatgacgaagatgctcctgagattggtattgatgagttattggatgaattggatgatatgacgttggatgatactccaatgaattag

SEQ ID NO: 5541 - DNA, 480 bp, Candida albicans
aaatctcggtggtgttctcatccagatgattcttgtttgggttactatttgacaaatacaaatataaattctgaattgtgggatactttggatactgataatactcctgaagttgtgatagtgaagaaacattatgcaagaaaatctaagaaatctaagaacagaaaatggaagttgaagagaatggcaagagaacacaacgatatcgttgccaatgacgatagcagacaagcaagacaagaacaagagagagccgaaagagattacgagttgttcttgcaagaattagaagaagatgatgaattaagacaaacaattaacttgtataaggcaggtgaaaatcaaccacaagtgtccagaaaccatgacgacatgaatgacgaagatgaggatgatgacgaagatgctcctgagattggtattgatgagttattggatgaattggatgatatgacgttggatgatactccaatgaattag

SEQ ID NO: 5542 - DNA, 2139 bp, Candida albicans
tctttgcttcaatacccagatcatccaactatgccatcacataatccgttggtgatatcattaccatacacattctctaaccaggatgttcccacagagatcatggctaatcgattttcggcttggagatccatcatcaaagatttagtcaactatttcaaagagtattctagtgttcaagaagaaataataagacaacaatctcgcttacaacaagcagttggacaaattacaaatactacaaacaacaatagcaactataataataatacaactcctaacagtgagattgaagctatcaataactttttcttacccataggtaacggctccgttcaagatatcccaaatgcattatttaaattccatcaaaaaaatgttgttgatggaacgaaaacgttaaaggatataaatggacttattatccctaagttggaggaattaagaaaagacttgcttgtcaaaattaaggaaattaaaaatctacaaaatgattttaaaaacaatttatccaaagaattgaatgactcgaaatctttgatcagtcaatataatcaagctattgagttagctaataaattgggtagcactggtaatttcagccatattaccactttgcatgaagccgatagtgggaaaagtgatccttatttagtaaaaattagattagaacgacaattgaaacgtcagttggtcgaagagaattatctttatgatgcatatgcaaacctacaaaatgctggacgtcaattggaatcgattgttgttttagaagtccaaaattatgtatcaatgtttttgaatttagtgaatgaggagaattcaaatttcagtcaacatttattgtcaaatattagcaatggattcttaagtaaagaatcgaattttgaatgggatgcctttattgaacgcaatttacctaatgtgaataaccatggtactatctcaagtggtacttttattgatttaaatataccaaaaagacatttatccgattttgttatcaaaaattttgattccaatttgaatgttgccattagagagggataccttgaacgaagatcgaaattcttgaagaattacactagtgcttggtatgttttaacctgtagctatattcatgaattcaaatccaatgatcgtaagaaggaccctcaacctgttatgtctttacccttggactcgtgtactgttagtgatcattctaaaaacgatggtaaattggaaggtgtttataagttcatattgacttcaaaactgcacaatactttgatgaacaagacacacaaatgggttttccgaaccaatacttatcaaaacatgattgaatggtttgatagtattaagaaaatgacaagtttacctacaccagcaactcgagcaagaaccattgaaggtggtcatggtaacagcaacaatggtaaaactaatgttagtgatataaccagtggtcattcaatttctcgtgtttcgtcaaccaatactgctcgctcaccggcaagatctttgaaaactgttagcacaaatacaacttctgcgtcccaagcatataaacatagatctttaaaccaggttagttctagtcataaacggttgtcatcgacattttctcagagaaataataatcaatcaccaagactcactaatatgatcaatagtgatggaactataattactccagttgatacagacgaagattcaacgaaacggtcaagcagaatttaccagcaacaaaaacaacagcaacagcagcaacagcaaccccaacaacagggtccatgtacaccaaatcaacagccaggtccttatcacttgatacctgttgataccatgggtaaccaacaaccacaacagcaacagcaacagcaacaacaacaatttgtgaatccaccagctggttatcagtattatattccttccaatgctcagcaaggggtacaacagttttatgatcctgttcaacaacagtattatacaatcacaccaactgtaccagttaattcaaattctagcaacaatcaacaaccacaacaacaacagcaagcacctcaaccacagtatttttcaacttcgcctcttccgacaccacaacttattcctggctctccagttgcaccagcattcggacaatacttctaa

SEQ ID NO: 5543 - DNA, 3651 bp, Candida albicans
ttcgttgagttttccgatctcttaatcacacaattgctcagtttctcttctttatttgtctctctttcaataagattacgtaatcacacgttcaactataacgatatctttaacacgctacaattcaaactctctccccaaaaaaaaaaatttttttttttgccattcaacaacttcaatttgactaacttgttcctttttttttggttttttttttggttaggtttcttcatgtcatcaacagatcacacatgtcgtatttgtcgtggtgaggctacttcatcacaacctctatatcatccgtgcaaatgtcgaggatcaataaaatatattcatcaagattgtttgatggaatggttgaaacattcaaacaaatccactgaaaaatgtgacatttgtaactccccttataagtttaaaattatttatgacccggcaatgccacagtatattccacttgatttaatttggaaaaaatttctacaaatcacatcttcaacagtattcaaatcgatttcaatatcactatatatactatgcattgttattcaagtgccattattttggaagttctccggaagagtgtatacatgggcaatagatgggacattaccgttagtgaaccagaagtttgtggatgccttgttgtttggtgaatttgatattaatacttatctagccgacaaactgcaaacaccattgcagctttccctaatgaagttgaaaaagttttttggttgcacttatttcagtggagtcagatatttatttgttgcaattgtggctaatatagctttatttattgaacgtgaatgggtggttagggacgaaggatacttgaagatgttgcataaaaaaatcggtaaggaacatagagcaaaacttgtggatatgttgcaaaatgcattacaaggtttaagaacagatggaaacaatggcgatgaagcagcagcagcaaatttacagcggttggaaacattggcgacagctataaatgatttgcagaatgaagatagagatatgaatgttgctgcccgtggagaagcagctttacgaagagccatcgatcaaaatcaactttttggaaatgagcaacaaccgattttgaaccaatttgaaaacgggattggccaacatgatgctcttccaactcataatttcgatgcgccagaaaatataatgaatggcgtttttaatggaagaaatgacattggaagtgacgacgaagaggatgaagaacaacaagaagaagaagatgatgatgaagaagctgcagtagaagaagatgtcgacgtggcagcggcagcagcagcaggtgcagatggtggtgtcgtgggcgaattcttggaagcctttggggttactctaaccttaagcacacccatttatctcatgtttctttgtaattgcattgttgctgtttacttgtttctcatttacttgatccctcacatgttggggaacactattgtttcgataactacctttttgttcaaactcatcaatgtaaccttaatatcatatatttcgaaacacattccattccccacttacatttatgaatttgcctcactgtatattacctcattgggtacatttaacccaaataaaggtgttactttgattgaaagaatctttatattaggtctcgggtatggtttaatctgtacaactatttacaggttgatgaaatttttagtatcagggccaaaaccaatttcgggcactccaaggaaggcatttaaagtattgttcgaaatcagttcaactgccaaagtgtttttaatatttgccattgaaatattctttttcccagtatattgtggctggttattagacttttgtgctgcccccttgtttgttcctcagtttattcaaaccgcagaaaacggaggcaaagttgtgacatttttagtcagttcatactttgaaatgatgcagttaccctatttgagagttttgttatattgggcaagtgggacactttacatgttgttttttgcattgtatattggtatggttagaagcacaatattgcgtccaggtgttttgtttttcataagatgtccagacgatccaaatactagattaatccacgatgccttagtgaagccgttgtcattgcaactctcacgcatttatttaacagccaaggtctatagtgcatttataatttttggaattggtggagtaacatggggattacgatatcttgtaactccaaaagacaaggattacaatgtgtttttaccaatccaaactccgtcatattttacatatctattattggcaataattgttccaacgttggttgactcgcaagcaacagtcactaaatatgttcgacaatattgggaacgagcatttgagatttcttcacataaattaagattgtctcattttatcgtggggaaacccatttcaagtgaaagaggatatgttatttataggaatatttggttacagttgtttggtctgaatgtgcaaccagattatactcaaccagtaacacgcaaagaagctttggcaaaatttaaacaggatcctaatgctgttgcattttttgtccctgatgggaactatgttagagctcccgccaacgatacgatttccagaaagtttgtgaaaaaattgtttgttgctgtatccaaagatgacagattattgcaagaagtcaaagaaacacctaaacgcagtggttatgaaacacctacttcagatgaagatgaagataccacaacaacaacgacagatgatgcttacacgatagtttatagaccaccaaatttcaaattgagatgttttgcgttaattcttatgctttggatatttgctataatcataatattacccgtgcttctatttgcggtcgttctaggacgaccaatattaagggctaatctgattattattgatcaattgccacacatcaatattgatgaattgactaacatggattggagattaacagatttggcttcaattgcaataggattggccgttgaattacaagctttgatttattatgacaagaattttgcagccgatgcaccaaacaatgcaggcggaaatgaaatccaacaagcagatccagtacgaggcatgttattgcaaggtaacttgttgaatcaagcattcaatagattacctgctcctgtgctatatactttgcctagtctgatgttgtggattatgtggatacttactgttcataaattatgtgtcgatcaaccaatacggtatatgacggggaatttgcacgttgaatttctattgaatttcaaaactttattgattcattttttggtttccttctggactattttaccagcattagtttacgtaactcgcagaatccccgtggaaggtcagactgcttggcaaactttaaaaagatgtgggataattccgtgtttacttaatttcagtatggttcacattccagcattcattgttctttatagtcttaaagtattggataaggcaaatatttctgttagtttctacatttggcctgttttattcatttgttttgctttggttaaattaattactgaaggtgcaaaattatataccaatatcaataatcaagtaaagcaagaaaaatatgttaagggtagagcaattgaaaatgttgaagatgatgattga

SEQ ID NO: 5544 - DNA, 771 bp, Candida albicans
accgtgaaagaaatctcccaggttattcacagtattgacgtggtttataggataagtagatttaatccgagactgcatagaaactgtaaatgtaaaaacgggtgtgaaaatgttttggcacttgattttgaaaacaacaaaagaaaaaaaaaaaaaacaccaaaaactttgggaatccttcttgctgtgccaaacaatttaagcattatgtctgatcaaataccagttgaaaaccaacaagttccttctgagaattcagaggaagtaaagaataaattggaagaaatggaacaagaaactgccaagttgagagaacttcattcacaattaagttcagagtctaccaatggcgtaactcatcctaccgatgaagaaaagagggacacagatgcaagatccatatacataggtaacgttgattatggttcaacaccattagaattgcaacaacatttttcaagtgccggggttgttaacagagtaacaatattgacaaacaaattcactggtcaaccaaaagggtttgcatatttggaatttgcagacactgatgcagtcaataaagctgttgctacgttggatgggtcgacttttagggaacgtcaattgaaggttctggcaaaaagaacaaatattcctggtataagtgtgaaaagaggttttcctggaagaggcagaggcaacttccgacgtggtacaggcacaggtggcacacgtggaacaagtggtttcagaagcgcaagaagcggacctacatttaacccatattga

SEQ ID NO: 5545 - DNA, 513 bp, Candida albicans
cgaaagaaagaaggtttaaaaatgtctgaagaaaaagttagagttccagaaactgaagaagagagacaagaaagattggctaaacaagaagaaatcgatggtcgttcagtatatgttggtaatgtcgactatcaaagtaccccagaacaattggaagaatttttccatggtgttggggtaattgaacgtgttaccatcttgtttgatagatttagtggattacctaagggatacgcttatattgaatttgaacaaactgaaagtgtacaaaaagccattgatgaattacatggtaaagaattcagaggtagagaattaagagttactgccaaaagaaccaatttacctggtttcagaagaggtagaggtagaggtggattcagagccagaggaagaggaagaggtggattcagaggaagaggtagaggcagaggtggttttaattccagaggcactagaaatggtgactctgaacaagctgatggtgatgccgagaatgaggaaaccgattaa

SEQ ID NO: 5546 - DNA, 1071 bp, Candida albicans
gaatggtttatggttaaaagagtaagggaaattttttatattttttatatatatatatatattttttttcaaacgtttagtgttgtgtgcgccaacctcatctcgtcttcttcttcttcttcttcttcttcttcttcttcttccttcctctttctctttctctttctctctctatttctatttctatttctatcgcaccaccaaccaaccaacaagaaatataatccccactctcaaacatgtcaacttacttattcattaactaaactaaccccatacatcatcttcatgaatacaattaaacaaataaatcaaataaatcaaaaagaattgaattctcaaacatcttataaatcatcatggcattatgattatcgtgatacaaattatttatatattgggaatattccttataatttaaccactaaagatttaattattatatttagtcaatatggtataccaactcatattaatttaattaaggataaagaatctagtaaacatcatcgaggatttggatttttaaaatatgcaaattttaaaagttgtatattagctattgataattttaatgggattaaattgggtgatcgatatttaaaagttgatcataattattataaattacgaggtgatgaaaatgaagatgattatttgattgattatgaagagattaaaagagagatggaagagaaagaaaagaaagaaaagaaagcaaagagagttgataatgatgggagattgattgaaggaaataaagaaattaaggaaattgaaggaggagaaaagaaagaagaagaagaagaagaagataatgaagaagataatgacaataatgatgacgatgaatttaaagatccaatggctcaatatttgacaaagacaaatgacaaggaaagggacgatgatgatgatgatgatgagtttaaagatccaatggaacaatttattaaagataaaaagaaaaaaagtgggaaacatagatcatctcatagatcatcacataggtcatcgcatagatcgtcccatcataaatcaaaagatcgtgaaaaaagtcctactagataa

SEQ ID NO: 5547 - DNA, 297 bp, Candida albicans
ctaaatgttcgtatagagaaagtacatgtgataacatccgatgccagatttttcgaagggatattggaagggtatgataaatcaacaaacataatactaagtaattgtattgaaagaatcatatattctaaagatgatgaagaaggggaaaatcaagaaataccattaggggtttatataatgcgtggtaatgagattgtatgtgttggagaaatagacgatgagttatacaaatcaatcaattgggaaacattaaaaggtcatgctttgaaatctacgaaaaatcctttaaagtga

SEQ ID NO: 5548 - DNA, 2289 bp, Candida albicans
gagtattttgcttgtttgtttttacgtttactaacaaaaaaatcaattgatatagcctttggtggatcttgggcagacgcagatgttgacatggcgtcaatttctgttccaattgaaaaaggatcatttcacgatggagatggattcaatcaacatcatttaggagacccagttatttcaggacctccctatattattaaattattaaacttacccgtcacagctaatgattcatttgtccaagacttgtttcaaagcagatttaccccatatgtcaaatttaaaattgtaacagaccccgcatcaaatattttggagactcatgtcattagacaagtggcttttgtggaattggaatcggccagtgatatgtcaaaagctttaaaatggcatgatttgtattataaggcaaatagaagagtaactgttgaagtggcagattttaatgattttcaaaattgtattaaattcaatcaagaacatgaacgtgaaattatgcaaatccaacaagaattcattgctcagaaacaacaacaacggcaacccagacatatggctcttttagatgaatttgaaagaaaccagcgcggtcctggatcacccttgcatcaaaaccatgatcaccacaatccccacccacaacaacaacaacaacaccatcatttcaatcctaatttaaacagaccttcaggtagatcaagtcttccaatagatgagacgtctcattcaagaagaacttcttttgaagctcaattacatcctcatcaacagacccatggacagcgtattagacaaccatcttttgacaatgcattcccagacactcctcatccaccatttggtggtggtggtggtatgcgtcaacaaatccatcctacaaaccaaccaggacttccaagtagtgctcctgcgctgaaaccttttgtaacaccaatttcgtcagccagtacttcttctagacccaaatcaaatccatttggagccgcgaaacccgttgatactttatctaaacaacaagagattgagaagaaactaatcaatttgaataaaactacagtacagactttaggagatgtagaaacccctgaagaagttcaagcaactattaaaaaatttcatgaaaatggttcaccaaaattgagaagagcttcggtaggtacaccaagaagattatcatcagaaaagagaccatcagtatcaattttaagaagagatttaccagagagacaacaaccaccaccaccacctcaacaacaacaacaacagcaacctccacaacaacaagatcagaacacaaagcaaactgcattacatcaaccagatcaactacaaaatcattcatcaaatgtttctctgacccaaccttctggagaatcacctttggcagaaactcaatcgttatcaactaacccttatacttctaatggaacaggtaaatctttagcacaattgttaagtgaacaatcagatattatgtccgctccacctataactggtaagaaaacacccagaagtaatagtaatactaaaaaaccagtagtggctgctaaacctgttattttgaagaagaaaacacctacatcaccaccagttcaaagaattgatttaacaattaaagaaagtgaatatttgaagaaacaggacgaaactgatgatttgattgatgcaaatgttgaaaccaaattggaaaaattggatttgaatagtgagacattactggaaaatggaactaaagaatcaacaaagacaagaattgataatcctaaacgagaaaatgatcaacatgatgatcgtccaaactttaaaaatttggatcaattagttcagaaaagaaatgatagtcgagcatcatcttcttcttcaaatagtagaagatttgaatttattcgaggattaaaagaagaaaatgaaagagtcccatccccatcctcctcctcttcttcttcttctgccaccaagacttcccagaacaattttgaaaaatcactggaatcagcaatttcaagaactgatgatcagcaagatttgtcttctactaacactgggtcagaaggtagaatgtgggaaagaggaagaggtagaggtagaggtggtttcagtttcagaagcagaggtggtttcagaggtagaggagctgggtttagaggtagtggtagaggtggcccaagaagaagagggggcaatggtgctagtggtgctggtggtactgctagtggtagtaccggcagtgccaattataaccttcattatgtaagatcaaaaccaactcccgttgaaaccaatgagtaa

SEQ ID NO: 5549 - DNA, 873 bp, Candida albicans
tctatctcaaatatggcaccaccactatatgtcaaagggggtgtttggacaaatgttgaagatgagatattgaaagctgccatacaaaagtatggtatttatcaatgggagagaatttcttcattattaccagagaaatctgcaaaacaagtgaaagcaagatgggttgaatatttatcacctcttctaaataaaacagattggacaaaagaagaagatgaaaagttgttaaatttacacaaaatatttcccaatcaatggagaagtatatcaaacattcttaaccgaactgcggtccaatgtgtggagcgttatcagaaactaattgatgaagctgctggaatcaaacctggagatgacgaggaaaatttgggattgtctggaccaggtatcgagacattaccggcagttggtgcttctagtggattggcagttggagaaatgaatttgaatccagaaagcaaacctgcaagaccagatgacgaagatctaccagatgatgagcgtgaaatgttggctgaagcaaaggcgagattaggaaatatccagggtaaaaaggcgaaacgaaaagctcgtgaaagaatgttagaagagagtaagcgtattgcattgcttcagaaaaggagagagttgaaatcagcgggaataaatgtgaagttaacaacacgaaataaaaagaaacggaaagaatttgattataatgccgatatacctcatgagattattcctcaagcaagtccttatgataccgcagaagaattgaaacagaatgattttgaaaagcaacaatttggccagcaagtgtcaacaaagggaattagtatgaaagatatagatgacagaattgccaaagaagaatcaagtaaggaataa

SEQ ID NO: 5550 - DNA, 531 bp, Candida albicans
cgatgggctgctgttattccaagaacttgttacaaatgtggtgaagtcggtcacgtagctgatgactgtcaacaagaagaaagattgtgttacaattgtcacaaaccaggacatgaatcaaatgattgtcctgatccaaaacaaaataccgccaaacaatgttactcatgtggtgatgtaggtcatattcaaactgaatgtccaaaccaagctcaaggtgccaaatgctacaactgtggtcaatttggacacatttctaaaaactgtgattccgctccttcctccactaacaatgctccaagcttcaagagaccttctggtagagcttctggtactacttgttacaagtgtggtggtccaaaccattttgctagagactgtcaagctaacactgttaaatgttacgcttgtggtaaggttggtcacatttccaaagattgtcactcttctgctggtggttccaacttttctgctaaaacttgttacaactgtggaaagtctggccatatctcaaaggaatgtactgcttga

SEQ ID NO: 5551 - DNA, 1233 bp, Candida albicans
gatgcaaatgtctacactaagcataattcaataccaataatcatgtctgatactgaagaacatctacaacaacaacatgtcgactctagagagttaaagaaggaaaaaaagagtaaaagcaaactgaaatcaaaaatatctgattctgatgaaatagaaatcgatttaaatgctcaaatcccactttctaaaaagcaacaacgtcaattgaaaaagggtaaattagatttagaaaaactagccagaaagaacccatcacctaaacctgaaactagtacaaatgacaacaacgaaaactctgaagatgcttctggtgtgaatctgacaacagtgacgtcaaagaaatcaccatttggtgtttggatcgggaacttatcatttgacaccacaagggaagatttgattcggtttatagttggtaaaacaactactctggatccaaaaataactgaagaagatataactcgtgttaacattccgaaaaagggtaatcaaatcaaagggtttgcatatgttgatgtaccttcttcgtctcatgttgaaactattgttggtctttcagaatcaattttgaacgggaggaaattgttaattaaagatgctaattcctttgaaggtcgtcctgaacaatccaaatcagatgcaacacaaagtggtggaatcaatagttcaaacccaccaagtcgaattttgtttgttggtaacttatcatttgatacaactgaagatttattggaagaacatttcagacattgtggggaaatagtgaaaatcagaatggccactttccaagacacaggaaaatgtaaaggttttgcctttattgatttcaaagatgaagaaggtgccacaacagcattgaaatcaaaattaaccaaaatgttaatcaatagaaaattacgaatggagtacggagaagatagatctaaaagaagaccaaaaagagccaacgattttggtgatcatagtaataataataatgatagctataaagagaataatagaactgttaacgacaaacctgaatttgattccctgaatcaaagatttgatggtaatgattcttatggtgaaagagataataaaaagagacaataccgtgaaagaaatgatggatataataagaccaacaattccaacaaacgtatgaaatcttcagttgctctagcctcggcacaaagagctagtgttgcaattgtcccatcagctggtaaaaagattaagtttgattag

SEQ ID NO: 5552 - DNA, 330 bp, Candida albicans
ctcgacgttaataatttaaaatcacatattggaattcatattcaagaaaaaccatttataggtagtaaaggtggtaaactgttggctagatttcaagacaaaaaacgtcaggaattattacatccaggtattaaaaattttaaatgtgaaggttatttacaagatggtactagatggggatgtggtaaactgtttgctcgtgctgatgccttacgacgacattttcaaactgaagcagggaaacaatgtgttaaacgattattattagaagaacaagcaaattcaagtggtaaaccacttgctactagtagtggtgttgaaattacttag

SEQ ID NO: 5553 - DNA, 1245 bp, Candida albicans
gaaatgaatctgaattttaatgatgagcaaattcagaatgttaatgaacgtgtacgtccaagattaccttcgattcaacaattgaccaatgggcatatatttcatcgagatggaaatccgtctcatcccacagatattataataccagcagtgaaaagtcctattggaggagcacaactgtcggcaatccgcatgccagaagtacaggacttgcaacaacagcaaagacgtcaaaatgtcaatgaacaattacaggctactccctctgtcaagcaaagattagtcaagagatatttttgtaaaatttgtgctcaagggtttacacggaaacataatatggtcagtcatgaattgattcattcttcgttaaagcctcatatatgtcaagtgtgtaatttacgatttcgaagaattcatgatttaaaacgacatgaaaagttgcatactggagaaaaaccttattcgtgctccaaatgtttaagaagttttgctaggcctgatgctttgacaagacatcaaaattcacaaaatgcatgtacaggatctgcttctgtaacagcaaattcaaggctggacccacagacattacaaacttcatctagcaaccaaagtgaaatcataacaaatggaaacactagtcctggtgggattaatgaaaaatctgtcgatagcaatattgccaatggatcatcggtccatataaacagttcctcaggccatcgtgaaataaataaccagcccagtcacagcaatagtttacctgttgaaaataacgagccaatttcacctcatcaacttcaacatcctcaacagcatccaccgattagacaacttaatttaccccaattgcaatcaaaatctccattcccagttaacaatacttattatcatcctcctcatgttaccccacaagctcaatcctattcccaaaattatagaacaccgatgcaaactcctcccaatggctgtcccgcaaaggtggtaatacatctaatccaaaatcggccaaattcccaaccactgtctttgccaaatcaacggccaacaagtggtgtttccaacaaatccatccttttccaccatccaaatttcacacttccacccataatttcccctattattatccaaattccgcggtttaccattatctcccccaccgcacacaacacaatcccaatggcctccctctttcaattcaacacaaacaaaattaagtccccttccttaacgtgggtactctccctc

SEQ ID NO: 5554 - DNA, 288 bp, Candida albicans
attatggatatagaaaccactaaagaaagaagaagaaaagtatccagagcttgtgattactgtaagaagcgaaaatacaaatgcagtgggattgcaccctgtaatttatgttcaaagaaacaaattgactgtatttttagtattgtggacaaacggacaaccaaggggtcgaaagtttacaagccatcttcgatagagattctttcacataataacttagcccaacgaaacagtcttattactgatgatattcaaaacaaaataaacaaacactctcgggccccagtt

SEQ ID NO: 5555 - DNA, 1632 bp, Candida albicans
tacatcatggcggtagcagaaatcaaaaaagaaaagggttccagcttgtcgcctgaaccttcttcgcctattcaaatactaagcactgaaccagatgcaaatacagatattaagcaggagaaatttacaccaaaagatatattaccaggatgtaaagtacatgtttccaaagatggagaattcaggctagcagaaattttacaagagcatattaaaaagggtcgtaaggtattctatgtgcattaccaagattttaacaaacgtttagatgaatggattgaactcgacaggatagactttactcgaagtcttattttaccagaaataaaagcagacacaaaggaaaataaactgaaaaagaagagcaaatccaaaggacagacaaagttgtccaaaaataatactactgccaatagtacaaccggtaccccacagccaagtgatggacaacctattatgggagatgatgaaatggatttggaaaacttgaatgtccaaggtttgaaacgcccgggagaagaattcagcagagaagatgaaattaaaaagttacgtacgagtggttccatgacccaaaatcatctggaggtggcaagagtaaggaatttgtcaacgattattttgggtgaacacattatcgaaccttggtatttctctccataccctattgaattgacagaagaagatgagatatacatttgcgattttacactatcctattttggatccaaaaaacagtttgagagatttcgttcaaaatgttcaatgaaacacccgccaggtaacgagatataccgagattcgaaagtcagcttttgggaaatagacggcagaaagcaaagaacatggtgtcgaaatttgtgtctattaagtaaattgtttcttgatcataagacattgtactatgatgttgatccctttttgttttacatcatgaccatcaaatccgaccaaggtcatcatgtcgtggggtatttttctaaagaaaaagaaagtgcagatggatataatgtggcgtgtattttaactctaccctgctatcaaaaaagagggtttgggaaattgttgatccagttttcatacatgctaacgaaagttgaaagaaaagtaggttcgccagaaaagccattatcggatttgggattgttgtcatatcgtgcctattggacagacacattggtaaagctattggtagaaagaaacagtcctgctttattccgtaagaataattctcagttagagtacgatgaagctgaaaatggcaaagacagctctgcaacaccaacaccggggccaggttcaaatgcctcccaatcatctatattggctagtgctgctgcatcaaggctgggacttaattcatcgcctattttttctaatgaaattaccattgaggacatttcatccataacatgcatgaccacgacagatatactacacacattaaccacattacagatgttgcgatactacaagggacaacacataattgtgttaaccgatcaaataatggaattgtatgaaaaactagttaaaaaggtaaaagagaaaaagaagcatgagttaaatccaaaattattgcactggacaccacctctgttcactgcaaaccaattacggtttgggtggtaa

SEQ ID NO: 5556 - DNA, 795 bp, Candida albicans
cttaaattttcaaaaacaacaactacaacaactataattaataatactatctcgatatatatcatgtcagggacatcacaagtacttcaaaacgattcccatcaatcacagcacgcatgtatggcttataatcaaagacaaccaatgatgtatccaccaccacaacaacaaccacttcattcacaaaatagtttacctccattgccaccaatacctgctccatctttacctcctatatcaaataatatatcgaatggtaatactaatgaattgaataacaacaatcagcaacaacaacaacatggacagccaccacttccaccaccaccaattaatgcaaatcaacaatattatgccgtgcctcctttacgtgcaccacctccattgaatactttatcatcagtagtaaattctttaccaacactaacgccgacattaaccaatgctacacattcgactatgtcatctaattcatcagctgaatcgtcggcatcaagttcatctaattcaataactaaacctaaatcaaaaagatcaagtaaaggtagagtatttcaatgtactggatatcctggttgtaatatgtccttcactagaagtgaacatttagctcgtcataaacgtaaacatactggtgaacgaccttttacttgtccttattgttccaaaaatttcagtcgtttagataatttacgtcaacataaacaaactgtacatgcttatgaaacttatttaactaaggataatcgtgatagtaaattattaattgaacgatctaaactgaaaaagaaattg

SEQ ID NO: 5557 - DNA, 402 bp, Candida albicans
tatatgtctaccatgagtactcaaaaagcaaatagttccacaccaggggagactgattcttcatcaagtttaccacctccggagataacagaacccacctataagaagcccgaaaaatcgacaaaaaggaggaaaaagaagttggaaattgcatgtgtttattgccgccgatcacatatgatatgtgatgaatcaagaccatgtcaacgatgtataaaaagaaggattgcccatctttgttatgatgaaccctctaactcgcgacaacgtaaaaaggcgggcgctttaagaaagactcagagtgaaagggcaccaatggtgacatcaccaataacgcttcctttgaacggggtcaacggggaaacaactgccgttaccgttgccaccattacaagcatctca

SEQ ID NO: 5558 - DNA, 1185 bp, Candida albicans
cgtggatcttccaggcccggggtcgaagaccaacagccacagccacagcctcaatcaaggttaataaaaaactcagtgctatcccagactttgccttacaatcaacaaccattcttctactcagaacatgcaaatagtgagtttagttctttgaatgactttttgtcaatgattgatgacccggagttagtcaacggggctttaaatgatgatacagatggacttttgaattttggggttggtaacaacaacaatagcggtggcagcaacagcaatattaacaacactcacaacaacaataataacgggtttagtattagcggcgggaatagcacgactaacttgaatgcagttttggcgtattcacctaattctaatttgtttccaccaacttttggtaatgaagcggattcaactcaaatccaatcacaacaacaacaacctgaattgacacaacaaccccctgcattgaacccagtgaaggttgagcctcaagctgagaagactgaacaacaacctgtgatctcagattctgcaagagataagttctttcttacagcagctgaccctactactgagatttcacctgaagaacgattgaaacaagttattaaggcaaaattggaggcaggtttactacaaccgtacaattatgccaaaggctacgccagacttcagagatatatggacaactatatgaatatatcaagtagacaaagaattctaaagccactatcaatatttcgaccggcttttagggcaattgcacgtacattgaaagatgtggatttggttttggttgaagaaagttttgagagaatgttgttggattatgatcgtgtttttacggcaatggcaatacctgcttgtttatggagacgtactggagagatatacaggggcaataaagagtttgcctcgttggtaggtgtgaccacggacgatcttaaggacgggaagttggccatctatgaattaatgagcgaggaaagtgccgtcaatttctgggaaaagtatggtgcaattgcttttgataaaggtcagaaagcggtcttaaccagttgtaatttaagaactagagatggtattaaacgaaaaagttgctgtttcagctttactataaggagagatagatacaatattcccagttgtatagtgggtaattttatccccattgatccttag

SEQ ID NO: 5559 - DNA, 1143 bp, Candida albicans
tatgctgttttcccaagttcaaacaactttacctcctcagtttaccgagtatccacaacaagctttcgtacaacaaacttatcaacaacaacagcaacaacaacatttgcaagctcaacaagcatttcaacaacaccaacaacttcaacttttgatgcaacaatcagggcaacatcaacatcaataccagccacagccacagcaacaacaacaacaacaacaacctttttctttccactcagcttaccagttctccaacaacaacaggtttatgcccaaccagtgaatcaaagtgaaaactattacatacaagcacccagaggatacggttattcttcaagtctttcgtcaaataccagcaatgcaagtgtacaacaatatcctttgaatgaactaagacaagcaaatgtacattcaattactcccgaaaaacaaagcattaatttcaattctgaaaactacaattatttggttccatctttacccccattgaacacaattgggggcagtactggatcacatactcctcaacaacaacatcagcaacaaccacaagtctataatacttctccattgtctgctacttatgtgcacgaaaatgcccaatacgtggtaccatcggtagacacagtcagaggtttccctgctcgtggagggattgttcctaaaagaggtagaaaaagaagacacactgctactgttcacaacatgactcctgaaactgccgaaagaaacagatgtcgtatttgcaacaaacaatttaaacgtccatcatcattacaaactcattattattctcatactggagaaaaaattttcaagtgtccttgggatggctgtggaagattgttttctgttaaatctaatatgacaagacattatagattacatgaacgtgatttcaaaagagctcaagatcttcaatttggaccctcccaaccacaacaaccaccacaaccaccacaacaacaagtaactggtattgcagcttctcatgctccaaccacagctctacaacaacaagaaccatttaataccaataatcaaaatttgggatcaagtgattctgctgccaaatcacaatatccttcttatttatcatcttcaaatttacctacaactgataataacccatccatataa

SEQ ID NO: 5560 - DNA, 2001 bp, Candida albicans
aaccaagggaggagacagatttcaagggaaatataccctgatcttgatgaaacttgccaacttcctgtatttgtcatcgataggaatactaattcagaggaatcctccaacttacgtcatgcagtgaacttatctgaactcaaagcgcctacgtatagacgagtcccacagttgagcttaacacccacaaacctacgattcagcaagcaattatcggagtatggatttcaaaacccatccaagttaacaaacaaaccaaatccagatacatacattagaccattccagctcaatgcatcacttagggaaacgacggcatcaattgaaaagttcattgagaaaaagaaaaatctagtggaatatgatatggatgaacaggactatttgtttttgcaagatcgaaacaaccagcccgaaaatgttattaaaattacaccagaagttttcgaaatcatgatgacgtctttggagaatcaatggtgtgcattagaattgaaaatgaactccattacgacgaatgtggggagcagtactagtgatcctggatcgaaccacaaattgctcactataggtcacaataatgccaaatacggaaatgatgatgggattgttcctgggtccatttatgatcaaaaatgtgctatttgtaatgatagtgattgtgataatgccaatgccattgttttttgtgatgggtgtgacattgcagtgcaccaggaatgttatggggttgcatttattcctgaaggtcagtggttatgtcggaaatgtatgattaataaaaaccgaacaacagaatgtgtattttgtccaagtacgactggtgcgttcaaacaattggataacagcttatggagtcatgtaatttgtggattgtggattaatgaattatattttgccaatccgatttatatggaacccattgaagggatggaaggaataccaaaaagccgatggaaattgacttgctatatatgcaagcagagagtgggtgcttgtattcagtgttgtaaccgaagttgtttccaagcataccatgtaacttgtgccaaacgtgctgggttgtatatgagtatgacgcagggtatcaaaggcgcaataagcaataaattgacattaaagtcgtactgtgagagacacagtcccgctgagtttgatgaaaccaaagtgctagatggtataagaagaactaggttgtattatcgcgatacaaagttattgaatgaggagaatgcacgattgagcaaagatagagaaactgcaaataaattgaatatcttcaaatggaacacggaagctaacacaccaattgcccctaaattatttagcgacgttctagtccagatactatatcagttgaaagtggaaaatcaaataagtttacctgaggaatcgacgaacgaggtattgcatttgaaggttttgcccaatcgaaccaagatggagattttgcaagatttaaggtcaattgccgatgaagtgtgtcgatattggtgtttgaagaggaaactgaaacgaggggcatctttgattcgcaaaaacaataatttgatagcaacaagctcaatattatatgattctaactctcttgaaaataacaatgcttgtgaactgacaaagaaaatagaatttgctgaatcgttggtaagtgatattgatagactaatttctatgggtgaaatgttaacagacgaacaagaagcaaatcatgaaataaatctggtgagttttgatgttgttgatctggtatactttcctttgaaacaacttattgagttgacaataatgcgtctaaataataaatttgatttcaatgaaactttacgaacttacaaacccaaatcagatgctgttatttctttaaattctatttcgggaaagaattcacaatatgggtaccaatcgatagatcagctcgagcaggatgtcgaaaatttgcgagaatacatattccaagagaacaagccttcttacaccgaagggcctggaaggaaacgcact

SEQ ID NO: 5561 - DNA, 774 bp, Candida albicans
atatcaagcatttatggggaaaagtattacggtacgaagtacgaggcagtgaaagaggaagatggtcgggatggcggacttgaagctgactctgatggttcgatagaagtggtcaaggtagagaagatccaacgcaagtgtcgcaagagaaaacaagacaatgtccacattacaaatacacatgagagtgtgtccaccaagagaccacacaaacaaccagacatccctcgtgaatgtgctctttgtcccaacacactccaacaaacaaaatactcccattccgctttattcgagttgctacaagctgatacgtatggcacaacacctgagaggccccgtcgagtgcacaagatatgtgctagtatgttccctcatcaacttaagtgcgacttcaaaaccaacacagtacacgggctagacgatattaccaagaaccagaagaaactacgctgtggtgtttgtcgtcagagtgagatgggagcatgtttccaatgcagttataagaaatgcactcgagcatttcatggaagttgtgggttggttgatggagttcagtatgattttgattctggagaagcattctgtaaattccaccgccagggccccacatcagcagagttcaaagttggaatgtatgtgcagtttttgttcaaccacggagtatattttggacaattagtcaatttgggagatggggatgttgaggttgaggtgtatccttctgctcaagatgtcattgaaataccaacgacaagcataattaatgttgtataa

SEQ ID NO: 5562 - DNA, 657 bp, Candida albicans
aatcaacacatgctacagctgaatccagtaatacatccaaatacatcaaacagacattttaagtttgaaccatttttacgtcaggaatataattttggtcttgatcctgatcgtccagtatgtcaattctacaacccattaaatcctgacaattcttgtccccagggcaacaactgtcctaataaacacgtatctgcaatgtattccaataagattgtttgtaaacattggttaagaggattatgtaaaaagggtgatcattgcgagttcttacatgaatacaatttaagaaaaatgcctgaatgtttgttttattccaaaaatggctactgtactcaaacatcagagtgtttgtatctacatgttgatcctcaactgaaaataccagaatgcttaaactataatcaagggttctgtagtgaaggtcccaattgtaagaatcgtcatgtcagacgagtgctatgcccgttatatctttatggattctgtccaaaaggccctgaatgtgaatttactcatcccaagtttgatttccataatttgaatttaagaattagacccgataatttgatacaaatgacaagtaaacatgtggataattcaaaggaagaatcagataagaaagaagattcagaaccgaaggaagaaagtatatag

SEQ ID NO: 5563 - DNA, 1620 bp, Candida albicans
atgaaatttttggtgatgacgatgatgaatgagaaactaaaaagagaaaaaaaaaaaatttttggtgttatcactccctttcaaaagtatttatatacaccaagaattatcaacacagtacaccttatcatcatgtcttctaaaggaataactaaaaagaaagtcaaatctttgaaaaatttagattataccaagaagttggctgaaaaaatcaaacaacaagcattacagaaacaacagaaacaacagaaacaacaagaacaagaaaatgcaaaccacaaccaaaccgaatcatcattatcatcatcttcttctaccacctcttcctcaattacaacaattgatccagatgcagaattaaaatttaaaacatttaaagaattaaatttagttcctgatttattagaatctatcgaatcaatgaaattcactaaaccaacaccaattcaatcagaagccattcctcatgcattagaaggtaaagatattattggattagcacaaactggttcaggtaaaacagcagcatttgctatccctattttacaatcattatggcatgctcaacaaccttattttgcattagttttggccccaactagagaattaacttttcaaattaaagatacttttgatgccttgggaagttcaatgggattacgttcaagttgtatagttggtggtatggatatgatggatcaagcaagagatttaatgagaaaacctcatgttatagtggctacaccaggaagaattatggatcatttagaacataccaaaggattttctttaaaaaatttgaaatatttagttatggatgaagctgatagattattagatatggattttggtcccgcattagataaaattttaaaagtaataccaattaaacgtacaacttatttattttctgctactatgactaataaaattgaaaaattacaacgagcttcattacataatccagtaagagttgctgtttcatcaaaatatcaaactgccgataatttagttcaatcaatgatgctagtgaatgatggttataaaaacaccattttaattcatttattaaatgaattcatggggaaatcaatcattgtattcacaagaacagtagctcatgctcaaagaacagcattattggcaagaattttgggatttaatgccgttccattacatggtcaattatcacaatctcaaagattaggctcactaaataaatttaaatctaatcaagcaaatattttggtagctactgatgttgctgcaagaggtttagatattccttctgttgatgtagtaataaattatgatatccctactgattcaaaagcttatattcatcgtgttggtagaactgctcgtgctggtagatcggggaagtcgatttctttaatcactcaatatgatttggaaatgtatttacgtattgaaagtgttttaggtaaaaaattgcctaaagaggataaaccaccaaaagaagtattggatgcattacatgttcatgttgataaggcaacagctgaagcaattagacaaactaaagaaattcatgataaaagaaatggtggtggtggtagaagaagaaatagagatgatgccgatagagaagaaagataa

SEQ ID NO: 5564 - DNA, 648 bp, Candida albicans
tacatcttactcttcacaactgtttcttaccaacaacaaaaaatggcaaagacaaccaaagtaaaaggtaacaagaagaaatctgatacatcaaaagttgtatctaaagtttccagaaaaagatctcatgaagattcagaatccgaagttgaagataatgaaaaagtagttgaagaattagatgctgattttgatgaagttgcaggattattaggtgacgatattgaagatcctgaatcgaaatcccaatccaagaaagaaaaacaaaaggccaaagatgaagccaaacttgaacaattaaccaaacctcaagtatccaatgaagttcctgacaatgacaacgacgatgacagctccgaagatgtattattcgagaatgctgatttttctgaaccaaccatgaaagccatcaaggagatgggatttaccaaaatgacaaaagttcaagctaaaacgataccaccattattggcaggtagagatgttttgggagcagcaaagaccggatctggtaaaacattaccattcttaattcccgcaattgaattattgtattcattgaaaatcaaaccaagaaatggtactgcagtgataataattaccccaattagagaaataacccttacaaatttttggtgttgctcgtga

SEQ ID NO: 5565 - DNA, 2430 bp, Candida albicans
gtttattttttttccctaccatttttcaaaagtataagcagagatgagattgtaggaatttttttttatttttctagaatagtcttccttccatttttacctttacttatttcaatacaaccatcaagaataatggccaagaatcttaaaaaaggaaagaaagtgttcaataaatctaccagaaaaatcaatcgtttgaaagaagaagaagagttggcaaaattgcaagaaagaattaacaattatgacccaaaaacagatgaagcatccgtatctcaattcagtgatctccctattactgagaatactttgaaaggattaaaagaagccacttttgtatctttaactgacattcaaaagaaaacaatcccaatagctttgaagggtgaggatttaatgggaacagcacgaactggatccggtaaaacattggcattcttaattccagtgatagaatcattaatacgaaacaaaattaccgagtatgacgggttagcagcattaattgtttctccaacaagagaattggcagtgcagatttttgaagtcttgactaagattggtaaatataataccttctccgcaggtttggtgactggtgggaaagatgtacagtttgaaaaagaaagagtttcgagaatgaacattttggtaggtactccgggaagaatttcacaacatttgaacgaagctgttggaatggaaacttcaaatttacaagtattagttttagatgaagcagatcgatgcctagatatggggtttaaaaaacaaattgacaatattttaggtcatttacctaccacaagacaaacattgttgttttcggcaactcaatccgagagtgttaatgatttggcaagattgtcgttgactaacccaaacaagattggtgtgtcatcagatcaagaagtatcagccactccagagtcattagaacaatattacgtgaaagtgccattagatgaaaaattggatgttttgtggtcatttatcaagtcacatttaaaaagcaaaatcttggtgtttttctcatcctccaagcaagtccagtatacttatgaaacatttcgtacgttgcaaccaggtatatcattaatgaaattatatggccgtcataaacagacatcacgtttggaaacaactatgaaattttctcaagctcagcatgcatgtttgtttgcaaccgatatagtggcgagagggttagatttccctgccattgattgggttgttcaggttgattgtccggaagatgctgcgacatatgtgcatcgagttggtcgttctgcgcgttttggtagaaaagggaaatctttgttgatgttattacccctggaagaagaaggtatgttaaaaagattaaagatccataagattgaaccaaaattgatgaacattaaacaaaaatcaaagaaatcaataagaccacaattgcagtcgttgtgttttaaagatcctgttatgaagaatttgggtcagagagcttttattgcttacttcaaatctgtacatatacaaaaagataaagatgttttcaaagttgaggagctaccagcagaatcttacgctgcttctttgggattacctggtgcaccaaagatcaaaattaaaggtggtgaatcgaacaaagaaaagaagaacgcatcaagaaaattgatagcattagcaaaaacagacgctgatggcgaagttcaaaccgggaacgaaaaagttagaaccaagtatgatagaatgtttgaaagaaagaatcaaacgattttgtctgaccattatttgaatatgactggcaacaaagtaaatagcgatggagaaagtgaagatgaagatttcatgacagtgaaaagaaaagaccatgaattgaaagaagaagaactcccagatttgacaataccggtatccaaaagacaagccaagaaagctctttcaagaaaggctacgcttgcatctaaaggtaatcctacaaaattgaaatttgatgatgatggtgttgcacacgccatttatgaattagaagacgaagatgattttattaaagccggtgatgctaagaaacaaaaggaagaatttgtaaataaagaaagggagactatgaaaatatcagatatcaccgataaagaggttgaaagacaaaagagacaagaaaagaagagaaaaagaaaagaaatcgaaagaagaatgagagaggaggaagaagaagatttcgacaatgaacaaacggtagtgacattaggtgcacctgatttggatagagacttgcaatacgataacggttctgatgttgaagagccagtatctaagaaacctaaatggtttgaaggtggtgacgatgacaagagcaagaacacaaatgatggttttgttgaatatgatgaacctgaaacattagaagatttggaatctttgacagctagattgattggtaattag

SEQ ID NO: 5566 - DNA, 564 bp, Candida albicans
aaatcgatgtttagactacttataccaagaagatttcctacagttcgattctactcaattatgcaagagccacctatcaaaaagacaaaattggatttaatgcaactgtttcttaaggaaaaaccacaaataccgaaaaagccattggtatgggttgattgtgagatgacaggattagatgtatttggtgatgataatattatagaaatatgttgtataatcactaatgaagaccttgatattgttgatgaaaatgggtatgaaagtactatttattatctaaaatcaaggttggataaaatgaatgaatggtgtattgaaactcatggtaaatcaggattaacagacaaaatcttagccaatcctgatagaaaactttctgttgtcgaagatgaattatcggagtatataaagaaatatgtccctgaagtaagaactggtttattggcggggatttctggttatatggatagattctttatgatgaaagagttccccaaagtcattgaccatttacattatagaaatgtcgaagtgtctaataaaatggaatttggaatataa

SEQ ID NO: 5567 - DNA, 297 bp, Candida albicans
caaatatttttctttttagtggatacttctgttccacacccaaaaattgttaagaaatacaccaagaaattcaagagacaccattctgacagatatcacagagtcgctgaaaactggagaaaacaaaaaggtattgattcatgtgttagaagaagattcagaggtaccatcccacaaccaaacattggttacggttccaacaaaaagaccaagttcttgaacccagctggttacaaagtttacttggttaccaacgttaaagacttagatgtacaccagacggctggaaggaccgaa

SEQ ID NO: 5568 - DNA, 372 bp, Candida albicans
ttagctttaccagttggtgcagttatgaattgtgctgataactctggtgccagaaacttgtacgttttagccgtcaaaggtactggtgccagattaaacagattaccagctgctgctgccggtgatatggttatggccactgttaaaaaaggtaaaccagaattaagaaagaaagttatgccagctattgttattagacaaagtaaaccatggagaagaagagatggtgtttatttgtatttcgaagataatgctggtgttattgttaatccaaaaggtgaaatgaaaggtagtgctattactggtccagttgctaaagaatgtgctgatttatggccacgtattgcttctaactctggtgttgttgtttaa

SEQ ID NO: 5569 - DNA, 627 bp, Candida albicans
gtaaaaatgggtatttctagagattcacgtcacaaaagatccgccactggtgccaaaagagcccaattcagaaagaagagaaagtttgaattaggtagacaaccagccaacaccaagattggtccaaaaagaattcactctgtcagaaccagaggtggtaaccaaaaattcagagctttgagagttgaaaccggtaacttctcttggggttccgaaggtgtttccagaaaaaccagaattgctggtgtcgtttaccatccatctaataacgaattggttagaaccaacaccttgaccaaatctgctgttgttcaaattgatgctactccattcagacaatggtacgaaaaccactacggtgctactttaggtaaaaagaagggtggtgctcatgctgctcacgctgctgaagttgccgatgccaagagatcaagaaaagtcgaaagaaaattggctgctagatctggtgctgctgccattgaatccgctgttgactctcaattcggttctggtagattatacgctgtcatttcttcaagaccaggtcaatctggtagatgtgatggttacatcttggaaggtgaagaattagccttctacttgagaagattaactgctaagaaataa

SEQ ID NO: 5570 - DNA, 336 bp, Candida albicans
aaaagaaaaggtaccaaagacgccagaatgccatctcaagttttatggatgagaagattaagagtcttgagaaaattattggctaaatacagagatgctggtaaaattgacaaacacttgtaccacaacttgtacaaagctgctaaaggtaacaccttcaaacacaagagatctttagttgaacacattattgctgctaaagccgaagccttgcgtgaaaaggctcttaaagaagaagctgaagctagaagagttagaaacagagctgctagagaaagaagacaacaaagattggctgaaaagaaagaagctttatttgctgaagccgccaactaa

SEQ ID NO: 5571 - DNA, 414 bp, Candida albicans
aaattttccaaaatccaggagtttagagcttttgaaagaatcccaagagaagtttgtagaacacatgggtttacgttaaaagaaaaagttaccaaagaccccagaatgccatctcaagttttatggatgagaagattaagagtcttgagaaaattattggctaaatacagagatgcttgtaaaattgacacacacttgtaccacgacttgtacaaagctgctaaaggtaacaccttcaaacacaagagatctttagttgaacacattattgctgctaaagccgaagccttgcgtgaaaaggctcttaaagaagaagctgaagctagaagagttagaaacagagctgctagagaaagaagacaacaaagattggctgaaaagaaagaagctttatttgctgaagccgccaactaa

SEQ ID NO: 5572 - DNA, 207 bp, Candida albicans
aacaagagacaagcttacgctgtcgctgaaaatgccggtcaccaaacctctgctgaatcatggggtaccggtagagctgttgccagaattccaagagttggtggtggtggtactcaccgttccggtcaagatgcttttggtaacatgtgtagaggtggtcgtatgtttgctccaaccaagattgttcaccacgcgtggaaatccgca

SEQ ID NO: 5573 - DNA, 252 bp, Candida albicans
ccctttgtgtctcggaagaagagaagaaaaaatttttcactatttcaaagctgtacccatcatttcttcttcttttttcctcttttttctttctttctttatcatcattatactacaatgtcatcaagaccacaagtttctgttatttccgttaaaggtgaacaaggttcatcccaattaccattaccagctgttttcgctgctccagtcagaccagacttagtccactctgtctttgttagagttaactaa

SEQ ID NO: 5574 - DNA, 603 bp, Candida albicans
agatatgccaccgcttctgccattgctgcttctgctgtcacttctttggttttagctagaggtcacagagttgaacaagttaaagaattaccattggttgtctctaacgaattcgaatccgtcaccaaaaccaaggatgccgttgctgttttgaaggctgttggtgcccacaaagatgttgtcaaggttatcaaatccaagaaattgagagccggtaaaggtaaattgagaggtagaagattcacccaaagaagaggtccattggttgtttacgctcaagacaacggtattgttaaagccttgagaaacgttccaggtgtcgaaaccgcttctgtcaaacacttgggtttgttgcaattggctccaggtgctcacttgggtagattcatcatctggacccaaggtgctttcgaatcattggactctgtctacggttctgactccaccaaatcaatcaaatctggttacaccttgccatctaacatcatttctaacactgatgttaccagattgattaactccgctgaagtccacaccgttgttagaccagctggtgataagaaccaccagaaatctcacgtcttgaagaagaacccattgaaa

SEQ ID NO: 5575 - DNA, 423 bp, Candida albicans
caaccacacattttcaccaacccaaaggctaaagccaacaagaaaaccaagagatggtataaagatgttggtttaggtttcaaaaccccaaaagctgccattgaaggttcttacattgacaaaaaatgtccattcgctggtactgtttccatcagaggtaaaatcttgaccggtactgttgtttccaccaaaatgcaccgtaccatcattatcagaagagattacttgcattacgttccaaaatataacagatacgaaaaaagacacaagaatgttgctgcccacgtctctccagctttcagagttgaagaaggtgatgttgtcaccgttggtcaatgtagaccaatttctaaaactgtcagattcaatgttttgaaagtttctgctggtgcttctagatccaagaaattctctaaattctaa

SEQ ID NO: 5576 - DNA, 363 bp, Candida albicans
ttaaacatctcatatccagccaacggtactcaaaaatctattgatatcgatgatgaacacaaattacgtgttttctacgaaaaaagaatgggtcaagaagttgaaggtgactcagttggagatgaattcaaaggttacatcttcaaaatcactggtggtaacgataaacaaggtttcccaatgaaacaaggtgttatgcacccaaccagagttagattattattatctaaaggtcactcttgttacagaccaagaagaactggtgaaagaaaaagaaaatccgttagaggttgtattgttgctcaagaattgtcagttttggctttgtctatcgttaaacaatgtgacaatgaaattgaatga

SEQ ID NO: 5577 - DNA, 204 bp, Candida albicans
ccaaagctccaaaggattcaaagattagttactccacaaactttacaaagaaagagagctttgaaagctaaaaaagtcaagaatgctcaacaacaaagagatgctgctgctgaatacgctcaattgttggctaagagattgcatgaaagaaaagaagaaagagctgaaattaaaaagaagagagctgaatctttaaagaactaa

SEQ ID NO: 5578 - DNA, 618 bp, Candida albicans
cgttttgtttattctcataattttaaggacatcattctaacatttatttcttcaggtgctccaagaacttactccaagacttactccgtcccaaagagaccatatgaatcagctcgtttagacgctgaattgaaattggccggtgaatacggtttaaaaaacaagagagaaatctacagaattggtttccaattgtctaaaatcagaagagctgctcgtgatttgttaaccagagatgaaaaagacccaaaaagattattcgaaggtaatgctttgatcagaagattagtcagaatcggtgtcttgtctgaagacaaaatgaaattggattatgtcttggctttgaaaccagaagatttcttggaaagaagattacaaacccaagttttcaaattaggtttagctagatctatccaccacgccagagttttgatcacccaaagacacattgctgttggtaaacaaattgttaacatcccatcattcactgtcagattggactctcaaaaacacattgactttgcccacaactctccatacggtggtggtagagccggtagagttaagagaaagaaccaaggtaaaggtggtgaagaaggtgccgaagaagaagaataa

SEQ ID NO: 5579 - DNA, 216 bp, Candida albicans
actgaggattggaaaatgttaaacaatttggctgttcttcaggaattcttgaacagagttaaatctaacgctgctaaaaagagagaagctaaagctaacggtgaaacggtttacttgaagagacaagctgccaagccaagaggttcaagaattatctccactgaaggtaacattcctcaaactttggctccagtcgcttacgaaactttcatttaa

SEQ ID NO: 5580 - DNA, 201 bp, Candida albicans
tatttttatagtcgtggttacagatcaggtactcgttacgctttccaacgtgacttcaaaaaacatggtgctattccattgtctacttacttgaaggtttacaaagttggtgacattgttgatatcaaagccactggttccatccagtacgaaaggccagattttcaccacagccctagcgcatcagttatctccccccta

SEQ ID NO: 5581 - DNA, 900 bp, Candida albicans
gtgaaaaaaaaaaaattttctgttaatattcattcacagtttgattcaaattttttggaatatttgggtgtgggaaggtacaagtatctaattattcaaaccgctagcatatcacattatcaaatgttgtcttctaaacttattaatactggtatattacgaaatactaccagaatatcggtgactcaatggtcaaaatcattttccacctcaataatctctggcaatcaatacgctgactttatacctgccaatgccgaacaagagcaatttttaactagacaaactgaaaaaccattattttccagaaagacttatttaattgatttttacaagcatttatacgataacaatgaaatcttgttattcgttcaccataacaatttaaacaaatccgacaataagagatatcgacaagaattgttcaaatcgggagcaaacttacatgttattaaatctagtatgttcaaattattattgagatctatcaatgaggctgacccagcacaaaagggaatgtcggcaaagaataaagataaagtccatgacttggatccattacttgctggaccaacggcaattataacaattccaaagagtgatcctcaagtagtcacatcagtgatgaaagttttaaagagtgccaatgaaagattacttttaattggagccaagattgaaaataatgtaatgaatcttgatgaaattaatcagttcaaaactttacctactaaggaatctttacaaggacaattggttggattattgactatggctggtggtgctggattagtcagaactttggaaacacctggaaaggtattatatttgaatttggatcaaagaaagaaagatatggagggtcctaaacaagaagaaaaaacagaaaacaaagagtag

SEQ ID NO: 5582 - DNA, 360 bp, Candida albicans
gccggtgttaaaactttcgaattaagaactaaatctaaggaacaattagaatctcaattggttgaattgaaacaagaattggccactttaaaagttcaaaaattacaaagaccaagtttaccaagaattcacactgttcgtaaaaacattgctagagtattgactgttattaacttgaatcaaagagaaaatgttcgtgccttttacgctggtaaaaaatacattccaaaagatttaagagctaaaaagactagagctttaagaagaaaattgactaaatttgaagcttctcaagaaactgaaaaagctagaaaacaaagaattgcttttccacaaagaaaatttgctattaaagcttaa

SEQ ID NO: 5583 - DNA, 408 bp, Candida albicans
acttttggtaaaaagaagactgccactgccgttgctcatgttaaagccggtaaaggtttaattaaaattaacggttccccaatcaccttggtccaaccagaaatcttaagattcaaagtttacgaaccattgactttggttggtttagataaattccaaggtatcgacatcagagttaaagtcactggtggtggtcacgtttctcaagtctacgccatcagacaagctattgctaaaggtttggttgcttaccaccaaaaatacgttgacgaagcttctaagaacgaattaaagaaaattttcgcttcttacgataagaccttgttagttgccgactcaagaagaatggaaccaaagaaattcggtggtcgtggtgccagagcaagattccaaaaatcttaccgttaa

SEQ ID NO: 5584 - DNA, 669 bp, Candida albicans
aactacttttcattggaaaacagttctacttcctacaagtctaaccaccagaaagcaacaatggctatttccaagaacttaccattattgaacaaccacttcagaaagcactggcaagaaagagtcagagttcactttgaccaagctggtaaaaaagcttcaagaagacaatctagattgagaaaagctgccaagattgccccaagaccaatcgatgctttaagaccagtcgtcagagctccaactgtcaaatacaacagaaaagtcagagccggtagaggtttcactttggccgaattgaaagccgttggtattgctccaaaatacgccagaaccattggtatctcagttgaccacagaagacaaaacaaatctcaagaaacttttgatgctaacgtcgccagattacaagaatacaaatctaaattagttatctttgacaaaaagaccaaggcttctgaagttgcttctttcgaacaagttgatgtctctgccaccttcccagttgaacaaccagctccagaatctggtttgagagctgttgaagttccagaacaaactgcttacagaaccttgagattggctagaaacgaaaagaaatacaagggtatcagagaaaagagagctaaagaaaaggctgaagccgaagctgaaaaagctaaaaaataa

SEQ ID NO: 5585 - DNA, 402 bp, Candida albicans
agaattatgccacccccactttccagccctgtggtgtctactatgccaatgtctactgaagccgccgtctcatacgctgctttaatcttagcagatgctgaacaagaaatcacttctgaaaaattattatccatcaccaaggctgctggtgccaatgttgaccaagtttgggctgatgttttcgccaaagccgttgaaggtaaaaacttcaaagaattattattctcttttgctgctgctgctccagcttccggtgctgctgctggttctgcttctggtgctgctgccggtggtgaagctgctgccgaagataatccgctgaataataatctgctgaagaatctgatgacgacatgggtttcggtttattcgattaaagagtttagccaaacaaataaataa

SEQ ID NO: 5586 - DNA, 333 bp, Candida albicans
ttccttattacaatgtctactgaatctgcattatcatacgccgctttaatcttagctgacgccgaagttgaaatcacttctgaaaaattattagctttagtcaccaaagctaatgttgaagttgaaggtatctgggctgatttattcgccaaagctttagaaggtaaagacttgaaagaatttttcttcaacttctctgctgctccagctgccgctgctgctggtggtgctgctggtggtggtgctgctgccgaagaagctgctgaagaagaaaaagaagaagaagccaaagaagaatccgatgatgacatgggtttcggtttattcgattaa

SEQ ID NO: 5587 - DNA, 201 bp, Candida albicans
ttacacggtgtcaatttcaaaaagagagctccaaaagctgtcaaagaaatcaagaaattcgccactttacacatgggtaccactgatgttagattagacccaaaattgaacattgccatttggaaaagaagtgttcaaggtgttgaaaacagaatgagattaagaatttccagaaaaagaaatgatgaagaagatgcttaa

SEQ ID NO: 5588 - DNA, 447 bp, Candida albicans
ctattaggggggattatgatggaagacaaatttaattcaggagtagggggaatttgctttaaggaccagctttttaacatgggtataccaatgtctccattaatggctttgaaaactgagaaaagattgtacccggtgattaaatcaccattcgctcaagcaaagacaagacaaaatttccacagagtcacctataagaagaaattagtggcttatgatgccaatcctgaaataattgatttgtggttgtcatatataaacaagaataagtttaccgatgtggagtacaaggctactgtttcttcttacgagtccttaaattatcacgaagaattaaaatcattaaaagagttcaacttaccagatgcttatgaaggtattgaagatcctgtggctaagaaagtccaagaattacttaaatgtaagtcattcaaaaaacatttgtaa

SEQ ID NO: 5589 - DNA, 435 bp, Candida albicans
ggtaaaggtatttcttcttccgctcttccatactcaagaaacgctccatcctggttcaaattgtcttctgacgatgttgttgaacaaatcatcaaatacgccagaaaaggtttgactccatctcaaattggtgttatcttaagagatgctcacggtgtttctcaagccaaggttgtcactggtaacaagatcttgagaatcttaaaatctaacggtttagctccagaaattccagaagatttatactacttgatcaagaaagctgtctctgtcagaaagcacttggaaaaaaacagaaaagacaaagattctaaattcagattaattttgattgaatcaagaatccacagattggctagatactacagaactgttgctgtcttaccaccaaactggaaatacgaatctgctactgcctctgctttagttgcttaa

SEQ ID NO: 5590 - DNA, 405 bp, Candida albicans
tacacgactcacactcgagtgcattttttttttcccttcaacaatttcaatacaattgtttcctgtattttcattctttctgttggaatcgaatcacaattcaacctggtcatgttttcaaatatattaagacaaagcagtaggggacttataaatttcactagtgtctcatctagaccgttaggtgttcctgcttttggaatgaaccctttaataacaagctcaccattgcagtcggttgttggattgatgcaacagagatttaaatcaagaggaaatacctatcaaccttcaactagaaaaagaaagagaaaattggggttcttggctagactcaggtccattggtggtagaaaaatacttgaaagaagaagagcaaagggtagatggttcttaagtcattag

SEQ ID NO: 5591 - DNA, 444 bp, Candida albicans
cggtccctcgaagtcggcaagcctgctgataaaactaccatttcatgcaacatatacgtgcgtcaggaacaaggggctgcaccaatcgtgggaaaagtcgatatcccattccccgtgcaaagaaaaaccaaaccagtcgtgttcaccacccagcagccagtgatcgaagagttgaaaaaagccggaatagaaacttttggcggcagagagttgctcgacaagtttatcaaccaggaattgaccccagatatgttcacccacgcatttgccactcaagaaatggcaccacatttgaaatctgtcgccagaatcttaggtcgagctggtttacagccaactgccaaaaaggggactataacagacgacgtaaacaccatcctcgacgtcatgagatcgttccagatcaaacaaaaggaaaaccacatctcctttccccgtgggtaa

SEQ ID NO: 5592 - DNA, 261 bp, Candida albicans
gtatatactaactgcaaaatgaataaacactttatccgttcgttttctcaaagcggtgtggtcttaagacctggttattctactgtaaatccagtacatcatttggttaaagttgagaaatctaaattaaggccaggattgaaagaactattacttccaaaagatgatatcagatcagtcaaattcaaaccaactgaaatttcacaagatagagtcaacgagtattatcaaaatgccttgcaatctgatttattattgcat

SEQ ID NO: 5593 - DNA, 615 bp, Candida albicans
ggcagcgctggaccgtccagccgcgtggtgaagaagcgttcttggggaactgatacaccttttaaattgtaccgtccattgcgaaaaccagttggaagtacaagaccaacgaaaaatatttatccaataaacaacaagaatgttcctaaattagaaagtattgttgttcaatcatataataaaaatgcattggaatcgccctggttgaatatcaccaccagattgcaacttgcgactattaccaatgttaaaccaaagattctttatggtaaatcaaatattttaccatggaaagtgagagtaggaagagcatgtggtgccaaggttgaattatttgatagagacatgagtcaatttattagcactttgaccgaattagtgttaccaagaattagagcatttaagggtatcccaagaacttcgggtgataagaatggtaatatatctatgggattgactccagaagattgtcaatttttccccgaattggaacatttccaagaattattccctaacttgaatggtttacaaattacttttaaaactaccgcacaaactgacaaccacgccaaaaccttgcttagttgttatggtttcccattttctaagaattaa

SEQ ID NO: 5594 - DNA, 369 bp, Candida albicans
ttattctattatagatttttaaagaaggaaaaaatgaaatacttagctgcttacttattgttagttcaaggtggtaacacctctccatcagcttctgatatcaccgctttattggaatccgttggtgttgaagccgaagaatccagattacaagctttattgaaagatttggaaggtaaagacttgcaagaattgattgctgaaggtaacaccaaattagcttctgtcccatccggtggtgctgctgctggtggtgcttctgcctctgctggtgccgctgctggtggtgctgctgaagctgaagaagaaaaagaagaagaagccaaagaagaatctgatgatgatatgggtttcggtttattcgattag

SEQ ID NO: 5595 - DNA, 354 bp, Candida albicans
cattttcatgttactaacaagaatatagtgaaatacttagctgcttacttattattagttaacgccggtaacgccaccccatctgctgccgatgtcaaagctgttttgtcagctgctgatattgaagtcgaagaagaaaaagttgaaaaattgatcagcgaattggacggtaagaacgtcgaagaattgattgctgaaggtaacgaaaaattatcatcagtcccatctggtgctccagctgctgctgctggtggtgcttctgctgccgccggtggtgaagccactgaagaagctgctgaagaagaagctgctgaagaatctgatgacgatatgggtttcggtttattcgattaa

SEQ ID NO: 5596 - DNA, 504 bp, Candida albicans
tcaaagatgcctccaaaatttgatccaaatgaagttaaattcctttacttaagagctgttggtggtgaagttggtgcttcatctgctttagctccaaagattggtccattaggtttatccccaaagaaagttggtgaagatattgccaaagccaccaaagaatacaaaggtattaaagttactgttcaattgagaattcaaaacagacaagctactgcttctgttgttccatccgcttcatctttagtcatcaccgctttgaaagaaccagtcagagacagaaagaaggaaaagaacgtcaaacactctggtaacattccattagatgaaatctttgaaattgccagaaaaatgcaacacaaatcattcggtaagaatttggcatctgtctccaaggaaatcttgggtactgctcaatctgttggttgtagagttgatggtaagaaccctcatgacatcattgacgccatcaacgctggtgaaattgatgttccagaaaactag

SEQ ID NO: 5597 - DNA, 408 bp, Candida albicans
agtattcgatttactaacattatgaattattattatagtttgttaaacaccaacattgatggtagaatcaagatcatgtacgccttgaccaagatcagaggtgtcggtagaagatatgccaacttggtttgtaaaaaagccgatgttgaattaaccaaaagagctggtgaattgacccaagaagaattggaaagaattgtcaccattatgcaaaacccaaccaactataaaatcccagcttggttcttgaacagacaaaaagatcaagttgatggtaaagattaccatgttttagctaacaacttggaatctaaattgagagatgatttggaaagattgaagaaaatcagatctcacagaggtattagacacttctggggattgaaagttagaagttcaacatactaa

SEQ ID NO: 5598 - DNA, 342 bp, Candida albicans
atattcaaagtaacgaaacctcagaatcgaataaaaacaacagtaatactaacaaatcaaattttgatttttatagagggtactccatctttaggtaaacgtcacaacaaatctcacaccttatgtaacagatgtggccgtcgttcattccacgttcaaaagaagacctgttcttcttgtggttacccagctgctaaaatgagatctcacaactgggccttaaaagccaagagaagaagaactactggtaccggtagaatggcttacttgaaacacgttaccagaagattcaagaacggtttccaaactggtgttgctaaagctcaaaccccttccgcttaa

SEQ ID NO: 5599 - DNA, 402 bp, Candida albicans
ataaaaatagatagcactattttggaacttgttgaagatattaaaatagaatgggatttcaacatagatattcaaagtaacgaaacctcacaatcaaataaaaacaacagtaatactaacaattcaatttttatttttatagagggtactccatctttaggtaaacgtcacaacaaatctcacaccttatgttacagatgtggccgtcgttcattccacgtccaaaagaaaacctgttcttcttgtggttacccagctgctaaaatgagatctcacaactgggccttaaaagccaaaagaagaagaactactggtaccggtagaatggcttacttgaaacacgttaccagaagattcaagaacggtttccaaactggtgttgctaaagctcaaaccccttcc

SEQ ID NO: 5600 - DNA, 828 bp, Candida albicans
cggttgcaagatcacacagaagtagtggtagaaacaatgaaggtaaaatcactgttcgtggtcgaggtggtggccacaaggaaaagagccagattaatcgatttccatcgttggaatgccggaagacaagaagttgtcagaatagaatacgatccaaacagatcaggacatattgcattacttaaacatttggagacgggggatttatcgtatattttagccccacaaggtttgagaagtggtgatattgttgaaagtgtcagacagggtataccaaaagattttatggaagaaatggaaagaaccaataatggtgaaatcgatgatgctttgttgtctgccagaatattacagagaggcaattgcttgccattaagaatgttgccagtaggttccattattcataatattggtttgcgtccaggagatagagctcaattggtcagatctgcaggtacttttggtaaaattttgtcgaaacatcctgaaaaaaacagagctgttattaagttgtcatcaggcgaacagagatacgtcattttagattgccatgccaccttaggtgtggtttctaacaaagaacaccaattgatttcttggggtaaagccgggagaagccgttaccgaggtttccgaccaaaggtgagaggtgtagccatgaatgcctgtgaccatcctcatggtggtggtagaggaaaatccaagtcgaacaaggtttctcaatcgatgtggggtttgaagaaatttcaaaagactagattaagaccaaacccagatcaaataagaaacagaaagggccacttgataaatcatgacaaatttaaataa

SEQ ID NO: 5601 - DNA, 549 bp, Candida albicans
ggcgagaaagaaaaaacgaaagaaaaattttcttcaataccaagtagtacatatacatttcagggacaactaaaccaacacatcatgttaccgataacgagaagatggttggggaatactgcaagtccagcagtcagtctattgaaatacagcagagcatttgttcgattcaactctacatctgagttgactgaattggaacttcaagatatcaaatacagaaaacaaagagaattgagtttaaagttaacaaagatgaagaattatggagatgcattcccagcacattcgcaccctggttcaacgcactataaaaaaccagtgcacgatcatttacacaagggtagacccattaaggaattaacggttgcaagatcacacagaagtagtggtagaaacaatgaaggtaaaatcactgttcgtggtcgaggtggtggccacaaggaaaagagccagattaatcgatttccatcgttggaatgccggaagacaagaagttgtcagaatagaatacgatccaaacagatcaggacatattgcattacttaa

SEQ ID NO: 5602 - DNA, 465 bp, Candida albicans
aaaaattgtctgccaaaaatttcacacctctttatcctatcacaacccaaatcaacaatgagtgacgccgttaccatcagaactagaaaggttatttccaacccattattggccagaagacaattcgtcattgatgttttacacccaaacagagccaacgtctccaaggatgagttaagagaaaaattagctgaaatctacaaggccgaaaaggacgccgtctccgtttttggattcagaacccaatttggtggtggtaaatccactggttttggtttaatctaccaatccgtcgccgatgccaaaagattcgaaccagcttacagattagtcagatacggtttagctgaaaaagtcgaaaaggcttccagacaacaaagaaaacaaaagaagaacagagacaagaagatctttggtactcaaagaagagctcaaaagagagctgccagaagaaacgccgactaa

SEQ ID NO: 5603 - DNA, 366 bp, Candida albicans
ttaaacatgccaaaaaagagagcttccaacggtagaaacaagaaaggtagaggtcacgttaaaccagtcagatgtttgaactgtgctagatgtgttccaaaggataaagccatcaagagagtcaccatcagaaacatggttgaagctgctgctgtcagagatttgtctgaagcttctgtctacgctgaatacgctttaccaaaattatacaacaaattacactactgtgtctcttgtgctatccacgccagaattgttagagttagatcaagaactgacagaaaaattagaactccaccacaaagaaagagattcacctctgacagaaaagtttctccacaagatgctgctaaaaaagctaactaa

SEQ ID NO: 5604 - DNA, 660 bp, Candida albicans
ataaagatgtctaaaatcaccagttctggcgttagagaaaacgtccacaaattattggaatactccactgaaaccaaaaagagaaactttttggaaaccgttgaattacaagttggtttgaaaaactatgatcctcaaagagacaagcgtttctctggtactttgaaattacctcaagttccgagaccaaacatgaccatctgtatttttggtgatgcttttgacgttgatagagccaagtctttgggtgttgatgctatgtccgttgatgacttgaaaaaattgaacaaaaacaagaaattgattaaaaaattggctaagaaatacaacgctttcattgcttctgaagttttgatcaaacaaattccaagattattgggtccaactttatctaaagctggtaagttcccaactccagtttctcacaatgatgatttatacagtaaagttactgatgttaaatccactatcaaattccaattgaaaaaagtcttgtgtttggccgttgctgttggtaacgttgatatggaagaagatgtcttggttaaccaaatcatgatggctgctaacttcttggtttctttgttgaaaaagaactggcaaaatgttggttccttggttattaaatctaccatgggtccatcatttagaatctactaa

SEQ ID NO: 5605 - DNA, 756 bp, Candida albicans
ttaacaatgtcagctgaagccccaaaaagacaatttggtgatagaagaagaggtggtagaagaggtggtagaagagatggtgaagaaaaaggttggactccagtcaccaagttaggtagattagtcaaagctggtaaaatcaccagtgttgaacaaatctacttgcactctttgccagtcaaggaataccaaatcattgatttgttattgccagacttgaaagatgatgtcatgaagatcagatctgtccaaaaacaaaccagagctggtcaaagaaccagaatgaaggctgttgtcgtcattggtgactctaacggtcacgttggtttgggtatcaagaccgctaaagaagttgcttctgccattaaagctgctattgttattgccaaattatccatcatcccaatcagaagaggttactggggttctaacttgggtcaaccacactctttgccatgtaaagtcactggtaaatgtggttccgttgccgttagattaatcccagccccaagaggtaaaggtattgttgcttctccagttgtcaagagattaatgcaattggctggtgttgaagatgtctatacttcctcttctggttctaccagaactaccgaaaacaccttgaaagctgcctttgctgctatcggtaacacttacagtttcttgactccaaacttgtgggctgaaactccattagctgcttctccattggaagtttacgctgaagaagctgctgctggtaaaaagagatactaa

SEQ ID NO: 5606 - DNA, 627 bp, Candida albicans
gccaacaaagaaaagagaaaggttatctttgacagagctgctgcttaccaaaaggaatacactgaagctgaaagatctgtcatcaaagccaagagagatgctaaagcttctaactcttactacgttgatgctcaaccaaaattggttttcgttgtcagaatcaagggtattaacaagattccaccaaagccaagaaaggtcttgcaattattaagattgacccaaatcaatgctggtgtttttgtcagattgactaaagccacctctgaattgatcaaattggctgaaccatacgttgcttacggttacccatctttgtctaccatcagacaattagtttacaagagaggtttcggtaaggtcaacaagcaaagaattgctttgtccgacaatgccatcattgaagccaacttgggtaaattcaacatcttgtctattgaagatttgattcacgaaatttacactgttggtccaaacttcaaacaagtcagcaacttcttgtggccattcaaattatccaatccaaacggtggtttcagagccagaaaattccaacactttatccaaggtggtgacaccggtaacagagaacaattcattaacgctttggtcgtacaaatgaactaa

SEQ ID NO: 5607 - DNA, 471 bp, Candida albicans
aaaatgaagattgaagttgactccttttcaggttctaaaatctacccaggtagaggtactttatttgtcagaggtgactctaaaatttttagattccaatcctcaaaatctgcttctttattccaacaaagaaagaacccaagaagaatttcttggactgttttgtacagaagacaccacaaaaaaggtatttctgaagaagctgctaaaaagagaaccagaaagaccgtcaagcaccaaagagctattgtcggtgcttctttggaattgatcaaagaaagaagaagtcaaaaaccatctgacagaaaagctgctagagactctaaattggctaaagacaaagaagctaaaaaagctgctaaagctgccagaaaagctgaaaaggctaaggctgttgcttccggtgcttctgttgtttctaaacaacaagctaaaggttctttccaaaaagttaaagctacctcccgttaa

SEQ ID NO: 5608 - DNA, 318 bp, Candida albicans
gccccaccatgttacgagaaccaagtagacatcaactcaaaattagctttgactatcaagtcaggtaaatacacgttgggttacaaatcagttgtcaaatctttgagaactggtaaagctaaattggttatcattgctgctaacaccccagtcttgagaaaatcagaattggaatattacgctatgttgtctaagaccccagtctactacttccaaggtggtaacaacgaattgggtaccgtttgtggtaaattattcagagttggtactttgtccattttagatgctggtgactccgatatcctttcttctatctaa

SEQ ID NO: 5609 - DNA, 219 bp, Candida albicans
ggacaaggctcaacacattgtcatcttggaccaagaaaatacgacagaatcttgaaagatgttccaacttataaatacgtttctgtttccgtcttagtcgatagattgaagattggtggttctttagccagagttgctttgagacaattggaagaagatggtatcatcaccccagtcttgaaacactccaaacaagctatgtacactcgtgcccaataa

SEQ ID NO: 5610 - DNA, 522 bp, Candida albicans
tctgacaaatcccaaaatgttatgcgtgaattacgtattgaaaaattagttttaaacatttgtgttggtgaatccggtgatagattaaccagagccgccaaagttttagaacaattatctggtcaaaccccagttcaatctaaagctagatacactgtcagaactttcggtattagaagaaatgaaaaaattgccgtccacgttactgtcagaggtccaaaagctgaagaaatcttggaaagaggtttgaaagttaaagaatatcaattaagatctaaaaacttctctgctaccggtaactttggtttcggtattgatgaacatattgatttaggtatcaaatatgatccatctattggtatttacggtatggatttctacgttgttatgggtagagccggtgctagagtcaccagaagaaagagagctagatccactattggtaactctcacaaaaccaacaaagaagataccatccaatggttcaagaccagatacgatgctgaagttttggataaataa

SEQ ID NO: 5611 - DNA, 576 bp, Candida albicans
ggatgttgtggtagtgattgtgtgttcccaccaaataactttgcggacactctcatatactcaatttttttctcacaaaaattttttttcttctacttttttcaagaattcttcttttacaattcaacaacatcaatcatgggtaaaggtaaaccaagagggcttaactctgctagaaaattaagagttcacagaagaaacaacagatgggctgatcaagcttataaagctagattattaggtaccgctttcaaatcttctccatttggtggttcatctcacgccaaaggtatcgttttggaaaaaattggtattgaatctaaacaaccaaactctgctatcagaaaatgtgtcagagtccaattaatcaaaaacggtaagaaagtcactgctttcgttccaaacgatggttgtttgaactttgttgacgaaaatgacgaagtcttgttggctggtttcggtagaagaggtaaagctaagggggatattccaggggttagattcaaggttgttaaagtttccggtgtctctttattagctttatggaaagaaaagaaagaaaagccaagatcatag

SEQ ID NO: 5612 - DNA, 660 bp, Candida albicans
ggacgctggtccttccagccgcgtggtgaagacttgggaaaaattgttttggctgccagaatcattgctgctgttccaaacgcttctgatgttgctgtttgttcttcaagaactttcggtcaaagagctgttttgaaatttgctgctcacactggtgctactgccattgctggtagattcactccaggtaactttaccaattatatcactcgttcattcaaagaaccaagattagttgttgttactgacccaagaaccgatgctcaagccatcaaagaatcatcttatgttaacattccagttattgccttgactgacatggactctccatctgaatacgttgatgttgccattccatgtaacaacaaaggtaaacactctattggtttaatctggtggttgcttgctagagaagtcttgagattaagaggtattatcccagacagaactaccgaatggtcagttatgccagatttgtacttctacagagacccagaagaaattgaacaaaatgccgtcgaagaagctaaaactgaagaagttgaagaagctccagttgctgaagctgaaaccgaatggactggtgaaactgaagatgttgattgggctgattctggtgctaccccagctgctgaagatgctgctgcttctaactggtaa

SEQ ID NO: 5613 - DNA, 231 bp, Candida albicans
aaacaagcaataatgtctgccccaatcaacaaggaaaaagtcgaacaagaaactgaacaacaaattcacaaaatcagaattaccttaacttccaccaaagttaaacaattggaaaacgtgtctgctaacatcatcagaaacgctgcccaatacaacattgtcaagaaaggtccagtgagaatgcaaaccaaggttttgaaaatcaccaccagaaaaaactccaatgggtga

SEQ ID NO: 5614 - DNA, 393 bp, Candida albicans
  unsure (9),(89): Identity of nucleotide sequences at the above locations are unknown.
ctaaatttnttagctattgttgtaagaggtcgttacgctggtaaaaaagtagtcattgtgaaaccacatgatgaaaggtacaaatctcnaccattcccacatgccattgtcgctggtattgaaagagctccattgaaggttaccaagaagatggatgctaaaaaagttaccaaaagaactaaagtcaagccatttgttaaattagtaaactacaaccatttaatgccaactagatactcattggatgttgaatcattcaaatctgctgtcacttctgaagctttagaagaaccatctcaaagagaagaagctaaaaaagttgtcaagaaggcttttgaagaaaaacatcaagctggtaagaacaaatggttcttccaaaaattacacttttaa

SEQ ID NO: 5615 - DNA, 582 bp, Candida albicans
tactactttaaatatcaaacatccacaaccatggttagggcattaaaacatcatgagaaaaaattattgaaaaaagtagatttcctcgattggaaacaagatcaaggtcatcgagacactcaagtgatgagaacgtatcatattcaaaatcgtgaagattatcataaatacaataagatatgtggtgatattaggaaattagcacataaattatcattattacaaccaactgatccatttagaattaaacatgaacaattattattagaaaaattatataatatgggagtattactgacaaaatcgaaaatatccgatttggaaaataaagttactgtgagtagtttatgtcgaagaagaatcggggtggttatgtgtcgattgaaaatggcagaaactataagtgatgcagtgaaatttattgaacaaggtcatgttagagttgggccaaatgttattactgatcccgcatatttaatcacgagaaatttagaagattatttgacttgggttgataattcaaaaattaaaagaaatgttcttaaatataagaataaaattgatgattttgatttagcataa

SEQ ID NO: 5616 - DNA, 708 bp, Candida albicans
gtagttttttttctctcctacagtcgttttccctatagtaaaaaattcttttttttttttttgaaaacttcctttaacctttccttatatcttaatcaatcaaccatgtcctcatttgaaaaagttgttgttattgatggtaaaggccatttgttgggtcgtttagcctctattgtttctaaacaaatccttaatggtcaaaaagtcgtcgttgtcagatgtgaagaattgaacatttgtggtgaatttttcagaaacaaattaaagtaccacgactacttgagaaaagctactagatacaacaagaagaagggtccattccatttcagagccccatctagaatcttatacaaggccatcagaggtatgattcctcacaaaactgccagaggtaaagcagccttggaaagattgaaggttttcgaaggtgtcccaccaccatacgacaagaaaaagagagttgttgttcctcaagctttgagagtcttaagattgaaaccaggtagaaaatacaccaccgttggtaaattatcttcagctgttggttggaaatacgaatcagttgttgaaaaattagaagaaaagagaaaagtccaatctgctgaatactacgccaagaagaaggctttgaccaaaaaattgaacgctgctaaagcttctactgctgaatctgaagccgctcaaaaattagctgctttcggttactaa

SEQ ID NO: 5617 - DNA, 789 bp, Candida albicans
  unsure (531): Identity of nucleotide sequences at the above locations are unknown.
ttgtttactaacatttctatttctacaggtagagttattcgtaaccaaagaaaaggtgctggttctattttcacttctcacaccagattaagaaaaggtgctgccaagttaagaaccttggattatgctgaacgtcatggttacatccgtggtgttgttaaacaaatcatccatgacccaggtagaggtgctccattagccaaagttgctttcagagacccatacaagtacaaattgagagaagaaactttcattgctaacgaaggtgtctacactggtcaatttatttacgccggtaaaaaagcttccttgaacgttggtaacatcttgccattgggtgcttgtccagaaggtaccattgtctccaatgttgaagaaaaagttggtgacagaggtgctttaggtagaacctccggtaactacgttattatcattggtcacaacccagatgaaaacaaaaccagagttaagttgccatctggtgccaagaagatcatctcttctgatgccagaggtgttattggtgttgtngctggtggtggtaaaatcgataaaccattattgaaagctggtagagccttccacaaatacaaggtcaagagaaactcatggccaaagaccagaggtgttgctatgaacccagtagaccatccacacgggggtggtaaccatcaacacattggtaaagcttctactatttctagaggtgctgtttccggtcaaaaggctggtttgattgctgctaaaataactggtttgttacgtggtacacaaaaaactgctgaataa

SEQ ID NO: 5618 - DNA, 327 bp, Candida albicans
tcaaactttttgccaacaacaaaaccaaaaaaggaaaaagaactcattactagcaaacttgaattaggctatattggtgaatttgaatacattgacgatcacagatcaggtaagattgttgttcaattaaacggtagattaaacaaatgtggtgttatccaaccaagattcaacgttaaaattaacgacattgaaagatggactgataacttgttaccagctagacaattcggttatgtcatcttaaccacttctgctggtatcatggaccatgaagaagctagaagaaagcatgtttcaggtaaaattttgggtttcgtttattag

SEQ ID NO: 5619 - DNA, 186 bp, Candida albicans
aataaaatgactagaacctccgtcttagctgatgctttaaatgctattaacaatgctgaaaaaactggtaaacgtcaagttttgattagaccatcttcaaaggttattatcaaatttttaactgttatgcaaaagcatggtatgtatttttttttttttggaaacattggacaattatttgattaa

SEQ ID NO: 5620 - DNA, 354 bp, Candida albicans
gaattgttcaaggtaaagaatctggtgttactaaaagttagatggcttgctaaatctgtcaattttgtcaaagatttattaagaatcgctcaagctaatgctgaagttaaaggtttggattctagtaaattagttatttctcatattcaagtcaatcatgctccaaaacaaagaagaagaacttatagagctcatggtagaattaatgcttatcaatctactctttcccacattgaattaactttgactgaagaagatgaaattgttgaaaaaccagttgaacaaaaacaaatcagattgaactcaagacaaagaggtagattagcttctcaaaaacgtttaactgctgcttaa

SEQ ID NO: 5621 - DNA, 210 bp, Candida albicans
gtttgggtgagaacgaaaaaaaaaaattctactaacaaaatatttttcaaaggaaaaaaaaattttttacagttaactttttctcacattgaaatccacattaaatataattcaacaatggttcgttacgctgccactcctgctaacccagccaaatcagcttctgcccgtggttcttacttgagagtttcattcaaaaacaccagataa

SEQ ID NO: 5622 - DNA, 195 bp, Candida albicans
gttgaattatacgtcccaagaaaatgttctgctaccaacagaattattaaagccaaagatcacgcttctgttcaaatctcaattgctaaagttgatgaagacggtagagctattgctggtgaaaacatcacttacgctttaagtggttacgttagaggtagaggtgaagctcatgactcaccaattttcaacagc

SEQ ID NO: 5623 - DNA, 684 bp, Candida albicans
cccaagatgtctgacgttgaagaaaaataccaagaagaaacacaaccagtcgttcaagaagaattacaagtcgttgaattagccactaccatcccattggatgttcaagaagctcaaagagaagtcaaattattcaacaaatggtcttttgaagatgttgaagttaaagacgtttcattagtcgactacattcaaatcagaaacccagttttcgtttcccatactgctggtaaatacgcctctaaaagattcagaaaggctcaatgtccaatcgttgaaagattaaccaactctttgatgatgaatggtagaaacaatggtaaaaaattgaaggccgttagaatcgtcaaacacgctttggaaatcattcacgttttaactgaacaaaacccaatccaagttgttgttgatgctattgtcaactctggtgccagagaagattccaccagaattggttcttctggtactgtcagaagacaagctgttgatgtttctccattaagaagagtcaaccaagctattgccttgttgaccatcggtgccagagaagcttctttcagaaacatcaaaactattgctgaatgtttagctgaagaattgatcaacgctgctaaaggttcttctacttcttacgctatcaagaagaaggatgaattagaaagagttgctaaatctaaccgttaa

SEQ ID NO: 5624 - DNA, 321 bp, Candida albicans
atctatcgacgtagacttttatcttcttggtgtattttttttgtcttaatttttttcactcttattcacttcatactttttatattactgttttcaaagacactaacaaattcttattattatagaaagaagcatttgaaaagattagcagctccatctcattggatgttggacaaattgtccggtacctatgctccaagaccatctgctggtccacacaaattgagagaatcattaccattggttgtctttttaagaaacagattgaagtatgctatcttcacccacagggggccgaagatccgcgataaaattcgcggt

SEQ ID NO: 5625 - DNA, 795 bp, Candida albicans
accacaatgggtagaggtccaaagaaacacttgaaaagattagcagctccatctcactggatgttggacaaattgtccggtacttatgctccaagaccatctgctggtccacacaaattgagagaatcattaccattggttgtctttttaagaaacagattgaagtatgctttgaacggtagagaagtcaaagccatcatgatgcaacaacacgttcaagttgacggtaaagtcagaactgataccacctacccagctggtttcatggatgtcatcaccttggaagctaccaacgaacatttcagattagtctacgatgttaaaggtaaattcgctgttcacagaatttctgctgaagaagctgcctacaaattgggtaaagtcaagaaagtccaattaggtaagaaaggtgttccatacgttgttacccacgacggtagaactatcagatacccagatccattgatcagagctaacgataccgttaagatcgatttggctaccggtaagattgatgatttcatcaaattcgacactggtagattagttatggttactggtggtagaaatttgggtagagttggtgttattgtccacagagaaaaacacgaaggaggtttcgatttggtccacatcaaagatgctttggaaaacactttcgttaccagattgtctaacgtttttgttattggtactgaagccggtaaaccatgggtctcattaccaaagggtaaaggtatcaaattgtctatttctgaagaaagagacagaagaagagctcaacaaggtttgtaa

SEQ ID NO: 5626 - DNA, 357 bp, Candida albicans
attagatatctcctttccctccaccatcaacgcaaatttttttttatctttctttctttctatctatcttttaattttgatttacttacatttatattacatttcaacatggttttagttcaagatttattacatccaaatccaattactgaaaatgaaaagaataaattaaaaaaattggttcaagaaccaaattcatttttcctcgatattaaatgtccaagttgtttcaatataaaaactattttcagtcatgctcaaacagcaatcacttgtgataaatgttctactttattatctagtcctactggtggtaaggctaaattggttgatggttcttcatttagaagaaagtag

SEQ ID NO: 5627 - DNA, 696 bp, Candida albicans
acaatgcctagatcaaaacgttcgaaacttgttactttagcacagactgaaaagaaggggaaagaaaacaagactcgtttatttgatgaagttagatctgcattagatacttttaaatatatatgggttttacaatttgatgatattagaactccagtattacaagatgttagaaatgattgggttggatcaaaattgattttaggtaaaagaaaagtattacaaaaggcattaggtgaaaccattgaagaagaatataaagacaatttacatcaattatctaaattatgtgaaggtttaccaggattattatttactgatgaatcaccagaaactgttgaagcttatttcaaagcatattccaaacaagattattctagagccaaatctagagcaccaatagattttactatacctgcagggattgtttattctagaggtggacaaatttccatagaagaagatgttccaatgtcacattctttagaagaaactttaagaaacaaattaaaagttccaactaaaatcaaagccggtaaaattattcttgaagaaccttatgttgtttgtaataaaggtgatgttttagatactagacaagctttgttattgaaacaatttggtgttgctgcgagtgaatttaaaattcctattcttggttattatgatggagaagtacataaatatgataattaa

SEQ ID NO: 5628 - DNA, 285 bp, Candida albicans
gttttgattgatggtccaaaaatccaaagacaagctattgctttagctaaaattgttcttaccccaattgttttaccaaacttgccaagaggttcaagaactgctactgttactaaaaaatgggctgctgctgatattgacgccaaatgggctgcttctggctgggctaagaaattggctaacaaagaaagaagatctcaattatctgactttgaaagattccaagttatggtcttgaagaaacaaagaagatttgctactaaaaaagccttagttaaagcttaa

SEQ ID NO: 5629 - DNA, 609 bp, Candida albicans
tctatccatataccaacccacttaaaaatggctccaaaaggtaaaaaggttgctccagctccattggctactaaatccgccaaatcttctgaatccaaaaacccattattcgaatccactccaaagaatttcggtattggtcaatccattcaaccaaaaagaaatttatccagatttgttaaatggccagaatacgttagattacaaagacaaaagaaaattttatctttaagattaaaagttccaccatctattgctcaattttctcaaactttagataaaaacactgctgctcaagcttttaaattattaaacaaatatagaccagaaacttctgctgaaaagaaagaaagattaactaaagaagctgctgctattgctgaaggtaaaaccgctaaagatgtttcaccaaaaccagttgttgtcaaatatggtttgaaccatgttgtttcattaattgaaaacaaaaaggctaaattagttttaattgctaatgatgttgatccaattgaattagttgtctttttaccagccttatgtaaaaaaatgggtgttccttatgctattgttaaaggtaaagctagattgggaactttggttcacaagaag

SEQ ID NO: 5630 - DNA, 798 bp, Candida albicans
ctttactcaatgacacagccttcttcaaaaaaagttgctccagctccattagctactaaatctaaagcttctacaagcaccaagaacccattgttcgaatctaccccaaagaattttggtattggtcaatctattcaaccaaaaagaaacttgtccagatttgttaaatggccagaatatgtcagattacaaagacaaaagaaaatcttgtccttgagattgaaagttccaccatctattgctcaattttctcaaactttagataagaacactgctgctcaagctttcaaattattgaacaaatacagaccagaaacttctgctgaaaagaaagaaagattgactaaagaagctgctgctatcgccgaaggtaaaactgccaaggacgtttcaccaaagccagttgttgtcaaatacggtttgaaccacgttgtttccttgattgaaaacaaaaaggccaaattagttttgattgctaacgatgttgacccaattgaattggtcgtctttttaccagctttatgtaagaaaatgggtgttccatatgccattgtgaaaggtaaggctagattgggaactttggttcacaaaaagacttctgccgttgctgctttgaccgaagttaactctgctgatgaagctgaattatctaaattggtctccactatcaacgccaactacattgaaaaatacgaagaaaacagaaagcactggggtggtggtatcatgggttctaaagccaatgataaaatcgccaaaaaggctaaagctgctgccgctgccgtttctactgcttaa

SEQ ID NO: 5631 - DNA, 612 bp, Candida albicans
cattatacatatatatctacaacaatgaggatttatcaatgtcatttttgttcatcaccggtatatccattacatgggatcacatttgtaagaaatgatgccaaagaattccgtttctgtcgttctaaatgtcataaagcattcaaacaacgtagaaacccaagaaaattacgttggactaaagcatttagaaaagctgctggtaaagaattggtggttgattctacattaacatttgctgctagaagaaatgttccagttagatataatagagatttggttgccactactttgaaaggtatgagtagaattgaagaaattagacaaagaagagaaagagcattctataagaatagaatgaagggtaataaagaaagacagttggctgctgatagaaaattggttgctgataatccagaattattaagattaagagaagttgaattaagaagaaaagccgagaaattagctgctaaagaaaatgccatggaagaagatgaagaaacagaggttgaagaggaaggagaaggtgatgaagaaatgataagtggagaggaagaatgggaaagtgaagatgaaagtgaaagggaaagtgacacaaaaacgtgttaa

SEQ ID NO: 5632 - DNA, 363 bp, Candida albicans
acttctaagaaatccaaatctgtcaagaaatttgttgttgacgttgctgctccagttgaaaacgatgtctttgaccaagaaagttatgtcaaatacttggttgaacacgttaaagttgacggtattgttggtaacttaggtaacgacatttccatcactgctgaatctgacaacaaagttgttgttgtcgttagtggtaacggtagcttttctggtaaatacttgaaatatttgaccaagaaatacttgaaaaagaaccaaatcagagactggattagatttgtttctgtcaagcaaaaccaatacaaattacaattttacgctgtcgctgaagatgacgaagaagaagaagacgaagaataa

SEQ ID NO: 5633 - DNA, 198 bp, Candida albicans
agatacaagttcccaggtcaacaaaaaattattatttttaagaaatggggtttcactccattgaacagagatgaatatattgccaagaagactaacggtgaagttatcgatgatggtgcttacgttaaattcttgtcaagaaaaggtaacttggaagctaacttgcaacaattcccaaattaccaatactctgcctaa

SEQ ID NO: 5634 - DNA, 753 bp, Candida albicans
ataatttacattcttcattatttgcaagactatatttgcaacaaaaaagttttatccatactaacaaataattcttttatattagacaaaatggctagaagaccagctagatgttacagatactgtaaaaacaaaccatacccaaaatctagatacaacagagctgtcccagacgccaaaatcagaatctacgatttaggtagaaagaaggccactgttgatgaattcccattatgtattcatttggtttctaatgaattggaacaattatcatctgaagctttggaagctgctcgtatctgtgctaacaaatacattaccaaagtttctggtagagattcattccatttgagagtcagagttcatccattccacgttttacgtatcaataaaatgttgtcatgtgccggtgccgatagattgcaacaaggtatgagaggtgcttggggtaagccacatggtttagctgccagagtttctattggtcaaatcatcatgtctgctagaactaaagactctaacaaagatgttgtcattgaaggtttaagaagagttagatacaagttcccaggtctacaaaaaattattatttctaagaaatggggtttcactccattgaacagagatgaatatattgccaagaagactaacggtgaagttatcgatgatggtgcttacgttaaattcttgtcaagaaaaggtaacttggaagctaacttgcaacaattcccaaactaccaatactctgcctaa

SEQ ID NO: 5635 - DNA, 189 bp, Candida albicans
ggtaaagttcacggttccttagctcgtgctggtaaagttaaatctcaaactccaaaagttgaaaaacaagaaaaaccaaagaaacctcaaggtacagcttacatgagattattgtacactagaacattcgtcaatgttactttaaccaatggtaaaagaaagatgaacccatctccagcttctcaataa

SEQ ID NO: 5636 - DNA, 264 bp, Candida albicans
ccacttcaacctataacaactccaaccatggctagagaaatcaaggatatcaaagaattcgtcgaattggctagaagatcagacatcaaatctgctattgtcaaagttaacgccaaggtcaatgctaacggtaaaaaattcaaacaaaccaaattcaaggtcagaggttcaagataccaatacactttagttgtcaacgatgcttctaaagctaaaaaattacaacaatctttaccaccaaccttaaaaatcaccaacttgtaa

SEQ ID NO: 5637 - DNA, 315 bp, Candida albicans
tcagccatttgttttcttctatcaacaccattgcttcatatttctgtgggcgcgaagaacacccgaccctggccatctgttggtcactccatcattaacaactacaagaacgtcttggctttgtctgttgccactgactacacttacgaaggttctgaagctgttaaagacagattagctaacccagaagcttacgctgctgctgctccagctgctgccgctgctggtggtgctgctgaagaagctgccactgaagaagctgctgccgatgaagaagaatctgatgacgacatgggtttcggtttattcgattaa

SEQ ID NO: 5638 - DNA, 525 bp, Candida albicans
aacaaagtcgaaatgggtggtgctagagaaaagaaagttcaatacttctccaaattaagagaattgttagaagaatacaaatctatcttcgtcgttggtgtcgataatgtttcttcccaacaaatgcacgaaatcagaaaggccttgagaggtgatgccgtcgtcttgatgggtaaaaacaccatggtcagaagagccatcagaggtttcttgtctgaattgccagaatttgaaaaattgttgccattcatcaaaggtaacgttggtttcattttcaccaacggtgatttaaaatccattagagacattgttgtttctaatgttgttgctgcaccagccagagctggtgccgttgctccaaaagatgtttggattccagccggtaacactggtatggaaccaggtaagacctctttcttccaagctttgggtgttccaaccaagattgccagaggtaccattgaaattgtttgcccctgttattcttcactcacgaggcagccaggatccgcaattatttcttag

SEQ ID NO: 5639 - DNA, 393 bp, Candida albicans
aatactaacaaaaattccatttatatagacgtttcttcatctcgttctaaagctagaaaagcttatttcactgcttcatcagttgaaagaagagttcttttatctgctccattatccaaagaattaagacgacaatacaatgtcaaatctttgccaattagacaaaatgatgaagttttagttgttagaggttctaaaaaaggttctgaaggtaaagttaattctgtttatagattgaaatttgctattcaagttgataaattacaaaaagaaaaatcaaatggtgcttctgttccaatcaacattcatccatctaaagttgtcattactaaattacatttggacaaagatagaaaagctttgattcaaagaaaaggtggtaaagctgaataa

SEQ ID NO: 5640 - DNA, 399 bp, Candida albicans
atgacgcggatcttccagcccccgtggtcgaagaacttggaagacaacaccttattggtttctggtccattcaaagtcaatggtgttccattgagaagagttaacgctagatacgttatcgccacctccaccaaagtcaacgtttctggtgttgatgtttctaaattcaacgtcgaatactttgctagagaaaaatcttctaaatctaaaaaatccgaagctgaattcttcaatgaatctcaaccaaagaaagaaatcaaagctgaaagagttgctgaccaaaaatctgtcgatgctgctttattaagtgaaatcaaaaagaccccattattgaaacaatacttggccgcctcattctctttgaagaacggtgacagaccacacttgttaaaattttaa

SEQ ID NO: 5641 - DNA, 843 bp, Candida albicans
aaattttttactaggaatttttttcttttacgtttttcacttgtttcatataatcaccaactcaagtacaacatggctgtcggtaaaaacaagagattgtccaaaggaaagaaaggattaaaaaagaaagtcgttgacccattcaccagaaaagattggtttgacatcaaagctccaaccacttttgaaaacagaaatgttggtaaaactttgatcaacagatctaccggtttaaagaatgccgctgatggcttggaaagtagagttttcgaagtttgtttggccgacttacaaggttccgaagaacactcttacagaaaaatccaattgagagttgatgaagtccaaggtaaaaacttgttgacctacttccatggtttggatttcatttctgacaaattaagatcattggtcagaaaatggcaatcattagtagaagctaatgtcactgttaaaacttccgacgattacgttttgagagtttttgccattgctttcaccaaaagacaaccaaaccaaatcaagaaaactacttacgctcaatcctctaaattgagagaagtcagaaagaagatgattgaaattatgcaaagagaagtttccaactgtactttagctcaattaacttccaaattgattccagaagtcattggccgtgaaattgaaaaatccacccaaaccattttcccattacaaaatgtccacatcagaaaagtcaaattgttgaaacaaccaaaattcgacttgggttcattattggctttgcacggtgaaggttcaaccgaagaaaaaggtaagaaagtttcttctggtttcaaagatgttgttttagaatctgtttaa

SEQ ID NO: 5642 - DNA, 615 bp, Candida albicans
  unsure (34): Identity of nucleotide sequences at the above locations are unknown.
agagtgcctacaaatattgagaagaattgcaaangaaagaagcaatctgatgttatgagattcttgtatcgtgtcagatgttgggaatacagacaaaagaatgtcatccacagagcttccagaccatctagaccagacaaggctagaagattaggttacaaagctaaacaaggtttcgttatctacagaatcagagttagaagaggtggtagaaagagaccagttccaaagggtgccacttacggtaaaccaaccaaccaaggggttaaccaattgaaataccaaaaatcattgagatctactgctgaagaaagagttggtcgtcgtgcttctaacttgagagtcttgaactcatactgggttaaccaagattccacctacaaatactttgaagttattttagtcgacccatctcacaaagctatcagaagagatgctagatacaactggatcgttaacccagttcacaaacacagagaagccagaggtttgacttctgctggtaagaaatccagaggtattaacaagggtcacttgttcaacaaaaccaaagctggtagaagacacacctggaagaagcacaacactttatctttatggagatacagatcttaa

SEQ ID NO: 5643 - DNA, 324 bp, Candida albicans
  unsure (292): Identity of nucleotide sequences at the above locations are unknown.
tgtggatcgcaccaaataatttgtctaatcgtatttgaagactggtttttttttttcctctcagtttttctaaacactcaaaaagctgaacgaaaaaaatttttttttcacaattctactgttttcacctattaccatcaaccacattgcatatattatcttacaatggcaagacaaaattttgtgggggtcgtcatttcccaaggaaaaatgaacaaaacagtcaaagtccgtgttcaaggaagagtatacgataagcgtgttgacaaagagatccttaccagaaaagatnacttggttcatgatgaaagtatcatttgttag

SEQ ID NO: 5644 - DNA, 300 bp, Candida albicans
ataggaattgctgcaggtgttaacaaaggtagaaaaactactgccaaagaagttgccccaaaaatctcatacagaaaaggtgcttcatctcaaagaaccgttttcgttagatcaatcgtcaaagaagttgctggtttagctccatacgaaagaagattgattgaattgattagaaatgctggtgaaaagagagctaagaaattggctaagaagagattaggtactcataagagagctttaagaaaagttgaagaaatgactcaagttattcttcaccacggccggctggaaggaccaccg

SEQ ID NO: 5645 - DNA, 342 bp, Candida albicans
agaataaaacttggatatactaacacatgtattatagagggtgtcgttgttgctaagaaagacttcaaccaaccaaagcacgatgaaattgatactagaaacttgttcgtcatcaaagctttacaatctttgacttctaaaggttacgtcaagactcaattctcatggcaatactactactacaccttgactgatgaaggtgttgaattcttgagaaccgaattgaacattccagaaggtatcttgccattgaccagattgaagaatgctccagctgaaagaccaagaccatcaagaggcggtccaagaagaggtggttacagaggtagagctagagactaa

SEQ ID NO: 5646 - DNA, 561 bp, Candida albicans
ataaaaagatttactaacttaatttcaattatttatagaaagatgtctagattaaacgaatatcaagttattggtcgtaatttaccaactgaatccgttccagaaccaaagttgttcagaatgagaatttttgctccaaacaccgttgttgccaaatcaagatattggtatttcttgcaaaaattgcataaagttaaaaaagcttctggtgaaattgtatctgtcaacattatttctgaagctaaaccaactaaagttaaaacttttggtatttggttaagatatgaatccagatctggtattcataacatgtacaaagaatacagagatgttactagagttggtgctgttgaaaccatgtaccaagatttagctgctagacacagagctagatttagaagtatccatattttgaaagttgttgaattagaaaaaactgatgatgttaaaagacaatacgttaaacaatttttgactaaagatttgaaattcccattaccacacagagtccaaaaatctaagaaattgttccaagctactgctccaaccactttctactaa

SEQ ID NO: 5647 - DNA, 447 bp, Candida albicans
tttactaacaaatacatcttattgttcagagacgttccagctcaagatttcattaacgcttacgctcaattcttgcaaagacaaggtaaattagaagttccaggttacgttgacattgtcaagacctctgccggtaacgacttgccaccacaagaagccgaaacttggttctacaaaagagctgcttctattgctagacacatctacttgagaaaacaagttggtgttggtgctttgaacaaattgtacggtggtgctaaaaacagaggtttcagaccacacaaacacgttgatgcttccggttctatcaacagaaaatgtgtccaagctttacaaaagattggtgttttggaaatctctccaaaaggtggtagaagaatctctgaaaacggtcaaagagatttggaccgtattgctgcccaaactttggaagaagatgacgaataa

SEQ ID NO: 5648 - DNA, 495 bp, Candida albicans
gcagaagtgatatggaataccgtactaacaatgtcttttattttaggtcgtactgatgctccattcaacaaagtcatcttgaaatctttgttcttgtctaaaatcaacagaccaccagtttccgtttctagaatttctagagctttgaaacaaaaaggtgctgctgaaaagaccattgtcgttgttggtaccgttaccgatgacaacagattattggaattcccaaaggccactattgctgctttgagattcactgccggtgctaaagacagaatcttgaagaatggtggtgaagccattactttggatcaattagctctaagagctccaaaaggtcaaaacactttgattgtcagaggtccaagaaactccagagaagccgttagacactttggtttcggtccacacaaaggtaaagctccaagaatcttatccaaaggtagaaaattcgaaagagctagaggtagaagaagatctagaggtttcaaagtttaa

SEQ ID NO: 5649 - DNA, 864 bp, Candida albicans
acttgttgtctaatgttcagtctaccttcattaacacaaaagcttgcaataagtaaagcaagtttcttgactccaatccgacaacttggagctttaggttatttgaaacctcatgaaggttctacattcaattataaaaaattgggtcgtggtcaatcatcaggtaaggggaaaacagcaggacgtgggcaaaaaggtcaaaaggctagaagtaaagttccatggtggtttgaagggggtcaaacaccatattacaaacgtttcccaattactggttttagaaaaccatatcaaacagtattagaagaagttaatttactgaaaattcaagatttttgggataatggtagaattccattacaaaaaggtgaaactttgaatataaaagtaatgaaagattgtggacttgtaactgggagtttaaaagatggtattaaaattttgggtaaaggagttgagaattataatgttccattaaatattgaagcttctagagctagtgatattgccattcaagcaattgaaaaagcaggtaattcttttacagcaagatatttcacaagattgggtttaagagctcatgtgaacccagaacaatttcttttaaagagaggttacgtccctttacaagctagaccaacacacaaaagagatattgaattttattctaatcctgacaaaagaggatatttacaaaaggatagatcaatattgttggatcctttggaaaaagctcgtgaagaacttgctaataaaaaaccaaccaagaagttatctaaatttaaatcattggaagaacaattagaagaagcttctacaattagttacaaaccatcaaaaacaatcagtgttagcgatgtctag

SEQ ID NO: 5650 - DNA, 393 bp, Candida albicans
gctgggaaagctgcccctgctccacctgtgggtccagcattaggttccaaaggggtcaaagccattgatttttgtaaagaattcaatgctcgtactgccatttacaatcaaggagttgctatacccgtcataatacaattcaaacctgatcgtacttttacatttgaaatgaaatctccacctacttcatggttattgatgaaagctgccggagtagaaaaaggtagtgggaaagcattgaaagaacccgttggtgaagtgtcgttgaaacatatttgggagattgccaagattaaaaaaaccgatgatagacataaatcagttgatcttaaagctattgttggaagcgtgattagtacggcaaaagtggttggtatcaaagttgtaccataa

SEQ ID NO: 5651 - DNA, 192 bp, Candida albicans
aaagctgccggagtagaaaaaggtagtgggaaagcattgaaagaacccgttggtgaagtgtcgttgaaacatatttgggagattgccaagattaaaaaaaccgatgatagacataaatcagttgatcttaaagctattgttggaagcgtaattagtacggcaaaagtggttggtatcaaagttgtaccataa

SEQ ID NO: 5652 - DNA, 561 bp, Candida albicans
aagatccatgaattaacttcattgattgttaaaagattcaaattatctccagaaggtattgccatttatgctgaaagagttgaagaaagaggtttatctgctgctgttcaagctgaagctttgaaagccaaattattgtctggtttaccaattagaagagctgcttatggtgttttaagatttgctatgggtgccggtgctaaaggtgttgaagttgttatctctggtaaattaagagctgctagagctaaatctcaaaaatatgctgatggttttatgattcattctggtcaaccaactagagatttcattgatattgccattagacacgttttaatgagacaaggtgttttgggtatcaaagttaaaattatgaaagatccagctgctaatagatttggtccaagagctttaccagatgctgttaaaattgctgaagctaaagatgaagatgaagttattccagctccaactgttaaatcttataaacaaactgctgaagatgaaactgaaactgatgctccagttgaagctgaagctgaagttgaagctactgcttaa

SEQ ID NO: 5653 - DNA, 336 bp, Candida albicans
caatcctcttgtgttatagttaacgttccaaaaactagaaagacctactgtaaaggtaaagaatgccgtaaacatacccaacacaaagttacccaatacaaagctggtaaagcttctttgttcgctcaaggtaaaagaagatatgacagaaaacaatccggttatggtggtcaaaccaaacaaattttccacaagaaagccaagactaccaaaaaagttgttttgagattggaatgtgttgtctgtaaaaccaaggctcaattaccattgaaaagatgtaaacatttcgaattgggtggtgacaaaaaacaaaaaggtcaagctttacaattttaa

SEQ ID NO: 5654 - DNA, 378 bp, Candida albicans
cgtgtcaaaatgggtgtggtcgtatttggtaaatcaataaaacacaactttcctgtccgtatagggttggccaagacgatatttggtataggatatcagacagcagaaagattgatggctaaagtgggaatatatcctaattgcagaatgaatcagctaaccgaaccacagatcatggatttgaacaaagaaatctcacaattattagttgaagggcatttgaaacataaaatcaataatgacatcaagatgaagagaacaatcggttcctatgctggatcaagacacgcattgggtttcccagtcagaggtcaacgtacaaagacaaatggttctacagccagacaattgaacagaacagaaagattccgtttataa

SEQ ID NO: 5655 - DNA, 186 bp, Candida albicans
tatccagctcgatactttcacggctgcctgaataatgaattgattgttgctggtaactccttggaagctgtttctcaaaatgctgctgatattcaacaaatctgtcgtgtcagaaacaaggatatccgtaaattcttggatggtatttatgtttctgaaagaggtaccattgttgaagaaatctaa

SEQ ID NO: 5656 - DNA, 399 bp, Candida albicans
  unsure (29): Identity of nucleotide sequences at the above locations are unknown.
agagctagaataatgtttcctgatgaagnacaagaacaagaaaaaaccacaaatgaacaagaagctggtcaactggaagattcagaatccgaaaccaaacaaaaaatcataaaattagacaacaatcaattagtggtagataaatttggtaatgatttaggattgatttgtattgaagatttgattcatgaaatttcccaactttcagataatttcaatagtataactaattggttattaccatttcaattgaatgctccagttaatggatggggaccacaagctaaattggctagattgcttaaagctgatgaaaataaacaaaaaatcagtcttgctcaagatttcaaattacaagaagttgaagatattgataagataattgatgaacaaaattaa

SEQ ID NO: 5657 - DNA, 381 bp, Candida albicans
aaaatagaaaaaaaaaatattcagaaatcatctgagtccttcttccacattcaacaacattatatttatttacaaaaagaattcaagatggctatattgaactcaaaccctgaagttcttttacgtaaaagaaaaaatgccgataggaaaagaatcgaaaagcaagaacaaattcgtgaacgacaactcaacaaaaataaattgaagaaaaaaaatcagaataaattcattcgtgctgaaacattagttagtaatcataaatcaaatgaattagaaagaaaaagaatcaagagtttgattaaaaaacaaaagcaaacccaacaacaacaagaatcagcagcagcagactctggtgatgctaaattattattttttacctag

SEQ ID NO: 5658 - DNA, 591 bp, Candida albicans
tcaaatacaccaccatacaataatcaacttgttatgattagatcactattcaatggtattaggttagttaaacctaataataccaatatcaatggtattactagaccaatcacttcatatatgaactcaataaattccaacataccaatactcaaaaaccacaacatcaacaacaacaacaacaacctttcatcattcaatcaagttcgtcattcatcattaaatcaaattcaaaaatataaacattatgatccaattaaacccaatgtaaccaagtcaccagatttagacaataatccattcaaaaagggagttgtattaagaataatgattttaaaaccgaaaaaaccaaattctgcattaagaaaatgtgccagagtaagattaactaatgggaatgttataagtgctttaatacctggtgaaggacataatttacaagaacatcatgttgtattggttagaggtggtagagttcaagatgttcctggggtcaaatatcatttggttagaggtgcttttgatttggttggagttgctaatagagcttcatcaagatcaaaatatggtgccaaaaaacccaaacaatag

SEQ ID NO: 5659 - DNA, 597 bp, Candida albicans
tcaaatacaccaccatacaataatcaacttgttatgattagatcactattcaatggtattaggttagttaaacctaataataccaatatcaatggtattactagaccaatcacttcatatatgaactcaataaattccaacataccaatactcaaaaaccacaacaacaacctttcatcattcaatcaagttcgtcattcatcattaaatcaaattcaaaaatataaacattatgatccaattaaacccaatgtaaccaagtcaccagatttagataataatccattcaaaaagggagttgtattaagaataatgattttaaaaccgaaaaaaccaaattctgcattaagaaaatgtgccagagtaagattaactaatgggaatgttataagtgctttaatacctggtgaaggacataatttacaagaacatcatgttgtattggttagaggtggtagagttcaagatgttcctggggttaaatatcatttggttagaggtgcttttgatttggttggagttgctaataaagcttcatcaagatcaaaatatggtgccaaaaaacccaaacaatataaagaaatagtgtacgttacg

SEQ ID NO: 5660 - DNA, 438 bp, Candida albicans
attttttttcttatagcaactactaaagcttcagctgctaaaaaagctgctttgaaaggtgttaacggtaaaaaggctttaaaagttagaactagtactactttcagattaccaaaaaccttaaaattaaccagatctccaaaataccaaagaaaatcagtcccacactacaacagattggatgcccacaaaatcattgttgctccaattgccactgaaactgctatgaaaaaagtcgaagatggtaacactttggttttccaagttgacatcaaatccaacaaacaccaaatcaaatctgctgttaaagaattatacgatgttgatgccttatacgttaacactttgatcagacctaacggtaccaagaaagcttacatcagattaacctctgactacgatgctttggatattgctaacagaatcggttacatctaa

SEQ ID NO: 5661 - DNA, 387 bp, Candida albicans
tttaaaaagaatttggttagaaatgcccaaattgaggaatattacccaattttatatggtgccagagttcaagaagaagattattccagaggttttagaattccaagaccaatgggttttaatccaaaaaatttgagagcttccagagctgccaatggaacccaaatgaaaagaccagccgttgtcaaaactcacttgagaaacatgattgttgttccagaaatgattggttctgttgttggtgtctacaatggtaaagttttcaacactgttgaaattaaaccagaaatggttggtcactacttgggtgaattctccattacctatattccagttagacacggtagagctggtaatgcttcttctaaattcatgccattgagataa

SEQ ID NO: 5662 - DNA, 426 bp, Candida albicans
  unsure (161),(268): Identity of nucleotide sequences at the above locations are unknown.
gaaagttggttgaattggggttggcatccagttaatttaattgacgttgccagagctggtcaaaccgttaccccccatagaacttttttcaaccaccaagtttacagagttggtaaagttaccgatgaagctatgtgccccaccgaatttgacagaaccanaaagaccattaacccaatgggtgttttcgttagatacggtaacgttaacaacgactttgtcttattaaaggtttctatcccaggtgtcaagaagagagttgttactntgagaaaatcattgtacgttgacacttccagaagagctgttgaaaaggttaacttgaaatggatcgataccgcttctagattcggtaagggtagattccaaaccccagctgaaaaacacgctttcatgggtactttgaaaaaagacttggaaaactaa

SEQ ID NO: 5663 - DNA, 801 bp, Candida albicans
aagcagttctcaaaaattcctctccttcctggggggcggttggaaaacttttttttttttggcagttgtggaaaaaaaatcattttcaccagtgtacatgtgctaacaccctgcaaaaagctctcgttttttgatagggagagttactggttcacaatagtatactccacaggggtgttctttttttggggaatagtcaaccaacagcaaatagccaaggatcaagcttcatcattaatcatgtcttttaagatcttatcagaacacccaagtgaattagaattaaaagttgctcaagctttcgttgattgggaatctcaagctgatttaaaagctgaattgagaccattacaattcaaatctatcaaagaaattgatgttaatggaggtaaaaaagctttagctgtttttgttccaccaccaagtttacaagcttacagaaaagttcaaactagattaagtagagaattagaaaaaaaattcccagatagacatgttgtctttttagctgaaagaagaatcttaccaaaaccagctagaaaagctagaaaacaacaaaaaagaccaagatcaagaactttgactgctgttcatgataaaattttggaagatttagttttcccaactgaaatcattggtaaaagagttagatacttggttggtggtaacaaaatccaaaaagtcttgttggattctaaagattcaactgctgttgattacaaattggattctttccaacaattgtactcaaaattgactggtaaacaagttgtttttgaaatcccaggtgaatctcattag

SEQ ID NO: 5664 - DNA, 471 bp, Candida albicans
gaagaaaaaattaaaaaaatgtctgacgttgaacaagaacaaattgttgaagaagttgttgttgaagaacaatccggtgccatcaccattgaagatgctttaaaagttgttttaagaacttctttagtccatgatggtttagctagaggtttaagagaagcttctaaagctttatctaaaagagaagctcaattatgtgttttgtgtgactctgttactgaagaatcaatcatcaaattggttgaagctttatgtaatgaaccagaagaaaaaatcccattgattaaagtttccgatgctaaattattgggtgaatgggctggtttatgtcaattagatagagatggtaatgctagaaaagttgttggtgcctcttgtgttgttgtcaaaaactggggtgctgattctgatgaaagaaacatcttgttggaacacttttcttcaaccaatataatggatttcttccaccac

SEQ ID NO: 5665 - DNA, 318 bp, Candida albicans
catttttttatagtatacgttaaaggtaaacacatttcttaccaacgttctaagagcgttactaacccaaacgtgtcattgattcaaattgaaggtgttgcttctccaaaagacgctaaattctacttgggtaaaagaattgcttacgtttatagagctccaaaagaaatcagaggttctaagatcagagttatctggggtaaagtcaccagaactcacggtaacaacggtttagtcagagctaacttcaaaaagaacttgccaccaaagacttttggtgcttctgttagaattatgttgtacccatctaacatctaa

SEQ ID NO: 5666 - DNA, 408 bp, Candida albicans
aaggtgctttccgatggtggtttgtacgttccacactcaccaaacagattcccaggttgggatatcgaagccgaagaattggatgctgaattattgagaaaaacattttcggtggtcaccgttgctgaatacatggaagaattattggatgatgatgaagaaaaataccaatctatcttcaaaaactacatcgaagaagaaattgaaagtgaagatgttgaagaaatttacgctaacgctcacgaagccattagagctgacccatctttcaaaccaactgaaaagaaattcaccaaagaacaatacaaggctgaatctaagaaatacagacaacaaaaattgaccagagctgaaagacaagccaaagttgctaagaagattgctgaattcaaagctcaacaagaataa

SEQ ID NO: 5667 - DNA, 636 bp, Candida albicans
ctctctttccctttttttttcgaatcaaggtaccatatcattaccaaattagacatcatgcctatgcaaaaagaattcagaacctctgcttaccactcccgtttccaaactcctttccgtagaagacaagaaggtaaaaccgactactaccaaagaaagagattagtcactcaacacaaggctaaatacaactcaccaaaatacagattggttgttagattcaccaacaaggatatcattgctcaaattgtcagtgctcacattactggtgatgttgttttcaccgctgcttatgctcacgaattaccaagatacggtatcaaatacggtttgaccaattggtctgctgcttacgccgttggtttattggttgccagaagagctttgcaaaaattaggtttggatgaaacttacactggtgttgaagaagttgaaggtgaatttgaattgactgaagccgttgaagacggtccaagaccatttaaagtctttttggacattggtttgcaaagaaccaccactggtgccagattctttggtgttttgaaaggtgctttccgatggtggtttgtacgttccacactcaccaaacagattcccaggttgggatatcgaagccgaagaattggatgctga

SEQ ID NO: 5668 - DNA, 300 bp, Candida albicans
cttattattttttttttgaataggactaaaagaacaaagaaggtgggaatcaccggtaaatttggtgtcagatatggttcatcattgagaagacaaaccaagaaattggaagttcaacaacatgccaaatacgattgttcattctgtggtaaaagaactgttcaaagaggtgctactggtatctggaactgtaaatcttgtaaaaaaaccgttgctggtggtgcttacactgtttctactgctgctgccgctactgtcaaatctaccattcgtcgtttgagaaaattagctgaagcttaa

SEQ ID NO: 5669 - DNA, 870 bp, Candida albicans
aggaaggaaaaaaaattttttagagaccatatttcaacagattactgtcaacaagtttcttccattaacaattctaaacatcaaatcaccctagaagtaatggcatcagttgcaagaccagcagtagcaccttccaatgctacttttaaagataaagaaaaaccacaagaagttcgtaaagccaacattcttgctgctagagctgtatcagatgcaattcgtacatccttgggacctaaagggatggacaaaatgatcagaaccaaaaatggagaaatcattatatcaaacgatggagcaaccattttgaagcatatggcggttttacatcctgctgctagaatgttagtcgatgtaagtcatgcccaagatgttgaagccggagatggtaccaccaccgttgccatcttgacaggtgcatttttgggtgcagcagaacgattattaagtaaaggaatccatccaactttaattgctgaatctttccaaagagcagctcaacgttcagttgaaattttgttagatatgtcatataaaataagtttggataaccgtgaacaattgatccgtgctgccactacttcattaagttcaaaaattgtctcacaacactcacaattattggctcctttagctgttgattctgtattaaaagttataaatgaagaagaaattagtagtggccctgatgaaactattatgaagaaaaatgtcgatttaaatgatattagattgattaaaaaagtcggcggtaccatcgatgatactcatttagttaatgggattgtattgactcaaaatgtcgttaaacacgctggaggacctgtacgtgtggacaaagccaaaattggttatattcacccgcgctga

SEQ ID NO: 5670 - DNA, 555 bp, Candida albicans
gtattggtgaatttaattgaagaacttgttagttcaggttctaaaattgttgaaatcactggtgtgaagtccagaaatattaaaccaacagtatctgtcattataagaggggccaataacttgtttcttgatgaaactgaaagatctttacacgatgccttgtgtgttattagatgtttggtcaaacaacaggctttaattgctggtggtggtgctccagaaatcgaagtttctagacaattgatgaaagaagccaataaattatccggggtggaacaatttgtttataaagaatttgctcaagctctagaagttatcccaacaacacttgctgaaaatgctgggttgaatccaataaatgttgttacagatttgagaaatagacacgaaaatggcgaaaaagatgcgggtatttctgtcagaagatctggcgcctcaaacacttatgatgaacatgtattgcaaccagtattggtaagtacaagtgccatcgtattggcatctgaatgtgtcaaatcaatattgagaatcgatgatatccaatttagtcgttaa

SEQ ID NO: 5671 - DNA, 246 bp, Candida albicans
gttcaattgttacttcgaataactcaattactaccaagaacacccccaataaaaatgtctaccgtgtactttgatgtctccgccgatggtcaaaaattaggaaagatcaccttcaaattgtacgaagatgtcgtttcaaagactgctgaaaatttcacagctttatgtactggtgaaaaaagtgttggttacaaaggttctattttcccccgagtcaccccacaattcatgcttccaagtgggtga

SEQ ID NO: 5672 - DNA, 207 bp, Candida albicans
  unsure (30): Identity of nucleotide sequences at the above locations are unknown.
ccaatttgcggaccttccacggccgtggtngaacacggttcccaattctgcattaccaccgttccatgcccatggttggatggtaaacacgttgttttcggtgaagtcactgatggtttagacattgttaaaaagattgaatcttttggttctggcagcggtgctacttctaagaaaattgtcattgaagaatctggtcaattgtaa

SEQ ID NO: 5673 - DNA, 1185 bp, Candida albicans
ttagaggaatctggtgggattgaaattaacttaaagatggtaaaagtttatttaactggaatgcaaattcaacaccccaacggcaatgatgatagccccgtgatgccattgccccaagttgaaattactggagatggaataacaacgttatttttgttagttggggaattattaaagcaagccgaaagatttatcagtgaaggtgttcacccacaagttattgtcgatgggtttgaaattgctcgtgaaatttcattggaattccttgatcagtttaagcaaaaggttgaaatttttgatcgtgaattccttttgcaaattgctcggtcatcattagccactaaagtcaccaatgaattagctgatgttttgactccaattgtcactgacgccgtattgactgtcaaagaagaatcacaaagaaatttggatttacatatgattgaaattatgactatgcaacatggccattctaaagaaactgaattgattcaaggtttggttttggatcacggagctagacacccagatatgcctagaagagtcaagaacgcttatattttgattcttaatgtctccttggagtacgaaaaaactgaagtcaactctgggtttttctattcctctgccgaacaaagagaaaaattagtggcctcagaaagaaaatttgttgatgataaattacgaaagattatagaattgaagaatgaagtgtgtgatttgaactccgataaagggtttgttataataaatcaaaaaggtatagacccaatgtctttggatgtgttggccaagaatggtattttggcgttaagaagagctaaaagaagaaacatggaacgtttgcaattgatttgtggtggagaagcacaaaactctgttgatgatttgagtccggaaattttgggatatgctgggctagtttatgaaaacgccattggtgaggataagtttacctatgtcacagaatgtaaagacccaagagctgctacaattttgatcaaaggttccaacagccatgttttacaacaaactaaagatgctataagagatggattaagagctgtttctaatgtgattaaagatgcctctatcttaccaggtgctggtgcattttggttaagctgcaataattatttattacaaagtgatgctagtaaaaagattttgataggtaaaaactaa

SEQ ID NO: 5674 - DNA, 1677 bp, Candida albicans
aatcatacaataatgttttcaactgcacgttcagatacattatttttaggagcacaaaagataagtggagacgatgttcgtactcaaactgtacttgcagctcaaactgtcgccaacgtcgtcaaatcatcattagggccagttggattggataaaatgttagttgatgatattggtgatgtcactgttaccaatgatggagccaccattttgtctttattggacgtacagcaccctgcaggtaaaatattagttgagttagcccaacaacaagaccgtgaagtcggtgatggtaccacaagtgtcgttatcattgctgccgaattgttaaagcgtgcacacgaattggtgagacatggtattcacccaactacaattataagtggatatagattggctttaagagaatctattagatatatcaaccaagttttgtcacaaaatgtcgatcaattgggcaaagaaactttgataaacattgctaaaacatcaatgagctctaaaatcattggttctgattccgatttttttggaaaaatggtagtggatgctatgttggccgtaaagaccaccaacggtaaaggtgaaaccaagtaccctgtcaaagcagttaatattttaaaagcccatggtaaatcagccttagaatctgttttagttgatggttatgctttgaattgtactgttgcatcgcaagcaatggtaaagtcagttaaaaatgcaaagattgcttgtttagatattaatttacaaaaggcaagaatggccatgggtgtgcaaataaatatagatgatcctgaccaattagaagaaattagaaaaagagaatatggtataatcattgaaagaattcaaaagatcttggctagtggtgctaatgttattttaaccacaaagggtattgatgacttgtgtttgaaagaatttgttgaaaatgattgtatggcagttagacgttgtaaaaaagaggatttaagaagaattgctcgtgccactggtgccactttggtgtcatccttgtctaatttggaaggtgaggagactttcgaaacttccaatttgggatatgccgaagaagttgttcaaaccagaatcagtgatgatgaatgtattttaatcaagggtacaaggcaacacacttcaagttccataatattgcgtggtccaaacgatttctccttggatgaaatgcaaagatcattacacgattccctttctgttgtgaaacgtactttagaaagtggacacgttgtaccaggaggtggggctgttgaagctgcattgaacatttatttggaaaattttgcaacaaccgttggctcacgtgaacaattggctattgctgaatttgcaaatgctttattggttattccaaagaccttggctctgaatgctgccaaagatgctagtgatttagtggctaaattgagaacttaccatgctgctgcacaaattgctaaacctgatgatgaaaaacgtagaaaatacaaaaactatgggttagatttaatcaatggtaagatcgtcaacgaagcaactaacggtgtattggaaccaacagtatccaaaatcaaatccttgaaatccgctttggaagcatgtgtttcaattttaagaattgacactattatagaagttcaccctgaacctccaaaagaagatcctcatgctcattaa

SEQ ID NO: 5675 - DNA, 867 bp, Candida albicans
agattttcttttaaaattcttaacagttgttactttttttttctttattcaattcaactcaataaaaccctgcaaatgtcgagtattttactagccgttatattccttgtgaatttggtattatcgtcggtcatccctcaaactgatctcaaattatcagttgaagagcaatcacatttagaaggtgacccttctgttactcataaagtagtatttacaattaaacatggtgatgagttattgggtgatttgactcttgcattatttggagaaacatgtcccataactgttgaaaatttttatcaattagccattagaggagaagatggtcaaggttataaaaatagtaaatttcatcgtattattaataattttgttatacaaggaggtgattatgatggtcgcggtgggaaactgatttatggtgatagttttaatgatgaaaatttcattttaaaacataataaattggggagattatcaatggctaatgctggaccaaatactaatggtggacaatttttcattttaaatggtaaacctactccacatttagatggtcatcatgtagtttttggacaattggttgatgggtttgatactttacagaagataagtacagttgaaacaaaagattcaagtcctttgaaaccagtggttattagtgatgttaaaactgccattgataaatcaaaggtaaaccaaaaggaagaaacagggacatcgtcatcttcagaaactgaaggaatcacagcagtgtcaacttcagtttatagctatttgttcataatactcttgttaggtgttgtttttgctgcatataagatgatgcccagacgtgatcaaatcactactatcaaagattaa

SEQ ID NO: 5676 - DNA, 741 bp, Candida albicans
caagaagggcgattgctaagtagaaaatgtaaagagaaaaaaagtttacacatgtcgagatcttttacacagttccacagtccaacaaaaccgcaattatcaatgaagtcgttgacatcaatcgcattgattgcttcaatcatagtagcattctatactcaacttgttttgggtggttcctcgaacttaccaaagaacccacctgtgacaaacaaggtatatttcgacgtcgaggaggatggcaaatcgattggccgtatcaccattggtctctttggcacggttgttccaaaaactgttgagaacttcagagtcttgtgtaccggcgagcttggacctagctacgaaaataccgttttccacagagtgatcaaggatttcatgattcaatccggagattttgaatatggccaagggtatggtggttattctcctacccacaacaatgggaagttcgacgacgaaaactttgaattgaaacatgacagaaagtaccgtttgagcatggccaatgctggaaagaacaccaacgggagtcagtttttcatcaccactgccttaacaaagtggttggacggggcacatgttgtgtttggcgaggtcttagatggcaaggatgttgttgattacattgaaaatgtcaaaactggtagaggtgaccgtccagtcaaagaaatcaaaattgttgcttctggggagttgaaggatagtgaaaccaatccatccaaagatgagctttaa

SEQ ID NO: 5677 - DNA, 363 bp, Candida albicans
gaaattcttaaatctgttgaatgtaaacgtaaaaccaaatcaggagattttataagtgttcattattccggtaaattagaagcagatggtaaagaatttgatagttcatatctgagaggtacaccattaccatttaatctcggtgggaaacaagtgattacttgttgggatgaaggattattagatatgtgtattggtgagaaaagagaattatggtgtcatccaaatgtagcttatgggagtcaaggaattggtccaattccacctaatgctgcattaatatttactgctgaattgattgatattgctggggttgataaagaagaacaagaagaagaagttgtaaacaaagatgaattataa

SEQ ID NO: 5678 - DNA, 927 bp, Candida albicans
ttaactttaattgtgcctacacgtgcgtttgtggaaaaaaaaaaacagcccctaaacctagacccagcgtaccatgtaattatcaccacaatggaccaaaccatagcccagattataaatgatgatattgacttgtatgctgtattaggggtttcaagtgacagtactcctcaggatattcgtcgagcctatcgacaaaaagccttactatttcatcctgacaagtacgatggtgatgaaacaaaatttaatttgattttgaaaagttatgaaatacttagtgatacttcattaaagtcgaaatatgacgaactttgtcaaataaagttgacaaaactagagaatcgtgctaaactagatgatttaacaagaagatttcaagatgaactaatagcgtcagaactgaaaagacaaaagcatcgacatcccgatatcgaatcaatgaaacaagaaggattgaaaaaaagaagaatccaggaacagaaattatttaatgaaaagaaaacatgtactacgatatatgatataccgttgaataataatgtgtcagttagcctgacgtatgccaatacgacagtgagcttaaaatacaaattcaaaaaggagcttgaaactctaattgatgaaaatgttctatccaaaatcatgctgattttcggtgaggttacaaaagtaacaatgaatggacatgataatagatatgcttatgcgtatattgattttgctacaatagatggttgcaaccaagctttacgtcacaactatagcgaatcagcaagaaaatgggacggcactgatgtgagaaagttggctagtttacttagagaatgcaagaaagcagacacaggaaactcagactttactaataatgctaaagttaaccaaattttgagagattatttgaaaagtgtcaattcccgtatctga

SEQ ID NO: 5679 - DNA, 609 bp, Candida albicans
aaaaagcttatagaaagcaagctatcaaattgcaccctgataaaaatgccaatgatcctaaagctgctgaaaaaatttcaagaattgggcgaagcgtacggtattttactgaatcctgaaagtagaaagatatatgatgagtttggggttgaaggaatgaaggaaaatccaaccatgcaacaagctgccgatatagatcctgcggaatttttcagtatgatttttggtggtgattcattcaagcaatggatcggagaattgagtatgttgaacgatatgtcgaaaatgggggagattattactgaagatgaagtagaattagataatgttgaagaggaaagtaaactggggaaacagcatggagctacagattcattgaatgagtctgttcaaacattgacaatttctgataacaacaacaacaataatactaaggtatccagcagcaacaataaaccaacatcaaacttaacttcagaagaaattaaaaaattgaagaaacaaaagatcaatgaacaacaaagagaacaaatgttaaagtaccaagaagaagctaaacaagctaagttgaaacgtatagatgatttaacaagtggtatgttaaaaaga

SEQ ID NO: 5680 - DNA, 591 bp, Candida albicans
agacaaaagctcatgattgacaaagccaatgctactattcatgcatcaaaaacttttggtgtatcaaaaattttcacttcggttaaatcaaagacagaaacagtcaaaaatggttattcaattttgaaaaccgcagttgatgctcagttatcaattgaacagatggttaaggaacaagaacaatttttattagcacaggaagaaggacaccagccaactcaagaggaattggtaaaacaagcagaaatggaaagaatcatcaccggtaaattcttagctactgcatgggcaactacaaagtttgaagtcaccgatatcttgcgtaaagtttgtcataatgtattgcgtgataaaaccatttccaagaaggaacgagttgctagagcagaagcattgttgtatatcggtaaagagatgtcgaaagttgaaaggtcccctgaagaggaagaagaagcaagaatatttgaggaaatgatggcagaggctcaagccaagaaatcttccaaaaagcaaaaatcaatgaataacaaggagttagaagaatatatgaagaaaatggctgctgagaatgctgaagcagaggaaaattga

SEQ ID NO: 5681 - DNA, 1017 bp, Candida albicans
actttgagaagaccaccaaaatcaaagtttttttacaatcgacgtgttttttcaaagtgttttttttccaactctttccttcttaataatcccactacatcatattggaaggtcatgaaattcataaaagttttcctcttatttgtaaccattgtggttgcagctcattggagtaaagaagattacgaaattttcagtttgaatgataaacttcaacaagatttaggtcatgatattactttttataaatggttaggattagaaaaaggtccaaaatcaaatttacaagaaatcaccaaagcctatagaaaattatcaagaaaattacatccagataaatttgcctcagcgagtcgatctgataaaaagaaagctaataaaagatttcaaagattatcattagtaggaaatatattaaaagatcaatctttgaaaagaagatacgattatttttataccaaaggtttccctaaatggaaaggtaccggatattattattctaaatttcgtccaggggttatattcactttaattattctttatgtgttagttgggtttttgcattttttctctcttaaaattaatagaaaacaagcatttaaaagaatagttgatttgaaaaatgaagtgaaaaatcaagcttggggtggattacaattcccacctggtgatggttctgatcgtaaactttcaaatgaggctaccggaaaagtttttttggttaaagctgatggtacggtttggttagttgaaaatgatggcgaacaacatttaattgatgaatatgatgttaatgtcaatcctggttttaaagaatcattatttttcaaaatccccgttaaaatttggaatttgatattaggtaaatgggttccaattgatacttcggttgaatataagaaacaagaaacatcacctcaagaagacgacactaagaagaaagtacagaaaaagaaaagtaaaggtaaaaaagttgaattgccgaatgggaaagttgtatacagtagaaagaaatga

SEQ ID NO: 5682 - DNA, 870 bp, Candida albicans
  unsure (100),(841): Identity of nucleotide sequences at the above locations are unknown.
cccaaaccatttgttcatcgaagatttgtcaccaagttaagttattattttcccaatttggccgtggatgttattttaagattaaaaggatgtaccaatntaaaccatattcaaattattaaaaaagtcggtggcaaattatccgattcttacttggaccaagggtttatattggaaaagaaatttggtattgttcaaccgaaaaaaatcaccgatgctaaaatccttattgctaatacttccatggacaccgataaggtgaagatttttggtgctaaattcaaagttgattccacatcaaaattggccgaattagaaaaagccgaaaaattgaaaatgaaaaataaagttgacaaaatagccaagtttggcattaatgtgtttatcaatcgtcaattaatttatgactacccagaacaattattcactgatgccaagattaactccatagaacacgctgattttgatggggttgaaagattagcattagtcactggtggagaagtggtgagtacttttgatagcccagacaatgttaaattgggacattgtgagtcaattgaagaaattataattggcgaagacaccttcctcaagttctctggagttgctgctggtgaagcatgtaccatagtgttacgtggtgctaccgagcaagttttggatgaagctgaaagatcgttgcacgatgcattatcggtattgtcacaaactactagggaaaccaaaactgtgttgggaggaggatgttctgagatgttaatggctaaagctgttgatcaagcagctgcaaacgaaacaggaaagagtgctttggccatagaagccttcagtagagctntgagacaattgccaactattttagccgat

SEQ ID NO: 5683 - DNA, 300 bp, Candida albicans
actgggaaaaaaaaggcaaagaaaaaaccatcgttggtatttttagttcaacacttacaaaccccatacagttcatctcttcacatcccacatctagctattaattttacaaaaatggtgaaagatacaacatattatgatatcttacaagttgaggtgacagcaactgacgttgaattgaaaaaagcttatagaaagcaagctatcaaattgcaccctgataaaaatgccaatgatcctaaagctgctgaaaaaatttcaagaattgggcgaagcgtacggtattttactgaatcctga

SEQ ID NO: 5684 - DNA, 1548 bp, Candida albicans
actataccactaacaatcaacatggtagtcgataatacgtattacgatcttttaaacattgaaaccagtgccacatcattagaaatcaaaaaggcgtatcgtaaagctgcgattaagttacatccagataagaatcccaatgatcctgatgccgccgctaaattccaagaagttggtgaagcatatcaagtattgagtgatgaaacgttaagagcaaaatatgataaatatggtaaacaggaatcaatccctcaagaagggtttgaagatcccgctgaatttttttccatgatttttggtggtgaagcatttaaagattggattggagaattgagtttgttactggaattatcaaaatcagctgaactatctggatattctgatgatgcagacaagaaaaaggatactaagactgctggaactgggtctgatgagtcaaaggaatccaatgaatcgaagaaacaaaagcttgacactacagagaatggccacaaatcatcaactgaacctcgcttattagcaaatggtgaaaatactcctggaaaccagttaactgaaaaggaactcgaagagaaaaaacgtaaggaggaattggaaaagtttgaagaagagtgtcgagtgaaaaaaatcgaaactagaaatgaattgagtaaaaaattgattaacaaattatcgttattcactgaaactgatatgaaagatgatgtagttgagtctttccaaactaaaatcaaatatgaagctgaatctttgaaaatggaaagttttggattagaaattttacacactattggacatatttataaaaccaagtcaaaaatatttttgaagaaccagacatttttcggttggggtgggttttggtggtcaatgaaggaaaaagggggtgttgtgaaagatacgtttaagacagtttcggctgcattagatgcacaaagaacaatggaagagtatacacaaatgcaacaggacaatgagtatcatgctaaaaaggaagcagaagaggaagaagccaagaaacaagctaacgaagaagtatctaaattggagaaagagttggaagaggtgaaaaaggaacaacaacaacaaaagtctcaagataagccggctgctgaaactgaaggtagttcgactggtgattctcaactcaaagaaggacaagaagcagaaggaagtgtcagcaaatctgaaactaaagaacctgccaaacacactgctgaagaattggctgaaatggaaaaatatcttatgggtaaagtgttagcagcagcatggaatggatcaaaattcgagattcaaggtactgtccgtgctgtttgtgataacatattggaggacaaagatgtgtcacttgagactagagttgctcgtgccaaagcattaagactaataggtgatgtttttgtttctatgacacgtacagaagctgaagctgaagaagcaagggtttttgaagaattggtcgcagaagcaagtaaaaaaagagaaaagaaaaagacaccaactgaagcagagcaacaacaagaacgtgctgaacacgcttcttga

SEQ ID NO: 5685 - DNA, 1461 bp, Candida albicans
caacaactttcagttatggcattttctaatcaaacaccaacaattgttgttttaaaaaaggggacagattcatctcaaggacgaggtcaaattttaaccaacattaatgcttgtttagccattcaagacactttaaaaccaacattaggaccatttggatccgatattttaatagttgatagtaatgggaaacctactatatctaatgatggggccactatattaaaattattagatattgttcatcctgcagcacaaatgttagttgatatttctcgatctcaaaattgtgaagttggtgatgggacaacatcggtgactattatagctggagaattattaaaagaagcaaaaaattttattgaagatggaatcaatcctcatttaattattaaaggttatagaaaggcatgtcaattaagtattgaaaaaatcgaatcattatcaattgatgtattggaaaataatactgatagtggcaatttccgtgatttattggaaaaatgtgctactactgccatgtcatcaaaattaattaaaactaattctaaatttttcacaaaaatggtagttgatgccgtattaactttagatcgtaatgatttgaatgaaaatttaattgggattaaaaaagttccaggtggttcattagaagattcattatttattgatggtgtagcatttaagaaaactttttcatatgcaggatttgaacaacaaccaaaatcattcagtaaccccaaaatattatgtcttaatgttgaattagaattaaaagctgaaaaagataatgccgaaattagaattgatcaagttaatcaatatcaacaaattgttgatgccgaatggaaattcattttcgataaattagaatcaatttatcagactggagcacaaattgttttatcaaaattacgtattggtgatttagatactcaatattttgctgatcgtaatatattttgtgctggtagagttagtgatgatgatatgaatcgtgtgattcaagctgttggtggtgatattcaatcgagttgttctaatttacttaaagatgggaaattaggtcaatgtgaaagttttgaagaaattcaaattggtaatgaacgatttaatatttttaaaggttgtccacaaactaaaacttgtacattaatattaagaggtggagcagaacaagtgattgctgaagtagaacgttcattacacgatgccattatgattgttaaacgatcaattactcataaaaaaattgttgctggtggtggtgccattgaaatggaattatcgaaatatttacgtgattatagtagacaaattcatgggaaacaacaattaattattgctgcttttgctaaagctttagaagtgattccaagacaattgtgtgaaaatgcagggtttgatagtattgaattattaaatcgtttaagaagttatcatgctaaagtgaaagtgttc

SEQ ID NO: 5686 - DNA, 2079 bp, Candida albicans
aatcatttcaatataatgagatcatcacaatcttcttggttaccacgtattggtttattatatgtggcgttagttatacttataccatttttggtttcaccgaagcacgcatttgcggttgctgcagtgagcgatgatgaatcctcgacagataattatggtacagtcattggtatagatttgggtaccacttattcctgtgttggtgttatgaaaaacggtaaggttgaaattttggccaacgatcaaggtaatagaatcactccatcatacgtgtcgttcaatggcgatgaaagattggttggagacgctgccaagaatcaagcttcctctaatgtcaacaacactgttttcgatattaaaagattgattggtttgaaatataatgatgacactgtgcaaaaggaacttaaacatttgccttacaaaattgaaaataagggtaacaaaccagttgttaaagttgaataccaaggtgaagaaaaaactttctcccctgaagaaatttcatctatggttttgggtaaaatgaagagtattgctgaagattaccttggcaaaaaagttactcatgccgttgtcactgttccagcttatttcaacgatgctcaaagacaagctactaaagatgccggtactattgctggtttgaacgttttgagaattgtcaatgaacctactgctgccgctattgcctatggattagacaaaggcgaccaagaaaaacaaattattgtttacgatttgggtggtggtacttttgatgtttctttattgtccattgaaggtggtgttttcgaagtcttggctactgctggtgatactcacttgggtggtgaagattttgatttcaagattgtcagatacttggccaaacaattcgagaagaagcacaatattgatatcactgccaatgctaaagccatttccaaattgaagagagaagccgaaaaggccaagagaactttatcttctcaaatgagtactagagttgaaatcgactcctttgttgatggtattgacttttctgaaactctttcaagagccaagtttgaagaattgaacatcgctgctttcagaaagactttgaaaccagttgaacaagtgttgaaggatggtggtgtcaagaaatccgacattgatgatattgttttggttggtggttccaccagaattccaaaagttcaagaattattggaaggattctttgatggtaaaaaggcttctaaaggtattaacccagatgaagctgttgcttatggtgccgctgttcaagcaggtgttttgagtggtgaagaaggtgttgatgacattgttttgttggatgttaacccattgactttaggtattgaaacttctggtggggttatgaccactttgatcaagagaaacactgccatcccaaccaagaaatctcaaatcttctcaactgctgctgataaccaaccaactgttttgatccaagtctatgaaggtgaaagaaccatggctaaagacaacaacagattgggtaaattcgaattgactggtattccaccagctccaagaggtgtcccacaaattgaagtcactttctcattggatgccaatggtatcttgaaagttgaagctgctgataagggaactggtaaatctgaatccattactatcaccaacgaaaagggtagattatccaaggatgaaattgatagaatggttgaagaagctgaaaaatacgctcaacaagatcaagaattgaaagaaaagattgaagctagaaactcattagaaaactatgctcatgtcttgagaggtcaattgagtgatacttctgaaaccggtttaggttctaaattggatgacgatgacaaggaaactttggatgacgctatcaaggaaactttagaatttattgaagataactttgatactgctactgctgaagaatttgaagaacaaaaacaaaaattaattgacgttgctaacccaatcacagcaaaattatacggtggagctgctggtgaaggtgctggtggcgccggggatgccaaattcggtgatgatgattcagatgatgaattcgatcacgatgaattgtag

SEQ ID NO: 5687 - DNA, 1590 bp, Candida albicans
atgtcaattcaagctcctgttgtatatttaaacacttctacgcaaagacagcagggaagacaagcacaagttgctaatatcactgcagccaaagccgttgccgatattattcgtacctgtttagggccaaaggcaatgctcaagatgttattagatccaatgggtgggatagtgttgactaatgatggtcacgccatattaagagaaattgatgtatctcacccagccgccaagtcaatgattgaattatcaagaactcaagatgaagaagttggagacggtaccaccaccgttatcattttagcaggagaaatcttagcacaaacattcccttacattgagaaaaacattcatccagtaatcattattaaagctttaaaacaagcattgaaagatgctttggaaatcatacacgacgtgtcaactccagttgatatcaaaaatgatgctgccatgttgaagttgattaaagcttctattggaaccaaatatgtcaacaaatggtctactaaaatgtgcgaattatcattgaaagctgttagaacagttatggttgaaaaaggagattacaaggaaatcgatgtgaaaagatatgttcgtattgaaaagattccagggggcgaagtcaccgatagtgaagtgttagatggtattttattaaacaaagatgttgttcatcctaaaatgaaaagagaaataacaaatccacgtattatattattagattgcccattggaatataaaaagggtgaatctcaaaccaacattgaaatcacaaaggaagaagactggaacagaatattacaaatcgaagaagaacaagttaaattaatgtgtgatcaaatcttggagtttaaaccagatttggtgatcactgaaaaaggtgtaagtgatttagctcaacattatcttttgaaaggtggagcttctgctttacgaagagttaaaaaatcagacaacaatagaattgcaagagctactggagccactatcgtaaatagagttgaagatttgaaagaatccgatattggtactaaatgtggagaattcaaagttgaattgattggtgacgaatatttcacttatttggtcaaatgtgaaaacccacaagcctgtactgtgttgttaagaggtgcctccaaagatatccttaatgaaattgaaagaaacttacatgatgctatggctgtcaccagaaacgtcatgtttgaaccttcattgtctccagggggtggggccaccgagatggcttgtagtgtcagattggctgaaaaggcaaagaccattgaaggaattgaacaatacccataccaagctgttgcagatgcctttgaagtcataccaagaactttaatccaaaactgtgggggtaatccaatcaaagtgttatcgcagttaagagccaaacaagcacaaggtcaatacacatacggtattgatggtgaaaatggtaaggttgttgacatgaaagattacggtatctgggaaccagaagtgatcaaacaacaatcaattaaaactgctattgaaagtgcctgtttattgttaagagttgatgatattgtcagtggagtacgtcaaagtcaatag

SEQ ID NO: 5688 - DNA, 1473 bp, Candida albicans
agaaacaagatcatcgtcaacaagttgggcaaaaaattcatcaccaacgatgccgccaccatgcttaacgaattggaaattgtccaccccgtagtgaaaatcttgatccaggcatcaaagcagcaggaattcgaaatgggcgacaacactaacatagtaatcatccttgctggcgagttcctcaacgttgctgaaaaattgttaacattgggcttgaatgtcagtgaaatcatccaggggttcaacttggcaaacaagtttgtgatgaaaacattggacgagttggtcgttgaaaaagtcgagtcgttcgaaactgacctattaaaagcagtgaagccagtgatcgccgctaaacagtacggcgtagaagataccatcgccaaactcgtcgttgatgccgttgccctagttatgaagaacgggtctttcaatgtcgacaacataagagtggtcaaggtcatgggtgcatcgctctcccaatcgcaagtggtcaagggtatggtcttcccaagagaacctgaaggtaccgtcaaaaacgccgccaaatccaaagttgtcgtgtttaccaaccccatcgatatttccaccaccgaaaccaaaggtacagtgctcctccacaatgcccatgaaatgcttgatttcaccaagggcgaagaacaacagttggaccagttgtgcaaggaaatccacgattcaggagttaaggtggttgttgctggttctagtgtgggcgagttggcgttacattacctcaacaagtacggcatcttggtgttgagagtgccatcgaaattcgatttaagaagaatctgccaggtgtgtggcgccacccccttgcctcgtttgggcgcaccaacaccagacgaaatgggcgaaatcgatatcatcgaaaccaaagaaattggtggcgacagagttacaatctttagacaggacgagtcgagctcaagaactgccaccatagtcgtaagaggggcaacccaaaacaacttggacgatattgaaagagctattgacgacggtgtaaactccatcaaaggattgatcaaagataacagattattgcctggtgccggtgcagttgaaatagagttgatgaagcgtatcaccgcctatggcgagtccactcctgggctcttgcaattagctataaagagttttgccaaggcatttgaggtgatcccaagagtgttggccgaaacttctggtcacgactcttcagaaatattaagtaaactccatgctgcccacgctgaagacactggtctcagagctggtatcgatatagattcaggagaggtggctgatactgccgtgttggatatcttggctacaaagaaatccgctatagatttagctgttgatgctacaaacactatcttatctatagatcaaataatcatggctaaaagagctggaggcccagttatgccacaacagccaagaccgggcaactgggatcaagacgactga

SEQ ID NO: 5689 - DNA, 1701 bp, Candida albicans
ctacttctgcatacccaagtagcaaacaattttcacatctcatttatagacaatatggctcgtgcaccacagggaatgcccgatttaagtaatgcgattgttgctcaagatgaaatgggtagaccattcattatagtgagagatcaaggtaaaaaggaaagaaaacatgggattgaagctacaagatcacatattcttgcagccagatcagtggcatctattgttaagacatcattgggccccagaggtcttgataagatcttgattagtccagatggtgagatcactattacaaatgacggtgctacaattttatcgcaaatggatttggaaaaccaaattgccaagttgttagtcgagttatccagatcacaagacgatgagattggagatggtaccactggggttgttgtattagcaagtgcattattggatcaagctttagaattgattgataaaggcattcacccaattaagattgccaatggattcgacgaggcatgcagaattgccgttgaacatttgaacaccgtggctgataacatattaatagatgacaaggaaaatcttttaagagcagcaaaaacatctcttgggtctaaaatagtttccaaagcccacgaccattttgcgaagatggctgttgacgctgttttggaagttgccgatttggatagaaaggatgtcgattttgaattaatcaaaatggagaagaaagtaggtggatcaattgaagactcttctttaattaaaggggttttattggataaagacttttctcacccacagatgccaaaagaagtaagagactgcaaaatcgctattttgacatgtccgtttgaaccacctaagccaaaaaccaagcacaagttggatatttctaccgtagaggaattcaaggtcttgcaagaatacgagcaaaaaaaattccaggaaatgatagatgcagtgaagcaatcaggggcaaatgttgttgcttgtcaatgggggttcgatgatgaagccaaccacttgcttttagccaacggattaaacgccataagatggattggtggttctgaactagaattattggctattgctacaaacggtcgtattgttcctcgttttgaggatttaactcctgacaagttaggtactgctggtgtcattagggaattggagtttggaactacaaaggatcgtatgttggttattgaggaatgctcgaatacaaaagccgtgacttgctttatcaggggatcaaacgaaatgattgctgccgaaggtatcagagcattacacgattctctttgtgttgttcgtaatttggtaagagacagcagagtcgtttacggtggaggtgctgccgaattgacatgttcattggcagtttctgaagcagcagacagacaaaagggtattgatcagtatgcttttagagcatttgctacagctttagataccattcctatgacattggccgaaaattctgggttggatccaattgaaactttgtcagctttgaaatccaagcaagttaacgaaaactcatcacatttaggtgttgactgtctcggtaagggaactaatgatatgaaagaattatttgttattgatccattgatcggaaagagacaacaattgttattggccacccaattaacgagaatgattttaaaaataaatgatgttatcattagtggaaaggatgagtattag

SEQ ID NO: 5690 - DNA, 477 bp, Candida albicans
aatcatagtttacatgacaatttcctaatgatatcatactataaagtattgggagttacaccagaagcaagtatcccagaactcaaacaagcatataagctgaaattgttaacctcacatcctgataagattgataactcgtcggcacaagttgatataccactaattaaacaagcatttgcgacattagttgatccaacatctagaaaacaatatgacaaacagctcattgaatcatcaaaattgaaaggattcaacataaatggaggtgggttggatatttatagcctcgacgattttgagtttgacaatgatgaatggtcaaaatcatgccccagatgcactgcccacaatagtatctgcctcacagaaacagatttagaaaagggaacaccagataaagatggcgggtttgatatcatagtacagtgcaatagctgcagtctttggattcaagtgaaatattacgaggaatga

SEQ ID NO: 5691 - DNA, 2055 bp, Candida albicans
ttctttctctctctattttttttttacattaaatcaacacctaatcaagatattttacatcaccaacccaattactgttccttcattattcacatatacagaatgaagggatctctatttattttttatatattgtccattgttttttgtgcaatattaggaattgattatggacaacaattcaccaaagcagtactactcgcaccaggtgtaccgtttgaaattgtattaactgatgaagggaagagaaaggacttatcaggtttatgcattagaaaagtatcgaataatgacttggaaagagtatacggatctcaaatgggttccttagtaaccagattcccacacaattgtattttggatttgaagcaattattaggaaaaagcatagatgatccttcagtgaatcaatatttgaaaaatcattttgttaaattagttgcagatgaagcaagaaacggaataaaatttgatttaggatttaataattcgactttagagttttcagtcgaagagattttggctatgaatttgaatgaaatcaaatcccgtgcgttgaatgatttggaagcaaatccacatgcggctgcattagttgaggatgtggcagtatcgattcctccttttgcgtcccaagctgtcagacaagcttatttggactccttggcgttggccaacttttccaatgttttgggattagtcgaagaaggtacttctgttgccttgaattacatcaccaacaagaaattggataaagatctgtacgacaatgttaaacactattatttgatctatgatgttggtgcaggatataccacgactacattgttttcgtttactccaaaatccattgggcaatctgtattggaaattgaaagtattggctatgacgaaatgcttggaggtaaaacattgaccaatagtgcttactcattagtgttggaaaagttcttgaatcaatttaatttagaagaatccgatttaactgacaaaattgctgcaagattacaagatactgccgaaaaagccaagataattttatctgccaatagcgattttcaaacaactttagagtctgtttataatgagaaagatttcaaattgtccatcacgagacaagaatttgaagatatcaatgccgacataatgaatcacattgcagacccggtgttgaaaaccgtcttggaagctgggttgaaggtggacgatattgaatacgttattttgaatggtggatctaccagggttcctttcatccaaaaacatattgccactttagttggtgagaataaaatctcgaaatcagtgaatacggatgaaagttctgccttagggaccacagcaaaagcattgagattaaaggctggcgtcagcagcggtaaagacatgattttattggaaaaaagtttttcaaattttgaagttggcttaaatgatcaagaagaaactaaagtcgtgtttgcaaaaggtgcaactataggaaataccaccagagttcatttagggaaaataagtgaggacaggattgctatctcgttatatgaaaatggcgctttaattaaatcatacaattttgatgatcttttatccaaagcaaaaaagttggactgcaaattaatagaagataagaatatatttggcaagctctcgttggataataacaaaatatttgacttagttggtcttgaagtcgaatgctcttctggaaaagaaggatccttttttgataaattgatgaagaagggtcactccgaaaacgatgaaggttctgataatcaagaagagtcaacaccagaaaattccaccaactccaccaaaaattctaactcatcaaagaaagtgagatctccaaaagtcatttatgttccagtttccaaaccaacttaccctcatataaaacctattggtagagttgccaaacaatcattattggataaattggcatatttgaaagctcaagatgagcttaagattgctacagatcacatcaagaacgaattagaaggtcaatgttacaaattgcgcgagttcattgaaacacatcattcagcatga

SEQ ID NO: 5692 - DNA, 1107 bp, Candida albicans
gtgatgaatattttgaagatgatgatgacgatgaggaggagattgaggaggaagatgaattggacgaggaagaaggagaggaagaagcagaagcaggaaaatttttcacagaaatctattggtaaaaagtccagtaagaaagatgaagatgaagaagaagacgatgaggaagaagacgatgaagacgaggatgaagatgaagatgacgtttttgaatacattgtttgtactttatcaccaagacatcaataccaacaaactcttgatttaactattactccagatgaagaagtttattttgttgttactggttcatacccaattcatttgactggtaattatattgagcatccagctgatcaagatgaagaagattatgatgatgaagatgaagattacgatgatgaatatgatttgtctccagatgaagatgaaatcatttatggtgctgcattagatgatgaatatgacgatgaagaagaaagtgaagaagaaggaactccaaagattgaagaaattgttgaagaaaaagaaaaagaaaaagttaaggaatcaccaaaagaatccaaaaaaagagtcgctgaagaatcaacttctaaaaaatctaaaaaggctaaaaaagatgaaaagaaatcagttcaattttcaaaagaattagaacaaggtccaactggttctacattagtcgaaaaggacaataagaaagccactccaactaaagataaaaaggaaaccccagtgaaagatgatggtgataaaaagaaaaaattcccaaccaagactttattaggtggtgttataactgaagatagaaaaattggttctggtgccactgccaaatccggtgctaaagttggtattagatatattggtaaattgaaaaatggtaaagttttcgataaaaatacttcagggaaaccatttagttttaaattaggtaaaggtgaatgtattaaaggatttgatttaggtgttactggtatggctgttggtggtgaaagaagagttattatcccaccaaaaatgggttatggatctcaagctttgccaggtattccagctaattcagaattgacttttgatattaaattggtttccttgaaataa

SEQ ID NO: 5693 - DNA, 564 bp, Candida albicans
gacgtgacatatactgttacaattgatcatggtaaaggtacatatacatgcaatacagaaaaaggggagtcttcatggtgcaaacatctttatatgtaccataaaatgaggttcttggtatttggagataacatggagaagcaaatggattttcctgtggaagactcccaggattatttttcggatgaagatgatggttctttttcggatattgaattggagaatcaagaaagagattttcattttgataacgagcttgcttctagctatgatgatcctctggatattattgatgttgttaatctgacgagttctaataatgaaggaacgtctacagggcagtctgatcaaaatataccccaaaaaacttttgaagagttaagtacagaaattgaaggttatttggaaaacatttcaaaaagatacaaggaaatacttgaaaattcacctgagaaagttagcgaacttgcactttacatgagaagttttagtcaacaattagagtatatctcaacaggtaaacaagaccttgatcatgatccaaaacgcagaaaaaaaaattag

SEQ ID NO: 5694 - DNA, 288 bp, Candida albicans
cataacaagtgttcaatatatttcaaacattccgtcatgtcctcatcctatacaaaagagcaagaatcaatagttttaaaagtcttatcgtacaagccccatcagttttatgaaattttgtcggtggagaaatccgccagtgagggcgaaataaaaaaatcatacaggaagctagctataaagtgccatcctgataaaaaccctcatccaagatcatcagaagcgttcaagattttaaataaagcatgggaggtgttgagtgacccacaaatagaagagaatatttga

SEQ ID NO: 5695 - DNA, 357 bp, Candida albicans
atctttcaaaaattcaactacaactacaaaacataccaaaaagtcatgaaaacatgttactatgaattattagaagtatcatcaacggcaaccgataccgaattgaaaaaagcatatcgtaaaaaggcattattacttcatccagataagaatcctgataatgttgaagaagccaatcataaattttcattagttagagctgcttatgaagtattaagtgatcctcaagaacgagcatggtatgataatcataaacaatcaatattaaatgatgaagatgaaattattgaaagagaatcatatttcccttccatttctactggaagaatttttcgtttttttaatccatcaatgtaa

SEQ ID NO: 5696 - DNA, 1299 bp, Candida albicans
agaaatcccaacatgttaaatatcctaaaatttcctgggtatgaggaatatcatgatgatgatgataaaaatattaatgccattaatccatcacttataaagtatcccagatttggtaatagtcaaagttcttatattgatcaaattcgaccatttaataatgtttggggatcatttcaaacttgtaaaacttttaattggaaagatgaatatcgatattccgtggctccggatagaagaacaagaagaatgatggaaagagaaaataaaaaattacgtgatgaagcaagaaaagaatataatgaaaccattaaaaaatttgtaagttttattaaaaaaagagatccaagagttaaattggggcaagaagaattaaataaattgaataaacgtaaacaattacaagaatacgagaatcaaattcgtcaacaacaacaattaaataaattgaaaaataataataatggaggtgatgctaaattcacagaacaagattggcaaaaattgacacctgaagaattacaagaattagaacaaatgttacaagaagaatatgaagaagaagaagaggccgatagtactgattcagaatttggccatgatgataatgaaaactttgaggttcatgaatttgaatgtattgtttgtgataaaatttttaaaaatgaacaacaatttcaaattcatgaggattctaaaaaacataaaaaaaatgttcgtcaattacaatgggaaatgaaacaagaagggattgaattaggtatagataaacatgatggtgatgatttaagtgaatttgaaaccgcatcaagtgaattccacgacgacgacgatgatgatgatgatactgatgttagtgaagaattagaggaggaagttttagaggatcaagacaatgaactcaaaacagacgaagacaacctagtagagaaatctacagacaatattgatcttgataatttagaagttgatgatgaaatagatgaagatattgttgttaatactacgacaacaccaaaaaaggagtccaaacccactttaaataaagtggaagaagatttagctcatttattaggacaaacaagtctatcgaccaagggtattgatgaatctgatgatgattggctggataataaaagaaaacctaagaagggtaaaaagacaaagaaaaaatcccaaacaaattctaaagaatcaacaccaaatacagaaaataaaccaattatcaataatattgaaaaatgttcagtatgtggaactacttttgaatcaagaaatcaattgtttaatcatgttaaa

SEQ ID NO: 5697 - DNA, 918 bp, Candida albicans
caactacagacaggccaaatgattttcaactacttgttggcattgtttcaaattcttgttttagcctctgctagagctcaggcagatgaatatgcgtcagacccaaatattttcgagttgacgccttcaaattttgacaaagtggttcacaagtctaattacactactttggtaaagttttacgccccttggtgtggatactgtcagaaattacaaccagtataccataaattgggcaaatacatcaataaagatgcaaagtattccatcaatattgctagtgtaaattgtgataaggattacaataaacagttgtgttcacaataccaagttcgaggatttcccacattaatggtgttcagacctcctaaatacgaaaaggggaaacaagtaaagttgcagaaacatgccagtgaagtttatcaaggtgagagaactgtcaagtcaatcaccaagtttttaacttcaagattgaaaaattatgtgaaaaagtttcacaacatcagaagtgatggtattgctgaatggttggcagaagatataccttctgttttacttatttccaatgcaaatctggttagtccattgttgaaatccatagccattgattttcttgaccgtgtcaacgtcggaatgatatccaaatttaatgatgagtcgcataaatttgttattggcgataaagaaattgaagttccagctacctccaaatcgagcttgttctattttaataaggaaaagggagagttggtggcttatactaaatctgacaaattaaatgacaagatcaaaataactgaatggataatagaacaaacccagcaacaaccaatagagggcccattatccaagaaggaaaagaagtattactacaaatatagaacaggaaaaaaaaaaatagaacatgacgaattatag

SEQ ID NO: 5698 - DNA, 1992 bp, Candida albicans
aatttttttttcttgcttcttcatcaccccaaaacatctcacataaacttcctttctttaatgaaaatattgaagaagttattttcctctacaatattttatagtcaaagaagataccattcaatgtcagtcgaaacaattagtgatagtttgaaacaattgggattaagtcaaccagcagccattgaaggtacccaccctcaatataatgtggttgatgtctttagaaactatatcgctgaagaattacatcgtatttcatcagttgacaaatctattatcattcaagctttggatacaccaaaagtattagatcaaggtgatattattgttcctattccaaaattaagattaaaaggaatcaatcctaatgaaaaatccaaggaatgggctgaaaatttcaataaagggaaattcatttctgaaatcaaacctcaaggagtgtttttacaattctattttgctaaaacattattgtataatttggtcattgaagatgttttaaagagaaaatcagattatggttacttacctttgggtgttggtaaaaaagccattgttgaattctcgtctccaaatattgccaaacctttccatgctggacatttaagatctactattataggtgggttcatttctaacttgtacgaaaaagttggctgggatgtcaccagaatcaattatttgggagattgggggaaacaatttggtttgtcagctgttggttttgaaagatacggtgacgaatctaacttagcttcatatccaatcaaccacttgtttgaagtttatgtcaagattaatcaagatgtcaccaacgagactagtgaagccactggtgaaactccagcagaaaccattgatgcttctgaacaggatgaaaagaaaatccaatcctctaccaatgaagaagctagaagatttttcagaagaatggaagatggtgatgaatcagcattgaaaatttgggcaagattcagagatttgtctattgaaaaatatgttgacacttatggtcgacttaatattaaatatgatgtttattctggtgaatctcaagttccacaagagaaaatgaaagaagctaccaaattgttcgaagataaaggtttgattgatattgaccgtggtgccaaattaattgacttgactaaatttaacaaaaaattgggtaaagcattagttgaaaaatcagatggtacttccctttatttgactcgtgatgttggtgaagctattaagcgttatgaaacctacaagtttgataagatgatttacgttattgctgcccaacaagatttgcattgtgctcaattctttgaaattttgaaacaaatgggattcgaatgggcccacaatttggaacatgttaactttggtatggtccaaggtatgagtaccagaaaaggtactgttgtgtttttagataacattttacaagaaaccaaagaaaagatgcacgaagttatgcagaaaaacgaagagaaatatgctcaaatcgaagacccagataagattgctgatttgattggtatttctgctgttatgattcaagatatgcaatctaaacgtattcacaattacgaattcaaatgggacagaatgacttcatttgaaggtgacactggtccatacttgcaatatgctcactctcgtttgtgttccatgcaaagaaaatcaggtatttctatagaggaattagaacatgccaactttgatttgttggttgaaccatgtgccagtgcattagcaagaactttagcgcaatacccggacgttattaaaaaggctgtcaaagggttggaaccatccacaatcgttacttatttgttcagtgtgacacatattgtctcccaatgttacgatattttatgggtttctggtcaagaaaaggatgttgccattgcaagattggctttatatgaagctgctagacaagttataaataacggtatgaccttgttaggtttgactccagttaatcgtatgtaa

SEQ ID NO: 5699 - DNA, 642 bp, Candida albicans
ttgtattgggaaaatacattttgcaagtattcaaataacaactgcattcccatcatcattccccgatgtattaggattaccaccaaagacccttgtttaattccttgtgccatagatcaagatccttattttagagtttgtagagatgttgccgataaattaagatttaccaaaccatcattaattcatgctaaatttttcccagctttacaaggggcatcgacaaaaatgtcagcttctgatactacaacttcgattttcatgggtgatacagcaaaacaaattcagaaaaaaattaataaatatgcattttccggtggtagagccactgctgaagaacatcgagaattaggaggtaacccagaagtagatgttgcattccaatatttatcatttttcagttatgatgatgaaaaattggcacaattagaacaaggttatagaaagggagaaatattatcaggagaaatgaaaaaagaatgtattacagttttacaagaatttgtatctgcttatcaagaaagaagaagtaaagttgacgaccaagttgttgaaaaattcatgaaaccacataaattggtgtttggtaataaggaaagaaaagttcctgccaaacaaagagaaaagaaagccaaaaagtaa

SEQ ID NO: 5700 - DNA, 768 bp, Candida albicans
caaggactagaatataaatcactccacatttcattaatgtcagttgaagaaaaagtatcacagctcaaagttactgaggagtcagaacaaaaaatcactccatgggaagtagaaggtgccgttgtagacgggaaatcaatggggattgattatgataaattaattagtcaattcggtaccaaacatatcactgaggaaacattagaaagatttaaacaagttactggtgaagagcctcatccatttttgaaaagaggagtatttttttcacaaagagatttagatcgtattttagatttatatgaacacggagaaccattctttttatatactggaagaggtccatcatctgattcaatgcatttgggtcatatggtaccatttatatttacaaaatggttacaagaagtatttgatgtcccattagttattgaattaactgatgatgagaaatttttatttaaacaccaattaactattgatgatgttaaaggttttgccgcagaaaatgctaaagatataattgccgttggattcaatccggaaaatacatttatcttttcagatttacaatatatgggtggagcattttatgaaaacgtcgttagaacatcacgtcaaatcactacttctacagctaaagcagtatttggattcactgattctgattgtattgggaaaatacattttgcaagtattcaaataacaactgcattcccatcatcattccccgatgtattaggattaccaccaaagacccttgtttaa

SEQ ID NO: 5701 - DNA, 1308 bp, Candida albicans
agacatggaaatttactgaagtacagggggaaagaattggatgaattcaaaatgcatccacaacaacaacaacaacaacaagaagttaaacaagaattatcccctgccgaaagtaatgaaagtaatgaaagtcttgccaaagatagttcaacaactccagctagtataagtgattctccactgcattctgaaactgaatcaacagtatcttctactattattgccaattctaatcaaattttcaaatgtcctagttgtgatgccgagtttagagttcgtggttatttaacaagacatatgaagaaacattctacgaaaaaagcttatacatgtccattccatgataaaagtatttatgttgatgaaaataatataactcataaatgtcattctagtggagggttttccagaagagatacttataaaacccatcttaaactgcgtcatttcaattatgcaaaaccaataaaatcagcagaacgttcaaaagtccctggacaatgtgccatgtgtggtgaacattttaatagtgccgaaatatggtgtgagattcatgttgaaggtggtgaatgtaaatttttacccatgggatttaaaggtaaatcaagaatcaagaatagattaaagaaacaaatacagaaaaacaaaatgattgatcctgaattggtaccgtttgctagtaaagttttagaagaagttgaacaagaacgacaaaagaagaagaattatagaactactggtactggtagtgaatcatcaatacaatctcaagagagtgaaagttcaattaattcaacacctttatcaatgcaaatttcagcaccagtaccgatgccagtatcaattcaacaacaacaccaacaccaacaccaacatcatcatcatgtgcaaaatcaaaatcaacaacaatcaattgccactccagcatcgatatattcatcttcagcgtcgtctacatcatcatatgaatccacccattcaccatatactccacaatcatctcgttctccattgagtcatatgtataatccccaacaaccaccttatttcaatcaaattgctcaagctcatcaacaagatggtcaaaagaatcaagtcaaagatgattatgacgatgaatattgtcttgatgttgatcaattgaatactacatttgttaatgaaactgttgccaattatttacaaattcatgatttccattcaatgaatcaatatcaacctggtcaacagcatcaacaacaacaacagcagcagcagcagcagcaacaacgacaacatcaagaacaacaaccatcaatgtatttctga

SEQ ID NO: 5702 - DNA, 1329 bp, Candida albicans
agaaccaattctataactatgttgatactttccataggtttaatccaccacacatcaaacaaaagtttatacaccatatcaccaaataaaggaaaaagatatgaaccttttaccacgacgagtcttggcaacttccagttccatgtagtcaggtttttacacagattgatttatgggacacaaagatatcaagaattattcccaccaatacaaaagattaagaatatcaacaatgtgaaacagcataggattttccctgtgaattgtgcagcagatgatttggatttaggctttggtgaatcagatcaaattgagctttttaaccatccttccaaagacacttatggccaatttaacttgattcagttaattgacattttcgacccaccacaggtgcatgcgccatcttcagcagatgagtttttcaagagcaacaagggctctgaacacattgatatatttgatatgatcaccagacaaccaccgccattccaccaacaccaattaaatatcgaaacgccatattttgaagactttgctacaccacttgttttacccccacatgaggtctcctcagatgatgtcgagtcttatttctctggctctgtttcaacagtttcttctattgaaccattagatgacgagtttgtaccaccaccgcaaccaccaagaactcacacatcaagaaaaagaaaacacgattcaatttcaccaccagcatcatcagattcttcttcttcttcttcttacgtaccacaacttataccatcaagcagttcttcagttacatcaaacggcgattcacctgtatctcctaccaccaagagaaaatacaccaagaaaaagcaaccagtattttcaaatgttgacgaacctatagtcattaccactactactaaaacaaacaatattgatgttaaaaaaatcaccacaactaaaaatgggacagttgagaatagatttgattgtccatcttgtgatgcttctttcaaagttaaaggatacctcacgagacatttgaaaaagcattctacgagtaaggcatttgaatgtccatttttcgataaccatggtgttcatggaagtaaatgtcatccaacaggtggattcagtcggagggacactttcaaagttcatttaagagcccttcattttatatatcctgctggtgtaaaggcaagtcagagaaatagttttaatggaagatgtgctggctgtttccaatattttgacaacaactctgaatggttagaaaaccatattgaagctggcaagtgtacgggaactgtgcaatataaacagaatgtaagcaatctattactagattaa

SEQ ID NO: 5703 - DNA, 1182 bp, Candida albicans
aatcacgaaatggaaacaaaagaccacgaagcaacacatagcccacaacaatctatccaattatcttctagcacagtacaacaggatcaaaatcagaaagggctaccactgcagcagcagcagcagcaggaggatgagcagcagcctcagaagtaccaaacagacaatattagagttccttctcagcttccgtcaaactatgatttcaccaccactaccgagaccatatctagctcgtatgtaatgccgctgagcaatatacaaggtaattctcaataccaaaaacaacatttctccactgatcctgtaccgtcaccagtaccacatcaatttagttacccaggctcagcggtatcacaagcgccaccacaatcatcagctccaccatcacaatcacattcaatacccctgtatcatcaatattttggacagagtttaccgaatgatcagctacaattacattcttcagttcatgaaccaagaaatacccatttatcgttaaattctacaagaccctactattcttcaatttcacagccacaaccaccgccaccaccacctccagcaccacaacgtctaccatcactaccgacatattcaatgcctgaaaccgagtcccaacaacaacactatgtttggtccactcaggacagtcaatctcatcaccatcaagtaccaccttctgcaattactactgatagttccactgcttctactaccactcgtaatactatgccttttcaagtctccaccaacattgatatcaaccgattccctgacgtgacgtcattggtcaactcgaatgccaatattgttgttccattagttgagagtcgatttgttgatgctaaaatttgtactatttgcgggaaaagaatcactagagacatgtcacgacacttgaggacccatcaagtagaagctcgtttccattgtgtttttcccaaacgtcaatgtcgtcataaactggggaaattcaatcgaccatatgatttcaagaaacatttattgaatcgtcatttcatatttgatgattcagcaattaagcgattacataacttgagtgataaattagatcattgggggatgtgtccttgtggcttaagatttactggtaaagattggttaaatgaccatattttaactaatgatcgtacaaaaaagtgccgcttagttgagtga

SEQ ID NO: 5704 - DNA, 774 bp, Candida albicans
caagcttcttttcaatctgatttaattttacttaagcccttaatattcaacatgtcaactaaagtatactcctactccgactcacaagatgtggccaattcagttggaaaatatgttattgaacaacaaaacaaagccattgaagccaacggttcttttaaaattgctttgtctggtggttcattaggtaagattttgaaacaagcattgatcgataataaggagattggttccaaggcacaatgggataagtgggaagtctacttcagtgatgagagattagtcccattgtatcatcctgattcaaattttggattgttcaacgaaatggttttaaaaaatttgcctcaagagaccacaaacatgaaattgcatgtcattgatcaatcattgcttaccggaaaagacggaaaattagacgatttagtcgaccaagcaaaggatcaagaaattgctaaagaatacgctaatgggttaccaaaacaatttgatttgattttgcttgggtgtgggccagatggacacacttgctctttattcccaggtcataaattattggaagaaagagacgaattgatttcatatataagtgattctccaaaaccaccaccaagaagaattacattcaccttcccagtgttagaaaatgccaaagcaattgcatttgttgcaactggtgctggaaaagctcctgttttgcgtgaaattttcctgggccaaagcaagttaccatgtgctttagtcaacgatataaagactggggtatcagtaagc

SEQ ID NO: 5705 - DNA, 1371 bp, Candida albicans
tgttatgtaatatgtggcaaggtcaggtttgagtatttaagcagctgtcaatcctttagtcaatatgtcttgggcatagtttttgaaattcaccttcttgttgaattatcggttttttttgcttttactcacaatttgtacatataccgtcagagtgttcaatttttaatctcttgtgctttcactttcattacctccactatataccactgtattattaactataatatcaattataacatgttatcaatggccgtaaccccaagtaatactttaacttcacaatatccaacaaaacaagaaaattacaaccaaaattactgttctattaaatcgccatctccaacatgtacgccaacctcaacatcattaaccatgacttctccaccacaattacataatccacatgcatcaataactttaccatcaatacattccttggatatcccagcttttccacattatgagcaagagtatagtcgagctagtgtattccaaaactattcgtcgaattcacccacaccttccaatagttcatattcacccactttattgataccgagtaacgatagaccggcttcctcgtctgtgtactcaaattcttcaagcactttattattaagtcctggtatgtctactacacccaatgtaaattgtattgctcctgtgtcaagaccaagaagtacgtcaaatttgacagaaaattcagagcaactgtttacttcacaacaactgcatccagctatactgtctaatgccactattacatcacctcaactttcagtgaaatcagaagacgagcaacttcatgaaccacaaaactcaaatactattatatcaccaagacagaataagaaaaattggaaaccaagaaagaagaaacaatgtcctgagtgtaatttatatttttcaaatttagctactcataaatcgactcatttgaaaccaaacaatcgtcctcatatttgtaaatattgtgaacgaggatttgctcgaccaaatgatttattcagacatgtcaaatgtcattggaaagaaatagggtcagatcaaggacaatttaaatgtcctttcaagaacatcgattcatctaaaagagagaatcaagaaaaagtaactggtaatactggtgtaccagatcattgttgtcataatactgggatattttctcgatgtgatacattcaaaaatcacttgaaagctattcatttccaatatccaaatggtacgaaaaaggaacaaagaaatctagttaatggtaaatgtagaatgtgtcaacaagaattcagaaatgtcgatgattggatgcataatcatatagaaactaatctgtgtccttatgctattaatttgatcaaaaaagaacattaa

SEQ ID NO: 5706 - DNA, 1104 bp, Candida albicans
tctaacagaaatatcgttatttccttaacttcgttaactttcttaactttcttgaataaaatgactacaacagttccattgatttattcatttcctgagtttttaggagttgctgatgcagttgctgatcatattattactgctcaaaatcaaacactttacaatactactgatcttgatcaaattgaactaatcaaacaaagatcaggtaataccccttcacatactccaagacatagtcaaagtggtatagaattgccttcaactacagcatcaggcgcgttgaatactccactatcaagaaatggatcatcacctaaattgaataataataacggaaacactaccactactagtagtagtggtagacctaaaaaggaaaagaaaattcaaaaaaaacaagaagttcgatttaaaattgccatttctggtggttcattaataaaaattttacatcaaggattattaccaagacaaaaatatattgaatgggataaatgggatatttattttgctgatgaaagattagtaccgtttgaaagtcctgattcaaattatggtcaagctaaaagagaaatatttgatttaattactggtgataaaaaaccaagaattttccatgttgatgaatcattaattgatgattctcaagaagctgctgatgaatatgaaaaacaattgattaataattttgctaaaaaagattcggtgaaattacctttatttgatttatttttattaggttgtgcaccggatggtcatattgcttcattatttcctaatcatggtgaacaattgagagaaaaattagcttgggttttaccagtatcaaatgctcctctgggaccagaaaatagaataactttatctatcccagttatatgtcattccgcaagagtgacatttgttgttgaagggttaactaaggcaccaattattaaaaccattatggaaagaccagaaaaaggtttaccaagttcaattgttaatgaaggtgctgctggtagagtgagttggtttgttgatgatgatgcattgaatgatttgtttgatataactaaaaagaaatacaaatatttatctatacctgaaccaagtcattaa

SEQ ID NO: 5707 - DNA, 744 bp, Candida albicans
gcacatttaattcattgtaaatatatatacacatcattaattgtaactggaaataggaagttcaaaaaaagggacaccgagaaaaaaaaaaatcatgaatcatctaaattacaaccatcgatgccaccaccagataaagcaagaagagacgttctcatttcaaaggcattatcatatttgctcagacatggtgctgaaaaagagaagctatccattgatgatcaaggatacgtcaagatatctgatgtgttatcgcatcagcgactcaaaagtttgaaaacaaccagagatgacatcaacagaattgttcaagaaaatgacaagaaaagatttaccattaaagatgacatgatatgtgccaaccagggccattcgttaaaagcagtgaaaaatgataacctaactccaatgaccgtcgacgagctcaaccaattgcgtatttatcatggaacttatagaaccaaattgccattaataaagtcaagtggtgggttgagtaagatgaacagaaaccatatccatttcacctgtgagcaatattctacatgttcgggaataagatataatgctaatgtgctaatttatatcaatgcctccaaatgtattgagcacggtattgtattctataagagtttaaacaatgtgatcttgaccagtggggataaggatgggaagctaagctgggagtttattgatcgcattgttggccttgacggtaatgaaattaacaaagagcaagtttag

SEQ ID NO: 5708 - DNA, 1260 bp, Candida albicans
tacaaaaacatagagtttccaaactggatactaaccgctttttttgaagtcactatcaaaaacgcaggcaaaacatatgacattgaacttcaagaagaagacaatggtcagaccttaaagtctaaaattcaacaattgacattgatcccaccagaaagacaaaaaattttgataaagggaggcaaattgaccgatgaggtgattgtatctactttgaatttgaaaagtccagttatggttttaggcactccagacaagaatttgccttcaaagccagttgaaaaacaagtttttctcgaagatttgaataaaaatcaattggttaaagttagtaatgaacctagtgggttgaccaatttagggaacacttgttacttgaactcaagtttacaaacaatattccatattgatgatgtgaataacaggttgaaagattacacttttggtggagccaatcaagccaatagtgcctttgtgttgtcattgaaaagtatgttccagcaaatgtcgaaaaaacaagaagttataactccttctacatttctttctcttttcagaagatcttatcctcaatttgctgaacaacaaaatggtatttataaacaacaagacgccgaagaagcattttcccaaattttgagctctttgagaagcgaattgaaaatagatgatgtgttcaaaattacatttaacaccaagactcaatgcttggctattccagaagatgtcacagaagggtttgaagaagcatataaattgaattgtcatatcggcgtcaagaccaattttttgagagatggattgttggctggattaaaagaaacgattgaaaaacataattcaactttgaatgctgatactgagtatgaaacaaccaagaccataactagattaccaaaatacttgacagtacattttattagatttttctggaaacgagacatcaataagaaatccaagattttgagaaaggttcaattcccatttgaattagatttagcagaaatgttggatgtatcaataaaggcagataaagtttccaatagagatacaattagaaaagttgaaaaagataatttggatatgataagagatttcagaaagaccaaaaatgacaccagtttaacaccattggaacaactagaggaggatgagatgaagattacatcaatcaagagtaagtttaaagacgacttgaatagcgctttgcccaacgttgattttaacaccaccacagaaaacccttctagtgtgtatgaa

SEQ ID NO: 5709 - DNA, 648 bp, Candida albicans
gccgctcaaggacaaagaaaagaattgaccgaagaggaaaagaaagccaaagcagctgccaaagaggccaagaaagctgccaaagctaaagcaaatgctgaaaagaacaaacaacaacaagctcctgttgccacaccaccgaacccatccatgatcgacttcagagttgggtttattgaaaaagctgaaaagcatccaaacgcagactcattgtatatgtcaacgattgatatgggagatgcagaggggcctagaattgtctgttcaggtttagtgaaatacattccaattgaagagatgcaaaagagatacgttgtcgtagtggcaaatttgaaaccagtcaccatgagaggtgtcaagtcttgtgccatggtgttatgtgcttctgattccgaaaaggtcgaatttgttaacccaccagcaggttccaaaccaggtgataaaatcttctttgaaggattcaacggtacaccagagaaacaattgaacccaaagaagaaggtttgggaagcagttcaaccccacttttccactaatgaaaattacgaagttacctatactgaagaaggaaaagaaccaaagagattggttaatgaaaagggagaattatgtaagaactccagtattgttaaagctgatgtcaaatag

SEQ ID NO: 5710 - DNA, 525 bp, Candida albicans
tacactaaagatgccccatcgtatctcaaactccaggttggtcagatccaattatgtaaaagacatgacgattccgataaattatatgtctctcaagttgaaataggaaatgacacgacaattcaagtctgctctggcttagttccatacattcctattgatcaaatgcaaaatagaaaagttgtggtagttactaatatgaggacaagaaaactacgtggggaaaagtccatgggaatgattcttgcagctgagaaggagataaacgagcaattgaatgttgagcctgtaataccgccaaccacatcaataattggtgaacgattgcattttggaattgcagataattttgaacctcctaaattgaaggacaaggtttgggagtatattcaaccacggttgaaaacaactgcagacaaaaaagtggtttttgtcgatgaagaggacaatgagttggtgttacgaggtagcgactcgtcagatgcagcacacgttcaatcactagatggggctaaaatactttaa

SEQ ID NO: 5711 - DNA, 690 bp, Candida albicans
  unsure (593): Identity of nucleotide sequences at the above locations are unknown.
gacctctcaatccatccaaaaagaagaatttttcataacgaatctctatttcacccgttgacaaaaggaccatacacaaccatgtcagacttaattgcaaaattttcaaagatttctttagctgatatttcaaaatcagactcttctaagttcccagaattgtcagcagaacaaaaagcattagcctcacaattcgaaactttggccaacagattaaacgaacaagaatcattgattgctttaaatgactcattaagaaccaagacttttattgtcggtaacattccaagccatgcagatttagtggtttttgaaaaagtattctctttggcttctcaatggactagcaaagatgatgttgcaaaatatagacacattctcagatgggccgatttggttcaaaatacattagttaatgtcccagaaacaatcaagattaattacgatatcgacataccaggagaagtcggagagatgaagataccagccgaagaagctgaaaagtctgccaccccaaaaccaaaggctaaagctacaccatacgccgctcggggaccaagactagaattgaaccgaggaagaccagaatgccntggcaaccggccagagaagccaagaatactggcaaaggctaaaagcaaatgctggaaaaaaatcaaaccaacaccagcccccggttggccacaccac

SEQ ID NO: 5712 - DNA, 714 bp, Candida albicans
ggtggcctcaagacccaccgcatgagtgacaaagaagatttaaatcttatatctgacaataatagagttatttcaatgagacaattgattttacaattactgactacaggaataaacaaaaaatataaacgatatactaacatgtttgatagtactactgccactcaagctgatgtcactgtctacaaagctttccaaaaggaattcccacaattcaccagatggttcaaccacattgcttcattcactgaagaattcgaagacttgccagccggtaaagccccagccgcttctggttctgctgctgccgctgctgaagaagaagatgacgaagatgtcgacttgttcggttctgatgatgaagttgatgaagaagctgaaaaattgaagcaacaaagattagctgaatacgctgctaagaaggctgctaaaggtccaaaaccagctgccaaatctattgtcaccttggatgtcaaaccatgggatgatgaaactgatttggatgaattattgaccaacgtcaaagctatcgaaatggaaggtttgacttggggtgctcaccaatggattccagttggtttcggtattaaaaaattacaaattaacttggttgttgaagatgctttagtctcattggatgacttacaagctgctgttgaagaagatgaagaccacgtccaatctactgatattgctgctatgcaaaaattgtaa

SEQ ID NO: 5713 - DNA, 525 bp, Candida albicans
attattatgactggtgttactgaaggtggagacaccaaagtaattgaatcaaaaatcaatgaattaaacattgataaacctaaacttgaagacaacaatgaagcaaaaggcaatggcaacggcaatgaaagtggtggtggtgatgatgatgataaagaagaagatgatgataatgatgaaataactgaaccatctacttctacagcatcgggtgataaaaagaagaagaagaataaaaataaaaagaagaaaaagaagaagattgtatctatagattcatcatatcctgaaggaatttttcctgaaggtcaatggatggaatatccattagaagatataaattcatatcgtactacatcagaagaaaagagatatttagatcgacaacaaaataataaatggcaagatttccgtaaaggagcggaaattcatcgtcgagtaagacataaagctcaatcaagtattagaccagggatgacaatgattgaaattgccaatttaattgaagattccgtacgtaattat

SEQ ID NO: 5714 - DNA, 1323 bp, Candida albicans
attattatggctggtgttactgaaggtgaagacaccaaagtaattgaatcaaaaatcaatgaattaaacattgataaacctaaacttgaagacaacaatgaagccaaaggcaatggcaacggcaatgaaagtggtgatgatgatgataatgaaataactgaaccatatacttctacagcatcgggtgatgaaaagcagaagaagaataaaaataaaaagaagaaaaagaagaagattgtatctatagattcatcatatcctgaaggaattttccctgaaggtcaatggatggaatatccattagaagacataaattcatatcgtactacatcagaagaaaagagatatttagatcgacaacaaaataataaatggcaagatttccgtaaaggagcggaaattcatcgtcgagtaagacataaagctcaatcaagtattagaccagggatgacaatgattgaaattgccaatttaattgaagattccgtacgtaattattctggtaatgatcatactttaaaagctggtattggattcccaacggggttatcattaaatcatgtagctgctcattatactcctaatactggagataaattaattttgaaaaaagatgatataatgaaagttgatattggggttcatgttaatggacgtatttgtgattcagcattcaccatgacatttaatgaagatgggaaatatgatacgattatgcaagctgttaaagaagcgacatatacggggattaaagaactgggtattgatgttagattaaatgatattggtgctgctattcaagaagttatggaatcatatgaaatggaagaaaatgggaaaacttaccccattaaatgtatcaagaatttaaatggtcataatattgatgattttgttattcattcaggaaaatctgtccctattatagctaatggagatatgacaaaaatggaagaaggagaaacttttgctattgaaacatttggatccactggtaatggttatgtcttacccgagggagaatgttctcattatgccatgaataaaggagttgaacatttaaaaccaccttcagaaagatcaaaacaattattagaaactattaaacaaaatttcggtactttaccatggtgtcgtagatatttagaacgaactggtgaagaaaaatatttgtttgcattaaatcaattggttagacatggtattgtcgaagaatatcctccaattgttgataaaagaggtagttatactgctcaatttgaacatactattttattacatcctcataaaaaagaagttgtcaccaaaggtgatgattattaa

SEQ ID NO: 5715 - DNA, 615 bp, Candida albicans
tcaatcatgggtaaagaaaaaactcacgttaacgttgttgttattggtcacgtcgattccggtaaatctactaccaccggtcacttaatttacaagtgtggtggtattgataaaagaaccattgaaaagttcgaaaaagaagctgctgaattgggtaaaggttctttcaaatacgcttgggtcttggacaaattgaaggctgaaagagaaagaggtatcaccattgatatcgctttgtggaaattcgaaactccaaaataccacgttaccgtcattgatgctccaggtcacagagatttcatcaagaatatgatcactggtacttctcaagctgattgtgctattttgattattgctggtggtactggtgaattcgaagccggtatttctaaggatggtcaaaccagagaacacgctttgttggcttacactttgggtgtcaaacaattgattgttgctgtcaacaagatggactctgtcaaatgggataaaaacagatttgaagaaatcatcaaggaaacctccaatttcgtcaaaaaagttggtttaaaaccaaaagatgtcccatttcgttccaatcttttggttgggaatggtggacaacatggattgtaa

SEQ ID NO: 5716 - DNA, 1383 bp, Candida albicans
tcaatcatgggtaaagaaaaaactcacgttaacgttgttgttattggtcacgtcgattccggtaaatctactaccaccggtcacttaatttacaagtgtggtggtattgataaaagaaccattgaaaaatttgaaaaagaagctgctgaattgggtaaaggttctttcaaatacgcttgggtcttggacaaattgaaggctgaaagagaaagaggtatcaccattgatattgctttgtggaaattcgaaactccaaaataccacgttaccgtcattgatgctccaggtcacagagatttcatcaagaatatgatcactggtacttctcaagctgattgtgctattttgattattgctggtggtactggtgaattcgaagccggtatttctaaggatggtcaaaccagagaacacgctttgttggcttacactttgggtgtcaaacaattgattgttgctgtcaacaagatggactctgtcaaatgggacaaaaacagatttgaagaaatcatcaaggaaacctccaacttcgtcaagaaggttggttacaacccaaagactgttccattcgttccaatctctggttggaatggtgacaacatgattgaaccatccaccaactgtccatggtacaagggttgggaaaaggaaaccaaatccggtaaagttactggtaagaccttgttagaagctattgacgctattgaaccaccaaccagaccaaccgacaaaccattgagattgccattgcaagatgtttacaagatcggtggtattggtactgtgccagtcggtagagttgaaactggtatcatcaaagccggtatggttgttactttcgccccagctggtgttaccactgaagtcaaatccgttgaaatgcatcacgaacaattggctgaaggtgttccaggtgacaatgttggtttcaacgttaagaacgtttccgttaaagaaattagaagaggtaacgtttgtggtgactccaagaacgatccaccaaagggttgtgactctttcaatgcccaagtcattgttttgaaccatccaggtcaaatctctgctggttactctccagtcttggattgtcacactgcccacattgcttgtaaattcgacactttggttgaaaagattgacagaagaactggtaagaaattggaagaaaatccaaaattcgtcaaatccggtgatgctgctatcgtcaagatggtcccaaccaaaccaatgtgtgttgaagctttcactgactacccaccattaggtagattcgctgtcagagatatgagacaaaccgttgctgttggtgtcatcaaatctgttgaaaaatccgacaaagctggtaaagttaccaaggctgctcaaaaagctgctaagaaataa

SEQ ID NO: 5717 - DNA, 1320 bp, Candida albicans
aacaagagaatgtctgaaacagaagctgaaaagaatattgaaatatggaaggtcaagaagttgatcaagtctttggaaatggctagaggtaatggtacttccatgatttctttggttataccaccaaaaggtcaaatttcattgatccaaaaaatgttgacagaagaatacggtaccgcctcgaacattaagtcaagagtcaatagattgtctgtcttatcagcaattacttctacacaacaaaaattaaagttgtataacagtgttccaagaaacggattagttgtttattgtggtgatgtcataactgatgaaggtaaagaaaagaagttgaacatagattttgaacctttcaagccaataaacacatctctttatttgtgtgacaacaaattccacgttgaggctttgaatgaattgttggaaaacgacgatagatttggtttcattattatggatggtaatggtgcattgtttggtgctgtcagtggtaacactagagaagtcttgcacaaattcacagtggatttaccaaaaaagcatggtagaggtggtcaatctgctgttcgtttctctcgtttaagagaggaaaagagacacaattatgtcagaaaagttgctgaagttgcagtacaaaatttcattactgctgataaggtgaatgtcaagggtttgatcttggctggttctgcagactttaagaatgaattgtcaaaatctgatttgtttgataatagattgcaagcaaaagtcattaaaattgttgatatttcatatggtggagaaaatggtttcaatcaggctattgaattgtctgctgaaactttggctaatgtcaaatttgtccaagaaaagaaattattagaagcatattttgaggaaatcagtcaagacactgggaaattctgttatggtatcgaagatactttgaaggctttagatttggggtcttgtgaaaagatcattgtttacgagaatttaaacaccatcagatacacattaaaagatattgaaggagaagaagttgttgcacatgttaatccagaattgcctgataaatcatggcagttggacaaaaagacaggaacagaaatggaaattgtcaaggaagaatcattcttggaatggttggctgaaaactataaaaattacggtgctgaattagagtttgttaccgataagtcatctgaaggtgcccaattcgtacaaggtttcggtggtattggtgctatattgagatacaaggttaattttgaacaattggcagatgaatcgagtgaggacgaatattatgatgatgacgatgacagttttatttag

SEQ ID NO: 5718 - DNA, 1086 bp, Candida albicans
attctagtccaacaagtttgtattcctcaatccattttgggaactgatgttttgtgtcaggccaagtctggtttgggtaaaactgctgtttttgtattgtcaacattgcaacaattagacccagttccaggtgaaatttccactttggttatttgtcatactagagaattggcctaccaaatccgtaacgaatatgccagattttccaagtacatgccagatgttaaaactgatgtgttctatggtggtaccccaatcaaaagggatattgaaaaattaaagaacaaagatacatgtccacatattgtagtggcaactccaggtagattacatgctttggttgaagaaaaagctatcagattgaacaatgtcaagtcgtttgttattgatgaatgtgacaaagtcttggaatccatcgatatgagaagagatgtgcaagatatcttccgtgccactcctcaccaaaagcaagttatgatgttttctgccaccttatctcaagatattcgtccagtttgtaaaaaatttatgcaaaatccattggaaatttatgttgacgatgaggccaaattgaccttgcatggtttgcaacaatactacatcaaattggatgagaaagagaagaatagaaaattgtctgacttgttggattcattggaattcaaccaagtcattattttcgtcaagtccactagaagagccaacgaattgaacaaattgttgtgtgcttgtaacttcccatcgattgctgtgcattctggtttaccacaagaagaaagaatcgaaagatacagatcttttaaagaatttaataagagaatctgtgtttccactgatgttttcggtagaggtattgatattgaaagaattaacttggccatcaactatgacttgccaaacgaagctgatcaatacttacatagagttggtagagctggtagatttggtaccaaggggttagctgtctcttttgtttcttctaaagaagacgaggaagtcttggaaaagattcaaagcagatttgatgttaaaatcaccgagttcccagaagaaggtgttgatccatctacttatatgaacacttga

SEQ ID NO: 5719 - DNA, 201 bp, Candida albicans
attattcagattctgaagaaatcgccgtttcaaccaacaatcaagcttcttggtgaagctcaatctaatgataaagaaagtgataaaaaaggatcttatgttggtatccatgccactggtttcagagactttttattgaaaccagaattgttgagagcaattggggattgtggttttgaacatccttctgaaggtatgtaa

SEQ ID NO: 5720 - DNA, 1206 bp, Candida albicans
ttaataatggatgattttgatagagatttagataatgagttggaatttagtcataaatcaacgaaaggaataaaggttcatcgcacttttgaaagtatgaatttgaaacctgatcttttgaaaggaatatatgcctatggatttgaaacaccatctgctattcaatctagggctattatgcagatcatcagtggtagagacacaatagcacaggcacaatctggaactgggaaaactgctactttttctattggtatgcttgaggttatagatactaaatcaaaagagtgtcaagcacttatcttgtctcctactagagagttggcaattcaaatacaaaatgtggtcaagcatttaggagattatatgaacatccacacccatgcctgtattggtgggaaaaatgtcggtgaggatgttaaaaaattgcagcaagggcaacaaatagttagtgggacaccaggtagagtgattgatgtgataaaaagaagaaatctacaaactagaaatatcaagtttcttattttagatgaagctgatgaactttttacaaaagggtttaaagaacagatctacgaaatctacaaagatttaccaccttcggttcaagtagtagttgttagtgccactttgccacgtgaagtattggagatgacaagtaagtttaccactgatccagtgaaaatcttggtgaagagggatgagatttcgcttctgggaatcaaacaatattatgttcaatgtgaacgtgaagattggaagtttgatacactatgtgatttgtatgacaaccttacaataactcaagcagtgatattttgtaataccaaattgaaggtgaattggcttgctgatcaaatgaaaaagcaaaactttactgttgtggcaatgcatggtgatatgaaacaagatgaacgagattcaattatgaacgattttagaagggggaattcaagagtattaatatccacagatgtttgggcaagaggtattgatgtccaacaagtctcgttggtaataaattatgatttgcccaccgataaggaaaactatattcatagaattggacgatcaggtagatttggtagaaagggaacagctataaacttgataactaaagatgatgtggtcactttaaaagaatttgagaaatattattcaacgaaaattaaggaaatgccaatgaatattaatgatataatgtaa

SEQ ID NO: 5721 - DNA, 477 bp, Candida albicans
cccgcgtgggtgaagaaataccaacaaggttataacaacagaggtggataccagcaaaactacaataaccgtggtggctatcaaggatataaccaaaaccaacaatatggaggatatcagcaatacaattcgcaacctcaacaacaacagcaacaacaatctcaaggtatgtcgttggcagatttccaaaaacaaaaaactgaacaacaagcttctttgaataaaccagctgttaagaaaacccttaaattggcaggatcttcaagtataaaattagcaaatgctacaaagaaagtggataccactagcaaaccacaatctaaagaatcatctccagctccagctccagctccaactgcttctgcttctacttccgcttctcaagaagaaaagaatgaagaaaaagaagctgctgctactactcctgctgctgctcctgaaaccaaaaaggaaacttccgcaccagcagaaaccaaa

SEQ ID NO: 5722 - DNA, 420 bp, Candida albicans
aggtggatcttccagccggctggtgaataccaaaaccaacaatatggaggatatcagcaatacaattcgcaacctcaacaacaacagcaacaacaatctcaaggtatgtcgttggcagatttccaaaaacaaaaaactgaacaacaagcttctttgaataaaccagctgtgaagaaaacccttaaattggcaggatcttcaggtataaaattagcaaatgctacaaagaaagtggataccactagcaaaccacaatctaaagaatcatctccagctccagctccagctccagctgctttcgcttcccaagaagaaaagaaggaagaaaaagaagctgctgctgctactcctgaaaccaaaaacgaaacttccgcaccagcagaaaccaaaaaagaaactactcccaccccctgctgctaa

SEQ ID NO: 5723 - DNA, 534 bp, Candida albicans
caaatgctacaaagaaagtggataccactagcaaaccacaatctaaagaatcatctccagctccagctccagctccagctgctttcgcttcccaagaagaaaagaaggaagaaaaagaagctgctgctgctactcctgaaaccaaaaacgaaacttccgcaccagcagaaaccaaaaaagaaactactcccaccccctgctgctaaaaaggaatcaaccccaactcctgctactgctactacgaaagagtcaactccagtttcaaactctgcttctgtggcaactgcagatgctcttgttaaagaacaagaagatgaaattgacgaagaagttgtcaaggatatgtttggtggtaaagatcatgtgtctattatattcatgggtcacgttgatgctggtaaatctaccatgggcggtaacattttatacttgacaggatctgttgataaacgtactgttgaaaaatacgatcgagaagccaaagatgctggtagacaatgttggtatttgtcttgggttatggacaccaactag

SEQ ID NO: 5724 - DNA, 192 bp, Candida albicans
gatgctccaggacacaaaatgtacgtttcagatatgattggtggtgcatctcaagctgatgttggtatttgggttatctctgcaagaaaaggtgaatacgaaactgggttcgaaaaaggtggtcaaaccagggagcatgcattattggccaaaactcaaggtgtcaacaaaattattgttgtcgtcaactag

SEQ ID NO: 5725 - DNA, 831 bp, Candida albicans
atggatgattccactgttggttggtctaaggaaagatatcaagaatgtaccaccaagttgggtgctttcttgaaaggtattggatatgccaaagatgatatcatttacatgccagtatctggttacaccggtgctggtttgaaagacagagtagatccaaaggattgtccatggtatgacggaccttcattattggaatacttggataatatggataccatgaaccgtaaaattaacggtccattcatgatgccagtcagtggtaaaatgaaggatttgggtacaatcgttgaaggtaagattgaatcaggacatgttaagaagggtactaatttgattatgatgcctaccaagactcctattgaagttttaaccattttcaacgaaactgaacaagaatgtgatactgccttcagtggtgaacaagtcagattgaaaattaaaggtattgaagaagaagatttgcagcctggttatgtgttgacttcacctaaaaacccagttaaaactgtcacaagatttgaggcccaaattgctattgtggagttgaaatctattttatccaatgggttctcttgtgttatgcatttgcatactgctattgaagaagttaaatttattgagttgaaacataaattagaaaaaggtaccaatagaaaatctaagaaaccaccagcatttgccaaaaaagggatgaagatcattgctattttagaagtcggtgaacttgtttgtgctgaaacttacaaggattacccacaattgggtagatttactttgagagatcaaggtacaaccattgccattggtaagattaccaaattgttgtaa

SEQ ID NO: 5726 - DNA, 2163 bp, Candida albicans
gcaagacgaacaaccaacatggctccaaaactgaaaaagcaagcagctacgcaatcgaaatcgaagaagctgaaagacttagttgatgagagatttcaagcaattgttttgacagactccttcgaaactaggtttatgccattaacagcggtgcatccaagatgtttgttaccattagccaatgtccctttaatcgagtacactttagaatttttagccaatgccggggtcaatgaagtttaccttatgtgttcagcacatgctgatcagattcaagaatatattgaaaactccaaatggatgggtgataactcgcctttcagtgtgaccacgatcatgtcaattgaatcaagatctgttggtgacacgatgagagatttggacaatcgtggcttaattgctggtgatttcttattagtatctggggatgtggttaccaatatggattttagcaaggcattgcaattccataaacagaaaaaagcacaagataaggatcacattgccaccatggtattgaatcaggcttcgcctttgcatagaacaagatcacaaatagaccctgcagcatttgtgttggacaaggagactaatcgttgtatattctaccagagtatccctccagtaagtggtaaaaagacatgtatatccattgatccagaattgttggaagatttccaaggtgaactccaggtgcgcaatgacttgatagactgtcacgttgatatttgctcgcctcatgttccacaaatatttcaggaaaactttgattatcagtatcttagaagtgatttccttaaaggggtgttgacatcagatttgctcaagaaaacaatttacgcctatatcagtaaggatagttccgaatatgcagcaagagtggaaagctggagcacttatgatgctatatctcaagacatattggcacgttggtgttatcctttggttcctgattccaaccttgttgaaggcaattcttattcctacgaactcaataacatttacaaagaggataagattatattggcacaatcttgtaagattggcacttcaacttcaattgggagaaactctagtgtgggtgaaggcacacagataaagaattctgttattggaagaaattgtaccatcggtaaaaatgttgtgattgagaattcctatatttgggacaatgctgtcatcaaagacaattcagttttaaatcgctcaatagttgcagcagatgcacaaattggaaataatgttacgttgtcacctggctcagtaattggttttaatgtaattattggcgacgacaaagtaattccacacaatgtaaagattgttgaaactccgatcgttacggagaatgagtttggagattttgatgacgagagcaacagtgaagacgaaaatgaatatgaagatggaaatgctgtgccggtcttggcagttaaagatgttgaattggttggtgaaacaggaaaaggatttgcatatgagtcagaaatagagagtggcgacgaagatgatgaagaatttgttgggaatggcacttactcgggtataatctaccaaatgaagtctttgaatgtctctgacgactcgattgcttctgttagcaataagaaagtcaaaaaacattctcatagacgtagattgtcgatgaattctatgatcagtgataatggaggagcatttgaaagtgatgaaggtgaagaagaagaagacttcggtgtagaagggttggccacggttacacgagctattgaaaataaccatgacattgacactgctttgttagagttgaatacgttgagaatgtcgatgaatgtcacttatcatgacgtaagatcggtcaccacacaagctttggtgaataagattgttgactttataacaaccggtaccttaactccacaagaagctgctaccaagatttttactaaatgggggattatgtttaagagacaagtgtttagtccagaggaagaagttgatttattgaatattgtggaagaaaattcttccgtattggacaaagcgtataatcagattgtgttatttcttggtgtaaaatcgttttacgatatggaagtcgttgaagaagaaaatattttaaaatggtggaacgatggtgagaacgatgaggtgagaacgttaactgccaaatttattacctag

SEQ ID NO: 5727 - DNA, 1458 bp, Candida albicans
gaagttccatccgatgatccattctgtactgctatcagaaactgtgaccctaacgctgatttgatgttgtacgtctccaagatggttcctacatccgataaaggtagattctacgctttcggtagagttttcgctggtaccgttaaatccggtcaaaaagttagaatccaaggtccaaactaccaagttggtaagaaagaagacttgttcttgaaatctattcaaagaaccgttttgatgatgggtagatctgttgaacaaattgatgactgtccagctggtaacattattggtttggttggtattgatcaattcttgttgaaatctggtaccatcaccaccaacgaagctgctcacaacatgaaagtcatgaaattctctgtctccccagttgttcaagttgctgttgaagttaagaacgctaacgatttaccaaaattagtcgaaggtttgaagagattgtccaaatccgatccatgtgttttgacttacatgtccgaatctggtgaacatattgttgctggtaccggtgaattgcacttggaaatttgtttacaagatttagaaaacgatcatgctggtgttccattgagaatctccccaccagttgtttcttacagagaaactgtggaaggtgaatcctccatggttgctttgtccaaatcaccaaacaagcataacagaatttacgttaaagctcaaccaattgatgaagaagtttctttggatattgaaaatggtgtcattaacccaagagatgatttcaaagccagagctagaattttggctgacaaacacggttgggatgtcgttgatgctagaaagatctggtgtttcggtccagatggtaacggtcctaacttggttgttgatcaaaccaaggctgttcaatacttgaacgaaattaaagattccgttgttgctgctttccaatgggctaccaaagaaggtccaattttcggtgaaaactgtagatccgtcagagttaacattttggatgttactttgcatgctgatgctatccacagaggtggtggtcaaatcatcccaaccatgagaagagttacttacgcttctatgttgttggctgaaccagctattcaagaaccagttttcttggttgaaattcaatgtccagaaaacgctattggtggtatctactcagtcttgaacaagaagagaggtcaagttatttctgaagaacaaagaccaggtactccattgttcactgttaaggcttacttgccagttaacgaatccttcggtttcactggtgaattgagacaagctactggtggtcaagctttcccacaattgattttcgatcattggcaagttatgtccggtgatgttaccgatgaaaacagtaaacctggtgctattgtcaaggaaaagagagttagagccggtttgaaaccagaagttccagaatacactgaatattacgataaattgtaa

SEQ ID NO: 5728 - DNA, 714 bp, Candida albicans
gagtcactgatggtgcattggttgtcgttgataccgttgaaggtgtctgttatcaaaactgaaaccgttttgagacaagctttgggtgaaagaattaaaccagttgttgttattaacaaggttgacagagctttgttggaattgcaaaccaccaaagaagatttgtaccaaacttttgccagaactgttgaatccgttaacgttattatctccacttactgtgacccagttttaggtgatgtccaagtttacccacaaaaaggaacagtagcctttgcttccggtttacacggttgggctttcactgttagacaatttgccaacaagtattccaagaaattcggtgttgacaaagaaaagatgatggaaagattatggggtgattcttacttcaacccaaagaccaagaaatggactaacaaagacaaagatgctgatggtaagccattagaaagagctttcaacatgttcatcttggacccaattttcagattgtttgctgccatcatgaacttcaagaaagatgaaattccagtcttgttggaaaaattggaaatccaattgaaaggtgacgaaaaagatttggaaggtaaagctttgttgaaggttgttatgaaaaaattcttaccagctgccgatgctttattggaaatgattgtcttgcacttgccatctccagttactgcccaagcttacagagttggaattttgtaa

SEQ ID NO: 5729 - DNA, 426 bp, Candida albicans
tgtattatagttgctttcactattgaacaaatccgtggtttgatggacaaggtcaccaatgtccgtaacatgtctgtcatttgccacgtcgatcacggtaaatccactttatctgattctttggttcaaaaagctggtattatttccgctgccaaggctggtgatgccagatttatggataccagaaaagatgaacaagaaagaggtatcactattaaatctactgctatttctttgtatgcttccatgactgacgaagatgtcaaagacattaaacaaaagaccgatggtaactccttcttggttaacttgattgattccccaggtcacgttgatttctcctctgaagtcactgctgctttgagagtcactgatggtgcattggttgtcgttgataccgttgaaggtgtctgttatcaaaactga

SEQ ID NO: 5730 - DNA, 462 bp, Candida albicans
cacacttttgaaaccgctgatgccggtgctgctttaactttcccaatgcaatgttccgctttaagaaagaacggtcacgttgtcattaagaacagaccatgtaaaattgttgatatgtctacttctaaaaccggtaagcacggtcacgctaaagtccatttagttgccattgatattttcactggtaaaaaattagaagatttatctccatctacccacaatatggaagttccaaatgtctctagacaagaattccaattgttagacattgatgatggttatttgtctttaatgactgctgatggtgacaccaaagatgatgtcaaagtcccagaaggtgaattgggtgacaagttacaatccgaattcgatgaaggtaaagatttgattgttaccatcatttctgccatgggtgaagaagctgctatttcttacaaagaagctccaaaaggttctgcttaa

SEQ ID NO: 5731 - DNA, 1596 bp, Candida albicans
agcatgtcatacgacgatatagaaaatgccactcctgatattgttattgggagtactatagaggaacctgaagaagattaccaagtggaaagtgacaatgagttacaagccgcagaccatgagtcatcgcaaataaatgaagaatcagccaaaggcaaaaagtcagttgcatttactggattggatgaagacgaggaaaatgcagaggaattggccagaaaggagtttgaagaaggtggtggattgcctgaacaaccagaaaacccagatttcaatgagttaacacctttatctcccgagattatcaacaggcaagccaccattaatattggtaccattggtcatgtcgcccacgggaagtctactgttgtcagggctatctctggtgtccagaccgttcgtttcaaggatgaattagaaagaaacattactatcaagttaggttacgccaatgccaaaatttacaaatgtgataacccagagtgtccagaaccagattgttacagatcattcaaatcagataaggaaataagaccaaaatgtcaaagagctggctgtgacggtcgctacaaattgttaagacatgtctcttttgttgattgtccaggacatgatattttgatgagtactatgttgtcaggtgctgccgtgatggatgccgccttgttgttgattgccggtaatgaaagttgtccacaaccccagacttctgagcatttggctgccattgaaattatgaaattgaaacatgttattattttgcaaaataaagttgatttgatgagagaagaatcagccttggaacacgaaaaatctatcattcagtttattagaggtacaattgccgataatgctccgatcgtgcctatttctgctcaattgaaatacaacattgatgcagtgaatcaatttattgttaactacatacctgtgccaatgagagactttactgcttcaccaagattgatcgttatcagatctttcgatgtgaacaagcctggtgcagatgtagacgaattgaaaggaggtgttgcaggtggttctattttgactggtgtttttaagattggtgatgagatcgagattagacctggtatcgtcaccaaagatgatcaaggaaagattcaatgtaaacctatattctcgaacgtggtttccttgtttgctgagcataacgatttgaaatttgctgttcctggtggtttgattggtgttggtactaaagttgatcctacgttgtgtagggctgatagattggttggtcaagttgttggtgcaaaaggaaacttgccctctatttacgctgatattgagataaactatttcctattaagaagattgttgggtgtcaaaactgaaggtcaaaagcaaggtgctaaagttcgtaagttggaacaatctgaagtgttgatggtaaatattggttctactgcaactggtgctagagtggttgctgttaaagcagatatggctcgtttacaattgactacaccagcctgtacagaaatcaacgaaaaaattgcgttgtctagacgtattgaaaagcattggcgtttgattggttgggccactatcaagaaaggtacagcattataa

SEQ ID NO: 5732 - DNA, 1200 bp, Candida albicans
cacagaaaaaaaaaattttttttttgtttcgggttagagactcatctcttaatgcttctgtttactctacgaagagccatgtcatttacaaccagaatattaaaagtcagacccgaaagcatacagtttgtgaatgataaacctcagatctccgacaatgaaaccttgataaacttagaaattgctgccaaagaacttacaactacacataatgccatagggttcccaacagaaacggtgtatggacttgctgggtctgcattatctgatgaatcagtcaaatctatatacaaagctaaaaacagaccggcagataaccctttgattgtacatatatcatcgatcgaacaattaaaacgcaaattgatcaattatgaaataccacaagtgtacgttgatttaatttcccatttttggcatggtccgttaaccattctcttgcccataaccaaagatagtccgatatcaaaattggtaactgccaaccaagatacgtttgcggtgagaatgccaaatcacccagttgcacgagccttgattgcaatgagtgatacaccaattgctgccccttcagctaatgcatcaaccagacctagtccgacattggcagagcatgtttaccacgatctaaatggtaaaatacctttgattttggatggtggcgcatgcaatgtaggtgttgaaagtacggttattgacgggttagttgacccaccaatgctattgcgaccaggaggtgtttcattagaggacattaaacgcgtcggtggcaaactatgggaaaacattgttgtggcgaaaaagacagcaggaaaattagagccagtaaagacaccagggatgaaatatcgacattattcaccaacagcaaaagtggtactatttgtcaattgtggagatggtataaatgccattgaaaattatttgaccaacaataaagtagatgccagtaccaccaagatagcgttgttgaaatcgaaacactttggcgaggatcacccacactttattattaaaagactaggcactacagggaatgagatatctcataatttgtttaaatacttgagagaagtggatgaagaggacaaggtggaattgatatttgtcgaagggatagacgaaacaaacgaaggactagcggtcatgaatcgattaagcaaagctgctatggaagtagttaatggaggggaggcatag

SEQ ID NO: 5733 - DNA, 645 bp, Candida albicans
  unsure (23): Identity of nucleotide sequences at the above locations are unknown.
attagaaaagaatcacttcaacntgattcattagttgctattgatgcagaattgatcatgttaacacctgaagaattggaaattcattatgctggatatataaaattagttaaacccaaacaattatctttggcaagaatatcagtattaagagaaaatggaattccatttattgatgattatattgttcatacatcagatatttatgattatttaaccaattttagtggtattgaacctaatgatttaaatttaacattaagtaatcgagaaaatctcgttacgttacaaactgcatatagaaaattgtggttattattaaatttaggagtaatatttgttggacatggattatataatgatttccgaacgattaatttacaagttccagaacggcaaattcgtgatacagcggtgatttattataaatctgattttaaaagacaattaagtttaaaatttttagcctatgtgatgttaaaagaaaaagttcaaagtgggaatcatgattcaattgaagatgcaaatacagcattattattgtataaaaaatatcaaaatttatataataaagaagattttgaactgatattgaattatatatattctgaaggtcaacaattgagatttaaagttccagaatag

SEQ ID NO: 5734 - DNA, 945 bp, Candida albicans
agtaaagattttgtcaatttccttcaaccagtagaacaaccagatattattgattctaattttgaaatcattgatatagatgctaatgtgcctttatcaattgttggaatgccatattataaggaattattattatcaaattatccgaatgatttgagatttgttaaggaaacagcaaaattacctgaaccgatagatatagaattgattttagaaaatgaaactcgaaataatggtaccaagaaatttttcccttatgataaattaaaatatggtccaggaaatgtttataaaccttatcaatcattaaaggataataaggaaaataaagaaatactgattccgaaatttattagtgaaagatcaacaaccacaaccacaaccaccaaagaattgaaagctgataatgatggtaaatttattgatgatagtatttttcaatataaattccaggggaaattaaataaagtaccaaattgttattcaagattacaaattcaatattcgaaatttggaattaaagattttgattttagttattataataaaactaaagaatgttgtggattggaaaatcatactgataattcatatattaattctcttttacaattatatcgatttcaatcgagtatatataatcaagttgttggttcattatcaaaagaatggttacctaatgatatcaccactattatcactaccaacaaccctgaaggttcatctattttaaatgaattgggatatttatttgatatgatgtttaaagcacaatctaataatgttaaaatttataatttaagtcaagttttgaatcatcatccgaatgctcaaaaattactcaataataatgaattattaaatttaaattctcaacaagttcgagatttagttattgaatttaataattttttattaacaactttacatctagatggtcaagct

SEQ ID NO: 5735 - DNA, 804 bp, Candida albicans
acaaaatttcatatgggtggtgattcaagaggttatactagatcatttactggatcatttgcaacaaattctttatatgggaatttacaactttatccttatacgaaattccatactagtgatgtaaattataataacccaataaaacaaatactatctcatcgagaaggaatattatcattactgaataatgcaataagttttaatagtagaagaggattatcaaaactacaagtcacatctaagacatttaataataatgctactactgaaaataaatttaataatttacaagcaatgacattcaattgtaattcattcaatgatgttgttgttggcactgatacatcaatgatgaaatttgatttaaataaacccaatgttttatcatcatttgatcatcaaggagggatttcattattaaataatttgggtaaatttttaactatagcaaatagtaatggatcattagatatatttgatcctgtatccaattcgacagtgaaaacttttagtgctcataatggatttatttctaatttagacgttagaggcaattatattgctacttgtggttattcaattaaacctaaacgatattatcataatcaacctgcagaatatatagtggatccattggtcaatatatatgatacaagaataatgagagctatagctccagtaccattccctgctggtgctgcatcagtgaaattccaccctaaattgccaaatattataattattgcatcaacatcgggacaaatgcaatttgttgaaatttttgatcaaacaaatgtttaa

SEQ ID NO: 5736 - DNA, 1809 bp, Candida albicans
  unsure (1804): Identity of nucleotide sequences at the above locations are unknown.
gacaccacagctgttgaaaaaccaatagtggaagaaaaaccagtagaagtgaatgataaagttgaactgcaaattgaacttcaatcaccatctgttgaaggagatagtgaatcgatagtggagaatgaagatgaagaagagtctactatttcagaaaaaggagaaccacaaaccgaaaccgaaactgaaactgaaactcaaactgaaccagaaccagaatctgaaccaactcctactgctaatgctccagaatttactatatctcaattcttagaaagattgaagattgcaactccaattgatgatattcttgccacaaaataccctgaaaccatccaaggtgttgatggatcgaaacaaatttctgggaaaaaatacagatatgatccacaatttttaattcaattcagagacgttatttcatacactattgatccaactttcaaagctcatttggaatcattggatattcatccaaatgcaatgaaacgttccggttccactagagatgcctcatcacgtggtggtttaccaaataaattcactggaggattacctgccagatttaatggacctggaggtaaaggtggtggtcaatttgatggtggtagacaaaattcaagaagtggatccaaaagaggaggaggtagaggtgcatcatcaagagataaatctacaagaaaaggtacaccttctaaaagaggaggtagaggaggagatagatctgagatgcgtgaacgaggaggagcaggagcaggagcaggaggagaaaatgatggcaataatcaaggtgatggtaaacctgttgaagaagtcaaaccattggaaaaatctgccaatagatgggttcctaaatcaagaatgcaagccaagaaagaaactaaggttgctgaagatggtactattttattagaaccagaagatattgaaaagaagactaaatctttattgaacaaattaacattagaaatgtttactgcaattagtgatgaaatcattgctcttaccaatcaatcaaaacatgaaaaagatgctgccactataaaacaaataatttcattaacatttgccaaagcttgtgatgaaccccattggtcagaaatgtatgctaaattatgtgccaaaatgtgtacaagtgtttccaatgatattactgatgaaagtattacattgaaagatggtactcatgcatctggaggtgtacttgcccgaagacttttattagctacatgtcaaaaagaatatgaaaaaggttggacagataaattaccaactaatcctgatggttcaccattagaaccagaaatgatgtctgatgaatattatgccatggctgctgctaaaagaagaggtcttggtttagtcaaattcattggtcatttatataatttgaatatgttgaatgatcatgtcatatatgtttgtttgaaagatcaaacgaaaaatactgttgatccatcagatgatagtttagaaaatttgactcaattgattcaaactgtgggaccaaaacttgattctaatgaaagaacaagaactatgcttaagattgtttttgattatattgaaaaagttctagaaggggtgaaattaccatcaagaattaaatttatgttgatggatttacaagatttaagagaagctaaatgggtaagtcttaaaggtgatgctggtccaaaaaccattgaagaaattcatcgtgatgctgaaattaaaaaaatggaagaagaaagacccagaatgaaaagaaaaagaaacaacatcaattgggtggacgacgacgtggacgtggtggtactgatancctaa

SEQ ID NO: 5737 - DNA, 1563 bp, Candida albicans
aaattttctgttctttccaattcacatttacgatcaactgttatctcaatacaccatattatggctgacgtggaaaagaaaccggaggcggtctcctctgatccagcagaaaagaaactttcaaacaaggagttgaaagaattgaaaaagaaggaaaaggcagccaaaagagcagcccagaaggaagccattgggatcactccagaacaacaaaagaaaatagccgaacaaaagattgaaaagaagaagcagcaacaaactacatcagcatcaaatgtaaagaaacaattgaaccaaactattgtcaaagacgaaagaaaagttccagctttatttggccatttagagactcgtgaacaaagaaatgccgcatcaccaactatttccaatgttgtacatcctaccatcttgtccctaacattgaaatattctagttacaaagttgtgggatcaagttcaagattgagcaacatgttacaagcttttaaacaagtgatccaagattattcaacccctgagaacacaacattgactagacatttgacagctcacttatcccatcaaattgaattcttgaaaacgggccgtcctttatcagtttctatgggtaatgcaatcagatggttgaaacaagaaatatctgtgatttcaattgatactttagaagccaaagctaaagaaatactatgcacaaagattgatgatttcattaaggaaaaaatcgttctttctgatcgtttgattgtggattcagcttcaagacatatttgtaatgggtctactattttaacttatggccactcacaagtattagaagagttgtttaaatattgtgtcgttgaacaaggtaaaaaattcaatttaataattgtggattctcgacctttatttgaagggaagaaattattgaaaaacttggtgagtacatctttggaagaaaaggttgaaacaaattctgtttctagtttgacaatggaaaaggtcccaattacacaaagtcacattagtgttcaatatgttcttatcaatgccttgtcatcaactcttttagaagatgtggattgtgtgtttttgggtgcccatgcaatgttatccaatggatttctttactccagagtgggtactgctttgatcgctatgatgagtcacaccagaaatatcccggtcttagcctgttgtgagtctgtcatattctcagacaaagtgcaattagattctgtcacaactaatgaattggctgattctgaagatttaattcaaggtattgattccaagaaaccaccacaaaaacaatcatttgcattagaacaatttttgaaagaaagtgaacaagaaaacaaacaaccaaaacaagttaaaggtaagctggaagcagatgctaccgcagaccaatcagatgatctggaacctttgaagaattggcaagacgtgaaaaatttaaatataatcaacattatgtatgacttgaccccaccagagtatatcaacaaagttatcacagaattgggtgcgttacctccttcttctgttcctgtgattttaagagagtataaaaatgcataa

SEQ ID NO: 5738 - DNA, 1221 bp, Candida albicans
tcttatattaacaacaaacacctaatcatggcatccgaaggtattactgaaatcgactctggtttaattgaaaccaattacgataacgtcgtctacaagttcgacgatttaaacttgaaaccaaacattgttagaggtatttttggttacgggtatgaaactccatccgctattcaacaaagagccatcttgccaatcactgaaggtagagatgttttggctcaagctcaatccggtactggtaaaaccgctacctttaccatttctgcattacaaagaatcaatgaaaatgaaaaagccactcaagctttaatcttggccccaaccagagaattggctttgcaaatcaagaatgttatcactgctattggtttgtacttgaaggttactgtccatgcttctattggtggtacctcaatgagtgacgatattgaagctttcagatctggtgttcaaattgtcgttggtactccaggtagagtcttagacatgattgaaagaagatatttcaaaaccgataaagtcaagatgttcattttggatgaagctgatgaaatgttatcaagtggatttaaagaacaaatttacaacattttcagattattaccagaaaccacccaaattgtcttattatctgccaccatgccacaagacgttttggaagtcaccaccaaattcatgaacaacccagtcagaatcttagtcaaaaaagatgaattgactttggaaggtatcaaacaattctatattaatgttgaattagaagattacaaattcgattgtttgtgtgatttgtacgattctatttctgtcacccaagccgtcattttctgtaacactagatccaaggttgaatttttaaccaacaaattgagagaacaacactttactgtctctgccatccacgctgatttgccacaagccgaaagagacaccattatgaaagaattcagatctggttcttcaagaatcttgatctctactgatttgttagctagaggtattgatgtccaacaagtttctttagttatcaactacgatttgccagccaacaaggaaaactacattcatagaattggtagaggtggtcgtttcggtagaaagggggttgccatcaactttgtcactgacagagatgttggtatgatgagagaaattgaaaaattctactctactcaaatcgaagaaatgccagctgatattggtgctttatttgcttag

SEQ ID NO: 5739 - DNA, 531 bp, Candida albicans
  unsure (27),(86): Identity of nucleotide sequences at the above locations are unknown.
gattatatgaaaccctggggtgagccnttaagtagaaagtatggtcatgcgtatgatgctctcaagatatttatcaccgatctttntgttttgaacagtgtcgatgtactttcaaaggacgtattggaagaattaaagttatacatttcaagaagattaacacctcaggcaattaacatcagagccgatgttgatgtctcgtgttttagttacgaaggtatagatgctataaaggaagctttaaaagctgctgagagcgtctcaacttcacaaatgcaagtcaaggctaaattggtggctgctccattgtacttcattactgttcaagccttggataagaatgaaggtgtcaaacttttagaaaaagccattgaaaaaatcaccgaatcaattgaagctagcggcggtaactgtaaagtcagtatgcctccaaaggctgtttcggctaacgaagatgcagaattagaacgtatgttgcaaagaagagaagccgaagacaaagattcatctgacgaggaagatgacgcataa

SEQ ID NO: 5740 - DNA, 357 bp, Candida albicans
aggatgagtacaacaaattgcagattttatgaaaacaagtatccagaagtggatgaagttgttatggttaacgtccaggaaattgccgagatgggtgcatacgtgaagttgttagaatatgacaatatcgaagggatggtgttattatcggaattgtcgagaagacgtattcgttctatccaaaaattgatccgtgtcggtaagaacgaagtggccgtagtattgagagttgacaaggaaaagggatacattgatttgtccaaaaaagttgtttcagctgaagatatagtgaagtgtgatgaaagatataataaatcaaaagctgtccattccatcttgagtcttcaccacgcgtag

SEQ ID NO: 5741 - DNA, 615 bp, Candida albicans
  unsure (539): Identity of nucleotide sequences at the above locations are unknown.
ttcaacccaatcatggaaaaaaccatgaaacttgaatattcaattgataataatgatccacttactaataatttcccagaagtaaattattcacgagattatttaatttctttattaaatcaatcacctgaaagaattcgaaatgtttcaattattggagatttccaaagtggtaaaacatctttaattgatcaattaatcatgtatattcatcccaaaattaatattaaaaaatatttagataatcataaattagaaattgaacgagaattaaccataaaatcatcaccaataacattattattatcagatctgaaatctcgatcacaaattttaaatttaatagatacacccggtcatgttgattttgaagatgaaaccttggcagcattaaatattactgatggagtagtattaattattgatgctgtattagggatgactatacaagatcaatatttaattgatcaagtgataaaacaaaggttatctatgattataattattaataaatttgatagattgattttggaattganattaccaattaaagaatgttattataaattagttggaataaatgatgatattaatgattatattaaatcaatccac

SEQ ID NO: 5742 - DNA, 1557 bp, Candida albicans
gacactgtggacacgttagctagggtgacgaaattaattgaatctagtgatgggaaatcatttagtgcattagtaagaatatataaaggaggtttaaccatgggagataaaattaaaatttatggtgaaaattatcatgaagataaagatgattatagattagaaatcattaagaaaatttatttacctggtggaaggtataattttcctataaatcaagcaagtttaggaaatattgttttgattgatggtattgattcaataattaaaaaagggtcagctataataaccaatgaatcaactaatgatacggaagatattgataaattgtcttttgttccaccatccccaccaaaatatacaaataattcagtgtttaaaattgctattgaaccagaaattccatcagaattaccaattttattagaaggattaagaaaaattaataaatcatatttatcatcaattattaatgttgaagaaaatggtgaacatataatattaactaaaggagaattatcaatggattgtatattacatgatttaagatttttcttttgtgatgatttagaaattaaagttagtgatccaatggtgaaattttctgaaacttgtattgaaaatggttacattagaacatcaacaacgacaacaacaacaacaacaaccaacgaggataaagataaagataaagattctttattatcgatgactataattgttgaacctattatagattataaattcagtcatgatattgaaattgggaaattaaaatttgataatattgatattgattctaaacaattgatcaaaatattgaaaacagaatatggttgggattctttagctgctagatctctttgggcaattggaccaattaatgatttacaaaatcctagtattttattaaatgatacattaaatcaacaccatcaacaagacaacaacaacatcattgaatcaattaaatcgtcgataatttctggatttaaatggagtattaatgaaggtccattatgtggagatccaattcgaaatgttcaatttaaaatcatcgatattaccacaaacaataataataaaactacaacactggataataataataataataataaattattattatctccagcacaaataatcccattaatgagaagagcatgtcataatgcaatcactaatgccataccaaaattaatggaacctatttatcaattaaatgtaatttgttcatataaagccatcaatgttataaaacatttattattaaataaaaacccacaacaacaacaacaacaacaacaacaacaacaacaacaacaacaacaacgacgtggtgaaattgatactgtaaccccaataccaggaacacctttattttctattaaaggttatttaccagtaattgattcaattgggatattaactgatattaaattaaatactcaaggtcaagctataggatcattaaaatttaattattgggaaattgttcctgatgaattaagtgaagaatttataattaaaaccaggaaaagaaaaggtatataa

SEQ ID NO: 5743 - DNA, 690 bp, Candida albicans
ttttttttcagttgttgccatttttcaaccatgtctcaaggtattttatatgtattaaaactttcaccaagatcttctattttaactgatcttatcaaatattataaattagatattgaaatctctactgatactgaatcggaatcatttattaaactattcccattacgtaaaactccaacatttataggtaatgatggattccaattaactgaaacaatagccattggtatttattttttatcaatgattcctaatcatgatttattaggtgataatgatcaagaatttgctagtataattagatttctttcaatgttgaatcaagaaggtgctatgtcttgggttggtgcctttttcagattatcaggaagattaccttataataaagaaattattgatgagaatttgatcacgttagatattattggccaaattcttgataatagattagctaatgataggattagtggctatttagttggggacaagatttcttatgctgatttatatggtgttaaattatttggaattgctttatatacattgttaggtgagccatatttgacaaaatatcccaattttgctaaatggtttaaaagagcatctgataatgaatttttcagaggtcaatataaagatataaagtttcctcaacagcaattgacttatcctggttcagaagattga

SEQ ID NO: 5744 - DNA, 276 bp, Candida albicans
gctaaagtcaacaataagctttttatgttggtgaccgagtctcacaaatttgtcagattgtttcccttggcacttaatgacctacctaacagcattagtcatttcgattatgacgaaaacagaaccgaagagctcaaccacagtggacaagaacttttcgaaaccaggtttgttgatttcacacctcatgaatacattactgctttgataacagatttgggagtattgactccatctgcagtcagtgaagagttgataaaaatatggtacgattga

SEQ ID NO: 5745 - DNA, 435 bp, Candida albicans
tctagaatggctgattttgacattaaggaaacgtatcttaagtttttagaagaagacaaagatatgactatgcctatcgcggcaattgagtcacttgtgtcaatgttaaaagcaaagtcaccatcaacttcctccgaattaatcaatttagtttcgaaaaatattgatttattaaagtcttcaattcccaacaatatttctctttctgctgggtgtgatttatttatgagatttgtgttgagaaacactaatgtatattctgattgggagtcattttcacagaatcttgttgagaatggagaattgtttgttcaacgtgctaaggaatcaagacttaaactggcagaatacggtgttccatttatcaaggatgacgatgtaatattagtgcattcatatgcacgtgtcgtttacagtctattgttgaaggctaaa

SEQ ID NO: 5746 - DNA, 528 bp, Candida albicans
aacgccggcaagggatcgtttgcacttgcttgggtgatggaccagactgaagaagagaggtcgcatggtgttactgttgatatatgtgccactgattttgaaactgacaccaccaaattcactgccattgatgctcctggacacaaggattttgttccgcaaatgattagtggggtatcgcaagctgattttgcgttgttggttgatgattcgatttcgggcgagtttgaggcggggtttgcgttagatggccagaccaaggagcatacaattttagccaagaattttggactagagaagatatgtgttgctgttaacaagatggataaggagaactgggatgaacatcgatttgatgctataaagagccagatgacagagtttttgaccagcccggaggtagactttgataagagtcagatagattttattccgatttcggggttgacggggaataatgttgtcaagagagatttgtcggtggactcgttcaaatggtacgtgggcccgactttggcgtcttcgagc

SEQ ID NO: 5747 - DNA, 711 bp, Candida albicans
gtgtcttccatggacttctcaaagaaaaagagcaacgaaaaaaaaaacttgccatcgacattacttctttgctacactatgtcgaaactagcacaactagctaaagcaagatcacaaaggcccgactcatcagtgccccgatctattgcgatacttgataagttgaccaatacaactacaccagttaggcaacccagaaagagaaaaccttcgccagaagttaaacaaccaaaaccacagcccacgcctaccattacgtttggcatatctgttgatgattccatacttttgagccaacctagagaggatgtgtcggtattttggtgtcgaaatagctcaaccaccgagaaccacaaaagaagacgtcttgactctatctaccaacccattactaacctatctatagagaaaatcaccaaagccaaagagaatttcacccagccatcgcctgacgatgtggtactaaatgcccagaagcaagcatttgaaggtgtagccaacttgaagattgccccaccgaaacaaaccaaaccattcaagaaagtcgatatcagcaaagcacttttatcccccgattatgctaaaccacgcaagtcttttgttgttattgggcatgtcgatgcagggaaatccacattaatgggaagacttttgtatgattttggaattattgatgccaagacagttaacaaactagttaaggaagcataa

SEQ ID NO: 5748 - DNA, 423 bp, Candida albicans
caaacaaatatgctggcacaatcttggctggtcttggtgtgttgcttttgcctgtgccaattgcgttccgtgtgtatggtaaaaagattcgtgaaaacagtaagtacgcgtataagtaaaagtatgaagaattttttttttttttggcaagttttttctttttcagaacccaccacaatggattatgatgatgacgatttagactatagctctcatgaagaagaagagtttgatgagaataagttgaataatgacgagtacaacttgttgcatgatacgcttcctgcactcaaggagaaactaaagtcatacaacgacgaaataccagaatacgatttgaaggaggcgttatactacaactatttcgaaatagaacccaccgtcgaagaattaaaatcaaagttcaaaaagagtatgtattga

SEQ ID NO: 5749 - DNA, 597 bp, Candida albicans
ccattttttttatcggtgcatgatgtgtataaagataaaggggaattgaaagtgagtggtaaagtcagtagtggggtgatatcatctggcgaaacgattgtggccttgccaagtggggaatcattgcaagtgcaatcgctaaaagtttcgaaaaaaccagttgactttgccatatctggtgagttagcacaaatagcattcaagacaagccaaatatccaatgaaagcgttgatcagattagaattggggacttgattaccaaaccagggtcgccagtgaaaactgcgcacaaacttttagtgctgcttcatttgtttaacatggacaagccgttgttggtgggcacgccatttgttttgtttaggaataatacccaagtgccagcaagggtttccaaaattgtcgaagttgtcaatggcaagaagaagaagaaggtattgcatttggtttcaaggcagactgcgatagtggagattgcacttaccaatgcattgccggttacaaaattcgacgacaataaagtgctaggcagaatcgttataagaagagagggtacaactattggcgcaggtacggttattgatttttcagaatga

SEQ ID NO: 5750 - DNA, 1317 bp, Candida albicans
aaaaattttttttcctttcttataatttctttctttctttctttcttcttcttcttcttctttttcttctttttatcaacaacattttggaaaatgtctgctgctagtgaatccaaatattctactgaagtgctttccgaattattgagcaaattacaagttgctgataataaggatgaagctgcttccaacatttccacttttttaaactcatctattgttgaacacgatgttccagttgaatttttcgaagatttgaaaaaacaaattcaatctaaagatgctaaagtttctcttgctgctttggatgcttacaaacacattgcttcaaccaacggtttatccccatccgttgaaccatatgttgttgacttggttagtgaagttgccgttaaagctggtgacaaaaacaaggatgttcaaactgctgcttctgatgctttattggccattgcttctgccatcaccccaactgctgtcaaagccatcttaccaaaattgattgacaacttgaccaacaccaacaaatggactgaaaaagttgccatcttgagagctgtttctcaattggttgacactgctaaagctcaaattgctttgagaatgcctgaattgattccagtcttgtctgaatctatgtgggataccaaaaaagaagtcaaagaagccgccactgctaccatgaccaaatccactgaaaccattgacaataaagatattgaaaaattcattcctcaattgatttcttgtattgccaaaccaactgaagtgccagaaaccgtccacttgttgggtgctaccacttttgtttctgaagttaccatggccactttgtcgattatggctccattgttgtctagaggtttagctgaaagagacactgctatcaaacgtaaagctgctgttattgttgataacatgtgtaaattggtcgaagatccacaaattgttgctccatttatggacaaattgttgccaggtttgaaaaacaactttgccaacatggctgatccagaagctagagaagttactcaaagagctttgaacactttaagaagagttggtgccgttggtgaaaacgatagcatcccagaagtttctactgctggtgatatcgatgtcactttgaatgaattcaacaaattggttgctgacaaaaaaatcgccaaaagatttgacgttgctttgaactatattgctgctattgctggtgatttggttgatgaaagagaaattcaaccagaagcttggttacaaaatgttttaccatttgccaccatttttcttcaccacgaggggcacgaccgcctagattaa

SEQ ID NO: 5751 - DNA, 564 bp, Candida albicans
aaggaagctttggcttctggtcaattcagaccattaaccagaaaagaaattgaagaacattgtgctatgttgggtttggatgccgaattggtttctcactctagaattagaggtttatctggtggtcaaaaagttaaattggtcttggctgcttgtacttggcaaagacctcatttgattgttttggatgaaccaaccaattatttggatagagattctttgggtgctttgtctaaagctttgaaagctttcgaaggtggtattgttatcattactcactctgctgaattcaccaaagatttgactgaagaagtctgggctgttttggacggtagaatgactccatctggtcacaattgggtccaaggtcaaggttctggtccaagaattgaaaagaaggatgatgaagaagaagataaattcgatgctatgggtaacaagattgccgctgctaagaagaagaagaagttatcttctgctgaattaagaaagaaaaagaaggaaagaatgaagaagaagaaggaattgggtgatgcttatgtctcatctgatgaagaattctaa

SEQ ID NO: 5752 - DNA, 234 bp, Candida albicans
tattcaacgttatttaagcttttggacggggaatataccccaaccatggggaagttaacgtccagcgaaaatgttcgtattgcttacattaaaccacatgtttttgttcataatgataaccatttgacaaaaactcattctgaaatattcattgaagattccaaactgtggaagatagagaaaccatggatagagcttttagacaaatcaatgaaggagatgaacaaaacatga

SEQ ID NO: 5753 - DNA, 1782 bp, Candida albicans
cggcggtgtgaaaaccacgttgaccgtgccaagtccacattatcagatcgattattagaaatgacaggggtgatcaaaccaggatccaagtctcaggttttggataaattagatgtcgagagggaaagaggaattacagtgaaagcccagactgtgtctatgttttataacgatgggaaacaagattatttattacatttggttgacacaccagggcatgtggatttcagagcagaagtgtcaaggtcatatgcatcttgtggaggagcattgttgttagtcgatgcatctcaaggagttcaagcacagacagtagcaaatttctacttggcatacagcatgggattgaaattgattcccataataaacaaaattgatttggatctggctaacattcctggagcgagggagcaaattgaaacgacatttgagttagaccccaatgaatgcatcccagtgagcgccaagaccggtttaaatgtcgaacaaataataccgtctgtaattaaaaatatcccatctcctgtatgtgatgtgaacaagcctttgcgagctttattggtggattcttggcatgatccctacgttggtgtggtaatgcttgttcatattgtggatggtagaatgaaaaaaggtatgaaaatcttgtcagcgcacacaaataggacatacgacgttaaggaagttgggataatgtatccagatagaacaccgaccagtttcattaaagctggacaagtcgcctatattataccggggatgaagaaccctcgagaagcgcttgtgggtgacacgttttatcaaatgggcaaacatgaaggtcttgaacctttaccaggatttgaagaacctaagccaatggtatttgttggggcattccctgcagatgggaaagagtttaatgctatggatgatcaaatgcagaatttagttttgaatgataggtcggtaaccttagagcaggaaacatctaatgcattggggttaggttggagattgggattcttaggctcattacatgcgtcagtgtttaaagaaagattagaaaaagaatatggggcgaaaattattttgacagcccccacggtgccctacaagattatctataaaaatggcgaagaaagaattgtcacaaatcctgacgattttccagacaaccagaaacatcacgatgttgaaagctatatggaaccatatgttgaggcgataatgaccgttccaaatgaatatgttggaaatgttatgactttgtgtttaaataatcgaggagaacagaaagagatcgaatacttgacaacaggacaggtattgctaaagtatgagatcccaacctcacaactagtggaggatttttttgggaaactaaaaggatgcaccaaaggatatgcttcgcttgactatgaagaagcacgatatagaaaatcagatatagttaagatgcagctttgtgtgaatggtgagccacaagatgcgttaactacagttatacacagatcacaagcgcaagcaaggggtaaggagtacgttacgaggtttaagaaatttttgagctaccagctatttgaagttgccattcaagcaaaaattaataacaaagtggtggcaagagaaaccatcaaagcaaaaagaaaagacgtaacacaaagattacatgcagcagacatatcaagatataagaaattgttggaaagacaaaaggagggtaagaaacagatgaaattaagcggcagagtgacaatcaagaacgacgcttatcaagccttcttacgtagagaagactaa

SEQ ID NO: 5754 - DNA, 1128 bp, Candida albicans
ataactccccaccaaagatataaccaatcgatgtcgaaattgcttactcctgaaattctagcgctcatagacccagtggtgtctagtttgaaacgtcatcagcttgtggatgataaggagatagcattaacaattgcccagttgttgatgaaagtcatatcagcagcaagatggtctaatacatatgatttaattgaattgataagacaaattggtgttatatttaccgaagcatatcctagaaaagtcattccaggaaatattgtgagaagagtgttagctttaatacgtgatgaaaccgaaactgagactgagaacgagactgaacaaacagataacatcccaatgatgagctctatgtttagtttattggcaacacataacaaaaatgaaactataaaggaacaaacacaattacaactgaagaaacaaacaagcgatatgagagccataattatacaagggattagagatttagttgatgaaatttccaatgttaatgatgggattgaaactatggcggttgatttgattcatgacgatgaaatattattaactccaacccctaattcggaaacagtgcaacattttttaatcaaagcaagattgaaaagaaaattcacagtagttgttactgaaaactatccaaacgacatcaaggcagcccacaagtttgtcaagacactagctgaacacaacatcgaaacaattttaattccagacacaacaatttatgcagtgatgtcaagagttgggaaagttataataggtactaatgctgtatttgccaatggtggctgtttgtcaaattcaggtgttgccaatgtagttgaatgtgccaaagaacacagaacacctgtgtttgctgtggcagggttattcaaattatctccattgtatccatttacaagaaacgatttgattgaagtaggaaactccgggaaggttttgaactacgacgattttgaattggtgcaaaatgttgatgttgtgactaatcctttggaagattatatacctcctcaacatatcgacatttttatgaccaatattggagggttttctccttcatttatttatagaattgttttggataattataaagctgaagacaacaaacttgaataa

SEQ ID NO: 5755 - DNA, 906 bp, Candida albicans
ggacaccagggggtaatttggtctattgatgttgacccagaaacacacttatgtgccactggaggaggggatttagccatcaaattgtggaaagttgaaaatggtcaatgtgtgtatacatgggattctccatccccagtgagaagagttgcattttcaccagatggtaaaaaattgttagccattgctgatcaagttatgggtcacattggtactgtttctgtatttgatataaacgatgatgacgccactctaagccagcaaaaagcagaaccttctttagtgattgaaactaaatctgaggggtcaaaggccaccgtagcgggatggtctggtgatggagattatatcattgttggtcatgacaacgggtacgtttctaagtacgattcgaaaacaggcaaattagtcacatctttacaagcccacggtatacataatgaagagaaaaacgtcagtatcaccgatatccaattcgccccagaagacagatcatattttatcacatcttcaaaagacaaaaccgccactttgattgacgttgacacctttgaaattctcaaagtatacaaagctgatgctccaatgaacacagctgccattaccccggtcaaagactttgttattttgggaggtggtcaagaagcaagaaatgttacaaccacagctgaatcacaaggtaaatttgaagccagattttaccataaaatttttgaagaggaaattggacgtgtcaagggtcatttcggtccattgaacactgttgctgttcaccctgatggtactggttacagtagtggaggagaagatggtttcattagagttcatacatttgataagtcatatcaagatttccttttcgatgcagaaagaactgaaagagctgctgctgcaggaactatttaa

SEQ ID NO: 5756 - DNA, 507 bp, Candida albicans
cgacactttttttttttatttaacagcacattatattcaacaatgggtaaatcatccggtaaaggaaaaggaggtaaaaatagaagaagaggaaagaatgtcaacagtggacaaaaaagagaattaatctataaagaagagggccaagaatatgctcaaatcactaaaatgttaggtaatggtagaatcgaagtaagttgtttcgatggtattaaaagaatgggtcacattagaggaaaattgagaaagaaggtgtggatgggacaaggtgatattattttggtgtcgttgagagatttccaggacgaccaatgtgatgttgtccacaagtacaactctgatgaagccagaacattgaagaatgttggtgaattgcctgaaaatgccaagattaatgaaactgatacctttggtgctgatgatgatgaagaggtcaatttcgaattcggtggagccgatgaagatgaatctgaagaggatgaagagttggatattgacgatatttag

SEQ ID NO: 5757 - DNA, 1890 bp, Candida albicans
acgcttagcgcggtaccttcgaccccctggggtagaagacaaagtcgtggtaaaaagaatattgataaattggaacaaattgctactttggaaaaattattagaagcaaatgtttctaaaagttcaccatttgaattgatttctatttatcagatgttattatcagttagatttgatgcttcatctaatcaagcttttatgcctttggaacaatggcaaaagaatgaacacgatttaggtaaattattggatttgttggaagctaatgttgatacttatcaagtttctgaattgggttcaactactgatgatattgatattgaaccagttgctaatgcccaaggtgttaaagttattttcggatcaatcacttcttctattgatagattggacgatgaattgaccaaatctttacaacatactgacccacattctattgaatatgttgaaagattgaaggatgaaagtactatttacaatttgattgttagaggtcaagcatatgttgaatccataactccagaagatgtcaagtataaatctgaacaattggcaagaattgttttgagaagattggaacacatttattataaaccaaaacaattgattaaagctaatgaagaagaagcttggcgtaatattgaatacaattcatctattgtcagtaaaggttcttcagttgatgaagttattgatcaattgacggaatttttacaaaagcaacaaaaaaacaaaacttatgggaaacatgctatactattctccatttattattatgctgtcaatagtcaatatgaaaaggctaaagaattatttttgagatctcaattttatagtaacatcaattctgctgaatcttctttacaagttcaatataatcgtgctttagttcaattaggtttaagtgcttttagagctggtagtattgaagaatctcataaaattttgaatgaaattgtcaattctcaaagatctaaagaattattgggtcaaggtttcaattctaaattccccaatcaagctactgttttggaaagacaaaaattattaccattccatcaacatattaatttggaattattggaatgtgtatttatgacttgttctttattaattgaaattccaactttggctgctattgctaataatcataaggattcaaaacgtaaaaatgcttcattgaaatctttcaaaagtaaattggatttccatgatagacaatttttcactggtccaccagaaagtattaaagatcatattgttcatgcttccattgctttacaaaaaggtgattggttaaagagttacaatttattgtcatctatcaagatttggaaattgtttcctgataatgataaattattggccatgatgaaaaatcaattacaaattgaagggttaagaacttatattttcacttataaatcagttttcaagaaattatcgatagaaaaattacaacaaatttttcaactttcaaaagatgaagttgtttccatattagaaaaaatgattactactggaaatgttagtggaggagaaatcattgataacaagtttataagtttcacttcaactactgaaccacaaagatctaaattacaagaattggctattgtgttgaatgaaaagattcaattattaactgaaaagaatgaaaaaacacaatctaatggttatggtaaaaaacaacaaaacaaagatcaacaaaatcaacaaaatcaacaacaacaaaaccaaaaccaacaacaacaacaaaaccagcaacaacaacaacaacaacaatcatctcaacaacaatcaaataatatcttgtctgaagaatctgctaataaatttagatatgccaatgttaattctaataatgatgaatttcaagctacagcttag

SEQ ID NO: 5758 - DNA, 351 bp, Candida albicans
ttgttatttttactccattgtatgtcaactatccaaaacttaaacgcatttgatccattcgccgacactggtgattcagaagctcaaccaacaaattacattcatattcgtatccaacaacgtaatggtagaaaaactttaaccacagttcaaggtgttccaaatgaatatgatttgaaaaaaattttaaaagtcttgaaaaaagactttgcttgtaatggtaatattgttaaagatgatgaattgggtgaagttatccaattacaaggtgatcaaagagttaaagttagtgaatttttaactgctcaattacaattaccaaagaaaaacatcaaaatccacggtttctaa

SEQ ID NO: 5759 - DNA, 1965 bp, Candida albicans
ttgattatgtctcagtggattcctttgagtcatgccatattggggtcagtgattgaatacttgccaagccccattgttgctcagcgtgaaagaatagacaagattttggatgaaacgatttatagtgcagtggattcagaattggataaatccaaactagtcgacccttcatttgtcaaggcgatgcaggaatgtgatagttcacacccggaaacccatacaatagcatatgtatcaaaattgttgtcaatccccaatgaagacttacccaaagctagtaatgccgctactggaggattgacggccgatgaaatccaagaacgaggaagaattgctcgagaattagccaaaaaggcatctgaagcagctgctttggcacaagaaggttccaaaaatgaagatgagtttgccattaaacccaagaaagatccatttgaatgggaatttgaggaggacgattttgagaatgaggaagatgagagcgatgcaaacgcagttgaagaatcaactgaaaccatagtgggtttcactcgtatttattctggatcgttatctagaggccaaaagctcacggtaattggacccaaatacgacccttcattacctagagaccatcaaaccaactttgaacaaataaccaatgaagttgaaattaaagacttgtttttaatcatgggacgagaattagtgagaatggaaaaagtccctgcgggtaatattgttggggttgttggattggataacgccgtgcttaagaatgccacaatttgctcaccgttacctgaagataaaccatacattaatttagcttcaacatcaaccttgatccacaataaaccaattatgaaaatagcagttgaaccaacaaacccaataaaactagcaaaattggaacgaggattagatttattggccaaagccgacccggttttggaatggtatgtcgacgacgagtcaggtgaattgattgtttgtgttgctggagaattgcatctagaacgatgcttgaaagatttagaagagagattcgctaagggttgtgaagttaccgtcaaagagccagtcattcccttcagagaggggttggcagatgacaaaatcagtaccaacaccaataataaccacgacgacaatgaagatcatgaattagatgaaaacgaagatgagcttgctgatttagagtttgatatttctccgttgccattagaagtgactcagtttttaattgagaatgaaacgattattgccgaaattgtcaacaacaagcaagatactcatgaaattagaaacgattttattgaaaaatttgccactattattgataattctaatttggctacacaatttccagacaccaagtcttttatcaacaatataatttgctttggacctaaacgtgttgggcctaatattttcattgaagattatgggttaaacaaatttagacatctacttggtgaatctgccactgaatctcgatttgtttatgagaataatgtgttcaatggggttcaattggtattcaatgggggtccgttagcatcagagccaatgcaaggtattattgttagacttaagaaggcagaaaaaagagaagttgacgaggataagatagtcaaccctggtaaaataatcacacagactcgtgacttgatttacaagcggtttttgcaaaaatcaccacgcttgttccttgcaatgtatacgtgtgaaatccaagcagctgccgaagtgttgggtaaagtatatgctgttgttcaacgacgcgaagggtcaatcatatcagaagaaatgaaagaaggtactccgttctttactattgtggcaaaaatccctgtgattgaggcatttgggttttccgaggatattagaaagaaaacatccggggcaactagtcctcaattagttattgatgggtatgatatgtcagatatcgatccattttgggttccacatactgaataa

SEQ ID NO: 5760 - DNA, 483 bp, Candida albicans
gaacaaccaaccaatatcccgaagatttcaccagagacagtacatatactacaactggatgcatcgtgtataagatacatctgtattttagcacatgtcgaccacggtaaaacctcattgagtgactcattattagccaccaatggaatcatttcccaacgtatggcaggtaaagttcgatatcttgattcgagagaagatgaacaactgagaggtataaccatggagtcctcggcaatttctttatatttcaaagtcatgcgattgcaacaaggatcacaagaaccagaagttcacgaacatttgattaatttgattgattcacctgggcatattgacttttcgtctgaagtgagtacttcttcgagattatgtgatggtgcagttgttttggtcgatgtcgtcgaaggtgtctgctcacacacagtcaacgttttacgccaatcttggatcgataagttgaaatttgccacacggcgctag

SEQ ID NO: 5761 - DNA, 246 bp, Candida albicans
cacattcatagggaaagaatgtccgatttcaaaaaaagtgaaactaccatccaatctggtcaacatgttttgatccgtctaccatcagaggggttgaaaatcgttcatttacaagatacaggtataataggattagggaaatttggatcttttgaagtttccaatattttgggctacccattgggcacgtcatttgaaattattgcagatcacaaggtcttcaccacggcgtggaagatccacgtc

SEQ ID NO: 5762 - DNA, 948 bp, Candida albicans
aaacgtgctgggcaggaagggtttgataagaaaaccatattttcccaacaaaaataccttaaaagaaagcaacaaaagtttttgagacgtttcacagttgattatcttggagggagtgaattattgcagtattatattgagaaagatttgaatagggttttagatcttagtgttgaaaccttaggcttgatgttgacatacagtaatgttcgtcctggtgggaaatatcttataattgacgaaacaggtggagtgttaacttatgcaatgatggaaagaatgaattgcgaaggaacaatagtttcaattcacgagaatgaacatgcaaatttaatagccttaagatattcagactatggtaatgaattggaaactaagaccgtgaaaagtgtgaattggttacaatttatagaccctcaaagcgagagaattgattggacagatcttccagacgaagaagttaaaaaaattaagaataaaagccagtataaaaaacgtcgtgaccgtgctttacagattaatgaagttattcaactagttgaagaaggaaattttgatgcattcatatctgtctcaacattaaatatgtctgaagtgttagagtatgtccttcctaaaatcggtggctctagaccgattgtcgtgtataatcaattcaaagaatcattgttagaggttcaacaagcattgtcaggagacaaaagagtgttagctccatccatatatgaaaccagagttagaccataccaaactattccaggacggatgcatcctgtgatgacaaatagaggcggtggtggttatatattgtgggggacacgagtgattcctcatgatgctattactgcagtgggcaagggattcgcaaagcgaaagagagtggaaactccatcgaagactgacacaggaacagtagaagtacaaaacgatcaagagaactctgcctaa

SEQ ID NO: 5763 - DNA, 984 bp, Candida albicans
gcgcggtaccggccagctcccgtcggtgaagacagagcgattgacaacattccacaaccaccatcatttgaagatgaagaagatgaaggtgaagatttatgtaattgtgaattctctttggcttatggtgccaagatcttgttgaacaagacccaattcagattaaagagaaacagaagatatggtttgtgtggtccaaatggtgctggtaaatctactttgatgagagctattgctaacggtcaagttgaaggtttcccaacccaagacgaatgtaaaaccgtttacgttgaacacgatatcgatggtactcacgccgacacaaccgttgttgaattcgtcattgaagatggtgaagttggtttgaccaaagacgttgttgttgacaaattgagagaattcaatttctccgatgaaatgatcaacatgccaattcaatccttatctggtggttggaaaatgaaattggctttggctagagctgtgttgaataatgccgatatcttgttgttggatgaaccaactaaccatttggatactgtcaatgttgcttggttagtcaactacttgaacacttgtggtattacttccattattgtttcccacgattccggtttcttggacaatgttactcaatatattatccattacgaaggtttcaaattaagaaaatacaagggtaacttgtctgaattcgtcaagaaatgtccatctgctcaatcttattatgaattaggtgcttctgatttggaatttagattcccagaaccaggtttcttggaaggggttaaaactaaacaaaaagctattgttaaagtttctaacatgtcattccaatacccaggtacttctaaaccacaaattcaagacattaacttccaatgttctttatcatctagaattgctgtcattggtccaaatggtgctggtaaatccaccttaaataacgttttgactggtgaattattaccaaccactgggtga

SEQ ID NO: 5764 - DNA, 354 bp, Candida albicans
agattccaaactgtggaagatagagaaaccatggatagagcttttagacaaatcaatgaaggagatgaacaaaacatgaaccagattttcaaaattgaaggtacaccaagaagaattgctgtattcaacgccagaagaaagttcaagaactcttatgaatatgaaatttcttggatgttgggtgaaaacattggtatgaagaatgaaagatgggtaccaatgatgtctgttgacaacacttggttgccaagaggtgaattgatggaaactcacgccaagttggttgctgaagttgatatgaaaggaagctttggcttctggtcaattcagaccattaaccagaaaagaaattga

SEQ ID NO: 5765 - DNA, 1122 bp, Candida albicans
tatttttggatccagcaaattcaattcattttcaaaattcggtttcctactgtttcatctaatattcccaaattggatattgaaaaattaactcgagaggcattagcttctgttccagagtcgcaccatacattaccttattgttggaccatatggtatcattcaagaaataaaaagaaagaacaaggacaaaaagtatcggaagaattacaagagtcaattgaagaacaactgccagagcaacaacaacaacaaagtgttggagtcgattcatatttacagaccactaatgaattggagtttattgacttttctactgggaacccaatccatcatattgcttctttagaacaattatggagtagtttttcatcaattaaaaaaacatatacattgaatattggcactgaatttttaattttcaaaactggtgtgaatcctgtatgggaagatccaataaattccaaaggaggtagatgggttttccgttttaatagaaaaatcatggatgggtataataataatgataagaagagtaataaacaagagttgttccggaaaagaacaagtttaatttgggaaagattagtgttaaagactttaacgggatctttaattccggattcgaattctagtgaaatccaagaattattattaaatgatatttgtggattagtgttgagtgttcgtaaagatgaagatattataagtttatggaattcaaatttaaattttttcggaaaaaaggaccaaaccaaaaagttgacttcattccaagcaagaagaattatttgtgattcaatattacgtgtcattcgtgaatgtgatttgattaatcaaggtagtgattgtgttgaaactattgataccggttctaatgaaagagtttttggtgttagttttgattatagaattcatgctgataatgaaagagaaagagaaaagtctattgctagtaatggtgctaatggttctacaacaggtggcagtacaggtagcaatagtggacaaacttatggaaaccattacaataggagatacaacaaatataacagcaacagcaataacagcaataacagcaacagcaacactgctagcaaaacagattccattgccaagtaa

SEQ ID NO: 5766 - DNA, 669 bp, Candida albicans
tttgaatctgaactgaatgctaaccttgtttttttagttatgtctgaagaattagctcaaaaaactgaagaattgtcattagattccaagactgtttttgattccaaagaagaatttaatgcaaagcatccattgaacagtagatggacattatggtacactaaaccacaaaccaacaagagtgaaaactggcatgatttattaaagccagttataactttctcatctgttgaagaattttggggaatttacaactcgattccaccagcaaatcaattacctttgaaatcagattatcatttgttcaaagaaggaattagaccggaatgggaagatgaggctaactcaaaaggtggtaaatggcaattctccttcaacaaaaaactggaagtcaatccaatcataaatgatttgtggttaagaggtttgttggcagttattggtgaaaccattgaggatgaagaaaacgaagtcaatgggattgtgttgaatatcagaaagcaagcttacagagtcggtatttggaccaaagattgtgatgaatccaaattaaagactgtcggtgagagattgaagaaagtcttgcaattaaacgatgaacaaaaagttgaattcatgtcgcatgatgcttccaatactagaggcgctgaacctcaaattgttttgtaa

SEQ ID NO: 5767 - DNA, 270 bp, Candida albicans
aacaatatcacaccaacttctgaactgggtctcaaggcggactatcatctcttcaaaaagggcatcaggccagagtgggaagacccccagaacaagcacggtggcaagtggtcatactcgttcaaagacaagcgctccgtaccgatcgacgatctttggcttcacgctcaactggcagctatcggcgagactcttgagaacgatggtgacaacgaggttatgggtgtggttgtgaacgtgcgcaagggattttaccgtgttggtctgtag

SEQ ID NO: 5768 - DNA, 855 bp, Candida albicans
tctttacgcggtcctgctcactcccgtggtgaagacatagaagataaaaaggcgaaaattttccctcaaagttataccatctatagtgacactgatgagaatgggaatgaaagtccaatgtttttggacacatacagccaagcagatattgaatttcatcaagcattatctatcagaactcaaatgtgttggagataccctgcagcaaccgtcagcaataaattgttgaatagtggaatttttcttggatcgtgcctgcaaatattcagcgttttcgatgagcaaaaagataaatttactgaatcatattttgaaaaacgttctttgatgaaaattgtacgtgatttggctcgaagatcttggaagcatgcattgcatcaagcaagtgttggatttttcattgttcccaaacaagctacttttttcagatgtaacaatttgccggtgttgatggaggctaatagatactttatgaaaaaacaagctattgcaaaatcagcatctcaaaacacacaagcacctaataaacaagataaacaatcaggggcacatgtgggaaacgattccttagtgggagaaaatacagaactaggagaaaagactaatgtcaaaagaagtgttattgggtcgaattgtaagattggtaagaagaataagattacagggtgtttaattttggataatgttgaaatccacgatgacgtgacgttggaaaattgtattattggtcatgatgttattattcagggtaaatgtaaattgaccaattgtaacgtggaaagcaccaacgaggtagctcataacacacaagccaagaattcgaatctattgtgtttgaccttggaaggtcattaa

SEQ ID NO: 5769 - DNA, 459 bp, Candida albicans
  unsure (254),(256),(260),(262),(355),(363): Identity of nucleotide sequences at the above locations are unknown.
agtgagatggagttcacagcagttattgtctgtggtaaggggaaagctttgacacccttttcccaagctcgttctacaggaatcccgaaaccattattgccaattgcaaacaaacctatggttcaatatgtgttggattggtgtttacaagccaatttttcaagaataatcgttctttttgaaaaagaggacgaatcttctggtgttctagaacagactataaagagatctcaagaggaaaaagagaagaccancnccantnaaaacgaatctcacgttagtattgatgttataccttacaattgtgaaaacaatggattaatattatacaaattgtatgaattatacagtgaanacaaagtntcaaacaacaatttcataattttaccatgtgacttgataaccaatttacccactcaagtgataattgaagcatatgaaattaaaattgaatccgat

SEQ ID NO: 5770 - DNA, 546 bp, Candida albicans
ttcttactctacgatatggccaaatacactgaagaacaattacttgaattaaaatctgaagcacacactccaaagcctgaaattttggatgcattcaacaagttaattgaagaagttaaagaatccattgaacaacaccaacagcatcaaagaaaatggcacaatggcgatacttatattgacgaacacggtcatgaaagatcatatcatcacattaatagaagaagacaatctaaaggtgcttctggtgtaccacgaccaaatttaagaaagaaatcagaaccagttgttgatgaagatggttgggctactttatctaaacctaaaaaaggttcttttgctgaaggtgatgccatagaagaaagaattaaatttagagaaaccaacaatagtggtgctggcattaaggccagacctaataataagaatttgggtagttcaaaagctgtggatcctagagaaattgcttctgataaacaaaccaaagcctttaatgcctttgctgctttaggagatgaagatgatgatgacgaagatgatgaataa

SEQ ID NO: 5771 - DNA, 927 bp, Candida albicans
actattttctccaatttggaatttttcaaaactaatgaaagagatatcccagttgaaaaattagaattaaaagatgtggtggttaattttgcttgggaaccaaatactgaaagatttattactattagtagattagatgatggtaatccgaatcctgctattccaaaaaataccatttcattctatgcaccagaagttaccaaaggtggagttaatcacaatctgaaaaagaaaggtggtgccgccattgctgctgctgttgctgctgctgctattaataatcaactgtcaactaaatataaggcatacaccaaaatcgaaaacaaacactcaaacactattttctggtcaccaaagggaagatatgttgttgttgctactatttcaagaacttctggtgaattggaatttttcgatgtttcatttgatgatgaaactaataaaaaatcattacctgctaatgtcaaattattaaagaccgataaattttctggaatgaccaatatttcttgggatccatcaggtagatttgttgctgcttggtcaacttcttggttacatgccattgaaaatggttatagactttatgaattcactggtaatttattaagagatgattcaattgatcaattcaaagattttgtttggagaccaagaccaccatctttattgaccaatagtgataaaaagaaggtcagatccaatttacgtgaatatagtgcacaatttgaagaagctgatgctatggaagctgatgctgctgttaaagaaatcattttggctcgtaaaaaggctttggaagaatggagaaagtaccgtgccaaacatattagtaaacaaggtaattccaagaacgaagttcaagcagaaattattgaagaaattaaagaagagattattgaagaaaaagaagaaattgttgaataa

SEQ ID NO: 5772 - DNA, 858 bp, Candida albicans
aacatgtctgatttaggttttgatccaagtttgaagaagaagaaaaagtccaagaaggttgcttctgtggtggacgacacagattccaaggaatcaacaccccaaccccaaaacccaggtgatgcatcggttgatgatttgttttctgggttaaagaaaaagaagaagtcgtcgtctaagaagtcagcagaagaatcagggtcgccgtcagtagatgaagacttatcatcgtcattgggcgatttaactttaaagaagaaaaagaaaaagagtactaaaagcttggatctcaatgagttcgagcaacaattagaagaagcaggtgtggaagacttaacagaatctaccaatggtgccacaaatgatcaatcagcaattggattatcttatcctgacttgttgtcacgtttctttgatattttgaagaagaacaaccctgaattggctggtgacagatctggtccaaaattccgtattcctccaccaatagtccaaagagaaggttccaaaaagacattgtttgccaacgttcaagaaattgctaccgttttacagagaagtccagaacatttaatccaatatttgtttgcagaattgggtactactggttccattgatggtgaaaagagattgatattaaagggtaaattccaaccaaaacaaatggaatctgttttgagaagatacattattgaatatgtcacttgtaagacatgtaagagtatgaataccgagttgaagagagaaagtgccaaccgtttacatttcttgagttgtaaggcatgtggttctacgagatccgtgtcttcgatcaagactgggttccaagcccaaatcgggaagagaaagaagttctaa

SEQ ID NO: 5773 - DNA, 3591 bp, Candida albicans
  unsure (1472): Identity of nucleotide sequences at the above locations are unknown.
acaatgtccaagtcttttgacgattttataaaacagcagaagcaacaacaatccaaacctaaagggtttggttatagaaataacaatcaaggaggctacaattataatcaagcatatggcaatgtacctacgtttcaacctggaaatcaacaatttcaatatcaaggaggatataaccaaggattcaatcaacaacaataccaatatcaaggacaagggtacaacaatcaaggttataattccaataatagatataacaacagtaacaactataactataataataacactaaccaaagttccaccatttcaactccagtagactcattacctacaagtggaagaagtactcctaatccgaatgcatcaaccacttcattaacatcattgaatactgctcttgctaaattaaatgtttccaatattccatttgaagaaaatttgagtaatattgagaaagccggtaagatagctgagattagacccgaagtggaaaccattgttaagataattgatgaacaagaagatttatcgattattaatgaatggaaattgaatgaaattttgaaatctttattgaaacctaaaagtcctgcattagttaaagaaggagctttattaatcattcaacaattggcaactaaatttggtggtcaaacccccaaagaagcttatttattacagtttttaagtactgcttatgatatgtttactgataaagataaaaatgttgttaaagctgctaaatctgctactgatgcattatttggaatttaccctgtggaagcattaggatcaattgtattagatgaatatttaactattttcaaatcaggggctaaatggaattctaaagttgctgcattagtcaattttgataaattaattgatgatgttccggcagatattttagaaatgaaatttattgatgttgttccggtattgactgatttatctactgatttcaaaccagaattggctaaagccggtctttcaactttgaaaaaatttgttaaagttttagataatttggatttacaaaacaaatatgatttgattgttgacactttagctgatcccaaaaaagttactgattgtatcaaaaatttatcatcagtgacttttgttgctgaagtcaccgaaccagcattatcaatattagtccccattttaaataaatcattgaaaatgtcatcatcatcaaatgagcaattgagacaaacatttatggagacagaaattttaacccgattggtcaataatgaaagaggaattgaacaatttattccaattttgttacctggggtggaaaaagttgttaacaatgcttcattaccagaagttagagaattggccggtaaggctttgaaagttttgaaagatgctgaaaatgaacaaactgatggtaaattccatggaagaattactcttgaacaagcagaaagattttacactgaagatattcctgatgnacaacatcaacaaccagttcaattgttaaaagatgatattttgaagaaatatttggctaccgtgttacaaatcgatgctcatgtcaatgattggaaacgtttacaagaatatttgatgatggctactaataacaatgaaacttactcacaattagtagttactcatgtcaagaatttatttaaccctgaatcagctgcagataatgagaatgacgatggtgctgttgttattgttgacacccatttctcattagcctatggtactcgtatgttattgaacaaaaccaaattaagattattgaaaggacatagatacgggttatgtggtagaaatagtgctggtaaatcaactttaatgagagccatttctaaaggtcaattagaaggtttcccaactgctgatgaattgaaaacatgttttgttgaacataaattacaaggatctgaagctgatatggatttagttagttttattggtctggatccagaattagccaatgttggtcgtgaagaaattgaacaagctttgaaagatgttggtttccccgatgaaagattacaacaacaagtaggatcattatctggtggttggaaaatgaaattagaattggccagagccatgttgatgaaagctgatgttttattattggatgaacctacaaatcatttggatgttgctaatgtcaaatggttacaagattatttagtggagaatactgaaatcacttcattaattgtttctcatgattctggatttttggatgctgtttgtactgatattattcattatgaaaacaaaaagttggcttattataaaggtaatttatctgaatttgttaaaatcaaacctgaaggtaaatcttattatacattaactgattcaaatgttaaaatggcattcccaccaccagggattttgacaggtgtcaaatcaaacactaaagctgttgcacgtatgtccaatgttacatttgcttatccaggtgccgataaaccatctttaaagaatgtttcatgttcattatcattatcatcaagagttgctatcttgggtccaaatggtgctggtaaatctactttgattaaattattaactgcagaattagtaccacaagaaagtaaagttgagaaacatccaaatttaagaattggttacattgctcaacatgcattacaacatgttgaacaacacaaggagaaaactgctaatcaatatttacaatggcgttatagatttggtgatgatcgtgaagttttattgaaagaaagtagaaaagtttctgatgaagaacaagaaatgatgaaaaaagaaattgatattggtgatggtagaggtaaacgtgccattgaagcattagttggtagacaaaaattgaaaaaatcattccaatatgaagtgaaatggaaatattggttacctaaatataattcttgggtaccaaaagaagttttacttgaacatggatttgataaattgattcaaaaattcgatgatcatgaagcttcaagagaagggttaggatatagagaattaactccatcagtgattcgtaaacattttgaagatgttggattggatggagatattgctgatcataccccaatgggatcattatctggtggtcaattagtcaaagtggttattgctggtgctatgtggaataatcctcatttattggtgttggatgaaccaacgaattatcttgatcgtgattcattaggtggattagctatggcaattagagaatggaatggtggggtagttatgatctcacataataatgagtttgttggagcattatgtcccgaacaatggcatgtggaaaatggtgaagtgattcaaaagggaaccgttgctgttgatgctaaaagatttgaagatcaaggtggtgatgaagcatcttcttctaaagaaggtacacctgtgccagaaccagttaaaaagagagctgatgatgatgattctcctgctaatattaaagtaagaacaagaaagaagaaaatgaccagaaatgaaaagaaagctcaagcagaaagaagaagattaagatatattgaatggttaagttcacctaaaggtacaccaaaaccagtagatactgatgatgaagaagattag

SEQ ID NO: 5774 - DNA, 585 bp, Candida albicans
ttagtgattaacttggctgatccaaaatccaaattgttgggtaaaaacgctgttgaatattctcaaattttgagatggctttcattagctaacactgaattgttgccaactgaagctagagttttccaaccattgaatggaattattccatacaacaagaaacaagttgatgacaattctgcttacttagctaaagtcgttgacatttttgaaaaaagattagctgatttcacttatttagtaggtgcacgtcttacttttgctgatatttttgctgctactcttttcgttagaggatttgatttcttgttcggtaaagaatggagaaaacaacacccaaacaccaccagatggttcaagaccattattgctactccaattttggctgaattccttggtgattacagtttcattgaaaaaccaatcgaatacgttccaccaaagaaggaaaagaagaaggacgctgctccaaagaaagatgctgctgctgctccaaagaagaaggaagctgctgctccagctgcttcagaagaaccagccccagctccaaaaccaagactcttcaccacgcgctggcaggaccaa

SEQ ID NO: 5775 - DNA, 234 bp, Candida albicans
aacattttcataatgtcacaaggtactttatatgttactcaacaaattagaagtttagcaccaaaagctttggtcaaacacttcaaattagatatcaaactttctgataaggatgaagctttcaacaaagctttcccattgaacaaaattcctgcttttattggaccaaaaggtttcaaattgactgaagtcattgccgtttgtctttattgtatgtataatttatcacgttaa

SEQ ID NO: 5776 - DNA, 1170 bp, Candida albicans
aattggagggtaaaattaattggaatatttattcaggaatttccattaggtaaaattccagctttggttggtgttaaagtttcccaattaactgaaacaattggtattcccattatttttttatcattaattccaaatcaagaattattaggtaaaaacaatcaagaatatgctaatattattaaatatgtttctttattgaatcaagaaggtgttatttcttgggctgcagcttatttcagattaaatggtagattcccatataataaaaaagaagttgatgaaaatttgaaaatttttaacactattggtgaaattttagaaaaaagattacatgatttcacttatttagttggtgaaagaatttcttatgctgatttatttgctgttaaagttgttattggtgctgttgctactgtttttggtaaaccatttttaactaaatatccaagtattgctagatgggttaaaactgtttcccaaaatgaaattttccaaggtcaatttaaagatcttaaattcccagaacaacaattagcttttgttccaccaaagaaagaaaaaaagaaagatgctactccaaaagctgaatctgctgctccaaagaaaaaggaaactccagctgctgctgctgctgctgctacttctgcttctgaagaaccagctgctgctccaaaaccaaaacatccattggaagctttaggtaaaccaaagaatccattagatgaatggaagagaacttattctaatgaagaaactagagaagttgccattccatggttttggaaaaatcaatatgatccagaagaatggtcattatggaaagttgattataaatataatgatgaattgactttaactttcatgtccaacaatttagttggtggtttctttaacagattatctgcttctactaaatatatgtttggttgtatggttgtttatggtgaaaacaacaataatggtatcactggtgctttcttggttagaggtcaagattatgttccagcttttgatgttgctccagattgggaatcttatgaatttactaaattggatggatctaatgaagatgataaaaaattcattaacaatatgtttgcttgggatgaaccagttgttgttaatggtgaaaagagagaaatcgctgatggtaaagtcttcaaataa

SEQ ID NO: 5777 - DNA, 1089 bp, Candida albicans
cgattattcataatgtcatttattaacatttgtcgtgataacacggatcctttctaccgttataaaatgcctccacttcaatcaaaaactgaaggtagaggtaatggtattaaaactgctattgtcaatttagctgaagttgctcgagctttaaatcgtccaccagcttatttagtcaagtttttcggttatgaattaggtgctcaaacccaaattttaaatgatagatatttagttaatggagcacatgattcaaatgaattacaagattcattagatggttttattaataaatttgttttatgtggatcttgtaaaaacccggaaacagaaattgttttaaaagggaaagattcattagaaagagattgtaaagcatgtggtaaaatttctatgattgatccaaaacataaattatattcatttattgttaaaaatccacccgataataaaaagggtaaaaaatccgctactgcaactgctaatgttgttggtggtggtaaatccatttccgatattgcttctggtcataatggtcaaggaggtgaacctggaaataataataataatggtggtggtgccaatggtgaaaatggtgaaaatggtgaaggttatgatgaagatgatgaagatgatgatttattagctaaaaaaattaatgctgaagtggcacaattaaaagccatggaaattaaagatgatgaatgggctgttgatatgtcacaagaagcaattgctgctatagcaagagaattagaaggtttatcattacaaaataataaatttgatgaatttggtgaatggttattaaaagaatctaatggatcaaaagatgatttaccttctgatgtcgaaatatataaacgtattgttgaattagaaattgctgatactccagaaactttacaagttttaggtcaagtattatttgatgatgatataataaatcaaattgaacctcatgtcggtttattaactaaattaattaatggtgatgaagaatttgaaaaagctttattacgtggtctggaaaaatttttggtttacaaaaaccaattaatcccaaaacgacatcgaacatatatcctt

SEQ ID NO: 5778 - DNA, 756 bp, Candida albicans
tgtgattcttgtaaacatccggaaacagaaattgttttaaaagggaaagattcattagaaagagattgtaaagcatgtggtaaaatttctatgattgatccaaaacataaattatattcatttattgttaaaaatccacccgataataaaaagggtaaaaaatccgctactgcaactgctaatgttgttggtggtggtaaatccatttccgatattgcttctggtcataatggtcaaggaggtgaacctggaaataataataataataataataatggtggtggtgccaatggtgaaaatggtgaaaatggtgaaggttatgaagatgatgatgaagatgatgatttattagctaaaaaaattaatgctgaagtggcacaattaaaagccatggaaattaaagatgatgaatgggctgttgatatgtcacaagaagcaattgctgctagagcaagagaattagaaggtttatcattacaaaataataaatttgatgaatttggtgaatggttattaaaagaatctaatggatcaaaagatgatttaccttctgatgtcgaaatatataaacgtattgttgaattagaaattgctgatactccagaaactttacaagttttaggtcaagtattatttgatgatgatataataaatcaaattgaacctcatgttggtttattaactaaattaattaatggtgatgaagaatttgaaaaagctttattaggtggtttggaaagattttttggtttataa

SEQ ID NO: 5779 - DNA, 948 bp, Candida albicans
ctccccgcgatggcctgccgccgttgtgaagactcgaatttaccatgggaagttgaagaaagtaacgttattagacattttgaagatagaatgcaagccaaagatattatttccgatattgttttaccaaaagatagagacactggtagattaagaggatttgcctttgttacattcaatgatcgtgctttattagaagaatccttgaatttatccatgactgaattccaaggaagaaaaatttacgttaatgtggctgctccaccaaagggtgaagatggtgattggagagctggtagatctggaagcaatagaagaggtggtgaagatcgtgaaccagctccagaattggattggggtgctgccagaaattctcaagctgaattaccaccaagacaaagatcaaacagattaggtagtggtagtggtccatcaggcgaatcatcatcatcatctagaccatcaagaagacaagaagttgaattggattggggttccgctagaaattcaagagatggattaccaccacaaagagaaagatcaaatagaacaccaagaaaacaagaaccagaatttgattggaatactgctagaaacactcaagctgaattacctgttagagaaagagaaagaccacaaagagaaaaccctgatggaactccaagagaaaactctactagacaaacaccaagaaagcaagaaccagaatttgattggggtgctgccagaaacactaaaaccagtttaccaccaagagaaagacttaatagaactggttccaacagtggtaaaaaatcaactgaacctgatttcgattggaaaagaggccaaagtttaccatcacgtaatgtttcaagatcaagtggtaacagaaaagatgttataaaagatgaacaacaaaatcaaccaccaaaaccacatattcacccggacgtgccgatccagcta

SEQ ID NO: 5780 - DNA, 867 bp, Candida albicans
acaatgtcgaacgttggactacaagtcagacaagcggtcccttctattgaccctatagttgctgaatatgctgttgggtatattcagcatgtttctaattccacagaagacagtgttttggcacaacaagtggacatcccccaagaaatggaattcattaacgacttgttagttcaagcaggtggttctttagagaaggtcgaagcattaactcagggtttaaagaaacagttatcagataaattgaatgaaaatatggaaaagttagcacttactggtgacacgtccaagcgattgttggatataaatgttttacaaaacaataccaaaagagatatcaattcatcgttggctttattgaacagtggaaatgatattgcccacactggtagacagatggaaagtacagttgataagaagaaattggaaaaacaagaaagaaagattgcgaagaaagttgctaaacgaaacaacaaatttgtcaaatatgaagcttccaagttattaaacgagaagaaagaagaagactacgattcatttttcttggaaattaaccccatggaatttggttctagtgctggtaagtctaaggatatcaagattgatacttttgatctttatgtcggtgatggtcaaagaatcttgagcgaggcgtcattgacattggcttatggtcgaagatacggtttggttggtcagaatggtattggtaaatctacattattacgtgccttgtcgaggagagagttaaacattcctaaacatatttcaattttacacgtcgagcaagaaattataggtgacgatacaccagctttacaaagtgtgttggatgcacatgtttggataaagagtttgttacaataa

SEQ ID NO: 5781 - DNA, 1026 bp, Candida albicans
tcgcttgaagttaaaaaactatataacgaaagatacgatttggaatcgcatttacaagaagttagcgacaaactttatgaaatggaatcacataaagcagaaagtatagcagcacgaatcttgtatggtttgggtttcacaaaggaaactcaacatacaccaacgaaacagttttcaggggggtggagaatgagattatcactagccagggcattgttttgtcaaccagatttattgttattggatgaaccgtcgaatatgttggatgttccttccattacctttttagcaaagtatttgcaaacattcaagtcaacagtgttggttgtgtcgcatgatcgtgcattccttaatgaagttgctacagatataatccatcaacactcggaaagattagactactatcgtgggtccaactttgactctttctatgcaactcgtgaggaaagaatcaagaaccaacgtcgtgaatacgaaagtcagttggcctacagaaaacatttacaagagtttattgataaattcagatataatgctgctagagctcaagaagcacagtctcgtatcaagaagttggaaaaattgccagtgttggagccaccagaagatgagaaaactgtcacttttaaatttgctgaacccgatagcatatctgcgccaatcttgcaattgcaagatgtcagttttggttacgatacaaacaaaatgttattcaaggatgtaaacttggacgttcaaatggactcaagaatagccttctgtggtggtaatggtactggtaaaactacattgttgaaacttgtcatggaccaactctcaccaacaagtggatatgtcaataaaaacggtagattaagaattggttatttcgcacaacatcacgttgatgctatggatcttacgctctcggccgtttcttggatgtcacaagctttccctggtaaaacagatgaagaatatagacgtcatctaggtcttttgtcatcagtcttcaccacggaggctgccgcatccgcgcttatctat

SEQ ID NO: 5782 - DNA, 897 bp, Candida albicans
ggtacagttgttaaagatgagattgtgccagatttgttaaagagattgaaagagccaaatgcattgcttgcattgaaagatattatgctgaacaaatccgatgttattttccctattttgttgccaacattgcttacctcaccggtcgatactgaagcgttggcggctttggcaccagtagcagggtctgctctatacaagaggttggcggtgattatcaataccttggtaaatgccgaaagtgaggctatcgacgaagtcatgttgtcggtagaggatgatggagttcacacgttgatgcaaattattatgggtcttctcaaggatgaagatactaagagaagggtatttatattctcgagattagctggattttttgcaaataccgagctcgactattcgatgtatctcgaggatatggttacacgattgatactttcgttggcagatccgtcacccgatgttgttaaaggtgcatttgaggcgttgtcggctttggtcaagagacaaccaaaagaggttttggagaagttggttaaacctgctaagcaaacattggacttgtgtattgacatccctgcatttagcttgccgaaaggtccaaactgtattttgccaattttcttgcatgggttgatgtatggtaatcataaggaagaggcggcattgggtattgctgatattattgacaagactccagcagagaatttgcgcccattctctacctcaattactggtccgttgattagagttattggagaaaaggtagcaagtgatatcaaagcggctattcttgtggctctcaacaatctattgttgaagattccgcaatttcttcgtccatttattcctcagttgcaaagaacatttgttaggtcgttgtccggacagcaatga

SEQ ID NO: 5783 - DNA, 1338 bp, Candida albicans
ttgatacagaaagaagaaaaagaaagggaaaaagaaaaagaaaaagtgaaaaaaaaaaatgttgaaaaatttttcgtttcaagtagagagaaaaaaaattttcttattcgtgtgagagaacctacccactctttttcctctatagacatgacggatagttgggagacattagagcctgtttacgaaaaaggcatactggattcgttggtttcagttagaatcccaattttatcatctattaaatcagtactatctgagatccccgagcaagaattgaacaagatcgtagtggctttgttaaagacatttaattattaccacgatgcccaatctagaaatacagtattgagtgttgtacaagctattggtggccacaacccaaattattttcaagtgtatattcgttttatcaagcagcaagttgatggacctaccttgccaattactgattatatgactcttttgcaatggatcaatgcgttcgttgttgctttggctagacttggcaaattggacgattcagtggcattggctcaaggaaagttgttaagcaagtgtattacatttgaaggtaaacgaaggaggatttataaatcggcaattcaaactacaaaaactgccatcagtgatgccgtggccattgattcgggttatttggatatcattgtgaaaaacaaatcgtttgcattattgggggtgttagacctggcgctagacaagcatccgggattgtttgaagtttataaagagaaatatgcacccgaaattttggacttttttgtaaaccagggtttgttaagtaaagtaccacctccaactcaagatttagcagtatttggcagttgtatcaagagtttggtcatagacttttctgggctagtccctcacattgaaaaggcaatattaaggtcgtcagagaattcgtttgtgtatacccttccggttttgtttgaaaacttgtcgattgacatagaattgagtgccaaattggtcaatgcaattatctcaggcatcaagtctaccaaggagcatgtgaggactggtgctgccaagactttggaattgactttacagaagaatactgctgatttagttgatgagattttcagggccattaaagccacctcaaacgccgaagctaaggcattgattatcaagtctttgttacatttacacgattcagaaaagattgttaaacagttgttgccgttagtgtcgaaagaccaaaacgaaacatcattggctagttcagttagggttttcacatatcattccttaaagtatcacaatgacgaagttgtcaaacagtttaatacaggtttcaattcacctaagttg

SEQ ID NO: 5784 - DNA, 3177 bp, Candida albicans
tacgcaattgcggatcctttcagccccgtggtggaacatgacaggcaaagatctccattgcttaatgattcaagaatattcagtaaacttgacgaagttgaattgaaatggttggttcgtgcattaaagaatgatcctgctggttggatatatgtgttgaccaacgctccatacaaaataagattatttgcattggagaaggtagtgttaaatgatgaactaagcgaaggattgatcaaggagttgttgaatggggatttggcacatgttggtcccgtttttgcattgcttagtcgctacaccaaaaattttacaagcctaattcttcctgcaagtaaggcaggggttgattggattgcattagcacaaaaatccaagatagatcttgggaaattagttggtgaaaactttggtgctattttcaacgaatgtgtcaatgatggatcacctgctgctataaaggcgattgccgatattgcatttatccaaccagatcttattgaaccgatcgtttcgcttattgatttggatgtgtcaaaacttaactttagccagcaagagattgacatttaccagggtcaagaaggtgaattggtggtcaatgtacttaatgaaaagcaacttgataagaactcgaaagactatgaaatcaagaaatgggaacaatccatcaaaaaggaattgaaacaacctaaaaagttgtcgaaagaagaacaagctttggttaataaacaactagccaaagagagtgagatcaggacgagagttggcgaggttgttaaacgtactaattttgtaatcagtttgattatccaattgacaaaacaagctagactcgttaataatggtgctaacttatggttccctgttgctgtaaacaaattacttgccttgccccaatcacctttatttaacccgattgatgcgttccttgaattgtcactgttaatttcacctagacttggggttttgtgcaagttcattggtgtagccacactcaggtcatatggattgaaattggatgaaagtttagagcaagaaccattagtttcgcttttgggaagaattttatacagaatcaagatgcttagtgaccaacaaccgcttgactcgttgagtttgtcgtatgtgttgccgttgttgacacgagtattgtatgacgggaaggcagtggcaataaagaatgcttcgaaagtggccgtcacatctgaatttgttgaagaagacccagaggaggagcaattgttgttggctattgagattatttccgcccatgccgaatcatttgaagacgacaagattcctcgtactagtattttggaagtcttgatttcgttaatgaaattgccatctaaagccaagttgtcaaaggaatgctttttgtcattgtgtcaacacattgcttttaatatttgtgagggtgacttgcaattgttgttgggtagtttgattacaccacatgtatttgtcagatcgaccttgttggaagggttggatgctgagtttgagttggaaaagtattcgaaagagttatttgtggtcgcccacgataacgaccagaactgtcgtgaaattgctcaaactatctgggatgataacgaattgaaagtggaggatgcatctaatttgcttagtttgtttggcaatagtgatgctgggttgcggaactcgatagctcatgcgtatgttgatgcatgccagcaaacttcattaaacatccaagaattgtttgcattgtatgaagaaaagaaggacccaccagcaccaaaactagaccagtttgggttggtgatcaagtctactatcgataatcgtgatcgatgggaagaacggtcaacagtggcaattgcgttaaaattgttggctccattgtatacagaagcacatgtcaagcaattgtttgagtttcttgttgagacttgtgataaggacgagttggtcgcccaggaattgcaggatgctggtgttgaggcaatcaagttacatggtgcttccaatgttgaggttttgatacctatttttgaaaacagtttggccaagacaagtaaagaatcggtagtggtgttgtacggtacgttggcacgtgatttagacaagaacgatccaagattgaagatcatcattgacaggcttatgaagagtttggacacgcctgccgtgcaatatgccgtttctgaatgtattgctcctttggttgttgctatggacaatttgccacaagtgtttgacgagttgtttgagaaattgtttactgctaaaaaagtgtcatcgcgtcgaggtgcagcatatggtatcgctgggttggttaaaggtagcggtataaaatcgttgagttcatacgatattattcgaaacttgacagatgctgctgaagaaaaagatgcgatcaagcgtgagagtgtatctgttgcgtttgaaacgttgtccagaagtttgggtaaatactttgagccgtacgtcttggaaatattgcccattattcttaaatcgcttggtgatccaataccagaagtgagattggctactgataatgccgttaaggaaattatgaaaaacacaacctcgtttggtgttaagaagcttatcccattggccatttccaatcttgatgaaattgcctggagatcgaaaaaggggtcagttgagttgctcgggtcaatggcgtatttggaccccacgcagttgtcggcatcgttgtcaatcattatcccacaaattgttggtgtgcttaatgatacccacaaggaagttagaaaagctgcttctgcggcattgcagagatttggtgaggttatccgtaatccagaaatccaggccattgtgcccgaccttatcaatgctattggtgacccaaccaagtatactgatgaggcattagacaaattgatcaagacccagtttgtccattacattgatggtccatcgttggcgttgattatccatgttatttatagaggtatgaaagatcgagcatccacgaaaaagaaagcatgtcaaattgttggtaatatggctattttggttgactcaaaggacttgcgtccatacttgaatgagttagttggcgagttggagattgctatggttgatccagttcctgccaccagatcaacggctgctagagcattggggtcgttggttgatcttcacccacggggctggaaggacccgcgctca

SEQ ID NO: 5785 - DNA, 363 bp, Candida albicans
aaacgtgccaattccgacaatgcttatatgagtgacaacgccactatcgctattggtaaattgttattgcttggtgttgagagtaaggagttggttgaccagcttgcattgaatgctgttgcacccaaatcatcgtctcccgataccagacgtttatcgttggtggttcttagaactgtaaccatacacaaaggaattaccgatttggatactgttgtgcctaacatttttgcatgtgttcgagaccccatcattcctatcaagttggcggcagaaaaggcgtaccttgaagtgtatgatatggtgaatggcagtgccaagtttgatgggtggtctaagaatgagaatttgagctaccacggc

SEQ ID NO: 5786 - DNA, 900 bp, Candida albicans
accaaaatgtcattttttcagtacaagaattacatagaggagggtgatctagtgcttgcatatatcagtagatctacaatcaagccaataaatgttaagaaaggtgaaatttttaataccagatatggtcattttgagcatgataaaatgattgggatgaagtatggagaacaaatgcctggggccaaaggatacggatttattcacttattgcatccaacaccagaattatggacattatcattacctcatagaacccagatagtgtattcacccgactcatcatacattatacagcgtttgaatgtgaagccaggatcccgagtgattgaagcaggaactggttctgcatctttcactcactcatttgcaagaaccgttacattactgggcaaagtattcacatatgagttccacgagccaagatacttagaggcaaaaaaggaattagaagaacataaattggacaacaccaccatcactcatcgtgacgtatgtaacgatggtttcagcattgataatgaatctattgaaggggatgttgtatttttagacttgccatcaccatgggatgccatacctcatcttgattcagtgatctctacaagcaaagcagctggaatatgttgtttctccccctgtatagaacaagtggatagaactgtacgtgcattagaggaaaatggttggactgagattgaaatagttgaagtggcggctaaacgttggagtgcaagaaaagaaatggttaggtcagtagctgatgcagtacaaagaattagagaaattcaaaatggacgcaagacaggattggaagtaatgaaaaagggaccttccgaagagccaccaccaaagttgcaaaagaccgatttttgcccaaggagtcgaaaatcccgctca

SEQ ID NO: 5787 - DNA, 549 bp, Candida albicans
tttaatttattagaatcgataaatatggaattacaagttatacaacatcgtcctacaaatgatgatatcaattcttattcgtctacatcttccaacagattagaaacccaagattcaagatcgataaacaagagtaaaaaaaatggtggtggtggtgatggtggtgacgacgacgacgacgatgattatggatttacgacaaaattagaatcaataccaaaaatatcatatcaagtttctgatttaataaataaacaagggaagattttacaaccatttacaatcacttctcaacgacaaaaattaaaggaaaaagtatttggtacgggtcaaatactaccttctatgacagtcgaagaatatttggattatgaattagctaatgggaaaatgttaaaagatgaagttaaagataataatccagcaaataaagatgataatgatagtgatactgaagattctgaagctgaagaagaaaaaagacgatgggatgattggaaagatgaaaatcctaaaggtgctggtaatatgaaagctaatattggttaa

SEQ ID NO: 5788 - DNA, 981 bp, Candida albicans
  unsure (14): Identity of nucleotide sequences at the above locations are unknown.
ggttacaggcaccntgaatatatttctcgtaacaacaccattatatttttgaagaatttgttggctgtttaccccactgttgatgatcatggtgctcaaattgttaatttgattgaaaagttatctacaacagaaaagagaaacgatttgaagttagcttcgaatgcattgttggttcatgtcaaatcgaaatccaagaattgggttcctatttgggactttatttcaatgagtgaagaagagaaggaagaaataattaaagcaaaggaggaagaaaaacaaagaattattaaagaagaggcagaagccaaaagacagaaggaattggagttggagaaggaaaaacaaatgaaattagccaaagaagaagaagaaaagaaaaaactattagctgctgcatctttgaactatgactcactgactgccggtggtagtggtggtggtgctagaactcaaacaagaaccacacaaattggaagaacatatgaaaagtatgcaatagaaacaaaatcagaagcacattcaagacagacaactcctataccgacacaaccacggactttatcttctgttcccacgtcaccaagttcattgtccaaagagaacaagttacaggaaagagtgaataaaatgaaacaagcttataaagagtctcgattttcttcagacacggagaacaaagttttgaattctgagtctcttgatggtcacgaggcaactagtaatgaaaaagaagctaaacaagaagaaagcaatgaccaagaaaaattagattcagaagcaaaagagaaagccaaccctggtcagaataacgaagaaacccaactatctactgaaaaagaagacagcgccggtgataactcaacaaacacatcaaatttggcagcacaaaaagaatccgagcaaaaacgatcccccttacctccacagaatgaaattaaaaaatcaatttccctgggaagatttcaagggaccaactga

SEQ ID NO: 5789 - DNA, 1431 bp, Candida albicans
ttgaacaacatctacagtttcaactatcaagcacactctccaccaataaatttatcacccccaacaatgtctttattgtacattactgaagaggtggttgagaacttttctggtagtggaatggatctgctatttgaagtgttggaatcctaccaagaaaatgatgcagaatccgaggagatacttgctcaaattttcacagagctattgataacatttgaggagaacaaattggatgtcaatgatatcaaaaagtttttcactcaggcaattaaatcggacgatcaggcaagaatttttttccaagtactcaattcgtttgctgtatcgaaaaatattcacgatttgttgcatttacttttccgagacaataaaatcaaaatagaaacattagctttacacctcagctcagattttttaaaatcagtggaaattgttccaaaagactatttccagagaactttaagtcacaagatcagagatgaatatttcacgcagaaaaagttcaacttacttcatgaagaagtggaagggtattcgaagtttacgtcggaaatgcattctattttagatagcagcgatgctgaatttcaacttgattatgctattcaggttatggaaaaattgattggtcattatgaccttgatcccaacagatgtttgagtttgttatttcaagtcttcaccggaaccatagtgcctcattaccgtttcatattaaatgtcttaaagaagagtaggtggtggccaaatgttgaaagtgataattcctcattgttaagccttgggaatggaggaagcgaaacagcagccaaagtgattggcctagagcttgtgggtgagtgtggtacaagagatttacctgaaacatacaagtgtcttgtggccattcttattaaagaaggattgataagctttggatcattgtacaaatttatgggccctgatgaatcggaaatggacgaacttgaggccgaatacaaaaagaagttagatcgtgatgtattagttgctggggctactgcccttgctctcgctgcaccattagctgatgaagaggatgaagaaggagaaaaaggtgaaagcaagacgaaaaacaaaaccagtcaagcttcaacagagaaagatttatctagcttattaaaactgaacatgaagttccaatttcttaaagtatttttgggtgttggactttactggccagcgatattcattttgacgaaatatccatacttggctcaaattgacgaagaaataccgatcttaatcaacagattatttgcaactatgattgatccattatacaacaaaataagaattttcagtgacgaagagataagtaatcttcaaaaacctaaaggaataacatttagtcgtccccataatacatttttgtcgatcttcaccacgacgtggaaggaccgcattggt

SEQ ID NO: 5790 - DNA, 555 bp, Candida albicans
aaaaagcaattttttatttgctcgcaactcccaaaaaaaaaaaatttctctgtttctttttcatcaacgatgtttctgttcaagggttttgggtcggcaattaggccacttcgatttgttaatcatgggatgttccggtttcagtctacacgtgctgcgaaaccacagggaataaaagccctaatgaaagaatatgggtatccggcacttgcgggtaacttgggtctctctggtattgatttgccaatatgtgatgttttggttcattctatgggaccagaaaagatcgaggtgtttgaaaataaagtgaaacaaacgtttgggtacggtatttctgatgaaaaattgaagaagaacccagagattaacaagatccagcaagactttgagtcgccgggccaaacaaccccggaaaattctgggtcgatggtcagctaccttattgaacccattttcatggaaggatttggcccttggcgtttggggattcataaatccgtaaattttccattaggttgccaatcactggctggccattacgcccgggaatattga

SEQ ID NO: 5791 - DNA, 465 bp, Candida albicans
aaaatcatgttttacaagaaaggtccttattatctatccaccaaatattccaatctagtacttttcaaatccaatgattcactaatgaacctacaagggttgccaatttcgaaacattttggtaaacatgatcaaggcaaatctgctttggtggttcttcatgatgaattacaggttgatttaggtaaatatcagatccgtaaacctggtacaagctcaagaggacataatggattgaagtccattgataagtatctcaagaatagatattttaagcttggaataggtattggtcgcccgccagcgtcacaatcagtggtgcactatgtcttgaaaaagtttctgctgcaagagttggatgtgattgattgggaagtgttaccaaaatgcgtaaaagatttagagaatatggttataaaagatttagaactacaaagtggtaaggagaagataaacggcatatga

SEQ ID NO: 5792 - DNA, 621 bp, Candida albicans
tcatcaaacggtttcttcccgtcaactcaattccctttatcttgctcaagaagatatttatttatgccctctataggaaatcctgagccgcaatacgctaataccagacataatgctggacatagattgatgaaccaattgattgatgtatactggaaagatcatgtttacaagaaaggtccttattatctatccaccaaatattccaatctagtacttttcaaatccaatgattcactaatgaacctacaagggttgccaatttcgaaacattttggtaaacatgatcaaggcaaatctgctttggtggttcttcatgatgaattacaggttgatttaggtaaatatcagatccgtaaacctggtacaagctcaagaggacataatggattgaagtccattgataagtatctcaagaatagatattttaagcttggaataggtattggtcgcccgccagcgtcacaatcagtagtgcactatgtcttgaaaaactttctgctgcaagagttggatgtgattgattgggaagtattaccaaaatgcgtaaaagatttagagaatatggttataaaagatttagaactacaaagtggtaaggagaagataaacggcatatga

SEQ ID NO: 5793 - DNA, 1119 bp, Candida albicans
aatcaccgaattatatcacataaatccatgacaagtacacctcaagaatcctctaatttaaagagacaattagaaaacagtgaggactccagctcaccaaataagaaatctaaaacagagactaccacggaaaaccagagctcatgggagtctgactttaatagtttaccagtggaattactacaaactgaaacaaatggtacatcatcagcaccagcaccagcaacaccgatcgataccaccaatgcatcaagcacaaaggaacgtgatcaggatacttctaaattaaatgacgcgattgctgctgctggagttgatattcaacaagaagaagagatattattacaacaacaattaaatagaaaatctgcagagggtatggcaagcaatctaaagagtgtgatcaggtccagcaaactgcatccatttgtacacaattaccatttagctgcctttattgataaagtggctaaacaaaatggaattcaacagaatttcttaatggatggtgagatgttggaattaatttcagctgcttgtgagacttggttaagtaatctagcaacaaaaacgataatcttgtcacgccacaggagaaggggaatacctgttattaataagaagtcaggaagtagttcagttccaagatcagaaatttcaaaagaattgagaagcttggccttaaaacaaaaggaaatggaagagaaacgagtgaataaaagagtgatgttggggttggaaaaaagcaccaaagacgcatccaaaaatgacgaaaatggtgaatcaaaagctggtgctgaagaaacattacatcgtgcagcaaatgctacagctgcaatgatgactatgaatcccgggagaaagaaatatagttggatgacttcaagtgctacagcaggcggtgggtcagactttggtaaatcaagtggtggatcatcaaaggactcgggaaaacaccaaagtcctattatttcagtacgtggtgataatggccttaggtttagagaaataaggtcaggtaattccattattatgaaagatttgttaggcgcaattgaagatgaaaaaatgggtacgagaaatgctgtaataaaaggatatgcaaaattgaaagattaa

SEQ ID NO: 5794 - DNA, 1650 bp, Candida albicans
ccaaagaacactgttatcgatgctaagcgtttgattggtagagctatcgacgatgaatctgtccaaaaagatatcagttcatggccattcaaagttgttgaatccaacggtcaaccattgattgaagttgaatacttggacgaaaccaatactttctccccacaagagatttcctccatggtcttgaccgagatgaaggaaattgctgaagccaagatcggtaaaaaagttgaaaaagctgttgtcactgttccagcttatttcaatgatgctcaaagacaagccaccaaagatgctggtgccattgccggtttaaacgttttgagaatcattaacgaaccaactgctgccgccattgcttacggtttaggtgccggtaaatctgaaaaagaaagacacgtcttgatcttcgatttgggtggtggtactttcgatgtttccttattgaacattactggtggtgttttcactgttaaagccactgctggtgacactcacttgggtggtcaagatttcgataccaacttgttggaacacttcaagaaggaattccaaaagaagaccggtaacgatatttctggcgatgctagagctttaagaagattgagaactgcttgtgaaagagctaagagatctttgtcttctggtacccaaaccactgttgaaatcgactccttgtttgatggtgaagatttctctgccaacattaccagagccagattcgaagacatcaactctgctttgttcaaatctactttagaaccagttgaacaagttttgaaagatgctaaaatcagcaaatcccaagttgacgaagttgtcttggttggtggttccaccagaattccaaaagtccaaaaattgttgtctgacttctttgacggtaaacaattggaaaaatctattaacccagatgaagctgttgcttacggtgctgctgttcaaggtgctatcttgaccggtcaatccactaacgatgacaccaaagacttgttattgttggatgtcattccattgtctctcggtgttgctatgcaaggtaacgtttttgctccagttgtcccaagaaacaccactgttccaaccatcaagagaagaactttcaccactgttgctgaccaccaaaccactgttcaattcccagtttaccaaggtgaacgtgtcaactgtactgaaaacaccttgttgggtgaatttgacttgaaaaacatcccaccaatgcaagccggtgaaccagttttggaagccatttttgaagttgatgctaacggtatcttgaaggtcactgctgttgaaaaatccactggtagatctgctaacatcaccatctccaactccattggtagattgtcaactgaagaaatcgaaaaaatgatctctgatgctgaaaaattcaaatcatccgatgatgctttcgccaagagacacgaacaaaaacaaaaattagaagcttacgttgcttccgttgaatctactgtcactgacccagtcttgtctgctaaattgaagaaatctgccaaggacaagatcgaagctgctttgtctgatgctttgcaaactttggaaattgaagaatcttctgctgacgactacagaaaagctgaattagctttgaagagagctgtcaccaaaggtatggctacccgttaa

SEQ ID NO: 5795 - DNA, 543 bp, Candida albicans
acagtattatataaacaacattttattcagcaaataattacaatgggtcaagcttttagttttggtaatattttttcaaagctctggggaactaataaggagataaggattcttatattgggtctagatggtgctggtaaaacaacaatattgtatcgtttgcaaatgggagaagtggtcactactaaacctacaattggattcaatgtggagacattaaaatacaagaacattacgttaaacatatgggatttgggtggacaaacttccattagaccttactggagatgttactacagcaatacatcagcagttatctttgttgtcgattcaacagataaagatcgtatcgacactgcctgcaaggaattacatcaaatgttgaaagaagaagagttacaagatagtgcattattagtgtttgcaaacaaacaagatcaacctggagctatgactgctgccgaagtgagccaagctttaagtctaactgatttgaaagacagaagttggagtattgttgcttcgagtgccattaaaggttga

SEQ ID NO: 5796 - DNA, 720 bp, Candida albicans
cctgtgaatatgatggcatataaggatattgttccaattggaacttcattgatcattggatctacttgttttggtttaggaattatctacggtaattggccatatgatcttaacactttatggattcatgatatccctgaagcattcgatgcctctttacgtcattatcaacaatgggggaactctccaatgtatgttcattatacattacacgctgttggattattaggtttaattggacatttcatcaaattatacaaacccgatgaggatgctaaatatttcgagtatggtagtttaggtttatttatggttggtgtggttatttatttgactaatttaagaaccggtgtcaattcatgtcttgttggacaatggggtgatgttgattaccaaaccgggatcaatgtcatggctgcttctcaagtgatgatcatttttgttcttttgggtgtgttattattacaaggtggattgtattatgctcaatggtacgataacaaattgaaagaagaattctatcgtcaagaagccaaagaagctgctcttgctgcagaatcacaagctcaacaagaacatgatattgcaactaaggggaagaaagataaggctcaaccacaaggggaagtgattgaagaagtaacaggtgccactaccaccacaggtgctgcttctgctaccaagggacaaaagaagaccacaaagaaaagaaaatcgtaa

SEQ ID NO: 5797 - DNA, 801 bp, Candida albicans
cgaataaacaaaatttatattcatagatcaaaatcaataatgggagttattgaaatcgagtcagaacaacagttcactgaattaaccaaagccgatccatccaagttgattgcactttatttccatacaccatgggcaggaccttgtaaaaccatgaatcaagtattcaaaaccttagctgattccaaagaatcagataattcaataatctttttaagtataaatgctgatgagttaccggaaatcagtgaaatctttgaagttagtgcagttccttatttcatattgattcgtaatcaaaccatattgaaagaattatcaggagctgatcctaaagaatttattcaagcattaaaccaattttccaataacaccaacagcactactaccagtaataacgataacgtccaggcatcaattaacagcacaactgccaataccaatagtaataataccaccactaatgctcctgaagtggaggaatcagaggaagcattaaatgaacgattaaataaattaactaaagctgctccaatcatgttgtttatgaaaggttcaccatcttcaccacaatgtggattttctcgtcaattagtggcaattttaagagaacatcaagttagatttggatttttcgatattttaaaagatgattcagtaagacaaggtttaaaaaaattcagtgattggccaactttccctcaattatacattaatggtgaattccaaggtggattggatatcatcaaagaaagtattgaagatgatgagaaattcttcgaacatgctttagaagcttga

SEQ ID NO: 5798 - DNA, 2463 bp, Candida albicans
tgtgagaactaccaaaaaaaaaaaaaaaattgttttcaactggccaggttgttgacaatggatgatgtgggaagaatacgttatcagatctctcctgtgattgaaagtatacacctagaagatgagactatcacagatataaccacatacgagaacaacttatatgttggcacaagcaatggccaactattgcatttccaccgattcgacgacacaacagaatatatccccataactactatcaacgtggggactcactccgtatccaaaatcttatgcattgagtctattcagagactacttgtcatatcaaatcgtattgtcttgtcctatgtcttgccagaactttccccatgtcgaatgaaaaagatgaaggatgttactgatttacagaagttggacagtctggtgctcgttttgtcgccgacaaagatcagaatcataaacatacaagcggataccattacgttagcaaaagagataaattaccaaggaggagtggcgtgtcgatcgtgcaaagatagcaattttattgtggtcgccaacaacgagagttacgatattatagatttagacaataatagaaaagttcccttatttagctacaagtcagagtcaacagtccacccatggatcataccatttgacggagaatacttgttgtcagttctgtcagataccaacacgtccatggcaatgtttataaatagtgtgggagatgttacgcgtggaaccttgacatgggtggacaaagggtaccccgaaaactcaattgcccttgagggtgagtacgtttttgcattgtttaaaaacaagatgattgtttcgtcgttggtttcacttgacacagttttggaaatggaaaatccgggatacactatcacgaaagtgccaccggcaattgtcaatgacaagagcttggcaaatatcatagatactattcaacctacggccagtttgattttgactaatgggaaacaaatatttggtttacacaaagtacacaaattagtggaaatacagcaacagtttataaatgacagtctaacagaattaaaccccgcaagctatactggtaatgccagggattatatcacctaccttgcattggtccaagctgtaattaccaaaaatgatgacaagttttgggaatttgccaaccaggaaacaaatgagcagttggttgtttcaccacagtttgtgttctatatattgggtggaggtgaaaagcatctcccattccctggtctcaaagaaatatgccaacactacggaacgtataagaatgacaaattactcaaaaagtatatccagggcttgccggacaaatacttatcaactgatatcaaactttattactaccagaattgcacgaacgaggaaggcctcgcattcaccgaaagagttacttttgaagataacccccaacctatcattgacttactcatccatcaacacaggataaaatgtgcatcagaagtgtataagaaagttcctttactaatcgagtacaacacatttataaacaagcatttactggattcattggttgacgatgcagtagcgcttcttttatcaggaaaacttgacgaaaatgaatattcaaaaacattgattagcttgctaaaatttgatgataaaaggggaattggcgtacttaaaaatggcccttctaaatactacaatatcaaccaaactgtaatgaaagacctatcagaaaccacacaggacgaaaaagggtatttgcttctacgcatagagttgatggaaattacagaaaactcatcagaagaattgttacaacttatcgtacaagccatgaacctattatatgacagcctcaaggatgaatttacacttttgcatcaagaatttagacgcctcaattcattggagaacgagagatggccaaaactatcctggccaaactttcttgatataagtggaaaatccaaagagctactgacatttgttgagctttacttaaaatcgtttgaattggcacgtgaggcgcccgatggacccatctttgactaccacagaatgtttaacaaccacgacattgacgctttattggagtttggcgattattcaacagctgaatcaatagcaacaggaacaaatcccttcccgaaaaagaccttttatggaacaatggatttcacttcacaaccaagcaccaccggactcatacaaatcctcaatttttacttgacgcagtactcctctggcaagcaagtagaaaatacgattaaacactttgctgaggcttactatcatactatcgcaccatggcagtttctccaactaatcccaccagacttcccactagcgcatttagtcggctatttccatttagtcacgaccgatcaaacccaacaatacagagacgttttgattagaaagtctatttctagagccgaaaatctacgtacaaaaaaactcttagatgtatccaagtag

SEQ ID NO: 5799 - DNA, 579 bp, Candida albicans
tccgccatgacttccccaaaaagacgtattgaaaaagatgttatggaattgatgatgagtgatcatgacgttactttaatagacgattcaatccaacaattttttgttattttccatggaccaccagacactccctacgaaggaggcgtttggaaaattagagtggagttacctgatcaatatcctataaaatcgccttccattgggtttaccaacaaaatctatcatccaaacatagacgaaggatcaggttcggtttgtctcgatgtaataaatcaaacttggtctccaatgtttggtctattaaatattttcgaaaactttttgccccatctattgaggtacgctaacccaagtgatccattgaatacggaggcgtccaatttaatgacgaaggatgaggcaaagtataatgatactgttaaaaagtatgtgcaacaatatgccaagaacaattttgatattacaggcaaagatgacaatgaagataatgatgatgacgacgatgaattaagcgatgtaagaagtttatccagtgatgatgacaatgaagatgtatctggttcgatggaggtataa

SEQ ID NO: 5800 - DNA, 1395 bp, Candida albicans
ttagtttttccatacacacacacactcaattctatcaacacattcataaattttgatacttcttcgacttccgatccagtgatcttgatttctccacccatcttcataatgtcgaatttaagaaggtctgataattcaaatgaaaagtatggtattgtcattgattcaggctcgtctggttctagaattcaaatatacaaatggactgaccaaaaattcgaattgaaatcttccaaagatcaatctgtattgcaatcgccaccaaagattacacaagaaaaaggatggacaaagaaaattacacctgggatctctacatacaactcaaaagataaatttggtagaatttggcaagatcattattcggagttgttaaagttcgctgaaggtatcattccttctgaaaaacaaccagaaactcctgtatttgttttgagtactgctgggatgagattgttgccgaaaaagactcaaaaatcaatcgtaaaggagacctgtactggtatcaaacaaaacaccaacttttatatccctactgagaattgtgagaattttgttgaaataatcgatggatcaactgaaggtatatatgggtggctcggactaaattatttgatgaaacaattcaataattatgatagctcacaagacatcttgcatgaatctattggatttatggatatgggaggagcatccactcaaattgcatttgttccatcatctaaagaacaaatcaccaaacataaagaggacctttcgactgtcacattaagaaacattaatggggaaactcaaacatgggatttatttgttgccacatggttaggttttggtgcaaatcaggcacgtaaaaggtttcttaatcaattaattaatttggcaattgttaatggagagaactggaatagtgaaattaacgatccttgcttaccaaagggagcttcaatggaatataattacgaaaacaaaaaatatttggtgaaaggagtcgggaactatgaaatgtgtatcaagacaatatatcccttgttgatgaagaatatggtttgtattgatgagccgtgtcttttcaatggtattcatgggcccaagtttaattttgaaaaagacaagttcattggtatttctgaatattggtatactgccaatgatatttttcaaagtggtggtgagtacaatttcaaaacatttaacgcaaaggtgaaagaatactgtgaaagcaactgggatgagattctcaaaaattccgaacaaggtcaatactcaaaattagatcccgataaattccttaaagatgcatgtttcaaagcaagttgggtcatgaatgttttgcatgaagggtttgagttacctataatcggttttgaaacagaaaatgaagatcatactgaataa

SEQ ID NO: 5801 - DNA, 801 bp, Candida albicans
gacaaaaaaataactaatgctcacgttccgtttaaatctgctgattcagtggaaggagaagagttatcgtggacgctaggtaaaatacttttatttgcatcatcacaaattgaaccaaaagaaggagataccgaggctaagcaaattggtatatatccgagtcaaatctctggacataaatttgtaccgggtggtgtcttgttatctagtgatggtgattattcgactgacgatgaagatgatgatttgggtggtcaatttagtcatatactatactcgttaatttttgttttgttgttgttattctttttgtttcattttgggaaatctcattttggaagatggacaaataagtttagaagatttcaaataccggttgaagtcaaaagagcggttaattcaattgggtctaaaattcctggagttaggcattattttgaaaatattgtcatgtttctggaccttcaagatcaaaatataattttagaagaaggaatatttgataacacatcgtctaataataccaattttaaaagcttacagaatcaacaacagcctgcgtctgcatctgtgttaagaacaagactggcaataggattaaacgaagattctgggaatgatcataaaagtggctctgcacaatcgctttcaaactttaactcaaaggggaataactattataacaagtcgttttcgtcaccaaataagaacatttatatatctgccaacaatagccgagagtccttagccagagcatctagtaatgcttctattcctaggtctaaaagctcattagattaa

SEQ ID NO: 5802 - DNA, 327 bp, Candida albicans
tacactttacgtgattcttatctttcatgtggtatgaactggccttatgaattggtgaatgtgggaccatttttaagacaagaaaaagttatgcatcaattgaatttaatcgatttgcaaaaatggaatgaatgtaatggcagagttgttcgtacatttcaagcaagacattttattcatgcagtacataccttacctgtattaatcaacgatatccagttgattataatcaatgttattatggaggttcattacaatatatacaaatggcattatttattaattcttcagctaaacatattgccccgtttgccacgaaatcagtag

SEQ ID NO: 5803 - DNA, 1578 bp, Candida albicans
tcaatcaaacacaaatcaattatgaaattaatattatcaacattgattgtatttattcacaccttattggtgctggctttacctacaaaagaagggtcagatcctaactcagctaagaaatatttagtttctgatttacctggattacatgagaatataactccagataattccatacctttgatgtttgctggacaactagaaatatatcctgaaactgatactcattattttttctggaaattcagtgatctgaatccagaaacggttactaatagaactatattttggcttaatggtgggcctggttgttcgtctatggatggtgcattattagaaactggacctttcagaataaactcccaacaacaagtcattagcaataatggatcatggcataagatgggggatattatatatgttgatcaacctgctggtactggattcagttattctgatacttatatcactgatttagatcaagtggctgagtattttttaaaatttatggaaaaatattatgaattatttcctgaagaaataggctatgagatttattttgctggtgaaagttatgctggtcagtatattccttatattgccgatgctatattacaaagaaataaaaagttggttgatggtgaacataaatatgatttgcgtggagtcttaattgggaatggttgggtttctcctaatgaacaaagtttatcatatttgccatttttcaaagaccatgggttgattgatgtgcatcatccaaagtgggcaacattattagctaaacatgaacaatgtcaaaaaatcgttaataaaatagactctacttttgatgatggtgtagttcattattatgaggtcagctcttctacttgtgaagccattttaactgatttattggagtacactcaagatacggctagtgaaaaggaccaaagatgtgttaacatgtatgattacactttacgtgattcttatccttcatgtggtatgaactggccttatgaattggtgaatgtgggaccatttttaagacaagaaaaagttatgcatcaattgaatttaatcaatttgaaaaaatggaatgaatgtaatggcagagttggtcgtacatttcaagcaagacattctattcctgcagtacatcttttacctgaattagccaaagaaatcccggtgatgttattcaatggtgccaatgatattatttgtaattctcaaggtgttttgtcatatctccagaaattacaatggaatggtgaaacgggatttactaataaagataaccaaataagttggatttatgacaataaagaagttggttatatcatatgggaaagaaatatttcattcattaacatttataactcatcacatatggtaccatatgatttacccgatgtatcaagagcgttgattgatttaataacgggtaaatatgatgaaaaggatgttgatggcaaaaaatcatttgtgacgtacccattaggatcgagaaaggaaagtgatgcttccgccgatggagaagagaatgctggactggacaaatatcctggtgatagtcttcacagactatag

SEQ ID NO: 5804 - DNA, 570 bp, Candida albicans
gtagaggtcattgccagttttctttctttctttgctctgcacaccatggctgaaaagagattattcaaagagtacaaccagtaccaaaaacacttaccacaactcaacaatgaccaaatagtatcgctaagcccactttcacccgacaagaatattttattatgggaagccaccattgccaagcccaccaaaaaggattctccatattactatggcggacaatggaagttgagtataaacgtgcccacgtcgtatcctattgatccgcccacaatcaagtttgtcacccctatagtgcatccaaatataaatttaggttctggtgaaatatgtttagacattttaaagaaagagagttggtcgccagcatggaaccttgaacatcttgtggttgctattttgatgttgttagaccaacccgagccagactcgccgttgaacatcgatgcagcaaacttgtatagacaagataaagttgcttacgaaagtatagttcagtttaatatctggaaacacaataatttctacagtgcgtttgtgcgagacacaagtggggttagaagtttatag

SEQ ID NO: 5805 - DNA, 378 bp, Candida albicans
tccctagtttatttcccaaaaatgttgcaaaatattgaaaccaaacaacaattttcttctgctttacaaaacaagaatgacatgattgttcttgactttttcgacgaatgttcacattgtagtgacttgaatgataaattggatgaattctccgatatgtatgaagctcaaaacattaggttctataaggttaatattgaagaagatagagaattggctgaagactacaaagtttcttccattcctaccactttatttttcaaaaagggaaaagtttttgataaagttgttggacctgaaccaaatgaaatcaagaaagttcttgacaagaatttaatgggctggtcaggtcgtccactgcaatcatccagaacatga

SEQ ID NO: 5806 - DNA, 990 bp, Candida albicans
tcagagatgtcaattaaatttgttaagtcatctaaagattttgaaggttatttgaaaaacaacactcatctcgtattgaatttcactgcctcttggtgtggtccttgtcaagcaatcaaacctgtaattgatcaagcttacggacaatttcaaaatgttgaaattgtgagaattgatttagatagtcaacgtgagttagcatcgaaatacaacattacatctgttcctacatttgtgtttctcgaaacagggaaagaagttgaccgtatccagggtgccaatcctcaagcattgattacgaagttgcaagagtttaacactaaagcaaacggacaaaagagaagaggcaatggtacggctagtgaagatttgattactcaaaatagtagtctaaaagatataaaaccattgattcctaaaaactttgaaatattgaatgccactatagattatagtggatacgaagttttaaactgtttaccattgtacaaagactcgaaaacaaagcatgttgtaagcttggataatacagataaatccgcagttatatcagattcagattctcaattgcttttttatattcccttcttgaacatttccaaaatttattcgattttggtaaaagtgaaatctactaaaacgtacaaagaagttgacgaaagtgcattggatgtcgacagtgacgacttggatgaaattcaaccacctaatttaattaaagtgtggtgcaacactcaatccatcttatcttttgatgaagctagtgctgatacaagtgctccacatattgaaaaagtatccactaacgatgaagagcaatggttggatattaaattcaaatttgttaggttccagaatgttcaaaatttgactattttcgttgatggtgaagacgaagattatcacacggttattgagaaaatagtcattgtcggtgtcaatggcgaaagtaaagagcaaggaaagataaatcaaatagatgatgaatag

SEQ ID NO: 5807 - DNA, 1473 bp, Candida albicans
aaaaatatgcaaaaaaaaaaaaacaaatgttacccagtttgtttcttttttatcaacatctattcatttttgttaaataactatgatttctttagcagaagtatgtatataagtttgcaatgtaatgaccaacaatatactaacttttacaagtcatttgcctttcttgactcaccatcaattaattggaaaacaattattgttggctttactattggccaatatgttttcgagacttatttagatcttagacaatatagagtgttacaactgaaaacagcaccaaagtcaattgaaaaagaagtttcacaagaaacattcgacaaatcccaagagtattcccgtgctaaagcacagttttcagtcttttccagtacgttcagcttgttgcagaacttggcaatctttaaatatgacttgttacctaaaacctggacattggctgggactatcatgaagagtagtgctgcagttttacctaaggccatgagtggtgttattactcaatcgcttttttttgttttcaccacccaaatcttgacaactttgattggattaccattgagttactacaaaaactttgtgttagaggagagattgggattcaacaagcaaacaattggtttgtgggttagcgatatgttaaaaggaattggtatctctatagttttgggatcgccagttattgccggatttttgaaaattattgattactttgatgataagttcattttctatctcatgggattcattttagtagtcaacttgattgctatgaccatagttccaacattgattatgccattatttaacaagtttactcccttggaagatggtgagttgaaaaccgccattgaaaaattagctttagaacaaaaattcccattgacaaaattgtttgtcattgatggatcaaaaagatcgtcccattcaaatgcttatttcacaggattgccatggagcaaacaaattgttttgtttgacactttaattgaacacaattcaactgaagaaactgttgctgtcttggctcatgaaattggtcactggaaattgaaccatttgccaaagatgataaccatgatgcaaggccatttgtttttgattttttccttgtattctgctttcattcataacaaatcattatacacaagttttgggtttgtcaagcaacaaccaatcttgatcggatttatgttattcaacgacattttccaaccagtggaatgtctcttgacattcgtcctgaacttgatttcaagaaagcatgaatatgaggccgacaagtatgctagtgactgtggatattctgaggaattgagcagatctttgatcaagttatccaatgaaaacttgtcaagtatgaatgccgattggttgttttcctcttaccattattctcatcctatattaccagaaagattaagtgcattggggtacgtttcaaaggtaaaggttaagaaagatgaataa

SEQ ID NO: 5808 - DNA, 330 bp, Candida albicans
ttatattttttttcaaagatggttcacgttgtcactgaagttaacgaattccaaacccttttaaaggaaaacaacttagttattgttgacttttttgccacttggtgtggtccatgtaaaatgattgctccattattagaaaaattccaaaatgaatattctaatattaaatttttgaaaattgatgttgatcaattgggttctttagcacaagaatataatgttagttctatgccaactttgattttattcaaaaatggtgaagaagtcaatcgtgtcattggtgctaacccagctgctattaaacaagctttggcttctcttgcttaa

SEQ ID NO: 5809 - DNA, 627 bp, Candida albicans
aaagattgtgtttacaagttttaccaccatcgaaatcaagcttcaacaatgtttaatttagtgaatagggcacaagcagctgccaatctggcatttacttcatccatagtgataacatcagtagtgatagtgttgacattgttgcaattgtataaagacaatgtgtggtcgctcaacaccacttcaataactaacataagaccaacagcatcaattaaacaatcattccattatggttctttgaacaggaagccaaaagagaatgccaaaatccaatttgatttaagctcagatttgacaccattatttaattggaacaccaaacaaattttcatttatttaactgctgaatatccgggcaaaagtgaaggttccagcaataaagtcacattttgggataaaattataactaataaagaagatgctaatttaactttaaccaaccaaagaggaaaatattctgtttgggatgttgagaaatcattcagaggtagaaatgcaacagttagattagagtggaatatacaaccttatgtgggaccattaatttttggatctacagaaggattcggtgaattccaatttgctgatactcaaaaaaagaaagaatcaactaaaaacacttga

SEQ ID NO: 5810 - DNA, 1179 bp, Candida albicans
atacacttccgcaatttatttcaaatgttattgtcgattcaggctctttctgatttgatgattgtggactcgatttacaatttctcggtttcttccagtttatacaatagcaatcagactgccattatgaagtatggatatggtggtcaattcccagtttatttcatcaacgaaaccattagatctaacgattggaagttgtccaatttgtccgtgggattggcaaatatttctgatatggattcattttcggggatcttgggaattggattcacccgacaagaactattcaaaacaaattatctgaatttcccctatttgttgaaagatcagggttatacaaaaagtgttttattttccttcaatggccaagatcaaaacccatctattatttttggtggtattagtaccaacatcatcgacggtccattagttagagccccctttattaaagtaatcagttttattaaccaattagattattggttaatgcatacattcactgtcaatcaaatcaaacttggtgatacaattgtttccaaccagaaaacgttgtaccaaattgatagtggcaccaacggatttgtaccaccaactcccgttttaaacaacatcttgaaaatattgggtgatgactatattcaggatgacaacggcaatatttactttgatatcaaatacattgaaggattaaatattacttttagtgtccaaggctatgatattgggtttcagttagttgatattgttggtgataccatagagagaaacagtaccactttcgttgctttgaatgttgcctcttgtgatatcggctacaatgcctatgaaggtttattgccaaatttaattttcaaatatcattatgccatttttgattatgataatgctcaaatttactttggaaagtataagaattcaaatggggaggcgaatgttgtcgctgtagaaaatggctaccagttaccggtacccactgttgatgtcccggatgttgaagatacatactcggtaatctatattgctgaaagtgaaaccactgttacagttgctcccacagaagtacaatcaacatactcatcattcagtatttccgaaggtacttcaagtaatctaacttccggttcaactagtgatgacaagattacaagtgtaacctgtaacccacagtattgttag

SEQ ID NO: 5811 - DNA, 477 bp, Candida albicans
aagactaaggtggccagagaagtgttggacattactgccagtaacgttaaaccaggtatcaccaccgacgaattggatgcaattttgcataaagaatgtgttaaaagaaatgcttatccatcgcctttgaactactacaatttccctaaatcgttgtgtacatctatcaatgaagttatttgtcatggtataccagataaaaccaagttacaggacggcgatattataaacttggatgttactatatattatcttgggtttcatgctgatcttaatgaaacttattacgttggtgacaaggcaaaatgcaatccagaactagtcaatttggttgagaccaccagagagtgtcttgatttagctattaaacatgtaaagccagggattgcatttagagaattgggtaatatcattgaaaagcatgcaagtgaaaacaactgttcggttgtgcgtacatattgtggccatggttgcggg

SEQ ID NO: 5812 - DNA, 465 bp, Candida albicans
aactataatccattaatatatatatatatatatagacatgttaaagactatgttttgttagaggtttgtactacaccactacaaccaaccatgaattgtttcttttctgcaacaactttacaaactaatttcaagaaaccattaattgaacaacacaataataaatgttataaatatattaaattaaataataatggactaaaagttttattaatatctgattgtcatcatcacggtggtttgaaaaatcattttacatgttcaatgacaattaaaaattttggtagttttaatgatccaatgaattatttaggattaactcatttattagaacatttaataatttttaatcattatcaatttattaatcaattgaaaaaaatgggtggtgatataaatggatatactttgggtgattttatgaatatttattttgatgtattgataaatgaaccacaaagatag

SEQ ID NO: 5813 - DNA, 1077 bp, Candida albicans
tgtgaaattcattacattactaaatggctgtgcggtattttatcaatgcaagataacgagcgagaaaaaaaaaattgtggtggtggtgaagatagttgccgaacgaaaaaaaaaaaactgtggtgtatggctcgttgcaataacttcttcttcccaataaagataaactttaaagatcataggttttatatatgcatttgtatatatattcttatgataattccctccttgaaattgacaaccactagaagttcctttgtttcagtgagcaaatattattcaagaatgagtaatcaatttactattttatctgatgacaagaccattgaaaaaccattactcgatgatcgttcatatagatttattaaattgaataacaacggattgagagtattgttaataaatgatcctactactgataaagcagctgcttctttagatgttaatgtgggttcattcactgataaagagtataatatttctggactcgcccatttctgtgaacatttattgtttatgggcacagaaaagtaccctaaagaaaatgaatattcgaattatttatccaaacattcaggtagctctaatgcttatactgctgcagaacatacaaactattatttccaagtgggtgccgattatttggaaggcgcattggacagattttcccagtttttcatagcacctttatttagtaaatcatgtcaagaccgtgaaatcaatgctgttgattccgaaaataagaaaaacttgcaaagtgatatgtggaggttatatcagttggataaatttacgagtaactcggcccatccatacagtggattttccacggggaattatcaaacattacatactgatcctgtagcaaaaggagttgatgttcgtgatattttgattgattttcataagcaacattactcatctaatttaatgagtttggtcatattaggtaaagaagatttgaataccttgactaattgggcaatagaaaagtttcagcagttcctaataaggatttatctcgaccaaattataacggagaattggtgtataagcctcaacaattgggaaaattga

SEQ ID NO: 5814 - DNA, 2469 bp, Candida albicans
ttgggcaatagaaaagtttcagcagttcctaataaggatttatctcgaccaaattataacggagaattggtgtataagcctcaacaattgggaaaattgattaaagctaaaccaattatggataatcataaaatggaattgaattttttgatccctgatgatttggaagacaaatgggacactaagccaaacggttatttctctcatttggtaggtcatgaaagtaaagggtcaataatttactatttgaaacaaaaaggttgggctacagatttatcagctggtgctatgactgtttgtcaaggtacttcaaatttctatattgaatttcaattgacacccaaaggttttgaaaattggcaagaaattattgttattacgtttcaatacttgaatttcatcaccaacgatgaaccccaaaaatggatttgggatgaaattgaagaaatgtctcaagttaatttcaaatttaaacagaaaatggaagcatctaaaacagtttctactttgagtaataaattatacaaatttgatgaatatatcccagcatcgtatttattaagttctgccattgtgagaaaatttgaccctgaagcgataaaaaggtttgggtcttatttcacaccagagaatttgagaattacattagcttcgcaattattaactggattgaataaacaagaaaaatggtatggtactgagtatgagtatgacgatataccacaagagttgattcatcaaattaaatcacaaccatatgacaacaatcagaatttgcattatcctcgaccaaatcattttatcccaactaattttgacgtgactaaaccaaaactgaaacatccacaagttgctccatatttgattgagcacaataacaaaattaatgtgtggtataaacaagatgatacttttgaagttcctaaaggttccattgaagtggcattccatttgcctagttccaatactgatattaacacctcagtgatgtcaaatttggcaattgaaatgttggatgatgaattaaatgagttgacgtattttgctgaattggttggattaaaagttaaattacatgcatggcgtgatggatttttaatcaatgtttcagggtatagtcataaattatccaatttgttacaagaagttttgaacaattttttccaattcaaacctaaacaagacagatttgaatcgattaaatttaaattgttgaagaattttaaaaattttgggtttcaagtacctttccaacaagttggtgtttatcatttacaattattgaacgacaagctttatcaacaagatgataaaattgaagctttggagaaagtgacctatgaagatgtttatcaacatttcactcaaaatatttggcaactgggtatttttgctgaagtgttgattcatggtaattttgattttgcccaatcaaaacagatcagagacatcattaatgagtcaatggaaaatgttaaaccatggatggaaaagtataatgaggaacaatttcatttacaaagttatgtgttacaaccaaatgaaacgataagatacgaagtgccattgaaagatacagctaatattaactcgtgtattgagtattatattcaaatcaataccaataccgataatttgaaattacgtgttttgacagacttatttgctacaataattagagaaccttgttttgatcaattgagaactaaagaacaattagggtatgttgtattctcagggacggttttaggaagaacaacattgggattcagagttttgatccaatcggaaagaacatgtgactacttgcagtaccgtattgaagagtttttagtccaatttgggaactatatcaacaatgagttgtcaacagaagattttattaaattcaaacatgctttgaaaaatatcaaattgaccaaattgaaacatttgaatgaagaaactgttagaatttggtcaaatataattgatgggtactatgattttgattcaagaactcgacaagttgaaatattggaaaatattaccaaagacgaattagttgaatttttcaatacgtttattgcaaaatccgataatactggtaaattaattacttatttgaaatctcaaaatccaattgaatttactgaatcgaaaaaattacactcaggaataatcaattatttgtatcgtaatcaaattgaaatcaatcatgaattgattgataatttggttaaacaatatgatgagcataaagatttggccgttattgccaaagaattatcacatgatataaatgtcaataaagataaattattgaaagtcttgaataaatccattgctcaacctgtccctgaaatttatcctactgggaaattggttgttaatgataaggagtttagaaagaatcgtcaattaagtggtacaccaaaaccagttaacccattatcgaaatttttgtataatgatcaatcacatttatag

SEQ ID NO: 5815 - DNA, 819 bp, Candida albicans
ttcgtggacatggatctgctagcggctgtctgtaaaccaccaactaatgttgaggtgactaaaccaaaactgaaacatccacaagttgctccatatttgattgagcacaataacaaaattaatgtgtggtataaacaagatgatacttttgaagttcctaaaggttccattgaagtggcattccatttgcctagttccaatactgatattaacacctcagtgatgtcaaatttggcaattgaaatgttggatgatgaattaaatgagttgacgtattttgctgaattggttggattaaaagttaaattacatgcatggcgtgatggatttttaatcaatgtttcagggtatagtcataaattatccaatttgttgcaagaagttttgaacaattttttccaattcaaacctaaacaagacagatttgaatcgataaagtttaaattgttgaagaattttaaaaattttgggtttcaagtacctttccaacaagttggtgtttatcatttacaattattgaacgacaagctttatcaacaagatgataaaattgaagctttggagaaagtgacctgtgaagatgtttatcaacatttcactcaaaatatttggcaactgggtatttttgctgaagtgttgatccatggtaattttgattttgcccaatcaaaacagatcagagacatcattaatgagtcaatggagaatgttaaaccatggatggaaaagtataatgaggaacaatttcatttacaaagttatgtgttgcaaccaaatgaaacgattgattatccgaacgacgctggcagaatccacgct

SEQ ID NO: 5816 - DNA, 573 bp, Candida albicans
attttttttactctgctaacaacaactatcgaaactgtcaaaaccacctaccaatttccaacaatgtcacaattgaaaaagaccaatttgaactcagtcaacgatttacgtcaaaccacggatgatcatttagggttggttttccagcagcttggttacaacgagtcatttacattgattgatttaaagttaggattaggattatccacagtggtaatagctggattgctattcttggtcgataaaaaatatgcatggaaagatagctacaacctcacagttattgcctgtgttttatacggtataatcagtggtgttttgtatttgatcaatttttttaacaaaaatgtcaaatacataggctatgataacaaaggcaacaaattgtctgtggcaacttcgtccaataaattggatcctatctataatgttacaatcagtttgaatgatagatcagtcaatgcagcatttggtttcaataaattttttgatgttgtggggtttttcaatagagatgcatttacaaaattggttgaaaacgaattaaacaaattaaataaaaaaaatgaataa

SEQ ID NO: 5817 - DNA, 1125 bp, Candida albicans
  unsure (1061),(1074): Identity of nucleotide sequences at the above locations are unknown.
ataactttcaccccctttttttctttcttcttcactttcttcaacccctacactcaatcgccacacataacagaaatgactttaacgactcccgaattaaatttcaaagcttatacttataaaaacagcagtactcctgttcaattgactgataaatcaattaaattagtcaaagatccctcaaatcctgactcctatgtggccccaccaggtaaaatcttgcttaaaattaactatacttcattaaacccagttgatgttaaattacaccatcttgccactagtttagtttcattattagtcaacaacaacaatggatttggtagagatttcagtggtgaagttctttctattggtgataatgtgaaaactaatgttaaagttggtgatttggttcaagggatttatcataaagtttattcccaaggtactgcatcacagtatcttttagttgatccaaatgaagttgatatgattgccaaaccagataatatttctttggctgaagcttccagttggccaactgtgtttggaactgctttattaatgtccaaagatttaaaatataaagatagtaaagttttagttattggtggaggtacttcagtcgggagatatcttgttcaacttgctaaacaaggtggtgctaaagaagttgttgttacttgttcaccaagaactgaagatgttattaaatccttgggggctgatactattattgattacactaaacataaaaacattctttatcctgttttagaatcagttaaatcaactgggaaatttgattatatattggattcttatggaggtcacgagttattcccagaaattaataatattttgactgaaaaaatcggtcgttattatagtattgttggtgattatccaggatctagcttttataatttgatttcaactgtatcaaaagttgcatggagacaacttcttggtgctcttggattgttatcattcaattataaatttataatgttagataatttcaaagaaagtatgccagaagcaagagatttgatcggtagtggcaacttgaaaatctntgttgatagcatntacccatttaatcaattggaatcagccatcgagaagttagattctgggtaa

SEQ ID NO: 5818 - DNA, 1089 bp, Candida albicans
tcaactattaattggatttcatttcatctatacccaacaatgacaaaattaacttataaaagatatggttttaaaaatgggggatctccattagagataattaccgatagttttgatttcccaactgatgctcaaggcaactttattatcccgaagaataaaatattaatcaaaatctattatgcttcattgaatccagttgattataaattgaagaaaatcacatatttcccacctttctcattgcatggtattggtaaagattatagtggtgaaatcgttggtcttggttccaatgtgaaaaatttcaaagttggtgaatttgttcaaggatttcatcctggtgttatcactgatgatgggacattcagtcaatatttattaatagacactaaagggttatttaaaactgaaattgccactgtacctcaaaatataagtttggaacaagctgctgcttggccattggttttaggtactgccattaaagttattggtgatttgcctatcaagggtaagaaaattttagtgtttggtggagctacgtcagtgggaagatatttagtacaattattacaagctgaaaaagctggtgaaatagttgttagttgttcacctagatctcaagaacttgtcactgaattgggtgcaacaaagattatcaattatagagaaaacgttttgaatcaagttttggaaaatgtcaaggataaaccttttgattatatatttgatacttggggaggtaacgaattattcccacatttgaaacaaattttggtcaataacggaacttatcatactattgttggagatgatcctcattcattctttacagggacaagcaaatcattttttagaacatttttaagtcggcttcatttgttagattattcatatcaatatgttttattgggtgcaggtggtactggatggattaacaaagcaagggaatatgttgctaatgatgatgtgcaaatttttattgataagatttacaaatttgaagatttgaatgatgcaattgaatataataagaccggtacagctcaaggtaaattaatcattaatgttaaagacttcaaatag

SEQ ID NO: 5819 - DNA, 840 bp, Candida albicans
ttaaaggaattcaagaaggtcgtgataaaaagggagcaatctatgttttcgcttctggaaatggtggtagatttggtgattcttgtaatttgcgatggttatactaattctatttattcaattactgttggtgccattgattataaaggattacatccacaatattctgaagcttgttctgctgttatggtggttacttattcttctggatcaggtgaacatattcataccactgatatcaagaaaaaatgttcggcaactcatggtggtacttctgctgctgcagctttagctagtgggatttattcattaatattatcagctaatcctaatttaacttggagagacgttcagtatatttctgtattaagtgctactcctataaatgaagaagatggtaattatcaaactacagctttgaatagaaaatattctcataaatacggttatggtaaaactgatgcttataaaatggttcatttcgctaaaacttgggtaaatgttaaacctcaagcttggtattatagtgatgtcattcaagttaatcaaactattactactaccccagaacagaaagctccaagtaaacgtgattctcctcagaaaatcattcattcatcagttaatgttagtgagaaagatttaaaaattatgaatgttgaaagagttgaacatattactgttaaagtaaatattgattctacttatagaggtagagttggtatgagaattatttctcccacgggggttattagtgatttagcaactttccgagttaatgatgcttcaactagaggatttcaaaattggacatttatgtcagtggctcattggggtgaa

SEQ ID NO: 5820 - DNA, 1191 bp, Candida albicans
ggagtaaccttcaccggcgccggtagaaaagattcaccgagaggactggagtctgattttcgcaattctacagactctcaattatctgacatttttgaagacttggaaaactattctggtctgagtggtcaaaaaattgaagatttcaatgacagtccgttgtttcaatctgttttgatgcgatataaaaacgaaggcatcagcggtagaacatgtggcatattcagcttagtggcgatatttttatggattggaagcgttataatatattctcgagtgaatcattcaacaattggtaacgatttaacctggaaaaccaacattattcaactaaatggggaaaatatcacactcaatgaatacaaccccaatttcaaaaacatcactatgaatgattggagaaaaggcaaatatcacacttttgaaaaacaaataaggtggttgacttctaaacagtctcctaaaagcaaacatggtggtggattttatgtactagatgaacatgacaagatagttgtcaatcaaattggacaagtggacaaaagtgatacctttctatcaaacaagcaatttgagtacggaaacaatttttttaaaatccaagattttattttgaacccactgcaatcaattgaagattcggaagttgtacattttatcataacagacacggtacaccaatggcgacatctgagtttcgcattatattggttatttaaacctttggttgggacatacacacccattcagccaccacgaaataataacaagggaaatggtttggaagttgatgcattggacaagttacattacgctgacttttcctctgatggaaaatacatcgtgtttggtttcgaacataatctatttattcaggatttggctactggcgaaatacagcaaataacagacgatgggtcaccaaatataatcaacggaaagtctgattggatatatgaagaagaagtcattgctagcaataaaatgatttggtggtctccaagcgggaatcattttatttttgcaaaaatcaatgagacaaaggttcaagaggttgacatggattattatacaaagcaaaataccaatatagggatgcaatatcagcaagtaggtgaatcaaaatatgagggtgttaatcaatatcccataaatacaccattgaaataccctaaaaccgggaacaagtaa

SEQ ID NO: 5821 - DNA, 1581 bp, Candida albicans
aataccctaaaaccgggaacaagtaatccaatactatcattgtatatttatgacatcgccaacaagaaaacagaggagataattgatggagatgataatttgggaaccgaatatattttgtattatgccaaatggatcgatgccaacagctttttgatgaaacaatcagacagaaccagctcagttctcactaaaaagttgtatgacttagacaagaatcatgtgagtattgtgagttcaagcaatgtcacaaaggaatataagggatgggttgaaaggatgaatcccattactttacttgatgatggcaagtacattgacaatgttgtgattgataacagaaatactttagcgttattcgattccccacatctggtgtcaccatcaaaagttttggttgataacaaggattgggatataactggtgaagccatctatgatgctcaagagaagttcgtttattttttaagtacggtaagaagctctatggatgctcatttggttggaattgatcttgcagataactataaactttacaatattacagacacgaagaaagacgggatttttgaaacaaagttttccgaaaacgggcagtacttgagtttggtttaccagggacctaaccagccatggcagaggttgataaatatggcaaatgtgcatgatttcattaaatccgaagaatatggtaaatcaaccatcgaggaagcagtcatattgaaccagccaattgttaatagtttggcaaatttaaaagaaattaatttgccaacagtcagatacaaagaggtgacaataggaaaaaaagaagaccaggtaactttgaatattatggagatattgccacctaattttaaggcaaaaaaccaaaagtaccctttgtttgtgtacacatatggagggccaggttcacaaactgttatgaagaaatttgatattgggtttcttcaaattgttagcgctagattgaactctattattttggtgattgatcctcgtggaactggaggcaaaggttggaaatttgaatcatttgccaaaaataatattggatattgggaatcaagagatttgaaaacaataacctctgaatatataaagaaaaacaaaaaactcattgataaagaaagagttgctctatggggttggtcatatggtggatttgtcactttaaagactttggaatatgataagggtgaagttttcaaatacggaatggcagttgcacctgtgacaaattggttgttttacgattctatatacaccgagaggtatatgggtcttccagatactgatcccaattatgagacttcggcaagaattaatgattttgacaacttcaaatctgtgaaaagattcttgctagtacatggcactggtgatgacaatgtacatgtacaaaacctaatgtggttattagatcaattaaatattcataatgttgagaattacgacatgcatttatttcctgatagtgatcatagtattctgtatgacaatgctggtgttattgtatacgataagctatactactggctacaaaatgcattcagaggaaattttgacgaattaaactag

SEQ ID NO: 5822 - DNA, 459 bp, Candida albicans
atttggaaatttggggatgttgggggacaggaatccattgccgaaataggtgttccaggaactttaagcaatgccatggcttcatatttaaaattgattctaacgataactgaagggtttccggatggctatgcaacaatgattgatattgcaccaggcgatatttggaggcagattgacgaagacgacaagaacaacgacaacgacaacagcaatgttgacggaacagtaaatgtgccaataataatgatggcaaacaagcaagatataccgcaggctgtagatttggtttctctcaaaaccggggtgtttatcaaattagtcagcgaattggaagctacggactcaaagttattgccagtgtcggtcttggaaaatcaaggattgcaagaaagtttagaatggttagtgacgcgattgatttacaacagacgtaacaaaaagcctgagtataagtga

SEQ ID NO: 5823 - DNA, 1122 bp, Candida albicans
atcaattcagcaatcatggttcactataggaatcgatacctaaattatatacgaagaaaaccattagcattattggctcctatcactttattggttgtgatctacttttatttcttttctgcccatgggttttcttcaaacaagcagaaatataactacaataaaaagagtagaggatggttttacaaaaacagagatacagtaatattaaaagatttacctaagaatcatattagtcattatgatttgaataaattgacggcatccaaagacgcattgaacaaaagagaagaagtgttgatcttaactccaatgtccaaattcttacctgaatattgggaaaatataaataaactcacctatgaccattcgttaatttcattagggtttattttcccaagaactactcaaggagatgatgctttaaaagaactcgaaaatgcattaaagaaaacgaaaagagaaaaacggttgaacttcaaaaaaatcactattttaagacaagattccaattctttacaaagtcaattagaaaaagatagacatgcattcaaagttcaaaaggaaagaagatcaatgatggcattagcaagaaactcattggttttcagtacaattttaccatctacttcttgggtcttatggttggatgcagatatcgttgaaactccagtgacattgattcaagacttgactggtcacaacaaacccgtcgtttccgctaatgtccaccaaagatttatcaaccaagatacaaaacagccagacatcagaccatacgatttcaataattgggtcgaaagtgaggaaggattgaaattggctgctagtttaccagatgacgaaattattgtcgaaggttattcagaaatggttactcatagagcattaatggctcatttttacgatcctaaaggtgatccaagtacagaaatgacattagacggtgttggtggaggtgcagttatggttaaagctgacgtacatagagatggtgccatgttcccatcgttcccattctatcatttgattgaaacggaaggatttgctaaaatggcaaaaagattagtctatgaagtgtacggtttaccaaagtgtagaggagcggaccgatacatgtaa

SEQ ID NO: 5824 - DNA, 465 bp, Candida albicans
agaagaagtagaaaccaccagtctccaactctattattaatattatctctattcacaatgacatcaataaaaccatttcaaatggaagatctattcgaattgaaccccgtcaatttagatccattaacggaaaacttcaatgtatcattctattcccaatacttgattgaatggccacaattgttttacaaatctgttgaaaccccaaatggccaagctagtggatatatgatggcaaaaacagaaggtcaattatcgaaaaaagaatggcatacgcatatcactgcggtaacagttctggaccaataccgtagaatcggattagcctcaaaattgtgtcttgaattagaaaatttgactcaagtcaaagatacattattcattgatctatttgtcaaggttaccaatactttaggaagaatattgtatgaaaaactcgggtatagtgttttcagaagagtagtg

SEQ ID NO: 5825 - DNA, 1926 bp, Candida albicans
atacaaaccaaaactggagtcaccaatattcgcttggcttattgttggaataatatattgacaattttagaattggacaacaagagtgtttcgggaagaatactagattttataaacaatgctaaagataaaaataaagtaatatcaaaattaccttttaaaaaaattgccagattgactgatgagagaataatacgtgacattaaatggcttcaatctgatattttatgtgtatttttggataatgaaatgatcaccatttatagtaatggcacaatgttggtacctgctgcaagtcagacaattggtaatatctccgacataaatttatctaaacatagagttatatatactgatgagtcaaaactatttattggtaaactgttaggatgggcagacattctattaaacaagctatcacaagggttatatgcagaagcattgagcattgccgataattattacaactcgaattctgtggggaaactaacagttgttggattgccgcaaaatcaaaagcagcgaggtgatttgattgaaccttatcttattaaaataatgagagaggcaatgccgcatttgatacaatcagatcatgaatcgtatatcacattatgtttgaatattattgcgtacctagctgtaccaaatgatttacttgaagccttatatgaaattgtacaggataattctatatttttccaagctttggaaccttttattttatcagggttgatactttccttgccaccggttgtcttgaaagcattaattcagtattatgtcaaagcagagaatcaacaatctacaaatatggacgatgatggtgagttgttgacagagattatatgtacattggatataaaactgttggacattgatttaactattcaattatgtaaacaatacaaccttcgagaatgtttggtttatgtctggaattttgttttgaatgattatcaaacaccattggttgatttttttgttgatataaagaaaaatccttcttcaccagacaattttaaagtttacacatatttatcctatattttaactggacgtcaatacccaatagataaattcattaataatgatatggtggcaaagaaaactatttgtgatatattattttcaagttcaacaattagttctgtgccaacggagaatggcaacacaatttttccttatttatacactttacttaaatttgactctttggaaatgttatcttgtcttaatgaattttttgaagatctgtttttgaatgaagatccaaaattaaatcgacaatatttgatagaagcattaatagatattttcgaagctaatgatgaacaatttacagattttgacaagtgtcaattactgattttcattgctagaaactatcccaaatatagtcaatttttacgattatcagattcaatattatcagatgttttcaatcgattatgtgaaaataagtcggaatctattttcctggattgtgaattggcattacagagtttattaccttattttgaaccagaagatgaatattatgtggaaaaattggaagtggcaaaatattataatgtgttgattaatatgtatgagtcagaaggaatgttttcacaagctttaaagatgtggttgaaacgagaacacgagaatgcttctgaagatactcttgataatgaaacaccagaaatggacatagatggtggtagtgatgatcatgatcatgatcatgtcgatcagttatatttgctattggagagttcgtttgcatctagtaagaatcctagtgatcgattaaacttggttaaaatagtgaaagataattttggcaaatttttgaaattgaattatgtgtcagactacaatatttctagatttgtgaatttaattgaacaattttcaccgaatttacatttggaagtttta

SEQ ID NO: 5826 - DNA, 804 bp, Candida albicans
attttgaaagatattttccaatggaatgaattgaagacaatttcagacactattaattcccctgaattcatcaatctgcatggctcacgtctatttgtcaaatccaatgcagtatatattgccattattacaaatcggggcaatatagtgatttttaattatagacaagaaatagattatatattagtgccgactcaaagtactgatgaaaattgttcaatctcatgtattgcattttcatctgattgttcttatttggcagcaggactacaagatggttcaattagactatggaatttgaaaaaagcaactaaggggaaccatatccccaatttaccattttatacaatatacccaatcagtttaaaatcaaggtttgcccagaatgtccaaggtcatgtcataaataccaagatcacgtatatttcatttgttggagaatctaattatcaattaattactgcggatgattgtggattggtgtttttccataacggtatcaaaaaattcatgaatttgatttatgtcactactaaacttttaggtaaaaatgatgcaaatttggatgatagtaaattcaaaattcgtcgtatggaaatgttgcctttgggttccgcacaccaaataactgataaaatgggtatagtagcaattatgactgatgatttattagttattgtatctgcaatttctttgaatgatgatactgtactgtatgtcaaacaacattttaaaataggcaaacccaaacatatcatccatgaacaagattttccttcttactgcttaagttggatgccatag

SEQ ID NO: 5827 - DNA, 1035 bp, Candida albicans
aaaatactgttgggtacgttgattttgataaaattgatggattggaaggaactattattgttaatgttgttgcccatgctcaagctaatgaaggttactaaaaatttacaaacattgatttctcataatgatggtagtgaatgggataaattagtaccaccaactattgattctgaaggtataaaatatccatgtactggtcaatccttaaataaatgtgccttacatttacatggatttactgaacgtgctgattatcgtgatacattttcaagtgggtctgctacaggatttttgattggtgtgggaaatgttggtgaattcttaactccaatggatgacccatcaacagcaacatttttaagtaccgatgggggtgttacttggaaggaaatcaaaaaaggggtttatatgtgggagtatggggatcaagggacaattttggttttagttaatgcagtggaaaatactgatgttttgtattattcattagatgaaggccaaacttggaaagaatacaaattctctgaatataaagtcaatatttatgatttagccacggttcctactgatacagcacgtaaatttattatatttgctgaaaatccaaaggatcatagagatatacaaacttttaccattgatttcacaaacatttaccctcgtcaatgtcaattaaatttagatgacccagaacatgatgattatgaatactggtcacctacacatccaattggtggtgataaatgtatctttggacatgaatcgaaatacttgcgtcgagcaaaaggtcatactgattgttttattggtagtgctccattatctgaaggttataaattggagaaaaattgttcatgtacaagaagagattatgaatgtgattataattatgtcagagatgtcaatgataacacctgtaaattagtgaaaggaatgacttcagctgataggaaaacgaccatgtgttctaaagaaaatgctttccaatattttgaaagtacaggatatagaaaatgtggcccacgggaatag

SEQ ID NO: 5828 - DNA, 306 bp, Candida albicans
aataaacttgccttgtttagcttgaaggaatcatcactggaagagcctaaaaaaatatttgaaaatattgtcggttatgcaattactggaacttatgttgttgttgccactatcgatgacaataccgattcattattatcaaaagttactgttgatggtgacatatttgctgatgctgatttccctcatgatttaaaagtggaaccacatcaagcattcacagtattggattcaagttctaaagctgtattcatgcatgtcacaaccaatgaaaaacccaaatttcgaatatggtcaacttcttaa

SEQ ID NO: 5829 - DNA, 1089 bp, Candida albicans
attaatgattatgtatccagagatggtgaaaattttgttagagcagatttagatattgatataaaatatggtgtcatgtcatttttaccatcttctgtttcttcattatttttaacaattatggattttaattctcgtgctttccaaacagcttcattttatggttctgattcttctggattacactttactaaactattagataatgttgctggtgggaacattcaaaaaattgaaaacattgatggtgcctggatagctaatatcggtgttgactctaacaatccatatgatggtgataaatccttgttggataatttgtttggcggtacttatgccaaaagcattgttagtaaagtttctattaatgatggtaaagattggtcattaatcaaactcaatgataacagttgtaaaattgaagatgaatgttcattgcatttatgggacttcacagaattggatggtgaagggaaatttgttactggaccaactccaggtatcttattaggagttggtaataaaggtaaaaatttggctcatgagtttgagaaaatgaaaacctatgtgtcacgtgatggaggggtgacatggaataaggcattagatttcccagctgtatttgcctttggtgatcaaggtaatgtgattttggcagttccttataatggtaagaaaaaatatgaagctgccaaacatttctatttttcattagatcaaggtaaaagttgggaaaaagtcgatttagagcatccaatttatccattaagtatattgacaacaattgacggtacatcacggaaatttattatgggtggtattgatgattctagaagagctgaaaacgaatacatttattctgttgattttaccaatgcctttgatggtaaaacttgtggtgatgacgattttgaagagtttgttgccaggaaatcaaatgataatggcaatgatgaacctctttgtgtttatggacatcgtgagaaattcagaagaagaaaacaagatgccaaatgttttgtcaataaattatttgaagatattaaagtgattgaaagatccttgtccatgtacagaacaggattttga

SEQ ID NO: 5830 - DNA, 738 bp, Candida albicans
aaatcaccactttttttttctatttttatcaagtatccccaaaacaggctaatcaataaatcaaagaacgcaaagatggcagaagaaaccgtgactcctgaaccggaaattgtaaaaatttctgttttcactccattgatttatgtgggtgtggtattgtcgatattcatcacattttcgatcatatacagaaagagacgattacaatcattgaccaaagtggaaccacttttcaaggagaattacactgctgttttgtaccaacacttaaaggatcaatatactaataaagatttgcctaaagatcagagacctcatgaaaaagtaatgaaggcagcattgttgagacgtgcagttgaggccattagaaggtcgatgaagttgaaagaaaatgaaccggtgtttaataaattgtatcaaaatggattaattggtgatgacattttcaaacaatatcaaatccaaataaaattccaggagttggaattgaaagatattgttactgaatgtgaaacttataaaaaaggctgggttcaaacatttttcccattggcacaggaaatatgtttcaatgaagcattgagaagaagattgaaagcactggatgatatagcagacacatttagtaaattatgggaaacatacgctgataagtctgaaaaatctttagaatcagcaaagaaagttgaatcaaagaaaactgtggaaggcagtgaaagccgaaaaatacaaagataa

SEQ ID NO: 5831 - DNA, 1509 bp, Candida albicans
attccaacattttatctagtccgtcttcttgatttggtaaagttcttcttaccaatcttacctgagattgaatatccatttgaaaaagtatcatttgatgaaaaaattgttttcacagtgggttctgccattatttttttatttggacaattaccaatttatggattaatacctaatgctcaattttatttattagatccattttctaattttagatcaatttttgccatgaataaaggtactttattagaattgggtttattaccgatcattacttcagcatttatttggcaaattgctgctggattaagattaattaatgttaatttcaaattaagaattgatcgtgaattatttcaaactggtcaaaaattaactagttttattttcagtcttattttcgctattggattgatttattcaggatattatgataatgccattagaggttataatccattacaagatggtattccttatggatcttatgctttgattttattacaaattactgcttggtcatggattgtcactttattggtagaaatctttgataaaggttatagttttggatcaggaattttatgtttccttgctattcaatcatcaactaatttcattgctaatttattaggattagaaaatttcccggtggttaattcaaataaatttgaaagttatggagccttgatgaatttaatcaaaaatttttcaattttcaatccaaaacaaactgtttatcaaatttggcattctttctttagaattcaattacctaatttaactcaattttatatttctttggcatcaattttaattgttgttgctttacaaaatttccgcattgaattaccaattagatctactaaagttagaggtatgaataatgttttcccaattagattattatacactggtgggttacctgttttgtttgcctttactgtggttgccaatattcaagtcgttggttatttaattcattcagtattatcgaaacttggtacttctccaattgttatttctatcattggcaattatgtttataatccatcttcaaatgaattagatttaaattcaggtattttgaattattttactagttcatcttcattagttgaatccattatttcaccaattaaaactacagtttattcaatcacaattattgttttagcagtttggtttgctaataaatggagttatatttctggcagttcaccaaaagatatttccaaacaattcaaagatcaaggtatttctctcgctggtaaaagagatatttctatcaccaaagaattatcaagagtcattccagttgcctcagttagtggtgcttttattttgagtgttgttgccttaattggtgatttttttggtggattaggttatggtgttgctagtatcattggtgtaacagcttcttttgctgttttagaagaattcatgactgaatatcaacaaaatggtggtggtcaattcagtaatgcccttgcttcattccaataa

SEQ ID NO: 5832 - DNA, 975 bp, Candida albicans
  unsure (114): Identity of nucleotide sequences at the above locations are unknown.
catacaaacaatgaaatgtatgttgatgtaattgaaacgttgaatgtcattataaagcctacaaccaaaaaagcaaaaagacatttacaactggaaaagcaaaaccaaggattngactctgccttttattcttcagcatctagcagatcgctaaaccatgatatagagaatcatttgattagtggatacattgacggtgaaatcaactttttgagtcggttgaccggtgtgccatctttgcagttatcgttgaattccataggaacaagcagaatagagttgccaagtttacacaggtgcattgattttgatgtttggaacgaaaaaagagggatattgtcgtttattccacctgatgggaaatctactctaatgaggtatcaaattgatttgaaccaaaccaatcagtacggcacgtctaacaagcaatcaatgttgagcatgataaagtcaacaagtattgaagcagagtttatttgccatgaaaatacttccgattttgaaattagattaaacttatccccatctatatctaaaatagattccctaaatgttgaaattgtgtgtgagcacccagaggatcaaatcaaaatgaaccgtgttactcacggagacttttcatcaaaaggaaatggaaaagcggaatggattttacgacaactaaaaccaaatgtgttttcacctgtgttttatggatcaatcatatctaatacagagaattccagcgatgaagaggaagaagaagagaaagaaggagcaagagacgagaacaaccaagctaaacacgataaaaaagtgagaatttctaaaccaagttatataaaactaagttatagccacaaaggaccagttccaagtggattgaaggtcgatagcttaaagataattagtgcaaaagggttaggcgatacagtcaaaccttacaaaggtgtcaagtatatgaccaagtctggtaattatatagtgagatcataa

SEQ ID NO: 5833 - DNA, 615 bp, Candida albicans
  unsure (14),(25),(45): Identity of nucleotide sequences at the above locations are unknown.
cttcgcggattgcnggacgtcccantgccgtgtgtgaaaaattcnagagtcatgagtgaagcaatatatatttcagactcaactaactcattggtttacgagtacacaacttcactatgcatcccaaaatttaaatcattagttcccaaagttacttcgtttaacgattcaacaaccaccaataagattccattaaattcaaagttgtacttatttgtgcatcatcatcagcagtcagggttgcagttttacttgttatgcaaagagattgataatgcaaacccattgattccctcaatttttattcaaaggttaatcgaagtgatggaagattactttggggatttgaatagtgtcaagatcgaagcaaataatgaaatcttaacgttattattataccaaatgttggacgatggcaccccttacattacagatttcaataaattgcgagacttggttagttataaatcattactttccaagcttctcagtagtgctaccactgtcgcatccaaagccactggaacggcaatgagcaataaaggtcccttagatttgcataaaacaaataaccatcaaacatcggatattctttggagaagaagcaacgtataa

SEQ ID NO: 5834 - DNA, 630 bp, Candida albicans
ggctttactaacataacaaaacacataaagtacattgatgaggttgatcttgaacttgttaatcaagagctaaatttccattcccccgacaacaatttggtgataaaggggggttgtgagttgtttaccaccaaacccataggatctgataggaagttgttcaagacgattgataagcatttggaccaaataatagaggataatcaattttcacgatcaatcgagagggaaaaacgaaattcaataagttctatgtttggaagcaatgccagttcaccagatttaagaagacacagtgctatttcaataagtgatatgagaagaagagccagctctaacctgggcagtataaatttcaatagaaactctttaccgaaaaatgaacaacacaacgacaacaacaacacgtctttgttatcgcaatcgttgaatgactctggagttattgatgataacgagcatgcaattgatgaatcaccttttgggcctttgaaaaatgtcacaacaaggaaaacttttgcctatttaattgccattttaaacagcagtttcccagatcaagattttaccaatttacaaccaacaacggagaatttttataggatagaatcaccagacgagttggtgcac

SEQ ID NO: 5835 - DNA, 495 bp, Candida albicans
acaaacaccaggagtatttttttggtcaatctgctaatgtctttactaaataagggttttactaacataacaaaacacataaagtacattgatgaggttgatcttgaacttgttaatcaagagctaaatttccattcccccgacaacaatttggtgataaaggggggttgtgaattgtttaccaccaaacccataggatcagataggaagttgttcaagacgattgataagcatttggaccaaataatagaggataatcaattttcacgatcaatcgagagggaaaaacgaaattcaataagttctatgtttggaagcaacgccagttcaccagatttaagaaggcacagtgctatttcaataagtgatatgagaagaagagccagctctaacctgggcagtataaatttcaatagaaatctttaccgaaaaatgaacaacacaacaacaacaacaacagtctctggtcttgcccaagggtggaaaatccgcgtc

SEQ ID NO: 5836 - DNA, 405 bp, Candida albicans
atttttttcaaagcagcattattcgataagaaccggaggatgttattttgtgggaatagaatagggtgtttcaatgggccaattataaccggtcgggaagaagcagttgatgcgtatttcaaggcattgcaattgaaaccgacttttgtaagagcaagaaacaatttaggggtttcgagtataaatattggttgttacaaggaagcagcagagcatttgttaagtgggttgtcaatgcatcaagtagaaggggtggacactgtatcgacattgaatcataaccagtcgacatcgttgacagaaacattaaagagggcttttattgcgatggagagaagagatttattggagttggttaaaccaaatatggatttgaatcaattcagaggcgaatttagtttctaa

SEQ ID NO: 5837 - DNA, 867 bp, Candida albicans
gggcacattctccatcgggccaagtgcacaaccccattacccaagactgaagtcccagtgaatgctcaatggccagggggtttaagccaagcacccgcaacgcaacagcacaaccagagacctggccaattggcccttggtcttgggggatacggtccaatgatgggaatgtgtatggcataccaactgcaacgtcaacaacaacaacaacaacgacatattcaggagccacaagttgattgggagaatcagtttaaggaaatagaggagttgacaaacaaggccgaggaagttgaggaaatccagagagaacagtctcctgagattgttgttgatgacaagtatcaggccactttccaagaagtgtgggacagtttgaattcagaatcttttgaaaatgactttatcaatcagcaatatgaagatttcaagagaactcaaaaagatgggtttccagctgatatgaatcaatgggagaaagattttgcaaagtatgcgtctacgcgtgcccactttggtgactaccaatttgaagataaacagagtaaccagtttttggacttacctaaagaccaagacccatatgagattggtttgcagttgatggagaatggtgccaaattgtctgaggctgctttggcgttcgaggctgcaattcaaagagatgaaaatcacgttgatgcctggttgaagctaggcgaagtccaaactcaaaatgaaaaggagattgctggtatttctgccttggaaaaatgtttggagttgcacccagagaattcagaggcgttgatgaacttggcaattagttatatcaacgaagggtatgataatgccgcatttgccactttggtctccaccacggcgtga

SEQ ID NO: 5838 - DNA, 747 bp, Candida albicans
  unsure (741),(742): Identity of nucleotide sequences at the above locations are unknown.
tattttcattacatgcagaccagcagcaccccaccaagaaagatcaatcggatttcatttctggatcaaggctttagtattggcgattcggagtataatgcccctgggtcacccatcaaacgatcacattggaagcaactgtcatcagtaaatcgatgcaccctttgtgacacgacactaagtgtcaagaacggtatagtcaactgccgcaaatgtggagaattgttttgcaatgaacatactcattataaggtacgattacggaatccagataaaggtgagacgactccacagtatgactctcggggagtatggtgcagatgttgtgagacttgctttttcaataaacagaaatctactgaagtcaacagtgttgatttgaccgaacagtttaaacagaaacgtttagcaaaagtcgaagcacaacaattacatcgaacaagaatacagcgcaactttataaagttgacagattcattaatgaacaagtcctcagtggatggtattgcaaattggtctcccaatactaagaattgttctatttgctttgtggaatttaatttatttataagacggcatcactgtcgcttatgtggtagtgttgtttgtgatgatccgaatggcactcgcaaaggttgttcaatgaatgtcccgttggtgaaactagttgaaaaattgccgcagttgaattacacacacgagtacgaagaaatagatgaaaacttacggttcaaatgttgnntatga

SEQ ID NO: 5839 - DNA, 219 bp, Candida albicans
  unsure (26): Identity of nucleotide sequences at the above locations are unknown.
agactccatctcctccgcggcttacntaagaaagagattagagaaatgagagagcagttgatggtgatgaatgagcaaaagttccttgttaaaaatttaatcaaagagtataccaaagcgagacggtttgatgagttggattcattgatagccaataaaaacgaactaaacgaaacgattgcaagacttgaaagtgaattaggagagtttggattttaa

SEQ ID NO: 5840 - DNA, 1179 bp, Candida albicans
agaatcaattacactataagtggtttttataatatcatatacttagaccacaaaatgggtgaagaaacacctaatcaaactcatgaaatattatttaatgatttcataccattatcattcagaataactgttgcaattcattttggattaatattatggttgatactaaatttgttattaactaatttcacttcaattaatgtattacatttattaaaattatcatatacaccacataattatactcatttagatgatctactgcataaccaagataccaacatcaacaccaacaacaaccataaccataaccataaccaaattgagtcattgggggaatatgctgcatttttacctagtgatcctcatgaaaatgatcgattaattaaaggaatctggtcaaatttaaaatttgtatcaattattaatatcacttgttggataatttataaatcaattgctaatatttcttggttaacaccattattttatacattaccattggtttcattattcatgacaatttataagcttttctttaaaaactcatattcttcacctggtcaaattagaattttcactacgattaaaagaatcattaggggtaatattaatagtcaaaccatgagaactaatgacattttaataagtgatagtttagtttcatattctcgagtgataaatgatttaggtttagtaatttggaattattggtttgatagtaatattggatataattataaatttgaatcgatgatattatcaattcctacttggattcgtattaaacaatgttggtatgaatataaattgacggggaaaactcaacatttatttaatttaattaaatattctactgggttaggaccattgttgattaatgtattacttaaacgaatgttattaaatgctactgaacaagaaaaaaccagtggagaattattacttaaattaaatcatttaaataattggttatattttgcattagctgtgaattcaacttattcattcatatgggatattaaaatggattggcatttagaattatttgatgggttgttcctggtaatttctggaaagaaaacttctcattctgttgtttctgtttctaattatcgattccaaattttaaggaaacaattggcattaccaagatcaatcttcacccacgggacctga

SEQ ID NO: 5841 - DNA, 1401 bp, Candida albicans
agtcatctccatttcataaaattcccgctgaattggcatatttggaagaacagaaatcccaaaattgatcccaaaccaatcattgataaaaatgccaatcataatccagtaccaaatagtagattccgattaaaagacttgcctgatttgagtaaattgaaatttttcgatgtcaagaatatttccgtgcagaacaaagaaaccgaattacaatttcattataccactatcaatttaccaccaagttccgatagtgttattgttgatattaaatttggagggttgaacgcattggattatgctaagattaatcagtatgtgttgaatcttagtaatgtcaaagttggaatgggatatgagttttctggggttatcaccaacgttggttcgtctatggccaagaactattctgttggagattatgtttttgggttaatagaccctacatcaagacgtggatcattatcatcaagtcaattgatttaccctaatcgtgatgttttgataaaagttgatgaagaaactttgaataagcttcaccaaattgatatcaatataaatactgcaggagtcggaaaagattttcaaattgaagaagacgaacagtcatcaacaaccccaaaagaagatagcaaatacgaggttgcttcaacaagtcacaaaaattctgaaccacatagtacacttcctccattggcaaagttgtgttccttccccttattgtacaatcattccaaacaattgcttcaacacttgaatcctaaaaatactgaggcgaatattttgattaatggtgctgatataaaccttggcttaacattgctacaaatcttgttgatagagtatccaaaccttgaatacatgaagcttattttagttattcgagagaaatctttgaaattcatggaaggtattgttgatcaatttcaaaaaaaatattacaatccttcacaaacaagagattttaaaattataagttttgatttatttaatgatggattgtatttccctggggaaaaaattcctgttaatttcaaaaaaccaaatttttttgctagtgaagtgatcaatgcattattagtaccacttcgtcataacggtgatgttggagaacaacaaaaaattgatgagaaaaacattaatgattataaattggatatgattattgatttaattggatgtaagaaatatttccaaactaatagtactaaaattaatgaaattgaagaaatcaatttaccattcaaacaaaatatttccacttctcttgggaagttattcaatgggaatgtcagagcaccatttttgacaatgaatttgaaacccaaaaaatatggatctagcttagttaatgcatgttatttcgatatcagtgagcccacttatgataatgatcattag

SEQ ID NO: 5842 - DNA, 1620 bp, Candida albicans
agattaagaaccagaaatctcgctcaagtgattgaaattgctgaacatgctggaaaggaagaagaattaattactttcttggatatggccagagaaacattaagagaaccagttgttgatggtgctcttattaatgcttatgccactttagatagattgagtgatatggaaaaatttgttggtggctccaatgttgctgatttggaagctattggtgacaaattatttgaagcaaagaattataaaggtgctaaaattttgtattctaacgtttccaaatattccaaattagctactactttggtttacttgggtgattaccaaggtgctgttgactgtgctagaaaagcttctaacactcaagtttggaaacaagttaacagtgcttgtattgaaaacaaagagttcagattggctcaaatttgtggtttgaatttgattatcgatgctgaagaattgcctgaattggtcaagacttacgaatacaatggttatttcaacgaattgattgctcttttcgagaatgggttgagtttggaaagagctcacatgggtatgttcaccgaattggctatcttgtatgctaaatactctccagaaaaagttatggagcatttgaaattattctggtctagaattaatattccaaaagttttgactgcatgtgaagatgcacacttgtacccagaattgatctttttgtactgtcattacgaggaatgggataatgctgcattgaccatgattgaaaaatcagaagttgcatttgaccactcttctttcaaggaaatcattgttaaggcaccaaacttggaaattcattacaaggctattcaattctacatgaatgaaaacccttcgttgttggttgatttattgaaagtgttaacaccaaaattagatttgccaagagttgttagaatgtttgttcaaagtgacaacttgccaatgattaaaccatttttgatttctgttttggataagaacaattctgttgttaattctgcttaccatgatttattaattgaagaagaagattataaatctttgagatcatctattgaaaatgaaagcaacaatagattcaataaattggatttggctgaaagattggaaaagcatgatttgattttctttagacaaattgctgctactttatacactaaagaaaagaaattcaatagagccatttccattttgaaaactgacaaattatggccagatttattaagaacggttgctatttccaaatctaaaaagattgctcatgaattattagattactttgttgaaacaggtaatcatgaatgttttgttgccttgttgtatacttcttatgaattcattgctaatgattacgtgatggaattatcatggttgcacaacttgtccaactttattaaaccatatgagatttccattgcttttgaaaatcagaagaaattgaatgaagtataccaagatttacaaaagagaaaagaagcagatagaaaacaagaagaagaaccaggtgttggccaaccattgatgcttactaatggaccaatgagttatcaaggtactggtgccactggaattggttatcaaccaactggtactggatttggtaatgcattctag

SEQ ID NO: 5843 - DNA, 1176 bp, Candida albicans
acattttctttccaacctgatggttccccagatttcccaatcagtttacaagcttctaacaagtacggtattgtttatgtattgaccaaatacgggttcattcacttgtatgatatggaaactggggccaacttgtttgtcaacagaataactgccgatccagtattcactgcttctagttataacgatggcactggtttaataactatcaacaaggctggtcaagttttaagtgttgaagtttcccgtgacaagatcattccttatgttttggataaattatcaaatgtcccattggctttagctttatcctctcgtggtggattcccaggggctgaaaacttgttccaacaacaattccaaacttacttgaaccaaggtgattacagtaatgccgctaaagttgccgcttcatctgagcaattgcgtactcaagataccatcaacaaattgaagaatattactcctcaaccaggccaaatatcaccaattttgcaatatttctccactttgttagacagaggtactttgaacaaatttgaatcgattgaattggcaaaaccagttttacaacaagatcgtaaaccattatttgaaaaatggttgaaagaagacaaattgacatcttcagaagaattaggggatatcgtcaagtcttacaatgatacaactttggcacttgctgtttatattagagccaatgtaaatatcaaagtggtttcttgtttagctgaattaggccaatttgataaaattttgccatactgtcaaaaagttggttacaatcctgattacaccaatttgattcaaaacttggttagagtcaaccctgataaggccagtgaatttgctacttccttattgtcaagtccagatgccaacttagacgttgaacaaattgctgacttgttcttttcacaaaattacattcaacaaggtactgcattcttattggatgctttgaaaaacgacactccagctgaaggtcacttgcaaaccaaagttttggaaatcaacttgttacatgcacctcaagttgctgatgccattttaggtaatcaaatgtttagtcattatgataaaccaaccattggtaaattatgtgagaaatcaggattattccaaagagctttggaacattatgatgactgttcaccaccgggatggaagatccga

SEQ ID NO: 5844 - DNA, 825 bp, Candida albicans
  unsure (276): Identity of nucleotide sequences at the above locations are unknown.
acaatgtcgaacgatattcctattgactttactgaattaacccagttgatcgaattgggaattccacagacttcgttggatttcaaatcaacaactttggaatcagatcactacatatgtgtccgtgaatctggagctcaaggaaacaccgtggcaattgtcaatttaaaaaacaacaatgaagtgactagaaaaaatatgacggctgataatgccattatgcatcctaaggaatttgttatttcattgagagccaatggaaccactttacaaatnttcaacttgggatcaaaacaaagattgaaggctttcactatggatcaaccagtgatattttggaaatggctcgacgatacatatttagggttggtaacacaatcatcaatctactattggaatgtatttgatggaaccaacaatggaccaaccaaattgaccgatagacaccacacattgaacaattgtcaaatcataaactttgtcgctgaacctgatttgaattggtttgctgtcaccggtattgctcaagaagatggtcgtatcgctggtcacatccaattatactcaaaatcaagaaatgtttcgcaagctatcgaaggtcatgtatgtaaatttgcttctatatctttatctggaggtgtccaaccaactaaagttttctgtgttggtaacaagaatgcccaaggtcaaggcaacatgcatattattgagattgatcatgttgatggcaatccccaatttcaaaagaaagtggttgacattttctttccacctgatgcttccaagatttccgtcctcaccaggcggcagaaggatcaaacgtcc

SEQ ID NO: 5845 - DNA, 1143 bp, Candida albicans
  unsure (889),(917),(953),(958),(969),(1034),(1112),(1117): Identity of nucleotide sequences at the above locations are unknown.
tcagatttgattggtgctgccaaattaatcaaaatttttgaagagtacaagtgtactgaaggattgtactattatttaagttatattgtcaatttgactcaagacccagatgttgttttcaaatacattcaagctgcaggtagaatgaaccaaaccaaagaaatcgaaagagtggttagagataacaatgtttataacggtgaaaaagtgaagaactttttgaaagaatttaaattggatgatcaattacctttaatcattgtttgtgatagattcaactttgttcacgatttgattttgtatttgtacaagaatcaatactttaagtttattgaagtttatgttcaatcagttaatccagccaatactccacaagttgttgccggtgtattggatgttgattgtgatgaaaacatcattaaaggcttgttaatgtctgttttgggtagagttccaatcaaagaattggttgaagaagtcgaaaagagaaacagattgaaaatcttgttaccattcttggaaaaaacattagaaggcggatctaatgatcaagaagtatacaacactttagctaaaatctacattgattccaacaattcaccagaaaagtttttgcaagaaaacaacaactacgatacattggttgttggtaaatactgtgaaaagagagatccatatttggcttatatatcttattctaaaggtggcaacgatgaccaattgatttctattaccaacgaaaataaaatgtacaaataccaagccagatatgtgttatctaagtctgacattgagttatggaacaaagttttaagctctgactatatccacagaaaaaaattggttgatcaagtcatgtccactggtattccagaattggatgacccanaaacaatctcaattactgttaatgcatntatggaaaatgatttaccagaagaattgatggaatnattanaaaagatcatnttggaaccatctccatacagtgaaaatgcgtcattacacggattgatgattttgactgctatcanagctgaatcatcgaaggtgtctagttatattggaaaaataaaacgatttgaacctaacgaaaatgctccattatgtantgaanatggaatgcatgaacaaggcttttga

SEQ ID NO: 5846 - DNA, 522 bp, Candida albicans
ttcagttcagttcaacaattcattaattcattaattcaaactaatcacagcatggctttgaatttatcaaatattaaaaaggcatattttgacaaactattccttgtccagaatgatacaacagcaacagcaaccacgacaagtgtgtcgtctaacaattctactccaccatccaaaattaagccaagagtattgttattagacaaatatactacaccgattatatctatgtgttatactcaatctgaattattggcaaataatattatattaattgaattattacaaaactatcatgacttatcttcgatgaaacatttagattgtattatttatataaaaccatgtcaagaatcggttaatgatttgcgtcaagaattgcataaccctcattatggacaatataagttgtttttaaataattgtattcataaaaatcaattagagtcaattgctgaagctgatgaatatgaagttatcaccaaagtgatagaaattataccaagattatcttattattaa

SEQ ID NO: 5847 - DNA, 246 bp, Candida albicans
agactacatatcatgcttagtttgtctagtagtaaatgcgttgccgtattggttatgcttttgcaattatccaatgcattacatttctacgttaagaccggggaaaccaagtgtttctacgaagaattgcctgagaatactttggttgtgggcaaaatccatgcttacgaaaaacaagatcatagtaacgaatatgtcaagaatccaaatttaaaggttcaaattatagttgaagtatgtacataa

SEQ ID NO: 5848 - DNA, 435 bp, Candida albicans
gaaacattcgacaataaccataaagttgccaatcaaaagtctgctccagacggtgattttgcatttacatcattggactctggggaacatagattttgtttgacaccagtctacagcgataacactaataataaggtccatcgtatctttttcgatgttgcccaaggctctgccaacgaatatgtcgactctaaatcaactagaatggtggatgatttgactggtaaagtgaatcaattatatgataaattggataaaatacactgggaacaagaacatatgagagaaagagaagctacctttagagaccaatccgaatctactaattcaagagtagttaagtggtcaattgtgcaattaattgttttagtgggtacttgtgtctatcaattacgccatttgaaatcgttctttgtcaaacaaaagattgtttaa

SEQ ID NO: 5849 - DNA, 186 bp, Candida albicans
aaaacccaaatttcgaatatggtcaacttcttaaatctaattctaatggtacttattttgttcttactcttgataatgtccatagaaaatactgttgggtacgttgattttgataaaattgatggattggaaggaactattattgttaatgttgttgcccatgctcaagctaatgaaggttactaa

SEQ ID NO: 5850 - DNA, 858 bp, Candida albicans
ttgaaagatccttgtccatgtacagaacaggattttgaagggggtcctggatttagacttctggaaaaggaatcgactaatgtatgtgatcctgatcgtacacaacttacgcaattatgtcaatctaaaagtgaaattacttggcctaataaagttttagttgaaggtaatacatgtaatatgggagataaaaaattggaagattttgtttctcaagaaacattgaaatgttcagattatgttgataatggtggggatggtaatggggatgaacaaaaccctaatcaaggagattctaatcaaattgaagttcatattaatgattttgaaggtaaattatcccaatatcaatacatcgccgaatctaaagataataatgctgctgataatgttgtcatcaagaccatggatgatcgtctttggatatctaataatggaggtgtttcatttgtaagagtgccaatatctgataaaattcttggattttatgccggtccaattcctggtcaaattacacttataacggctacaaacattatttatgtttctgatgatggtggtgcaacatttattaaacggaaagttccaacccaaccatcacctagagttgatagagctattgcattccatagtaagaatgtggaaagatttatttggtttggtgaagaatgtgaatcaaatggtagatgtacatctaatgcttatatcactgatgatgctggtgccacgttcaataaattaatggctaatgtgagaacttgtgattatgttggagcagtattagaatcgggagatcatgaattaatttattgttccggacaaaattctcttgacaataataataataataaaaattaa

SEQ ID NO: 5851 - DNA, 759 bp, Candida albicans
ttagacaaactcaaacacttcaaaatgaggaataataattggaattggctaatattcttggtgccatttattttatccttaacaactgcttatactccagatatatcagttgttaaaaacaaatcaccagcaagagaaattaaatattttgatgattcttccaatttattagttttaagagatgaacatcttttgatctcgaaaaatgacggtaaatcatttgaagaaattcctgatattaaagatccaattatttattttgaaatggatccaactaacaagaatcgtgcctttgccatgacactttctcaaaaacaatatattacagaagatcagggtaataaatggcggacatttgaaattgatattttcaatggtgaaatggcatcaattcctaaaattacttttaattttgaaaatccaaattatttgatgatttcaaattatgaatgtcctgaaggtcaaagattaaatcgtaattgtaaacatagatattttttcacgaaagatgggtttaaatcaaaaccaaataaattacctgtcgatgctcatgtttgtcgatttgctaaatcaactaaaacctccaaaattggtaaaagtgaaacgattttttgtactgttaatcaattgaattcttatggtcatattgttgaatctcatttatataattcaaatgattttttccaaaataaaaatgacattaaaattaaacctttggattcttcaagtggtgaaatcattgatgttaacatacaataa

SEQ ID NO: 5852 - DNA, 804 bp, Candida albicans
agagaaaatttagcagctcaagagaacaattctgagcttgaacaggaaatgtggtcacaattgttgcttgtcccagtatcacattttaaatcaattaagactttattgtcattagagaacttttatcatttttataccaagttggataataaagctttacaaaaacaaatagccattgcgattgtcgatagaattttagagattgctagtgataatgataatgaattattgcacagtgtcgacgaaattgatggggtattcaagtatcttatggtattaattaaagagtcaccaagtaaattagacactgctaagcatttgggggtaactaaaaccatcaaagtgaataacggtgaggcattgattacggaggaattccttgaaactcaagagaagatttgcaagttaattcatcttgttgaacttagtgatgatcctattaaaaatgtttctaacttgatgtatgttagaaagaagtatttgaacaaaaattttgagaatatcattcatacttatcccactttgatatcgaaaattttattcaaattgaaattagctggttatgttaatttacatcaacgaaagaaaagtagaagcgatacagtggatttacaaatcacatcaaactttaagaatttgtcggtgattattgatgaattgtatcaatatcatcaagaatattcatctgaattgattctcaacatctatttgaacgttgctacagttgctgaccaattgaaactagaatccatatgctatgaattgttcaatcaatgctttgtcgtttatgaagatcttcaccac

SEQ ID NO: 5853 - DNA, 780 bp, Candida albicans
ctttcttttgactttaatttttcaattacatttcttactatcatgcaattgtcagctggagagcagaattcgatacttcaaagttgtattgccaatatcaatcaacaatccaatcttatgaaacatgatttaaatgagaataaattattaccggcattgaaacactgctctaattttcttaatgaattgagaacaaattcattatctccaaaacaatattacgaaatttatatgttagttttcgattcattagaaaccttatcaacatatttactaaactcccacacagcaagacaaaagtcgaagaatcgcgaggctaaaggcaacgacaccatcaaaaatggaaaacctgagaatgatggggaaggcacatcggcgtttttagcagatttatatgaaattgtccagtattcaggtaatattgtacctcgattatacatgatgattgttatcggtacaacctacatgtcgattgaaggatcacctaaaaaagatttaatgaaagatatgattgaaatgtgtcatggagtgcaacatccaatccgtggattgtttttacggtattatttatctcaacgaacgaaaaatcttttgcccttccaaaaccaaatagattttgaagagacagtagaatttttgatcaagaattttattgaaatgaataaactttgggtcagattacaacaccaagggcattcatcggaacgtgaattgagatatcgtgaacggaaggaactgaaaattcttgtcttcaccaagccgctggaaagaaaaccgctc

SEQ ID NO: 5854 - DNA, 1053 bp, Candida albicans
agtgctactatgtcgatattttttaaggcgccattagatattgaaattaggttagataatgaggatactcggaagcacgttgaagtgaaaactccgcaaggaagagttgaaaagctccctatttacaaggatggtgaatcagtgaaaggtgtggttacgttacgtactaaggaaggaaggaaattggaacatcttggtgttagagtgcaattgttagggtccatcgaaactaatactgatggaatactgtcgtcggaatttttaacattagccacggaactagccgctccagcacaattgtcgcatcctgaatcatatccttttgaatttaagaatgtcgagaaacagtatgaaagttatcgtggcaagaatgtcagactaagatactacattaaagtaacagtgttgagaaagtcgtcttcggagataattagggaaaaggaattgtgggtctatcattacaccacagcagttcccaaaccggtaaccggattgagcagtagctctacagccgattcaaaattgggtgctaagaaagccaatgaagatactttacaaaagcctgctacgccatccagtaatgatgatgccagtgctaatactagtaagggaagtactatatcaaaaaggaatgaatcccacagtgtgaaaatggacgtagggattgagaattgtttgcacattgagtttgagtattcacggtccaggttttcccttacagatgccataataggtaaaatatatttcttattggtgagattgaaaatcaagcatatggaattgtcgttgatcagaagagagactgtgggagcaccacctaatcaagtgacagacagcgaaacagtagtcagatttgaaatcatggacggtgcgccggtcaaaggcgagacaataccgattcgtttatttttaagtgggtttgatttggtgccaacttatagagacgtcaataagaaattctcaacaagaacttatctttcacttgtgttaattgatgaagatgccagaagatatttcaaacaaagtgaaatcattctttatcgagatcagtag

SEQ ID NO: 5855 - DNA, 633 bp, Candida albicans
ttgctttgtatattgaaacaaactcaaaagatgaagatttattacattggtattttaagatcaagtggagacaaggctttagagttaacttcagccagagatttatcacagttttcctttttcgaaagaaatggggtatcccaattcatgacttttttcgcagaaaccgtatcccaaagaactcaacctggacagagacaaagtgttgaagaaggtaattatattggtcatacttataccagatcagaaggaatttctggtatcattataacggacaaagattaccctgtaagaccagcatatacattaataaataaaatcttggaagaatatttatcattgcatcctaaatctgattgggaaaacattgataaagcaaatgaaactttacaatatggacaattagaagcatatttgaaaaaatatcaagatcccactcaagctgattcaatcatgaaagttcaacaagaattagatgatactaaggttgttttacacaaaactattgaaggggttttacaaagaggagagaaattagattcattggttgacaaatcagaagcattgtcaagttcttcaagaatgttttataaacaagcaaagaaaaccaattcttgttgtgtgattatgtga

SEQ ID NO: 5856 - DNA, 930 bp, Candida albicans
agattgaaaattatggatgcggtattaatttcattattaacaatcttactaggatttgttttaatactaattatttttttcatacaaactggtgggttgaaatccctcgtatcgaccaccacatccaagaaatcatcactttatcatccaactttccttatactaggagcaaacaattctgggaaaacatctttcttctacaaattactacaattatctaatgatgatgagatagatgacaaggccaacactactaccgttgctgccacagtatcatcattggaaccaaatgttacaaagataaatttaccaatttccaatccatcaattggtaaaccatttcaattgattgattatccaggacatttgaaattacaaaaagtgtttgaacgattaataattgatgaaataacattaaagaatcttaagggggttgtatatatgattgattcttctagtgttaatattaatgatgacaccaatttggaaagtattgttaaattcttgtacaatttatttagtattacggaacggatacctaatggagttgattttttgattgctattaataaaactgatttatttgattctgtccctgttcataaaataaagacaaaattagaattggaaatcaataaattgatccgtcatgaaattgaaaatgttgaaaaaacttcgggcattgacgataatgataacgataatggtaatcagaatagcaacggtggtggtggtaatagttccaatggtgataacagtgatggcattaacggtgaaagtttgagagcattttggatgagtgttgttgggtctggaaatttcacttttgataagttggaaggtaatgttgattttgttggtggtagcgttttgaaaaataagattagtcaatgggaaaattggtttgatgaaaaagttgttaatccataa

SEQ ID NO: 5857 - DNA, 1299 bp, Candida albicans
  unsure (3),(29),(53): Identity of nucleotide sequences at the above locations are unknown.
tanacagagttcaaaggatatcggagctnagaaactatcagggacgcattganagatgaaagaaacttttttgaaaatcacccatcatacagagccaaagcccaattctgtggtactccttacttggccaagaaattgaatggtattttgttgcaccacatcaagagtactttacctgacatcaagatgagaattgagcattcattgaagaagtatcaacaagaattatcaatgcttggacctgaaatggctgagtctcctgcatcaattgcattgagtatgatcactaatttctccaaagattacactggcatcttagatggtgaatccaaagaattgagctcacaagaattgagtggtggtgcccgtatttcctttgtgtttcatgaaattttcaagaatggggttaatgccattgatccatttgatcaaattaaagatgctgatattagaacaattatgcataatacctctgggtcggcaccctcgttgtttgtcggtacccaagctttcgaggtgttggtaagacaacaaatcaaaagattggaagaaccttctatcagatgtatcaatttaattttcgatgagttagtcagaattttatcacaaattattagtcaaccacaatattcaagataccccggtttgaaagagcaattgtctcagaatttcattttatacttgagagatttgttgattccaaccactgagtttgtcaatgatataattcaagctgaggagacatatgttaacactgctcatccagatttgttgaaggggacacaagcaatgtctattgtggaagagaagttccatccaaagccacaagttgctgttgatcctaagactggtaaaccattgccgccaagtcaacaaccagcacaagccacatcacctaaaccagaagatgggtcatctaatggattctttggtggattcttttctagcaaaaacaaaaagagattacaacaaatggaagccccacctccagtattgagagccacaggtactatgagtgaaagagaaactatggaaaccgaagttatcaaattattgatttcttcatactataatattgttaagcgtactgttggtgatgttgttcctaaagctattatgttgaaattgatcaacaaatccaaggatgagatccaaaagactttattggaaaagttgtacagcagtccagacttggatgatttggttaaggaaaatgagcttactgttcaaaagagaaaggaatgtgttagaatggttgaggtgttgagaaatgctagtgaaattgtttctagtgtttag

SEQ ID NO: 5858 - DNA, 570 bp, Candida albicans
aaagttatatcaaaaatggatgagacattgattgccaccattaacaaattacaagatgcattggctcctttaggtggaggatcatcctcgccagtagatttgcctcaaatcactgttgttggatcccaatccagtggtaaatcgtcagtattggaaaatgttgttggtagagactttttacctagaggaacaggtattgttaccagaaggcccttggttttacaattaatcaacagaagaccaagcaaggatttgaagaaagctaatgatttggttgatgttaatgcttcagaaagcacaggtggtcaatcagaaaataatgctgatgaatggggtgaatttttgcatttgccagggaaaaagtttttcaattttgaagatatcagaaacgaaattgttagagaaactgatgccaaaacaggtaagaatttgggtatttcaccagtgccaatcaatttgagaatttactctcctcacgttttaacgttaactttaattgatttaccagtgttgaacaaagtcccgttggtgatcaccccaaatatattgaaagactattcccagatttga

SEQ ID NO: 5859 - DNA, 717 bp, Candida albicans
tatattgtataccttcacctcatctatttattccaagttaaatttattttcatgtcgaacaaacaatctaaccaacgttttgcccaattcaaacttgtgcttttaggagaaagtgcagttggtaaatcatctatcgtacaccgttttgtcaagaacacatttgatgatatgagagaatcgactataggtgcagcatttttaacacaaacaataactataccggaatccgagacgacgattaaatttgaaatatgggatactgcaggacaggagcgttacaagtcattggcaccaatgtattatagaaacgccaatgctgcattatgtgtttatgatataactagtcgtagctcatttcaaaaagcccaagattggatcaaagaattgaaaaagcaagctccagaaggtattgttattgctctagttgggaacaagtctgatttagacgatgaaagagaagtcgaatcaagtgaagtgcaagagtatgttcaagagcaaaatagcgatggctgttctataattactgctgaatgttctgctaaatctggagatggggttttggatgtatttaacaaaataggaagagctttacctgtggacgaagttatagatgctagtagatcaagacaaggtgctggtgctggaggaagaagaccaggaggtgttgatttgaatagacctagaggtcaagtaaatcaaagcaactcttgctgttag

SEQ ID NO: 5860 - DNA, 615 bp, Candida albicans
aatattcttttaggagattcttccgtgggaaaaacgtcgcttgtacacagattcacaactaataggtttgatacacatactcccaataatattggtgcagcatttataacaaaggagttttcgccccatgaaaaccatgagcgtaaagtgaaactagagatatgggacacagcaggccaggaaaggtaccgttcattgactcctatgtactatagaaatgcgagggtagccctagtgtgttttgatttgagtaagtttgaaagcacattcaatactgcgaaatactggattcaacagttggaactaaacaattcttctgattcaagagaaaagatagagattcgattggtagggaccaaacgggatttagtgtcaacaatagacgacgccactaaagaccaagtcaataagttgataacagaacagtccaatgttgtaaaattccatgaaaccagttcaaaagaaggcacaggaattgaatcattgtttgaagccatagtgacaaacatagaagagacgtttttcacacaatattatgaacaaaatcgtgatacttctgatcaaataggaaacatgctacgtacgagacagacatctaactcatattgctgttaa

SEQ ID NO: 5861 - DNA, 486 bp, Candida albicans
agacaacaaaaagaaggaattaaacttgaagatgcaaattataatgtcaagagaaaactttggttaaaatttgctaaatatttaatcgatagactggatgacttgaatgaaacattgcatcacatcgtcaatgtttcaatgcttgatttgaaagaccttttgccattatttccggaaacgatactgattaataattttaaagacgagatagttgaatcactaaatgagtataataaacgaattgttcatttgtcgttagatatgaataactcgtctgagcatttgcgggaaatgaagaaaaaagtgatttataacaaaaagaaaacaaatgtggccataatagaaccaggtgaaccgtgtcgcaaatgtggcaaattgttagtacaagagaactttgtttattttccaaattgccatcatgcgttccataaggagtgtatgaaaaagaaccaatgtttattatgtaatgattttttgaatttatag

SEQ ID NO: 5862 - DNA, 2436 bp, Candida albicans
atgtcatccaacgggcataaaaccaaatccataaagtcggaaactaattcgtcatatacagttcattcattagatcaacaacaggcgtcaatatgtgataatctacaacaagcgaaatttgaattagattcagtacatttacagtttagtttatcgaataaacttaacaagctattggtatcaagcaatataatgtatatcctattaaccaatgttgtttataagattgatttggataatccttcacaggtggagaattatgcgttgcctggtaaagtaacgaatgcttggttgaatccaaatggtcaaactttgattgtgcagattgagaaacagacgtactatacatttaaaaagaaggtatttaaatcgttgaaattcaaaagtatagaagtcacatctattgcattttctaatcacaatatggtggtggggacaaaagacgggataatctacgtttatgaaaaatcattaaaacaggtctacaaagtcgattccccagtacaaggagtaatgttttccaatgattattctcaaatcaatgttttagcaaacagtttatacacctgggattgttttgatacttcatatgttgagttgcaaaaagtatttaaacaaacagcacctgttatcaaatcaattaacccacctgtgatattcacgtcaaacccacagaactatgtgtatatatcatcagataatgaaataataaccaacgacgaggaaatgcaattggatcgagttgatgaggggtttctgcaaattgcacttgcaccgcaccatcttattggtattgaagggaattctttaaagatatataacaaacttaacaagcaattgcaagagttgagcctttctgagaacaaaatacgaggaatcgccgtggataacttattcaacacctattgggtgtacaccaaaaactctatctacgagtttgttattgaaaacgagtcaatcctggtttggtatgattattacaaaatgggaaaatattcagaggcattgaaatatttggatgaagatgatgaggcaaattttctgaaacgtgatttagttttgattaagcaggggtatgattatttacaacgtggtggatttggaatactgtcggatgacttgagtttacagatacaggggattcaaatattggcaaaactgactgaaccatttgaaaaagtttgcttgatgttacttaaccataaacaatctgatgctttactcattgaatatttgttggccaaattgaataaaaagaataaagtccgagtaattgtgttgtcagcttggattattgaattgatggtgagaaatgatgattcgagagtttatgaattcattaaaaccaattataagctactcgatcgtcctacaatgtatcaaatattgaattctgagaaattgattttctatgccgaattgattgaagattataatttcattttaaagtattacattgataaaaagaattggacattagcggttaaaacattaataaaactttacactaaaggagatattgaaatagtttatgaaaatgccactattttgttaatgaactacccaaaagtgactgaaacgtggttaaaacttgatttggaatatgagaaacttttaccggcacttttgaagcaccaagagcaagcaattcatttcttacaacaagtcattatggataaacactacaagaaaaacaaacagttaaacaatgcttatttgtgtttattaattacaaaaccaggtactgataaacaaataataaaatttattaatttcacatccaattttgataccaatttcattcttcggttatgcatatctcacgaaaaatttcatcctgcggtattgatctacattgaaattgggttatttgatcaagccttagaacttgcccttaaacacgatttgactagtattgatgaatttatattgaacaagtacgccgaggacaaacaagtagagggaattaaacttgaagatgcaaattataatgtcaagagaaaactttggttaaaatttgctaaatatttaatcgacaaactggatgacttgaatgaaacattacatcatcacatcaacaatgtttcaatgcttgatttgaacgaccttttgccattatttccggaaacgatactgattaataattttaaagacgagatagttgaatcactcaatgagtataataaacgaattgttcatttgtcgttagatatgaataactcgtctgaacatttgcgggaaatgaagaaaaaagtgatttgtaataaaaagaaaacaaatgtggccataatagaaccaggtgaaccgtgtcgcaaatgtggcaaattattagtacaaaagaactttgtttatttcccaaattgccatcatgcgttccacaatgagtgtatgaaaaagaaccaatgtttattatgtaatgattttttgaatttatag

SEQ ID NO: 5863 - DNA, 1983 bp, Candida albicans
cctggtaaagtaacaaatgcttggttgaatccaaatggtcaaactttgattgtgcaaatagaaaaacaagcgtactatacacttgaaaagaaagtatttaaattgttgaaattcaaaaatatagaagtcacatctattgcattttctaatcacaatatggtagtggggacaaaagacgggataatctacatttatgaaaaatcattaaaacaggtctataaagtcgattctccagtacaaggagtaatgttttccaatgattattcccaaatcaatgctttagcaaacagtttgtacacctgggattgttttgatacttcatatgttgagttgcaaaaagtatttaaacaaacagcacctgttatcaaatcaattaacccacctgggatattcacgtcaaacccacagaactatgtgcatatatcatcaaataatgaaataataaccaacgacgaggaaatgcaattggatcgagttgatgaggagtttctgcaaattgcacttacactgcaccatcttattggtattgaagggaattctttaaagatatataacaaacttaacaagcaattgcaagagttgagcctttctgagaacaaaatacgaggaatcgccgtggataacttattcaacacctattgggtgtacaccaaaaactctatctacgagtttgttattgaaaacgagtcaatcctggtttggtatgattattacaaaatgggaaaatattcagaggcattgaaatatttggatgaagatgatgaggcaaattttctgaaacgtgatttagttttgattaagcaggggtatgattatttacaacgtggtggatttggaatactgtcggatgacttgagtttacagatacagggaattcaaatattggcgaaactgactgagccatttgaaaaagtttgcttaatgttacttaaccataaacaatctgatgctttgcttattgaatatttgttggccaaattggataaaaagaataaagtccgaatggttgtgttgccagcttggattattgaattgatggtgagaaatgatgattcgagagtttatgaatttattaaaaccaattataagctacttgatcgtcctacaatgtatcaaatattgaattctgagaagttgattttctatgctgagttgattgaagattataatttcattttaaagtattacattgataaaaagaattggacattagcggttaaaacattaataaaactttacactaaaggagatattgaattaatttatgaaaatgccactattttgttaatgaactacccaaaagtgactgaaacgtggttaaaacttgatttggaatatgagaaacttttaccggcacttttgaagcaccaagagcaagcaatccatttcttacaacaagtcattatggataaacactacaagaaaaacaaacagttaaacaatgcttatttgtgtttattaattacaaaaccaggtactgataaacaaataataaaattcattaatttcacatccaattttgataccaatttcattcttcggttatgtatatctcacgaaaaatttcatcctgcggtattaatttacattgaaattggcctatttgatcaagccttagaacttgccctcaaacatgatttgattggtcttgctgaatttatattgaacaagtacgacgaggacaaacaagtagagggaattaaacttgaagatgtaaattataatgtcaagagaaaactttggttaaaatttgctaaatatttaatcgacaaactggatgacttgaatgaaacattacatcatcacatcaacaatgtttcaatgcttgatttgaaagaccttttgccattatttccggaaacgatactgattaataatttcaaagacgagatagttgaatcactaaatgagtacaataaacgaattgtttatttgtcgttagatatgaataactcgtctgagcatttgcgggaaatgaagtaa

SEQ ID NO: 5864 - DNA, 1125 bp, Candida albicans
tttcattacatgtcttcatcacagcctagaactaaaccttgggaagtatcgcaaggaaaatcagcagcatcaacaactgaaccactaacgagtaatataccgccatcttcattatcaaactcctcaacaactgccacagctcaaggacaaccacaactgcaaatacagccaccgtctgtgccagaacttcctacctcgctttcatcagatttgaacaccatggcagaatcttcgccgtatgggggttatggaaattcgtcaatgaatcgatacggcaccactggtggctatggatcaagcatgtatggtggtggatatggatccagcatgtatggtaactcgatgtatggcggtggatatggatccagtatgtatggaggtgggtaccgaggttatgggagtggatatggtggatatgggagctatggaagtggaatgtacggtggtggaatgtatggtaacaacccttcgatgatgggacaaggaggactaggagaaggtacccaggctacatttcaattgatagagagtataataggggcagttgggggatttgctcaaatgttagaagccacatatatggccacacactcgtcatttttcacaatggtcaacttggcagagcaatttggcaatttgaagaacgcgttgggatcaatattaggtatatttgccttgataaagtttgttaaaaagatattctacaaaataactggtcgagtttataactatggcatcaacgcttcagaatttaccaagtttgaaaaaaatcaaaagaaattagaagaaaacttaagaagaaatcaatcaggccagaaaccaagaatttcattaaagccattggtgcttttcttggtggctgctgtaggattcccatatttattatccaaggcaatcaaactcattgaagaaaagaatcaacgcccaccacctgttcctagcaaaattcagtttgcgagagccttgtatgagttcaacccacaaaacccacaagttgaagcaccattggaacctaaagaaattgtagctatattggacagcagggataactggttgagaattagaaaaagaagcggaacaatgggatgggttcctctgaattatgtagaagtcattgatacttag

SEQ ID NO: 5865 - DNA, 291 bp, Candida albicans
aaaacaatacaagaattatcattgtttttgatgagtagaactgatgcttatttaagaactaaggattatatcaaagctttcaatgatgctgattttttgctcaatatgcaattaaacaccccagataactttttgagaaggggcgttgcaaatttctttttgggtaattatgaagcagctagaagtgattatcaaagaggattgacatttgatgaaaacaacgaaagattacagaaagaattaaacatatgtttagacaaaattctagaagagaatggtgattatttataa

SEQ ID NO: 5866 - DNA, 507 bp, Candida albicans
agactgttgttggagaatttgttttttttttcaccgcaaaatttttacttgctcatccattctggccacctcaccacatccttcccaatcgggaactcaaccttttttttattgacgtgttcggttgtgaaattttcaacacttaaacaacaacaaattttttttttttctttcaacgctactatcttttcttcttccaacaacactattatgagcggatttcgtgttttagatttggtgaaacctttcagtcccttcttaccagaagtcattgcacctgaacgtaaagttcaattccaacagcgtgtgatgtggaccatcataactttgttgatattcttggtaatgtccgaaatcccattatacggtattgcatctagtgattccagtgatccattgttctggttgagaatgatgttggcttccaatagaggtactttaatggaattgggtatctcccctatcgtcgtcttcaccacggggctggaacgatccgcgattgcgaaa

SEQ ID NO: 5867 - DNA, 975 bp, Candida albicans
ctcccccgctttcgcaaatgcggatcgccctcatcggctgtgtgtgaagacaaaggttatggtttgggaagtggtgtctcgttgttcactgctaccaacacttgtgaacaagtattttggaaagcatttgctccaaccacttcaacctccgccaagggaaccgaattcgacggtgctgtggtcgccatgttccacttgttaggatcaagaaaagacaaaaagagagcattgatcgaatccttctacagaccaaacttgccaaacatgttccaattattggctaccttgttggtgtttttcgctgttgtgtacttgcaaggtttcagaatcgagttgccaatgaaatctaccagacaaagaggtccatacggactgtacccaatcagattgttctacacttccaacatccccatcatgttggaaagtgcattggcttctaacatctttatcatctcccaattattgtttatgagatggccaaataacttgtttgtcaaattgttaggtacatgggacgccagagctgggtcctcccaattatacgccaatggcggcttggcatactacatccaacctccattcaactttactgatgccttgttagacccaatcaagaccaccatctatattgcttttgttttagggtcttgtgctgttttctctactacctggattgaaatcagtggtacttccccaagagacgtcgccaagcaattcaaagaacaaggtttggtcattgccggtcacagagacacttctgcttacaaggaattaaagaaaattatcccaattgctgctgcttttggtggtgctactattggtgcgttatctgttgtttgtgatttaatgggtactcttggttctggtacgtctattcttttggccgtcaccactatctatggatactacgagttggctgtaaaagaaggtggattcaacaaatcaattgtcagtggattctccgatggcatttaa

SEQ ID NO: 5868 - DNA, 2118 bp, Candida albicans
actcttcaattacagaaaaacatgaaagacattaatgccactgagaacaacttggcatctaaattccaacgattcaatgacaagacacttgaaaatttaattaatcagatttctaagatctattcatcaaacaatctactcgtgttggatgctgtgttatccccactaataaacagcttaacaaattttacgaaactaaaagaattaggcaaatttcaaaatatagtgtggttggataatgagttagtaagcattgggtcgagtgtattagccaagtatgcgagtttgattgttgttgtaccgacaagttcattggagaacatcaatatattgaataaattgatacattcacaaccagatttgcatagtttaaaacttaatattattgtgaaggatttaaaaatgagtttcatgtatcaaattaacaaagttttcaacggaattgtcaattttgaaagtatattatctccagagaaatatcaaaaacctatatctgtcacatctcgcataaaaatttataattggaagacttcacccatatacacagatgaaattttggttaccgaaatcaataaatttaatggaattgacgattattttagtaaaccacttaaacaagtgaatcagttaagtgaagctttaatgcaattgctttttatgggaatacaaaatgggaagcacgatcatttattcaaattacgaaacatctacggtaaaggaaatcactccaaacttttaatagaccagttgcagaattcaaaaataccagagtttatgaacgagaatatgacgaccttagaaattgacttttattcagatgtacttcacagtaataccgacttggttgttttggaacgaaatctcgattttacttcttgtatattcaatcaattaaactaccatgggataatagatgatatgtttagcattaagtttgaaaatattgagcaattactgagcaacgaaatcagcaagagtttagcgaatgacaagttgtattcacaagacttgaaacacttgaatttttcgtcaattggattgagactaaacaaattggcaaagtatatccaacaacaattcaaaacctcatctgctcaaaaaaattcaagctcatcggaaccaaacataagtgatataaaacaattagtgtccaaccttggtacgttatccatacaacaagaattggtgaaaaaacataccataatcggggaggaagtgatggaaaagataaataaaaattacgaacagtttcttacttttcaaaatgatatttttgagatggactacaaatcccaagttgccaagcttagagagtttgttaattgtaattatccgatcgagtttgttctttcagcaattctattaattggatatttgaatgatgggatttcaaataaagaaattgattggctttctctagaaatgcaagacaattacggacttgaggctgttttcactttggaaaaattgatccagtttaacatgattcgagtcattcatggatcctcagtagactttttcagtagcttggggtttaccagccaaaagaaaaagcccacaacccacagccagtctgaatttgaagatgacaaaaatgttgggatcagtgggagtggagatgtcttcagaaacaactacaccttgatcaataaattttggaacttacacccgttggacgacgacgaatccttatcacaaaacttgacagagtcgggcagtaatgaactgacaaacttgctagatttgtattcaaacccatcttttacattaccgggcaacacagttccacttatttatcgttttgtcgaggcattgtatttcagagatttcttgaaacataaaccaataaataacctcaagagacgtccaaattgggacaatttgggtgtcaatacaatgtttgctggcaaaaccattgatttgaatttggataacgtgaatgacgatagatccaagtacttggtaattgtcgtcattggaggtgtgactcgaagtgaactaacctgtttcaaatacttacaggagaggtttaggaaacaaggaaaaacaaaagagattattatagtatccaatggaatcgttaatagtagtaaactaatgcagtttatgtcgaactga

SEQ ID NO: 5869 - DNA, 600 bp, Candida albicans
aataacaatttgcatgatgatccggtacaatcggagtccacgaatgtaaatcaagttgaaagcagcacaccaaagggcaactttcttgatattgcggggtctgagaaagaacaatctggagtcgaagaattgagtttaaaagtaggagattctgaatctaaaacaactagtgatgtgcccactgaagatgtatcaacctctgacgcaaataaatcccataaacacagattcccaattaatgattcttcggagcaaaacaaacaatcgcataaaccatttgattttcaaacatttttagttcaattacgtaaaaagtctgcagatccaatagtgagatacattcgatcgtttttaagttcattcattagacagggtcacacatttacatctgatcaaagaataaagattattctggatttcaagattttcatgaatgagaagtctacattgtatgaaccatttgcgtctatggatcaaattgatttggagaattctcgtgaacgattaaaaacattgatcatgaatcgtttgcatgatttgtgtttcccccagaaattgttaaacaaaacttgtcttacatccctgaaccttatacactag

SEQ ID NO: 5870 - DNA, 1017 bp, Candida albicans
tttgtgtttcccccagaaattgttaaacaaaacttgtcttacatccctgaaccttatacactagatttgcaaaaggacgagtctttcgctttgcaattggaaaagttttcttggatcaatgggaaccacttggatatcgatatgaatgatttggcaaacaaaattgtgaaaaatgaccagtcatttcttgagtatgccattactgaactaaacaaaatcaacaattacagagcaccacgagataaaatcatatgtattctcaatgcatgtaagattatattcagttatttgaagttaagcaaacaagaaacaaacgcggattcctttattccaatattgattttagtcatattcaaagccaaaacggaccacttgattagtaacattcactatattgagaatttcagaggacaagagtggttattacatggagaaacaagctactatctttcctcgattcaaggtgcagttgagttcatacaaaacattactgcagaagatttgacaatcagtcaagctgagtttgatgcccatatggaagcctgggatgcccagaggaaacagaaagtgcaacaattgaaattagtacaaccaattccaacaatacctacaacaccgacagatggtactggtgaaacaaacttaaaaccagatatgtcccatactccaaatggactttcaccttcgaaggtattgttttctagtgcagagatgtttacaaaatccattaccaactttttatcgccactgccacatttatccgaatctgaacctgaagaatttcaaccaccaccaaattcaccaccacctcaagaccaaaatgatccttcagctcaatatcaaccattacctccaagggaagaagagattaatgctgaacaaatgcggaaagcctacgatacattaattgaaatatttccttcgttagatactaacattttaaaagatgtgatatttatcaatcgtggggatatagatgtctgtattgatgcatgtttacaattggtcgatggttga

SEQ ID NO: 5871 - DNA, 495 bp, Candida albicans
gcttcacctgattcacaatttttacaaagacgtcgtcgaggattacatagatttttaaatcaattaattaaacatccaatattaagtcaagaaccaattgttcaatcatttcttactgtacctactgatttaactacttggaaaaaacaagctaaaattgattcatcattagaatttaaaggtcaaaaaatccaaaccgattttattaatgtgatttggccaattatgggggaaccatttttgaaaaaatggcgtcaagctgaggaaaatattcaatttataattgataaatgggttaaaataattatattagtagaaagatatgaaagacgtccacaacaaattagttttgataatgggaaatttgctgaaatgtcaaatggatttagtaaattaaataccaagatgtatcctgataatgaagataataacaatagtactagaaatgatgttaatgttaatgtagttgttgtcgataataatgacaattattaa

SEQ ID NO: 5872 - DNA, 543 bp, Candida albicans
  unsure (33): Identity of nucleotide sequences at the above locations are unknown.
caagaatttgattttaattcttcaggtgatatnattaatattaatcaatgtgtaaattccattggagaatttttcaataaatcatctcaagtattaaatgatgaaagtgatattattaatactaaaactttagaaaagtttaaaaattatttggattatttgaattcattacaagaattatttgaaagaactaaacaattatcaattaatcaaattgatttattagataaacgtataaaagatcaagaaattaaatttaaaaaaattagtgaagaaaatcctgatatcaaaggtggtgaattaattaaattaagacaatcaattataaatgataaacaagaaatttttcaacaattaaataaagattggttaattaaacaatgttgtttacaagaatttattattttccaagaaactcaatttttaattacggaactttgggttgaatggtgtaaagatcgtttgaaatgtcaagagaaattagttggtttatatgataatttaaatcaagaaattattcatgatatgcctctagagagatga

SEQ ID NO: 5873 - DNA, 1434 bp, Candida albicans
  unsure (1325): Identity of nucleotide sequences at the above locations are unknown.
acaacaatatttcgatcaacaatgccaagaatcaaaaatcaagtagaaaaggaggaacagttaatagaagaaccaaaacacgagagagataatgagtataaagatgaacaaggggtagagccacaggaagaggagcaggatgatgataatgatgatgatgatgaacaactcgccgaagaagattctgaaatcgccccagcacgcaaaagaggtagaaaacggaaaatcacaaccgttgttgaagatgaagataacaataccacaaaaattagaaagaaagttaaaagtgaagatgatgaaggtcaagcagcaaatgaaaatgaagaagaagatgacgacgacgacgacgaagaagaagaagaagctgatgaagaagatgacgatgacggagaaactgagggggacgggaagaaaaaaagaggtagaaagaagaaacccaaagtacaactttatggggatgatgtatttgatgatgagggaaaccccttaataatagaaaatgatgaagttgtcattccacaagaagatccaaaggggaaagaaaagattgatgaattgggttatcttcaaggggacagaaaatttcgaatgaaaacatttaaattgttaggcaaaggtgatagattatacatgatatctactgagcctgccagattggttggattccgtgattcgtatttgttatttaaaactcaccgtaccttgtttaaaaaagtagccgataatgatgagaaaatggatcttatccaacgagggatcatcccaaactcatataaaggaagagctgtcaatttagtaacagcaagatccatatttagagaatttggttcgagaatgattgagaatggcaaaaaggtgattgatgatttctgggaacaacgggcaattgacaatggtgatatacctggtgaattggcagatcctgatcaattgtacaagactaaattgtccaatgttttaggtgattctggcatagtcagtactggtcatgcgactccgttaactgcgactccaattgtcaattatcaaggagatcctacttggatgtatcaaattgccaaacaaacatctgaatacaataagaaattatatgaactcagaactaataatatgtataaaggctataaagatacttacacgaatttgactttatatccacaatcaacacaaccaacccagataaagtatctgaaatttaacaacaataatgggaaattggtgtacgacattgtcatgacaaataaaaatataaggaagccaattactggattggcaaaagtgccgcaagctatattgaatgagatagatgatccagagataaaacnagcaataatcgattcacaagaatatgaaattagtgctagagaaatattaagaaagaccagctgggacatttttttgtacatttctcttgatatagcattgttactttaa

SEQ ID NO: 5874 - DNA, 993 bp, Candida albicans
aatcctaatgatactgaagctcatgataaatttttagaaattggtgaagcttatgaagtattaagtgatcccgagaaaagacgtaattatgatcaatttggtgatcctaatggacaaccacaaccacaaggtggtggagcacattttgattttggagatatgtttggacaattctttggaggtcatggacatggacatggtcaacaacaacgtcaacaaccagggaaacgtaaaggggattcagcacaattaggattaaatatcccacttctggatttttataatgggaaaattgtggaatttgatgttgaaatgatgaatgattgtgaatattgtgatggaacaggatctaaagataaacaacgtaaagtatgtgatagatgtcaaggaacaggtcatattactgtgactcatcaattagctcctggtatggttcaacaaatgcgcatggcatgcgatcaatgtggaggaattggaaaagttgttaatgatccatgtaatcattgtcatggtcaaggtatatcacgaggtccaagacattatgaaatttatgttaaacctggtcaacctagagattcaccccatgttttggaaggagaaggtgataaaaatccaaattggatacctggtgatttgattgtgttgttaaaggaagaattggacaaaagttggggttatagaagaattggtagtcatttatatcgtactgaagctttaactttgaatgaatcgttatatggaggatgggaaagaaaaattgcatttttggataatgaagaaccacaactcacattgtcaagagatcaaggtattcctgtatttgatggagaagttgaaattgtttctggtaagggtatgccaatagtaactgatcatgatgaagaagaaagatttggagatttatttattgaatataaggttattatacctggtggtgctccaaagggaaaaaattcaaattcaaaaaaaggtgtaacaaaagatgaattatag

SEQ ID NO: 5875 - DNA, 189 bp, Candida albicans
tatcatttcattagtagtaggaaatacctatatattatgtcgtggtttggacgagcaacatcagatgctccagtggcaacaatttctcaagtcgaattagataataaaatcgtggaagcaacatcagaatctatccctaatggagaaattgatttatcaatagcatttgaaatcactgatttaattcgt

SEQ ID NO: 5876 - DNA, 2241 bp, Candida albicans
ctccgcacccttgacattagatccttgccagccgccgtgtgtgaagacatggactatttaattgatttcatattcaaaattcattacaatactaaggagttgacatatggtcatggtggcggtgatgtgggcaataaaattaaaattggagaaatgattttaaaatatttacaaaattggaaaatcatatttgaaaatcaacaacaattgcaatatgttgaaaaaaaatatcaagaattaaaaaatcaaggatttgaattccccgataataataataatagcggtgaaaatgatgattttaatgaccaagtaacacaattgaatagtaaatttgttgttgattcagaagttccacctgattgggtagataatgaagaatgtatgatttgttattccccattttccatgcttaatagaaagcatcattgtcgtgcttgtgggggagttttctgtcaaactcattcaagcaataatatccctttagttaatttaggaattatggaaccagtaagagtgtgtgataattgttttgctaaatatgataaatcgaaaaaacatctgagaaatactagtagtagtggggattataatcatcaactgagatcaattcaaaatgattatggtggtacccatggatcaagaagaccaggaaataacaacgacgatgaccaccacgaagaagaacaaattagaaaggcaatcgaattaagtctcaaagaatctggcgctggtggtagtggtagtggcggaccaaactcgataccatcacaatcaagaccttcagcacaaccaccaattgatcgagaaccagaactggaaacgggtaatgccgatgacgatgaagatgccgaaatgaaagcagcaattgcggcaagtttaaaagaatatgaaacagaaaaatcaagacaatctcaatatcaacaaatacaaccagttcaatctactcaatcaactcaaccagaactggatttgtataatattagttttccaacattttcatcaacttcaaattatccacaaccacaattcactgcatcacaaccaccaccacaacaacagcagcagcagcaggcccaacaacaagctccatcacaagatttatcacaagcagaagaagaacaaatcaatttatttattaccttaatgaatagtattaaaaatgattcaagaaaacaaaaagatattatgtatgataccaatttaaatgaattatatggtaaagtaattaaacttagacctaaattaaataaatctttaagaaattcaattgaaaaatatgaaacatttttagaaatgaataataaaatttcaactataactagattatatgatcaatttttggaacagaaattaaatatggcatatggaaatcatcatattagtacacaatttactggagttccacaacaacaacaggaaggtcaattcactggtagccaacaacaacaacagcaacaacaacctcatcttccagctcaaggtactggttatcctcgttatggtggatctgataccaatgtagcacaacaacaacaacagccaccaatttcacctaatgaattttataataatctaccacaacatacaggatttcaaaattatccatcatatcctcaaaatcaagggacggcacctgataattcatatctttcacaacaaccatcaggagcttccacaaggcaacaacagcaacagccaccaatacaaacctatccaaatcaattacaaccatctgaacccgattttgaagatgatgataatgaggaacctgttaataccccacaaatcagagtagcacataatcgaacatcttctggtagttgtccactttatccaactaatgatattatccctgatccttatagcgctaacactaacaaatcgactacacctaatagcgatgatcataattatgtggcagtttcattacctcattatcctccaccagaagatttaagtaatgaattaccaccacaacaacattatgttagaagagcatcttcttcattaccaccaaatgcttatgaagatgcaagtttaaaatatcctacattagaaaacgttgaacatgattatgataagaagaagaaccagaagcaacaacaatcagttaatgagagtgatttccctgatgtttcaaaagtatcacaatttaataatagaggagaagaaaatgaaggaagaagaaatagtggtgccagtggtgcaagtagtaataagaaatttgttgttgaaccataa

SEQ ID NO: 5877 - DNA, 468 bp, Candida albicans
agacttgttgttgtttgttttgccgttgaattatcacaaattcatgctagtgcaagagatattttccgtggatttgttccttcgaaacaaatgtttgatggtaatgggatgaccattgcaacttctatcattgggtctacagtgatgatccattcgttgtttttgggttcaggattagttcaaccccgtttacgtgactttgacgttaaacatggatatgtgaatttggatgatattctcaacaaaaatgaccaaccacaatttccagttattgaatcatcaacaactacaccatctgagaaaaaagatgacgcaaagaataatgtcaaagtatcaatgtatgaaaaagaagctgattatttttatcattattataaaccatcctatcaatcaattaaatattccttaaagtattccatagtggaattaactatcactttgatcacattagcccttttcgtcaattca

SEQ ID NO: 5878 - DNA, 654 bp, Candida albicans
cggtctaggatttttacatttcatcaaagcattctagtgataaatattccaaaaaaacaacaagaatctttcacttgtgtaacacctaaagaaatgacaactacttcttcctcaacaaacgagtctataagaccgaaaaataaccatacaaccatttccacaactggagtttctacaacattagatcaaactactactactcgttttagaaataattatgacgacaataacaacaatagcgttattagtaaagacagctccacatttgcatatgtcgtgaacagatccaagagtgtacttaaaaaatacggatcatttgttggtccaggaatgttgatcagtgttgcctatatggatcctggtaattatgcaacagggattactgcaggggcatcaaatgaatattctctattgttcattgtgtttttatctaatgttattgccatatttttacaaagtctctgtataaaattaggttcagtaacaggttatgatttggctcgttgttgtcgagaatatttacctaaacaactaaattgggtcttgtggtttttagctgaatgtgccatcattgctactgatgtagctgaagtcattgggtcgcccattgctttgaacagtcttacacggacggggaaggaaggaaacgcgctg

SEQ ID NO: 5879 - DNA, 1521 bp, Candida albicans
attttgaatatttctgtaaaaaaaacacttctaataaccaaaaaaactatatcaatacagatcatggagaataaagtatcagaaatatcagaaatgacaaccgatttaaattcgaattctgaaactaaatttgatcatttaacaagtacaactaaaactacaactgatcaaattcaaaaaaaatcaactgaaacaacaactactactcaatcaatcagtataaacagtaaagatgaaaaaaaagctggctctaagctttcaagagttgttaaagtttcaagacgagcacttacaacttatgcatcattcattggtcctggtttattagttagtgttgcttatatggatcctgggaattatgccacgggtataactgctggtgcatccaataaatattctttattatttattgtcttattagctgatataattgcaatttttttacaagtactttgtataaaattaggttgtgttacaggttatgatttagctcgatgttgtcgtgaatatttacctaaaaaattgaattggattttatggatattagctgaatgtgctattatatctactgatgttgctgaagttatcggttccgctacagcattaaatatcttattaaaaattccattaccggcaggggtggttattactattgttgatgttatatttgtacttattgcttatcgtacagatacttcactgttgaaatttgttaaaatatttgaatatgccgttgggtgtttagttatgattgttgttatatgttttgccgttgaattatcacaaattactgctaatgtgggtcaagttttccgaggatttgttcattctaaagaaatgtttgatgggaatggtatgacggtggatacttcagttattggttctacagttatgattcattcattgtttttgggttcgggtttagtacaacctagaatgcgtgactatgatgttaaacatggatatgtcaatttatacgaaattgccaaagaagagaaagtacaagaggaagaggaagaagaccaaactgagatttcaccagttgcatcaaatcctattcaaaacaatattgctcctacatatgaacaagaggcaaaatttttccgaatcaaatataaaccatcttataaatcaatttgttattgtttaaaatattccaaaattgaattaattgtaacattagcaacaattgccctttttgtgaatgctgctattgttattattgctggggcaacattatatggtacatcagaagccatgaatgctgatctttataccattcatagtttattaagcaaaagtttatcacctgctgttggtactatctttatggtggcattattatcgagtggtcaaagtgctggtgtggtgtgtactattgctggacaaatggtgggtgaaggtcatatcaattggactttaaaaccatggatgagaagaatattgactcgagctatatctattattccttgtttgaccatttcgtgttccaccacgggctggataagtcccgcgtcgggc

SEQ ID NO: 5880 - DNA, 837 bp, Candida albicans
gatctctttctttcaattcaacttcaaatgattacggcaatatttatttatgattctaaaggtgacatattaatatccaagttatacaaggatggaatcaaacgtaatatatcggatgtgtttagaattcaagtgattagtcaaacttcaaccaatcgagccaaagaataccgatcacctgttttaactttaggttcaacgtcattcatatatattaaactggggaaaatttggattactgctgttactagatcgaatcaagattgttctttgataatggaatttctatataaattggaagcactattacgtacagtattgggacgagataagaagaagcagttgatggaattaacggataattatataattaataattttgcattgtgctatgagatattaagtgaagtgtgtgaatttggattcccaattaatttagatttgaactatttaaagaaatatattgatgatataaatgttgacgatagcattttcaagattgcgccattgaaaagaagatcaacaatcaatccattgttaggcaaaagcattaccagcggtaacactaacaccactagcaataataacaacagtagtaacagttctttgaaaagatcatcagcagaggaaaacattacatggagatcatcaggaattaagtatcgacgcaatgaaattttccttaatgttactgaacgagttaatgtgttgatgaattcacaatctgatgttttgaatgcgtacgttgatggttcaatacaaatgaaaacacacttatcgggtatgccgttgtgtacatttggattcaacgacaatactaatttacttttcccatga

SEQ ID NO: 5881 - DNA, 369 bp, Candida albicans
gaaaaattgcctgccacaaacgtttcattacagattcctacaccaagaggaggaacgattctttccaacctttccagttcgataggtaaaacgaaatttcatcctgaggacaatctgatttcatggaaatgtaacaagtttttcggggaacaagaacatgttcttactgcggaaattgaggttaatctgagttcagatgaactattatattggactcgacctcctataaaattagatttcttttgggatatgttttcaagttctggattaacagtaaagtttttaagagttcaaggaaagaataattatagaacagtgaaatgggttaaatatggcactcaatctggatcgtatgaaataaggtattga

SEQ ID NO: 5882 - DNA, 531 bp, Candida albicans
actagttttaacaagggattcataatcaatcaacaaaatttcataatgtggtcattaattttatgtgttttaggattgactcaattcatttctgcatcagcatttacttttatattgggagcaaatcaaaaatcatgttattatattttcactgaaaaaccaaaagttccaattcgttattattttgccgttcaaagtggtggatcatttgatgttgattatgaaattgttgatcctaatggtaataaagttgtttctgattctaaacaaagacaaggtgattttgtcttcaatgctgattttgttggtgaatatgaattttgtttctcaaataccatgtctacatttgctgaaaaagtgattgattttgaaattaaatttgaaaatgaagataatgctgaaaaatttagagcaaatctaccaaatcaacccgatgtgaaaccattaactcatgttgaaaatatgcaaaccaccattgatagaattgatgctcatttggatggattatataaagctatgccatatttataa

SEQ ID NO: 5883 - DNA, 444 bp, Candida albicans
gttggatcttccagccggcggggtcgaagacagacagaacctggatccattcaacaactgcaacaacaggttcaaatcacttatgagcccattaatgctgaagaattggaacaacaaacattgcttattctagagcgtgaacgtgaaatacatcggattcaacaggacacacaagaaattaatgatattttcagtaactggtcctccatagtgaatgaacaacaatttcaaattgatagtattgagaataatatttttagttatagttccaatgcaagagaagcatcaaatgagcttcgtagggcagatagatatcgaaaaagatctagtggaagattgttatgttggcttcatgatacttgttgctatagcatcatttataattttaatagggttgattttttagaaaataaatgtacagaggagaagtttgctctttattag

SEQ ID NO: 5884 - DNA, 927 bp, Candida albicans
gcttgttgtttccctaaccaactacttgacagctattcactgcacaaatttttgactaatcatataatgtcatttgctaatattgatttagaggcccaaaaggaaccattattgaaaggcaaagaaaatgatgctaattacacttcacctgatgaattggacacaattattgggaaaacctctcgccagctactggtatttggaaacttaatttcacaatttgaaacacaacgtaaacagataggtactagaagagatactcaagagttgagaaatactatagatgtattgacaggtaaaatccaagagatggatagagctatcctggccctaattgccaacttatccactcttatcaacctgaaaaacagcatcacagctagtgctagtatatccaatagacatatagttattgaagaaaggttaagccgccagtatagcgagttatcaaaggcattcaataaatcaacaaaagtgtatcaagagaaaaagagaaccacacctttattgactaggccaagtaaagagacagaggaacaaactaaatctgaagatacgttggccacaagccagcaggaacaagagcaagttcaaacacaagttgaccaagacctcattgaccaaaccgaactacagtaccacatattattaaccgaagaacgaaacagagaaatagaacaagtaacagaaggaataatggaggtaaattctatatttaaagatttgagtcagttggtacatcaacaaggagagcaagtgaacactatcgaggacaatattttacaactacatggaaatacacaacaggcatctaacgagttgaataaagcaaatgagtatcaaaagcaaaaagggaaatggtcatgtatattgcttgttgcgctttgtatatttttactagtgattgttcttatagtagtcagctaa

SEQ ID NO: 5885 - DNA, 471 bp, Candida albicans
agattccggaatgtacaaaataattatatgaaatttttgaaaaatgatgatgaagaagaaaaagaagaagaagaagaagaagatatattgaatatgaatgatgaacaagctacattattgaatgaaggaaatgattcaaaatcgacaacaccaagaacaacaacaacaacaaattttaccaatcaacaacagcaacaacaacaacaacaagtacaagtccaactccaactccaacatcaacaaggtaataataatattcaatatttacaacaacgagaaagagaaatttcaaaattagctcatggaataattgaaattctgacaatttttaaagaaatggaatcaatggtgatagaacaaggtacaatattagatcgaattgattataatctagtcaataccgtacaagatttaaaacaagctgataaagaattaattaaagctcatcattatcaaaaaagatcaacaaaa

SEQ ID NO: 5886 - DNA, 714 bp, Candida albicans
tatttctactatttgtattgcatggtcgcattcaggatcaaagagccaaaatacatactagcaatgagtcaacatccagcccccgcaacagcagtgaaattggttttattgggagaagctgcagtaggaaattcgtcgttggtgttgcgatttgtgtccaatgatttccaagaaaacaaagagccaactataggagctgcgtttttaactcaaaagtgcaccatcggtgagcgcactataaagtatgaaatctgggacactgctgggcaggagcgttttgcttctcttgccccgatgtattatagaaatgcccaagctgctattgtcgtttacgatattaccaaaccagcttcatttataaaagctagacattgggttaaagagttgcatgagcaggctaatagagatataacgattgcattggttggaaacaagcttgacttggtagaagatgatagtgcagaagatggtgagactttacgaaaggtgagtgtcgaggaagggcaaagtttggctgatgaagaaggtttgttattttttgagaccagtgcaaagactggcaataatgttaacgaggtatttgtgggtattggaagcaagatcccgagtgtgacggttactggtggcgaggctcaagaaggttcaaatggtcgcagaattgatttgactgcaaacactgataatgctaatgctccaagaagcacatgttgctaa

SEQ ID NO: 5887 - DNA, 492 bp, Candida albicans
attaaaaaacaatcttccttggatcccataaaagttgacggggcattgagatcattggaatatgcttggaaagtacaagaatcacttcatttacaagttaaaagaatatctggagaaatgatgtttgaaagaaaaggagtcatagatttcacggagaaaaaaatacaacgcttgatgaaaggttatactttgcacaaagtagaacaccataggaaaattcttaagcattttgaaaatataaggttggatgtacgaagtgtcgatgataagggtggattatctagactcaatcgtgacaacttgactaatttgaagcataacttgacacaatcacaatcttcacaaggagattcatggtcttcaagaactttcaggtcgttggaaaaggaagaagaagaaaatgaaaacaaaaagtcggatgtaaatgggtttgaatcggcaactgttgatgctagaaatgcggcaagtctcttaggcgtggctacattctaa

SEQ ID NO: 5888 - DNA, 957 bp, Candida albicans
tcccgtggtgaagatccagaagattttgaaaacaataacccatttgcagaacctgtcatttctgatcaagtcaatggcgtacattcacaaacggaaaacaatgaaacacaactcccagaaggagagcccacggccccgcaaagtggtgaaccatcaccagaccctaactctgaaagcatattaactgaagacgaactaagaaagcttattccagaaagattcacaaccaaatacagtttaagcatccagctagtggaaattgaaaaaaataaaccagggaacccaatacttaaaatgaatgttaaagtaaaaggcttaccacgctatagacagtcgatttataaagatgttcgtacaacttttaatgaggtggtgaaatttaacagatatttaattgtttcaaatttagaagtgtttgtacctgttatccccagtgccataacatcgtatccaacaggtggcgaagatgagagaaagaaactttttgtcgaatggcaagaatggttggatagaattactagcaatcccattttaattagagatgaagaatttgtttactttgtcgaaaacgattttggatactctgttatcaataccaataggaaaacatctgttgcaagtgggatcatgagaaagacactaaaacagtttgctgtgccatacgacccttacgaagagttggctaattttaggccaattattaaagaagcgtatttaacttttcaaaaattacacaaacttctcgatagaaactcgaaaactgaaaagcaactttcaattcatatctatgatatggcgaataaattgaatcagttgtctgaatttgaaaccactcatccaggaatgaaaaatatgtgggagaaattgggtaaaatcacacaaaagcaatctgattttacgtcggtggactcgattaacgaaatggcaacattgggagatggaactcaaatattaata

SEQ ID NO: 5889 - DNA, 2031 bp, Candida albicans
gtgataataatgggttcttcagaatataattatgatgagctgggagaaacatggccattctttgtgttggcgttgttatcttttattttgttgccattgaccataaagtacatatctagagtttttacaaataccaatcccaccaaggaaaatcaatccattgttggagcaattcaagaaaacagcgagactttgaaagtgcccaacttgtctgaaatcaaatcgttccaatccaagcaaaagtctctgaaaatattcaataaaacattaatcttcttgcttatcggatggagcattgttatatacgtggcaaagtatgttaccaaggaagctgatttaacagtattatttgatccatacactattttggatgtctcgtttactgctagtgaaagagaaatcaagagtcattatagaaagttatctttgaaatatcatccagataaattacctaaggatttgactgaggaacaaagatctcaagcagaacaagcttatattagattgacttctgcttacaaggcattgactgatgaagttaccagagaaaactttttaaggtacggtcaccctgacggggagcaaccagccacacatggtattgccttgcctcaatttttggtcgaaggaaaatatagttcattagttgttgttttatattttatggtcataggtatcttgttaccatttattgttggaaaatggtggagcaatgtgaagtcacataccaggaaaggtttgcatgttgatactgctgccaactttgttcgtaagtttaccgacagggatcctgcaaaggtcattacaccagatgttattttggattatgttttggaaagtgaagaaattagacaagaatttcctaatgcttcacatgcagagttgaaagatttggtgtacaggtatttaaatagacagtttgacagtgatcctaaagtcgagaagaaaaaagttgatctcattgcaagattaccatttttgattaatggattgattgacatagccattgtgttcagactccacgaaacaattttcgccgccgaagatttgaagaagtcaataattcaagctgttaagccaacagggagataccaagagttattacagttaccatatgtggatccagaaattgtatccaaacaatctatccgaaaattaggtaagcttttcgctatttctaaggatgaagccaagaaagcattgggaatacaaagcgatgaacatttggagcgtgcattgaatgtagctcaacacattccgacacttcgtattattgatgctgagatcaaagtccctggcgaagaagatggtgctgttcatccaaactcacaaggacacatttccattaagtttttggttaaatctcctaaattgaaatcatgtcctgatattgaagatgagagattaaaagatgaagaaactttggaatacatgaagaacccattaattgtcaatgagcaacaaaagaaattgccatattcttatgctccatatttcccgcaaccaatccgtaattcttggagttgctatgttatcggacagaaggaaaacagattgcttgaagacagtaccaactatgtgttggaaaatatagatttgaacaacttggaattactgcaagaagcatggatcaagggaactgatgttagaatcggaacctataaaattcaattacctggagctattggtaacgttgggaactattattatagattggttatgaagaacaatgcatatttcggatgtgacgttgatatacctattgatttagaagttacaccagtatccattggtaagagtcttgcaggattgaaaaagaagtttgacgaagaggacgagtcagaagacagcgaatctgatagtgatatttcagatccagaagaagacagtttagcaggagctatagctgcattaagaggatccgatctcaagaaaaagaaatcatcaaaagatgaagtcgaggaagaaagtgaagatgaagaggtgttcactgatattaatactgatacagaagatgaaggagataattaa

SEQ ID NO: 5890 - DNA, 285 bp, Candida albicans
gggaaggttagagaaccaactgaatttggagatggtcatattccaagagctttgaatattccatttaaaagtagtcccggcgcattggatttgccagaagaagatttccaagaacattttggattccctaaaccaagtactgataaggaattgattttctatgttcttggaggtgttagatctactgcagctgaagaattggccaatacttttggttataagaaaagaggaaattatcttggaagttgggaagattgggtaaaacatgaaaataaaaagaactaa

SEQ ID NO: 5891 - DNA, 228 bp, Candida albicans
caaatcgatgatactgtcggtatcatgagagataacattaacaaagtggcagaaagaggtgaaagattagattctattgaaaataaaacagataatttagccatcagtgcccaaggtttcagaagaggtgctaacagagtgagaaaagatatgtggtggaaagattttaaaatgagaatgtgtcgtcttcaccacggcccgctggaaggagcccaacttgcgttagga

SEQ ID NO: 5892 - DNA, 1422 bp, Candida albicans
ttattgttttatcttttttttttttttggaccttttcctaacaacaccaccattctattataccttagcctttggattattcagcacatcactgcatcaacagctatcatgaatggatacaactggcaaaatgggaatcttcacagtaataataactcacccactcccttgaactttcgtagcatacagcatctttatcctgatcaatttaaaaataattctgcggatcagttgaatccacacaattatacccccatggaagtacatagtgacaataatagctatgataacatatccctgttaagagacttggaagatggtattccattatcgttaactgcccaagaattaacattacaagaatccaaaacatatatgaggtggtatagtgatatactagccagaacaaattcacgaacaatttctattcacgatgtctataattttttaaacaatttcaagattccagagaagatcaaggaaataatcaacaagatatttttcaaaatattgcattctatcaatatcggggagttttttgcattattaagattaatcagtcatactttgcaaggagaaacaccactgaggtccttgattaaaatcaaagcaccagtacctacaccgccgtcaatcttatcaaaaaaaaggctacaagaagaagaggaaacagaccaaaaccaagagcctcagcaaccgtgggatattgatggattcacacagtttttgttgacaggtgaaagaccttcaagtaacaaacgatcgaaaaaatcaaaatcagtagagtttaccgatgaagtacatgttcatgatgcttcgttaataagtccagcacaatcccctctactagttgatccactgcaactgctgctacaacaacagcaacgattagattatctgttacctatggataaattactacaacaaatgaaaaagcctgatgaggaggagaaagaagtgcttaaagacatggagtcacaaatgaaccattttcaaaacttgaatgctgttgatacaatgagtgttggtggcacaccatacttgcaacccaatatgactggacctgctcaaatggcaagattgtttagtccttcgccggaaccgttgagaccgaatgtaacgggtcctgcggatatggctagaatgtttgctccatcgaaggattctcaaactactaccactaccaataataatagtaatgattttaatgatttcatcactaatgacaattcttataataatagtcttgaacataattctgcaccactgccaccacaaccaaaagtttcactttctgcttttacaagtcagatgactgggcaaaccatggaaaacaccattcaaaatagtggatcttctctgttgggcccgatccctccaccatcaagacatagatcagcgtcatcaccattaccaaataaa

SEQ ID NO: 5893 - DNA, 627 bp, Candida albicans
ttgcttgtcaatcatttcgctatggcatcacagatacattttttagacatcaagggcaaacctttattgtcaagagactataagggagatatttcttctactacaattgaaaagttcccgcttttgctattggaattggaaaacactgttgatgacggtgaatacaaaccgtttatcaaccatgaaggcataaactacattttcatcaaccacaataacttgtacatttgtgcattgacacggaagaacgagaatattatgacgatcattatatttttatcaaagttggttgaagtcatgacccagtactttaaatcgttggaggaagagagtattaaagacaattttgttattatttatgagttgttagacgagatgatggatttcggggttccacaaacaacagacacaaagatccttaaggaatatattacccaagactattattctttgatcaagagcacacccacgcacttggttgctccgcctaatgctttgaccaattctgtcagttggagaaaagaaggtatattttacaagaagaacgaagcatttttggatgtgattgagtctatcaacatgttgattactgccaatggccacgtgttgaatactgagattttgggg

SEQ ID NO: 5894 - DNA, 1131 bp, Candida albicans
gctatttcacaattggaaattcattcaactactgatttgaaatcaattgctcgtaaacattgtcatgataatgaagtaccttatttgacaccagttttgaatttaattgatagtaaatatactactactgctgagaatattgctaatgaagataattttgaaatttctaaacaagtcaattggagagatcattcagcatatatttataatgatgaagtggcattaaaaatttcttatttgaataataatattcattgggataaatctaatgatattaatcaatttgactcaattattactcaatggaatgaaattttatcattgcataaatccgacacagaaagaaatcaagatgatgatgatttagaacaagtacaaaatcgtgccatcttattgacgtatattaattataatttattatttaccaccttgaaaagagatttattattgattggacaattagccaaaattgatgataataaagatatcattagattattcaatgggattcttgttattgttcaaaatttaaaagatttaccaggggtttataatgatgaagatttatatgattcattagataatttagaaaaatttttcattgctcaaaaaaatcaagtaattgctgaatcttatcaatttaatagtcaatttgctgaactgttgaaaatttatcaatttattaatcaagaaatttccaatgcaacaacaacaacaaaacaaggatcatcatctttttataaaactgatttcccatttaatattagtacaaatgaacaaattgctattttcaaaaatgatatcaccaagaaaatattacaaaatcaaattagtgctcaatttgaacaatctaaagtgatatcaagttcaccatatactattgaaaatttgaataaatatcctaaaggattgacaactattataaatttaaacaaaattgaaccaatgatgtgtaaaccagtattatttgatgttgcctttaattatatttcatatgattcaaccaaacaaaccaccaccaataccgctactaccactccagtggaaacttcgtcccctgatgttgatgaaacaattgataatgaaaattccaaaaaacggggattcttcggtatatttggacgtcgttag

SEQ ID NO: 5895 - DNA, 1353 bp, Candida albicans
cgcggatctccacccgtggtgaagacattgtctactttgaacacaacccaaacattagcattgttagacaaagcttctcaagtggtacatgcagaattatctggagaagatttggtgtcagagttattgccgatcaaattaaccacagcatatgtttatcaattaactggtgaatcaaataaaagtttggaaattttggaaagtattgatgttgaaaaaatcaatgatcttttaataaaattgattgtgaaaaataacctttattcacattctacaatcactaatatcaacttagtagacagagacttgaattatcaacaaaatttacataaattgagtcaaaaattgaccgttttgcaatatgaaagagttttgaaaaatagcttggttttgaagtttgctagtggaactttgagcaaatcacaattaaacaatcagtttattaataattttcaacaaactttccctggtgatcttcttccattatcatataaagtgttgtcaacacttaatatagatcacaaagatttacaagatttaacaaaactgaaacagataggcagaaaacttgtcaaatacattccaacacagacagataatgatttgaaaattgttgctacattaattttggtttctgtgaatgctcaaattggatcatttgatcagagtttacctattttagaacaattgacccatgaatcattggctacacccaaggcattaccaggattgattggaactttgatagctgtttatgaaaacacccataataccaaaaaattaactgatttattattgaaagttttagaaaaattattatacactcctaaagaattattatctggagatattaattattacaattttgccaaaattgttgcattcaaagcattgaatcaaggtcatgataaaactgccactcaattgtttgaatatttgtatgaagttaattccaatgatcaattaatccattcaattttatctaatacaaataatgatttattaccccttgatgaattaacaagtaaaaaaccaatagatgaaatattatcagttgatattgatacattaataccaacaacgaaaaataaacctataaaaccaattgttaaaaaagtttctaaaataactaaaaagaaacaaaaccccaaatttggacctaataaagttttgaaacctatagaagatttacaattggatgaagaaagatggttgcctatgaaattaagatcttattataaacctactaagaaagaaaagaagaaagctagtggtggtggcggtcaacaaggagctagtgaatgtagtactcgtacaacttcgctgtctaaaaagaaaaagaagaaaggttag

SEQ ID NO: 5896 - DNA, 960 bp, Candida albicans
aaactaaagcataacgagttccacgtcattttccaacgtctttcacccaacattacccatacgatcaaactgcaaactatgtcggcacccacccctccacaaactggccaatttcaagttgctacttcagctcaaagatcaccagtagctgtgaatattgtcaactacttgtttcaaaatcctatattgaaacaaagaacaggtttattagataacacaaatgatatcgagtttttcagattcaaaagattgcaaagagcattattgagcgatgactataaacagaaacaacaaaatcccaagaatgggttgattcctgttgcaaataatgaagatgtacaaaaagtttttgttttgttgatccagaaccaattgctcttaccacttcagaaattgcattacgccgaagttaaagcagtcaagggctggaagcctaataaagagaaaccaactttgaaaagggccgacaaagcagtaatggatcctgatgtttattatggttggttgtaccaaaaacctaacccatacatcttgctttacagttttttggctatagctggtgtgtttgccgttatattatttccactttggcccaactttatgaagagaggtgtttggtatctttctatgggtgcattagggttgattgctttattttttgccactgcaattgtaagattgataatctacattatttcattagtggccttccataagccattttggttattccccaacttatttgaagattgtggtgttattgaaagtttccaaccagtctacgcctgggaggaacctaagaaaaagaaaggcaagaagaagaaggaaccaaagttggaggttgttgaagagaaagttggcagttcttctggggacgtgaaagtcacaggaagtgaactttcgaatggttcttccacaactggcaagagaaaggtaactttagaggaagttgaagaataa

SEQ ID NO: 5897 - DNA, 975 bp, Candida albicans
tcggcatcggcgtgtgtgagagattttcaaaacggaaactatgagttgtctactttgatcttgttatatttacaagacaacttgactacgtcacaatttttcaaaatattaagtcaaactgaaagtgttttgaaaaaagaaaactcaaccaaacaaactatccagaagttggacattgatgttaaatcagaatacatgcaagtcacaggagaagttgttggccatgcttgggaagaatcaatagcgaaaaatgtatcaccacgcttgcttgagacatatctcaaacacgaagatagggtaaacgaattgaatatatttaagatacagcaatttaaacgggaccctgaacttcataaggacaactactacgaactgtacaagtctgttttgactaaagctatcaacaggtcgacaaaccaacgtatttccaaagcattgcagcgcgaaattcaagttttggaattgcaaaagaagcttagtgagacctatttaacagatttttaccaggaaaagactttgatggcaatattaaagcggatgattgctatgaatcaaattaaacccgccaagaaaatagttgcaaacttccaactatcagtagagaagttttggtatcttgtattgaacacattaatggatcgacgtgaatttgaccaattgtatgagtttgcttttggttcaagtgaccagacttctggtaattcacccattgggtttgagccatttgctgaattaggtttgcagaaaaatgccccacaaagccatatttctacatatattaaaaactcaaacaagtacaaatacgaagaaaaaatatccatgtttatcaaaaatgatgattatgaatctgctgcattagaggcattcagaaataaagacattgatattttgaaaagtttactacaaaaaataccaaattctaatcaagctgacattcaagtagtaaatagttatattcaacaactaggctattaa

SEQ ID NO: 5898 - DNA, 837 bp, Candida albicans
aagaaaatatttgtcataaacaacaaatttgaccaaatattattggattatgacacttcaaatgaaagtatcgacccatatcaagtggaatggtgtggcaatgacgcaatagtcttatcctttagagatgagataaaattaattggacctggccaacaatcaatttcatttttttatgatatagaagatgatgacgaatttgatttagataatttaatggttagaaaagacaataagaacacagactataaaaaatttgatgacttgcttttcacaattcgtattttacaaactagcattgatgggttaaaaatcgtcactactaataaagtccagtttttaagcagagtgcctgaaactagcgttgaaatgtaccaagttggatcaactgcacctagcagtattttggctgactgcattgacaaattttctgcaaatgcctctaaagctgatagcaatatatctttattgagagcagacaatacgttattaaaggccatggaagattgtattcaagtggctttagacgagttttcgccagattggcagagaagagctttaaaggcggtatcatttggaaaggtatactatgatgattatttcgattctgacaaattcgtatcagtagtagatatcattaaagttttgaatctaattcgctcaccagaattaggattatttttgacttatcagcagattgagaaaattggtgggtgggaagaagtgatcaaaatgcttttgcgaaggaaccatcatgatttaagtttagatatcattgataaattgacatttggggaacgccaaacctttagtatatattcaaaagtgttgttataa

SEQ ID NO: 5899 - DNA, 543 bp, Candida albicans
tcaatgccatctaatccaagttttaattggctgaagctacaaaatgtatattataacatcagaacatgttacgatgaaatggattggtccattgacaacttatattccaactacttagtatcactatcacctaatacaactttgatagctattgcttcaaaaagtgcaccacatccaaatctaattgaaatatattccaacagtggccacaaactatggtcagtagtttataatagtacccacaatgattatatccagagctttcattttacaagcgacgaagacttgataattgttttgaataacggcagatacagacattattacaatttgataagtagtttcaatgagtataactttgtcgaggatttagtcactatggataacataagccaaagacataacactggtgataaaattgacgcaaaccctgacaatactcgaatgattaccaatttagaaaacaaccaaacagaagaaataattaagatcattgaggtcaacacgtggaatcaatttttagttgtacggctcgaaagctaa

SEQ ID NO: 5900 - DNA, 759 bp, Candida albicans
gcggctccttccagcgcccgtggtagaagaagtgatattcaaggtttaattgaacatgttcagtcatcgaatttgcaccaagacgaaggacataaacaaacaattgaacatataaaggaaggtaaattcacattgagagatttccaaaatcaaatgaacaatttcttgaaaatgggaccattaacaaatatagcatcgatgattcctggtctttccaatataatgtcacaagtgggagacgaagaaacatcgaaaaagatcaaaaatatgatttatatcatggattcaatgaccatcaaagaactagaaagtgatggtagaatattcataaaggaaccaagcagaatcgtcagagtaccgagaggttctgggtgtgctgttgtcgaagtggagatgatattacaacaacatagaatgatgtcaactatggccaaatctgccatggctgcacaaggtggtcaaccaggccaaccaggaaacccaatggccaacaatccacaaatgcaaagaatgatgcaacaggctcaatcaaacccaaattttatgcaacaagccatgaatatgttaggaggcgccggtggcggtgctggtggcgctgggggattagctggaatgatgaacaaccctgctatgatgcaacaagcacaacagatgatgagactgaatcctcaaatgatgcaacaggctcaacaaatgatgaaaaatccaggaatgatgcaaaagatgatgcaacagtttggtggtatgggtggtatgtaa

SEQ ID NO: 5901 - DNA, 888 bp, Candida albicans
ttcaatagaatgtcattttttgggtttgatccagcagctcctcctcaaggagccaataaaaaagatgatgcttacgactttgaaaatacttatgatgggttaggtgaattggaagaagatgatgcattcaaccaagaaacatttggaactagtaccagtgatattagaaaggattttgattttggtcaaggagattctcagcaatccgagacccacgcaaaggcttcagcccctcctgctcaaactattagttatgcccaggcagcaaccgtcccagtaaatgatgatgagtttatgcaagaattatggggatcgtccaatgcaccaagtaaaaatcatgctgattccactgaagacaaaccagcaggcggtcaacctgagaagaaaattttgtctttagaggaaattgaggcccaattaactgcaattgatcattctcagcaaccaccacaacaggtgcctcaacaacaatttcctcctcaaccttatggtgttccaggaatgatgcctccacctccacaatttggttacatgatggcgccaggatttatgccacctcagtatccttatccaggtatgattccacagcaaatgccacctatgcaacaaggtcaatttccacctcctcaacagcaacagcaacagcaacaacagcagcaacagcatcaaccaccaccacagcaacagcctcagcaaccaccaccacaggctactggtactgtatataaagaaaatacagaagctcctgttcgttctccagcttccaataaagcccaaaaaatggatttgtctaatttcccacttttaggatcaaaatatgcacaatcccatccacaaatctttccacaaataatatctacatccgcaacactttccccaccatcataa

SEQ ID NO: 5902 - DNA, 762 bp, Candida albicans
caaatattattggcgaatttaaggaatgtgaaagggaatcaagaactagagctgatgttgatactagtacattatgggaatcattggagtattggagcattcttcatcatctggggtgaagaaagtgcagtccatccattcattcaatgtttgaactataacaagatgttgcagattttgcttcgtcttttcaagtttttaaccagagaacaaatattaactattgtaacattaatcatgtataatttagaaaatttgttggtgatcaagaatgggtcgtacactacatatcctaacaaaaaagtaccagaaaatattgtcaaattggtagaagcctatactttgacattttcaaaagtgttaatgaatgcagtgttggatttcaaatttaatgaaatcattgggttattagttattttgattgaacacaataatgtttcatttgtatctactactaagattgggttatcgatattgacaacattgttatcacgtgcagaattgatcattggtgaagggtcaatatcagcaactgatttatcggaatggtcctcgtgttatgatgaattgtttacatcattagaatcaagaattgcagcaattttcccacctaaccctgaagatgttgatgatggttcttctggagaaaattatatatggcaatttttagccacattgtcgttaggtggtaaattgagtcatcaaagaattattgttgatgaagtacgtgatgaaatttttcggagtaatgaatcgagctaa

SEQ ID NO: 5903 - DNA, 1692 bp, Candida albicans
  unsure (47): Identity of nucleotide sequences at the above locations are unknown.
cgaaaaagtatattgaccagtcgttattggttgggtatattgcgttnttggcaagccaagttttatgggtggattgttgccgacttggataggtaccaccacaatttggggttgccgtttcgtaccattgatttgtttgagacgttgtgggcagattttcattcgccgattatcaagtttttccagcaccagcatgccgttgtgtttgaagagattaacaacaacctcatagagtgtcagcgggaagggaaaccggggagttttaaagtcaagccagtggagatgaggaagattaacgatagttttatcaagtttatcaaggatgtgtttgggttttattcgagattgctaaagtattttgttacccattacaggaactcgtactcgccaaagaagtttatggagtcgtttaattttacggtcgagaaactggcggtgtattgtgctgacgataatttccaggccaatgtgttgtacctcgtgcacaggtgctgtttgtcgttgggggatatacaccgacaccggacatttatagagacgagttttgtcacgccggcgtcgtcgaacagagagtatttccggatccggtcgagcactgacaagacgtttttgtttccggcgtactccaaggcgttgcaatactaccatttgtgcattatgttgttgccggcgttgaacgagccgtataaccatattggggtgatctacaatttggtcgatgaaaagtttactgccgtatactggtttttgcggtcgcagtttacgcggatcccagactacaagttggggcttgccaatttgaccaagttgttgcagaaacactggtttacgacggcgttggtggatattgtcaagtcgacgccagaacggcgctttagcaacaccaggataatgaatgtgtacttggtgtgtttgattgggtatatatattgtccggaaaagtacaagagtggccccaatattgtcaagaagattctgttttctaagattgagacagactttttcaagatgttggacaagaattttgaggaagaggtggtgttgcagcagcttgtggtggcgttttcgtttttaaagttggatggccaagaaaagttggtaaagtttacatttaggtttgtggagagggtattggggtgtttgaaaacccaggagtcgttggtgattctaaggtttttgttgaatgtattacgtgagaaccaagagtttttgagggtgtttcagtcgcggagaaagtgtgtggtgtacttgtgtgcggtgttgaataagtactaccaggaggttagtcaccgcccgacgcgtgcctactatttctgggaggatgtgcatttccgggacttttcgttgatcaagtaccagtttaaggattttagagacgatgggatatttgaggcgaatgatatagatgtgttggtcggggattatgcgggagatagactgaatgagaatgatctacgtgctaaggcggtgttggtgctaggcaagaaaatattaggtggggccgaagggtatgaagtgaaggaggccgataagttgtctatcaagagacgcgaccaggctgtggtggtgccgcagtctcttgaagaaatccaactgcttatatcgaaccaggcaaaggaactttgtatggacattgaccaaggcatgcaaaatatggttgacaaactagtagaagatgatccgatctggtga

SEQ ID NO: 5904 - DNA, 1488 bp, Candida albicans
  unsure (2): Identity of nucleotide sequences at the above locations are unknown.
anaccaagaggctcagagttgagtagtggtgttactggtttaaagtctcttggtgtcagagatttgacatataagctcgcctttggagcttgccacgttgcttccatggttaataaggcaggtgggaatgaacagcttgaagttgatttgaatgaccaagaagtttttcttacatctttgagtgatgctgaagtattacaattaaaggaaatggtcaaggatgaacatatttatgacaagcttgtgaactcaattgcaccagctgtgtttggccacgaagtgatcaaaaagggaattcttttgcaattattaggcggtgttcacaaacaaacagtagatggaatcaacttaagaggggatataaacatttgtattgttggtgacccatccacttcgaaatcacagtttttgaagtatgtctgtgggttttcgcctcgtgctgtctacacttctggtaaggcttcttctgctgctgggttgacagcggctgtagtgaaggacgaagaaagcggagaatacactattgaagcaggtgctttgatgttggcagataacggtatttgtgcaattgatgaatttgacaagatggatattgctgaccaagttgctattcacgaagccatggaacaacaaacaatctccattgcaaaagctggtattcatgctaccttaaatgcccgtacatctatcttagcagctgctaaccctattgggggtagatataatagaaaattgggtcttcgttctaatttgaatatgacagcaccaattatgtcgagatttgatttgttctttgttgttcttgatgattgtaatgaaagaattgatactcaattagcatcacacattgttgatttgcacatgcttagagacgatgcaattgatccaccttactcagccgaacaattagcaagatacattaaatacgcaaagactttcaagcctagaatgactaaagaagctagagactttttggtcactagatacaaggaattgagagaagatgatgctcaaggtttagggaggtcctcgtacagaattactgttagacaattggagtccatgattagattgtcagaagctatagccagagccaattgtaccgaagaaataacgccaagttttgttgctgaggcctatgatttgttgaagcaatctattatcagagtcgaaatggatgacatcgaaatggatgatgaagaaagaccaactggagaaccggggcaagcacaagaacaagatcagccacaggaccaagatactcagcaatcgcaaccttctgaaagagtacctccagtgtcaattagttatgacaaatatgtttctataatgaatatgttagtcaagaaaataaccgaggacgaaaaaaatggaggtgatggactttcggctgatactttagttgaatggtatttgcttcaaaaggaagacgagatttctgaccgaaacaagaatacttacgagaaagagaattggcttataaggtga

SEQ ID NO: 5905 - DNA, 1059 bp, Candida albicans
gttataatgtccaattttgtatcatcaccagggagaatcccatcagctgctgcccagttgttgaattcacaaactctgtcttcttttggtagagacaattccacaccagcacagccaatattatattccgaagatcttccacctcatttacaactactacaacaacagcaacgtgcaattgctggaagaagaagacaaattgctgttccaaaagttgttgatgtaactggtgagaaagtcagggaaagttttgaaacttttattgaagaatttgttgatcctgaacaagcagatgatgattgggatgggaaaatttacttggcccaaattgaagctatgaaaacatacgagtatagtactttatatgttgattaccaacatttattgctgagagagaatggtgttttagccacagctatcctggaacaatactatcgtttctcaccctttttgttgaaaggtttgcatagattgttgaaaaaatatgcaccaagcttgttacataccagtttacttcacaataccgaagaaactgttagtgaaacttcaaccagttctcaagcaaatgaacgtgttttccaaatttcttttttcaatttaccaaccgtacaaagaatcagggatatcagatcaaataaaattggttcattaatgtcaattctgggtactgtaaccagaacatctgaagtgagacccgaattgtatcgtgcatgctttacttgtgacttgtgctcagcagttatcgaaggggtagaacaagtttttaaatataccgaacccaccgcatgtccttcttgtgagaatcaatcttactttactttgaatgtgtccaagtcccagttcattgattggcaaagaattagaatacaagaaaactccaatgaaatccccacaggatccatgccacgtactttggatgtgattttgagaggtgaaaccgttgaaagagcaaaaccaggtgacaaatgcaagtttactggatgtgaaattgtaatcccagatgtttctcaattaggtttaccagtgtcaaacctgtccaacaggcgaaaagatcattgt

SEQ ID NO: 5906 - DNA, 858 bp, Candida albicans
cccaacatgtcacaacgaattgcagattttgtttccaagatagccttgccggctggtatcaccattgcattggcacaatcagccttgtatgatgttcctgggggtaagcgtgcagttatatttgaccgtttaaagggggtcaaacagggagttattggcgaaggtacccactttttggtgccatggttacaaaaagcagtgatatttgatgttagagttgaaccacgagtaattactaccactacaggatcaaaggatttacagaatgtttcattgacattgagggtgttgagtagacccgaagtaagaaaattgcctaccatttaccaaactttggggttggattacggagaaagagtgttgcctgccattggtaatgaaattttgaaatcgattgtggcacaatttgatgctgctgaattgatcacccagagagaggttgtttctgccagaataagacaagagttgtcaagaagagctgcagagttcaatatagaattggaagatgtgtcgattacacatatgacatttggtagagagttcaccaaagccgtggaaaagaaacaaattgcacaacaagatgcagaaagatcaaagtaccttgtggagagagcagaacaggaaaagaaggctgcgattatcagagctgaaggggaggccgaatcagcagacgttgtttccaaagcgttggccaaagctggggatgggttattgatgatcagaagattggaggcatcaaaggacattgcatcaacattggccaactcaccaaatatcacttatttacctaatggtggcgctggcggcagcgatagcgacgggtccaaaaactcattattgttgaatattggccgttaa

SEQ ID NO: 5907 - DNA, 975 bp, Candida albicans
gtagaaggatacttaatctataaaatgaacgatcaaaattggaagaatttatcaaatgaattaagacgtagagctgaacaggctcggtcttcttcaaatatgaaatcaccaaaatcaccattaggtatatttggaggaattggtggattacttcttcttggaggtgccacaatgtttattcaaaatgctttattcaatgttgatggtggtcaaagagccatattatattcaagacttgatggtgtacaatcgaaaatttatcctgaaggtactcattttgttattccatggtttcaacgtccaattatttatgatgttagagctaaacctaaagaaatagcatcattaaccgggactaaagatttacaaatggttaatataacttgtagagttttatataaaccagatatttggcaattacctacaatttatagaactttggggttgaaatatgaagaaaaagttttgccatcaattgttaatgaagttttaaaatcggtggtggcacaatttaatgcatcacaattaattactcaaagagaaaaagtatcacgattagttcgagaaaatttagttcgtcgtgcttcaaaattcaatgttttattagatgatgtttcaattacttatatgacattttcaccagaattcagtcaagcagtagaagctaaacaaattgctcaacaagatgctcaaagagctgcttttgttgttgataaagccattcaagaaaaacaacaattggtggttaaagctcaaggggaagccaaatcagcagaattgattggtgaagccattaagaaatctaaagattatgttgaattgaaaagattggatactgctagagaaattgctaatattttggctgcttcacctaatagaattattttggataatgatacattattattaaacactgtcactgataatagaaaataccatcaaccctttgagtatgataaacaaagaaattattag

SEQ ID NO: 5908 - DNA, 1299 bp, Candida albicans
agaagaacaaagccttcgaaaaaacgtcgttcacagtcaccactggaagacatgctgaataaacagaaaccccatcaaccggaggtccccagaaccccagaaaaagctaaagtccatttggataaggtagtagaagaaccaaagcaaagaatttttaccaagaaggagcctcgggattccaagataaaagaatcaaacttcttaaacaaactctacgagacaagtaataagcatgataaagaagatgcccataaaatagatttcagtaaaagaaggtttgagtttcaattggataagtatacttttacgccaaaagacgttgttgatgatttagaaccgatatccaagctttacttgcgcagaagataccttgcccaactgcaaattgccgacattattgccgaaactgatagcaacatgaaattccttaaaattgacaagtttttagcgaaaacccataaatcaaacaactatgctgaacccaagtattgtaattggtgtcttgttgcctttgtggtgcgcaaggacccagtgcaggttgctgccaacaactctaaatacatcaagttgaaggttggaaattttatgaattctgtagacttgatgctttttgataacgcttttcagaaaaaccggataatccaaccgggtgatttattattcattttgaatccattgatcaacaagtatgaaatacaagttggcaagggccagtttcagtctgggttcaatttgaaagtagaaaacaccaatgtgtcaagtattttagagataggatcgttaagagattttgggttttgcaagtttactagaaagctagataatagcagatgcaaaagggccatcaacacaaggacgcaagaattctgcgatatacatttggatatgaagtttaagtctagtacaagaatggaattaaatggaagtgtttcgattagatccccgcaaaaaaacaagaaaaagatgtacatgaataaaaatgggtctggctttattaagcaatataacgaggagagtactgttataggaacaagctacggttctcctcttgatccaaaaaggtaccaagacccgaaagtactccagaaccaaatcaagcggcgcaaactaatagacgacaaggcaaaggagatgcttgaacaaaagctatcgaaactaggttcggcttcattattgaacaatttacaattatctaagaaagaagcaacagataaacttgcgagtgatcgtctgaagagcaaaggattcaccaacacaatgatttcacatagtcttccccacgggccggaaaatccgcga

SEQ ID NO: 5909 - DNA, 258 bp, Candida albicans
gataccagggggaaccaaggttgcggggtttatttgaaatggaaagaaccagatgtagatggattaattgagtttatggttaagcagaaagggtttagtgaggatagaatcagaagtggtgccgaaaagctaaagaaagggttgaaaggtggcgtccaaggtagactagatggattctttaaagttgtaaagaccgatgacaaaaagagaaaagccgaccctaaagaatcaaaggctagtaaaaagaagaaaaaatag

SEQ ID NO: 5910 - DNA, 675 bp, Candida albicans
ttaagactaaccatgggagttaaagggcttaatcaattaattaaagaacactcacctagtgcttataaagaatttcagttgaagaatctcttcggaagaaaagtagctatcgatgcctcaatgtgcctttatcaattcttgattgccgttagacaatcagatggacaacaattaactaacgaggatggggaaactacttcacatttgtctggtatgttttaccgtaccatcaaaatggttgaaaataacattaaaccagtatatgttttcgatgggaaaccacctgtattaaaaggcggagagttagaaaagagattattgcgtagagaagaggcacaaaagcaaaagactgcccttggtgatgaagggaccgttgaagaagtgttgaaatttgaaaagaggttagtaagagtgacaagagagcaaaacgaggaagccaataaattactacaattaatggggattccctgtgttgatgctccatgtgaagcggaggcgcaatgtgctgaattggcccgcggaggaaaagtctacgctgctgcttcagaggatatggacacattgtgttatgaaccaccttttttgttaagacatttgactttttcagaagcaagaaagatgcctatcgaccaaattgaatacaaggacgcaattgccggatttttcaacacgccg

SEQ ID NO: 5911 - DNA, 1803 bp, Candida albicans
tttgaaattttacaacaaacaacaacattcaacgttcaccaccacccaccactagtaaacacaatgtatataaccccgaaccaatatgcaaagacgttccaagatataaaacgctcatcattatctcactccacctgtaaacttgttatatttgtttcttgcttagatgtggatgcattatgtgctgccaaaattttgagtttacttttaagaaaagaattaatccaatatcaattaattcctacaacaggatactcggatttaaaattgcattatgataagttggatagtgaggtcacaaatataatactaattggatgtggtgccatgttggatttagaaggatttttcgatgtcaatccagaagagtttttaggtgataattctactaccaatggccacacaatagataacgacactgaattagaactagatgcagtgaaaactgacaattttgccttgacaagaaaaatctatgttgtagatggacacagaccgtggaatttggataatttatttgggtcggccatggttgtttgtttggataatgggtatattgatgggaacttgaacgaagaaaaggaagcatacaatgtgttggtagaaatgagtgatagtgaagacgaagatgaagatgaagggcacaaccagaacggtcatgctgatgatgaccaagagggagacaaaactgatgctgatgatgaaaatgacgaatcaagtgtttcaacatcacgcaaaggagttaaatccatcaatgaagataagattcagacatattacaaccagtcatcaacaatagcaagctcatgctcgataacagtttatgcattagttagtgccatcggtgagaccaatgttgacaacttatggttaggcattgtcggtgccagtggatttgattgttctatatttgtcgacgaagtgaggcgtttctcgaccgattctggtattcatatggaacgtgggacgtaccttccgttgttgcgacattcttctctttacgatgccttgctttataactggattgacggtgacaagagaatacacaagattcttgcaaaaatgggtgttccgattgttgctgcaaaacaacaatggcaatatttagatccaccaatcaagaacaaactacctggattattgaagaaatatctacctgaactcccacaagttgaaatattttaccgatgtggtgtcacgtccatggacgtgtttgtttcattaactgcattattagagaccggggttggtctcaacaatactagtgctaatagtattgaccatggtgaccttgaagatgaaaatgaactaattcgaagagaaattaaaagcagagagtcaagctacattcgaaatttttggtcagcctttgattcagtaagttcttttgggatttccaacaacattggattagaaaagggaataacagcagcaaaattggttcaaaaagaattattccaaactatcaaatacataattgaacaaaaattaattaaaaatttaaaagtttatcgactttgcattttaaaagatgagtcctcgcatctgggttttgataatccagtattgttaattaaattgtctaatcgtatcatggattatttaaaacaacaaacactgaaacctttagtggtagcagcagaactttccaatacatatttcgttttgggtatgggaattaacaatgcattttctaaaatttctggtgctcaaatgaagaaagatttctttgaagcatcattagtggaaattaaaaaggaagatttggctccatttttggaacaattgaccttcaatttataa

SEQ ID NO: 5912 - DNA, 1962 bp, Candida albicans
cttttattttttttttcctcgtttgttgggccaaattacacatcacaaatggaattaacacccacacagttggatattgtcaaccataattatgatccacagacagtactttcaattcaagcagggccaggaacgggtaaaacatttgcactaatcaaaagaatacagaaactcattgctgatggtgtgcctccacaaagtattgtcgtgctttcattgacaaatagaacggttaattcattgaggtctgcgctttccgagtatatcggaggtgatacaggtgatgtagttataaagacatttcattcttttgcctttgatttgattgagtccaatttgcaagagtattttcctgaaaagggtcgacagatgttgttagatgatataagttttcaaaactataggacattatttatgactggtaacagtgttaagcagctccatttggaaaaggcattactggaggttagagaaggtaaagatgtagctaatgtggcagagaagtacgggatttcgcagtcagatttgcatgaaacgataaagtttcttaacgacaacggcatgattagatatctggatttcataagagacgcaattgaattattagatgtatccaagggtgagattgtcaaggatatacgtgtgttgataattgacgagttccaggatatgcagcctcagttggtgacatttattgaaaagttggttgaaggtggaaacaagcacattactttggcgggcgattccaaccagtgcatatatgaatttttaggctcttcgcccgatataacacagaagtttgtatcaagtttaggttgggaaactgaagaaatttgtttgaatgaatcgtttagattgacgccagagaatcttcacatatcaaatatggtcatagaccaaaacaaacttgtatccaagaaagaaccatcagctgagccaacagtgtactcattggtttcaaaatacgatgaatacaattacattggcagtgagattgcgcgattgatttgccagctgggagggctattgaagttttctgattttatgattcttgcctctcagaatcgtgaggttgacagtattagcgaattcatgaccaatcattttgggtttaatgtgaataagtactcactgaattcagagtgggtgaattcgaacacacacgtgttaattgacatattaagtatattgaataaaggcaggggttctgatttagcattgctttgcacattgatgaagttgggaagcttgaagcagcttatacgtgagctatatttgggctataggttgtcgcaaagcacgtctttagaggactatttgaaatccgagtcagctagttgcaaattcaatagcaaaccgcgtattaagttcaaacgacaaattgatttgcttttgaatgtgattgaagaggagaggaagaatcttggtgacgccgtttctattatgtcaagtttagcaaggattgttagggaaactgacatcataacatacttgaacaaaccttcccggggccataaagaccaagaaaacgaaatcaagttggtgaacaacctcacttccttttatgagtcgttgagtttgtcttataagaaaaccccatcgttggactactttttgaataactatccagaagacgagcctgtgcttgaagagcgttcgattaatgtgtctactgttcataaggcaaagggtttagagttcccggttgtttttgttacaaatttcccacgctatttcggttcggcaaacgaaaggttgttgtatgttgcgttgacacgagctaaaaacttgctatacacggggtaccagggcaacacctttcaagcttataataatagtcgagggtttgaaatgaacagaacatggatcactaatgccgcaagagatttaaatagaagtgctccctctaaacatttgttaaatgctagcatgcgtatattaaaaactagtcgactaatttag

SEQ ID NO: 5913 - DNA, 1536 bp, Candida albicans
tttaatattcccggttttttttttcatcaaagcatcaaaccaatacccaacactttaatatctagggtttccattcacatatacacatataaacatatattaataatgataaatataactaaaccattaactccaaaatcaatttcacaacaaaaacaacaacaacaacatccatacaaaaacatttcaacaaccaaatccaacaacaacccccaagcttctggctccaaatcatttgttcaagaaaaatatccttcacaattatatgaatcggaaatcaaaattcataatcaaagtcttgctgaatatgatttagacatttatgatattatggttaatttgattgaaaccaataaaccaaatttatcattatataaacaacaaccatatttaactttcaccattcgattaaaattgattgattttttattaaaaatgtcgattcgtttaaaaattttaccatttgttttttttaaagcggtgaaaattttcgatagatattgttccaaaagaattgtattattagatcaatcccaattaattataactacatgtttatggattgcaagtaaagtaatgggtggtaataatcattttgttaatattaataatttagataaaattggtcaagaaaattttagaaccataaatgatttaggtatggatgtggtgggaaatatcttggtccaacagaaaagaatccgattaccgaaattacatgaattggtgaaattatgtggtgctaaatgtaaatatgaccaaggaatgtttaaacaaatggaagttcacgttttaaacactttagaatggtctttaaatgatccttcaattgaagaatttattattgacagtcatgaatttaatgtcatcaatattaacaataataatgaatatgaacagaccatcaccaccaatgatgaatctgccaatgccaatgccaatgccgatgccaatgatggtaatgaatttttcaagattaaagaatttcttagttatgcagccttatattcccatgatttaattgatactaatataattgaattaggtcaagttattatggatttaattaatgaaaccttccaattacaaccttttgataaacattatcaaacaattttaaattgtgatagtgatcatcctattagatttgatatgcaacgttataaacatattaaaaaagctgtgattaaatcggttttgaatgcttcggattttatgatgaaagttttccattcaaaaggtcctcaatttatttatcaacaatttaatttacaatataaacttaattatactaccaatagtatcattggcgggtttggtaatagtggttattccccaacaacaataacaacaacaacatctgataatatcagtactacaccaactaattctactggctctactactccagtatcatcatatattggttatgccaattcaagatcatcatcagtatcatctacttcatctgttgcatcatcttctaatgcaaatacacaagttcatcaggtagtaatacttcaacaactccattaa

SEQ ID NO: 5914 - DNA, 684 bp, Candida albicans
ttccaaaccatgtcttcacctccacaaagtactaatcaaaataattccaatccagctcaagattcacttgaaagagaatccgggtccatctcccaaagtcaacaaccaccaattgtatcttcaccattatttttcaattcatcaaatccaggttcagatattggtaattttaactctcaaagtcaaagtcaaagtcaaagtcaaagaagaaatgatatatcatcaccattacattacacttcctcagcacaacctacttctgatattggtgggtttgattctcaaagatctgctagagtacaagatgttggtagaataatgagaagagcacaaagaagtgatgtcactgattcagtatcttcacctcaacgtagtagaagatattttactcagggaagaggtaatggaccttcgaatttaaactctagcacttcagcacaatttagtactgatccagcagaacctaatgatgaaccagtgagagtcatttggggtacaaatgtttcaatccaagaatgttctaatattttcagagatttcttattatcattcaaatataaatacagaagagaattagaagaacaagcaattgaaccggaagaccatgaattatactatgttaatcaattgaataatattattgaattgggattaaccaatcttaatttagatgccaaaaattta

SEQ ID NO: 5915 - DNA, 492 bp, Candida albicans
gcaatcgcggtccgtccagcccgtggtgaaaacggggaggatgctagatcatcagaaaagagaatcaccgctactacaagacaattggaatcgatgattagattgtctgaagcccatgctaaaatgagattatctgaaagagttgaattgatcgatgttaaagaagcagtaagattaattaaatcggccattaaagattatgctactgatccagttactggtagaatcgatatggatatgattcaaactggtactacggcacaacaaagaagggtacaagaagatttggtcagtgaaattatgaaaatcatcgaagaaaataataatttaattagatttaatgatcttagtgttaaattgaatgaacgtagttcatttagagtggaaaatctggtgattaatgaagggttgagacgattacaacaagaaggtaaaatcatggaaactggtgatagtcatagaagaactattagaaaaattgctattgtataa

SEQ ID NO: 5916 - DNA, 519 bp, Candida albicans
gattgtttaatccaaataataaatgatgccaatgccaccactagtccagcacaatctaaacttgatgaaattgaaactaatgtttacaccatacgtccatacaatgtcaatttggttgaaaaaggtattcgtgaattgaatcctaatgatattgataagttagtaagtgttaaagggttgacattacgttctacttctatcattcctgatatgaaagtggcatttttcagatgtaacgcctgtggtcatactgttggggtggaaattgatcgtggtgtaatttccgaaccaacaaaatgtcctagagaagtatgtggtcaaaccaattcaatggtacttattcataatcgttcatcattttctgataaacaagtgattaaattacaagaaactcctgatttggtacctgatggtcaaaccccccattctatcaatttatgtgtttacgatgaattggttgattcttgtcgtgctggtgaccgtgttgatctgccccacagggcaaagtccgcgtatggt

SEQ ID NO: 5917 - DNA, 1497 bp, Candida albicans
acaacacgctcatttattccagaggttcacaacattatgcgatcttataaatcatccataacggatgaaaatgagttgacaaaacaaagacttagagccaaaagtattgccaatttgagcagcaatcacacaacagctgggcaaccatcaacaagctctcaacatagagaggcattgactgatttgacctcacaggagaataaaaatcacccaagagtgaaactaacacaaacaaacaccaatcatcacagaaacagctcaagtagttcgaacaaaatacaaatatatcaacaaatagagcaaaagaaaaccgatatccatcagttcaaaaaaccaagattggagaaggtattactaaatgacgacgacgatgaaaccgatgacgaatttgacgacgaagaagataaagaaaacagatatcatgatctagagttgaatgaagatgacagtaaacatcaactaataagtgaagcatttgaaacaattgatgatcggggaataagtgagggtgaaaatgatacagcgcaagaagcacgtgaaagattagaggaagaaacacaatcacatacacaggatatgagatcaatatatggggttcatgtgcccatgcaaccaatgtggaataatgcgataataaacgagctcaaatacgttatacaaaagtactctcgtaatacgttggacgaaaatgacgaagatacttatgatactaccatggtggcagaatattcaccggaaattttcaattacttgcatgaacttgaaaataagtttacacctgatccaaattatatggatttccaagacgatctaaagtgggagatgcgtgcagtgcttattgattgggtcgtccaagtgcatgctcgattcaacttgttttcagaaaccttgtacttgactgtaaattacattgacagattcttatccaagagaagggtgtcattatccagatttcagttagttggagcagtagcattgtttattgctgccaaatacgaagaaatcaattgtcctacagtccaagaaattgcatacatggcagacaatgcctattcaatcgacgagtttttaaaagccgagagatttatgattgatgtattggaatttgatttgggatggccagggccaatgtcgtttttgagaagaatatcaaaagctgacgattatgattatgaaactagaacacttgccaaatattttcttgaaataactataatggactcaaaatttgttgcttctccaccaagttggttggccgctggagcacattacatatcaagaatactattgggaagaggtgaatggacagaattgcatgttttttatagtggctataccgaaaagcaattgcagccattggcagacgttttgttagagaactgtcgccatgctgaaataaaccataaagccattttcgaaaaatacaaggaaagaaggtatagaaaaagttcactttttgttcaagaatattttcgtcacataatgtcccagagttga

SEQ ID NO: 5918 - DNA, 1308 bp, Candida albicans
gaaagcggaggttccgagaattacttaatcaagtgtgtacacaagatggcaatgatactcttcccaagttcaaccatggccgctggaaacttttttgccaaactaatcaaaattgctgaattgaaaatacccaagaccaatagaaaacgacaaatgtcacttctacaagattttgaagtggatttgagtgaaccaattgatgatttggtgatacctattcaatctaatttacagattcagatacctagtcacttaaattccaagcacaaggggttttcacgttcttcttcaatttcattcgatgggtttgatgataatgtgaatattttcttttcgttacaaatgcctcgacaattgactgttcgaggttccgatggtaatgcttatagattaatggttaaaagtgatgatacaagaaaagatgccaaagtagttgaatttaccaccatggtaaatagaatattatccaccagtacagaggcaagaaaacgaggattacagattgctaattattctgttgtaccactttctgatcattttggtattattgaatttgttatgaatgtgcaaactatgaaaggggtgatatctgaacaaaggaaacgtcaaggtattccaatcaatgaaaggaaagttttcatgcatattgattctttgcaaaaggccaaaaagaaagatagtaagcaattggataaattagtagcaggtttccgagcaataatggatcgatgtccgcctgttttacatacttggtttgttgaacaattttctgatcctagtgcctggtatatggcaagaaatgcatttactcggtcaagtgctgttatgtcgatggttggatatattatgggattaggagatcgacattgtgaaaatattttgattttcaaaaatactggtgctgtattgcatattgattttgattgcttgtttgaaaaaggtaccactttaccaacaccagaaattgtaccatttagattgacacaaaatatggttgatgccatggggatcactggagttgatgggatttatcgaataacatgtgaagtaacagggacattattacgagagaatgaacaaattttgatgaacattttggaaacattaatctatgatccgttaattgattggagaaatcacaatccacgtgaagatttatcgaaagtgcgtaaaaaaattagaggattaattaatgaagatgaagggttaccaatgaatattcatggtcaagtagatgtgttgattcaagaagctacatcattagagagattatcacaaatgtatgcaggttgggcagcttatatgtag

SEQ ID NO: 5919 - DNA, 345 bp, Candida albicans
tttgatattctaaaagataacaagtttcatgatgataagagtaaagcaaaagtacaactccaatatgcaaactggttagatgaatcaaatcatttgtcagctcaccaaattataacagagtacaacaaggcatttcatttgaatatggtggatgagaaatgtaattttgatatcgggaagtattataataaattgatggaatcttctaatgacgaatccgggggaatacggaaaaaaccccatttaacggtaaggaattatattaaagctgtttctgtgggcactacttatatatttgaagccttgccccaattattgacgatttggctagatttggctgattaa

SEQ ID NO: 5920 - DNA, 1440 bp, Candida albicans
aacatggttggtagatgtcacatttttttattaaagcgggccagtattgatattggtaaagtaattcagaaagcaaagaccagaacattatattttcaaagctatgcggttttgattcaaagggaacatgatattccattatgtgaacatttgttaagatacgttgctcttagtcatgttataaatgagggtgtccctgaagacctacacaaggaattcttgcatatattgaaaatggattctaagtctacttctcccgatcgtgctgaacaattgaaactatgttatcaaactattttttctgttgtggattatttcaatcaatgggtctccaatatgcgtgttgtcacgagtaattctgggtcagaattgacttcaagtgatatacgccataaaatggatgcagttgctaaatttagtctgttcccacaggatctacttactactagatcagctgaatgtgacgcatatgaaagaacaatcatgtatttggagaattgttatcgtgacagccaatcagaaaagtctttcaaattatcaaacttgaatggtgcggcaacattacaggacatgtatgcccatatcgatgactatgatgcattaaacggtactttgaagatgttctcgacaaataacttgaacgaaaaattaactactttccaatacagcgatagttggagtttggcacatgaatcatttgaacctttgggttcaacaaagaatagtgtatctgacaatacaaaatggttgcaatctttgaatgagcatggcttatataatgaggtattgtcgacattgtctgccaggacagattccaatgatttaaaatccattccattggattggtcattgatgggactacatgcagctgtatacaaaggtgattctaaacaacttgaaaaatggttacaggtgataaattatattggcaaaccacacgatatggaaacaatgataaattatgaattagccaaagctttgagttttttatttcaatctagaatagatatgttcaagggatccatggacaagttgtataatataattggatgttctttagttccttcagtgtcatcaaatttcaccagaaacatcactttgatgaatcaattgcatgcaatatatgatgtaagtttaattgttttatctaaagattctgaagacactttggatctacgtattggtaatgttgaccaagattttgatactcaacgaaatattctaacgttgcacaatgttgccaacactgttatgaagaatccggccatgatatcgaaaaatcttttacgagagtcttcgttggcaagaaaatataatcggttggatatttctactacgtctatagtgcaagcaatgtctttggaagacgaccaggcaaatatagaatttgcggaattgcaatgggcacaggggaaacaatcagaagcaataaagtgttag

SEQ ID NO: 5921 - DNA, 966 bp, Candida albicans
ttacaagccactttagaggagcataatttccatgtattatctttacgatgctggaacgagttgataaaaaaagtgccaccatcccatttgatatcattgattgatataatcatttcgataattttacaaaaattcgaaagttttggatctgaggctaaaagtattgcaattgaaattttaagaaaaatctatgaagaaataaaagacaaatacaatcggtattctttgtactttttatcattaccgtttctctcttacatggaagattatcaaatggtcaaagagtttcgaaatatgaaatccccatcacgcgctatgatttttctggaattcacaagacggttgcaaacatccaacatgtatgttgtcaaacatgctttatttgatttgtcaaactattttgagaaataccaaatcaactgccaaaaagatcttttcaaagatcccggtttaacaccggcaataacaagtttggtccgaactattttagacacagcagcaaaatttaaaaataaagacacaactgtttccactgcatgtgccaaagctttggcaattattggagctttagattcaaacaagttccaattcaaaactgtgaagctgctaattataatctcactggattttgaggacattgaagaaaattcgacatttttggtagacttgattgaaaatcatttacttaaaattttctgggcttctaatgatccccacaaacaattatttgctgcctatgtaatgcagagtttcttagcggttatgggacttgatgaacgtgttttgaacattaaagataatcgagtttggaacaagtttacggacgtggcaaaatcaacattgactccgtttctaaaatccaagtatgctgctcctaaacctaaattagacaacctcaaattcccttttttcaaattaggtatgaaatatgaaacatggttggtagatgtcacatttttttattaa

SEQ ID NO: 5922 - DNA, 2334 bp, Candida albicans
  unsure (2301): Identity of nucleotide sequences at the above locations are unknown.
ttaattgtgtgtgtatgtcaaatatctttaaaaaaactgaacaatatttggtacaaagggattgtagagaataaccacagcgaaaaaaaaaatcaaaatcaaagcaaaacgctactgtatggaaaatttacaaccatcaagaagaacgcgtcagaaactaaccagctagttaagaatataaagaatggcatgacgtcgaatcaatcaataagtactactgaactactacagtttttaacagatatagaaaccaatatcgacgatcatgaaaccgattttagaaaattgctactctatttactacgattcactaatgaaaaattaattgtcattgcacaagaagaaaacaaaacgccaactgaactacagttattgtccaaattaatcgacaccattgagttggtgctatcaaagaaaacacccttactttcaactttattaactattgaagacgtcaatataattcatactacaggttcgggatcattagtgtatgaggtccccttacatgaatggtgtatatcctttgccttactgcatattcctaattttgtttcccatactgctggattaaatcaactaaaacgactagttttccttattgtgaacttggttagtactcaattgcatagttttaaagtcattaaaagcactagaatacacctattaaaaacacttgatgataatttaaatttttgtttacaaaatttgctatcagccaacactttcttattcaaatctaaactaacaacagcagttaatttattttcaattgttcatgattatgatatatcgcaaaaactatcgttaaatctaaataattatcaattaaaatttgagagttgtagtaggaaaatttggtttattcttaatgaaataagtttggtttcagaacttgacaatttgaaccttttagattgtctaaaatcggttttcattttagatcagtctagtgctctagtattaaatgtactggttggctggaatcaaattggatttttgttaagttgcatagttgaatatttgcaacaagatttcagaaccctcgattcaaatacgaataattttgaatttgtgaatttgaatcgatcaatcagtttaagtttgctaaacgtatatattgtttgttttgacaaagatttgttggaaaattttatgtcattttcaaatatcaaggggatactttccaagttgatctatgatgacagtataccgtctgttattcgtaagacgttgaacatagtccagtatacataccaattaatgagtaacccagatggagatgatatcaagctttactccacatcggtatacaatgattatgtctggacaccctttgttgattcagaattagagtcacttcgtgctcgtctactagacttacaaggtaatcatgaagattccagaaaggaagaactactttcatttagtatagatgaaacccacaaattggctaaactgacaaattcattaaactatacagatgaaaaagcatggatccgtacagtgaaaaagttgattggcatcgacaaaaatgttttagaagatgagactacgttgtacactcttgtcacagcactcagccattatccatgtatcttaaagggtgattatgattatacaataaatgaatgcacaaaatgtgggtttggtcctttaaccaagaacaattatagcagtattgatccaaacagatttccattgaattatagtacagaagctacaactcttcaagatattatacaacagtttttgattcctaaattggagacacagcaagacccattattatgttgtaacacccttcttttaatatttaatttttatgccagtttcctgcccatggctgacatgcaagatcataatattctcgatttcttacttcggttgttagccactaacgataatcgtgatgttcgaatgctagttgcacgtatactaccactatatttaattcaactgaaagatgacaagttgctcgatgaaacattcaagtatattttccaaaaagtgacatctattgatttttcttcacaacatcggttacattttggtgaatcaacaattcgagctgttgttgagttagcaacagtttctacaggagaaagattgtgtgccatctatttcaaattagttgattggttgggtgagcagaatgaacaacacctgaactatgtttattgtggtatattgaaccttgcgtcggctaaatcattgccacctcataaattgctatcaccatatttaccgagtgttgcagaaatcattattaaaaaaccacaagtcattcggacgtcttcngtttgcctacgacggctatatccatatataggt

SEQ ID NO: 5923 - DNA, 690 bp, Candida albicans
caagcaccatcaccatcaccattaagtaaacaacccaattctatgacaacctcatatctagatacagagaatgataatgatattgatgataatgaagaagaagaagaagaagaattggctaatcttccatccacagtgaaatttttccctaatttatcagatttactagatgatgaggaatatcaagatgatgatgatgatgatggcactaacaataacaacacggtgattaatgaatgggcacttcgaaaatttggtacccttcaaatgaaattagaaaaaatgcaacattctagagatacattccaatcatttggatcacgagataatctaaccaatttttctcgaaatatattatataatttagctaatgaagtatttggatttgatggatggtcaacgacaattttggattgtaatttaaccaaacgggaaaataaagatgaaaacaagtattctgccctttgtgtagtgaaaatacgattaatattgaaagatggtacttttagagaacaactgggacaagcagaatctacaaatatgccttataaacatatgtgttatgctagtgctcgaaagaaagcagttactgatgctataaaaaatgccattgtggggttacgtgatctttatcttgaatatgaacaagaacaattgatgaaacaatttgctcctgaatatgatatataa

SEQ ID NO: 5924 - DNA, 1284 bp, Candida albicans
actccattgttgaagaaaataaaaaaaaagtgtgacgcgtcaaaaaaaaaaaaaaaaccacaacaactatccctctttatcatgaacactttacggagaagaagaataccaaaaccgatcccacggatctttgaagacgatgagtataaacaatacacacgtccgcacaattggagacttctctctttggttggcatttgctgggtattgttgatccactactttgaacgaacccgtccccaaaacactctatcgacatgccaatggaaaaactgggaacagtggaactcccccgactctgctcatagaatagtgttgattgctgatccacagattgtcgacgactactcctaccccaaacaattcaagataataaactactttaccaaaaaattggccgacaactatctccatagaaactacgaaatgatccattcagtgctagcaccagacacaaccatctttttgggagacttgtttgatggcggacggtactgggacgacaaacaatggatagacgagtacaaacggtttacaaaaatctttcctaaaaaaatcaaccgtcgtgatatccgctccatccccggcaaccacgatatagggtttcaaactatacgccacaaggtggttaaacggtttgccgagtattacggcgagctcaacgactatatagagctaggcaaccacacattggtattgctagactcgatatctttatcacatccagataaattgatccgaaaagaacccgacaacttcttagaccagctcaacaatcgaatcagctccaccttcccacgtatattgcttacacatgtaccattattccgaaaccctgtcacccaaacatgtggtccacacagagaaaagcgtaagccattcccgttacaacgaggcgatcagtaccaaaccgttattgagtacgagatatcacgcagaattctcaacaccataaaaccaacccttattttcgctggcgacgaccatgattattgcgatatcacccaggaatacgatggcggtgctgcccgagaaataaccgtcaagtctgctgccatgacaggaggaatcaagcacccagcagtgcagttgctttccctaaacacaaacgaacccacaagaacgtatgagacggaaatgtgctatatgccaaatgcataccacggcttatacgcctatatcacattcttactactcacctcgtttttcatcgatagatctattgtgtttctcaacctcgtctggcccttgtttatattaaatgtatactatatgactatttga

SEQ ID NO: 5925 - DNA, 1467 bp, Candida albicans
tacaatcatatataccaaatgttaaagcttaaaagtactcattttttgctgttgatactactagtgatatgggtcttgactttttatttacaagaaagatacttgacagccgcaacaattctgaaatgtcaatggccgcagttgtccacctcactgtcacaaacaaatatcttgttgattgctgatccccagctaatagataatcatacctatcctggtagaaatgaattattgttaaaattgtcaaaacatactgttgatacgtatataaagaaaaactataatgagttacttgatcaattacaacccaactacataatgttcttgggtgatttattagataatggaagagacgctacagatgaatattttgcacaagaatacaatcgatttaagagaatctttagaccgctggataaaatgtttttgaatgtaccggggaatcatgatattggatttggcaatggggtgaaaataccaatgagaacgcgatttgaaaaatcttttggttctgcaaatactgttgttgatattgatggagttgattttataatactagatacattaagcatatcaagcactgacgaaaccatcaacaaacaactgaaagactttttgtacagtattgccaaagaaaaatcaaaaccaagaatactacttacacatgtcccgttatatagagaccctaacttatcgtgtggaccattaagagaatccaagacatttgatgttaatgggtatgggtaccagtataaaaattcagtggaagaatcattgtcaagagatatcttgaatcaaattcagccagatataacatttactggagacgatcacgattattgtgatattcaacatgaaaatggatacagggaagttacagttaaatcaataagcatggcaatgggcaagaaatatcctgcagtacaattattgagtattaaaaatgaagataatttcaaaatggaaacagaaatatgttttttacaaaccccatacatcaatgttgctaattatgtggtacttgcaatagtttcaggtatactcatcttctggtggaatttaaaaacaaaacttacaagatatacgtacacatctattttgccattgcatgacgttgttaatattccatttgaacataccaaaaagcttcatagatttatcaaagaacaggatgacgagcatatggaacagaaacatttagacatttcgttaccaacgtcatcctcctcaaatgcatattcactacccagctccataccccagtacacatttacacaatcttcaagaccacaatttgtcaccaaattcaataatacaagactaggaaaaatttacatattaaacaagagacgactctttacatttataaagagatacagtttagtcagttttttcaaacaaagtttgatggtgggtattctggtggtcagtatttactacgtaggatttgtgttaactttgtattga

SEQ ID NO: 5926 - DNA, 660 bp, Candida albicans
gcacccagagtattggtgctatctggacctagtggctcctcaaagtctaccactgtaaaactactagctgaagaattgataactgtacgtgatgcctttgattccgtggtggttgaatatgatgaactggaagattttttgaaatttttacaagattgtcgatataaatccaagaatgtgatattagtggaagaattaccaaatatatatcatttggaaactttaaagaaatttcgagatgccataagggattggatatatcaagatgataatggattttcattaccacctttgattatatgtctaagtgagattgaatatgattccaatgatctcaggattagttatagcattgaaaataatttaacggtggatacattattgggtaaagaaattacaggattaaatcaagtggaaaatattaagttcaacagtattgccaacagatttttgaaaccaacaataaataagataattaaaccagaagggattttaaaaattgttaatcaacaaattttgatgagatttttggatgacatttttcaaattggagatattcgttccattatatttaacctcgaaatgtggattaaaaatgttaaacaatcttcgactaatagaatctcaatcgattcatttatgcgaagaaaattcaattaa

SEQ ID NO: 5927 - DNA, 978 bp, Candida albicans
gatttttggatgacatttttcaaattggagatattcgttccattatatttaacctcgaaatgtggattaaaaatgttaaacaatcttcgactaatagaatctcaatcgattcatttatgcgaagaaaattcaattaacttgtttcatgccatagggaagataatatattcaagttctaaagtgaataaaaatcgactgaaaattggtaataacgatgacgatagtgacccattagataaagacgatatagactatcaatcaattgaacaagtactacaactgtttcctgagaaaaatatggatttgttgaacttgtcactactagagaattatcacatttatcaagattctaattatgatttgaaattggcaagtaatatagttgatgatttgagtgttaatgacattatcaaacttggtgatactggtataagatctactaggataaatctaagcaaagcgcaaaaactttcaactagtcgatctacatctatgcctccatccaaattgaaaatgaagtttcctcgacatttaaaaatgatcaaaatgatgaataaaactaaaaatcaaatcagttcgtatcgtcgatatctcaatccacaaacatcatttcaagatttaaatttgattgatggatattatatgccaataatttataactctcagagaaagacaaggtacagatataatcgactaggtggtaaatttcaagaagtttatgcagatgatacaataccgattgatgaaggagaggtaacttatgaatatgatcaatttgaaattgacattaagaataaaataaatctagatctggatatgaaatattcggaagtgatcgatgaagacatggataatatgagtgatccaattgaatcagatgatgatcttgaagatattggagatataggggataatgaatctgatgcgtttctgagtgattccgaattagaattacttttaacacaaggtaaagtctga

SEQ ID NO: 5928 - DNA, 1530 bp, Candida albicans
ccaaaaaaatttaaaacaagtgtttctggatcgggtatggctagagatttagaagtcgcgtttgaaaaaaaaaaacaacaacaacaaccattacttttcatcatgacacccccagtaaagctgcagtttagtttggatgacttttttaaaaagtccaaatatctcaatcctgtgaaagccccggtgaagccggtttttcagcgacaagactcggtgcttacatctttagatgatgatgcagggtttgatgatgttgatgtttcgtatgatactagtgttgaagtggttaatttgagaaatactgtgttgccgacccaaacaaagagaagtgctgatgtgttggaagtgtaccagccccgcaaacttaccaaggtggaacccaccaaggaggtagcaccgcaggagatttgtttaagccctgaacaacagatggttgtcgatactgtggttcatgccaaagagagtatttttttcacagggagtgcaggaacaggtaagtcggttgttttgaaagagatggtcaaagcgtgcaaaggagtgtatggagacaattttggggttacggcatcgacaggtttggctgcatgcaatatccagggccagacagtgcacagatatctaggtattgggtttggaagagaccccgtcgacaagttggcagcgaaagtgagaaagaatgtcatgttgttaaggaaatggcaacaaatgaggttgcttattattgatgagatatcgatgattgatgccgggttgtttgacaagatcgaagaggttgcacggatagtgcgcaacaacgagaagccgtttggtgggatccagattgttgcgtgtggggatttctaccagttgccgccagtcaacaaggacggcaaggcgaggttttgttttgaagggaaaagttggcacaaagtgattaagaaatcgattgtgttgaaacaagtttttagacaaaagggggacacggagtttattgatatgttgaatgcattgcgacttgggaatttaaatgcggcggtgttggagaagtttgctactttgcagcgggagattcactacgaggacaagttagagcccacggaattgtttcctacactaaatgaggtgcgtcaggcgaacctgtcgaggcttgcacggttgccagggaaagaaagggtgtttgttgccactgatcgaggagaccccaggcagcataaaatgcttgataacttgatgtgtgagaaggtgttgcgtctcaaggaaggggcacaagtgatgaatattgtgaattattccgaggatattgtcaatgggtcattgggagtggttttgttttttgcgactagggaattgtactataagtttatccaacattatgggcccatcaatgcgaacgacgaggatgcgattaaagagatgaggtttatatgtcatagaattgacgagagcgagtatactgcagaagagaaggagtattatgagggcttactgaatgagcgccaaggagtgggtacagaatgctacaaacgttgccgtgagaggaactggtgttga

SEQ ID NO: 5929 - DNA, 2739 bp, Candida albicans
agaaatcatcagttgtatatgcttaatgcaaacaaatcaataatccgactagcaacttattccattagaaatagaattcatcatttacgaacacttcatagtttaaattatatcaatagtagaattaacatacaagacacaaatcatatcagacctacgcgtccttgtggatccaaacaattcatgttggaaagcgaattagacctggcattgatagagtttctagataacgacgaccccttcagtgatagtgagattaaggaatttgatgaactactgaaagggcaaagccatgtgtataatggaagccctgtcacgaaaaacctgattttgcaaatagaaaaacaacagattcaaaaatcacctagaccaactgagactaataaaaggatgcaaatacgaaaagatccagaccagaatgacaatggtgatgatgactcactatcgtcgacgtttgaatttagtgatatggatgatgatttcatggaagctctaaaagcagctgaagaaataactggtaataacactaattgtataaagagaactgcatcaactccgctaaagaaaccaattgcaaaatcaatgaaaaacctgagtacaccttcaaaatcagcagggaagaaatattgcaagtatataaaaacgtcgtcgccgagcccatcccattacctaatcagggaatctggttctggtgttgatatacttgaaggctctcctaataaagtgcaagctgacaacgcatcgccattcagaattacatcgtcattttcatccccatcacaaatacaaaaccaaggtgtgggtgccaatcctggacccaaatctaaagccgaacaaaatgtctcatctgcctcacaatcgtcatctccaccaatgaccgtatcccaagtgcgtaatccattcaaggtgcctacccaattccgaagaaactactcaactcgtcccatcacgaatcaagggtcagataccaagaaggggaatagtcatcacacaatattattggcaacacagaaaccaggagtaccttttagcaatccatctgaccgtagttatcacaaacttgagaaaacggaaggcattaatgaagcacaatctgaagcaaaaaatgtgaagccaatcattttgtcaaatgaacaagaatatgtattgaaacaagtgctactgggggtatccctattttacacagggtcggcaggtaccggtaaatcggtgttgctacgaagtataatcaaatctttacgtgataaatatcccaagggtgttgcggtgacagcttctaccggtctagctgcttgtaatattggaggtattactctccacagttttgctgggtttggtttaggacaaggtaaagtcgaaaacttgataaaaaagatcaaaagaaataagaaggcttttaccagatggcgtgaaacaagggttttgataattgatgaaatttccatggttgatggacatttgttaaataagttgaatgaaattgccaagaatctcagacgaaataatcgaccattcggtggaattcaactagtagcttgtggtgatttttatcaattaccaccggtcgtcaaaaagactgcgcatgatggtactgaattagatgatgttgaagtgttttttgcctttgaatcgtcggcttggaaggaaactattcagcgaactattacattgaaagagattttccgtcaaaaaggtgatcagcgttttatcaatatgttgaataatctcagagatgggaatgtacctgacgatacggctagggatttttgtcgtctttcccgtccattaaaatgtccagaagggatagtcccttcagaattgtatgctactaggtatgaagtagacatggcaaattcgagaaaattgaatacaatccagggtgatgtagttgtttataactcagttgatactggaatattacctgagccccaaaaaacacaagtgctaacgaactttcttgcgcctcaagtgctaaacttaaaagtcggtgcccaagtaatgtgtattaaaaattttgacgatcagctagtcaatggaaccttgggaaaagtaattgattttgttgatagggatacctatatgaaatcagaatccaaagaaaacccatctacagagacgtccgatgaagtatctggtttgaacgattatattttcaatgattttcaaaaacccaagaaagttgtcaaagaggatgcacctattgcagaacaagttttattcacgggtcagctttcacaaaaagttgaagacgaactggaaagcagtaaacgtaaatcaaaattaaaagatgacttgatgaaagactacaaaaataagaaataccctttggtcaaatttttgttgccggatggaatcactttccgaacggttgttgttgagccagagcaatggacaaccgaagacgaagatggtacagttttggtgtcgcgtatacagttcccgttaatattagcttggtcgttatccattcacaagtctcaggggcaaacgttgtcgaaggttgttgttgatatgaaaaagatttttgagaacggacaaccctatgtggcattatctacagcggtatcgagagcagggttgcaagttttaaatttcaatacatcgaaagttgcatcgcaccggaaggttattgagttttataagaatttatcaagtcatgagaaggagagtcgaagtgggcaacagcggttgaattttatgcaaacctcagtaaagtctgttgcaagggcacagatatag

SEQ ID NO: 5930 - DNA, 303 bp, Candida albicans
caggatttcaagatggaaaaggcgagcaagaaagttactgaccagttagacgaccttaatgttttggcaagagagcagttgccgcttttgcttgcatgggccatgtcgattcacaagtcgcagggtcagaccttggatagggttagggttgatttgggtcgtagttttgctgatggccaggcgtatgtggcgttgtcccgggcgaccagcaaagatcggttagagttgcgccactttcgaccagacaaggttacgacgtcgaatgctgtgagaatgttctaccagtcgttagagcaagtatag

SEQ ID NO: 5931 - DNA, 342 bp, Candida albicans
ctttgtcataatgataaaaaaggtaaattatttcaaggaatgaatttcaatttatctagtaatttaaatggtggaattgatgttatatctcgagttttaaaagatcatggaatgaataaatataaagaaattaaaactccaaataatttatcaaaatcattaatcaaaaccaactacaaaagtgatgaaaaaataattttaatagctaataagaaaaaagatactaaattgattaataattttaaaaaatcagttaaatctggtataattttagaatgggattggtgtgttaaatcaatatttaaaatggaattacaagattttaaaaaatttcagatatga

SEQ ID NO: 5932 - DNA, 807 bp, Candida albicans
  unsure (147): Identity of nucleotide sequences at the above locations are unknown.
caacagagaactaaacaagcactggctttagaagaagacaccaaaaagggccaagcatcgtttgttgagacaaaaaaaatcacttttaaaccaaagacagatccgtttgcaaatattgataaatcgaaatttttaaacaaatcaggntataaattatccctggtaactgcggagtcaaggactgtgccagcaagacctttgagtgcattctttgacgacggcaatacaccaagaatatattctcagggaaatagatcaacaccttcggttcaagattatgtgaaagaagagttagctaagggagaaagttatgaatttaatgaacccgatggaactttagagtttttaaaatctagagaagaagaaaaactaaatcaaagaaatgacaccggtggaagtttcaaagcagctttcaaaaatggattgagaaaaataagtactggtggaaatataagtgccaataacacgggtagctcggttaaaagtaatcgcagagcaagtctcaagcgtattattacaggaggaagcaatcataatagaaaacattctgaagagaatactaaaaatgtggaagatagtaatcctgtttcttctgcccctaagaaactatcaattcaacataggatgcaacaacttttgaatcaaaatgatcatcaacgcgtacaaaaatcagcacagggatatgggaagtatacagacataaaggcatctgaggatattgatgaaataaataaaccaacactttccaaacactctcagaagaaattgtcaccaccagtcttcaccacgcgtggcagaccgatgaat

SEQ ID NO: 5933 - DNA, 1629 bp, Candida albicans
gaagaaccaacatataaaaaaaatatagttaagcaccctttatcaaaacttcttgatggtacccatctaaattatagtctactttcaggatttctaacatatacagtctactcaatcatgtttcagaattgtaatttcttaataatcaaatcaaagcaattaactcaagacaaagatctatctcaattattacttgcaaataatgttgccaatatttatatcaaagatgattttgacaattctaaaaattatatggacccaccgaaaataactcacataatatctaatacaattgatttcattgaacatgatctagcgataaaatcaatgattccaatagtgacaccttcttgggtttatgattcaattagtagtcaaaaaatgcaaaatattagaacttataatcccgacccagcatattttttcaaagattgttttatatgttgtgctgacaacttgcctccaggtgataaagaattgatttatgcgccagttcagcaatttggaggagggtatttggataatatcacgaaatatactacacatttgatagccatggatatatctaatgaaaaatcaattttggcatcgagtattattcatgatgatgatgataatgatagtaatggagatatgcccaatattaaaattgttttaccgcattggattgatcattgtataaccatgggcaaaaaattgaatgaagataattatttattaccagatgcaaaaatattacatgatgaatccaatgatgtgttgaaaaatgaaatattaccagaaattttaaatgattctttacctcctcaaaatgaacttgattctgaattacaatttttcaaaaacaaaaaattttatataaattctgatttcaatttatctcaacgatcatctaatgcaataaaatttgtaattgaaagacatggtggtctgatcataaagaaatttgatgtcagtgaaattgatatttatttgggtaaatatcgacaaggtgatacttataaaaaaagttgtgctagtaatagaatcattgtggggaatttacaatggctatattttattttggcatctaaaagttggactctacctttaaattcaaatatcttatattatcctcaaccatcaacacctctcgatggtttgcaagggttgaaaatttcaattacaaattacagtggagaagctaggtcgtatttaagtaaactaatcactataatgggaggtgttttcacgaaaactctaaccagagacaatgattatcttgtgtgtgggaaagctgaagggaaaaaatttgatgccgctttgaataaatgggttgattctgaaggtaacctggaaattaaagttgtaaaccatttgtggttggaagattgttatgttcaatggcacaaggttgatagcagtcttgacaaatataaaaatttcggtgatgagtcaattggaatggaaccatgggttggacgtgctcatttggaccaagaagttttgaaacaatggtatgaagatgaagagaaaactgctagccatagctcacgaaacattgatgatagtatgagtgaacacgaatctacccaaagtccaacatgtgctactaccaaagaacaattggatcactctcaaacatctgaa

SEQ ID NO: 5934 - DNA, 471 bp, Candida albicans
aaattaaatgcagaagttaatgctagattcaatttcttacatactataatccaatcttcaattcaagaggcaaaaagaacttttgaaaaagccatgtggttaagaggattccaaggtactttgaaatttgattttgccgaaaaaacattacaattgaatgtacaaactggtaacgatgaaaagaaacgtaccgtggaatcattatctggtggtgaaaaatcattttcacaaattgccttattgttatctatttggaaagtgatgaattctcgtattagaggtttagatgagtttgatgtttatatggattcagtgaatcgttctattagtattaaattgttattgaaagaattaaagagatatccaaaatcacagaatatttttattactcctcaggatattgctgttgttggagaattaaatgataaaggagtgaaaattcacaaaatgtctgcccctagagaggaataa

SEQ ID NO: 5935 - DNA, 1227 bp, Candida albicans
ctattggtagctatattcatgtacagaatcaataccattaattggagacatttgttatctaccattttgaataaaacattggattcatttattgttacctatgagggtgatagaagtaggttggacagattactcaagcaatatcaaatacgtagcaacattattgtcaagaaaacagaaagattgaactatgcttccggtaaagcagattatgcattcaccactgttttagacatgttaaatgtggaaaatgatacgattttgtatgctttgattgatataaattccattgaaaaaaatgttatagtagaatctgccagtgaagctagagattcatgcaggagaagaaatgtccaaaattctttagttcttttcagaaaggattccggtcatagaatgagttatcaaaacaacacctttagacaagatcctatatactaccaaaatggaatggccaagtttggggtcgctaatatgtcagatttgatcagtgatctacaacgtgaattggatgaagaacatagacatcaaaatgatttagaaagacgggccagaagtataaaaatgaaattggatgccaagagagataatcttgtatctgaatctcgtgccatcaagagaaatttagatcaattgaaaagaaatcgtagtactttagaggatcaattggaagttgaagttgattattcaaatatcaccacattggaagcaagaatagaagacaataatgaacaaatccgtagattggttgctttgaacgaagcattattagaaaatctttctcagatgaatgaaaattataaggatttgaaacaacaaattgaagattgcaaatccaaaaaagttaaacatgaaaccattcgagaaaaatttgtgaaacagttagttgagattgaaactgaaattgaaacccaagaggaccttaaaaaacgttatttatacaagataactgaattggaagatagaatcaaaagagctgacgatatacttgctgaagggaatcgtaaattggaagaatttgttgccaaagctgaagaacattgtagcagagatagagttaccatataccctaatgatacccaagagacgatagcacaagattatcaagagactcgttttgatttggaaagagcagaaagtgctcttggaacttcattggaagaagtcttggaccaactagaaaatggtttatcagacaggccgctggaagatccacgtcggggagag

SEQ ID NO: 5936 - DNA, 921 bp, Candida albicans
  unsure (892): Identity of nucleotide sequences at the above locations are unknown.
tcaaaggatgggaaatctatttttggaatcacaatggttctcaaaattgaaggttcggaggcgtataaaccagaagttttggggaagaaattcattattgaaagaaaattacaaagatctggttccaatacatacagcattaaaaatgaagcaggaaaagtagtgtcaaacaaaaagagtgttttggatgagattctttacaagttttctatcaccattgataatccactcgccttcttgtctcaagacaaagctagagaattcttaacatcatcgagtgataaaaacaagtatgaatattttatggatggggcatttatcactgatatccttgaaaactatacaagtatttccaacaatgtccaagtgttggataataaagtccgtcaagctgaagaatacaccaaggtggctaaacaagaatacaaagcaattgccaaagttcataatgcgcatagaactaatgatgcattaagaaacaaattggaaatgttgaatgccaaaatctattggttcaatgttcaaaccatcgagaaaaaaattgatcaagaaaatcgacaaaaagacacttgcttgcaagaaattgagcaggccaaaaaccagattgatgtttgtgaaaaagaaattgaagcaaaaattcctcgaaaggatgctgctgatcagcaagttaaggaagtggaaagccaaataaaagatatagtggaagaatttgagggacttcgaagcaaaagatctgagatgaaatctgagttagaaatcaataaaaaggaaacgaaaaagaatattgatgaaatgaatagtttgaaagaagatattactaggaccgagactaagatagaacaggagagaagaagaattcaagaactacaaggggcaacaaggacaaaattgntgaagatgtcttcaccagccagaatatag

SEQ ID NO: 5937 - DNA, 2640 bp, Candida albicans
gcaaagcaagaacagaagtatcgtcacctatcagtagagtgccagccattccagagattgactcgtctgatagcgagccagaactaccaccaattagaagaagatgaaattgaagaaaccacgatcccaaatctccaaagtggtccagattcacctatcgttattgatgatgatgacgacgattttttggatttcacaactcagctcaacaaagaaagagagatcgactttattgaattggactctgacgacgacgtacaagaggaacaatggccaaaggaatcaaacgcaccaccagcaccagcacctacaaacccagtcttaacaattgactccgacgatgctttttccgatgacgatgaagatttgaaagaatatttcactgaaaaccgtgcatccaaaggttctgaaccatttatggacgaagtacacagtatccttaacaacgtgtttaaactcaagtcatttagggccaaccaacttgaagcagtactggccacattactgaacaaagacgtgtttgtgttgatgcctacgggaggaggtaaatctttgtgttatcagttgccagcattggtgaagagcggtgccaccaaggggacaacggtggtcatctctcccttgatttcgttgatgcaagatcaagttcagcatttattggcaaaaaacattaaagcgggaatgtttagctccaaaggtggtaacgacgataataaacatactatccatttgttcagggaggggtttctagacattgtgtatttatcacctgaaagggccaacaaatcgaatgctatgcaaacaattatgacaaaactatacaataacaaccagcttgcccgagtagttatagatgaagcccattgtttaagttcatggggacacgatttccgacctgactaccagggtctagggtttttcaaagataagttccccaaagttcccataatggcgttgacggcaactgccaatgaaaaagtgcagatggatatacttcacaatttgaaaatgaaagacccggtattattgaagcaaagttttaatagaacaaacttgttttatgaaatcaaattgaaaaagagtaattgtttgcttgaaatcaaagactacattttgagtcgtttcctgggtaaatctggtatcatctattgccattcaaagcaatcatgtgaacatacaagcatgaaactaaacgagtatgggttgaaaacatcattttaccatgcaggtatgagtgctgacaaacgattcaacatacaaaagagatggcaggagaataagatacaagtgatttgtgctactatagcgtttggtatgggtattgataagcccgatgtgaggtttgtcattcatttgtatttgccaagaactttggaagggtactaccaagaaactggacgtgctggccgtgatgggaacttttctgaatgtgtaatgtactactgctacaaggatgcacggtctttacaaaacttgattcaaagagatgaagaattgagcgaactggggagggagagccatttggctaaactaagacaggttattcagtactgtgaaaacaccaccgattgccgacgcaaacaggttttgcaatatttcaatgaaacttttgatccagcgaattgccacaagcaatgcgacaattgtcgagactataaccatgtgactctggtggagaaggattgtacggagtatgctaaggatataatcaaattagtgaaatcaatccaggatgaacaagtgacggttttgtactgtcaagatgtattccgaggcttgagccataagaaaattactgaagcaggtcatcatgaaaacgagtatcatggcaagggccaatctttggataagaacgacgtggagagaatattcttctatttattgagtcaacaatgcatcgtcgaataccacgtaatgcatggtggttttgccaccgattatgtcaaagttggcaagaatgccgatgtggtgttgaatggtcagaaaaagattataatactgttttcaagtagacctggaagtgccagcaacagtctcggtagaacagcagcaaatactggcaagccagttgaatatcaggagtcgtttattactgcaagacaaatgacaactgtggatgtaccggactcttcgttttcacaacggtgcttacaagaattgcgtgaagctagagaaaaggcactgactgaatgttctatatcgaatctgcagattgtcggtgaagttacgctccgggacatgctggctaagttgcctaccaataaaaaagattttgctaagttggagggtattaagaagggtcaattggagcattttacccatttcaaaaagatcttgacatcgttggcacgagagaaaaagaaaatggctaacacatcaataagcaccgttgtcagtgatatatcgtcgatatccacatctactgtttccccctatttccaaccatcacagcaagatcaagagatattggatacattacgggcggcatcacagccaaagcccagtaaaagttctactcaatcaagctataccaagaaaaaggggtctaaaaaattcaataaaggtcgctcagggaattattttaaaaaggcagcccccaaatctttggcaaactctcatagaaatgtaatgcctatgtaa

SEQ ID NO: 5938 - DNA, 825 bp, Candida albicans
gagaacacatatataaatacttctgaagaaagtaagaaacagaaagaatacaaattgttttctttctcttttgatttatcccgttataccaatagtctcactatcatggcaaaggcagagtttggaacagcaaaatatcaatctaaaaagctacgagcggcaggattacaaaaattgaagttctattgccaattgtgttctaaacagtgtcgagattccaatgggtttaaaaaccatctatcttcaccgctgcacataaagaaggtttccgaaatacatgaatctggtgatagctccaaactaatagaaacctactctacaaaattccaagataagtttatcaagttgctccgaatcaaccatggaactaaatttatcaatgccaataagttctaccaagaatatatccgcgagcgagatcatatccatatgaattccaccagatggagaagtctaacttcatttataaaacacttgggtaaaaatgggattgtgaaagtgcaaactaatgatgagagtaatgaagaagaggaagggtttaatttagaaattaaattgatcgaccgcacgcagacattgaatgcctatcagatcaaaagtggcggcaactcgttggaagacaatgatgaaatgaatgatgacaaactattgcaaaggcagattaaaaggggccaagaaatggagaaagacaaagatgcagaaaagtcaaaaactttagaacagctagtccctacttctgcgccagtaaagcttaccctcaaaaagaaaaagactgctacaaccaaaaaactagtaaatgcttttgatgagaatgagagcgagtaa

SEQ ID NO: 5939 - DNA, 993 bp, Candida albicans
ccaccggtaaacctttatacaagcacccgacattttatgtttagagtatacccaggcaacggggaggtggttcaggactcatacacctgggatatcgtactacgcatcatctacaaaatcattgccaagttcctagataggagacaaccaccaaagccactactactgactccccctatccatcgcacatccgacaagtacattctaaccaccaaaacaaagttggggtttctaaaagagaatgaaattgatgggctagtcgataatcggccataccacggaaaggaagcacccctacccagaataccaacaatcgcacacctcccacaccaatgtacatccacccacaccacccctcatctaacctcctcgcaaaccaatttggcaccagaaaaatttagagtgatcaaccaggtcgatcgcaagtttattttattggcggctgacgatcagctagtggtgttggaccagcacgcaagcgacgaaagaatcagagtcgagcagtatctacaagaatttgtgctgcagcccaacccgggattgagactacacagcccgattgctttcggcgtgcatgcttcagagcttatgttgtttgatcagtacgctgccaactttaatagttttggcatatgctacaccacagacaccgctcaagtggtcattacgcatttgccactaatacttcttacaaaggtagaggacgacgcagagtttctcaaggattctttgctacaacactgctacgacttgcacgaccacgtcaagcggatcagccccaactttgacaactggttcgaaacgtcgtaccacttgccccgaatcataactgagttgatcaactccaaggcctgtcgatcggcaataatgttcggtgacatcttgactaaagatgaaatgcaagacctagtaaacaaactcagccggtgcaagcttccgtttcagtgtgcccacggaaggccttctatagttccaatagcaaaccttatgtaa

SEQ ID NO: 5940 - DNA, 606 bp, Candida albicans
tcatcaaaaccaatcaactttccattaaactctttatctccagtcatcaacacccggaccctcttaccaactgacctatctattacttccaaaggcaacaccgtttgtgggactgtttcgtctgacatgattgttgacaaaaaagaaaaaggtttttttttggtttcaacaaaaaaaaaaattttatttccgctctccaccatgattctacggctagatgagtctgttatcacccaaatacgttcacacaccatcttccactccttggacctggttgtacgagaacttcttcaaaacagtctagatgcgggagctaacgaaataactatcaagatagatctctcgtcgttgagtgtatacatccacgacaatggcactggaatcacccctgacgatttggaaaaggttacattacaacattatacctcgaaatggcacagccacaactataaaggagaggcgctctttgcgttaaaagtcatttcaaacctaaccatcatatccaaagcacccgactacacaacaccgttcaagctaaacaacctggtggccgagttgtactacgagtattctgggtcttcaccacggggctggaaggtccagcgc

SEQ ID NO: 5941 - DNA, 528 bp, Candida albicans
cacaccgattcatcagatttacgaaaatacaagccattgattaagaaaaaaatgttgtcagacaaggaagtttcgcttgataaacaattgaattactggagaaagcaaaaagatactctaacaaaagctactacatacctcaaggaacaagcgaacattaatcaattgattgacaaatattcagctattgcacaaatggcatccaactatctatacaatgaatactgtctcaaattcactaaacttggtggttacgccaactggcaattacaacaatggaaagaaaatcaatcaaacaatgtagattatgaattagagtccttgtatagtagttattttgactcagaagaattcaatcaattgtctgatttggaaaaaagagaaataatgctagattacgaggaaaaatttggtcgtgatgacaacaatgaagaaaatatacctgttttcactgatgtgtttactatgaaagatctatattcaattttgaatcttgattatgagcttgtctaccctccttccaaatag

SEQ ID NO: 5942 - DNA, 1449 bp, Candida albicans
atcattagtttctacaccactagcatgtctaccgattcgtacactccctcacaagagcctggttcaaagcgtttaaagacgggcgaatctgtatttgcaagaagaggagtatcgccaagtactggtggagtggcatcagcctacggtaatgagagtgagaaaaagccatcgtggttacaaaccaacaaaagtgatattgatgggaagtacgataaatatggagagagaagaaatgcccatactacaacaagagactcaagacttgataggttaaagcgagttcgtcaaaagctggctgagcgggaagatgttggtcatgaaggagacgaaggagacgaggatgagggtatattaccttatattcatttacaagcggccaaccctgccatcattcacaacgagaaacaggaaaactatcgtacgtttcagagtaggatatcgaatagagagaatagagacatcaatagtattgtgagggcacactataatcagcgaacacaacaagcaaaacagcaaggatcccgagtcaattcgccaatttacaaaatgaggaatttcaacaatgccattaaatacatattgttgggtaattgggccaaacataatccagaggaattggatttgttttcttttttggatttatgttgtggcaaaggtggggatttgaacaaatgccaatttattggcattgatcaatatattggcattgacattgctgatttatcggtcaaagaagcatttgaacggtacacaaaacaaaaggcgaggttcagacactctaatcagaattctaatcggtatacttttgaggcgtgttttgccacaggggattgtttcacccaatttgtgcctgatatcctagagccaaatttccctggaattatagaacgtgcatttcccgtggatattgtttccgcccagttttcgttgcattattcttttgaaagtgaagaaaaggtacgtacattgttgaccaacgtcacaaggtcgttgcgttcaggaggcacttttattggcacaattccttcctctgatttcataaaggcaaaaatagttgacaaacatttgcaacgagatgaaaaggggaaagcgaagtttggtaatagtttgtattcggtgacgtttgaaaaagatcctccagaagatggcgtattccgtcctgcgtttgggaacaagtacaattattggttgaaagatgccgttgacaatgttcctgagtatgtggttccgtttgaaacattgagatcattgtgtgaagagtacgatttggttttgaagtataaaaagagttttacagatatattcaaccaggagattccaaagtattttagtaaattgaataaaaatctaattgatggaatgaaacgaagtgatggcaagtacggtgctgaaggcgacgaaaaggaagcagtggcattttacataggatttgtatttgagaaggtatag

SEQ ID NO: 5943 - DNA, 543 bp, Candida albicans
tatatcatcatggcatcgacatcaacaggcttaccacctaattggacgattagagtatccagatcccataacaaagagtatttcttaaaccaatctaccaatgagtcgtcttgggacccaccttatggcactgacaaagaagtattgaatgcatacattgcgaagtttaaaaacaatggttacaagccacttgtgaatgaggatggccaggttagagtttctcatttgttgatcaagaacaatcaatcaagaaaacccaagtcttggaagtccccagatggtataagtagaactagagacgaatctatacagatattgaagaaacatttggaaagaatattgagtggtgaggttaaactaagtgaattggcaaataccgaaagtgattgcagctcacatgacagaggtggtgatttagggttttttagcaaaggacaaatgcaaccaccattcgaagaagccgcattcaatttgcatgttggagaagtcagtaacataattgaaaccaatagtggtgtccatatcctccaaagaacaggataa

SEQ ID NO: 5944 - DNA, 1617 bp, Candida albicans
aaaaaatggtcaatgaatataaatttagatacagcgaaagatacgctttgcaagaatatattgatatatggatattgtaaatatgaaaacaaaggttgcgctttcagtcataatcgacagcaacctgctcaacaacaacaggctaccaatacctcgaacaattcgacaagtgtgattacaccaaatagtgctaactcaactgcatcatctgcagatttgtcgtccaagaaaaagttcaatttaaacaccccttcctttcaacccagtgtcagcaatttgtcgaacaagttttccactttgtcgccgaagttgaaagagattcctgtttttaagcctgagaatggtgtatctgaacctgatactgtggattcacctactacacaacgaccattcacatcaaagaggttcaacgtaagcactccttcatttactcccacaaactttgactttgcaaacaattccaatgcagatggcaataggggaggtgcatcaactccaataggtatttcatctgcaccacttgtacagaatcagcaacagcaacagcagcaacaacaacaacaacaaaagcaacctttggctgtcccttcaccattagcatcaggtgctcaacctcctaccatgcaacaccgtattttatctatgggggtttcgcagtcttcgccatctacaaacccttattttgcaaataatttggacatgtctgcaccaacacctggtctggaaacacctggtcctgtgttgcccggttcagcaggtgcagcagccgctgctgcaaaccaaccaatgtatccattacagtatcatttatatgcacccgctccaccaccaaggttgacgattcctttacaaccgtatgaaacaaacagtcaggcaatgtttattcccaatgatttgcgagagtatttgcataagaagaacgaagcaagtttgcaaagtttgagccatctgaatttgcctgagcatgttaaccagtatcattcattggtaccaatagacaaatcttatgaaccagtatccaaattgtggttaggtaaaaacagtttaattttcaaatgtcttgataatatagatggaaacttatatgttatgaggaaaattgagccatgcaatgagattataaatgaaaagccattcaaaactattaaaagatggaaatccataaagaacgccaatattgttggattgcaagatgcgtttaccactatggcattcaatgggaatcaatctggaaatacgtcattgtgtattatatatgattactatccaaatagtatcagtttattagagcatcataaaaaggggttacgtgttgaaccggtaaatgaggccttattgtggaattatttgattcaattgatcaatgctattatggccatccacgaaaaaggtttactggccagttcgactattgatttgagtaagattattgtcactaataaaaatagaataaaattgagctcagttggaattagtgatattttagaattcaaagacgatgaaaccaaccaggatattaagattagacagttacaagatatccaaaaagtgggtaaagtgttgatggagttgcctatcttatatcttcaccacggactgccggatccgactatttta

SEQ ID NO: 5945 - DNA, 414 bp, Candida albicans
aaacagaatcaatttccagctgctaaaaagacaagaactttgcaggattacattaattcaaacacccatttctcattaagaaagttagatggaaccaccgctgtgaaaagacaggaaacaatagccaaccaagtacaagatccaaaaatacgagcattgataacaaacgggcccaagttggctatagggaacattcgattgccagacttgaaaaagaaattacaaaacttgaatatgacagctgaattcaaaagtgagggtacattggtggtaaatgacattttagcagtcagaaagatcgcctatggattagttgaaagcgatgaatctggtgatatagtaatagatggtaatgttggtccattgtattataaagtcaaagaatgcataagggaaatgctagcatatgtatag

SEQ ID NO: 5946 - DNA, 1038 bp, Candida albicans
aaaaaaaaaacccagagaaaaagctttctgcatctactacaacaaagccaaaatcatttctttaaaggggatacaatgtttgggttttctcttttgactccaggagataatgatcattcttttaaagctgccttattagaatttgataatgaattcaagttgattgcagatccatcttggaatggtgtcgatgtaaatgcagccatgttcatggaagagcacttaaaagaaaccaatgcaatcctattatcacattcaacagcagaatttatcagtgggtttatactattgtgtataaagttcccaattttgatgtccagtatacctgtttattcgacattacccgtcaaccagttggggagagtttctacagtggaatattatcgtgctatgggatttttgggtcctgtggactcggctatacttgagttagatgaagtggacaactggtttgataaagtcaatttattaaagtatcaacaatcattgaatttatttgacaataaggtggtggtcacgccctataatgcagggcattcattgggaggcacattttggttaatcacgaaaagaatagatcgggtaatttatgcaccagcttggaatcattcaaaggactcttttctaaacagtgcttcctttatctcgccatcaactggtaacccacatttactgctattgaggccaacagctttcatcactgctacagatatgggatcggtgatgtcacataggaaaagaaccgagaaatttttgcaattggtggatgccacattagctaatggtggtgctgcagtattaccaacatctttatcaggaaggtttttagaattgtttcatttgatcgatgaacatttaaagggtgcaccaataccggtgtatttcctttcttattctggaactaaaatattaacgtatgcgtctaatctattggattggatgtccaaaagcttcactaaagaatgggaagaattatccagtgtccctttcaacccttcaaaagttgatttattgctagatccaagtgaattgttataa

SEQ ID NO: 5947 - DNA, 579 bp, Candida albicans
caatttaaaacgattaatgcaatggggtcaaaggtaaggaacgcatcagatattaaacaagagcagataacaagggatgaagctcttaggttgtacacgaacacgctaaatttcaatgtcattagccgatatgaccctgctattaaacagttgttgtgcaacacttctcattgtgtcttgtacaatttcaatgacgaaactgaagagtgggtgaagtcagattttcaaggaacattagcactttatgttcgagattttaaagttccatctactgcaactgcaccaagctatagagatttgcaaaaccttttctgttatggactcatacttttgaatagaaacaacccagaatgtttttcattgggtttattaccaaacaaaatcagcagtcagttttttccaaatggtttagatgactcttcgattctggaaatggacgttgaattgaatgacaacttaatcataataagaaatcttttaggtgaaatatacggtttatgggtgtttaatgaaagcgatagaatcaaactatttaaatcaatagagttctgtcttaacacagaggcaagcttaagctga

SEQ ID NO: 5948 - DNA, 426 bp, Candida albicans
agagaaaaaaaatatatacttctaaaagaaaaccccatctactcatcaaccaaacactcaaagatgaatcttattgaagacaatttcaaaaactcagcagaaagaatagataagccatctgcttacttaatcagaaaggcgagacacaattatggagaattggaaagagcaatgactctgaaaaccgtgtatgttggtaatttatctcatttcaccactgaagaacaaatacatgaattatttctgaaatgtggtgctattgatagaattataatgggattagatagaaataaattaactccctgtgggttttgctttgtgatatatcgaactgaacaaggttctttaaatgccatgaaatttttacaatcgaccattttggattctcaaagtatatcgattgatttggatcctgggttccggtga

SEQ ID NO: 5949 - DNA, 696 bp, Candida albicans
gatgaggtaacaattactacagctactacttattttgattttgattatacacagatacaaataatggcaaagaaaatatcgaaacatagtagagctgctagaagaggattaatagatacagacaccagtaatgaagctaaatcattagaatcaattcatagagagaaaagtgatgtcaaaaaatcaattattagaacaaccatcaagaatgaaaatttattgaataaaaaacttgaattatcaaaaataaaaaaatcaactactaaaaagaaaacatcagcattaaaacataaacttgaaagatccgataaaatcagtgggatattagctactaaaatcgatcaaagtatagcaagagcaaaatatgttcaaaatgctcgtaagtcaggatgggataaaaccaatcagagtataactttggaaaaccatttagctcaagagttgaaatctgctagtggtcttggtgatgaagaagaaaagaagaaagaattgacacaagaagaacttgataaaattgaagaagatgaatatgtaaagagtatttttgcaaagaaagaagaacaaaaggaggagggagaagcagaagaagaaactccaaataaatcattggcaaataacagatttgctttgttagatgatattgaggattatagagttttgttaggagaggaaatattgggtgtattaatagattga

SEQ ID NO: 5950 - DNA, 306 bp, Candida albicans
  unsure (181),(235): Identity of nucleotide sequences at the above locations are unknown.
tgggtaactcaaattggcctgtgttcaccctttgtaattgcaatttccaaccgtggaatcaaagtcttgccttctattttcaatgctgtcattttgtctgcattattatcagtggctaatgctagtgtttttgctacatacaagccattagttgccttaacacaagcgggccatggaacanagtttctggcttatgtggatcaaaaggcaataacaatatattcaattatcatanctcttggcttccgtcttattggaatttgtgggttcatcaagttatcaacctgttgtgttttaaattggtaa

SEQ ID NO: 5951 - DNA, 1020 bp, Candida albicans
  unsure (51),(52): Identity of nucleotide sequences at the above locations are unknown.
tgccttggatatacaatggattggccccataccaattatgactgtatattnntcgctcctgcatcaccttggttcttggtcagaaaaggtcgtttggaacaagccaagcatgccttggaacgtttattgtctcaaagtgaacatatccccgataagtctatcatttcccaaagtatgttgacaaaaatccaaatgactatcaaagaagaagatgctgtttctgctggttcatctattattgaatgttttaaaggtacaaactttaggagaactagaattgctgctttcacttggttgattcaaaacattaccggatcaagtttgatgggttattcaacatatttctatcaaaacgctggtgttccagtttccatgtcattcactttctcgatcattcaatattgtttaggtatcgttggtaccattggatcttggttcttgtcacaaaaatgtggtcgtttcacaatctacttttatggattatgtgccatgacagtacttttgttgcttactggtggtatgggtacgtccgacaaaaaatcacttagtatggccgttggtagtatgcttttggtttacacatttgtttacgatttgaccatcggaccaatgtgttactgcattgttggtgaaatgccatcatccaaacttagagccaagacggtgatgttggcaagaaacttgtataatattgctggtattattgttgctattgttactccatacatgttgaatcctactcaatggaattggaaggcaaaatctgcattcttgtgggctggtttcgcaatcttatctgctatttgggtatactttgaattacctgaaactaaaggtagaacttttgctgaattggataagatgtttgaagataaagttccagcaagaaaattcaaatacactactccaaccacttttgatgctggagaaatgatggaaaagatgggtaattctggtctcaaaagtattgttcacgatactgagcatgttgagagttctcatatcgaaacaaaggcttga

SEQ ID NO: 5952 - DNA, 606 bp, Candida albicans
gcgcgggtctttccagcccagtggtggacaattatcttgttctattttccccgggtgcatacttcaaagatgaaagacaatatgaattaccccagtaaaagagatcggttaacaatcagattgagcaaatctttccctatacggaaaaaggagaaagagatatcaagcacagttaattttgctaaacgcatgagcgttttgactccgatttttttaaaaaagttcaatttgaaaaagactatcgaggaaaacaacgaaactgtgaaaccacaaatattgagtattccagaaaatcctcgggagaatgctatgaagcccacagataacctcaatttgccaccagttataacaattggcagcagtggactagatccagtgagaggtggaattagcccagaacagagtttatacacagtcattcgttcttataacaagagtcttggtgatgagttaaatattgaagtaggagacaaagcagtgattttggaaaaacattctgatggctggtgtaaaattaggttggttcgtatgggcaaagattattataatcaccaattatctctggatatcggcttggttcccaaaatgtgtttacaaaaaatttaa

SEQ ID NO: 5953 - DNA, 393 bp, Candida albicans
aatcaagcaagagataacgaatgggaaagaaatcatttaccgttgacacaaggtagtcaggatatcaagaaggcgacaatctttacccagatcaccattcttgcctccagaacatttaaaaacttgtacagaaacccaagactcttgttggcacattatgttttgtccttggcagttgggttattttgtgggtatttgtactatgatgtttccaacgacattagtgggttccaaaatagattagggcttttcttctttttgttggcattttttggattttcagcattaactggattgcattcatttgccacagaaaggattattttcatcagagaacgagccaacaattattacaatccattaagttattatgttagtaagctttttctgtga

SEQ ID NO: 5954 - DNA, 861 bp, Candida albicans
tttgttgatcaagaggatcacttgatacttacgttgactgtatatgagactgttttaaacagtgcgttgttaaggcttccgcgtgacatgagttttggacaaaagcaagcaagagtaattgaagtacttagtgaactaagaatcttgggcatcaaggatagagttattggatctgattttaaaaggggtatttctggtggtgagaaaagaagagtctctattgcttgtgagttggttacttccccttcgattttatttttggatgagcctacttccggattagactcttacaatgcaagaaatgtaattgaaagtttggtcaagttatcacgtgattatgaaagaactgttgttttcacaattcatcagccaagaagtaatattgtatcgttgtttgataaattgcttttgcttagtgagggagatttgatatattcaggagaaatgatcaaatgtaatgatttcttcactaaaaatggttataaatgtccaccgggttacaacattgccgattatttgatcgatattactgttgatcacaacaagatagttaaagtttctgatgcagattccagtgttgctatagcgtcatcaagtgatttgcatgatgctaatgtccatgcagcttttttgagcactagatctgagagtcaagtagacaccactagtgaatgggagcattttgctgtgcatcgtgatgaatacaacactgatattattgggcatcgcaaatctaaaggtggtgaagaagaaactatacttcgcttaagaaataaattaccaactttgtttatagagtcgccctctgcatttgaaatcaagcaagagataacgaatgggaaagaaatcatttaccgttga

SEQ ID NO: 5955 - DNA, 1008 bp, Candida albicans
tccccccccatatcaactcaaaccatgaatggtaatttatttgtggcgtggacagtcatttcatgtctaaagcaattgacaatgggattgaaggttgagaataatcaagatcttgaagctacttttacaagaattaaaagatcactcgtacatcaagatatatttgagattaatcctcaaataaccgaacgtgccaaaccaggacatggcaatgatggtgatgacgataacaaagaatgtccaccatgtttcaattgtaacttaccaaatttcgagtgtacccaattttcccagtgtaatacatttacaggaatgtgtgaatgtcaagatggttttggaggcaatgattgctctgaacctttatgtggatctttaggagatggtaattcaaagagacccgtcagaaaaaagaaacagtgtgcatgtaaatcaggatggtctggaatcaattgtaacttgtgtgaaagagacgatgtgtgtgaccaattcatgccagaagggttaaagggaacttgttatagagaaggtattatagttaacaaatttcatcaaatgtgtgatgtaactaaccccaaaattctttctatattggatggcaaaatcccacaagctacattttcgtgcaataaaacttcggaaaattgtaattttcaattttggattgatcaggtagaatcattttattgtgatttgaacaaatgtaaattggattatgatttgaatgccaataccactcattataattgtgaagaagtagcttgtaaatgtttacctgatcgaatgctttgtggtaaggctggatcaattgatatttctgagtttttaactgaaacaattagaggtccaggcgatttcacctgtgatgtcgcaaccaaaaagtgtcgcttttccgagccaagtatgaatgatttgatccaaagtgtttttggcgatccatatatcacgttgcaatgtaaatcacgtgagtgtattcgttttcacacacgccgctggaaggaccaacgtcgg

SEQ ID NO: 5956 - DNA, 465 bp, Candida albicans
cttggttggtttgacaatggagcacaatgctttccttcaaagttattttggttttggtgttgtataatgtgtctgttgccccttgaaatgttgattgtgggtatattggtaaaagagccaggaacgtctacaatggttggggttttgttattattaatgtcattgctctttgctggcttatttataaacagtgaagatttgaacatgcaaataaaatggttggagtggatatccgtgtttcattatgcgtatgaatcattatccattaatgaagtaaaggacttgatattgcgggaaaagaaatatggattgtcaattgaagttccaggtgctgtaattttgagtacctttgggtttgatgtgggtgcgttttggaaggacatttcgtttttaggaggattgtctgctgtgttcttaggtctaggatacattttcttgttttattttacagttgagaaaagatga

SEQ ID NO: 5957 - DNA, 4089 bp, Candida albicans
ggtcgaagacgaggtacgctcgatgaaactccgatagttgacgataatggatttcttcacgaagataaaccacggagaaaaagagtcggggcaagtgaacctattgattcgaatgaaccaacttcattactaccaaaacaaaatttgagcaagaaattcaaaagagtgtcagtggcattacagaatacacgaacttcaggggaatcgtacaattttagaaatgtattccaaaataatgttgatcaagcaaatagaacagcaactcaagataatactgcccccaaacttgaacgcaaaagtacatattacagaaaactacaagagaaaaagctacaatcatcacaagaacaacaaggtacagaagtggagaatatggtaatttcaaatgatcaacactcggaagctagttctatcagcaccagagcatcaagtacacatactgataccagtggaagagacgacgaacaagatgataatctagtgaaaaagaattcgacaaattcatcatcaaattttgtattcagtaataataatttaccatcatcgtacaatttgggaggatctaaagtaaatgacgatataccaattcgaaaagatttaatcagagaaaataaagcacaagttcagcaggatgcaattgatagggaacgattacaaatgtacaataattcaacggcaatgtcagaagaaggtgggttgaacattgtttacaaagacgccaatactactagtgatgacacatacctgaaaccaccatctccaacaaaatctgaagaaaaagaagacaatttgtccgattttttcatacgagcattgcattcatttgattcatcaactttacaatcaaaatcagatgcatcaatttgtttatcatttgagaaaaatgacattgcatttcttcataccattgacgaatcaggatggggggaagtcactttattagaaactttacaaactggatggattcctatgaactatttttcgctcgttgttacatccagtgatgatgaagaggacgaggatgatagctatgaagataatgacgatgacgacagtaataaaatcccaaataatcattatttgaaaccattattacatgcatgtggacaatctctttctaatccattgagtcataaagatcgtcgaaacaagtacactttttccattagagtgataaattcaattagagatggtgtgaggttattattacaacaaactgattgtttatcaagatcgaatgaattagtcaccaaaagaccaattgtaagaaaatcgcggaaatcattattggcagattggtataatcttatggtcaaagctaatgaatttaaaggtacttcaaattacaacaaaatagaaatcttaacattaatggtgtatcaagtgagtcgtaaagctgtatcatttttagaaatatggtcagctgaaagtaaagaaatcattactcgtgatcacacggggaaaaaattatatgatgatttgaatgattgcccattattgaaaacgcctccattggccaaacaaagaatcacggaaatccatggggtattattttcctatttagggttaattataggaagattggatttgattgaacataatcaaattggatgtgatatgttagagactttagctcatcaaattatattacttttacgagaattattattcgtatcaagaacaggttcagaatattccaaagataaacctcgagaattagatagttctttagatggattattatctttagtcagcgatttggttgctagtgtgaaaaatttagtggttagaactgttaatgaaactgaagaagatcgtattcacaaatttggtggcccacaattaaatggggccagagattattattacacaccagaaggaggagaattgttacaaattgcatcaagaatggttaaagcaattagtgtgacagttgcatcgattagaaaattattggaagttactggtgatttcaaattaagttcagaaagatcttatccagattattcgaaaatgagaattgaacctcaagaatttattaagaaatgttcacagggaatcactaaactaaaagacatgccaatacaacaacccaacggcgcaacttctacttctaatagtggtggtattaaagcgtataaagctaatagatattctatgattagagctggtaaaactggggatttgggtttaactgagaatggtgtcaattacttacaatcattgaataatgaagatggtaatggtaataatgatgttgatgagcttgatggatcatcaccatttactctgtcagctcctgaatttaaaccattcacatcagaaggagggaatgaatcaaacaatgatgctaatattaatgccaatataaataacgaattatcagttgatagtaatggaaatctattagggggttcatttaaagggcttgtgtatactttaaccaatgaagatctgccaccagagtatttttttgtgtcaacatttttcatatgtttccgaagttttagtactgggattgatttaattgaagaattaataactagatttcaagttggttatgttagtaatgatattaatattgatttgaaattgaaaaagagaaggaaattagtggctaaactgattcaattatggatggaatcttattggaatcatgaagctgattataatttgttgacgacattaatcaattttttcaatgaaggtatgagtgattatttacctttggatgccattagattgattgatattggtgccagactttcatcaagaccattagtggagaatagatccagaagaattaaagacaccaaacaattagtcaatagaagtattaccaatgctgctaaattaccaagaaaaactgggtcaatccttggtgatgaaattaatcgttattcaatgattgatagttatagtctttccaagattaacagcaccagcagtagtaactcaactactagtagtagtggtcattcagcatcgttgccaatgccacttggacctactagtacatcgaaaacatcattattgacttcttcacaacttgaaactattgaaaaagttaatcttacttatagagcaatcttggggaatagttggtgttcacaaaaatatattaattcagttaaatatattccattagatttatcagtgttaatgccgaatttttatataatttgtgatcaaagttgggttttatcaaattatcgaccaaatttattagattttaatggattagaaattgctaaacaattaacattattagaatcatatattttttgttcaattaagcctgatgaattattaaatcaaaattatactaccaaaagagctcatttaaaactagctccaaatgttcgattatcattattattcaccaattgtttatcagggtatgttattgaatcaatattacaacccaatatcaccattaaattaagaattagtatggtgaaaatatggttaaaaatagccatctcatgtctttatttaagaaattttaattcattagcggcaattataacagcattagaatctcatttaatcaccaggatttcatcaatttggattaaattagaagataaatatactgaattatatgattatttatcaagtattattcatccagaaaaaaattatcgagtttatcgaaataaattacgaaattttttgaattcaccaatgggattagaaactccacctattcctattgttccttatttttcattatttttacaagatttaacatttattaatgatgggaatccaaattatcgtaaagctaatacatttttaaatcaaaaattaattaatattgataaatatttgaaaattaccagaattattgctgatattgaatgtttacaaatatcttatctagatgatccaaatattgttggtaatggtgatggtaattctttaatggaaaatggtgatgataaaccaaattatactattaatccagttgcaccattacaagaattgattttattggaattatggaagatttgtcaattgaataaaactgaagaagatcgtgcttggaaattgagttgtaagattcaaccaagagatgttagttag

SEQ ID NO: 5958 - DNA, 984 bp, Candida albicans
agaaccctaacaagtcaaacaaataataacatggcttctagagatttacctcattcactcaatgatcttgcctttggatggattaaacaccttaaagaagaaatcattattaataaaaattctcaacaattattcgatgaagatttccaacctgatgaagatgttactaaagaaaccaaagtcaaattaaataatttatggccggcatttgcctccggagctgggttatttgccgatgggtatgtcaataattctattggtattgttatggcatgtttaaaaattctttatggtgatgaattcacaaaatcaaatgccattagtaatattggatcaattggatttgttggtactgttgttggacaattgagttttggatatatttctgatcgagtagctagaaaaggtgggatgatgacagctaatatcatgttgattgctttcactttattatgtgctgtgggatcttggggtactactattcaaggatttttcgcatgtcttactgtttggagattttgtttaggtgtggctattggggccgagtatccaacgtcttctgtcattgcctcggaatttgctaatcaattgcctgctggtaaaagaaatagatatttcatttggttcacagggtttatgattgattttggatttgttgtttctgcgtttgtcccatttgtgttattgtggattttcactgaaaaacatttaagagcattatggagagtttcgattggattaggtgccattcttccaactgccttgttttttattagattgaaaatgaaagattcaacttcatttgaaaaattacatatgaaaaatgtcagatacagagattatccatggtggttaattgttaaattttattggtttagattaactattgtgtctatgatttggtttatctataacttttcactttattcatttggtacgtttaatgccattattttgggccaaattatccctgatgctccatta

SEQ ID NO: 5959 - DNA, 999 bp, Candida albicans
  unsure (974),(975): Identity of nucleotide sequences at the above locations are unknown.
ccaattcccttcttcaatcgacctattcagatttcctattccttatgtagtttgatttacttattaacttttttacccatttattccatccatcttgtaagtttcagttttcatttcctcatctatcttatcttatcttatcttttttatttggtcacacacttatacatatatctttttttgtttgaaacttctactgactttacaaatatgtctactagagatttacctcatagtttttccgagttgagttatggctgggtgaaaagaatacgtgctgaattcaccgttgggaaaagtaaagaacaattactcgctgaagattatcattctactactgatgaagattccgaagtagtcacatctgttaaagcaaatagtttatggccagcttttgcttctggagcaggattattttccgatggttatgttaataattccattagtacggtgcttttttgtttgaagaaaatttatcctgatgaaatcaccaaatcaaatgccattaataatattgcatcgatagcttttgttggtaccgttgttggtcaattaggttttggttatatttctgatagaattgctagaaaaggagggatgatggcagcaaatgttatgttgatttttttcacattaatgtgcgctgtaggatcttggggggttaccgtccaagggtttttcgcttgtcttactgtatggagattctttttgggggtagccattggtgcagaataccccacctcttctgtcattgcttctgaatttgctaatcaattaccaccaggtaaaagaaacagatatttcagttggtttactaatgccatgattgatctgggtttcgttgtttcagcttttgtcccatttgttttaatttggatttctactgaaaaacatctacgagcattatggacagtggccattgggttaggagttatcccacctttatcattatttttcatgcgtctgaaaatgannaattcatcttctttccacaaatga

SEQ ID NO: 5960 - DNA, 468 bp, Candida albicans
agaccagttgttttcggtatatttgctacattgggtgaatttggtcctggcggtaacattggattgttagcttccaaaacatcagctactccaatcagaggtcaatattacggtattgctgctgctatgggtaaaattggcgcttttgttggaacatggattttccctgctatccaaagaagatacgctagtaaaactaaccccgatttggaattacaggttccattttatctttcctcagggttatgtattttcagtgccttgttaacattctttttgtgccctcatgttggacaagatgccattaatagagaagataaagagtttgttgagtacttacgaaagaatggatttgatgtcagtaaattgggagaagacagcagttctgttgatgttgatgttgttaaagatactgattcagctgaaaaaattagtgaaactatcgaagttggtcaaaaattagcctaa

SEQ ID NO: 5961 - DNA, 930 bp, Candida albicans
atactaatcattgagatggcattctggagaaccatgtttgccattggatgtctttggccactatcagtgttttattttcgattgaaaatggtgacttcagaattatatactaaatcaggaataaagcaacgtgctccatattggttagctcttaaatattattggcctcgtttaattggtacttgtgttgcttggttcttatatgattttgttactttccctaatgggatttattcagcaggtattatttccaatgttatccctaaactggaaaagaataatttagaaaaaattgctgaatggaatttacttttaggtgccattgcccttccaggggtatttgttggtgcttatgttgttgatattttgggtcgtaaatatactatgatgattggattttgtggatatattgtgtttggattaattgttggttgtggatatcatcaaattaaacccataactgggttattcattgtattttatgggttaatgatgagttgtgggaattttggtcctggtaataatatgggattaacttcttcagaatcatttgctacaccaattagaggtactgcgtatggtatatcagctgccattggtaaagttggtgccgtagttggaactaaaacttttagtccaattcaaaagaatttaggtgataaatggacttttattattgctgccatttgtggattagctggagttttggtgacatttattttcataccacatttaaaagacgaagatttattagaagaagatgttaaatttaaaaattatttgattgataatggttggaaaggtaaatttggtattcaagaatatgatgaagaagaagatttggaaggtagtagtgaagattcatccgatggtgaaattgtgaaaaataataccaaaaatgatgtggaaaaagtggatgcattgaaataa

SEQ ID NO: 5962 - DNA, 594 bp, Candida albicans
ttagtacggtattatcattgtttgaaaaaaatttatggtgatgaatttattaaatctaatgctatgaataatattggatctattggatttgttggtacggtggtgggacaattaagttttggttatatttccgataatttcgatagaaaaaccggtatgttaactgctaatgtaatgctaattttctttacattaatgtgtgctgttgcttcttgggggacaacggttcaagggtttttcgcttgtcttacagtatggagatttttcttgggtattgctattggtgctgaatatccaacttcttcagttatagcttcagaatttgctaaccaattaccttccggtcatagaaatagatatttcagttggttcaccaatgctatgattgattttgggtttgttgtttcttcgtttgttccattggttttattatggattttcactcctcgtcatttaagagccgtttggagattaagtatcggattaggggtaattccaccattgattttgtttttcatccgtttaaaaatggataattccaaatcattcaaaaaaatgaatatgtcttcaccacgccgctggaaggatccgcac

SEQ ID NO: 5963 - DNA, 1599 bp, Candida albicans
  unsure (1525): Identity of nucleotide sequences at the above locations are unknown.
acaactcacacaagaaaaatgagatctattacatccagaacagaagatcatcttcataatgttatatcacacagatccgaggtaagatctattgacccacaacacaatgctggtgatgttgaattgttagctcaaattgggtataagcaagaattgagacgtcattacagtacatttcaagtttttggtattgctttctccatcatgggtttgttacctagtatatcttcggtattatcaattgggttagaaggtggaccagctgctttagtttggggctggatcctggcatccatttttatcctttgtgttggtacaagtcttgcatttcttggaagtgccatccccacctctggagggttatactactacacgaattattattgccctgatgcgtttagagtgccattgagttttatgattggctgttccaactcgttgggcttaattggtggattgtgtagtatcagttatggctttgccgttcaagtgttatctgctgtctatatccagcaggatggggcatttgagattacaagggcaaaatgttatggtatttttgttgcgtgtgttgtgtccaatgctattatatgttgtttagccacaaaacaagctgcgttattacagacaatctccattattgtgaatgtgtttttggtgttgttatttttaattgcagttccggttggtacagggcacgggtttaattctgctagctacatttttggtacgttaatcaacaacagagactacggtactgcctggtcctttttcttgagttggttaccggctatttggactataggttcgtttgattcaacaattcattgcagtgaagaagcaaaaaatgcccagagagctatacctgttggtattattggttctattagcgcctgtggaattttaggctgggcaatttgtattgtttgtgctgcttgcatcaaagacggtgatgtttctcgggttcttcagtcagacaccggttctgccatggcgcaaattatttatgatgcacttggtaagaaatgggcagttgcgtttatgtcgcttattgccgtgggtcagtatttaatggcagtatcagaaatgattgcattgtcgagacaaatttggtcatttgctagagatgatggtttgccggttgtttataattttgtgaaatacgttaatcccaagattaaagtgcctatcagagctagtatttttgcaggagtgttatcgaccttagttggcttattggtgttgattggggacgcaggttcaggggcacttttcagtcttgcaatcgctagtttacagttgtcgtggggacttcctgtgctacttgtccttttgccatacggtagaaggaaattcattagtggtccatttcattttggtttcaaaacaaatacggcaattaatcttgttactatctgttggtcagtgtatgcaattgtgttatctatgttcccagacagcagaaaagtagataaagcatccatgaattacacagttgtaatcaatgttggtgtttggttattancattgatatactattttgtttggggatacaggttctacagcggtcccaaatccaatcttgataaagatgacgat

SEQ ID NO: 5964 - DNA, 1428 bp, Candida albicans
tacgctgctccttcgacccgtctggtgaagactccagctggtttggtatggggttggtttttgtcttcaatctttatcctttgcattggtataagtcttgcatttcttggaagtgccatccccacctctggagggttatactactacacgaattattattgccctgatgcgtttagagtgccattgagttttatgattggctgttccaactcgttgggcttaattggtggattgtgtagtatcagttatggctttgccgttcaagtgttatctgctgtgtatatccagcaggatggggcatttgagattaccaatgcaaagtgttatggaatttttgttgcatgtgttgtgtccaacactattatatgttgtttagccacaaaacaagctgcgttattacagacagtctccattattgtgaatgtgtttttggtgttgttatttttaattgcagttccagcaagtaagggtggtgattttaactcacgcagttttatctttagcaattttgagaattctagagattatggtacagtgtggtctttcgcattgagttggatgccagctatctggactattggcgcatttgactccacgatccattgcagtgaagaagcaaaaaatgcccagagagctatacctgttggtattattggttctattagtgcttgttggattctaggatgggccatttgtattgtctgtgctgcttgcatcaaagacggtgatgtctctacagttcttgaatccgacactggatctgccatggcgcaaattatatatgatgcacttggtaagaaatgggcagttgcatttatgtcgcttattgccgtaggtcagtatttgatgtctgtgtcaattatgatagccctttctagacaaatttggtcttttgcaagagatgatggtttgccggttgtttataattttgttaaatacgttaatcccaagattaaagtacccataagagctacaatgtttgcagctgttttaggaatattattaggattattggttttgatcaatggaacagcaggatctggtgcacttttcagtcttgctgttgctagtaacgttctttcatggggacttcctgtgttgctcattcttttaccttatgggagaaaaaggtttattcctggaccattctattttggatctaccataagtaccctcatcaatattgtcagtgttggttggacaggatacgttattgttttgtgcatgttccctgattccattaccgttgacaagaactccatgaattacacggtagtcattaatgttggtgtttggttattggcgttgatttattatttcgtttggggctacagattctacacaggtcctaaatccaaccttgaagaagattttgtagaaggtgtcagcaccggcaatgtcgatgaagtcttgaacgaaaaagtctag

SEQ ID NO: 5965 - DNA, 2298 bp, Candida albicans
gtgattaggtaccacatatgtattttgtcctataataccgtattcgaagatatgaaaaatttatctgtgtttccatttttaactcgtataatgtacgatgcttcattggaagacgagtattatcgtcaaatgagacaaaaatcatcgtcgatatcggcattcaaagtagggttggtggcagctatgggtgggtttctttatgggtatgatactggtttaatcaatgacctattagaaatggaatatgtttacactcatttccctagcaacaacaaaagtttcacttctcatgaacgatctattcttgtggcaattttatcattaggtacttttattggtgcattgattgcacctttagcatctgaccgatatggcagaaaattttctattatgatgtcatcaggactaatattcattactgggaacattctacaaattgcatcagctagtattgccctaatgtgtgtggggagatttgtatctggggtatcagtagggatcctttctgctattgttccgttatatcaagctgaagtgtcgccaaaatggctgagaggttcagtggtgtttacttatcaatggagtataactgccggacttttagtttcgagtgccgtgtgtcaaggcacaaggaaaataaataattcagaatcatatcgaatacctataggtttacagtttttatgggcccttattttattttttggaatgtcttttctaccggaatccccacgttattatgtacaacaggataatttacaactggcattggattcattatgtaaattacggaaactaccgcctgatgacgacgatctaatagaagaattggtcgatataaaagctaattatgattatgaattatcttatgggaaaacgactgttttggattgtttcaaaagtggaggtggtcgacataaacaaggtttaaggatgctaactggtattggtgtccaatttttccaacaatgttccgggataaattttattttctattatggagtcaattttttttcatcaacagggataaataattattatattatgtcattcattacctatttggtcaatgttattttcacagtaccggggatcatgatgattgatgtcgttggtagacgaccgttattgttttggggaggtgttgggatggccgtgtgtaatttcattattgccattgctggtgtcagtgttaaaaatgatgaagttaatgggattttgtgtgtttcatttgcatgtgttttcattgcattttttgctagtacttggggtggttgtacttgggccctttgttcagatatttatggtatatctattagacaaaaggcagttgctttgacagcagctacaaattggttagtcaattttatttttgcgttcatcactccatatttaattgatacaggtcaacatactgccgccattggtagtaagatttttttcatctggggtagttttaatgcttgtggtgccatatttgtctttttcaccgtttatgaaactaaagggttaaaattagaagaagtcgattacatgtatgttcattgtgataatgctagagtttccactaaatttatatctacgaaaattgattttgctcatttagatgagaattataatccaataccaatgacacaattaccagactcgacatcatctaatgaaatgtaccacgataaaggatcagatgagaattcatcgcctcaacaactaccacactaccaccagcaacaaccattgtataatggcgaagatcagaataatttaacaataattccatacgacaattccctgacaatatctagtgttaattctattgaagaaagacgagattctattccatcaactaacgggttatctttcacgtcatcgtcacaatcacatccacaatcaaactcatattctcattctaattcacattcagcaacgtatcgatccaaaagtcataattcaatgatatccaacgattatcaactgtatttagaatcaattcaacgagaatattctcaacattatcaaaactcttcggctatgataaaacaattatctcgcaatagtcgaaacaatgggtccgatcaagaggaaagacatgaaccaatacaaaaacaagaaatcattgatagtccattgaatattaatagtattaaccatatcaataatatacctactacagtgatagcaacaccattttttgctcatcctccaagtgattcagattcgagtgatgatgaagaggaagaggaagtggtggtggaacaagaaggggtaaaaataaacgacgttactactattaaataa

SEQ ID NO: 5966 - DNA, 405 bp, Candida albicans
agttctccttctattgtttatacttgcattatttttacaaagatgagtgcaaatatccaagctcttatgaaaagctatgtcaattttgacgaacacacttctggttccgctgccagaggtattttaatcggtatgtttgctgcttttggtgggtttttgtttggttacgacactggtactatttctggtgtattgtctatggactacgttaaagccagattccccaacaacaaaaccgatttcacttctggtgaaagttcccttattgtctccattttatcagtcggtacttttgttggttccttgattgccccattgttttccgatagaattggtcgtatatggacattgattttatctactttgattgtttttaacttgggagttcttttacaaactgttgcc

SEQ ID NO: 5967 - DNA, 1077 bp, Candida albicans
agacctttagaacttgctcaagccattagaacttctactaaattattgaaaacaaccgcatttgtcaccatttaccaagctggtgaaggtatttatgaaacattcgatcgtgtcactgtgctttacgatggacatcaagtttattatggtccagcaaacaaggccaagaaatatttcgaagatatgggttgggaatgtccaccaagacaatcgacagcagaattcttaacagctattactgatccaattggtagattccctagagctggttgggaaaataaagttcctagaacagcacaagattttgaacattattggttgaattcaccacaatatcaagaattaatgcaagaaatcaaagattataatgacgaaattgatgaagatgaaactagaagcaaatattatcaatcaattcaacaagaaaaaatgaaaggttctagaaccaaatctcctttcacgattagttatttagaacaattgaaattatgtttcattagaagttatcaaagaatcttgggtgatagtgcttacacaataacccttatgtttgcctcagttgctcaagcttttgttgcagggtctttatattataatactcctgatgatgtttctggggcattttctcgaggtggggtcattttctttgctgttttgttcatgtcattaatgggtttagcagaaatttctgcttcatttagtagtcgaccaattttgatgaaacaaaaaaattatacaatgtatcacccatcagcagattccctttccaattttgtcatgtcgattccaattagtattttcatcaatacttttttcgtcattatcttgtactttttatccaatttagctcgtgatgctggcaagtttttcatttgttatttgtttgttattatgctacatttgacaatgaaatcaatgtttcaagcaattgctgccatcaacaaaagtattgccggtgcaaatgccatgggtgggattttgatgttggcatcattaatgtattcctcatatatgattcaacgtccttcaatgcatccatggttcaaatggatgtcctatatcaaccctgttttataa

SEQ ID NO: 5968 - DNA, 915 bp, Candida albicans
gaacagttcaatatgtcatcagaagatattggaagttcaagttcatctcttcaagagtatgttggtcaacagcaacacaacaaaatacaaccttccaccgatgatgattacaatgaagatgattatgaaagtagaagattacatttagtaagaacagtttcatcaatcaatcatcataattttgatgaaaaattcgatactatatcgagagaaatttcccgtcaagtgactaataaagaaggagaatttcaattaagattagatgaattcaatttagctaaaatattagccaattttgtttattttgctaaaaaacaaggaattgttttacggaaaagtggaattacattccaagatctttgtgtttatggagttgatgaatcatttgatattgctcctaccgttactgatttattaaagggaccagttggtgctgttcaagccatattatcacacatgaaaacaccaccacggaaaattttgaaaaatttaaatgggtttgctaaacccggtgaatcagtgttggttttaggtagaccaggtgctgggtgtacaactttcttgaaagcattaagtggaactgattttgatttatacaagggagtcacgggtgatatcagatacgatggattaccacaaaaggaaatgttgaaattgtttaagaatgatttggtgtataatcctgaattagatgttcatttcccccatttaacagtggatcaaactttgacatttgctattgcttgtaaaaccccagaaatgagaatcaatggagtcactagagatgaattcatcaatgctaaaaaagaaatattggcaactgtgtttgggttaagacacacttatcataccaaagtgggtaacgattttgttcgtgtgtttccgtcttcaccacgaggctggaaaatcccgcgc

SEQ ID NO: 5969 - DNA, 801 bp, Candida albicans
  unsure (642): Identity of nucleotide sequences at the above locations are unknown.
acatccaagatattaaacaacttatcatttgatatcgaatgtggtcaacttgtggcaattatgggtgggtcaggtagtgggaaaaccacattattaaacactttatcacaacgaaccaatatcaataataaaaacttggggttttctggatctgttacctatgaaacttctagtctgaataaacatatcaagcatgcatatcttttacaaacagatatatttttgcctgggttgaccgtatgggaaacattatcaacacaagcagacttacgattaccttcacatgtcactaaacaagaaaaaattgaattgattgaatatattttagatgttcttgaattaagtcaccttaaaaatacatatgtggcttcattttccctgaatgcaagtactttatctggaggagagcaaagacgagtatcattggccatacaaatgttgtcgaaaccagcaattctatttcttgacgaaccaacaactggactagatacatcatcatctttgaaattagttcacgttttgaaaaaactagcgtcaccagaatacgggatcactattattttatccattcaccaaccaagacctgagattggacaactttttgataaaatttgtttgttgaccacaggaggaagacttgtntactttggaaatttggccaatgcccagatgtatttcaataatctcaactttttgggcagagattcagatgaatcttccaaacacattttgggaatacattatggatttatcagtgaaaagacacaacatcatttgaaaaaggaacaacaaacgttttaa

SEQ ID NO: 5970 - DNA, 831 bp, Candida albicans
  unsure (45),(211),(820): Identity of nucleotide sequences at the above locations are unknown.
actggtgctcaaaatggtatgtttgggcctttcttatcaagtgtnattgctgctccacttattaatcaaattttagaaaaagctggactgagagatatttatgaagttcgagaaaaattatcaattacttatcattgttcacttttaatattaccacaaatcatatttgaagtgatttatatgatcattggtgggacaattatgtttgttngtctttatttcctaactcaagtgagtactgtggccctgcattccgggatgttttatttcagtcaagctattttccttcaaacatttgctgtttcatttggattaatggtactgtatgtttcccctgatattgaaagtgcttcagtgattgtttcattcttgtatacatttattgtatcattttccggtgttgttcaaccagttaatcttatgccgggattttggacatttatgaataaagtatcaccctatacttatttcattcaaaatcttgtttcatcatttttgcatgatagaaccattcgatgcaatgctaaagaattgtcatattttaatccaccatcaggacaaacttgtaaagaatttgcaagtgcatttattagtcgtaatggtggttatttagttgatgaaggagcaacttcaaattgtgggtattgtaattttagcaatgccgatcaatatttattgaccattggagcaaaattttcttatagatggagaaatattggatttttctgtgtttacattattttcaatattagtgtttgcttagtgctttattactttttgagatatagacagtatctttcagttttcgacagacgggcgngatcattgtat

SEQ ID NO: 5971 - DNA, 339 bp, Candida albicans
atacagcaagatgtcgaccgttcttgttttaatttatttttggatgtgaaatttttaaatcattgcaaattcaaattattcaaaatgtcctcaactaattcaacagaaaaccatgctgtggaggagaagtatgaagatccacaacaacaacaacaacaacaacaacaacaacaacaacaacaacaacaaaaagatgccttggccaaaaagcctatgtctgcgtatattggtatcagtataatgtgtgttcttattgcctttggtggttttgttttcggtttcgataccggtaccatttctggttttattaatatgtctgacttggtcgaaagatttgtg

SEQ ID NO: 5972 - DNA, 1521 bp, Candida albicans
aggaatatattggtattagtattttgtgttttccttattgcctttggtggtttcgtttttggtttcgatactggtaccatttctggtttcattaacatgactgactttttagaaagatttggtggtactaaagctgacggtactctttacttttccaacgttagaactggtttattgattggtttgttcaatgtgggttgtgccattggtgcattattcttgtccaaagtcggtgatatgtacggtagaagagttggtatcatgactgctatgatcatttatattgttggtattattgttcaaattgcttctcaacatgcttggtatcaaatcatgattggtagaattatcactggtcttgctgttggtatgttatcagttttgtgtccattatttatctcagaggtttctcccaaacatttaagaggtacattagtttattgtttccaattgatgattaccttgggtattttcttgggttactgtaccagttacggtactaagaaatattctgactccagacaatggagaattccattgggtttatgctttgcttgggccttgtgtttgcttggtggtatggtaagaatgccagaatctccacgttaccttgtcggtaaagatagaattgacgatgctaagatttcacttgccaaaactaacaaggtttctccagaggaccctgcattataccgtgaacttcaattaatccaagctggtgttgaaagagaaagattggccggtaaggcatcttggggtgctttaatcactggtaaaccaagaatccttgaaagagttattgttggaggtatgttgcaatcattgcaacaattgactggtgataactatttcttctactacagtaccaccattttcaagtctgtcggtttaaatgattccttcgaaacatctattatccttggtgtcatcaactttgcttccacttttgttggtatttatgccattgaaagattgggtagaagactctgtttattaactggttccgttgccatgtccatttgtttcttaatttactcattgattggtactcaacatctttacattgatcaaccaggtggtccaaccagaaaaccagatggtaacgctatgattttcattactgcactttatgttttcttcttcgcttctacatgggctggtggtgtctactccattgtttctgaactttatccattaaaagtcagaagtaaggctatgggttttgctaatgcatgtaactggttgtggggtttcttgatttccttcttcacttcatttatcactgatgctatccacttctattatggttttgtgtttatgggctgtttagtgttttccattttctttgtttactttatgatttatgaaactaaaggtcttactttagaggaaattgatgaattatactctaccaaggttgttccatggaaatcagccggttgggttccaccttctgacgaagaaatggttcgtgcaaaaggctatactggtgatatccacgcagatgaagagcaagtttaa

SEQ ID NO: 5973 - DNA, 1257 bp, Candida albicans
acatttgtctttccagccggctgtgtcgaatatgtccaaattgcgtctcaacatgcttggtatcaagttatgattggtagaatcattactggtctcgctgtcggtacattgagtgtcttgtgtccattatttatctcagaagtctcaccaaaacatttgagaggtactttggtgtgctgttttcaattgatgattaccttgggtatcttcttgggttactgtactacttacggtactaagacctattcggactccagacaatggagaattccattgggtttatgtttcgcctgggctttatgtttgcttggtggtatggtaagaatgccagaatccccacgttaccttgttggtaatgacagaattgaagatgccaagatttcacttgccaaaactaacaaagtttccccagaggacccagccttataccgtgaacttcaattaatccaagctggtgttgaaagagaaagattggctggttcagcatcatggaaatcattgataaccggtaaaccaagaattcttgaaagagtctttgtgggtgccatgttacaatcgttgcaacaattgactggtgataactatttcttctactacagtaccaccattttcaagtctgtcggtttaaatgactctttccaaacgtccatcattattggtgtgattaactttgcgtccacttttgttggtatctacgctattgagaaattaggtagaagacattgtttgttaatcggttccgttgcgatgtccatttgtttcttaatttactcattgattggtactcaacatctttacattgacaaaccaggtggtgctagtagaaaaccagatggtgatgctatgattttcattactgcactttacgttttcttcttcgcttctacatgggctggtggtgtttattcgatcatgtcagaactttatccattgaaggttagaagtaaggccatgggtatagctagtgcttctaactggttatggggtttcttgatttctttctttacttcattcattactgatgctatccacttctattatggttttgtgtttatgggctgcttagtgttttccatttttttcgtttactttatggtttatgaaactaaaggtcttactttagaggaaattgatgaattatactctaccaaggttgttccatggaaatcagccggttgggtgccaccttcagaagaagaaatggcgacctctactggttatgcgggtgatgccaaaccaacagaggaacacgtttaa

SEQ ID NO: 5974 - DNA, 648 bp, Candida albicans
  unsure (540),(598): Identity of nucleotide sequences at the above locations are unknown.
aagtgtattgatttgagggaattttttaaaaaaaagatgggaagttcaaccaataatacacaatcaaaagctacccccagtgtgttagaaaatgaagtcaatagctcaaaatcatcagttgtttcatcaacgtcttctgctaaagggttgctacgtgaaaccactaatcatggtactatggaaacatcctcggttcagatatctgaatcagaatctcgtccatcgaaaatggtacttgtattaacacttgcatcatcaatttctggatttatgtttgggtacgatactggttatatatcttcagcattagttcaaattggtacagatttatctaacaaaattctaacatcaggtgaaaaagaatttataacttctgccacatcgttaggagctcttcctggtgctgttgttggtggtgtattaccaaatttgattggtagacgtagagttttattgggctcaaatatcattttcgttgtggggacaataatacaattggctgctcgtactgtgtggactatgataaccgggcgaattgtnttaggttggggtgttggtattgcatcattgattgctcctttaatgatttcagatttanctcctgctaaatatcctggtaaaattaattgttaccaatgtcatatttaa

SEQ ID NO: 5975 - DNA, 1662 bp, Candida albicans
ataacatatatatattccattatgggtgggttcatatataatattttcaaaagaaccacaactgctggattaaccggtagaaaattacgtgcagcagtcactattactgccacacttgggttttcacttttcggatatgatcaaggtttaatggccggattaatttctgctgaacaattcaattgggaattccctgctactaaagataatagtgttatccaaggtgctgttactgcatcttatgaattgggatgtttctttggtgctatttttgctttacttagaggtgatgctttaggtagaaaaccaattattttctttggtgctactattattattcttggtacaattatttccgttactccatttagaccacattggccattaggtcaatttgtggttggtagagtcatcactggtattggtaatggtatgaatactgctactattccagtgtggcaatcagaaatgtcaaaaccagaaaatagaggtaaattggtcaatttagaaggtgccgtagtggcatttggtacttttattgcttattggttagattttgggttatcttatgttgattcttcagtttcttggagattcccagttgctttccaaattttctttgccttatgggttatttttggaattattcaattacctgaatctcctcgttggttgatttctaaagatagaaaaccagaagcttttgaagttttagctgcattaaatgatactactccagatgatgatgctattgttgctgaagctagtgttattattgacgccgttagaagaaacgctaaagtccaagctggtttcaaagatttgtttactggtggtaaaactgctcatttccaaagaatgcttattgggtcatcaacccaatttttccaacaattcactggttgtaatgctgctatttattattccactttattgttctacgaaaccgttttccatcatactaaataccgtttatcaatgattttgggtggggtgtttgctactatttatgctttagccactcttccatcattctttttaattgatactttgggtagaagaaatttgtttttaattggtgcaattggtcaagggatttcattccttatttcatttgcttgtttgattaacccaactgaacaaaatgctaaaggtgctgccgttggtatttatttgtttattgttttctttgccttcaccattttaccattaccatggatttacccaccagaaattaatccattgagaacaagaactactgcttctgccgtttccacttgtaccaattggttaaccaatttcgccgttgttatgtttactccaccatttatttctgctagtggttggggttgttatctttattttgccgttatgaatttcttgtttgttccaatcatctttttcttttatcccgaaactgctggtagatcattagaagaaattgatattatttttgctaaagcttacgttgaaaaaagacaaccatggagagttgctgctactttaccaaaattatcattacaagaagttgaagatgaatctaaaagcttgggtctttatgatgatgattttgaaaaagataatttcgaaactaaagaagatgtttctgatggtactgcttcaaacagtaatggtgtttttgaaaaaccagaaaatgtttaa

SEQ ID NO: 5976 - DNA, 1503 bp, Candida albicans
tacactaaagaacgccaccaccatgctagatttcttgctggaagaatggaatccaacaacaaaatggaaaaagaaagctcacttgaaaattcgagaaattcctcgataaatgaatttgatgattccactttgtctaacaaggtacacacatttttgggatactcgggtacccgattaaattttattatatctacttttgctggtgttggattctttttatttgggtacgatcaaagtttaattggaagtttattaacattgcccaattttgaagaaacgtgtccctctattctgggtcccgacgatggtgttctccaaggtactgttgtgagtatttacgaaataggatgttttgctggagctattgcaacaatctattgtggaaacaaatttgggcgtatcaagtgtatgcttattgggtgtatcattataatcatcggagctgccctccaagctagtgctttttcagtgggtcattttattgttgctagaatcgtcactggtgttggtactgggtttatgacatcgacagttccagtttggcagtctgagttatcccgagcaaccactagaggtaaacttattatgttgatggggagtttgatcactgcaggtgtagccactgcttattgggtcgattttggcttttactttgtcagtgagaacgaccccaaaggtatttcatggatacttccaattatattacaagtaatttttccaatgatgttgctaagtgttattttcaaagtacccgaatctccacgttggttaatgtccaagaaaagagttcgcgaagcaagaatagtgttttctgcaatctataacttgccagaaaatgacagcgaagtgaccagtcagttggcagagattcaaagtgcattagaattagaagaagccgagtctgctggatttaatattagggaattggtgaaacagggcccaacaagaaactttcagagattaagtttggcctgctggtcacaaattttccaacaaatatctggaataaatttgattacctattatgccggtactatttttgaaaaatacatccacatgtcgccattcaatgctagaattttagcggcctgtaacgggactgaatactttttggcttcattattgggtattgtttttattgaaagagttggaagacggaagttattgtttttcggagccattggccaagctttgactatgatggcattgaccattgctacatggcaagcagataaacaaagagcagaaaacggaggtgggactggcgcaggtattgctgcagctgtgtttctatttgtatttaattctgtttttggagtgctgtatttgggaggcacatggttattgccaactgaagtttcatctttacaattaagagcagccacggcagcgttatcaacgtcgtgcaactggcttttcaactttatggttgtatgtattaagttttcttttcttcttgttcaaggtttaaatttcagcatactaacgttttctaggttatga

SEQ ID NO: 5977 - DNA, 273 bp, Candida albicans
gttatgattactccagttgctttccaaaatattggttattacacctatacgatttttgcgtgtatcaacattttgatagcaccaatgatttatatattctacccagaaacttcaggaagaacattggaagaattggatataattttcagtaagaccccaatttggaaaccatgggaagttgttgccatagagaaagagacaccgaaacgtgacttcacaaaggatgttgaaaaaccattcacagaacatatagatcatgtagaactggattaa

SEQ ID NO: 5978 - DNA, 978 bp, Candida albicans
atgagtatgcgtatacaatttggtttagctgataaaactaaaacagaagatcaattggccaatttgaaatcaaatattactctgatggttatgttaggttctattggtggggcacttattgctatgaaaacagtggatttctttggaagaattagagctcttcaaattgtttgtgtggtattgattgttggtgttattatacaaatcacttcaaattccattggtcaattatatgctggtaaaattattgaaggactcgctgtcgggcatactacttctattggtccagtttatttatctgaagttgcccctagtcccattagaggtttagctacatgtattttctcaggggcagtttatttagggagtatgatttcctacttcacaaattatggtgttgcattacatgttcctgcagaaaaaaacggtcacattaataaaaatcaatggagaattactttagcaccaaaattaatactttcaggtttaattttcattatgtcatttgtattttgtattgaatcccccagatggttattgaaaaccaataaaccagataaagctgctgaaaatttgtctaaattgagacgtttacctgctgatcatccatacattattgctgaaattagtgatatcaatgaacaagtgattgccgagaaggaagctactaatcattctagtttattatcaaatttcaaggctttggtttcaaacaaaagtattgcttacagatttttcgttatttcttgtggttgtcaaattatcggtcaatggactggtgccaatgccgttactgtttatgcctcaaaattgttctcacttattggtgttactggtacagggactttgaaaatgtcggctgttttaagggtggttaaatttatctcggcatattggtctgctttcttccttattgatgtcattggtagaaaaagagctttatacactggtctttctttacaaatgacatgtatttaa

SEQ ID NO: 5979 - DNA, 1317 bp, Candida albicans
tttcatttttatttgtcacaacaatttgtttctctgtcacccaatctccttggtgagatggctacatatatccctgtatctggatcctttgttcaatttataacacgttgggtgtccaagagttgcggtgccgccaatggttggttatatggttggtcatgggccatcacatttgggttggaactatcgatcgttggtcaagtcatacaattttggaccgatgctatcccactagcggcatggatctcgatattttttgttttattgacagcactcaatttattccccgtgaagttttatggagaaattgaattttggatggcatcgataaaattgactgcggtgataggctggatcatttatgcgttttgtatggtatgtggggctggtaaaactggtcccgtggggttccgttattggcgaaatgggtatgcatggggtgatggaatgatagttctgaataatggtaaatacgccatttctttcatcaatggtcttatcaatgctgttttcaccttccaaggtactgaattggttgctatcactgctggtgaagcctcaccaaaagccctcaaaagtgccattcgtaaagtcatgttcagaattttggtgttttatgtcttgtgtatgcttttcattggtcttttggttccctataatgaccccaaattaactgaagatggcggctttacaagaaactctccattccttattgctatggaaaattccggtacgaaagttttaccacacattttcaatgccgtcattgtcacaaccattatctcagctggtaattctaccgtttatgcgggatcaagaattttttatggattggctgaatcaggagtagcaccaaagattttccttagcactactaaagctggtgttccttatgttgcagtattatttactgctgcatttggtgcattggggtatctagtggtttccaatgatggcacggttgttttcaattggcttttaaatattgctgccacagcggggttggttgcttgggggttcatttctgttagtcatatccgatttatgcaagttctcaaacaacgaggtatcagtagagatactctacctttcaaagctttctttatgccctatagtgcctattatgctgctatagttgtgtttacagtagcattaattcaaggttttactgtgttttgggatttcaatgccaccgatttctttactgcttatgtatcattaattgtctttgttgtttggtggattatgtttcattttttctttttcgggtttggcaaacaagcatggaaatggagtaatgtgttcatacctgtcttc

SEQ ID NO: 5980 - DNA, 432 bp, Candida albicans
tcaaaacaactatatatcaatattatgtttgaagtaggtgaaaaatatcctgttgaaagcagcagtagttcaaatgacatagaatctcgtggtgttcaacctataacatccctcaaagacaataaatcaataggaatgatagagaaagataatgatgatctatcatgtgaacaatatagtacttgtgatgaagtcaaaagagatttaaaagcaagacatgtttctatgattgccattggtggtacaataggtacagggttattcatatccactggttctttacttcacaccactggtccagtaatgtcattaatatcatttttatttgtcacaactttagcatattcagttacacaatcacttggggaaatgacaacatatatccccgtttctggtcttcaccaagggagcggcggatccgcaatagttagc

SEQ ID NO: 5981 - DNA, 798 bp, Candida albicans
  unsure (133): Identity of nucleotide sequences at the above locations are unknown.
atgggtagttcaaatgattcccatcaaagactgtacaacccatattcatcatcaatcagtaaatcaaatgaaaaaactaaacatcaaactgattttgttcaagattcagatataatagaagcttcaagtatanatgatgaatttggtgaagttaaaagagatttaaaagccagacacgtttctatgattgccattggtggtaccattggtacagggttatttatatcgactggttcattacttcataccactggtccagtaatgtcattgatttcatttttattcgtcacaacaatttgtttttccgtcactcaatctcttggtgaaatggctacttatatccctatttctggttcatttgctcaattcgtcactcgttgggtctccaagagttgtggtgctgctaatggttggttatattggttttcatgggctgtcacttttggtttagaattatcggttgttggtcaagtcattcaattctggactgatgccgtgccattggcagcttggatttctatatttttcgttattttgacaatttttaattttttccctgtgaaattttatggggaagtggaattttggattgcatcaatcaaaattattgccgttttcggttggatcatttatgctttcatcatggtttgtggtgctggtaaaactggacctgttgggttccgttattggagaaacggttacgcttggggtgacggtatcttggttaacaataatggtaaatatgttgctgcatttgttagtggccttattaactccattttcactatccagtccgcc

SEQ ID NO: 5982 - DNA, 594 bp, Candida albicans
agaccagtccttattgctatggaaaattccggtactaaagtcttaccacacattttcaatgccgtcattgtcacaaccattatctcagctggtaactcaaacatctattctggatcacgtatcctctatggtttagctcaagctggtgttgctcctaaatttttccttagaaccaataaaggtggtgttccattctttgccgttgcctttactgctgcatttggtgcattaagttacttggcctgttccagtcaaggtaacaaagctttcacttggcttttgaatattactgcaaccgcagggttaatctcatggggattcatttccgtaagtcacattagatttatgaaaactcttcaaagaaggggtatcagcagagataccctacctttcaaagctttctttatgccatttagtgcttactatggtatggttgtttgtttcattgtggttttaattcaaggttttaccgtgttttgggatttcaatgctagtgattttttcactgcttatatttctgttatattattcattgttctttgggttggattccactttttcttttatggattcgggaaagatcttttaaaatga

SEQ ID NO: 5983 - DNA, 1215 bp, Candida albicans
cacaattgggggagggtggggaccccaagagggggggggatttccatttttttcgtcttattaactacatttaatttattcccggtgaaatattatggagaggttgaattttggattgcttcaactaaagtaattgctattgttgggtggctcatatatgcattttgtatggtttgtggggctggtaaaactggaccagttgggttccgttattggcggaatggatatgcatggggtgatgggatgatagttctgaataatggtaaatacgccatttctttcattaatggtcttatcaatgctgtttttactttccaaggtactgaattggttgctgttactgcgggtgaagcttctccaagagcaatccgtagtgcaattaaaaaagtcatgttcagaattttggtattctatgtcttgtgtatgcttttcattggtcttttggttccttacaacgatccaaagcttactcaagatggtggttttacaagaaactctccattccttattgctatggaaaattccggtactaaagttttaccacacattttcaatgcagtgatcgttacaacaattatttcagctggtaattccaatgtttattcgggatcacgtattctttacgggttagcccaagctggtgtagctcctaaatttttccttaaaactaacaaaggtggtgttccatattttgctgtcttgttcactgcggcatttggtgcattgggatatttagcatgttcggaagatggtaataaagctttcacttggttattgaatattattgccactgctggattgatcgcttggggattcatttctgtgagtcatgtcagattcatgaatgttcttagaaaaagaggtttaagtcgagacattttaccttataaagcttttttcatgccatatagtgcatattatgccattattattatattcattgttgtgttgattcaaggtttcacagtgttttgggacttcaatgctagtgatttcttcactgcctatatatccgtgatattatttgttgttctttggattggtttccactttttcttttacgggtttggtaaagattcttttaaatgggaaaacatattaatcccattggatgattgtgatattgattctggtgttagagatattaatgatgctgaatttgatgtacctgaacctaaaaatgtttgggaaagattctggttacttattgcttaa

SEQ ID NO: 5984 - DNA, 618 bp, Candida albicans
gttgctgttactgccggtgaagcctcaccaagagctcttagaagtgccatcagaaaagttatgttcaggattttggtatttcacgtcttgtgtatgcttttcatgggtcttctagttccttacaacgatccaaaacttactcaagatggtggttttactagaaactctccattccatattgctatggaaaattccggtactaaagttttaccacacattttcaacgcagtcattgtcaccacaattatttctgctggtaactcaaacatctattctggatcccgtatcctctacggtttagctcaagctggtgttgttcctaaatttttccttagaaccaataaaggtggtgttccattctttgctgttgcctttactgctgcatttggtgcattaggttacttgtcctgttccagtcaaggtaacaaagctttcacttggcttttgaatattactgccaccgcaggtttaatttcatgggggttcatttccgtcagtcatattagatttatgaaaacccttaaaagaagaggtatcagcagagataccgtacctttcaaagctttctttatgccattcagtgcttactatggtatgtttgttcgtttggtcttcacc

SEQ ID NO: 5985 - DNA, 1221 bp, Candida albicans
  unsure (1152): Identity of nucleotide sequences at the above locations are unknown.
ttagatgggacacataaattaattgctgaaactgaaggtattgaattagtcagtgatggagaagaaactgatatttcattttggaatttagccaccatgtggttaagtgcaaatttagtcattgcaactttttcattaggtgctcttggtataaccgtatttggattagcttttggtcaagcagtattagtgattattttcttttcaatactaggtgggttccccgtggcatttttttcatgttttggatcagctttaggattaagacaaatgttattatcgaaatttcttattggtgatcttactacaagactttttgctgctattaatgttgttgcttgtgttggttggggtgcagttaataccatgtcttcagctcaattattgcatattgttaataatgggactttaccaccttgggctggttgtcttattattgttgtttgtaccgttttggtgacattttttggatatcatgttattcatgcttatgaaaaatgggcctggattccaaatttgattattttcattattataattgttagatttgccatgacaaataaattcactagtaaatcatttgaaggtggtgaaactactgctggtaatgttttaagttttggtggtacagttttcgggttcgccacgggttggactacttatctgagtgattatgttgtttatcatcctcgtaatactaattcttggaagatttttttcagtattttctttggattattaactccattaatgtttactttaatattgggtgctgcttgtgccactggtattgctggtgatccagaatggactagattatataaggaagattctgttggtgggttagtttatgccattttggttcatgattctttacatggatttggtcaattttgttgtgttgttttggctttatctactgtggctaataatgttcctaatatgtattctatggctttatcagctcaaactgtttgggctggtttcagaaaaatcccaagagttgcttggactattgctggtaatggtgccactttagccatttgtatccccgcatattataaatctgaagccgttatggaaaattttatgaatttaatttcctattatttatcaatttatgaaagtataatgtgtgcatctcatttcatntggaatagtggtagatttgatggatatgattatgaaagatggaatgataaagaaactaccctgttggtt

SEQ ID NO: 5986 - DNA, 444 bp, Candida albicans
aataatactggttatatgacatcatctcatttgacaggattagagaatttcagttcaccacatgtaccaggtagtggagctggggctggacttggagttggtgccagaagagatttaactcataatagtaatagtcttaacaatagtaatggtggtggtggtggtagtggaggaggaccagcaagtgccaataattctaataatactaacaaacgtaatacgatatataccgattcagaaactggtaccgggataacatttagatataaggctaaagctttatatagttatgatgctaatcctgatgatataaatgaaatatcatttgttaaagatgaaattttggaagttgatgatattgatggtaaatggtggcaagcaagacgagcaaatggtcaagttggtatttgtccttcaaattatgttaaattattagatacttga

SEQ ID NO: 5987 - DNA, 1155 bp, Candida albicans
atcaactatttggaaccaaaccttagatccaaacacacgcacattcacacattcacacatttacacaatatgggattttcactttcaaattttactagtgatccatttgccatttctacagtatcatttggtattatggcatgggtagttgctattgcaggagcagcatcatctaaacaagaaaatttccctcatttcagttggtgggggataagttatcaaattgttataattcttataatatttgtcttatatgccaataataatattgaattatataaatttaccttagttggattagtatcaattgcatttatttatacgacgaattccactaataatttaatttataattcaaattctgcaggtaatctttgttgtgctgctggttgtatattattgagtattttaaatttgatttggatattatattttggaggacatcctgaatcaccaactaatcaattcattgattcttttagtttaagaggtcaaggtcatgaacaattaggttctggttctcataatcacaatgccaataatgccaataataatatccccattggtgctggtaatgctattattggtaaaggtgaaatgtcaccttataatgatagatttgctgctagtggtgtcaatcaaccaacttcagaaagtttaagacttgctagtggtccacaaatgggtaatggaccatttactactactggtgccatcattaatcctaatttacaacaaccattatctgattctattggtggatcagctcatcatacacctataaatgtcaataataataataataataataataatactggttatatgacatcatctcatttgacaggattagagaatttcagttcaccacatgtaccaggtagtggaactggtgctggacttggagttggtgccggaagagatttaactcataatagtaatggtggtggtggtagtggaggaggaccagcaagtgccaataattctaataatactaacaaacgtaatacgatatataccgattcagaaactggtaccgggataacatttagatataaggctaaagctttatatagttatgatgctaatcctgatgatataaatgacatatcatttgttcttcaccaaggagtcgaaatccgcgtatacctgggt

SEQ ID NO: 5988 - DNA, 573 bp, Candida albicans
  unsure (534): Identity of nucleotide sequences at the above locations are unknown.
cataatcgattttcccgggctatatcaactaacagaagtgaagaagaatcatcatcatcattatcatctgattcggttgggtatgtgattaattcaatatggatggatttaccaacaatattattttccattagtattaatataatgacaatattattgattggtaaacttataattgctattagaacaagacgttatttaggattgaaacaatttgatagtttccatattttattaattggtttcagtcaaacattaattattccttcaattattttggtggttcattatttttatttatcacaaaataaagattctttattacaacaaattagtcttttattgattattttaatgttaccattaagttctttatgggctcaaactgctaataatactcataatattaattcatctccaagtttatcattcatatctcgtcatcatctgtctgatagtagtcgtagtggtggttccaatacaattgttagtaatggtggtagtaatggtggtggtcgtggtggtgggaatttncccaatttgtgcctcaccacgggcaaaaggaccgccaat

SEQ ID NO: 5989 - DNA, 1224 bp, Candida albicans
  unsure (164): Identity of nucleotide sequences at the above locations are unknown.
tatagtattggtgcaattttgtgtgcagccgcccccattccaaaagaattggctgatggcaccttcaacaaccataggtcccgagacgtcatgtatgcggggaagatttattttgggggattggtgttgggtatcgaaggtggtggtgtgggtgtgtacattantgagtctgtgcccagtaacaagcgtgggagtcttgtttcgctctatcaactcagtattgctcttggagaggttttggggtacgccattgctgctatcttctacgaggtgcacggagggtggcgtttcatggtgggttcgtcgttggtgttttctacgattgtgttgattggtcttttcttcttgccagagtccccgcgttacttggtgttcaaggggaagtttggcgaagcattcaatgtgtttgctcggttgagggacttgggggacagacacagcaagatcgagtttgtgcagatggtccaggctgcagaggcagaaagagagttgcgtctcacgcagaacaagagcaaggtgtggtttgagttggtcaccatccccagaaaccgccgtgccttggtgtatggtattgtgatgatcaccttgggtcagttgacgggtatcaacgctgttatgtactacttgtcgacgttgatgggcagaatcgggttctccacaaagaactccgtgtttatgtccttagttggtggcgggtcgttgcttattggtaccattccagcaatcttgtacatggacaagtttggtcgtcgtgtgtgggggtacaaccttgttgggttcttcgttgggttggtgttggttggtgttggatactcgattgacattgaaacaaacttggctgctgctgaaggtgtctatctcactggtcttattttgtacatgggctttttcgggtcgtacgcctgtttgacatgggttgtgcccgccgagtcgttttcgttggggaccagatctcaaggtatgactatctgctcggcattgttgtacttgtgggcgttcactgtcacatacaacttcaacagaatgaaggtggccatgacatacacagggttgactattgggttctacggtggtattgcgttcctcggtttcttctaccaggtgttgtttatgccagagaccaaggggaagactttggaagagattgacgagatattcgagaagccatccagacagctcatcaaggagaatctttcggggttgaagaggttctggggccgttga

SEQ ID NO: 5990 - DNA, 1872 bp, Candida albicans
ctcagtaccaaacaccaatcaatgccatcaacacagataaggaacagtaaaacaaggacatccttgaatggaaagtattccaagcaagttcaaaacaaatcaaatgggcctgttgttgatagtctacaattggagaacttattacttagagatgaagatattttccaaaccacactcaattcagaggactacttggagagtctagcacctatcatgaaagatgcaataaagtctaatgggttgagtgaattgcttgtgaaattgaatgaaattgtgaagtcaaaagacgaggaattaaatcaagcttcgatggagtccatggatgaaatcaatacatgtatcaacaccatcgacaatatccacaaggaagccaatgagttgaataaacaatttattcaagtgagctcaagtttaaataaatcagcctatgaattgatgtcaaagaaaaagaactacgtaaagtataaagatgtttgcgaacgaattaacgaaacacaagtggtgttgaatgagtgtattcaagtattagaattgatgaataaaattttagaattgattagacaaactaaatatttcctggctttgaaattaatagatgaaatcatcaacattcatatacaaaaagttgaggatttcagcttcgccaaaaaaatagttgattcgatccctcatttgacaaaaatggttaaagacgagtcatttgaaaacttgtgtaaatggttgtcgataaatttagagcggaaattacaggatattgccagtggactatacaataatttggatgaattgcaaaataactggtcaaaaatcaaaaaggaaaatggaccaacgtttttaccttacaaaataaattctcctgttgagttagcacttagggatcctgaattgaattacaatgtttttgaggatgtgagtttacaaataaacttaaatgctgtctacgacgccgtgttagtatatcaaactttacaagagttggatactttgagttctgcctatcataaagaatggatgtccaaatacagcagggtcatttatccgataactactgcatcagtgagtaaaaaagatgtggtgtttgacaataacgaattatatgaatacttgaggaagatagcagcattttttgttaccgataagcaattgaatcttataaccaaatttcagttaagatcaaacactcaagctgatgaattgtggttatcttacatgacaaagttgaaaccagtgttgattcaacttttgaaacatcacaactttaccaatatacgagaattgggttcatttaaaacaattgttggtgaatttttacaaattatggataatcacgattatgatatcagtgagttatacgaagtgatgatgatgattttcaaagaatactatgcaccattaacgatacagacattccggaaacagtttgtggcatccatacaatccgatcgttatcgaccacttacagtcacggatgaagccgattatactgcgattatgcaaaatgtgtggtacaaagatgatgcatcatttgctccagcatatgttaagagcttcccagtgacattcccctttagtgaagattatgtccattactgtatacaagtgagacgattgcttaaagatgtcttgcggtttattggtgattattataattatgaaattggggaattgaccaacaccatagtcaataacattattgaagtggtgttaagtgatgaaaagggatatggtattgcttatgaaattgaagagtttattaccagaaatgagaataataaagaaatcacagcccagacttataccaacttggaatattatttgtttagtttgtatgagattggcaaatgtcttcaccacggctggcgatcccgctca

SEQ ID NO: 5991 - DNA, 678 bp, Candida albicans
cgagtattgccctgtgaaaagaacgacgaacccaattttgccattaaagattttgcgttattttggaagaatttgtatacatcaatcttcaacaatttaccactgcaattgcgtacattgggctttttcaggacttatgattttgtttctgaatattttttaaatgtgttgaaagatgcaaatgtgtacaatagaatatttgttgccaatttcgatttggatattcagtacttggaaacctcgttgaggaatttacatgggtttaaagaagacggcgatgaagccaatggtaatggaggtaacgttgctttggaatatacattcactgaattgaggcaatgtattgatttgttgaatttagaagattatgaggaattcattaatgactcttcatttagaatgagacgctttgatagagtgaaatatgaagatggtataaatttgattaaaaaaatgcaagataacgaatctaaacaacaaacatcggtatcagcaatgtctgaaagaggaaccattggtggtgttatccctaactccagttcaacaagaagttttgtgaacatgttgagtaatttgtcaactgatgatgcaggcaacacttctagtgggagtatcgaatcgaccagtactacttcaaaattagctcagtttactactaggttcaaacagaacaaatag

SEQ ID NO: 5992 - DNA, 1353 bp, Candida albicans
tcctcttcccctggtgaagacggtgttactcttgccgaactttcgtcagcttatcctaatgctgcagcacaaatttattgggcacaaaaattggcacccccaaagtatgctcgtgcctgtgcttatttcactggtattttgctggcagctggtagtacttttactacagctagtgtcaatatgacatctgctacagctgttgttggtatgtacatgctccaccatcctgaaaaaacaattgaaagatggcaagtgtttattgtttatgaggctatcacagtattgttagtgtttttcaacatttacgaaaagccgttgcccatgatctcaagtaccaccttgtacacttctcttttttcatttgttgttatcaccattgttgttctttcgatgcacgatggcgactttcaaagcccacattttgttttcgttgaatttaataatggtactggttggtcctcttcagccattgcattcatcgttggtttgatcaatcctaattggagtttttcgtgtttggatgctgccacacacattgctgaagaaagtttaagtccagctacagatattcctaaagccattcttggaacagttgctattgggtttatcacttccttcacttattctattgctatgtttttttctattaaaaacttggatgagattttatcatccaacaccggggtacctattttggatatttattatcaggccaccaattctaaagctgcagctgtgggtttggaatttcttattcttttgacttcccttggttgttcgattggttgcagtacttgggcatcgagaattatttatagttttgccagagataacggattgccattgtcaaaagtatgggcaaaagttgatagcagaactggaaatgtggtgaatgcccatctcttgtcaaatttctgggtcatggttattggttgtatttatttgggttcctcaactgcgtacaattccattttgatttcttgtgttactttcttgttactttcatacttgattccaacagtattcttggtattcaaaagaaacaaattcagacatgggccattctggttaaatggttttggtttagtttgtaatatcgggttgattgtatgggctatattcgcttttgttttctataatttccctaacgtgatgccggttactggaagcaatatgaattactcgtcaggggtgtttggagtttgtttgattttttcggtagcagattggactttgagaggaagacaccaatacacgtctcttgaagaaagagaaaaagttaaggatgaattggccctgcaagtatccaatcaaattaccaatattcaatctattgtttcaaatagacactga

SEQ ID NO: 5993 - DNA, 1758 bp, Candida albicans
tctaatctagatctctctctatatttcttttttttcttcacttttttttcactttttcttatactacaacagattagtttgatactcatcactcgttccctttatattcctcccctttatcaaactcaatctaagtatttaatgactcaatcagatctaaatcaactggactctgttagtccccaattatcatcatttgctaccgacccaacagatcaagaaaaaaaattgactgaattcaatgatgataataaatcagtgacatctaaagatgaagataccaaaatgtcaagaaacttctcgacattacaaattgttactattggatttggtcttacaaattcatggttgggtattctgtcaacacttatattgtctatatcttcccttggtcccttacttgttgtctatggtattttgattgttgctagtgtatctgtttgtattgctgttactcttggagaaatggccctggctatgccatcagctggtggtcaatatgtctgggctagagtattggcaccaaaaaaatattcctcatttttagcttatataactggttctatatcatggggtggtgctattttcaccacggcatcaatgaatcttgctgttgcttatcaagttttgggattttggaatatgactcatccagatcatgtcaatcaaaaatgggaagtatttattatttataatattcttaattggattttattttttttcaatatttggcatcgatttttaccaatgattggtgatagtgttttcgggatttctttaacttcatattgtattattcttattacagttttagtttgtgctagaggtcattatcaagatgctaaattcgttttcgttcatgcagtaaataacactggttggccatcaaaagggattgcatttattgttggattagttaatccggcttgggcattctcatgtttagatagtgtcactcatttaagtgaagaaactgctcatccggaacgtgatgtaccaagagctgttttatcaactgtggggattggatttgtcacttcatttactttttctattgccatgtttttctgcattagaaatttagaagaaatcatgaattcagcaactggtttccccatgttggacattttttatcaagctttaggttctacaaaagtcggggccatttgtttgggttcattaattactttggttgctactggttgtactttatcttgtatcatttatcaactgagacttcttttttcattcctgcgtgataatggtatgccactctccaaatatttatcaatcattgatcctaaaactggtggcccattttacgctcatttattttctactgtgattgtatctgtggtatcagtattggtattttctgatgctgctcttcaagctacggccttagcgtgtgtttcattccttcttattgcttatctgattccaacaatttgtttacttgccagaaggcgtcaaattcgtcatggtccattttggttagggaaaattggtgtgttttgtaattttgttcttttggcttggtgtatatttgccgtggtatttttcagtttcccagctaattacccagttaccgctgaaggaatgaattatttctgtgttgttttagtggtatacattatttgtatgcttggatattggtggttcccaattaaaaaatatgcttgtaaatataatttcagaggaggtaatttgaatcaagaagaagttgaattcccagatgtttgcttaactaaatggtaa

SEQ ID NO: 5994 - DNA, 1143 bp, Candida albicans
  unsure (1124): Identity of nucleotide sequences at the above locations are unknown.
ctaacaaggaaatcatggatgaatgaagcccaaaaaattttttttatagattgtgttggtaattccagtttaactttggacactcaacaaataggtctggtcaaagtacagaaagggaagactggatttatgttatcacggaaaatagtattcccccaagcacaattagaaaaaaatctcaagttaataaagtacatgggattttcattcaatttgatatgttcagcacttgcaataagtacatttgtaagtacgtggatagaagtaggaggtagtccagtagtaatatttggattcattgttgccatcaccttggatctcattatttgttattccttagccgaattagcgtctgcttatccacattcatcggctcaagttcattggacatattgtttagcatcggagaaatacaaacgtagtcttagctttttaactggtattttatcatgtgcgggttggatatttgcttgttctagttctacttatgtggcatcaatgtttattttggcattggcacaaatttatcaccaagagtatatcccaaaaagtttccattattatcttgtttatttggcagtgtttttatcgggttatttggtcaatgtgtttttagtcaaattattaccgttaatcaccaatatttcagttgcggtaataaattttggaacattctttattattattacacttttagtcaaatcaccaaaacaatctgctgagtttgtgtttaaaaatatcatcaatgaaacgggctggtcctccaatggagtggtatttttcttggggatgttgcctagcttagcctgtgtcacattatttgatggagcagtacatttgacagatgaaattgcccaaccagaacgaaatataccgttagtgatggttatatcaaatacactttctggcgttatggcatttttcgctgctatagtctacatgttttgtgtggtgaatgtcaacaacttatcaaatccagtaggtggagaaccaattgtgcaattaatgtatgattcttttcaatcggaggcattaaccacaattggagtcgtttgtttaatattgacttttgttggctcgtcttatatgtattataccagtacttcaagattgatttggtcatntgcaaactcaaatggactt

SEQ ID NO: 5995 - DNA, 1695 bp, Candida albicans
ttacaatctaacccaggtgctggtgatgaagaagaagaagaggaaaatgactcttccttcaaagccgtcccagaagaattattgcaaactgacccaagagttggtttgactgatgatgaagtcaccaaaagaagaaagagatacggtttgaatcaaatggctgaagaacaagaaaacttggttcttaaattcgtcatgttctttgttggtccaattcaattcgttatggaagccgctgctgttttggctgctggtttagaagattgggtcgatttcggtgttatctgtgctttattgttattgaatgcttttgttggttttatccaagaataccaagctggttctattgtcgatgaattgaaaaagactttggccaactctgctcttgttgttagaaacggtcaattagttgaaatcccagctaacgaagttgttccaggtgatatcttgcaattggaagacggtaccgttattccaaccgatggtagaattgtttctgaagattgtttgttacaagttgatcaatctgctattactggtgaatctttagctgtcgacaaaagaagtggtgactcttgttactcttcttctactgttaagactggtgaagcctttatgattgttactgctactggtgactctactttcgtcggtagagctgctgctttggttaacaaagcttccgctggtactggtcatttcactgaagtcttgaacggtattggtactaccttgttggtctttgtcattgttactttgttggtcgtttgggttgcttgtttctacagaaccgttagaattgttccaatcttgagatacactttagccatcactattattggtgttccagttggtttgccagctgtcgttaccactaccatggctgtcggtgctgcttacttggccaagaaacaagctattgtccaaaaattgtctgccattgaatctttggctggtgttgaaatcttgtgttccgataaaaccggtactttgaccaagaacaaattgtccttgcacgaaccatacactgttgaaggtgttgaaccagatgacttgatgttgactgcttgtttagctgcttctagaaagaagaagggtttggatgccattgataaagctttcttgaaatctttgatcaactacccaagagctaaagctgctttgccaaaatacaaggttattgaattccaacctttcgatcctgtctccaagaaagttactgctattgttgaatcaccagaaggtgaaagaattatttgtgttaagggtgccccattattcgtcttaaagactgttgaagatgaccacccaatcccagaagatgtccacgaaaactaccaaaacaccgttgccgaatttgcttccagaggtttcagatctttgggtgttgccagaaagagaggtgaaggtcactgggaaattttgggtattatgccatgtatggatccaccaagagatgatactgctgccacagtcaatgaagctagaagattaggtttaagagttaagatgttaactggtgatgccgttggtattgctaaagaaacttgtcgtcaattaggtttgggtactaacatttacgatgccgacagattaggtttgtccggtggtggtgacatggctggttctgaaattgctgatttcgttgaaaatggtcatcaccagccggatggaggcatccgaacttgcgttagt

SEQ ID NO: 5996 - DNA, 1083 bp, Candida albicans
ttcccacaaaaaaaatttggtgcatttaaaaattatgctcaagaacgagctaatatgaaaccacaattaggaccagttggtggtaatccttatgccaatattaatcctggaaccaacaacaacaataataatccatatgccaatgataatgggaataatagtaatggcaaccccaacaacaacagcaacagcaacaacggtggtaacccctatggtggtggtgctactaataataacccttatggaggctctggtggtaatggaagaggatcatcacctagtccttatgcatcgactacatcgacaactactagatcatctaatccatatggaaataataatggttctagatcaagtcaaaacacttctagtccttatgccaaatcaactaacaattcatcatattctaactcaccgtattctggatcaactgtaaataatggtaatcgtggcggccatagcaacaacagcaatagttctgctggtggtaacccttatgctactggtggtagaagttcacaatctcaaaattcacgagacaatgtatatacagttcctgccactcgtacatcaactagacaaactcaaggatatggaggtggtgatactgattcgactcttgaccttaatgccattccatcacatcaaatgtttgataataagaagcctattaaaagaaatcaacaaagttcacaacaaccagctaatgattataatttagatttgaatgatgaatatggcgaagaagaagacttgaatttagatattagtgaagtacctgaagaacaacaacaaatcaattctgaagatgaagaagtagaagccattaaacaagatattaaatttgtcaaacaagaatcagttcaaagtactagaaatactcttagaatggcacaagaagctgatgcatcgggtactaatactttaggaatgttaggatcgcaactggaacgattatataatgctgaacaaaacttattattagcagaaacacaaactcaaatagctgatgaaaaagttaaagaattgaaacgattaaatcgatcgattttcatattttcaccacgggcctggaaggaccgc

SEQ ID NO: 5997 - DNA, 192 bp, Candida albicans
gaactgggaaaaagaattgctctgaatttgaatcaaattaatcattatgctaaaaaattgaaaggattagctaatactatgggtactgaagttgataatctaaatactagattgaagaagattgaagaaagtgctgataaactggatattaatgttcatatgaatacgactagattgaataatattcgttag

SEQ ID NO: 5998 - DNA, 2403 bp, Candida albicans
tttaaaggtatacactacattatggatccgccatatccgctactttcaaaacttgaagaagatgtcaagacaaatctcattctacatccacaaattagttctttcatccagctatttctacgatacttaaaagagccaagatatcaagcaccattaacaatcactgagttatccactctattcaaaaagttttaccaggatttgaacgtgttgaccatatgtatattcactcaatcaaactccacaaaaaagcagctaatctcacactgtgattatttcaacgaaaacccaaaagtgtgtgattatctattggccatagcaaattatagcacatcttccattagactattgaaaaggtcagataacgatgcgttataccaattacgtgtcttcaactactacaagttattaacaatatttgaatcaatccatttggcagagttggagttgtttcaatcggttagtttgggtgacgacatttgtttgtacgacaagatatttcgttttgatcagaaggacacaatataccaagagtttttacaggagaaattaaactgtttgcgccaactaaacttatcatttaaacattttattgatcaagaccttggaaatcaagataagttggtgaacattattgataacttgactcaagaagatttgatactgttgcaagaagatttaacaagtttgaatacagaaatcaccccctatgcaaaacttaagaagattgttagtttgcacaagaatctaatcaaactattttcacaaaagggatttgagaataaggagataaataacgatttgttgttacctgctttgatctacttgcttgtgtacaagcttgaaactaacgatttatatttatctttcctattcattcgaaatttcctcaatcttatcgattctctgccaatcgagttgtatcaaatcaatttgtacttatcgtataacccagcacaggaaaggactcctttgagtagcagcaagtacaagaaatcggatatacttggatatttgaatttgcaggattctcaagatttaccacaagagcaaagccacatacttagtgacgaattcaagtttttcacaaacgataaagaattgatatcatatataaaccaaaaattcctaaacaccggagagttgaattactatttgactaattttgaggccatgatagtttatttgtcgaatatgacaattgcagaactattgtcaaacagtgaaacggaaatttcttcagatttacgaaatagcagtattttgaagcaccctattgataaattggttgacgaggaattacttactcatttccagtttccagatggtgaacttgcaaatgaaatgaaagcaactgaaaacaaggtaagggaagatgaggctggaagatcgagatcgtcatctttgttaaacacaattagtaacaagattaatgaaacgagatctaggtctagctccttgagaaaagaaaaatttcctagtttaccaacaccgacggaagagcttgaagagaattctggatttgcaatgatgcgaaatattttgggaagattcagttcagcaagtggagctacagaaggtgtttacgacgaggaaaacaatgattcacctcaatcaaatttaaagaaaactaattcttttataagcaaagtttctccgattcattcccgtacacgctcatcgtcattagaaaatgcaacagcaactcctgggcattataaaagaaattcaatcacagctaaatttacaagtggtgtatctgagtttatgaccaaacttaatcagccagccataccttctaacttgcatccggacaacagtgtttccaatgtttcattacagtccatagaagatggagacagtgatgctactatgagcaggagaccaactgctggtcgaaacagaactacgagcatacaaattttagataaatggtttggtaacttgtcccctagtcagactaactcacaaccactaacagttcaacaacaagaggcgataccagcatccactatacccagtgtccaaccaccgattccacctaaagcaaagccagaagtattatcggaagaattgattgttgatatcgaacagctaacaaagtttcataattccgatttcgaatccctttctatccaggatttgcgagaattgaaaaactattatgatcagctatgtcaggacttattatccaatggaaaccacgaaagcaacggcaaaatttatgttaacagcagaacaaactcaatcgacaaagttggaagccacgcaaattcattggataagtttattggaaaagaggcacccgaagctggagacttgaatagcaaagccgaatcagttgagtccagtgataggtttggtactgcaactatcatcacttcaagtaacaatagtttatag

SEQ ID NO: 5999 - DNA, 666 bp, Candida albicans
cagctatactttgttgaaaaaaaaaaaacttataaaagtaacataaagtcccagtctcttaatctttttagtttattgtttcatttccttttggtttcccctttcctcctgagaaggcttatcacttttatcaattacacccatactaataccttacacaacttcaagatgggttttactgatttatataaacctctggaaagtcccgagaagaggtcagacaccaacaccgataatttgagtgaatattccactgatcatgaaatagaagctggtgttcaattggatcaaaatgtcaaacaaattggcataatttcagccacttttcttattatcaacagatgtattggtgctggtatttttgctactggttccacaatttatactttgtcaggtagtgttggaacatcattgattttatgggttgccggtactttaattgcctttgccggattattagtttatatggaatttgggtctgttttaactagaaatgggtccgaagtcgtttatcttcaacatatttacaaaagcccaagattcttggttatttcatcatatgcagtgtatgccctcactatgccttggactgctggtaatagtgtagtcactggagaatatattttaaccgccgttggaaaagaactcacgtcttcacccacgggg

SEQ ID NO: 6000 - DNA, 852 bp, Candida albicans
gtatatatattccccatgtcatatccaacccccaaaaaggagcaagactccatactaagtgaatcataccaaagtttttcaactgcatcgaccaaaaacccaatcaaaaatttcatttactcgttcagggttaacaaagatttacaagttacttctgatgagataactactccggatgacttattgaaaggatatcaagttaaactaattgctctatcgtcatgcattggtagtgggttattcatatcgagtgcatccatgatatcgtctgcaggtcccggtggtactgttattggatattttattgttgctatattgatgtttttcattgtacaagcattaggagaattgacaagttcatatcctgttagaggtaacttccttgtctacaatactcgttttattgatgaatcgtgggggtttgccatgaattggaattattgtttacaatggattgtcaatattcctttatctttggttgctgcttcattaactattcaatattggactgacaaaatcgaccctgcagtatgggtggcaatattttgggttgttattgtgggaatcagtatatttggtgtcaaaggttatggttacggagaaagtttgttttcagtaatcaaagtagtcgccatagctggattttgtattctaggagttatactagcagctggaggcggggaacaaggatacattggaggtcgtaactggcaccctccattcgtcaacgggtttcatggtatttgtaatactttggttaacctggctttcagttattccggaactgaattagcagcaattgccgccgcagaaacatcaaatccacgtaaatctttaaataaaatcatctag

SEQ ID NO: 6001 - DNA, 630 bp, Candida albicans
ccccgtggtcgaagacccaatttacaaagaaaattgaaaacaagacatttacaaatgatcgctattggatcatctataggaaccggtcttttcgttggtactggtggtgcattaagtactggtggaccagctgctattgttctagcatgggccataagtgctatatcggtatttatgacaatgcaaggattaggtgaattggccgttgcattcccagtttctggtggattcaatttatacgcaagtaaatttttagaaccaggtattggatttgctgttggttggaattatttcttacaattctttgtattattgccattagaattagttgctggtgctataactatcaaatattggaatgctagtataaattctgatgtgtttgttattatattttggtttgtggtgcttgtgatcaccatgttgggtgtaagatggtatggtgaagctgaacttgtattttgtaccatcaaagtcattgctgttattggatttatcattttagggattgtgtcaatttgtggtggtggaccaaatcatgaatttattggaggtaaatattggagagaaacgggtccttttgctaattcttttaaaggttttgctagttcacttatcaccgctgcattc

SEQ ID NO: 6002 - DNA, 1086 bp, Candida albicans
  unsure (987),(988): Identity of nucleotide sequences at the above locations are unknown.
ttacttgtgcttccagccaaagcggtattaactaaagcacttttagataaatcatttaaattaaatgccgaggcaagacataaatatccattaggtaaaataacttcaatgttaggaacagatttatctagaattgattttgcccttgggttccaaccttttttaatagtattcccggtaccgattggaattgctattgctattttaattattcatattggtccagcttcattagttggggtcgggattttatttgtttttatgattgccattgccttttccactgggaaattatttgcctataggaaaaaagccaatttttatactgattcaagagttaattatattaaagaagctttgacgaatttaaaagtgatcaaattttattcttgggaaccaccatatcatgaaaatatttctaatgttcgtaaaaaagaaatgaaaattatttatcgaatgcaagtattaagaaatgttgtcacatcatttgccatgtcattaacattgtttgcttcaatgacagcatttttagtactttatgccattagaactcataatcgagatccagcatcgattttttcatcactttcattatataatactttgactcaacaagttttccttttaccaatggctttagcaagtggtgctgatgcatttatgggtatttctcgtgttggtgaattcatgtctcaaggtgaaatacgcgaaggagaaaattctattgaagcaactccagaaatgaaacaattaatggaacaagatgatttagctatagaagtagatcatgctgattttgaatgggaaacttttgccgatgaagaagatccagataagaaaaaagatgttgatggtgatggtgatggtgatgatgaagacaagaacactgctgatgtaattacttcaactcatgaagttactagtgaaaaatcgtatgctaaagaaaatggaagttcaactattgctagtaatagtgaagagaaggannaagaaaaagcacaatccaaagacttggaagaaaaaatcactttcaaaggattaaaagacattaacattaaagtgaaaaaaggtgaatttatggttatc

SEQ ID NO: 6003 - DNA, 462 bp, Candida albicans
attgttcacattatgacacccccacctaattcagatgctcttgaaaatcaagagttacttcaacgacagaaacgattactaagtttcatgctatcgaaaaaagtcccacctgtgcctacccaagatgaaaggaaaccatatccagcaagttctgctaatatattttcccgaatgtttttctggtggttatcaccagtgatgaaatcgggttataaacgaactttgcaacccgatgatttgttttatttaactgacgatattaaagtacaacatatggctgatgcattttatgggtatatgagcaatgatatagcgaaagctagacaacaacatatactggaaaaatgtaaagaaagaggtgaaactctagtaaattcatcagttgatcctgagactgatttacaagattttaaattatctaaatttcttacagtatgggctttagcgaaaactttcaaatgg

SEQ ID NO: 6004 - DNA, 723 bp, Candida albicans
aactgggggaaaattattattgatgatattgatatttcaactttgggtttaaaagatcttcgatcaaaattatcaattattcctcaagatccagtattattccgaggttcaattcggaaaaacttggatccattcaatgaacattccgatgataaactttgggatgcattaagacgtactggattaattgaagaatcaagattagatatcgttaagaaacaaatcaaaccaaccattgaacacaagaaccaggacaccaagaaaaaaaacaagaaagacaacaagaaagataatggcaatggtgatagtggtagtggtgatgtcagttcaacattacataaattccatttagatcaaactgttgaagaagaaggatcaaatttttcccttggtgaacgtcaattaattgcctttgcaagagcattagttcgtgattcacgaattttaattcttgatgaagctacatcatcagttgattatgaaactgattctaaaattcaacacacaattattaaagaatttaaagattgtacaattttatgtattgctcatagattgaaaactattattaattatgatagaattttggtattagataaaggtgaaattaaagaatttgatactccttggaatttattcaatactgaaaatagtatttttcaacaaatgtgtcatcgttcaaatataactgaacaagatttccaagaagctactgggttttaa

SEQ ID NO: 6005 - DNA, 495 bp, Candida albicans
cgtgttgggaaacatattatgaataattgtattttagatttattaaaagataaaactagaatcttggccactcatcaattatcattaattggttctgctgatagagttattttcttgaatcctaatggtactattgatgttgggaaatttgaagaattacaagcaactaatgaaagttttagtaaattaatggcttacaatagtgaatcaaagaaagaaaacgacgaagacgaagacaaagacaatgatgaaccacaagatggaattgaactggaagaagatccaatggaagatgaacttgaagaagaaaggaaaatgattcaaagacaaatcactcaaagaactcaaccagaagataaagaggtagaagatgaagaaggacgtcatcgtgaattcaatgttgataacactgctgatggtacattaattgaagcagaagatcgtgcagttaatgccactagtcttcaccatggggatgggacgaaccgcccttga

SEQ ID NO: 6006 - DNA, 513 bp, Candida albicans
  unsure (485),(512): Identity of nucleotide sequences at the above locations are unknown.
gcccctatgtcatttatggatactacccctatggggagaattttgaatcgtttcactaaggatactgatgttttagataatgaaattggtgatcaattgaggtttttcttatttgtattggctaatattattggggtattgatattatgtattatttatcttccttggtttgctattgccataccgtttttagggtttttatttgttagtattgccaattattatcaagcttcagcaagagaaattaaacgtttggaagccattcaaagatcattagtttataataattttgatgaaactttgagtgggatgattactattaaagcatatcatgcaaccgaaagatttgccttgaaaaataattatttgatcgatagaatgaatgaagcttattatatcacaattgctaatcaacgttggttagccattcatatggattttgtggctgcacttttcgcattattaattgccttactggccttatnttcacctcggacctgcacgatccaatna

SEQ ID NO: 6007 - DNA, 384 bp, Candida albicans
ataatgaaaattgctgataaaagagatgacggtgatactaccatttacatgacattaacatctacatcaacattgggtagcaaaagctctccaaatgcgagccctactaatgtaatacaaatagtatcttgggtagcacagactattgaaacaactatcgttacatcaactccagtattgaaagtaccatctacatcgcaagtaaatactgtcacatcaaaatcaattacaacggtatcaaatacagctgaaacaaaaaaagtaatcggttcatctagcgctgaggctactatttccccatctcaatcagactttttatcaccaacagcatctaccgaacttggtgctgtttgttatcggacccggccgctagcaaatcatagt

SEQ ID NO: 6008 - DNA, 1743 bp, Candida albicans
  unsure (56): Identity of nucleotide sequences at the above locations are unknown.
ataatatttgagttactaaacttgatgcacgtagaagagcaagaatttttgactanaaataagaacattcgacgtgataaagaagccccaaaatcaaagaaccaaagtttagtacgtcgtaaacgtcggaagaataataagaaacaaccaaattcagaaagagatatactgagtccaaccattatccaaagtgtcgagaccgaaaagcaatttcagctttttatgtgtttaactacttatattgacaggttgagtttgtgggatacattatcagtcaaaagtggcggtgatggaatgtatgggtttattggatatgtattagtaccttacttccacaaaaaattacccaaactagttgaatttgttgttgagagtatggaaagtctgtatatgaaattagtcagtttaaagagaaagaaaagtgatcaagttgacaccgaagaacatgaacaagtggatacggaaatcgaacatggcacaacaccccaagaatctgatacacctaaacaccaagatgaaacactcaaaatgaaaccaagatccaaatacagaaaagtattactcgataagaaccctcctaaactatccaagtctacaagtatagttgactctgatgatttcaaaccattaatttctttaaaaaaatccaaatcaaatctttccgcaaaacatttatccaaacgtgaagttgatttaaacctcaaacaaagcagcaaagcagatttttcaagtattagtacggcatcactgtcgtttatatttggaacaagagcaaagaaatcattgtcggcttccactgttacgacgtctagaccaaccagaacaaagagtgaaaaaattgcaacgactcctgtaaagccaaaacttaagcattcagtatcacagattgaagcaacaccagcaaaggcaagaaaagtgtatatgcagccacaagttcaggcgactccagtagcaccacaacaacagccactacttctactgctgcaacaacaacagcagcaacgacattcaatatcaatttccccaagccacaaggaaaacaatgcaagcacattgagcgaatcagcttatctactggaagttgaggctactccgttgaaatcaaactctttagtgattacaacaccaacagaccaatttatcaaacccgataataaacatcgacaatcaatcaatgaaaaactatcatctctttcaaaatacttgacggttgagatgactcccaagcaaaacaatctgattttttcaactcctagaaacattcgtatcacgacagaaccaggtatggttagtaatagcgacaacaaaggtactggcaatgaaactaataatatgtttaatacgccgctacatcaccagcagttaattggatcgtcgccattgaaatctagacgtgaaagtgtttcaagtgtcactagcataattagcaacaccaacaataatcataatcattttgaaaatagatatggaaaatctggaccaaaaccaggcgatccagttgcattagaatcgtcaccgttcatatccattttaagtgattcagaaaatctaatggggttaagaccaaaaaagttatttgatagtattactacttcaccacaagacaagaactacgatgatgagaaagtcgttaaaaatagtcataacaataacgagtatgattctgagtatgattctgatgaattactaaacccatcatccaagcaaaccgtaaggtctacctattccaatagaagaaaataa

SEQ ID NO: 6009 - DNA, 1473 bp, Candida albicans
acttaccaaacccagcaatgccagcactacatcccacatttattggtcaaattattatacatctcgtcgacccatgcactatcgttaagtagatgctcctcgacaaatttgggcggtgaaaaaacaagcagcgagttcatgtcaaatgggctttgtcgagacacctgttcaaaggatgggtatgccgttgctgtcttgtcaggaaacgattgctactgtaccaacgatgtcccagcagacactactgatatgtcgaattgtgaaattggatgtccaggttataaagaccaggaaaattgtgctggagatggttattttgggtacttgattattggacaaccatcagcaaccgtcggaggagagacaagtacgagtaagtcaacacaaagctcaacaagcacatcaacaagtactagctccacctctacatcgagcaccacctcaagctcatcatccactagcaccacctcaagctcatcatccacttctacttccactacttcagaaacctcttcttccatctcccctgccaccaccatggttaccaaaacaacacaaatcacagaaactcatcgttcaagcaatattgttcaagtcacacagtactcgacagaagtacttaccgtgtttcccagcaccacatccaaatcttttacttcctcatcatcgaaatcctcctcacaaacaccaatagtatccacaaaaatcgaacaaacaacagcctactccatcaaaacagtaaatggaactcaaacacaagagatcaaaacactatacataacccaattcacgacccaatcaactctggattcgacaactggcaccacaagttttgaatcagcatcaatatctaatttgcggtctcaggacgcttctgttgcgccaaccctgtcggtgcccagctcatcaacaacggattcccccaagaccaacaagaatgcattttttgacgacaagggtaaggttgctggtacttttactgccgttggaatagttgttgtcgggatagtcggtgctatgttgtactgctgctgctgctttggtggagcaggtggcagacacaacgaccacgacgggtacagtgacgaagagaaccaatacagctctgacgaattgtcggtcaaccatgcaacagttgttgctccatacagcaagcaatcgtcattttctacattaaagagagacagttcctcaaagactttatttgcatattttacaggcgacaatacgaataaagagagtggagtcaaccgaagctcgtcaagacgaaaattgatgagcaggagaagcagtcaaatgagctcatcgcccaataacaacccagaagcagatggaggagctatgttcccaattaatgagatagattccagattagatccagacacaatgttcttgaatcaaaacttttccaacaaatcacttggtgataatcaagattattcaagaaagcttaaaatcactaatcctgagtaa

SEQ ID NO: 6010 - DNA, 342 bp, Candida albicans
ctcactcgcggatcctgccagcctcgtggtgaagatatgctggccgttatgttcttaaaccagttccacttaatcttagtgcattatttatgtaattccaaattgaatatcggtaacaagtcagcacctaaatcgcttgatagagatactatcattgataatattacattgattctagaattattagacgaatgtttagattatggattattgcaaataacagattacaagttattagaagaatatatcaaagtattgcccaatatccctaaaattgatggtttgacagataagtacgatacatctgatagtgacgactctattgatgaatacgaaccatag

SEQ ID NO: 6011 - DNA, 714 bp, Candida albicans
aaggagaccaagaaatcaaaatctaaaacgaagattggcaagaataataatggatcaaagaaggagataaaatctactcgcaatcaagcaataaaaacagatgtaattgaaaatgaacaaacaaatatgatcaacagctcgatattacgtacttattcactggcaataaattggagacctaaaggtatattttatgcaaagaatgaaatttttattgatatcattgaagattgcgagtttgtctacgatttgggaactggagttatcaaatgtaatgaaatatatggtacctgtgtcgtgaaatcttatttgtcaggtatgccagtttgtcgacttgggtttaacgaaaggaacttatcacgaatcgaagatgatcaagaagaagagtctttggggatacctgagaatcaattgaatttattgaaagaggatcaaaacgaagacgacgatgaagaggaaggtgaaggggatcaagagacaaatggcgaggaaactgaaatactagagcacataccagaattcccagcatcagaagcactaacagataaaaaacaaaaacataaaatccctatacgaaacattcagtttcatcagtgtattgaattgtcgaaaatttataaagaaaatatcgttacatttatcccaccagatgacaagtttgtgtggatgacttataatgttgagcaacaaaagcaaaagaagaagctccactaa

SEQ ID NO: 6012 - DNA, 660 bp, Candida albicans
acacgaatttccaccgaagaagacactgttaaagacttgattattcgaattccaattaaaccccattattttgatttggatgcaaatgatgatgacttaaagtataaggcagaattaggggaagtctcgttcaaaattgattcatttgagttgatttggaaaattgacagtattgatgggaaaaaaatggtgagaatgatgactgaactagctttagtaaatacagaggaagtcagtgaacaacggatactggattacctatcacgcagagctactgcatcatctgtggtaggaactgatgaacaaaattcaacagacacagccgaagataccagagaggagttggacaaattttatggagtaaatggcaagaccacctcactgacacaaaaaatgtctttaaaatttaaaagcagtgttttcaatgatgatatcaaagtacatttcaaattgccaatggtgacatattcgggattgaaattgagctatctcagtgtggaagaagaacaaatgaagtatccttgtttcccatgggtaagatacttaacaaaatcaatagatcactatgagccaagtattgcccttgagaatcaaaagttcagtggtagatgttgtgattatagattcaaactaagtctgaattgctttgtagtagcatag

SEQ ID NO: 6013 - DNA, 825 bp, Candida albicans
  unsure (710),(814): Identity of nucleotide sequences at the above locations are unknown.
aggtacatcaatcctagagcacaaaacaagtccatgatcaatgtttcacacataacatgtgtggtgtttgggttgggtattgctggttttagtgttatgttgcattatgtgggtgtacacatgacttggtttggatatttcacgccaatgatgatatgtcctggtattcttcccttgatatttacagttacttggaatagacagacatattgggcagcatttatttctcctcttgttgggttcgtagtaggtttggctgtatgggtttctacagcctatcacttttacggtgaggtcacgattaaatcaaccggtggccaattgccagcattgtatggctccttgactagtatgatgttaccaggagtattgagtattatcatatcgctagttaagcctgaaaagtttgattgggataagttgaaaacagctgatttgctaattggagaagaagaagaagaaggtagtagtccaaatattcaacctaagaatgaagaaagtgatttgaacaaggagaaacaggctggtgttgaagttaattttgaatccgttgaaacatcaagtttggaacaacaacaacaaaagctgtcttcccaattgacaaataaagagttggaattttggataaaaattgcaactggtgcagcaatatttgtattactcattacttgggttatttggccaatgtctgtatatccagattggatatntactgggacatactttaaacgttatgtgactgttggattgatttggtggtatagcacattgattgtgattggatcggtccccttttataccggaatgcattcancatctacagtt

SEQ ID NO: 6014 - DNA, 819 bp, Candida albicans
atggcacaactatcatcacagggaaataatgctatcatatatttaagttatgcatttatgttagctacaggcttgttcttggcttggaagttttcttcaaacaaagatttcttatcatcgaatggaacccagcgaggaatccctttggcattaaattttgtggcatcagccatgggagttggtattatcactacatatgctcaaattgctaatattgctgggttgcatgggttactagtttacaccatatgtggagctattcctattgtgggatttgcggtggtgggtcctgtaattcgtcgtaaatgtcctgatgggtttattttgaccgaatgggttagacaccgatttggaatggttacagcattgtacttgtcggctttcacatgtttgacaatgtttttgttcatggtgggtgagttatctgccatcagatcggcaatagaaactttgacagggttgaatgccttaggtgctgttattgtcgaatgtgtggtgacaactatctacacattttttggtggtttccgtgttagttttataacagataactttcaaggtgtttgtgtattgcttttgttgatcatctgtgctgctggaatgggtagttacattgaaatcgatacttccaaaataggaccaagtgggttgttgaaggcaaacaagttgggatggcagttggtctacatcttatttgttgccattgtgacaaacgattgctttatgtctgggttttggttgagaacttttgccagtaagaccgataaagatttatggattggaacctccagtgttcaccacggcctggaaggtccgcat

SEQ ID NO: 6015 - DNA, 1038 bp, Candida albicans
ttttttgaagtcagtctgagattcatggcagagaacattgttcatttattaacacagggagctggctatggagtattagtcggtgttggtgcagtatttgctggtggaatgattttaactacattcctataccaaaaataccttcatgaaaatgcctatagcacggaaacattttctgttgctaatcgttcagtagtaacttttctttcagcatcagcagtatactcaagctggtcgtgggctactgagtttttattggtgactctgatgacttataactatggcattcaagcaggattttattttggtgctggattagcagtgcaaattgctgttatgagtgttcttggaatccatgccaaaaagaaaattcctacagctcatacttcattagaagcagtgcagttaagatatggtaaggcagcacatctactttatttgcttttgtctttgatttgtaatatttgttcttgtctgtcaatgatattggcatgtgctgcaaacatttccataattgctggaaatctccatattgttgcatctacgatgttgattccatttggtgtcttgttgtatactgtggttggtgggttgaaagcaactttccttacagattttattcacactacaatattgctcattgttttgtgttatataaatactgctgttttaacatcagaacaagttggtggacttaacggattgtatgataagatcgtcgaagtgagcactaccaaatacatcgaaggaaattatgatggagcaattctcacaggaaagtcacaagggtcagtgatgtttggtttaattttaactatttgcaattttggattgacagttatggattcttcattttggcaaaaaacattttcagctagtccaagagctactgttcctgcttatcttttaacggcgtttcttattttctcgaatgtgtggcctattggtgctattattggtggagctctgcatttcctagagaatgacccttcatttcccccgtatcttcacctcgggactaacaagagcccgctatag

SEQ ID NO: 6016 - DNA, 1152 bp, Candida albicans
gagagatttcaaatgtcagagagtgcagtacatttattagaccaagcagcaggctatggggttttagtgggtgttggtgccttattcgcaggtggtatgattttgaccacttttttgttgcaaagatatcttcatgaaaacgcaaacagtacagaaacctttgcagttgcaaatagatcagtgggtactttcctttctgcctctgctgtttattcaagttggagttggagtactgaattcttgcttgtttcgctgatgacctacaattatggtatacaggctgggtattactacggtgctggcctcgcaattcaaattgcggttatgagtgttatcgggattcacgccaaaaagaaaatcccaacagcacatacatcgttagaggcaatcgaattgagatacggcaagtcagcacacttgctttacttgacattatcattgatttgtaacatttgttcttgcctggcaatgattttggcatgtgcatcaggtatttcaattattgcaggtaatcttcatattgttgcttctaccttgttgattccctttggtgtcttgttgtatactgtggtaggtggattgaaggcaacatttcttaccgatttcgtgcacagttccattttgctaattatcttgtgctatttgaacacttcagttttgacgtctgaacaagttggtgggctaaatggtttgtatgacaaattgcttaaagtaagtgcaaccaaacatatcgaaggtaactacgatggttcaattctcactggtaaatcccaaggtgcagcaatttttggtttaattttaactgcaggtaactttgggttatccattatggactcatccttttggcaaaagacattttctgcacgtccacgaagcacagttccatcgtatcttatcaccgccttccttatatgttcgaatgtttggccattaagtgcaatcattggtgggtcactgcacttcttggaaactgatccttcgttccccacctatcctcgtaaaatgaatcaatacgaagtggattctggatttgtgttgccctatgtgttgaaagcaacaataggaaacggaggtgttggtgccttgcttttgattttttatttagctgttacatcgacggtttctgctcaaatggtttctctgtcttcacct

SEQ ID NO: 6017 - DNA, 1512 bp, Candida albicans
caagctgtttgggaaatagttaccaagttggcagaatcaaatccaagagaaggcaatgctggtggatcctattttaccatgcattccagatctggtggtatgtttttcgttatcaatatcattggaaattttggaactgtgtttttggataatggttacttcaacaaggcatttgctgccaatccactgtctacttataagggatacatttttggaagtcttgcatggtgtgctattcctgccttgtgttcattaactatgggatttgccgccttggcattagaacacactgaatactggccattgggtagaccaatgactgctgctgaagttgcttctggtttggttttgcctaatgctgccagtgcccttttgggtaaagctggtgcagtgttagctttgttgatggtatttatggctgtaacttcagctatgagtgctgaattgattgctgtatccacaattgcaacatatgatatttacagaacttacatcaaccctaacgcttcaggaaaaaaattgatttgggtttcccatttgtcaacagttatctttgcttacactatggctgggtttgccattggtctttactacgctaaagtttccatgggttacttgtacgaaatgatgggtgtcattattggtggtgctgtgttgtcctctgctttgacaattttatccaaacgtcaaaactggcatgctgcaacatttagtccaataatttccacagccttggccattatggcatggttagtatgcaccaagaaaaagtttggctctgttacttatttgaaaacatttgaagacgacgctatgttgactggtaattgtgttgccttattgacaccatttattattgtcccaattcttacatttatatttaaaccacagaattttgattggaaattgttggaccaaaggattactcgtgttgacgaagaagaagaattagctgaagccttgggtggtactgtctcgagtgacccagaaagacttcatcctatcaaatcccaaatttctgtgattgccagtcaattagttgaaggtgaaagagaacaatatcaaaaggaaaaagagattttgaacaaatctttcaagatctgttgtattgtttgttgtacactcgctatttgtcttgtggttcttttcccaatgccattatacggaaccaaatatattttctctaagaaattcttcactggttgggttgttgttttcattatctggttgttctactctgctttccaagttattattttcccaatttgggaaagtagaactgatttgtatcatacttttagaggtatttattgggatttgactggtcaaacctacaaattgaaagcttggcgaaatgaacacccagaagaaatgcatgctgttagatcccaattacaagcacaattatcaagaactgctgttactcatgaaattgttgacggtaaagcatttggtgatggatatgtcaccccagcaaacattgacgatgcattagaggagaagaaaggatag

SEQ ID NO: 6018 - DNA, 2043 bp, Candida albicans
  unsure (1939),(2010): Identity of nucleotide sequences at the above locations are unknown.
atcacaatgtcggaaagttcagttcatttattaaaccaagctgcagggtatggtgttttaattggtgttggagcattatttgctggtggtatgatcttaaccacatttttattgcaaaaataccttcatgaaaatgccaatagtactgaaacattttcagttgcaaatcgttcagtaggtactttcctttcggcgtctgcagtttattcaagttggagttggagtacagagtttttattcgtatcactgatgacttataattacggagttcaagctgggtattattatggggcaggtcttgcgattcaaattgccgtaatgagtgttattggtattcacgctaagaaaaggattccaaccgcacatacctcgttagaagcagtgcaattaagatatggtaaggcagcacacttactttatttggttttgtctttgatttgtaatatttgttcttgtctggcaatgattttggcatgtgcatctggtatctcaatcattgctggtaaccttcatattgttgcatccacaatgttgattccatctggtgtcttgttgtatactgtggttggtgggttgaaagcaactttccttacagattttgttcacaccacagtgttacttgttgttttgtgttacatacacacggcggttttaacatctgaccaagttggtggaatagatggattatatgacaaaattattgaggttagtaagactaaattcatcgagggaaattatgacggatcaatccttacgggtaaatcaaaagggtcagtaatatttggattagtattaactgcaggtaattttggtttaacggttatggactcgtcattttggcaaaaaacattttcagctagtccaagagctactgttcctgcttatcttttaacggcatttttgatattttccaacgtgtggccaattagtgctattattggcgggtcactgcattttttggaatctgatccatcattccccacttatcctcgtaaaatgacccaatatgaaattgattctggatttgtcttaccatatgtgttaaaagcaatattagggaatggaggtgtaggtgcattactattaattttatatttagctgttacatcgactgtatcagcacaaatggtttcagtatcttccattgtatcatttgacatttacaaaaaatatattcatcctaatgcccaaaacaaatctatgatcaatgtttctcatataacttgtgttgtgtttggtttaggtattgctggattcagtatcatgttacattatgttggtgtgaatatgacttggtttggatattttatacctatggccatttgtccaggtgtgattccattgattttcactgttacccgggacagacaaaccttttgggcagcatttatttctccaattgttggatttgctgcagggttagcggtgtggatttcgacggcatatcacttttatggatctgtcacaattgaatcgactggcggtcaattgccagcattatacgggtcattaacagcattattgttacctggaacattgagtatcatcatttcatttattaaaccggaaaagtttgattgggaaaaattgaagcaagtcaatttgttagttgatggagatagttcatctgaagttgagatcgataatgacaccccaactatccctaaagaaaaacaagatggagttgaagtgaatttcgaatctgatgaaacatcaagtttggagcaacaacagcagtcccaagctgcttctcaattaacggttaaagaaatggatttctggatcaaaatctctaccggatctgtgatttttatattgttagttacttgggtcatttggccaatgtctgtatatcgagattgggtattcacagcttcgtattttaaaggatatgtcaccgttgccttaatttggttgtataccacattgattgtgatangattagttccattttatactggaagacattcagctgctaaagtgttaaaaagtgtttataatgactatatnaaaagaaaattatgctttatattattaaccaac

SEQ ID NO: 6019 - DNA, 609 bp, Candida albicans
  unsure (573): Identity of nucleotide sequences at the above locations are unknown.
tcaaaaatggttgatttatatgtcccattaccacagagtgctggttatgctgtggttgttggtttaggatttgtctttgcatttggtatgatgcttacgacatatattttaagaagatacaacaaagaggtcatgacggcagaagaatttgcaactgccggtagatctgtcaagactgggttaattgctgcatgtattgttctgagttggacatggagtgtcactttaaacggatcaacaagtcaagtttataataatggtgtttgtgggctgatcttttatgccatgggtgctactgttcaaatcactttgtttgcatgtcttgccatcaaggcaagagaacgtgctcctgctgcacatacatatttggaaattgtcaaaggtagatatggtaccactacccatttcgtttatattttttgggggatagtcaccaatatattagtgacatcaatgttgcttagtggtggaagtgccactgtcaatgacttgactgaaatgaatattgttgctgccatattacttttacctttaggggttgtgatctatacacttttgtgctggtatcaaagntacatgtcaacgccgggtgaaagtcaaagcttgcgt

SEQ ID NO: 6020 - DNA, 1203 bp, Candida albicans
  unsure (69): Identity of nucleotide sequences at the above locations are unknown.
aaggtttcaaaagatggttttcaggcgggttttaaaaaagggcaaaccccatacttggggaccattggngtttttttttttaccaaatataacaataggggccttttttataacaggggtggtttggtttataaagggggtgtgatttattgggttgtaggggtttgttattcattaccacacaatttgttcgtatattcacacaaggttgacgaatttgtatctggtagcagacgtgttggttttggtctcttgttagctggtattttgctgagttggacatggagtttaactttactagaatctgcagtcaaaagctacagtatgggcttctgtgggtcatactattatgctattggaggacttctccaagtttcaattttttcagttatttccagcaaaatcaaaaaaaatgcaaatttggtcaccacattcccagaaatggggtactttagatttggtgtacctggccacttagctttcctttggtgtgggtttgtgtgtaatgcaatcgttagctcatgtattcttcttggagggtctgctgtacttcacgctgtaaccggtgttagtcaatatgcttcacttttcttaattccttttggggttgccgtatatgtctcatttggtggcttgagcgccacattcatatcagatgcttcacatacatttatcatattaatttttattattgtctttatgttcgaagtgtatgtttcgaatgacaaaataggatcagcacaaaagatgtgggagttattggaatctttacctccagtcgaaaacaattaccaaggatcatatctcacttttaggtctgagcagggtgccatattcgccgtgattagtgttatcaccggtattggtttggttgttgctgatcaagcatatcttcaaagagcagttgcagctgaccccagaattacctctagggcatatttttttgctgctttgtgttggttcgttattccctttgcaatgggtgcttctttgggtcttggtgccagagctctttctgtctatccagattttccaaaattgactgactttgaagttggcgaaggacttcctgcagccgctgctgccacgtatttgatgggtaagacaggactggcaatgataatcgtcatgatattcttttctgtcacttcatcgtatgcgggagaattaattgctacttccactttggtttcatacgatctg

SEQ ID NO: 6021 - DNA, 540 bp, Candida albicans
cgcgggtcttccacttcgtggtgccgtatggccttggtcatgggaggggtgatatctattgtcttatctttgatttggccagcaaatttcgactttgacaacacaagaaacaagaccagtttggctgaacagaatactgaactaatcaaacaacaaagttcgggaaccactaagctcgacgaaaccaaggatcaaaacgtggaaattgaaacagaaattgcaaattccgatttggatatggatttaaatgccgaaattgatcataaacatttggatcaacaatttaaaaagtatacaatcttggttattgttcttgctataatattcgtgtttatcattcctgtgccgtcgggaggttccccctatgtattttcgccaaacttttcacttggttgtgtgattattatcactatttggttatacttttctttattctatgtcgtcatactaccattattcgaagctaggaaaactctatggcaaatcaccaaacatatctcaagaatagattccaaatcagaatcaaatcaatataaatag

SEQ ID NO: 6022 - DNA, 429 bp, Candida albicans
catcataatcatttaggtccatgtgcatgggttattgtggctgaggttttccccttgggtatgagagctaaaggtgtatcgcttggttcaagtttcaattggttaatgaatttttcggttgcaatctcaactcctaaatttgttgccaatgctaaatacggagcctatatttttcttggtttgatgtgtgttattggtctgatgtatgtttatttcatggttccagaaactaaaaataagactttagatgaattggacgaagtttttggagatttcactggtacttctaaaaaagaatctgaacttcgtgaaaaaatacttaaacaagttggtttggtggatttgcttgttggttctgataaagagttggattcttttcgttcaaaaccagaagttgaatataaggaaaaagaagcacacagtgaatga

SEQ ID NO: 6023 - DNA, 417 bp, Candida albicans
tgccatgatctttatgacttcactttatgtgtcttctttgcttctacatgggctggtggtgtttactccattatttctgaactttatccattgaaagttagaagtaaggttatgggtttagctaatgcttccaattggacctggggtttcttaatttctttctttacttcatttattactgatgctatccacttctactacggtttcgtctttatgggatgtttagttttctccattttctttgtctactttatggtttacgaaactaaaggtcttaccttggaagaaattgatgaattgtactccaccaaagtccttccatggaaatcagctggttgggtgccaccttccgaagaagaaatggcaacctctacgggatatgctggtgatgccaaaccagaagaggaacacgtttaa

SEQ ID NO: 6024 - DNA, 1125 bp, Candida albicans
aacccatcaaatatccttcttgtttatcgatttgttttctcttttttttatcattttcttcaaaccccatttataacggttattatcaaaatattcacaatgctgaagggagatttagaagaattagatattcaaaagcttatagttgaaaaaaggcttgaacaatcaaatggttcaggttttgccaccatgaagcgtaacaaaagagcacttggaacatgtttatttgtatcgttaggtgggatcttatatggttacaatcaaggtatgtttggacaagtttcaagtatgcattcttttggtgaaactgttggtattggtaaaatccaagataatccaacattacaaggtttattgacatcaattttggaattaggtgcttgggttggagtattaatgaatggttacgtggccgatgcattgggtcgacgtgcttctgttgtcatcggatgtattttattcaatattggtgttattattcaagcagttgctcgtgatgccgattatggttatattttgggtggacgttttgttattggtcttggagttggggtactttccatggttgtaccattatataattctgaaatttcgcgagctgaaataagaggagctaacactgccatctatcaactttccattacttttggtattatgatttcctattggatcacttatggaactaatttcattggtggaacaggtgacaatcaaagccaagcctcttggttagttccaatgtgtattcaagcggcgccagcaataatattggcagtgtttatctattctttcccagaatcacctagatggttgatcaatgttggtcaagaagataaagcattagaagttcttgcttggttacgagaaactgaacaagaaaatgttggtttgcaaattgaatttttggaaatgaaagcacaaaaaatatttgagcaaacacttgaaaccgaagcttatccacatttacaagatggaacaaaaatgtcaaaattcaaaatcaatttgaaccaatacaaatcaatggttacacatttaccaacatttaaacgagtctcagtggcttgtttgactatggtatttcaacaatggacaggagcgtatgtatcaaatactttttttttttga

SEQ ID NO: 6025 - DNA, 228 bp, Candida albicans
ggacaacgtagtgaaccaggaggtggtccttcggtatggtcatccgctggatcttccaagacaatgctaacaccttgcagcatgcttcggttagaagaagtatatgatgtaacggtcgtcaaagacggccaagaagcctacgacactgtcaaggcgaatatggaagagggcaaagtatttgacgtgatcttcatggacattcaggtatatgcaaccgtcactatgtag

SEQ ID NO: 6026 - DNA, 1047 bp, Candida albicans
gaaacgtataaatccaatagtgatggggtaatatcatatcaagttgaaaatttaccttcatggttatcatttgattcatcaagtagaacatttactgggaaacctcaagaatcagatgtgggcctgtttgagatcacattaattggtacagattctactgatcaatctcaattatcaaataattataccatgatggtttctaatgatactgggttatatttaacttctcaagcattattatattctgaattatctaaatcgggtcaaactaatggtaatggaggattagtagttaaacctggtgataaaataaagattcaatttgaaaaaaatttatttaaaagttattcatctagtgatcgacctattattgcttattatggtcgatcagccgatagaagttcattaccaaattggatatattttgatggtgatactttaacattctctggaacggttccttatgtaacttcagaaaatgctccatcaattgattatagttttagttttattgcttcggattattatggatttgctggagcagaagggaaatttaaaattgtagttggtggtcatcaattgagtacttcaatgaatgaaactaatattgttaatggtaccattggttcgaaaattgatgaatcaataccaattttatctgatgttttccttgatggtcaacccattagtaaagaaaatatttccgatatttatgatcaagatttaccaaattatgccacatttgataaaaataattttactattactggtactttccctaatacttcaaccactgacaattttactattgttgttaaagatatctatggtaatagtgtcgaattaccttattcatttgatgttgtgaattcaatttttacaattgattcccttaaagatgttaatgctacaagaggtcaatattttcaatatcaaatattaaaatcatatttcactgatgctgaagatactaaagttaccgttgattttggatcaggaaccaactctgattggttacaatatcatgattctaatatcttcaccacg

SEQ ID NO: 6027 - DNA, 228 bp, Candida albicans
  unsure (178),(202),(208): Identity of nucleotide sequences at the above locations are unknown.
tctcttcacgcacaaagctatcttttcactagcacaactttatcagattcaaccaccactttacatattggcatgaaatttgctgaatctttgaaagaaggtttagtccctgaatggcaggatcaatatgtggattataaagaagggataaaattaattggcacatgtccaaaattanttagaagatgtcgcccgggacccnacaggntattgaaattgccgcgctgc

SEQ ID NO: 6028 - DNA, 1059 bp, Candida albicans
tttttttcttaccgggggaatatactttacggtaatagtagaagatggttacaagtagccctttggagattattattgtctggattataccctgtggaattccgtgatttctttttaggtgatattgtgagttcattgacttataccatggggaacatttcatttttcttttgtttatattcacatcattggaaagggacattaccaggccaaataccatcacaaaatacttgtggatcagataaatctcgattaatgggatttttcagtactttgcccagtatatggagatttttacaatgtattcgtcgttatatggatactggtgattggttcccacatttagcaaacctgatgaagtacacaattacagcaatatattatatcacattgagtatctatcgtattgatagaaaaacccaaaatagggcagtgttcattgtgtttgcatctatgaattccattatttcatcaatttgggatattgttatggattggtcattattacaatctgattcgaaaaatttcttattgagggatcatttattttataagaatccaaattattattatgcagcaatgattactgatgtaattttaagatttcaatgggttttctatgcatttttcactcgacaaattcaacaatcagcagtgacaagtttttgtattgctgtagcagaaattgttagaagattcatttggatacttttccgaatggaaaacgaacatgccaccaatgtcattttatttagagcttccaaagatactccattaccttattctgtgtctaacaaggttgaaaaagccatcaagaaattagttgaattacggtattactccaagttttctgaacaacaagaacctaatttccaagattattcaatggatttccaatctacaagtcctagcaatgttggtgttaatgcatctactactattgatacttcagcaactactggttattctgctgctcgtgataaggatacacatatccatgaaagttctattccaatccataggaaaactattgctagtaaccgaattatcacttcttaa

SEQ ID NO: 6029 - DNA, 1725 bp, Candida albicans
ctgacacgcaaaatgaataaaccaaaatctttttggaaaaagttggttgtctccatggaagtccagccaaaaggcgacctatcaacggcacaaatgttcctttataatcacgatttaaggccagtagaggaggccagaagagagtgggcgtggtacaattatgtattcttttggattgctgattcattcaacatcaacacttggcaaattgctgccactggtatccaggcaggaggcatgaattggtggcagacatggattagtgtgtggttggggtatgctttgtgtggtatatttgtgagcattggtgcccgggttggtactttgtatcacatctctttccctgttgccgctagatcttcatttggaatctatggttcgttgtggccagtgttaaatcgtgttttcatgtcgtgcatctggtattccgttcagacagccattgctggtccaacgtttgaacttatgttgcactctatatttgggaagaacttgccgcaacgtattcacgacacaatacccgacaaagatttaacaacttttcaatttttggggatctttttgttctggttattccagttgccttttctttggttccccccacataagattagacacttgttcaccgtcaaagcatatgttgctcccattgctggtattgcatttttagtgtggactattgtaaaagctggtggcattggtccagttgttcatcaaaagtcgaaagtacacggatctgagttggcatgggtatttgttgagtctactatgaactccttgggtaactttgccacattgattgtcaatgctccagatttctcccgttttgctagccaaccttcgtttggaatgaagtacttggtgtacactttatccattccaatttgtttctcgatcacctcacttattggtattttggtcacttctgcttctgaagcaatgtatgggaaaccgttctggtctccgttggatgttttgggaacttttctaaatgactatactcccgggaatcgtgctggtgtgtttttcatttctgctgcttttgcattggcacagttggggacaaacatttctgccaactcgttatcgttcggtacagattgttcagctttgctaccaaggtttttgaacattagaagaggagggtatatttgtgcatttttggctcttgctatttgtccatggaaattaatctctacttcttccaagtttaccacgtacttatcggcatattctgtcttcttaagttcagtggctggagttgtagcatgtgattatttctatgttagaagagggttcattctgctaattgacttgtactccttgaccaatccagataataaacaccaagactcaatataccgttacaacaaaatcggtgtcaattggagagcttatgttgcatatatctgtggtatcttgccaaatattgtaggatttgtgggcgcaactgaaacccataaggtgcccattggggccacacaggtatacaggctaaacttttttatgggatttttcactgcttggataatatattctgttttgtgctactttttccctgtgcccactggaacagtcaaagttgggccatttgaaaaaggctggtttgaagagtggcaagatgttgagacatttgatgaagaattagttggccatgaagtgcatgatggtatcgaaaaaattgaatatttggaggaatctgtcagttcgaagaaaaagatttag

SEQ ID NO: 6030 - DNA, 633 bp, Candida albicans
ttgttgtctacaggtattttcgggatattgaaagcttttgcggcattggtttggatgttttgtattgtcgaccggctaggaagaaggacagcattaatatatttctcgtttccttgttcaatatgtatgtggtatattggtgcctacataaagattgccaaacccggtttaagagtggcaaatggtgacacacaccaagacgccggtggaaaagcagcacaagcaatgttatatatttggacgatattttacggctctagttggaatggtacaccctgggttatcaactctgaaatattcagtcaagaagtgagaacattgactcaggcaataaactcaatgtctaactggttctgggcttttataatgggtcggttttcaggtgaagctgttaaagccattggctacaaattctatttcatttttgcaacttgcatggcggtgtttccaattgtaattttctttttatatccagaaacaaaaggagtgccattggaagcagttgattatttgtttgaggttcctgcttggagagccagaccttatgctatggcaaaataccagaaagaataccaaaaacagaatctatctacaagcatacccgaggaacaattggaaaaacgtttagactag

SEQ ID NO: 6031 - DNA, 927 bp, Candida albicans
gaaagctttcacgaaatgagggtgctaacacgcaaagtaaaatccagacacaagaatgtatcattagcattgactattgcagtattcatgatattttggcttattggcgcgctaatatttcaaaaaattgaaaaatggtcatatttcgacgccatgtatttctgtctcttgtgtttgatcacgattggctatggtgattatgcacccaagaccagtcttggacgcgttttttttgtttcgtgggcagtgggtgctgtccctttaatgactatcttggtttccaatgttggtgatacattatatgaaatttccaacgacataagtgcttggttctccacctggatgttttccacaaaagaagagtacagggatttaaaatggaagaaaaagaaattgcaggaggaccaagaagatcagcttacagtaaactctgaggcggtacgtagtagcgaacttgatgaagatttggatcttgcaaaaatggaacaagaagctagtcttgaagcacgtgacaatagttccaacggtgaaattggggctgctagtatagataacccaaatgaagatgttaaagttgaggataatgatacttgtattacaaactcgagtaactccaatatgcggaaagaccaagagaataactcttattctgaaagatcggtttgtaaatcagaaaagcagaattttgacatcgagaggatacggcaaaagatcgcttccaagaaacaagtacatgaaatgctaatagattatttggaaaaaatgaaacctttgattggggacagtattgaatcacctaacagaaaatatagttataaacaatggaaaggagcatatgatgggttctggttgagtgaatcatcgcctttgagattgcctttaaaagaacccaattatttaatcttgaaaatctactttggagattga

SEQ ID NO: 6032 - DNA, 1287 bp, Candida albicans
atatatatcgatagtccagggaaaaacgttgtgaaagaaaaaaaaagaaatcttttcatacctgaccatactccacatgccccattatttagtgattatcagaatcttgataatcgattgtcattaaaaatgggcttccatgcacctttaaatggttcaagcaaaaactcaaaatcttcagcatttgcatcttttgattctgcatctgtcatgcaaatagtaaacaaagcaaaagataagatagtgcccgatgcacagttccatcagaccatcacagatcaaggaatacggcattaccaagaaaaactatctccactacttcaaaactcgtatcatggagcaaacgtaaacactaataagcaagattcttcccccatgaaatcaccagtgacattgcagcatgccttgaatgtgcgtttggaaagtatacttagtttgaatgttcgaccgggggagccattttttgtcttatggtttttaatttcaagttattttccattgattgccgcatgtctaggtcccttggcaaatatgatatcgatcgttgctttagtcgagcattggaaagtggacattattaccaggaaaaatgtccctgacataccaaaagtagttgtaatgaatgcagtttcattagcattgggtttgattggcaatatttcgttgttaatgaacttttctcgatctgtcaaatatttggtcagtcaatcggtttctataattgcatggctttgcgccagtgctttgctcgctgctgcactttttgtgacaaacagagagtttggtggtgaaaatccaaaatatgttccatcagaagggttttattttgcggcatttacttccggtaattattttgtatgtatgctaatcttggtaatcaatttcatgggatatagtttgaaaaaatatccgccaacattcaatctagaccaaagacagagaacattaatgttattcacgattttgttttccacttggacagtaataggagcattcaccatgggatcgttgatagatgatataagttatggttcagcattgtattattgtattgtttcttttttgactattgggttgggtgatattttgcctgaaacctctggtgccaaagtcgctgttttagtgttctctttgggaggtgtattgataatgggattgattgttgcaacccttcgcctggttatactatcttctgcagccccagccatattctggaacgatgttgaaaaaaccagaatagctctattatcacaattggacaaagaaaacagacatttaaccctgtaa

SEQ ID NO: 6033 - DNA, 1440 bp, Candida albicans
acatgttctgcagtagctggtgaaagctgtatagtaaggatgagtggcctggatagaggtgcaaatacggctactactactactacttcttcttcctccacaacatcgtcatcatcttatagtataacctattcaactaatgaaataccgatattaacatattccaataataataacaacaacagtctccatattcatcaatcttcagaagttcatgaaacttcccatcattctcaatacgaagaaaatacatttattgattggtcaaaggaatcaattataatttcaagaaatccatctgtttttctaaccaataaatggatcattttgattttttctgccattatattgggttatttcacatcagccattgatttgattcaagtatcactaaatgattttaaaaaggggatatgttttagttctaaagattcttggactttattaaatccttatatgacttgccctgtcgaggattggtacaattgggatcaaatatttttcaccatacgcaatccaattgttaaatttataattaatttcccaatttatttaattttggcccttgcgtttggtataatagctggatatttaacgtataatcgagcatatatgattcgtcaatcgggtataccagaaattaaactaattatatctggatttaatttgaaaattgatcaatatttgggatttaaaactttacttctgaaaagtattgccttaatatttgttgttagttccggattatggttaggtaaagaaggccctttggttcatatttcatgttgtgttttaaatatcatttatgaaatcatttctaagtattatagtaatcaaaatgaagcaattcgaagagaattattaactgctgctactgcgaccggtatatcagtggcattcaattcccttattggtggagtattatttgttttagaaagtatgcctagttatttcatccccacaaggatcatgtggaattcatttgtttccgccacagtagctacaattatcttgactggatttaaaatatttactgatggaagaaattttaatgaacaagttttatttcaagtcaattttggtaattttagttggttatttgttgaaatcattccatttataatgctagggataatgggtggggtttatggtcattattttattaaatttaatgggaaattttctaatattaaaatcagaagcttgattcgacaccgattatgtaatttattgaaagttgattataaatatggctcaattttggaaatcttattgattgttttaatcacaacaattataaatttcccatttgaaatatcaaaactacctttaaatgcattattgaatttattatttaaaagctgcaccaaagataacgataactcaaatttgtcaacaagtaaagatttcatttgtcaagattccaatggagtagcatta

SEQ ID NO: 6034 - DNA, 465 bp, Candida albicans
gcagccaaattggttaaattttatgcgccatctgctgctggctcgggaatttctgaaatcaaatgcattgtttccggatttgtaatggatggatttttagggtggccaacgttgttcatcaaaagtttgggcttgccattggccattggatctggattgagtgtcggtaaagaagggccaagtgtccattatgctgtttgtgtgggaaattctatagccaaattgattactaaataccgaaagagtgcactgagagcaagagaatttctaacagcaacagcagcagcaggcgttgcggttgcatttgggtcacccatggggggagtattattttcagtggaagaaatttctactgtgtttcaattgaacactatctggaaatcgtatttttgtgcattaatagcagtgactaccttggcagcactcaatccatttagaacagggcagatgttcttttttgaatga

SEQ ID NO: 6035 - DNA, 1248 bp, Candida albicans
atttcacatacgagttgttgcattcaggaaaaagtatttgggcaattttgcagtcagagaagttttgatatggactttgtttacagcaagtttttatatttcaaccagttcttacgtttggacatgaccgaaacaatgcaaatactcttccatgaatgtgataaaaactttcaccatccgatatgcgactctctgaataaaaagactggcatcattgtttcgttgttgtttgcaactttagcaagaatgctattgacaattgtcacatatggatgcatagtacctgctggtatatttgttcattcgatggcagctggtgcaacatttggtcgagccttggggataatagtcgatttagtttatgccaaccataaagactcttttgtgtttagaaactgtccaaaagatggcaagtgtatcattccggggacttatgcctttttgggagccgcagctgggttatgtggcattacggatttgacagttactgttgtcataattatgtttgaattaactggtgctctacgctatatcattccaacaatgattgttgtggcaattactaaaagtatcaacgataagtggggaaaaggtggaatagcagatcaaatgataaaattcaatggcttaccgttaattgattctaaagaagttttcacctttggcactactgttgagagcgcaatgtctactgttattgtatcactctcgaccgatttaaatgacagcataacattgaaacagttgcgaactactttacagaaaacgagatacagagggtttccaattataaagtcaagtaaagatccaaaaataataggatacgtctcacgacacgacttggagtgtattttgaaaacgcatgaaaatgtgaatgaggacatattatgcaattttaacgaggctgagtcaggaggggtcgataaagtagattttgatgctgtcatcaacaaatccccattgacagtaaatttcaatacatcattggagtatgttttggatatttttgcaaagttgggtgcacgatacttacttgtggagaaagaaggttgtttagttgggataataacaagaaaagatgtgttgcggtatgaatacaccgttcatgagcataatcgtgacaatgtccaacaagcaaatcatgacgcctttgatgaaaaagtatgggagtttattaatctaattggcacatcagcaaaaaagaatattggtaaaatactacataatgatgcaaatagatatttatag

SEQ ID NO: 6036 - DNA, 2466 bp, Candida albicans
aactctctttcatttttagaaaaagaaaactcgtttgtttgttcattttttacatgcatccattctacttatttcttcttctttattagagaaaaaaataatatgtcaagtgaccaaagtacatcaaatcacttgaatcaaaatactaaacccggattacaaaaacctaacctcacatttgctcccgatatcaaacacccgccgcactcctcattcatcaaagaccaaaccaaaacaattagaactgtacccaactctccctatatcgatagttgttcgacaccaccaccaccatcatcatcaaatacacttttatcaggatcaagacctttaactaaagttaaatcattggggaaaattgacattcgatcacctatccccataaattcagtattacaaacacccaggatcccagctttagatcaattacaagatgaaacctactctctaaggacaacccaaaccaatgaatcgatgaggagtcgattctttgggaaagtacatgacacttttatttcaataagaattttttataatgatttcacaactattgattggacaaaagcttatctcaaggggaatcaatttaattattcaattgagaaaaaacaatggattggtgatgattccgttaatgatggtcaagcaatcccttttcttcatagagcttattataccttgggtaaatggtttcttattttaattattgcattctttttttccattatagcattttgcatagataaagtagaaattctacttgttggtttcaagcatggatattgtcgatctaattggtttgctagtcaaatttcttgttgtatcgataatcccaaaaaattgaatgtatttaaaagtggatatgtgacaaataatacttgtgacaattgggtgagttggaataagtttttccatgaacactggttaaatacaatgcgatttgatttcataatttacgttgtgttgacgattcttttggcaatgtttgcttgtctcattacattgtcgacaaaaataactggtggatcaattcctgaagatcaatcaaatcatggcaaagaaatacatgctgatgataatgaaaatgccaccaaccaaggaagatccgtttctgtcaagcctagagtaatctatacagcaacagggtctggagttcctgaagtgaaaacaattttatcaggatttgtaatacgtcgattcttggggacatacactttgatagctaaaacagtagcattagtttttgctattgcactgggtatgtcattaggaaaagaaggaccttatgttcatttggcaacttgtgtcgggaatataacttcgagatttttcccctttatttatgaaaatgatttttttgaaaaacagattttatctgctagtgcatctgccggggtagctttggcatttggatctcccttgggtggggttttatttattcttgaagaaattaataattacctaccatctaatcaattgttccaaattttcttttgtgcaataatttcaacattgttcttaaaattcttgaacccttatggaactgggaaaacagtattgtttgaattggaatatttttcagattggagtcctatggaattgatttttttcgttgttattggaatcatgggtggagtctttggtgccagttttatcaagttttctcaatggtgggccaaaaaatttagatcaaataaacacatcaaaacccatcctatttttgaagttttccttgttgcagcagtaactggtataatttcattttggaacccttatacgaagcaagcctcggcagaattggtattagacttagcaacaccatgtagtggaggagaattagatcggtcattgtgtccacagacagaaaaacaattgttaaacgagttggcgtcacttttatttgcatttgttgttaaagtatttttaacatttataacatttgggttgaaattaccttgtgggatttatgttccttcaatggtttgtggagcattatttggtagaatttttgcattgtttattagatggttagagtttttatccaggaaatcatcgtcatcgtcctccgctttctccacactttcacttccagccccaccattggaatttggccttttatgttcatctgcaggtcctcattgtgttgatatgggcatttatgctatgatttctgcaggtgcatttatggcaggtgttaccagaatgaatataacattggtaacaattttgtttgaattaacttcatcttatacttatgttttaccaatttcaatagctatagctgtggcaaattggtcaggtggattattggagaaaaactcactttatgaatcattattaattagtaatgattatccatttatggcaccagaaactgaacccatagatccatatgtatctgctggtgatataattaatcaagattctcttcccacaacacggtattcaccccgcctggagatacga

SEQ ID NO: 6037 - DNA, 759 bp, Candida albicans
  unsure (572),(604),(680): Identity of nucleotide sequences at the above locations are unknown.
acgcggttttcattccgtgggcaagagggtgctgcatccttcatgactggagtcaccaaattgacaatgtcagtggtagtaataatgtttgaaatgactggtgcagtgacatatgtattaccaattatgggtggagtaatgacatcgaaatttgttagtgattggttgacaccaaataatatttatgatacttggctccaaaataatttcaaccaatcgagtgatggtgtagaaggtgttactaccaataaccaccttaacagcaatttttatgacaatggaaaccaattgattaatcaaggtaaggggactggattgatttcatttcagaatttaactagtacaataaaatcgaaattacccaatattaatattgcttcatcaatgatccccttattagatgttaaatgtttgtgtttattacctgatcaagaacaggaacagtttaccttgaactcgttaaactcatttattaataacgattgtcatgaaggttatccaatgattattaattataataacccaattatagtaggatatattcctaaatcacaattgttaaatcaattatntttatcattatcaaatcgagaaattgattcanattcaccaatttcatttcaaatcaaccacggtgttgatattcctgaacgagttgaacaattattatcgcaaagatnacaaccacaagttgtcctgattaatgtgcatccaatacaatccacattgaataataatgaaaaaacccccaatttataa

SEQ ID NO: 6038 - DNA, 534 bp, Candida albicans
ttacagaatcttggagcaactccatttcaaggttctttttttcttttgctgatctattttttgatttttcggccatttttctacgctcacaattcaccaatccttttgaataatcaacaaatgacaacataccaaccagttgaacaatcattagttgaagaagagtcagacctcacgctttttctggatctagttaggagtaggtctacaggctcatggataaatcaagacaatataagagaagttcaacgcttcaatgatttccgaacaatcgattgggtggaagatgaattagatgcacaaaagaagagagtgctcaaggctagacacataacatctcgtgggaataacatgaaagacaaaataatatcacaggcgcaaaactgggttgtgttggggattatgggctgctctataggattgatagcaggatcattaaatatcattacttcatttttatcaaatatcagaactggtcattgcaagagaaattttatcttatcttccccacgggctgcaaatccgcgtgccaat

SEQ ID NO: 6039 - DNA, 990 bp, Candida albicans
gtagggcaaatatggtgtctcttgcggctggtgaagaaaacaaatacaattccgtccagtactgaaacatctattaaatcggcaactgtcacaacaccagtttctgaatccacgaatactggaatgtcaatatttatgtcaacaactactgaatcaaaaacaactgacattaccactgaaacatctgtttctggggaagtgaacttgggatcagcaaccgttaaagtttcatcatcagaatttattagtaaaggaacggttactagaataatgcctactgaacttacaaattccgaatcaacatttactgcgtcaccatctttcgtgttgacaagtactgaatcaagcgttattgaaacaccagctacgatagaaatgagttccagatcatcatcttatagtgtgccattgtcaaaattacgaagtgaaggagaaactaccagagtaatacctactagctcaacagctactggatctactgtcattggatcaccatcatctgtatcgacaagtaatgaatcgataattactggatcttcatcatttgtgtctacaactgctgaaacaatttccactagatccatagttactgaatcaattgttgctggatccccatcattagtattgacaactaccgttttggacacaactgaaacaacaattacagaaacatcaattgtcggtgaactgagctccagatcattaactttcaaagcctcatcactaagcaaaggagaaattactggaactgtaacaccagaaatgtcagtttcaactagcaaagcaactactggcacgacttctgaagtatctattaaagagtcattaaccacaaaagttcctacttttacatcaacaacaattaaaccagagacttctgaaactcaacactctgaatcaagaactactcaaattccatattcagaaacaaagggttctcaattatctacagctaattcacaagtttctcaaactggaagctccaagtct

SEQ ID NO: 6040 - DNA, 939 bp, Candida albicans
gattctgataacaaatgttatttgacaactgaagtacaaagttctaccacttataccacaaccattgatggtgtgttgacggttattactacagctgtaccaatttctaaaactgaaacaagttctcctctggtgatcacttcttctgctgctgctgctgttactgaagaatcaactgaaaccgaggttttgactactgttattactgttacttcatgttctgataacaaatgtgcattaactgttttcactagtggttattcagtttataccattgatgaaactgcttatactacttatttcccagttacaacaatcacttctaaattatcgtctgcttctattaatggtgaagccacaaatactaaagctgctgccgctactaaagctactgctactgcttctgttgctacttctgttgctacttctggtactccacaagaaactgaaactaaaatatctacagcaattgttaccatcacttcctgttcaaacaataaatgtcatgaacaaacaaagactactggtattaaagtttacactagtgaagaaactgtttataccacttattgtccattatcaagtacttctgaacaaaaaaccactaactctgttgaaactccaaaatcaaatccatcaaatccttcatcttctccaattgttgaaaaatcttcaagtttagaagccacttctagtaatactgccaccacaagcactagtaccactacttctattccaccagttactattaatgtgatatcaggaaatatcgttactgaaactccagttgttgatcaaattcaatcaacttcaactcataatccacaaaaatcaactattgccattagtacttatgaaggtgttggtgctaccattatcacaagtaatgtgactggtttcctttctttagtgatttctcttattttctttatgatataa

SEQ ID NO: 6041 - DNA, 402 bp, Candida albicans
  unsure (372): Identity of nucleotide sequences at the above locations are unknown.
aaattaacaacatcaatgaagtttacccatttatttttcatcggtttattgactaaggtttatacagaaactgtgacagttttatcaaccagaagctacagattagcaaccacggagctgacccctactgatggtactgtttacttaacgttaacgagacaacaaagtctgtcaacttccttgaatgcttctacaattaccacaccaccactgaacctgtctgctagtgttcaaacaacagctgttactgactgtcactttcataattcggtccaatattgtgttgatggttacggaaatgaaggttcaatcttgccagttccaaccaatacaaacaaccttcctacaagctatgatggacccattcccacngtgatgatagctccggcaccacgagtatga

SEQ ID NO: 6042 - DNA, 2490 bp, Candida albicans
aatatgatgaccctggtagcagtgtcgattctaccacttatcaagatattagtaggattgaattttgaagtggttgttaaattagttgaaaaatttttcgaagacaattcatactatcgtacatttatatcaagtgttcatgtttttgatttcttgaatggttataattcaataaatgatagagattgggaaaatgacgatgatttattattggtatatatgattttatgtttatccattgaaagattgagtccccaagattttgttgaattaaacttgttacccgatggttcattgaatgtttgtacaaaatatcgaaagtttcttactcgtcaagtcctatataaaagttttgaacgattgaaagaaaatttagttgatgagtcaatgattactatccaagcttatattttatgttcagaatggttattcttacaacaaaactatgaagagtgttggaaaatgatgttccatgcttgttccatttcattttcaattggattacatattatgaatcaatttcgggaaactaataccaaagaaaataaaccatttaagaacgttgtcgacgctactatgggagagtctgactccagcagtgaaaaaaaggatacgatggaattggaagaggataaaaaaaatgaagacgaagaattgaatgctcagcagtatcgtctttggtatgctctcaaatatctgacctcagtgatctgttcaatatttgggcgaccaaaccccatctctgtgaaagttggtatgattgatagtacaccattgaatcaaatagatcaaaagttacatgttttacttaaatcagaatcaagtgagctgttaagattgtcaaatcttatgttgattgaaaattatatgattgatatctcatttgaaaatgtaatgacgttgaaattgaaatttgacactgatatattgactttggaagattcttatgatagcattcatggaaaaattacatgcagcttgattggtggttcagaacaacaaaataaatcaaatgacaatgctaataagtggattggttatgatgactatactaaaggctcattaactactaaagaattggatgtattatctgatactattattttgcacattaatagtgtaaaattgttggaaccatttgttaagaaatatgaaacacaaaaaggcaaggacactctttcggagaaacaaattgattcaattggcaaatttttacaactattgaatgtgtttatcgaaaagttcttgaacgtgtatatccaaaaacattcattggaaaaggaaagtcctaatgatacgagtggtactaatagtggtaagggatttcaagctgatcaaaatagattggatcgaatctctgtaccgccagctaaagccaattatggcccttcaaaatttggtagaaaattaaaaacttattatccatttttaaattcaatgttaggtcaaggtatgattgttatttttatctttttacaccataaggcaaaagagtttgttgaaaatgatcccaaaaccaagttgaataatgggtttttgcaactcattgaaaaaaatttagatactttgttgcaatttgaatttaggttgtcaactaagtatattactacttcaagaatgtggtcgtctaatatggtgtatttgattaaccgagttttgaatttgattaatatgatttatgaaaagcaagaagaattagaaagagagaaagatttcgatctagaatttgaagaatcagataaacaaagcttaataactatgaaatcagcatctagttctgaagagccttctaattcaacgccaccaattccgggtatagaagatgaattccccataactacagcacaaggaaatcttttgtatctattcaataccaattcatttggtgatccttcgcaatttgaatatttgaatggcttccacttgaatgatccaaattggttgacggtactggataacataccttattacttggaccctcttgttgatgggagtaaggaacaaattgctgattataagcagtacggaccagtaacagagacaacaaatggtaacattgatacttctcttgagccagttggagctgatattatggaaaatttgtcaacaaatgggccatcaggttccaattctgttaacaataccgcaattgctaatggtagtggaatggataattcaacaacggtatctaatactattgatcctgtgactgctgctgctgttgctgctggtactactacttccaccaatgtgattgctaactcttctactattccattacaaccacaatccaagagttcttctacaacccctgcaatattcaatcaaagttctggagatggctttggattaaattattataataatgggagctggacttcggcatcctccaatgattcatacaccaagtgttcaagaacaaccaatgtcgacagtgtccccaaactctggaatgccccctaccattggaatcacgaattccaagtctaa

SEQ ID NO: 6043 - DNA, 966 bp, Candida albicans
  unsure (122): Identity of nucleotide sequences at the above locations are unknown.
caagagttgcatctggtattttcaaagctactggtgagaatggcgaagagattacaaaaacaattccaattgagtacagaaaaactactgaaaggatcgagtttattactgtctgccccaantacactagcaaacggtcaagtcattgaaactactgctggaattgtcatcaccactaacaaacaaggagagaaggtcacaaagccagttccacttgagttcaccagcaccattgagtttagccaccacctcactactcatcctgttactttgccaaatggacaaatcactgttactacagagggtgtgataattacacgaaaaggggaacaacaatttaccaagacggttgaagttggaaacttacctagcaaaccaattgaagttgttcaaaagattagtgttgttccaaagacgttgccaaatagccaagttacttcagaaaccgttgccattcttgtgacagtaggcgaagagttgcaaccaattacaaagacaattccaattggaactagtgctcaagaaacagaaccatcctttgcagcatacagcgagattgtatttactacgtgttccgaaggtggatgcaatacatacactacaaatgttgaagtgattggtaacaaggtcattacaaagcaaagtgggaaaccaattgttgaggagcaaactaccaatggcattgtacatcaatctgataaagtatattacacgattgtttctggtgaaactaagactattcaaacacccggatccattgtatcaacttctcctgctgctattccagttgttacctcaaaaggatctcctaacattgttggatcttctgttgtggctggctcttctgtaacaacaagtgaagttagtacatctactgccggtgttttacagggaaacgcagcatcaagacaaagctttaattacaagtttattgttggtttgattttagcttatattattgcttag

SEQ ID NO: 6044 - DNA, 1374 bp, Candida albicans
attgctattaccaatgatgttgatcaagctatgaagctcgctcttgagcacaagggtgaaaccatcgaggtagacagtgttcaggcaagtaaattacttcgaaaaattgatttgtacttattacccgttatgtgcttgttgtattgctttcaattcatggataaattaacaacaagttatgcgtcagtgcttgggttaagaaaagaattaaaaatgcaaggtgacatgtatagttggacggctactgcattttacttgggatatcttgtctttgaattcccagcctcaatgcttttgcaacgattccccgttgctaaaacagtgtcagttttcattattctttgggggatgatattggctttgcattctgttccccaatacccagggtttgttgccttgagaactattttgggaatgttggaactgagtgtgacacccgccttcactattattacatctcaatggtacagaaaggaggaacaattccttagaactgcgtggtggtttgcttctaatggtataggtactattgtaggactggctattgcttatgggttatttaaaaataatggaaactattctttaccagcttggaaactcgtgtttgtcgtcactggttgtttgacgatattcttaggattcataattatggttcatatccctgacacaccagcaggtgcttggtttttaacagacgaggaaaaattaatggtagtggaacgtataagaactaatcaacaaggttttggtaacacacatttcaaaaagcatcaattcatcgaagcattgactgatcacagaacttggttgttttttttgtttgccttatctggtaatattccaaatggaggcttgacaagttttggtaccattttgttaaacgaagattttggttacaccccatctaaatcgcttttgatacaaatgccccaaggagctgttgaaattgttgggtgtgttttgtttgcttgggtttgcaaatttttcccatcacgtatgttgatgggtattattacaacatctattgctgtcttagcaaattgtctcttggctttttgcaaaggcactagtgcaagattggctggtttctatcttaatttgttagggccacttgggttcatttgctgtttgtcatgtgtatcttctaacgttgctgggcatacaaagaaggtgaccaccaatgccatgttcttgatagcttattgtgttgggaatttaattggaccacaaacatttatcagtacacaagcaccaggctacaccggagcaaaagttgctattgttgtttgtgggtttgtttcattgtttatattgattgcaatctatgtttcttatcacattgaaaatcttcacaacgacgtggcaggtcgatag

SEQ ID NO: 6045 - DNA, 774 bp, Candida albicans
agacaaagagaaagaatggtggttgaaagaattagaactaatcaacaaggttttggtaatactcatttcaaaaagcatcaatttattgaagcagttatggatcatagaacttggttatttataatttattcaatttctagtaatttacctaatggggggttaactagttttctggcaattttattaaatggagattttggttataatttaactgaatcattattaatgcaaatgccacctggtgcaattgctgttgttggatgtattatccttgcttattgtgggaaattcacttcatcaagattaattatggggatgatatcacaaattgttgttattatatgtaattgtttatttacatttgctaaaaatgataaagcaagattagctggtctttatattagtgctgtgggtcccgtaggtttcatttgttgtatatcttgtgtttcttcaaatgttgctggtcatactaaaaaaatcaccgctaatgccatgtttttaattgcttattgtgttggtaatcttgttggtccacaaacttttattgaatctcaagctccaaattatgttggtgctaaaattgccattgtcatttgttcttgtgtttcatttattactttggtattgatttatttatcttattactgggataataaatcaagagatattaaagcacgtaatagtgaagatgctgatttaatgaatcatattgaaaattatgaatttgctgatttgactgataaagaaaatttgaattttagatatagtctctag

SEQ ID NO: 6046 - DNA, 705 bp, Candida albicans
agacttgtacgaacttcgtggtggtttgcatttaatgggataggaactattcttggtctggcaatagcctatggattatatcaaaacgatggaaactattctttaccaacttggaaacttgtatttatagttacaggctgtttaaccatcttcttgggatttgtcgtcttgatacatattcctgataccccaacacaagcatggttcttgacagatgaggaaaaattgttggtcgtggaacgtattagaactaaccaacaagggtttggcaacactcacttcaaaaagaaccagttcatagaggctttaactgattacagatcatggttacttgttatttatgctttatcaagtaatatacccaatggtggattaaccaatttcagtggtatcttgctatatgaggatttccagtacagtgaagccaaatcactcttgatgcagatgcctcaaggagcagttgaaattgttggttgtgtgttgcttgcctggtgttctcaattcatttcatctcgattattgatgacagttttcacaacgagtttgacaatcatgtcagaatgtctcttaacgttttatcctgaaaaaagcggtagactagttggtttatatcttcctatgcttgaccctcttggatttatttgttgtttgtcgtgtgtatcctccaactttgctggacataccaaaaagatcaccactaaaccc

SEQ ID NO: 6047 - DNA, 660 bp, Candida albicans
caaaagatgaaacaacaagacgatttagaaaaatatcaagacattgatactaccaacaatgacattaaaccaataatttcttttactaaagaagatattgaagatggtaagaaccctaagaatcatcacgttataaccacaatcacatcttctgatggtaaaaaaatcaatattaccaatgatgttgatcaagccatggaagcagtattatcaaatgataatgaaccgccaattaactttgatgatatatcttcaactgaatggaagaaattattattaaaaattgatttatatttaatccccattatgtgtttattatattgtttccaattcatggataaaatgaccactagttatgcttccattttaggattacgtcaagaattaaaaatggtaggggatatgtatagttggacggggacatcattttatttaggatatcttgtatttgaattcccagcatcaatgttattacaacgattccctgtgactaaaacagtatcaattttcattattttatggggggttatattatgtttacattctgtacctaatcaatatggtggatttattacattaagaactttattaggaatgttagaactggcagtgacaccagcattcacgattattacatcacaatggtataaaaaagaggaa

SEQ ID NO: 6048 - DNA, 1659 bp, Candida albicans
ataactataaaaccaactcattccccttctatttcatcaactcacaggaagttttatcgtttaaaaaactccaagttagtaatgtccgaaaaaaaagaattgaaaaaccagaccgatatcgaaccgataatatcgttcaccaaagaagatatcgaagataataaaccacatgttttaactacaatcatttctccctctggtaaggagattgctattaccaatgatgttgatcaagctatgaagctcgcccttgagcacaagggtgaaaccatcgagttagacagtgttcaggcggataaattacttcgaaaaattgatttgtacttattacccgttatgtgcttgttgtattgctttcaattcatggataaattaacaacaagttatgcttcagtacttgggttaagaaaagaattaaaaatgcaaggtgacatgtatagttggacggctactgcattttacttgggatatcttgtctttgaattcccagcctcaatgcttttgcaacgattccccgttgctaaaacagtgtcagttttcattattctttgggggatgatattggctttgcattctgttccccaatacccagggtttgttgccttgagaactattttgggaatgttggaactgagtgtgacacccgccttcactattatcacatctcaatggtacagaaaggaggaacaattccttagaacttcttggtggtttgcttctaatggtatcggtactattgtaggactggctattgcttatgggttatttgaaaatgatgggaactattctttaccagcttggaaactcgtgtttattgtcactggttgcttgacaatatttttaggattcatagttatggttcatatccctgacacaccggcaggtgcttggtttttaacagatgaagaaaaattaatggtagtggaacgtattagaaccaatcaacaaggttttggtaacacacatttcaaaaagcatcaattcatagaagcattgactgatcatagaacttggttgtttttgttatttgcattgtctaataatattccaaatggaggattgacaagtttcggtaccatcttgttaaacgaagattttggctacaccccatctaaatcacttttgatgcaaatgcctcaaggagctgtcgagattgttgggtgtgtcttattggcttggctttgtaaatttctcccatcacgtatgttgatgggtattactgcaacatccattactgttttagctgaatgtctcttggctttttgtaagagtaacagtgcaagattggctggtttctatctttatttgttagggccacttgggttcatttgctgtttgtcatgtgtatcttctaacgttgttgggcatacaaagaaggtgaccacaaatgccatgtatttgatagcttattgtgttgggaatttgattggaccacaaacatttatcagcacgcaggcaccaggctataccggagcaaaagttgctattgttgtttgtgggtttgtttcattgtttacattgattgcaatatatatttcttattacattgaaaacaagaaaagaaactcaagaccaccagttgatatgagtcatattgaaaactacgagttcgccgacttgacagataaagaaaatccaaattttagatatagcatttag

SEQ ID NO: 6049 - DNA, 189 bp, Candida albicans
ttgagaaatgtcggcctatgtcgaggtgaaaatgttgctttattgtctttgatttgcttatacttttcctatgtttgggaaaacaaaaaacgggattcaaggacgatggttgatatgagccacattgaaaactatgaattcgctgatttgactgataaacaaaatccaaactttagatatagcaagtag

SEQ ID NO: 6050 - DNA, 756 bp, Candida albicans
tcgtgtcttcgaccgctggtgaagatactttgctttggattccaattggcaaccataacgttattacctggtgaaaccatgcgagtagtgatttctaaaccaaaagattgggttgctagtcctggctcttatgtgtttgtttcatttttcactcctaaatatttttggcaatcacatccattcacaatatctacttccactgaatcaactataactttatattgcaaagtgaaagaaggggtcactcaagcattatacaaagacttacttaattctccaaacaaaacaatcaaaataagagctggagttgaaggtccatatggtgaacttagtggtgctaaaacagctgagagtgcagtttttgttgctggtggtaatggtatacctggaatgtattcagaagctactcatttagcatcaagacgttcaattagatcatcgaaaaagataaaattatactggatagtaagagattatcgtttggtacaatggtattatgaagaattacaactgcttcaacgtaccaatattgaaactgtggtttatgttactcgtcctaatgatagccttgaagaagtggcatctaatttcacaagttccaattttgatgaaaaaagttgttattcacttggtgattctaaaactatgatttcatgtaattccaaatatactttaaatttgaaaaaagataataacaataataataactatcatcgtgttaaagaattaataaaagatgaattatcacatatttta

SEQ ID NO: 6051 - DNA, 1722 bp, Candida albicans
accatgttggtatcaatttttttgttagtctttggacttgcttcaacagttttatcttcatcaaatccataccgatacaccccactagatattgcacagtattcatgtgatgcctggataagtaaccataagccagtgtgtttacttcctgtggcttggggaggacataattatgattgctattgtaactccaatcctgcttttgctaccattatggattgttttatcaatggatacaacaatgattctgttattatcaatgaatttgctcagacttgtaacatgacatttgaatcgatgtttattaagtactatttaactttgaatttcaactcaacattattaagaaatttgtcattagcaaaaagatggggaaacactttaaccgaagatgatcttgtcaaaacaccaattttatacaattataccaatggctcttttgcagtttataaagatgtttataagttgtattatttaaacacaaatagatcaataacttatggaggtatattattggcatactgggctgttatcttggtacttgcaatcatagtaaacttggtcttgaaaatgtacttgggttgtatgattaatgcattcattggtaaagttgtcaatgtttacagaaaacatattggattaacaccaacattttccaaatcaaaatcaaaagaagtcagcattatgggttggttcttgcttgggacaattccatcaagattagaatccatcattttaggggggttttttgttgtcacaattgcagttcgtgcagtcaatattcaccacatacccaataaccccaaagaacctatcatggctgaggagttatgtgatttgatagcaacaagaacaggtatagtcacattatatttagtgccgttgttagtgttgtttgccggccgtaacaattttatgcaatggttaactggttggaagttctctacctatatgatgtatcatagatggatttctcgtgtgtgccttgccttggtgtttattcatggtgtcacttatacggtcgtcgataaactaaacggaacatatgcaactaacatgaagaccaataacgtgatttggggtattgttgcatgtgtttgtggtggattcattaccttttttggaatgttgatatttagacggaattattatgaattcttctacattttccatcttttgttggtagtattctttattgttggaggtgttagacatgttgttggcttgggatatgcaaattacttgtgggcttcgattgctgtgtgggtttttgatagagttcttcgtctcttcaaattggcatcgtttggggttaaaactgcacatattgccttgttggcaaatgaaaccattaaagtcaccatacctaagcctaaaagatggagaccaaagccaggtggacatgcttttgttcattttctcacaccatccacattttggcaatctcatccattttcgtttgtcattggtggtaatgatgatgaagaaattatgttttacattaaagtgaaagatggtataacgaaaacattgtataatcgtttgagccaatgtcctggtaaaatctcaacgatacccgttatggtcgaaggaccttatggtggaaatagccctggtcaaagatgcagacatttagtttatgttgctggtggtaatggtattcctggtctttattctgaatgtattgacgttgagtcttcaccacggcgtggaagacaacgt

SEQ ID NO: 6052 - DNA, 549 bp, Candida albicans
agcaaaatgtacaaaggagcagctggaatgggatctttcctaattatatctttttgtttattgattccgccatttttatggcacataagaagtagaaatttacctgctaccatattgattttctggttaatgtatgttgatttgacggggtttattagtactatgatatggagtggtgataattttgatgaagcttgggatgggcaagtttactgtgacattgttggtaagttggatgctggttcttctgttggaaaatgttgtgcaattgcttgtgtaattatgaacttgtattttgttctatgtgccaaacatcctacccttttagaacaaggttcatggaaaaaatttgcaatggatatggcaatttgtttaataaacccaatatttgtcatggctgtccattatattgtgacaggatcaagatatgcaattgtcaagtatcaagggtgcagtacaatttattcggctacatatgcttctcttcttttggtttccatctggactgtcttacacggacggagctggcaggtaccgcgcttagtgtgt

SEQ ID NO: 6053 - DNA, 633 bp, Candida albicans
ggacgcggatttcctttccgtggtgaagagcacttgctgaacaaaatcttgcacctagaaatatgtggatacgttgatcgtgctggtcgtccattagtcgctattcttataactaatgtatttggattattgagttttattgctgccagtggtaaagaagatgaagttttcacttggttattgtcaatttctgggttatcaagtattttcacttggttatgtatctgtatttctcatattagattcagacgtgccttgcacgttcaagggagaaatactgatgaattaacatttgtatcacaaactggggtcattggttcttggtttgggattttattgaatgtgttggttttagtagctgaattttggttagcaattttccccttgggtgaaaaatctaatgctaaaagtttttttgaaacgtatcttggatttgtaattttgattatattttattttggtcataaattatggagaaataattggatcttgtttattagaagtcgtgatattgatattgatagtggtagaagagaaactgatcttgaagcattgaaaagagaattacaagaagaaagagaagttttaaggaataaaccattttggtatagagcttatcatttctggtgttaa

SEQ ID NO: 6054 - DNA, 771 bp, Candida albicans
gcgcggatccttccagccccggtggttgaagacgcttctccatttgttattgccgtcagtcaaggaggaatcagagttgtccctcatatcatgaatgcagtggtcgttattgctgttatttcagtcggtaactcttccgtctatggatgttcacgtactttagcatcattggctgtccagggattattgccaaaatccatggggtacattgatcgtggtggtcgtccattgattgccatccttttcacatctgccattggtttattaggattccttgtcgtcgttgacgatgaaggagacgttttcacctggttcttctcgatttgttcgttgtcatcgtttttcacttggggtgcaattaacgttgttcatttgcgttggagatttgccttggctgcacaaggtcgttccactgatgaaatcattttcagatctcccttggggacttttgggtcttggactggtattcttgtcttaatccttattgttattggtgaagtttgggtgtcaatttggccaattggaagtcctgctgatgtacagcaattctggaaaaactgtttatccttacctttgatgattgtgatgtgggcaggattcaagacttatcaccgttcatggaatatgctttgggtcaaattaaaagatattgatttggataccggtagaagagaaattgacgttgaattattaaaacaagagttggcagaggaaagacaaatcataaagagtaagccatttgtctatcgtatctataaatttttcttctaa

SEQ ID NO: 6055 - DNA, 1038 bp, Candida albicans
ataagttttatagattcatttagagaattcgattactcaactttaccaccagtttataacaatatcaccgaccaggaaagtcaacttcaactcaatcctgctaatccaaatttcgactattctcatttcacacaattagaaagagatgcattgattactgcaagctcaccgttgtccaaacgattgaaaacaagacatttgacatggatatcattaggtgcatcaattggaagcggtctacttatatcttctggtagctcattggcccatgctggacccttgggtttattgattgtatggatttttgttgggtcggttatatttgcaaccatgtctagtttggcagaactagccactgcattcccagtgagtggttcatttacaacatatgttactttattcgttgataaatcaataagttttgccatagcatggaattacgcactacagtggctagtaacatttccgttacaattagttgctgcttctcttgccattgagtattggacaatcaaaattcacccagcaatatttgtcaccatcttttatgtctgtattgtttttatcaatttatttggagtctacggctatgcagaaattgaaatggtagtcagtattataaaagtaattgctgtgattggattcaatattttggcaatcataattgttactggtggcgtccctggacaaccatatattggtgccaaaaattggcagggtccacaagggggactattcaatacaattgaaccattcaaacaaatgtgtcatatagtatccaatgttgcgtttgcctatggtggtgtggaattgttcggattggcagctgtggaaacggcatcgcctaaaaaatcaatcaatcgtgccagaaaacaaattttttatcgactcatggtgttttatattttgtccattgttatgattggatttgctgtatcttataaaacccctgaattacaagatagtggtgcttttggtactgatatcaatgcttcaccttttgttattgccatcaagcaaggtgtccaacagccgtag

SEQ ID NO: 6056 - DNA, 702 bp, Candida albicans
atcaaaggtttacatagtgtcatcaatgccgtgattatgatatcggtattatctgttggtaatgcttcagtatatgcaacttcaagaactttaaactcacttgctgaacaaggaatggcacctaaatggacaggatatattgatagagccggaagaccattatttgctattcttatcaccaatgtatttggattatttgccttaattgctgctgataatgagaaacaggtggttgctttcaattggttattggctctttctggtctttcatcaattttcacctggatgagtattaacttgagccatatacgttttagaagagccatgaaagttcaaaatcgttcattaacggaattaccatttgttgctcaaagtggggtttggggatcatattttgggttaactttaaacattttgtatttaattgctcaattttatattggattattccctgttggtggtaaaccaaatgcttatgatttctttttggcatatttgggtgttccagtgattttagcatcatggataggttataaaatttggaaaagagattggacattatttatcagagcaaaagatattgaccttgatactggtagaatcaatgttgatttagatttgttacaacaagaaatagctgaagaaaaagctcaattagctgaaaaaccattctatattagaatttatagattttggtgctaa

SEQ ID NO: 6057 - DNA, 915 bp, Candida albicans
taccttcagccgttccggcagctcggtggtgaagacatgggttggaattatgctatgcaatggctagtggtgttgcccttggaattggttgctgcagcaatgacggtgaaatattgggatgccaaaacaaacctggcggcgttcgtggttattttctatgttttgattgttgctattaacttttttggtgtccgtggttacggtgaagctgaatttatatttagtgccgttaaagttttggctgttttgggtttcattattttgggtattgtattgtgtgctggtggtggtccacaaggtggttatattggaggtaaaaactggtatattgaaggtgctccattccctaatggtgctaaaggtgtcataacggtgtttgtgaatgctgcctttgctttcgctggtactgaattgtgtggattggctgctgctgaaaccgaaaacccaagaaaatcattaccaaaagcttgtaagcaagttttctggagaatcactttattctatgtcatctgtttgactttagttgggttattggttccatggaatgatgaaagattattgggtagttcttctgctgatgcttctgcttctccattcgtcatttcaattagaaatgctggtattaaaggtttaccatcagttatgaatgttgttattatgattgctgtcttatctgttggtaactcctctgtctatggttcctcaagaactttggctgctttggctgcttccaaccaagctccaaaaatatttggttacattgataaacaaggtaaaacgttagttggtattattgcccaattgcttgttggtttattatgtttccttgctgcatccgataaacaaggtgaaattttcaattggttgttggccttgtctggtttgttctctatttccacttgggggatcaattaa

SEQ ID NO: 6058 - DNA, 1527 bp, Candida albicans
tcctacaaaatgagtaggaagtcttctattgatatgcctaaagaggcatctagccccgagtgctacacaacatcgacatccagtaatgaaataagtgaaaaaccaggcatgtggcgaaacttcaaagattcattcaaacctcctgtgcccatcgatgatattgagaatggatcgatatcttcaactcaattaaaaggtggacagaatgttccattacaacaaagtttgaaaaaaagacaactacagatgattgcattaggtggatgtgtgggatcagggttattagtggcgtccggagctgctttgcgtaacggtccagcaagtttgttaattgcttggttcatcgtttctacatttttgtattgtacgatgcaatgtttagccgaattatcgagtactttccctgtgtcgggatcctttgcagtctattctataaagtttattgatccaagttggggtactgccatgggttataattatgcattattttgggttgttgtcatgccattggagttggttgcaagttcaatgactataaagttctggccatcaaatataaatacatctgtttgggtggcagtcttctatgttttgattattggtacaaatttgtttggaggaacaagagcttttggtgagacagagtttgttgcatctgttataaagttgttaggaattgttggtttcaacattttggcaattgttttgatttgtggtggtggtgaccaaggctatattggaggtaaaaactggcatcctccattcaccactggtgtcaaaggtgtgatatccgttttattgacagcaacgtattctttagctggtacagagttggtggggttgacatctgctgaagccgctggtgatgctcgaaaagttttaccaaaggcaatcaaacaagtattgtggagaattttgattttttacttgttgactttgacattagttgggtttttagttccggcctcagacccacaattaattggtggtggtagcggggcatctgcttctccatttgttattgcaattagagaaggtggaatcaaagggttgccttctgtatttaatgttgtcgtcttggtagctttattggctattgctaactctgcggtttacggattttcaagaaccattttggctttggctgaacaaggtgttgcccctagtatatttaaatacgttgacagacagggaagaccacttgctggtatagccacttctgccattgttgggttgttgtcttttgtttctgcctccaaacagcaagaacaagttttcgactggttagtcgctttgtctggtttgtctaccttcttcacctggggaagtattaatgctgcacatattagattcagaattgcaatgaaagttcaaggaagatcattagatgaattgccatacaaggcaaacacaggtgtattgggagcttactacggtttaatcatgaacgttgctgtattggcattacaattttggctcgcagtgtggccaattggaggtatcttcaccaccggtgaaaatccgact

SEQ ID NO: 6059 - DNA, 345 bp, Candida albicans
aaaacaggtgtattggggggcttaaataacggtttattatggaaaggtggcagaaattggcataaacaatttttggttcgcaagggtggccaattgggagttaaacccagagcccaactaatttttttaaacaatattttggttgatgtcttggtgcttgcggtttacgtaattcacaaagttgttaccagaaactggaaatttagggtcgattacaaggatatggatctgaattccggaagaagtgatatagatattgatatacttaaacaagagctcgaagaagaaagagaagcttataagagacagccatggtattacaagttttatcaattatggtgttaa

SEQ ID NO: 6060 - DNA, 528 bp, Candida albicans
tatttcttatcattaacttttattggattattagttccttctaattcccctcaacttttaggagcaagtggaacaagtgcatctccatttgtcattgccattaaaaatggaggtatttatgcattaccatcaatcttcaacgcttgtatattattatcggttttatccgtggggaacctggcagtatatggttgttcaagaactattcaaagtttaggtgctcaaggtttaggtcccaagatatttgcctatgttgatagaaaaggtcgtccattaggtggtttggtaatgtcagccatatttggtttgttatgtttcctttctgcttatcatgacgaagcaactatctttaattggttattgagtgttgctggtcttgctaccattttctcatggtttaacattggattatgtcacgtccgattcaggctagctttaagaaaacaaggtcgttccttacaagaattgacttttacagcattacctggagttgtctactgccgagctggccggatacgcgctatatct

SEQ ID NO: 6061 - DNA, 1734 bp, Candida albicans
agtgatgacgatgatgatggtgaaggtgaaaggagactaggaaatggcgcatctttaaccaaagctcaatcacatttggtgttgccatcaaaggatgagacgggtggaaagaaatacaccaagaggagcaacacactcgatactccacaacaaaacacaagcgatgggcgcaaaattcgaaagaaagcaccaaagcggaaaaccccaagaacacagagaaatgcatctttcaatcaacattcgaatgtctcaattggtgatggttctatagaaaatgtggacacgaacgattcctaccagagattgtcgcgaacaatgagtggcaattatctatcgtggacgcctactgttggtcggaattctacgtttattaagttgacggacgagcagaaagaggaattaggaggtattgagtatcgggcagttaagttgttgatcaaaattattgttgtctattatgtggggttcaatattatccctggtgtaatgttgctgatatggatatattgtatgcctcactatataaacttgatgataagcagttccatctcacccgcctggtgggcgtttttcacactgcagtcgtcattcaacgatttggggctcactttaacgtccaattcgatgatgtctttcaaccagaatgcgtttgtacaaatcctttgttcatttttgattgttatcggtaacacggggttcccaatattattgagatttataatctgggtcatgttcaaaacagcaagaccattatctttgtacaaggagtccttggggttcttattagatcatccacgtcgctgttttacgttgttgtttccttctgttcctacttggtggttgttctttatattagtagtattgaatgggtttgacttggtcatattctgtatacttgatctccatgatgacacttttaaaggggttgatatggggtacagggttttgaatggtttgtttcaagcattctgtactagaacagtgggattttcagtaatggatttatcgcagttgcatgcagcgactcaggtgagttacttgatcatgatgtatatttctgttttgcccattgctatttccgtgagaagtaccaatgtttatgaagaacagtcgttgggggtgtatgccaaggagaatgcagagggtgttgatgagagtgcgccatcaaactatgttgggtcgcatttgagaaaccaattgtcatatgatttgtggtatatttgtctagggctattcataatttgtattgccgagggtaagagattgaaggagcaggacctacgtttttcgatttttgcagttctttttgagatagtcagtgcatatggtacggtggggatgtctatgggatatccaggcgtggactgctctcttagtggtgaattcaatgtcatttcaaagttggtgattattgcgatgatgataagaggaagacatagagggttgccatacactatcgatcgtgctattatgctacctaacgctgctatgaaacgtcatgacagattgcaagaagagcacgcaatcaataggcacaatactatggaaagaacaaccacgctaggtcgtgttgccacttttggaaatggtccaatcgacgggggcaataatttgttaactcgagcaatcaccaacatcgagcacagattgaggaacagaagagatgggcggtctgagagtctgactgtgagtgaagatcctcgttatgtagtaagaactgtgagtgaagtatga

SEQ ID NO: 6062 - DNA, 1341 bp, Candida albicans
cataagacagcagatattagtatatcaaatataggatatttggacaggtgtacgaaagattcatcataccaagctatgttgtacagagtatctggattttacaaacgccacacccgaaatttcaccaatattgactatggttactacattagaaattttatccaccatatagcatcaaaaatatatccttatgccaaggttgtgctacccaattttcgggcagctcactatttctacattcttaccttggtcattttggggtcgatattggtgtatccagtaaagacatgtgcatatattgatgttttgtttttcacggcgggggcgtctacgcaagcaggtttgaataccgtcaatgtcaacgacctatccctataccaacaaattgtattgtatttgttggccactttggcgacgccgatatttattcatggctccttgctttttgttagactttactactttgagcgtcattttgataatatcaaagagcgttccttaatggattatagaatgagaaagtctgcaacacttgcaaggttgggatctgcaccaacaatgagttcaacaagattaaacactttcaacaaccaagtattgggttttcaagaacgagaggcagagaagggttcgtcttcatctcctcagtcatcttcatcacaaacaagccagccggttctgacagcttacaatgatcaaggtgggaatgatatagaacaccatagtgagccttcagacagcgatgatgatgagagtggtaatgggcctgttactttccaggagaagattcattttgaagagccacagagaccaagatctcaacgtcgacacagccgtactgattctggtatcaagttcagtgctttgcctcatccgagaagaaggaagtcgattgaccctgaagatatgtaccgatcgataaacatgttgcaagagcataagaaaaaccaagaggctaaatccaagggaattcagtttttgaacattggttctccggtccgtaggaaatcacgcagttcaaacattgaggcttttccagaggaggatactaatcctctgcgtggtgatgagatcactccagcaacaaatagtgtcggtactggcaataacgacgaggatgaagatgatattttgattatcaaaccaccaatagaaatagagaactcagatgaagcaaacccgattttcaccaagaagaagaaactcgcatcacagattcaatttaaagagacccctgggaaagcaaagaaatggattaccacgaaaacgcgcaaacattataacccttggacaagcaagttgaagaaaacattatcaaattcaagtaaaaaagctctctaa

SEQ ID NO: 6063 - DNA, 624 bp, Candida albicans
attccaaacgatttcttgacagtttttgacagtgtggccattatcgtctttatcccaatattcgaaagatttttatatccttttgttagacattttactccattcaaaccaatcactaagattttctgggggttcatgtttggatctggtgctatggtttacgccgctgttttgcaacactatatctacaaagccggtccatgttatgaccatcctttggattgtccaaacggtaaccacatcaacattggtttgcaaacacctgcatatgtcctcattgccatctctgaaattttggcctcgattactggtgttgagtatgcctacaataaggcacctgtgcaaatgaaatctttggtaatggcaatgtttttacttacaaacgccgttggtgctgccattggtattgccttgctgagtgttagtgtggatccaaaaatggtgtggacatacctgggattagctgtgctgtgtttcattgctggttgcttgttcttgactttgttcaaacactacaataaaaaggaagacgagtggaacaatttggaatacgaagccaatattgaagaggctgcgcttatgccagtttcttcattaactccgtcacgcaaatccattgcatag

SEQ ID NO: 6064 - DNA, 963 bp, Candida albicans
tttgcaatgtccacagaagagaaacatctgcaaacagatgttataaatagttctactcaaggctcacattccgtcgaaaaactgctgagggatgatgaatatgctggtgacaacttagggtccgatatacagatcgatgatgaaggtagagaacctaccgatcatgaaatggaaaccttgagacatgtttctgaatccattccaatatcatgttggttagttgctattgttgaattagctgaaagattttcctattatgggttgtcagctccgttccagaactatatgcaatttactccagaacattcaccaaaaggtatgcttggattaaagcaacaaggtgccactgcgttgtcgtactttttccaattctggtgttatgtcactcctattcttggtggttggatttctgacacctactggggtaaatataaaacaatttttgtcttttgtgttatttatatcgttggtattttcttattgttcatcacttccgttccatctataaccagtaaaagtactgctactgggggttatattgcggctattatcatcattggtcttggtacaggtggtgtcaaatccaacgtttccccattgattgctgatcaaattcctaaaaagaaaccatacattaaggtcaccaaaaagggagaaagagtcattgttgatccaaacatcactgttcaaaacgtattcatgttcttctaccttatgatcaacattgggtctttgtcagttattgccaccactcaaatggaggctcacattggattctggtcttcttacttgcttacgttctgcttcttctttatcgcaattgctgctttgattgttggtagaaacaaatatgtcaaggttcctgttggtgacaagattgtcaacaagactttcaaatgtgtttgggtcggtatcataaacggggtcaacttcgatgctgccaaaccctccgtcaaacaataa

SEQ ID NO: 6065 - DNA, 816 bp, Candida albicans
  unsure (9),(36): Identity of nucleotide sequences at the above locations are unknown.
tcgcatggnacacctgtccggccagtcggcgagttngaaaacagaggtactttggtgtgctgtttccaattgatgattaccttgggtatcttcttgggttattgtactacctatggtactaagagttactcagactctagacaatggagaattccattgggtttatgtttcgcctgggctttatgtttggttgctggtatggttagaatgccagaatctccacgttaccttgtcggtaaagacagaattgaagatgctaaaatgtcacttgccaaaactaacaaggtttctccagaggacccagcattataccgtgaacttcaattaatccaagctggtgttgaaagagaaagattagccggtaaggcatcttggggtactttattcaatggtaaaccaagaatctttgaaagggttattgttggtgtcatgttacaagccttacaacaattaactggtgataactatttcttctactacagtaccaccattttcaagtccgttggtatgaatgattctttccaaacttctatcattattggtgttattaactttgcatccacttttgttggtatttatgctattgaaagaatgggtagaagactctgtttgttaactggttccgttgccatgtctgtctgtttcttaatctattccttggttggtactcaacatctttatattgacaaaccaggtggtgctagtagaaaaccagatggtgatgccatgatctttatgacttcactttatgtgtcttctttgcttctacatgggctggtggtgtttactccattatttctgaactttatccattga

SEQ ID NO: 6066 - DNA, 372 bp, Candida albicans
acgtggacttctacccgtcgtgccgacattggctatttcgggtcgtacgcctgtttgacatgggttgtgcccgccgagtcgttttcgttggggaccagatctcaaggtatgactatctgctcggcattgttgtacttgtgggcgttcactgtcacatacaacttcaacagaatgaaggtggccatgacatacacagggttgactattgggttctacggtggtattgcgttcctcggtttcttctaccaggtgttgtttatgccagagaccaaggggaagactttggaagagattgacgagatattcgagaagccatccagacagctcatcaaggagaatctttcggggttgaagaggttctggggccgttga

SEQ ID NO: 6067 - DNA, 534 bp, Candida albicans
accacattaaacaacaacagtttatatttttatcccaactatttctacattcgcttttttaacaacaactgcctcccccctttatttataatgcaattccaaactttattagtcgtcgctggttctttagttgcctcaactttagccgtcaactccactgtcactgaacatcacactactgaaatcaccatcactcattgttccgacaacaaatgtgctactagtgttgctccagctgttcaatcagtcaacactgttactattgaaggtgttgtcactgaatacaccacttattgtccattgactgcttctgaacacaaacataaagaatcttcttctccttcatcagttgctccagttgcttctactgaatctgttgttacaactaccatcagtggtgttcacacttcttatactacttattgtccactttctggttcttctgaagcatcaactgttattactccaggtactgttgctggtgaatcttcttctagcagtgaagaagtcgtcttcacacacggcggctggtag

SEQ ID NO: 6068 - DNA, 1323 bp, Candida albicans
  unsure (1304): Identity of nucleotide sequences at the above locations are unknown.
tgtccgacgttgatctcattcgctggtgaagacttgggtgacatctttaattgtattccacacaacactcctcctgtctgtactgacttgggtctttaccacgatagctccatttcccttagtggttccaagaacaagagagaagctgaaattgtcaatgaagatggtacaattgaaaagagaacttttggaagcgctggtgtaaatgccggtttcaatgccgcatttgtcgtgtctaatgccaaaaaattatctgacggttcttatggtattgattgtaacttcaagagtgattcttctgtccaattgaacctggcctttggtaaaaaagttaaacaattgagtatcaccggtactggttattctgatatttcattattaggaaatgttgctaatccatttgaatggtcagcttccttgaaagtcaaagcagaaattgttaaaggaaaatgttgtcttccatcaggtttcagaatcgttacagatttcgaaagcaactgtcctgaatttgatgccatcaaacaattttttggcagttctcaaataatttacaaagtcaatgccgtttctaacgcaattggtacttttgatgcttctgcattattcaatgctcaagtcaaagccttccctgccaagagagaattagatgaatttgaagaattaagtaacgatggtgttactcacagcaagagaactttgggtttgcttttgggtttgcttaagaaagttactggtggatgtgatactttacaacaattctgttgggactgtcaatgtgacaccccatctccatcaactaccaccgtaagtacttcatctgctccatctacttccccagaatcatctgctccatctactactacagttaccacttcatcttctccagttacttctccagaatctagtgttccagaaactactaccgttactacttcatctgtcccagaaactactccagaatcatcagctccagaaaccaccacagttactacttcatctgttccttctactaccccagagtcttctgctccagaaaccactccagaatcatcagctccagaatctagtgttccagaatcatctgctccagaatctagtgccccagaatcatctgcaccagccactgaaacaccaactggtccagtttccactgttactgagcaatcaaagaccatcgtcaccatcacctcatgctccaacaatgcatgcagtgaatctaaggtcaccactggtgttgttgttgttacttctgaagatagggtttacactacattctgtccattaactgaaactactccagatantgatccagcctcaggtcat

SEQ ID NO: 6069 - DNA, 492 bp, Candida albicans
atttcccgcgttatgttcccaaggttttggaaattagggggaaacggggttgttggggggggcccatttaccttgggattatttgatactgctggtcaagaagattacgacagattaaggcctttgtcatatccatcgactgatgtattccttgtttgtttttccgtcatttctcctgcttcgtttgaaaatgttaaagaaaaatggttcccagaagttcatcaccattgtcccggtgtgccaataattattgtcggtacccaaactgatttacgaaacgatgatgttattttacagagattgcacatacaaaaattgtccccaatcacccaggaacagggtgaaaaattggctaaggaattgagagctgtcaagtatgttgagtgttctgcattgactcaaagaggattgaaaacagtgtttgacgaggctatagtagctgcattagaacctcctgtaattaaaaaatcgaaaaagtgtactattttatag

SEQ ID NO: 6070 - DNA, 198 bp, Candida albicans
ttaatatatccatatatcatgcaaactataaaatgtgttgttgtcggtgatggtgccgttggtaaaacttgcttattaatctcgtataccactagtaaatttccagctgattatgttcctactgtttttgataattatgctgtaaccgtgatgataggagacgaatcttcaccacgggctggaaaagaccagcgctac

SEQ ID NO: 6071 - DNA, 762 bp, Candida albicans
tccatcatgacaacactatcaacaatctggttatttttaataacaataacagcaatattccaattaggtttaagttcaaatgtcaccaccattattgatgacgataacaacaacaacaacaacaacaacaacaacgctgatgattttttggaaccacaaatagaaacaataaaagtcattggtaataaattttttgaatgtgaatcaggtcatcaattttttattaaaggtatagcttatcaaaaaacacgtcaagaaggagaaatctatgatactacaaaagaacctcattatatcgatccattagctaatccattcacttgtttaagagatttagattatttaaaagaattgggaataaatcttgttcgagtttatcaaattcatcccaatgctaatcatgatgtttgtatgaatgcatttgctgaagcggggatttatgtattggcggatttatccgaaccaacaatatcaataagacgagattatcctcattgggatacagaaattttcaatcgatatcaacaagttattgattcaatgtcaaactataaaaatttattaggttttttcgctggtaatgaagttacaaattgtcaatcaaatattgatgcttcaccatttgttagagccgctattcgtgattgtaaaaaatatattaatcaacaaggttatagaaaaatccctattggttatgcttcaaatgatgatgctaatataagaaaaaatcttgccaattattttgtttgttcaattaaatga

SEQ ID NO: 6072 - DNA, 1074 bp, Candida albicans
agaccaggatatcgtgatttaacaaccatgtttaaagattattctgtcccggtttttttcagtgaatttggttgtaatataattactcctagaccatttactgaagttgaagcaatttatggttctaccatgaaaaaagtttggtcaggtggaattgcttatgaatattttgaagaagtaaatcattatggaattttattaactaaaaaagatggtctgattactaaattacccgattttgatactttaaaaatgagatttcatgctgcaactccaattggtatcactatggatgaagctaccatatgtgaaccaccaatatgtagtaacagtgttattgacgataaatcttcttcttcttctttttgggatgtggcattaacattaccaccaactccaaatgaagctaaatgtgaatgtttatggcaatcattatcatgtgttgtttctgaagatgctacatttgatgaagaagtagcattaagagaattatgtttcaaagttgattgtgaagatattaatgccaatggaagatcaggaaaatatggtcgttattctgattgtaatccaacagttagaacttcttatgctttaaataaatattatgaacaatgtggtaaaaaacaagaaatttgtgattttcaaggtcgaggggaattattaccaaatagaaatggtggattacaagatttagaaaataaattttcaagtgatggtcaaaattgtttaagtttacttgaaggaaaagaagaagaaaaagaggtacaagaagaggaacctggtgtacctggtttaccaggttctaataaaggtaaagaggtagaaaatacccctaaaagaaaaggaaaaggcaaaagtaaagaaaaagaaaaagaaaaagggaaattaattgaagaagaagaagaagaagaagaagaggaggaggaaaataataaaactccttcatctggtgaaaaatcccctaaaacttcaaaactgattgctggtggtaatgccataacttttaaaaatgatagtatttggaaaacattcattgaaatcttatttacatgttctgctgctatattgatttaa

SEQ ID NO: 6073 - DNA, 1755 bp, Candida albicans
acatacctccccccctttttgggggatatcacatttacaacttacattatagtttttaccaaaagatggttggtgaaattcagcttcacactaaagaagtatcccaagggggtggtaaaaccgctatccacagattatttgggtacatttgccgatgtcgaagaccctttagaaagaagaagattggctttagaagaaattgataaagctggtttcggatggactcaagttaaaatgattttgattgctggtgtagggttcatgactgattcttatgatatctttgccattaatttgtcaatgaatatgttacaatacgtttactggaatggtactattccagattctactactactttgattaaggtttctacttctgttggtactgttattggacaaatcagttttggttctattgccgataaagtcggtcgtaaaaagatttatggtttggaattgattatcatgatttttgctacccttttccaatgtactttgggtacctcccctgctattaactttgtggccattttctcaactataagaattttaatgggtattggtattggtggtgattatccattatcttctattatctcatcagaattctctactaccaaatggagaggtgctattatggctgctgtcttctccaatcaaggtcttggtcaagtgtttgccggtattgttgccatgatttgtgttgccggttacaaagatgacttgatcattgccaacaaaggatctgaatgtgttggtagatgtagaaaagctgccgatcaaatgtgggagatcattgttggtttcggttgtgttccaggttgtattgccttatactatagattgactattgctgaatctccaagatatgcccttgatgtcgatgaacacgatgatcttgaaaaagttgctgacgctgaagctgccattgatgtccatgctcaagaaattgctccaccaaaggcttctttcaaagatttctgttctcatttcggtcaatggagatatggtaagatcttgttgggtactgctggctcttggttcatgttggatgttgcctactatggtttaggtttgaacactactaccatcttacaaactatcggttacgctggtcaaagtaacgtttacgaaaaattatacaattctgctgccggtaacttgattttagtttgtgctggttctttaccaggttattgggtgtctgccgccactatcgataccgtgggtagaaaaccaattcaaatgggtggtttcatcttgttgactattatcttatgtatcatgggtttcggttaccacaagattggtaatcatggtttgttgggtttgttcgtcattgcccaatttttccaaaatttcggtccaaacaccactacttttattgtcccaggtgaatgtttcccaactagatacagatctactgctcatggtttatctgctgccgctggtaaagtcggtgccattattgctcaaacttgtattggtactttggttaaccacggttgttctaaagaaaacaaaaattgtttcttacctcacgtcttggaaatctttgccttgttcatgttgcttggtattggtttgactttcttgattccagaaactgctagaagaactttagaagaaatttctgaaacttgtcatggtgaagttgatactactaaattgggtagagatagatttgccacacaagaagaaccatacgactctgcagaagtcaaaatgttccacaacgccgtaaggatccacctc

SEQ ID NO: 6074 - DNA, 573 bp, Candida albicans
  unsure (13),(14): Identity of nucleotide sequences at the above locations are unknown.
ggggggatgaccnncaatcgccggttaagacgcgtaaaagaaagttcgcctttgcccaccttgagaataaagaagggtgacagagttcaattatacttaattaacggttttgataatttgaatactacgttacattttcatgggttgttccaaaatggtacaaatcaaatggatggtcctgaaatggtcacacaatgtcctattccaccaggtgagacttatttatacaatttcactgttgaccaagttggaacgtactggtatcatagccatacagcaggccaatatggtgatggtatgagaggtgttttcgtcattgatgatgacgattttccttacgattatgacgaggatgttgttttgacagtgggagatcattatcataaatactcgagtgacatcatcccttcatttttaagcagattcaatccaactggtgctgaacctattccacaaaactttttgtttaacgaaaccaggaaccttacatggaaagttgagcccggcaaaacttatttggttagaattgttaatgttggtggatttgtgtcacagtacttgtggatggaggat

SEQ ID NO: 6075 - DNA, 1827 bp, Candida albicans
ggccctttaatattaggttcaggaaccattcatcgatttgattggaatgttagttatgtaatggctaatcctgatggtattcatcctcgaagaatgattggaattaataatcaatggcctaatccaactattcgtagtaagaaaaatgaccgagtgattattaatttaactaatgaattacctgataaaaatgtatctttacatttccatggattatttcaacgtggatataatgatcaagatggtccagcatttgtaacacaatgtcctatttcaccaggggtgacattcacttatgattttaatgttacggatcaatcaggcacttattggtatcattcccatatgggatcccaatatggtgatggattaagagggttgttcattattgaatacgataatgatgatgaatataataaagaattcccttatgaatacgatgaagatgtgactttaagtgtgggagatcattatcatttggaatcaccagaaattgttaaaaattttatgacaagatttaatcccactggtgctgaacctataccacaaaatggattatttaatgaaacgaaaaatgtaacttggcaagtgaatcccgatactacttatttattacgtatagtaaacatgggattatttacatcgcattatgtttatattgaagatcatacattcactattgttgaagtcgatggtgtggtggtcgaaccatacgaaaccgattcattatatgttgccgttgcacaaagatatgttgttttgatgaaaacaaagaaaagtgctgataaaaatttccgatttgtcaatgtattagatcaagatatgttagatttcttgccactggatttacaaattgtctcgaccaattggatagtttatgataaatcattagagttgccaccggcattaccatttaatcagtttcacaaaacaataaaatcacttgtggggtttgatgattttgatttacgaccattgcgtaaagtcaatctcttggatgaaccagattatactatacaagtgaacttaactatggaagtgttaggtgatggtgtaacttatgcaatgtttaatggtaaaacatttagaccacctaaagtcccctcgttgtacactgttttatctacccatggtaacactaatttaacaaccaatgaattgatttacggtactaatacaaattcatttgttttacaaggagatgaagttgttgagataattttaaataatatggatccaggtaaacatccatttcatttacatggacacaattttcaagtcatttctagatttgatactgatgatgaagataatcaattagtatttgatcctacaaatgaaacatacacaaattatcctgaattccctatggttagagatacagttgaagtaggacctaatggatttattgttcttcgatttaaagcagataatccaggggtgtggtttttccattgtcatgttgattggcatttagaacaaggtttagcaatattattagttgaagatcccttggaattgctttcttcaaatacaacgattcctcaaaatcatattgatgcttgtaatgccataggtatgccaattaaggggaatgctgctggtaatgatattgatctattagatttatatggtgaaaacattcaaccaaatcctttaccagctggattcactaataaaggttatttggcaattacatgttgtacattaattgcaatctacggattatggtcaatttataattatggtatggaagatattagtaaagataatgctgaagatgtgattgaaaaattatataaaatattggacgattatgataaatag

SEQ ID NO: 6076 - DNA, 963 bp, Candida albicans
atgcaaaggatgtcgattccaatggatgatatgttggaagattttaacttgaaaccgttagataaagaaaaacttgtggatgatgctgattatactataacagttgatgtgcaaatggacaatttaggcaatggagttaactatgcattttttaataacatcacttacatgacacctaaagttcctacattattaagtgttttaagcgctggtgatgcttcaactaatgaactagtatatggctcaaatacaaacagttttgtgttacaaggtggtgatgttgttgatattgttttgaataacttggatacaggtagacacccattccacttgcatggtcatgtatttcagttgatcgaaagacacgaagaaatccccgatacagaagacccagtttcctacaacgttagcgatcatgccgaatggcctgaatacccgatgagtagagatactgtttatgtgaaaccccagtcatatattgtcatgagattcaaggctgataaccctggtgtttggttttttcattgccatattgaatggcacttggatcaaggtttggctattgtgttaattgaagatccagaagctatccaaaaaaattcaagtcaacatttaactgataaccacaaacaaatttgtgagaaagtcggtgtgtcatgggaaggaaatgcagcagctaattccaataattacttggacttgaaaggcgaaaacattcaagtaaagaggttgccaactgggtttactgcaagaggtatcgttgctctagtgttttcatgtattgccgcatttttgggaatagctgccatcgcctactatggtatgaatgacattgaagatgtggaagaaagagtggcaagagatttggatgtggatttggatgaagaaaacgaggacgaagaagaagcagaaattgtgaacgaaggttcctcttcttctggaagtaactctaaacaacattag

SEQ ID NO: 6077 - DNA, 1728 bp, Candida albicans
caacttggtgattattatttatcccaaaacaaaaattatatatatacccagaaggaaggaactatttttaaaaacatgagaagtttatcaattttttctttagttttcctttttttctcaacattaattactgctaaaacccatacatggtactataaaactggttgggtgaatgctaacccagatggtggatttgaaagaccaatgattgggtttaacgatagttggccgttacctactttaagagttaagaaaggtgacactgttaatttatatttgatcaatggtttcgatgacagaaatacttctttgcatttccacggtttattccagcacggtactaatcaaatggatggtccagaaatggttacacaatgtcctattccaccaggtgaaactttcttatacaattttactgttgatgatcaagttggttcttactggtaccacagtcatacctcaggtcaatatggtgatggtatgagaggtgtctttattattgaagatgacgatttcccatacgactacgatgaagaagtcattttaactttgggtgaacattaccacgatttctctgatgatttacacaagaatttcatgagtagatacaaccctactggtgctgaaccaattccactgaacattttattcaatgaaactagaaacaacacttggaaagttgaaccaggtaaaacttattttgttagaatcatcaacattggtagatttgtatctcaatatgtttggatggaagatcacgaattcactattgttgaagtcgatggtatttacgttgaaaaaaacactactgatttgatttatatcactgttgctcaaagatatggggttttgattactaccaagaattctactgataaaaactatgctttcatgaacagagttgatattgatatgttggatgttattcctgatgaattggaattgaacggtactaactacattgaatataactcaaaagctgacaaaccagaaccataccttttggattctattgatgattattttgatgacttttacttgaagcctttgagtaaagagaaattattagatgacgctgattatactattactgtcgatgtgcaaatggacaatttaggtaatggtgtcaattatgctttcttcaacaacattacctacacgacacctagagttccaactttgttgagtgttttgagtgcaggtgacgatgcttccaatgaattggtttatggtactaacaccaacagttttgttttgcaaagtggtgacgttgttgatattgtattgaacaatttggataccggtaaacatccattccatttgcacggtcacgtattccaattaattgaaagacacgaagaaattccagaaacagaagatccagttggttataatgcttctgaccatgccgattggccagaatacccaatgttgagagatactgtttatgttagacctcaatcttatattgttatgagattcaaagctgacaacccaggtgtttggctcttccattgccatattgaatggcatttggatcaagggttagcaatccaattgattgaagatcctcagggtattcaaaagaacactagtcaacatatcaccgacaaccataaacaaatttgtgaaaaagtcggtgtgtcatgggaaggtaatgccgccgccaacagtaaagactacttgaacttgagtgttcacgacgggagtggccggaccgcggggatg

SEQ ID NO: 6078 - DNA, 1179 bp, Candida albicans
  unsure (1149),(1161),(1165): Identity of nucleotide sequences at the above locations are unknown.
gtggtgaagacagcttcattgatagctgctgaaactcacacatggtatttcaaaactggttgggtagacgcaaatcctgatggggtttatccccgtaaaatgattgggttcaatgattcatggccattacccactttgagagttaaaaagggcgacagagttcaattgtatttgattaatggatttgataacttaaatactactttacattttcatggattatttgttcgtggtgctaaccaaatggatgggccagagatggttacccagtgtcctatcccacctggtgaaacatacttgtacaacttcactgttactgatcaagtgggaacttattggtatcacagtcatacagggggtcagtatggagacggtatgagaggtgtctttattattgaagatgatgatttcccgtatgactacgatgaagaagttgttttaactttaagtgaccattaccacaaatattcaggtgacataaggcctgcctttttaaccagatttaatccgacaggagcagaaccgatcccacagaactttttgttcaatgaaacaagaaatgccacttggaaggtcgaacctggaaaaacttactttgttaggattcttaatgttggtggttttgtatcacagtacttgtggatggaagatcatgaatttactattgttgagatcgatggcgtttacgttgaaaaaaacaccactgatttgatttatatcacagttgctcaaagatatggggttttgataaccacaaaaaattcaaccgataagtactatgcatttatgaatggtgttgatactaccatgttggattcagttcctgttgatttgcaagtcaatgggaccaattatattgtttataatgaaagctccgccttaccggatgcttacgatatcgattcgtatgatgatgccttggatgatttatacttgaaacccttgagtaaacaaaagttgatggatgatgctgattacactattaccgttgatgttcaaatgaatgtcttgaatgatgggatcaattatgcttttttcaacaatattagttacaaagcaccaaaagttccaaccttgctaactgttttaagtgctggcgaagttgcaacaaacgaattgatttatggtacgaacaccgtccctttttcnttaagagcccanagcncaaattacccagta

SEQ ID NO: 6079 - DNA, 561 bp, Candida albicans
ctagaaacaaccatgagcaacccgtatcagaattcccagaatggttatcaacaaaacaactcatatgagttgaacaattatcctaataaacaatattcttcatctaatgaagatgactttgttcaatttatgaatgaaattcaagatataaattctcaattagataactattctaatataatcaatcttattgacaacaaacagaaaaactttttacatgggttggatttgaatgatgaagatactgattatgattcaaaacaaattgaaaatttggttaatgaagcccaatctttgcaattagacttgaaaaatagaatcaaaaatgtgcaaactcaagccgttcattccagagaccaaaccaaagttgatcaagctgaaacttgtagaaagagatttttagatttaattcaagattatagattggttgaagccagaaacaaagagagcaccaaggaacaagctgctagacagtatcaaataataaagcccgatgctactgatgaagagattaaggcagtagtagaagatgatctcaacaatgcttccaacaagcattaa

SEQ ID NO: 6080 - DNA, 750 bp, Candida albicans
aattccgatttttttttttggttttttgttttttcttattttattttattttattttccaacagacaacatgaatagtaaagaaattagaatagttgcgttattaattcttgatacggtatttttcttacttgaagctattattgggtatactgtccattcattagcattaattgctgattcatttcatatgttaaatgatattatctcattaatcattgctttatgggccgttagagttaaaaatactaaacctgccgatgggaaatatacttatggttggcaaagagccgaaattttaggggcattaattaatgcagtatttttattggcattatgttttacaattattatggattctatacaaagattttttgaaccacaagaaatttctaatcctaaattgattttaattgttgggattgctggattagtaagtaatggagtaggattagttttattccatgaacatggtcactctcattctcatggtggtggtggtggtggtggaagcgaccattctggagattctaaatcacattcacattcacactcacattctcatggggaagctactactttctcacaaggtgatgaagaagaacatattggcaccgaagaaaatgaacatacaccattattatataatattactcatacgactatgaaatctacaccatctgaagtatttgattatttaccagataacgttgttgaaagttttcacaccggcccggaaggaccgcaattg

SEQ ID NO: 6081 - DNA, 771 bp, Candida albicans
aaaactttgaaaattttggcaggatttaccaatgggacattgctagtcggtataagtggatctattttatttgaagccattggtagattgttcaacccagtacatttacaaaagactacagaattgataattgtttcaatattgggattgttagttaatttggttgggatatttgcttttaatcatggccattcacatggtcactcacatggtcactcacatggttcttctcatagccatgaacactcgcatggccattctcatgaacacctgcatgctcctaactgtgactcagaagatgaacacgaccatatgaatgataacatgaaaggtattttcttgcacataatggcagatgccttaggttcagtcggtgttgtgatttcgacaatattaacaaaatacttttcgtgggatggatttgatcctatagcgtcaattataattgccactttgatttttgtgtctgccgttcctttaataaaatcaaccgcatcgacattattgttgagtatctcgaagactaaagaagatcagattcggaatattttacatgaggttcaacaagtcaaaggagtgagatctctcacaaccccaaggttttggccaggtcctacaaataatgtttgtgggtatgttcatattcaagtttatcgaggtgaaaatacatcttatatcaagcgccaatgtgagaaaatgtttgaaagtaggaacatggatgtgatgcttcagattgaaaacgattacgacgattgttggtgtaggaagtaa

SEQ ID NO: 6082 - DNA, 735 bp, Candida albicans
gtagcgcgggttcttccggcaccagtggtggaagacggtattgcttaccaacaaaataacttggactccaacgaatcatttgttgacccattagctaatcctgagcactgtaaaagagatattccatacttggaagctgtcgacaccaatgtcatcagagtttatgctttagacaccagtcaagaccatactgaatgtatgcaaatgttgcaagatgccggtatttatgtcattgccgatttgtcccaaccagatgaatccatcaacagagacgacccatcctgggatttggatctttttgaaagatacacttctgttgtcgatttgttccacaactacactaacattttaggtttctttgccggtaatgaagtcaccaacaagaaatcaaacactgacgcttctgctttcgttaaggctgctatcagagataccaaagcctacatcaaaagcaaaggttacagaagtattccagtcagttactctgccaatgatgattccgccatcagagtttcattagccgactactttgcttgtggtgatgaagacgaagctgctgactttctcggtataaacatgtacgaatggtgtggagactcttcttacaaagcttctggttatgaatctgctaccaacgattacaaaaacttgggtatcccaatctttttctccgaaaaccgttgtaatgaagttaggcccaagaaaattcacagaagtggctactctttttggtga

SEQ ID NO: 6083 - DNA, 1590 bp, Candida albicans
  unsure (21): Identity of nucleotide sequences at the above locations are unknown.
atgaaactttgtccaatgaanatcttatttcaaacaagtacagattatgctagtgagaactcttttgccatcagcgaatctactttcataactgctagtgatttccaagctactgaatcattggtcactgagtcatatttttcaaaactgcaatctagtgattctgaatcttttgtaatcaatacatcttctgctgttgataattcatatgtttcaagttcctcaagtgctggtggatcatcctttcctgaagagacacatatgttgcaaacatctgatagtgatttgtcttctacagccggaagtgaatcagatgttacagaattcagtgatgtgtcattggctactgccagtgactcttccattgccgataaatcgattggaactgaatctttatattctgaaatatctttagtatctgctagtgagtcaactggttcaattggtgaactttctatttctggtgatacattacttaagacagctagtgaaaccaaatttgttaaatcatctttcctgagtgatttgatttctgaaacttctagtgaattatttgtcagctcatctgtttccactgatatgattcttgaaactgccaatgactctttcataactagtgacaaagttgtggaaactccatcctattccaatgaattggcttttgaaactgttagtgaaacaattataaattcatttgtctccagtgaaagctcccttaatactgctagcaactctctcattgctagtaaaccatctacagatagctcatcatatacaactgacattgattttgaaactacaactaaatcatttgctgagtcaccatcttatttcagtgagactgtttctgaaattgcaagcaaatcatccttatccatggttgaaccctcttgttggagcgaattaccgtttgaaacatccatcgaatcattaattgctccatcgtatatctccagcgagccagctcctgaaactgctagcgaatcatttattgtcaaaccatcctattccgaaatagcttctgaatccattaccaagtccatcatatctaccattgaggcttctatttctagtgacatattttctgatgcaactactgggtcaattgtagtacaaccatctgtctctagtggaatttctcttgaaattcccagtgaatctatgcttttcagtgaaagcagtatttccaaaccttttatttccagtcaatcaattcatgaatgtacgagtgattccatcttggttgttccatcattcttttccagtgatgtttcttttgaaactgttgaatattcatcgactgttagtacgtcagtggatgctgaaccgtcgtattccagcgaaatttctttgaaaactcctagtgaatctttcatcgttagtgagacatttcttgaaccctcttattctggtgaagtcgttcttgcaactcctagtgagtctgtcgttgctagtgaaacagacgtctacaaaccatcatattctaatgaaactgttttacaaactcctagtgaatcttatattctcagtgaaacaggcgttaaagaatcatcacaatcaagtgaatttgctctttcaactcctaattaa

SEQ ID NO: 6084 - DNA, 1065 bp, Candida albicans
acaactttatctacctttgctccatcatcatcatcatctgaaattgctcctgaatatacttcaacttgggaaattggctcttcaaatgagtctaatgttgtagaatatagtatcgtcaatcaatccaatgaaagtttgactaatagtgttagttcatatgaaccagccactgaatctgctatcgttagcccatctgatcaagtatcgactagtagtgctacctcatttgtatcagccagtgaattttcagctgttaccactaccactgtagattctgcttctgcttcttcttctactgacataaacaatgacgtcacagttcttgtttccccatcggaatctgaaatcaatactagtagctcaatttggaataatgaaaacaatgtctctggtgccgtttcaacttcagaatcaacatctattgctaataatcatgatggttcattatccatgaccaagacagaactggaaataaatgggttttattcaactgaatcaagtactatgtttgtcactgctactatcactagttgtaacaaatctgattgttttgaaaatgttgtaacttatgtttcaaatgattcttataccaccgttactactggacactccaatgataacacttctgttgataacaataatgttcctagtactttgattgaaaatgtttccaatacagagactatcccagttgtaaccaatactgaggaagtttctactaccgtttataatcctttaacttcaacttcaacttcaaatattgttgaatcaagcaacacatcaattgttgataatgaaaataatggagttcacatcaattccgatgatatgactgctatggtaactgcagttgaaaccggtaatggtattacaaatggtacaaatttcgtatctccatcaactattcctaatgaaatttctgaaactggatcacctgctacttctattgttggtactttgccatatgaaaatggatctaatcaattatcaattgaaaatattaaatatttaatattggtagtttttggattaagtcttcaccacgggctggaaggaccacgcttg

SEQ ID NO: 6085 - DNA, 597 bp, Candida albicans
gatggagtttccacaactttgtcactagttatgaaagagtcattggcagtttcaagaatcatatcagtggaaacagatgagctgacaaataattcactagaagtttcagaaatcaaatcactcaggaaagatgatttaacaaatttggtttcactagctgtcttaagtaatgtatcaccagaaatagaaagttcaccaattgaaccagttgactcactagcagatactaaagatatttcagaatataaagattcagttccaatcgatttatcggcaatggaagagtcactggcagtagccaatgacacatcactgaattctgtaacatctgattcacttccggctgtagaagacaaatcactatcagatgtttgcaacatatgtgtctcttcaggaaaggatgatccaccagcacttgaggaacttgaaacatatgaattatcaacagcagaagatgtattgattacaaaagattcagaatcactagattgcagttttgaaaaatatgactcagtgaccaatgattcagtagcttggaaatcactagcagttatgaaagtagattcgctgatggcaaaagagttctcactagcataa

SEQ ID NO: 6086 - DNA, 999 bp, Candida albicans
  unsure (952): Identity of nucleotide sequences at the above locations are unknown.
ccattagctttgatcatgataccacgttttattctactactatttctaataatgaactcatcatattgtgaaccttttgaatttgatttttttcaaaacttagatccatctacaaatctcaccgaaatcattaataataataataacagcatcagcaacaatgtatttaaagttcaaaactttgattccaaatcatcatcttcttcatctagctcatcttcttcaggtgaaggattacaagaatttacaccaataagagacacaatcattcaatcagaaacaaaatattattcatttagtgttaatacaaaatcggggattggagatttttatgaacttttaatttttttaagtgggaatatttgtactcaaccactgaatttattagaaaatgatacttcattagcagtttattattcatttaattcaaccatgtttactaataatgaaattggacaaatgcaattattcaaagatggatttttccaaggattagctgatttaccattaaccgagaccaccaccaccaccaacaatgataccactaccacgacagtgccagagaaaatcttgtatattgctgttagagcaccggaaaatactaatcgtacagcacaatggacatatcaaattggggtatcacaacatgatttagttttccaatgggatgatcgatcatgggggtcaattgtcgatgttgatgataatagtgcattaatagtgacggggaatcttacgaaattatcactggggaattatctggatttaaatgccacaaattctcaattttcattatatttatattcttatgataataaagattatttccaaggaatgaataatagttggtgtgctgtacgtagtggacctgttttagttaaaccagaagagattgatacacaatttattgctcgtcatggtagtatacaacaacaatttatggttaacaatntaaatgctagtacaaaatatattggcttatattgttatggagtctga

SEQ ID NO: 6087 - DNA, 738 bp, Candida albicans
atgctagtacaaaatatattggcttatattgttatggagtctgaaggggtagaatatggtggtgctgtacttcgaccgtttgaatttgaaactatggatggaactgcttgtgaattgatttatgatttggaattttgtgatcaagtggcttatagtgttcctgccattggtaattccctgttattagcttcaagtattgctggtgctgataataaaacattaacaaaaaaattatatgatgattatgctaaatcattatatacaaattttctgaaaggtttacaacaaattgcttgtgatacggttcctgaagccatctattcaaatttgaaaagttgtcaagattgtgctcaaagttataaaaattggttatgtgccgttactatacctcgatgttctacaaaaaatttcacgggttatatccatcgaaatgaaacaaatcaaagaaatgaatttttagctgatgttattcaaccaaatcaagattattatgaagtattaccttgtgttaatgtttgtcaagcaattgtaagagattgtccagcaaattttggatttttatgtcccacgaaaaatgattcaattaaattgagttattattgggatgttcatgtatctgatcaatggccaagttgtaattatcttggaccattaagaagtagtaaaagtggtaccataaaattgataatcaattggacaatcgttgtggtatcctttactttaatggttgtcatatag

SEQ ID NO: 6088 - DNA, 702 bp, Candida albicans
ttttctagtggtggtgatgatgatgggagtactgatgatgtgtttgcatcgccatttttaattggcttgataaatatgggtatgagttcaagttcatttttacttggttttttcaatttcattatattaatatcaatggtttcagccgccaattcaaatatttattttggatcaagatgtttattatcaatggtagaagaaggatatttcccagttgttttcggtgaaactaccaaaaatggtgttccattcaatgcaatattgttaacttcatcaattggattgatttctttattgtctaaattcaaatcaattgatatattttataaactattgattaatttatcatcaacttcaggattgattatgtggttatttattctgatcagttatttacaattcaggagggcattagcattcaattcaattgtttatgaaactttggcatatacagcggtgcataaatttcctatgataaagttaagttacattactatcgttagtatagtgacaattattataggtaatggtatagttaatatttgggagtttagttgggacctgtttattagttgttatttgacgctgattatattgattgttggaagtgtttggttgagtgtgatttggaaacagcccattttgaagaagattgaggacatagatatatttaccaatcaatcggtacatgcattcaaatag

SEQ ID NO: 6089 - DNA, 432 bp, Candida albicans
gtattactttccttctgccgcctgtgtaaaaacgtgattggtgtggtttcaattcgtttcagacgaggtttggaaaaacaaggaagaacccatgagttgttattcaaaaattggtcttatccttatggtcccttatacgttgtaattttaggtggattcatcattttagttcaaggatggaccacattttctccattttccgtgaatgattttttccagtcctatttggaattgggagttttcccgttgtgctttgttttttggtggttagtggttcgtaaggggaaagataaatttgtcaagtttgaagacatggattttgataccgataggtattatgaaactcctgaagaaatagagaaaaatagatacgccaactcattgaaaggatgggcaaagttcaagtacaattttgcagataactttttgtaa

SEQ ID NO: 6090 - DNA, 723 bp, Candida albicans
gttcccagtggaaattcttccatgccgttcattgaaacgcatgcgtcatataccaatcttctccccccaattgttgggttgacttggatgcttgtcgattgtttcagaccagtggttaaatggtcgactgttggtttatgtaagggtgctattgctgttcttgttggtatcactcctgctgctggttacgttcccgtttacacgtcagtaatcttcgggattgttccagccattatttgtaactttgcagtagacttgaaggacttgttgcagattgatgatggtatggacgtgtgggcactccatggtgttggtggatttgttggtaactttatgactgggttatttgctgcagactacgttgccatgattgatggaactgagattgatggtgggtggatgaaccaccactggaaacaattggggtatcagttagcaggaagctgtgcagtcgctgcctggtcgttcactgtgacgtccattattttgcttgccatggacagaatcccatttctcagaatccgtctccacgaagacgaggaaatgttgggaaccgacttggcccaaattggtgaatatgcctattatgctgatgacgatcctgaaaccaacccatacgtcttggaacctatccgttctactactataagccaaccattacctcatattgatgctgttgctgatgggtctagtaataacgactcaggagaagctaaaaattaa

SEQ ID NO: 6091 - DNA, 231 bp, Candida albicans
agcgcggtcaatctgcccgtggtgggcggatattatcttcaaatgcataagtttggcaaagggattatttttggtgtcgtaggtgcaatttctggtaatttagctactagattgaagtatttctttaatatcgactatgcattggacctcttcgcagttcatggtatcccgggaattgttggttctatgctaaccggtatttttgctaatgatttgtatgattcaaaatga

SEQ ID NO: 6092 - DNA, 387 bp, Candida albicans
ttaataaccaatatgtctggaaatttcactggaacaggcacaggtggagatgtgttcaaagtcgatttaaatgaacaatttgatcgtgccgatatggtatggattggcactgcaagtgttttggtatggattatgattcctggtgtgggtctcttgtattcagggatctcccgtaagaaacatgcattatcattaatgtgggctgctttgatggctgcgtgtgtggcagccttccaatggttctggtgggggtactcgttggtttttgcccacaatggctctgtgtttttagggaccttgcaaaacttttgtctcaaggatgttttggtgcaccatctattgttaaaaccgtgcccgattcttcaccacggggctggaaggaaccac

SEQ ID NO: 6093 - DNA, 492 bp, Candida albicans
  unsure (82),(122),(154): Identity of nucleotide sequences at the above locations are unknown.
ttcaccaaattaatattcaaaatgggtgaaattgttgttggtgttgttgttaaacaaacttcaggttcattctcattcttcncggggctgctgctggtgctgctgctgccactggttttcantaccaatttatttgataattcagttggttcanatagcaattcacctattttgttaccaccaaatgccaatagaaatccatcacctccaaatttgtttttatctaccaatagtagtaataacaacaatggatcaccgttaatgggtgcttctatgactcctacaagtacaagttttttgaataattcaccatctttagtgacaactggtcctatttcttcaaatacatggagtatgggggtatcaacacctactagtggttcaatttgggggaacaaattttcaggaacttcaaccactttgactgctacaccaattacaaaaactagcagtaatgtcatgtctagtttcaatggttcaaacttgtggtag

SEQ ID NO: 6094 - DNA, 2055 bp, Candida albicans
agatcgtcggttgctggagacgaaactagtgaatcgagtgtttcggttactagtgaatcgagtgaatcagttaccagtgaatcagttgccagtgaatcagttaccagtgaatcagttactgctgtgagtgatatttcagatttgtacactacgtcagaagaggtatccactagtgacagcaactctggtatgagctctcctataccatcgagtgaacagagatccagtattccgataatgtcgagctccgacgaatcaagtgagtcacgtgaatccagtattggtacaattttgagtgaagaaagcagtgactcgattccaacgacgttctcaacaagatattggtcgccatcgggaatgagttccagacattataccaattcgacagagacgctggtctcagatgttgttctgtcgtcggttgctggagacgaaactagtgaatcgagtgtttcggttattagtgaatcgagtgaatcagttaccagtgaatcagttgccagtgaatcagttactgctgtgagtgatatttcagatttgtacactacgtcagaagtggtatccactagtgacagtaaaatagttccaagtacttctgtaccatcgagtgaacagaggtccagtattccgataatgtcgagctccgacgaatcaagtgagtcacgtgagtccagtagtggtacaattttgagtgaagaaaacagtgactcgattccaacgacgttctcaacaagatatgtgtcggtttctcttaccgtgggggaactttcggcattacctagtttgcctggaaaattatctcatttaccatccagtttgtctgaaacgtccatcggaatgacaaaaagtgctaatttgctgccacagtttttttcaacatcagttgattcagctttactgtattgggctctgggctctagcagtgctgatcaccagagttctgctacgtgtgatgttagtgaatcatctgtggaaggtaatttgtctgcaatggcactagggatgtcgaattcagatgatggtttgtcagaggatacaagatcatcttcggttgccggtaaagaggagatagagttaactctgacgaattctgttggtgaaatcacccttataagctatagttcttcctcgcctacgacccatgaccacgggcgtgtgtcaaagagcatgggggcggcaccacttagtagtttattctcagtatcagtacatgctccactagttactgggctactggattctgatacttttccaagtgaaaattcaaatcggagtcgttcatttaaggagtctacagacaatactatttccatatcgagagaatctttgggaaatccatattcatcaatatcctcaccttccgattatgacgtgaaactgttcacgacgtccagagagctagtatcttcagaatctatactaccattttcagatgtaatggatgcaaatgatatgccgacatctggaagtaatttgcactctatggtgttttcaatatctgtgctaggcgaaaaatttaatgctaatatagagaagcataaaaacactaatgggcattattcatcaatggtatttacttatcaaagtgcaggtttggaagagtcagaccagaggatagctgttactaatactaaattcgaccaaaataaaattgacacaacaattgacagcaatacttttgttacgagtttgccattcgccactactttaaacgaccaaattgatcaagctgtaccaattaagattccggcatcttctacagcaggatttgtctctgatgtactcaagccagattattcgaaatctgtccaggctgaatctgtccaaactgattcaacaacttattcagaaatgatgtcaagtaaaagaaacaagaattcaggctttgggacaagctcactcaatttgaagcctaccattactgtcgtcactaagtctattgatactaaagttaatactatgaaagagggtggggtttccaaacaagtttcaacgactgtgactgcacaatatgacacctctaccttcttcaccaccgggctggaagatcaacgt

SEQ ID NO: 6095 - DNA, 666 bp, Candida albicans
  unsure (84): Identity of nucleotide sequences at the above locations are unknown.
ccaactatagcagtgctggggtctcgagtatttcccagtctacatcatctaccaacaatcaaaatctaccaagagttcaactangaagatgtttcctcttcacagatccaacaccgtgtaacgtcaaagaacttaaaaagcctagagaatagcacattaactaagcctacatctagatttgatagtaacaactacaacggaaccaattcgtcacttgtttccacagagtcggaataccagaacgatttaatcgatgcagaatcattagatactgaaggagacgatgatatcattgcagctccactgccactggactatacagatccattctcaagaccactttcacgaaactccacaactagttgtctttctacaacggcaacaaaagatgggatagaaggaagaagatttcgccgccacggtcccacagcttattcaagtcatatcatagcaggtatgatgcagcagcaacaacaacaacaacagaaactccttaaccaacagaatccaaccaaaagtttgttaaacaacgatgatgaacattacactcttttggactcgaccaatgcaagtgtagccagtcttcatcaaacttctatatatccaggtacaagaagtagtagcggttctgaacctacagtgtcatctaatgttaaagaggagtag

SEQ ID NO: 6096 - DNA, 1305 bp, Candida albicans
atcccccattataatagaaacatacaaacaaaaaagctaaatatgacatcacagtataacggtgacaccaactcgaccactatagacccaaacaatcgagaagggggtctggtcatagaccagtcaaataacctaccatctagctcatcttcatctttgaaccattcccattttcaaaaaccacaagtgtcgaatcttacaaagaacttgttatcatcttctggtggacaaactacacccgtggccacgaatgtgaattccaatacagcatcaaatcaacaaaatttattcacaaatacacccagcagttacactgaaccaattacaaatagagttcttcctaatttgaaggctagtgcaagccagatgagcaattcatttagtggttctttccatcagtcgcatgtacacaaccacaacgattccattaattatattccatcatcgcataatactcccactgccgtgagtagttcgtatacatcacatcactcttatccagcgtctttgtcgagtgttaacaattttattagtcagccgtcacaacagcaacagcaacagcctataccattgagtttcaaaccacctggtgtagtgccgaattcgatcccaaccacgaatgtgcataacgatactgcaaatagattttcgtctgtttcttccactggttctccattcagtaattcgccatttgcaacatcaacccaatttcaatcacctgcatcgatagctcagcccgttcacccaagctcgttgcagcaagttcaacaacagagatttccaaactcattccccaatacaacagtaacgcattttcccaatcctccaaatctacaacagctggcaataaacaggacccaacacaataacaacaaccataaccatcaccaccaccaccaacaacaaccaatagtgacagatacgctggtttctaccagtggatctactacaccagtggagaatcaaagaccagctgttaagtcagtacagtctactccgtctttaccacatggaaatcaacacgatcaaagtgctcgatctctggcactgtcacaatcgttccaaacatacgtacaacctgagcctgaccattacatgacatatagtgaattcttacataatttgagtgtaaaagatagtcaagatgagtcagctgcatatgaagaacatttaaatattgttgagtatcctgttaatgatttgataattatgttatcttgtttgttgacaaagataattgaggcaaatgataaattgcatccaaatcattttgaaaatactattgctataagacaaagactataa

SEQ ID NO: 6097 - DNA, 666 bp, Candida albicans
caagagaaattgattgacgaccaatttggtcgtagacattcaagtgtttcctcaacaattttccataatcaaaagaatgtatctcaccctaatttacttcttgttcattctgctcgtacttctgttagtggacctagcggaagcaattatggaaccgggtccccttcatacaacggatcccctttactgatgagcacagcggcatcaagaaacaattccatcactcattttgaacttatcaataactcaactataccttcaagaagatcaagcaccttcaattctgatttattccctaatccattagccaaagaaaacaacaatggcaacgacaatcataaacgacgcgagtcgcaaaactcgtctttcaattctccaatgttgacaccactgacaaggttttctgtgtcttccatgacgtctgtacataattcaactatacataattacaattcgtcgtcagtgacatctcctactacttcattcaagaatgcatattcagctagtagcacatcgataaatttaccagtagaggaagaggaaccagaaactggtgttgataagcagaaaatcaatgaaccaagcaaagatgaagtcacagctgaacaaaatggtgatgaaaaagtaggcaaaaagagaatggcagtttcttcattacttgattaa

SEQ ID NO: 6098 - DNA, 2118 bp, Candida albicans
  unsure (359): Identity of nucleotide sequences at the above locations are unknown.
accaacaaggtcatgtcagcacaaagtacacctaaaaaagagtattccaatgattcaagaccacagtccacggaaaatgatacagctcgttctaaaagagggggcaaggattctcaacccccaccatttcacaattccactgtaactcgttcgtctctccccaataatccaagaccagcatcaactggtaacattccacggaacactagtaccccatcattaaataaaaagcaggcaaaccgattgaaaacccacaataggtctctatctcacaacaagtctctaaccaagttatcgacatcaaccggagcaacggcgcgaccacatttaaatcgatcaaagtcaacagaggtcttgtngaagagcagacaaggtggtgctttgaaaagaaatagtagatcgttgaccaagatgacagcattacaacctatgacaaagacaacatcaagtccgactttgccaacacacaagtccaccacatctttgaaaaatatcaattcaacatgcagtattggattaaaatccagtgcccgcaaggggaaagctattcttcaattaaatgacgatgatgcagattatgaggatgttgaaaatctactgaatgatgaagacaccggagagaataatgctcctgtgcctgaaaggtttgatagtcaagatactatatcaacaacacacctgcaagacgaacagaatattcccagtttgtatgaacaaataaacagaatattaccagagccaaccccagcttctgaagaacctccaaagtttaaggataaactagaagttgtggaggaagggaacacaatcgatagcaaagttaacacaagtcatcctgaacttggttcttctacaaagagttcaacggatgatttctcacaggcaaacaatttttatagtggatcattactattgtcacagtctacaggtctagtgagaaaaattgatccaaaacatagtgccaacttgaaaatgacagaggcatatccagctatgccaagtgatgaagctttgaattcaactgcaataagtggcatttcatttaaagccaatcctatggagctcaacaatgctgcagaaccagtaactacaagtaaaaatgtgagtcaaaacaattcgtaccaacccgatcaaaccattttcaataatttgcaacgaacaaataatcaatatttgatgaacaaaaaacagcaacagcaacaaaaaacacaacagaagtcgcaacaaaagcaacagcaggtaaaaccactttctcctgctgggactgctatcaataatggcactaacaatttttccgattttcttcgaaccaacaattccacatcgtcagctgatctgcaatacggtcacaatatagaaactagaacgcaacagaggttgtggctacaaagagaaagttcacttatggacgttacaaatttagatgctaatcgtatgtccaacttttcaaacttgtccttgaacaatctaatgttttctcacaactacaacaatcagagtcaggcaaatattcgtgacctccagtatagtgggtctgttcctcaacaacatcaaccattaacacccatgacacccgccacacctggtgtaggaaacaatgggtcgtatcctggttccgatgtcaacggtaatcaagggttacttaatttagtacaaggcacccttccacatacagtacagacaaaaattgaatttgaaagattgaatagggaatatttgaatgtaagaaggcacgcaaaccctatgggagaaagtttgaaacgattggaatcatattcaggcaaagaactcaatgtatcgaaaacaagaaagggagataagtctactaccgatgctaatgcaagcacgtttgaagaattttctcctacatttcacgagaaagagaccgagatatccaatactttgagcaagctctggcaagatgcaatcgtatcttcgctgtcttcatcagcagccagaccaacccaaccagctacacagcatcatcctacgaatcagcgttctattaacccgcgcttagcatcttacaaccaaaactacaacaactcgagacagaaccaggcgccaaacacacgagcagtgaaactagctccaatacagacaacagatgcagcatga

SEQ ID NO: 6099 - DNA, 645 bp, Candida albicans
ggctccagttataccacagcttcagcttttgttcatgcttcaagtgctagtgaagaacagtttatatctgtttgggacacttccaattctggtggttctttaattctagagtccagcacgtcagtggcttctgttgtaacaaccccattaccattcacatcaaatgatatcataactgagatttcatccacctggaatggtgctaagtccgatagcccacatacttcagagtctgatattactagccaatacaactcacattctacttctgtcgctactcgttcagactcaatatcattaactgatactttcgaaattggctttgcatcaacttggacaaccggtggttctggaaatggtggttccatgaaatctgacgtcagtaatcaagattcttatgccacaatgttgcctacttcattcttggacacttcaaattcggatatcaccactggagttgtatcaacatgggatgctaaaaattccaattcatatacttcagctgagttatcaacagatccgtacagctctgatggttatgccagctctgctactgcagctctttctataaccgagtcaattccaactactgataccattaatactgagtaccattctgtttcaccacggcctggaaggaccgca

SEQ ID NO: 6100 - DNA, 213 bp, Candida albicans
aatataaccccaactgggacattttcattctttgctggattatgttttattgcatttttctttgtttatttcttgttaccagatactgctggtttggaattggaagaaaccaccgatttcttatccaacgggttcaatgtgaaacaagctgcacaattgtcaaaggaaagaaagaagcattccaagtttgctaaatcgaaaccaaccgtatag

SEQ ID NO: 6101 - DNA, 1365 bp, Candida albicans
  unsure (1215),(1241),(1268): Identity of nucleotide sequences at the above locations are unknown.
ccaaccttacagttctacatcaagggaatagactaccagccaggtggatcgtctgcagtctccgagctcaacgacccattatcggatcccgacaaatgtgctagagatataatcctatttcaagaattgggtatcaacaccattcgtatttattcaataaatgcacacctaaaccacgataaatgcatgaccatgttggccaaagcaggaatatacttgtttctagacgtaaactcgccattgccacaccaccacctaaaccgatacgagccgtggaattcgtacaacttgtactactttgaaaatgtctttaaggtggtagaacagttttcccactacaacaacacgctagggtttattgccgggaacgaaattgtcaacgaccccatctccgccagtgtggctgccccatatgtcaaagcggtggtccgcgaaatcaaaagctatatcgaatacaatgcaccaagaaccatccccgtcggttattcagcggccgacgacttgaactatcgaatgccactagcacagtacctcgagtgtggcgacgacaaccccaaagaatcagtcgacttttatggcgtcaactcgtaccagtggtgtggcgaccagacattctacagcagcgggtacaacatcttggtcaacgattacaaacatttcaccaaaccaatgtttttttcggaatatgggtgcaatgaggtgttgccgagaaatttcgatgaagtcccagtattgtacacaaacgatatgatagatgttttcagtggcggattggtatacgagttcacccaggaaccaaacaactatggcctagtcaaggttctctccaatggcgacgtcaaagtattgcgggactttattcagttgaaaaacaaattcgacaccctacccgagctagactatagctatatcatccaatcaatgaaggaaaacgcaaaggatatacaccaaaagttgacaacatttaaaacatcaattccgaaatgtgagttgctgtaccctaatcttgacatttctaggggcgttcctccaaccattgcgcagacattgattgaaactggcgttgacgctaagcgcggagaatatgtgactctatccaacgaggatctaacaacaacgtacaaattcttcgaagaaagcggcgaaaaactagccatcgtcaacagaattgaaaccatggtggaagttgatgaaaaggcgttggaaaaccgaganacaccccaagtacctgcggaacatgntgagcctgcggaacccacagaacctgntgagccccgttcaccaccacgtagcaccccgtttatcgactttatccacaaactaatagaccctttcaaaaccttctgtgctaacttgtttaattaa

SEQ ID NO: 6102 - DNA, 1458 bp, Candida albicans
acccccctcacgaaaattttaaaatcacaacaaataacacattctttttcttttttggcccggccaaacatcactaacttcaattcattcgttcatttctccatgttgtttagatctttagtaacttacttatccttggtttcctccgtcttgtctattgcttccatcaaagttgaaggtaatgcgttttgggacagcgaaagtggtgacagattctatattagaggggtcgactaccaaccaggtgggtcatccgagttggaagaccctttagctgataccaacgtttgtgaaagagacgtcaagtacttccaagagttgggtatcaacaccattagagtctactcgattgacaacaccaaaaaccacaccgagtgtatggataccttagccaaagccggtatttacgtgatactcgatgtcaataccccgcactcttcaatcactagaagtgacgctgcttgttcttacaacactgactatttgcaagaagtatttgcttctattgttgaatttgctcaattcgataacactttggggttctttgctggtaatgaggttatcaacgatggtccatctttagaagccgctccttacgtcaaggccgttgttagagacatgaagacttttatcaagaatagaggttttagaaccatccccgttggttactccgctgccagtgtcgacgaatacagattaccttctggtctctatttcaattgtggagacgacgacatggccagaatcgacatgtacggtattaatgactattcctggtgtggtgacgccagtatgactacttcccagtactctcaacaaatgaaggattttgcaaactataccgtgccattattcttttctgagtttgggtgtaatgccaaacgtccaagaccattttctgaaattgaggcaatttactctacggagatgtcgtctgtgttttctggtgggttggtatacgaatactccgaagaagcttctaactatggtttggtcgaattaaaaggcgacagcgtcaccaccaacgacgactttgacaatttgaaatctcaattcgaaaaaaccaagaacccatctggcgacggtggatacttaaagtctactggtggtaacaagtgtcctccaaaatcaaacatctggaatgtcaccgaagagattccagacacccccaaaggtgctttgaaatacttgaaaggtctcgctgagccaactggtcatgggttcgatgcttatgtgcaaggcaactgtaatgccaaaggtaacaacgtcgacgataccggtaactacacgtcctccattactgcatcaagtcgtgcctccccaagtcaaaccagccaagtttccagctcatctgcaacttctgccaattctacttcttcgaaaaagaacgacgctgccgtcgaaggtgccggatttttgagtgtcatcgctttagctgctggtattgccttactttag

SEQ ID NO: 6103 - DNA, 357 bp, Candida albicans
acattggatctttccagggccgttgtcgaatacgaacatgaatatgtggttattgagccgcctgcaggtcaaacttgtcaagaatacatgctggtatttataacgatgcatggaggttatctattacagtcaaacaatggtgctgcagagtcagggacatgtagctattgtacaatggatgaaaccaatacgttcttgaaatcggtcaatgcattatttagtcaacggtggagaaactacggtatttttaatgcatttattgttattaatgttgctcttgcgattttcttttattggttagctagagttcccaaaggcaatagagaaagtagaatcaaacatagaaaggaagaataa

SEQ ID NO: 6104 - DNA, 1476 bp, Candida albicans
ggttggaattatttgccaaactttaattggtggttattcttaggtgaaccaaattccaggtttagattctcaaaactgactgttcgatttgtatatttgatgagaaagttagctattcttggtcaagccattttgtgtagtatccatcaaccatcagctattattatggctgaatttgataaacttttatttttacaaaaaggtggaagaacggcttattttggtgaattaggtgagaactgtcaaaccatgatcaattattttgtcatatatggtgctgatccatgtcctaaggaagcaaatccagcagaatggatgttacaagtcgttggtgctgcaccaggatctcatgccaagcaagattattttgaagtttggagaaattctagtgagtatcaagccgttagagaagaaattaatagaatggaagctgaattatccaaattaccaagagataatgatccagaagctcttttgaaatatgctgcaccactttggaaacaatacttgttggtcagttggagaactattgttcaagattggagatcaccaggatatatttattcaaaattaatattagtcatttcgtcatcattatttattgggttttcatttttcaaatcgaaaaataaccttcaaggtttacaaagtcaaatgttggcggtatttatgtttttcgttccattcacgacatttattgatcaaatgctaccttattttgttaaacatagagctgtttatgaagtaagagaagctccatcgagaacattcagttggtttgcatttattgctggtcaaatcacttcagaaattccctttcaaatagttgttggtaccatttcatatttctgttggtattatccagttggattatatgccaatgctgaaccgacagactcagttaactctcgtggagttttaatgtggatgttattaactgcattttatgtttacacatcaactatgggacaattggcaatctctttgaatgaattgattgataatgctgctaatttggctacaactttatttacgttatgtttaatgttttgtggggtattggctggtcctaatgtgattcccgggttttggattttcatgtacagatgtaatccattcacttatttgattcaagccattctttctactggattagctaatgcaaaagtcacttgtgcacctagagaattggttactttaaaaccaccaatgggagaaacttgttcttcatttattggtccttataccgaagctgctggtggttatttttccacaaatagtgatggtacttgttcagtatgcagaatcgattcaaccaatcaatttttagaatccatcaatgctttgtttagtcaaagatggagaaattttggtatttttgttgcttttattggtatcaatatcattcttactattttcttttactggttggctagagttccaaaaggtaatagagaaaagaagatgaaaaaataa

SEQ ID NO: 6105 - DNA, 213 bp, Candida albicans
ttgctatttatcaatgttctcaagatgcctatgatttatttgataaagttgttgtcttgtatgaaggttatcaaattttgctttggtaaagccaccaaggctaaagaatattttgaaaagatgggtgggaaatgtcctcaaagacaaactactgctgatttcttgacttccttaaccaatccagctgaaaaagaaccattacccagtttatga

SEQ ID NO: 6106 - DNA, 1182 bp, Candida albicans
aaggtcaaaaacgaaaaaattatgtcagattctaagatgtcgtcgcaagatgaatctaaattagaaaaggcaattagtcaagactcttcttcagaaaaccattccattaatgaataccacgggtttgatgcccatacaagtgaaaacattcagaatttagccagaactttcactcatgattctttcaaagatgactcgtcagcaggtttattgaaatacttaacccatatgtcagaagtgcccggggtcaatccatatgaacatgaagaaataaataatgaccaattgaatcccgattcagaaaatttcaatgccaaattttgggttaaaaatttaagaaaattgtttgaatcagatcctgaatattataaaccttcgaaattgggaattggatatagaaatttaagagcatatggtgttgctaatgattctgattatcaaccaactgttactaacgcactttggaaattagccacagaaggtttcagacatttccaaaaagatgatgactcaagatattttgatattttgaaatcaatggatgccattatgagaccaggtgaacttactgtggttttggggagacccggtgctggttgttccacattgttaaagaccattgctgttaacacttatggtttccacattggtaaagaatcccaaattacttatgatgggttatccccacatgatattgaacgtcattaccgtggtgatgttatttattctgctgaaaccgatgttcatttccctcatttgagtgttggtgatactttggaatttgccgctagattaagaactccacaaaacagaggtgaaggtatcgacagagaaacttatgctaaacacatggctagtgtttatatggcaacctatgggttatcacacacaagaaatactaatgttggtaacgatttcgtccgtggtgtttccggtggtgaaaggaaaagagtgtcaattgctgaagcttctttgagtggtgctaatatccaatgttgggataatgccactagagggttagattctgctactgctttggaattcattagagctttgaaaacttcagcagtcattttagataccacccctttaattgctatttatcaatgttctcaagatgcctatgatttatttgataaagttgttgtcttgtatgaaggttatcaaattttgctttggtaa

SEQ ID NO: 6107 - DNA, 2085 bp, Candida albicans
aaaatattgtcgctttatgaagctagaccaattgtggaaaagcataggaaatatgctctttatcgtccatctgctgatgcattagctagtattattagcgaattacccgtcaagttactcatgaccatgtccttcaatatagtctactatttcatggtcaaccttagaagaactgcaggaaatttcttcttttattggttaatgtgtgcactgtgcactttggtaatgtcccacatgttcagatccattggtgctgttacaaccactattgctactgccatgtcactctccacagtatttttattggccatgatcatttatgctgggtttgttcttcctattccttacatattaggatggtccagatggataagatacatcaatcctgtgacatacatttttgaatcacttatggtgaatgaattccacggtcgtgaatttgaatgtggacaatatattcctagtggtcctggttttgaaaatcttccggttgaaaataaagtttgtacaacagttggatctactcctggaagcacagttgtccaaggtaccgaatatataaaattggcttatcaattttattcttcacacaaatggagaaactttggaattaccgttgcatttgctgttttcttcttaggagtttatgttgccttgactgaattcaataaaggtgctatgcaaaagggggaaattgttttgtttcttaaagggtctttgaaaaaacataaaagaaaaactgctgcttccaacaaaggtgatattgaagctggtcctgttgctggcaaacttgattatcaagatgaagctgaagctgtcaataatgaaaaattcactgaaaagggtagtactggaagtgttgatttcccagaaaaccgtgaaatatttttctggagagatttgacttatcaagttaaaatcaaaaaagaagatcgtgttattttagatcatgttgatggatgggtcaaacctggtcaaattactgcattgatgggagcatctggtgctggtaagaccacattattgaattgtttatctgaaagagtcactactggtattattactgatggtgaaagattggttaatggccatgccttagattcttcattccaaagatcaattggttatgtccaacaacaagacgttcatttggaaaccactactgttagagaagcattacaattttctgcttatttgagacaatccaacaagatttctaaaaaggagaaagatgattatgtcgattatgttattgatttattggaaatgactgattatgctgatgccctagttggtgtcgctggtgaaggtttgaatgttgaacaaagaaaaagattgaccattggggttgaattagttgccaaacctaaattgttgttattcttagatgaaccaacttcagggttagattctcaaactgcctggtcgatttgtaaattgatgagaaagttagctgatcatggtcaagccattttgtgtactatccatcaaccatcagcacttattatggctgagtttgatagacttttatttttacaaaaaggtggaagaacggcttattttggtgaattaggtgagaactgtcaaaccatgatcaattattttgaaaaatatggtgctgatccatgtcctaaggaagcaaatccagcagaatggatgttacaagttgttggtgctgcaccaggttcacatgccaaacaagattattttgaagtttggagaaattctagtgaatatcaagctgttagagaagaaattaatagaatggaagctgaattatctaaattaccaagagataatgatccagaagcgcttttgaaatatgctgcaccactttggaaacaatacttattggtcagttggagaactattgttcaagattggagatcaccaggatatatttattctaaaatctttttggttgtttcagcagctttatttaatggattttcatttttcaaagctaaaaataacatgcaaggtttacaaaatcaaatgttttcggtgtttatgtttttcattccattcaatactttggtgccacaaatcttcaccacgcgagtggccggaccacgattaagttag

SEQ ID NO: 6108 - DNA, 1878 bp, Candida albicans
cattggttttccattttattcttctggttgccatttaattttaaaagtaatcaaacaacaactgttgacaataaaatacttcaaaaaccagaaaatagtcaaccaatggtcaatatccaacctcaaaacgccacggagtatgcagtcaatcagtcttgtgagcatattacaacccctgcgtcctcggaatatgaaggctttgatcacaatgaagttagacagttagcaaagatcttaaccaatgataacgacgattctgcaaagtcaagtttggtccgacaactatcgaatatgagtaatgttcctggtgtaaacccatgtgacgcaaacaacctccttcttcagctaaatccaaattgtgatcaatttgattctaagttgtggataaaaaatttgaagaaactctatgaatcagatccagaatattggcagcattcaaagttgggtgttgcatatacaaacttgcgtgtatatgggattgcaaacgatgttgactaccaacccacggtcacgaatctactttggaaattaggtggtgaagcgtttcgaaagtattttagaaaaaatgacaagacccagtattttgatatattgaaaccaatggatgccattatgagacccggagaacctaccgtagttttgggtagaccgggtgctggttgttccacattactaaaaacaattgctgtcaacacgtatggatttcatgttggcaaggaatcaaagatttgctatgatggattaactgcccatgatatagaaaagcatttccgaggcgaggtcatttattcagccgagacagaggttcatatacctcatatgacagttggcgatactttagaatttgctgcccggttgcgaactccacagaatcgaggtgataatatagatagagaaacttatgctaaacgtatggccgatgcttatatggcaacatacggaatttcccacactagaaatacaaaagtcggtaatgatattgtgaggggggtctctggtggagaacggaaacgtgtctccattgccgaagtctcactaagtggcgctaaaatccagtgttgggataattcgaccagagggttagattcggctactgcattagaatttatacgagcattgagaacctcagccaaaattttagactgcactcctgtggtggcaatctaccaatgctcgcaagacgcttatgatttgtttgataacgttagtgttttatacgaaggttaccaaattttctttggtaaggcttccaaagccaaagaatattttgaaaaaatgggttggaaatgtcaaccacgacaaacaacggctgattttttaacatcattaactaatccagcggaaagacagactttaccagggtttgaagatagagtacctcggactccacaagaatttgaaagctattggaaacgctcgccagaatattcagaactcatgggccaaattgatggatattttgttgattgtgaaaccttgaacaccaaagaagttttccatcaagcacatgtggccaaacagtcaaatcatattcgcccttcttcaccatatagagtttccttttttatgcaaattaagtatttggttgggagaaattttaaacgattaaaaggtgacccatcattggcaatttttagggtctgtggacaaataataatggggctcattttgtcatcggtgttttataatttgcagtcgacaacagaatcattttattatcgtggagcagcattattctatgctgttttatttaatgcattctcctcattgttggaagtcatgacaatgtatgaagctcgaccagttgttgaaaagcatcggaaatttgccttctattgtccttcgttttcacctcgccatggccgaccacgcttgatt

SEQ ID NO: 6109 - DNA, 2223 bp, Candida albicans
  unsure (2218): Identity of nucleotide sequences at the above locations are unknown.
aaacatatgagtactgcaaacacgtctttgtcgcaacagctagacgaaaagccatgggtggatgcactggacaattcatcagttcaagaatatcaaggttttgatgctactgcaagtcacaacatccaagatttagccagaaaattgacccatggttctacaaatggtgatcaccattctgcaaatgatttagctagatatttgagccacatgtccgacatacctggtgttagtccattcaacggcaacattagtcatgaacaattagacccagattccgaaaatttcaatgccaaatactgggtgaaaaacttgaaaaaattatttgaatctgattctgattattataagccatcgaaattaggggttgcctatagaaatttaagagcttacggtattgctaatgattctgattatcaaccaactgtgactaacgcactttggaaatttactactgaagcaatcaataaattgaagaaaccagacgactcaaagtattttgatattttgaaatcaatggatgccattatgagaccaggtgaacttactgtggttttggggagacccggtgctggttgttccacattgttaaagaccattgctgttaacacttatggtttccacattggtaaagaatcccaaattacttatgatgggttatccccacatgatattgaacgtcattaccgtggtgatgttatttattctgctgaaaccgatgttcatttccctcatttgagtgttggtgatactttggaatttgccgctagattaagaactccacaaaacagaggtgaaggtatcgacagagaaacttatgctaaacatatggctagtgtttatatggcaacctatgggttatcacacacaagaaatactaatgttggtaacgattttgtgcgtggtgtttccggtggtgaaagaaaaagagtgtcaattgctgaagcttctttgagtggtgctaatatccaatgttgggataatgccactagatgtttagattctgctactgctttggaattcattagagctttgaaaacttcagcaactattttagatacaactccgttgattgccatttatcaatgttctcaagacgcttatgaattgttcgataacgttgttgttttatacgaaggttaccaaattttctttggtaaggcttccaaagccaaagaatattttgaaaatatgggttggaaatgtcctcaaagacaaactactgctgatttcttgacttccttaaccaatccagctgaaagagaaccgttaccaggttatgaagataaagtaccaagaactgctcaagaatttgaaacattttggaaaaatcctcccgaatatgctgaattaactaaggaaattgatgaatattgtgttgaatgtgaacgatccaacaccggggaaacttatcgtgaatctcatgttgccaaacaatccagcaatacaagaccttcttccccatatacagtttcatttttcatgcaagtgaggtatgttattgctagaaactttcttcgtatgaaaggtgatcggtcgattcatatattttccgttttcggtcaacttgtaatgggtctcatattgtcgtcggtgttctataatcttagtcaaaccactggatcgttttattatagaggtgctgccatgatctttgctgttttgtttaatgccttttcatcacttttggaaatcatgtcacttttcgaagccagaccaattgttgagaaacataaaaaatatgcctttattcgtccttcagctgatgccttggccagtattattagtgaattacctgtcaaattagccatgtcaatgtcatttaattttgtgttttattttatggttaattttagaagaaatccaggtagattctttttctattggttaatgtgtatttggtgtacatttgttatgtcccatttgtttagatccattggtgctgtttcaacatctatttctggtgccatgactcctgctaccgtgttgttattggctatggttatttatactgggttcgttatcccaactccaagtatgttgggttggtctcgatggattaattatattaaccctgttggttatgtgtttgaatcccttatggttaatgaattccacggtcgtgaattccaatgtgctcaatatgttccaagtggtccaggttatgaagatatatcacgttcaaatcaagtgtgtactgcagtggggtatgttccanggtaa

SEQ ID NO: 6110 - DNA, 723 bp, Candida albicans
  unsure (20): Identity of nucleotide sequences at the above locations are unknown.
ttgagattgcaaaatgcccnaaaaaacatacaaccattcattaatgccatatttttttcgggggcatttatgtcgtttatgtcagttgcgtacattccatcatatcttgaagacattcaaagttataagaaggagagaatgaatgggttgtatgggcccttggcattttccttagcaaattttttggttgggcttccatttttatttttaattgctgccgtgtttagcgttattacattttttatggtcaactttcaccaaacagcaagtgggttctggtattatttgatgtggctattcttggatttagtcgcagcagaatcaatgactacgttcattgccagcgttttcccgaactttgttgtgtcattagcaataacagcttttgccaatggattgtggatggcagtaggaggttttttagtgccttcaaatattttgaacgtgttttggtattataccttctattggattgattatcaaagatacgtctttcaaggaatgatcttcaatgagtttaccaacagagagtttcgttgtggagatgggtgtcattgcatgtatgattcacccttggcaagccagtgcaaaattagtggaaaagctgtattggaaagcttgggatacgggaactacgataagggattatggattggggttttaattgctctagtttttgtttacagatttgctacgtatatagttttaaaattgagaaagtaa

SEQ ID NO: 6111 - DNA, 1809 bp, Candida albicans
tcgttcctcggtttcgagcgcgggttcttccagcctcgtggtgaagatacggaaggtattaggttagttaatgggagaccattagactcgtcgtttcagagatctattgggtatgttcaacaacaagatttgcatttggagacttcaactgttagagaagcgttggaatttgctgcgtacttgcggcaaccaaaatcagtatctcgaaaggaaaagaacgagtatgtggattatataattcggttattggagatggaacagtatgcggatgcagtagttggtgttagtggtgaaggtttgaatgtcgagcaaagaaaaagattgtcaattggtgtcgagttggtagcaaagcccaaacttttggtgtttttagatgagccaacatctgggttagattcacaaacagcatggtcaatctgtaagttaatcagaaagctagctgataatgggcaagcaattttgtgcacaatacaccagccatcagccattcttcttgccgagtttgatagacttttatttttacagagaggtggtcgaacagtttactttggtgatttgggggaaaattttacaacgcttataaattactttgaaaagtacggtgctccaaaatgtccaccagaagctaatccagctgaatggatgttagaagttattggtgctgcacctggttccaaggccaaccaggattattacgatgtatggttgaaatctagtgaattccaagaaatgaacctggaactagacttgatgctggaagagcttgttaaaaagccgcttgacgatgatccagacaggctcaaaccttatgctgcaccttattgggagcagtatttgtttgttacaaagcgtgtttttgaacaaaattggagaaccccaagctatttatattccaagtttttgttggttgtcacttatagtttgtttaacggattttcattttacaaagctgataggtcattacagggattgcaaaatcagatgttttctgtgtttatgttccttgtgattcttcacactttgattcaacagtacttgccaacttttgtatctcaaagagatttgtatgaagtcagagaacgaccatcgaaaacttttagctggattacatttattgctgcccaagtcactgctgaaattccatggaatataatctgtggcacattgggctatttctgttggtattaccccgtgggcttgtaccagaatgcaacatatacaaatacagttcaccaaaggggtgcatttatgtggtttgctattgtattgtttttcatatatacctcgacaatggctcagttgtgtatttcatttttggagattgatgataatgctgctaatttgtctgttttacttttcacaatgtgtttggccttttgtggtgtgttagtgacaaaggagcagttaccaggcttctgggtattcatgtacagatgcagcccattcacatatttagtgtcggtgatgttgtcagtgggattagtagatgcacctgtgacatgtgcagcaaaagagtatttaagattcagtcctccacagggttatacatgtatgcaatatatggagccatatatgaaggttgcaggtggctacttacttaacgagaacagtacaacagagtgtgaattttgcacaatgaaagtgacaaatgtgtttttgaagatgattggttcagactattcgaaaagaggaagagatattggtatctacattgcttttattggcataaatattattggtacttttattctttattggtttgccagagtgccaaaaaattttgatatcaaacttagacgtaaacgttga

SEQ ID NO: 6112 - DNA, 1215 bp, Candida albicans
gttcattcgtgggatctgttttacaaaaatatgtccgattatcttgctcaatcgttaattcaactgccactgctggtactgcaacaggaacaacagtctttgttatcttcaattacaggacaaattgatactgcaagaaatgaagccaaagtattatacactgaaattcttagtgtgaaaagaaggacccaagatgccacaattcaagccatttcccaaaatgtcagtcaaataccaaaaaactcatgcaatctaacactatacaacaccttgcgaggacatcaaaacaaaattgccaaactctgctggagtagtgattcctcgaagatattatcagcatctcaagatggatttatgataatatgggatgcagttactggtttcaaaaaacatgttattcaattgagcaatccttgggtgttgacttgtagctattcgcctaatgaaaaactagttgcatcggcagggttggataacaactgcacaatatataaaatcaaaccggacacttcaaattttcctgttactgaagaaagaaatggaacctatcaaatgcaaggcaacttttatcaatctatacaatcaattttcaaaggtcatacggcatacatttcagaatgtgaatttattggcaataattccattgtaaccgccagtggtgatatgacatgtgccttatgggacttgacaaaaggtaccaagtccagagacttcgtggagcattcaggagatgttttgtgcttgagtacattcccgcaaaatatccttagtgccaatttatttgtgtctggaagttctgatggtagtgccaaaatctgggacttgagatctccaacccctacacaatcatttggaatatctaatagtgatgtcaatagtgttaaggtgtttccagatggtaatgcatttgcaacaggctctgacgatggactgatccggttattcgatttaaggtgtgattgtgaattgggtcattactctttgagtctggaattaagaaacaaacagaatttgttacacttgacgataccttcaccagctgatgaaagatacatgaaaaggtttggaaatacaacagctcagacatatgacgagcaactgacttcattgctacatagtaatggaagtagtagtggcaacattgatcagtatagtgtcaacagcttgcaatcagttattgaaaatcaaggtgtgttttctcttggatttcggtaa

SEQ ID NO: 6113 - DNA, 303 bp, Candida albicans
  unsure (291): Identity of nucleotide sequences at the above locations are unknown.
cttcattgctacatagtaatggaagtagtagtggcaacattgatcagtatagtgtcaacagcttgcaatcagttattgaaaatcaaggtgtgttttctcttggatttcggtaaaagcggtcggtttctctactcgtgctattctgaatatggctgtgttgtttgggatacattaaaaagcgagattgttggtatcatgggaagtgaacatttgaataagatcaatcaagtatcagtaagtcccgatggtgtagctttggcaactggttcatgggatgctacaatcaaagtntggtccgtctaa

SEQ ID NO: 6114 - DNA, 867 bp, Candida albicans
  unsure (753),(784): Identity of nucleotide sequences at the above locations are unknown.
gagcttggctccttccagcggcgtggtgaagagcaaaccatgatgaattatttcgaaagaaatggtgctgatccatgtcctaaggaagccaatccagcagaatggatgttagaagttgttggtgctgctcctggatctcatgctaagcaagattattttgacgtatggagaaactctaatgaatatcaagttgttaaagacgaaattagtagaatggaaattgagttatcaaaattatcaccgttaccgctgtcatctaatggacgtgatgaaaaagaatcccgattgacatatgcgtgtccactttggaaacaatatttgttggtaacgtggagaactatagttgaagattggcgaactccagggtacatttattccaaacttttcttggtggtttcgtcgtcattattcaatgggttttccttttttaaagcagataaaactatccaagggttacagaatcaaatgtttgccattttcatgtcatttattccattcaatactttgttgcaacaaatgctaccattttatgtgaagcaacgagatttatttgaagttagagaatcccctgctaggacttttagttggtttgcgtttattgctgcacagataacttcggaaattcctttccaaatagttcttggtaccattgcatatttttgttggtattatccagttgggttatatgttaatgctgagccaaccaaccaagtggtcagtcgtggagtcttaacttggttattgcaagtatcnatttatgtttatgtttcgaccatgggacatntatgttattccgttcttgaagctactgatgctgcggctaatttggcaaatttaatgttttcaatatgtttgaagttttgtggg

SEQ ID NO: 6115 - DNA, 1452 bp, Candida albicans
catttgcaatttgggcttgttttaatgatatacccattgatgcaagctattggtgaaatgtgttcttatttacccattaagggttcattctttcatttttctgctcgttatgttgatccagctttggggtttgcttcctcgttgatatatacttatactgcattaatgtttgtttgtattgaagcaacggcctgtgcaggattaatatcattttggacagatattaaccctggtgttttcattactattgcattagtgttatttttcttgctcaatttgtttggtgcccaattctatggtgaatttgaatcgattttttcttcatttaaagtaattttgattttgggcttaatgttgttttctttaatatcaatgtgtggtggtaatcctcaacataatgcttatgggtttcaacattggaaagaaggtggtcttttcagaccatatttggtgggtggcacaactggtaaatttttggggacatacaattgtttaatttgggctgggtttgcagctggtggtcctgatgtgttagcattgattgctgcagaagttaagatgccacgtaaaaacattgggattgttgctaaacgttcctatatcagaatatacttgttctatctcggtggtatttttttcttgaactgtcttatagcttctaatgatccatcattagtgaaatccttgaaatcatctactgtgtcaccttggactttaggtattcaaaatgttggtgttcgtgggttgggactggttgttaatggagctgttttgacttcggcattttcttgtgggaatgcatttttctttcttggaaccaggtcactttattctgcctctttggcaggatatgtcccaagattcttctctaaatgtttgaaaagtggtgttcctatcaattgtgtcatattcaccggtgttgtatcattgatttcatatttgaacgttagtcaatccactggagtggtatttaattggtttgttaatttagccaccacggggttattatgttcttatatctgtatgtggctcgcttatttcaaatttagaaaagcatatgtggttcaaactggtaaacaaatgaaaaagggagagtatccatattatttggcaccaaaattcattcatccttatttcacatactttggttttttcattaatgttgtggttttatttttcaatgggttctggatattttttcctggacaattctccgtatctaatttgtttacttcttattttgctccagtgtttttcatctgtttatttgttttttggaaagtgtttaaaaagactcattggagaaatgccatggaagctgatattactacaggtaaacaatacattgatgaagaagaagaaagagatattgaatttgaacttaaccgagaaagaagaaaaggatggttttttgttgcctgtagaaaggcatctgatttctgttttagttag

SEQ ID NO: 6116 - DNA, 1185 bp, Candida albicans
  unsure (101): Identity of nucleotide sequences at the above locations are unknown.
cgggtcttgtatgtttcgtttgttatggtgattgtttttggtattacaaaatatagcgacaacgattctatcagtggggccagtgtgggagcgttcactangggcaggttctatgatatcgacaaagttggcgagtctataacgcactttattgatcccaaagaaatgaaagagcatttagagtacttttcgtcgataccacacatcaccggcacgaaaggagacttggcgttggcaaagtatgtacagtcgtttttcaagaataatggtctacaccatgttgagttgaatgagttggaaagttttaccaattatccagacaagaccaagacgtacttgaaggttgaagattttgaggcgacgttgtttgagcaacataacgagggcatggagtttttggcatttaacccaaactcgttgaacacagaaacgcctatcaaggggagttttatttatgtgaattatggggaggccgaagactatgacaaggtgattgccaatggcgttgaagtgaaagataagattgtgttggtgaagtatggcggcaagacccctgaaccgaataaggtgtacattgccgagcagcacaaggccaaggcagtggtgtttatcaccaagaagtatagtgtttctgacgatgtgattcagagagagaatgttgggttgacacgaatgtcgcctggcgatattttgacccctggctgggcatcggagaacatgtatgtgactaggttgacgtgggacaagtctgagaccacgcccaaaatccccaccatcccggtgtcgtggaaagatggcgaaatcttgttgaggaagttggctggtggcgttgactttgatgggtacaagagtggtgacggtaaatcgccggccgtagaattgagtgtgcaaaacattgaccggccaatgcaccaggtgtggaatgttgctgggtctattgaagggcgagaacagaacgaaaagggggttattattggtgctgctcgagactctggctgttatgggacgatgggcagtaataccggcactgttgcgttattggaaatggtaaagatatttacgtcgatgcagagaaagtatctgtggaccccgtcgcggtcaatattttttgtttcgtttgatgccactgagtataatttggccggagctgctgaatggatagagaatagaaaggagtcgttgctc

SEQ ID NO: 6117 - DNA, 183 bp, Candida albicans
agaatttggtctttcggtgtcttctgtgtcatgggtggtgcttactacttgatgtctacttccgaagcctttgacaacttctgtaacggtagaaaaccacaacaacacactgacaagagatccttggaagatttccttgtgtccatgcaaagagtatctactcaacacgaaaaatctacttaa

SEQ ID NO: 6118 - DNA, 765 bp, Candida albicans
ccttacattatggaattcttaaaaagacacgaaggtcatatgcatatgagtgattcagccacatcaatggtaacgtcggccacttcagctgttatggacatggcttcagcaacaatgagcatgacaatgtcatcttatacttcctcatcatcgggtatggctatggaaggtatggaccacgtttcttctcacatggcaatgaacatgtggcttacagcttcatttaaggattatcctgttgtgttcaaagatttaagagctagcaccaaagctcaagcttttgggatatttgtgttgttattctttgttgccttccttgctagaatgttggaatttgttcgaaactatcttgaagaaattgtttggaaaaataataattatgccgaagtagaacaagggatttctcaacatagtgccaatttacaatcaccacccgtcaaatcctgctgtgatgataatgcaaaagaagttgtttcggatgaaagtattgataaacaaaattccccacaacatgaagaaaccacaaaagctcgtggaaccggtaaatcattatctttggcatcaactatttctagagatattattagacttgcattatgtattattccagatttgtttgcttactccttgatgttggctgctatgacctacactttgacttatttctttgccgtggttattggctccggtgttggaagatttgttgctgaaagattaatggaacactacagaattaaaagaggtcctcctagaaattgttgctaa

SEQ ID NO: 6119 - DNA, 1317 bp, Candida albicans
gaaaagtttatatctgaagataatgataaaagaagctctagtgaagatagtgaaatcagagaaattgacttgaatgatagtaggcaggatttactaggagaggcaaatcggtcgttcagtttgaaagataaatatcagatggacctgcatcatcgtaattatatacccctcagatcacaagcaaatgatcctgataatttggatgaaactactccagcacctaaacaaatgctagaggccaaaaacacttttttcaaaccagcaccccatacttttgaaaaactaaatttgaaaagagcattcttcagaagcagttggcaaagaatagacttcatatctatggtttgtttttggatttcattatttttatcaatcaatcattatgatgcggatcaccacattatgttgtttagagcactcagttgtctccgtattttgagactttgtaacttgactactggtactaccactatcttgacggcatgtaagatagccatcccgcaattgattgacgtttcaatttttattgcctgcttttggttattctttggtataataggtgtacaaactttcaagtcttcattaaccagacattgtgtatggaccaatcctgacgatccaagtgacacatatgtaaattcaggtctgtattgtggatcttatattggtcttaatggagaaccagcggcatatttaatgagagatggtctgtcatccaatgttataaagggctacagatgtcccatgtattcacaatgtatatcaggagataatccctacaatgggacactaaactttgacaatatattgcaatcgttagagattgtatttgttattatgagtgcaaatacttttactgatattatgtattacactatggatacagacaatatggcagcctgtttatttttcattggatgtatatttgtgatgacagtttggttaattaacgtatttattgccattatagttgcatcattcaatattacaagaatggaggtggcagaagaaaagaaaaagaaacgtgaaggaagacggatttttaaaatatttggatacgccgatcaagatgtccaaatgcacgaagaacgactcgaatttttgaagaatcaaaatgtgtttttgaaatggtattataatctcgaattcttttttgtgatctgtgttatcattgatttatttgtgcaatgcttcagaagagcagatatgtctgatcgtagggcacatttattatatcgttttgaagcatcctttaccgggtctttctggttgaaattattttgcgttttgtgtccaccacggcctggatggtcccgc

SEQ ID NO: 6120 - DNA, 1158 bp, Candida albicans
  unsure (1124),(1128): Identity of nucleotide sequences at the above locations are unknown.
tctcgccggctggcgaaaacatcttggaatgtaattgattttgtggtgttgctttctttgtggatagaaacaattgcatatatgaaaaatgacgggaaattatcaagaattgttagagggttgaaagcgttgagagcattaagattgttaaccgttagtgatacagcaaaagctaatttccataatacaatgattgctggattttggaaaattatcaatgctgcggttatttccctctgtttattgcttccattttcgatttgggggttaaatatttttaatggacgacttgggtattgtgttgacggactgtctgacatgagctcttgttacaatgaatatcaaaatactgtgttcaattggcaggttgttactccgaacgtatataccaatcctcaattagaattcaatcgatttgcatcgtcatttgcaactttgtttgaaattgtttctttagaaggttgggtcgacttattaaacaacgtcatggctagtacaggggtcggtacccccaaagataccaatgcaacaccattccatggattttttgtggttcttttcaatttcatcactattgttttcattttgacattgtttgtatctgttatcattagtaattactcgagatcaattggaagagcttatatgacaactgatcaaatatcatggtatcgagttaagaagatattggtgcaagtaaaaccttcgaaaagaaagaatattgaaaatcttcattttataagaagattttgctacagaatgaccgttgaaagaaatcctgtttggacaagaaccttgaattgtgttttggttttgcatgtcatagcattgttgttggaatgtttcccatcatatgatagtttgaatcaatttagaactctgatttatatgattgcatccagtatgttttttgtgaattcaatcatgcttttcacaggacaagggttttcgacatttatgcaatacaaatggaacatttttaatttggtggtatccttaggtgcctttggaacaacaaccggatcatactttttggatcctaattccccattgataaatattaacaagttattcttggttgctattttagtgtttgtgattcctcgaagtcatagagtgcgtcnattnttaacgacgagctgcagataccctagtttt

SEQ ID NO: 6121 - DNA, 804 bp, Candida albicans
ggtatgcaacaatatgccacaaccacatcatctcgatcatttggatcaatttttttgattggatggtttatgttgtctaatatgattatcctaaatattttcattgctgttattgctaaaacgttagaggtctcagaagaagccaagcggaaacagcaactattgcaattcattgatacaatgacaaacaagctacaagatattgaacaagattccgggttgctatccaaaatcaaaaagaaattgttcagacgaaaacaagtaaaagatgaactagaagaagcagttgttaatttacttttgagtgggactgctgtgaacgatttcttggaaaatgatgctcgcaatgaagttgatgatgaagaagaagcaataagaacgttgcctgcatcgacttggaaacgatggttaggcgtaaattactggcgtacccttaatttgttcagaaacaacccattttatggaaataaggccaaagggaggaaagtatcattggagaattttaatccagccaattttgccagaactattgttaaggaaagaaaaaacattgttagcaaacaaaacgagttcttggaagctaatccacgatacaattatgtgttttatgttattgggcctcatcatccacttcgtaggttgtgtcaaaaaatggttaaaccaagttatggggaaagaattgatggtgttgctccttataagcccattgcagaagccatggttgtatggatgtccattgcaactgtccctttaattggtattgcatgttatatgaaacccaatcttccgtattggaatatggcg

SEQ ID NO: 6122 - DNA, 699 bp, Candida albicans
ttttaccaagaattttattggcaattgccattgtacacatcgtttgatacaagtaattgttttaatttgattgattatttggatagaaggttgttgatacaaaaagttatgaagcgtttacataccaagcgagtctatgaaaccattgctacatatgtttgtcgttggaaatttaaaaaggacaatcgattaggtatcaaggatacaaatcttgcctttgataaaaaattagccagaaacagttatttgcggaatgatcaacttttgattaataagaatccaccaactatatttgtcactgatgaaggtggaaaaagaaatctgagtgatataaatgtacgagattcctcgtctttaagtacagaaagaaactcggtgatttatggagagcatagtatgtccagtggtgtatattatcctagtacaccagtggctaaacttaatcattctcaacatgtgaaacattctcatccgaaattatttattgaaattccatcacaaaagcctcaaagagaatttgtaaccactgaagatgaagtaaaagtgtcaccgtttatggatcctgaagaggttaatgaatatgaaagtaaaaacagtggttcattagttgatgttggtagtattgaggagattcttgaactgtcatcttggaaaaatgcatttgatgaattaaaatctgatgaaaaaaggaaaaaatag

SEQ ID NO: 6123 - DNA, 375 bp, Candida albicans
  unsure (8),(19): Identity of nucleotide sequences at the above locations are unknown.
attgcttntactaacggtntaggtggtggtgcttctaaagccagaggggtgtttttggaagcttttggtacttgtatcttgtgtttaaccgttttaatgatggccgttgaaaaatcaagagctacttttatggctccattcgtcattggtatttcattgtttttgggacatttaatttgtgtttactacactggtgctggtttgaacccagctagatcttttggtccatgtgttgctgctagatccttcccagtttatcactggatctattgggttggtccaattctcggttcagttatagcctttgccatttggaaaatcttcaaaatcttgaaatacgaaacctgtaacccaggtcaagattctgatgcttaa

SEQ ID NO: 6124 - DNA, 1134 bp, Candida albicans
agcagtgtttcattatttcgtgtgggtttaaatgtcaagatactaacaaattttttttctaggccattgaaagatgaaaacattcattctattcaaataactggcaattttgacaattggtcaagatcattacctactatcaagtcgaccaaagaatatttgcaagagataaaattggaatctagacaagatgttgtgttcaagttcattattaatgatgaccaatggattgtcaatgatcaatttaaagtgactcatgatgaacatggcaattctaataatattatttacgctgatgagttggttgaggaatttgataatgagaacaaagcaaatacaggcgccacaagtgaatccaaagataaagaaaatgcaccggagtcaagtttatctgagacaactgttgctctcaaacctgaagctaaatctgcatccaaaccaattgctctcaaaaatgacaatgatgccaatgatctaccagaaccaactattcagaaagagcaacctaaatcaacagaactacatgaaagtttagaagcaattggtattgaagatcacgaaagttttgttgagcccgtggtatctctgaaatccccatcgaaatcaatcattactgaggatgatattatttctgacattgattcgcacggtgacaatgttcctaagaagtcaggcgaccttccacaaccatcctcaactcaacagacattgaatcaggttttaactccgtcctcgtcttttgcagctgtttcgtcacctccagtttcctccgattacgaacacctcgatacaaaacacgaggaccaagaaactgaatacaacactgccgctaattctggagtttccaccgacacccaaggaaatgagatagttagtacattccaagaaaataagccagtcaaaccagtattattgccccatgattctgaatctactcttgaaagaactggtagtgaaactaacacaaacaacaataactcacctcgtatccctggacattatccatctagtcctgaacacaaatcatcatcaacagcctcattacaatctggcaataacgctggtgaaaatgactcgcaatatacgggcaagcgtgaaagcttgatatccaggttgagaaatttatttagataa

SEQ ID NO: 6125 - DNA, 1239 bp, Candida albicans
  unsure (1204): Identity of nucleotide sequences at the above locations are unknown.
cggattctcttgtttaggccaaagggtcccgaagacgtaattgtcactggtactttcgacaactggtcaaagtctttaccacttgttaaacaaacagatggctccttttcattgcaagtcccattaccacctaaagctgaggatgttatttataaatacgttgttgatggtgaatggagaattaactctgacgaaaacatcaccaaagacgaaagtggtattgaaaacaacattatctccaaagatcacttgaaggagttaattgctgttccaggatccttaattcctgaatccggcttacctgtaactacaccaacagctcaaccagtttctgacaatcaagatactttgaagactacagtgttacctaaagaagaacctcaccacccatctcttgctggtgaaccaggaattgttattccaaaggaaaaagacgctttatcagcatttgaaaaggttgaggatgcagatgccaaagctttgaataagaatgttactgaagttggaactgccaacgccgaggcacaaacaggttctgacaatcaagatactttaaagactacagtgttacctaaagaagaacctcaccacccatctcttgctggtgaaccaggaattgttattccaaaggaaaaagacgctttatcagcatttgaaaaggttgaggatgcagatgccaaagctttgaataagaatgttactgaagttggaactgcaaacgccgaaccagattctctagttgctgttccttcaacaggtgttttagttgaaggctccgaattaacccctgaagaaagaaagaaacaaaagaaaaaggtcaagaaatcgcaatacaaagctagaaagaagcaaagagctgctgaagctgctgctggcgaagccaatagtactagtgacattgacactgaagaagctactccagagccaactactcaagctgaagagaataatcattcaaaggccgccgctgttggcttagctgctgctggtactggtggtgcagctgctgccacaattgctgctactactgcattggctgatcatccagacactttaggatctacaactaacgggggacatattaccagtaaagatcctgtacaaccacctatctacgaaccacaaacatccatcgagaaaccaaaagattctgttacagaaccaaaactcgattcaaaatttaaaaccagggcttaccagattncttcggaggagcgtagcaggtcagtgtccggatga

SEQ ID NO: 6126 - DNA, 1671 bp, Candida albicans
acgccggctgttaagacacgagcaaatgaatgccgagagagatttgaagcattagacagtttaaatgatcatgacgcaccggcattccattacggtacccattattcttcggcaatgattgtgacatcgttcttgattcgtctaaaaccttatgttcaatcatatctattgttacaaggaggcaaatttgatcatgcagatcggttgtttaattcaattgaacgagcttggttatctgcgtcaagagacaacactactgacgttagagaattaacaccagaattttattacttgccagaatttttggtcaatgaaaataattttgagtttggtaaattacaaaatggtgagtcgtcacatgacgtaaaattgcctccatgggcaaaaggtgatcccaaaatatttattgctaaaaatagggaagccttggagagttcatatgtatcggcgaacttgcatttgtggattgatttgatttttggttataaacagagtggagaagaagctgttaaagctttaaatgttttccatcatctttcgtatagtggagcaatcaatttggataatataaatgatgaggtacaaaaacgtgcagtgattggaatgattaataattttggtcaaacaccttgcaagttatttaatcgtccacatccattacgagatgttctcaatttaccaaattattatttaacccagtttgatggcaatgcatcacggttgaagcttgtatttgaatccaaattgaaagctcctatatccaaattggaaataagttccaaaaatgccaacagatgggttggaagacagaattgcatttcatgtgaagatgatttgttgattagaaaagccaagaaattaaaacatgaatgtggctcattgttagttaatgatactttgttcctaagtgtgcattcatctgatattacaacagtattacagttgggacataaattatttgtcactggtgccgaagatggtagcatatatgtatggaaatgtaatttgagaccaacaacaacccttcaatacgaggcacttcttaggggccatttgacaagtattttgaaaattgtctacaccaaaagttttaaatttggtgcaagtattgataaggatgggattgttataatatgggatttcatacgattcaaatatgttagaaaattgttcccaccagttttaactgaggagaacactacagttaatccattattagctgtgtcgaatgaaagtggaaattttgctactgttcattttaacaaacatctaaatggacaactccagttgtttaccatcaatggtgagttaattatatcgtttgagtttcctgccgttgatggacaaacaattgaagcaataacttttgcaaccacaaattcaattatggttgacaacacaagaactaataatgttaataaacatatttattggtcaaaagaaattcttgccgttgctcgaaagaaatcgattgaactttgggaattgattccagagaatggttgggaattgaaacaacttgataaagttgatttacaggatagaatatcgggggatattaccgttattgagctttttaaatgttcagaagttgatacagaagataaattaatcagaggaaatttgaaattagtgattggtgattcaacaggaaaagtatatactttataa

SEQ ID NO: 6127 - DNA, 2970 bp, Candida albicans
gtcaatacatttgtttatagattagatgttaatggaatgagttcactaaatacaaaagaaataaaagaaattgaattaatcaatttactatataaaaacttccccacattacgactcaatcaagaactaataatcaattggcaagttgaattactggataaaactagtgaattttcatccttatcttcaattgtatctgataatattgttcttgatatagatgcaattgatttggaaaacgaacccaatatcattgaaatattgtcatatctagaacaggatttgactgttaataataataaagatgatgaagaagaggaagaagaagataatgatgaattcaaggttataatattagagattcttatttttattatttcttcgtcggttagattgagaatattactgcataatactttagaatatttgattgattcatttttgaagaaattgagttttggtggtggtgttactttggagaatatcagacaacctagtattattagccaatatatgagattaataattctatatatggaatttggatgtgataccagacatttcaaaaaattaatcaacccattgatccaaaaaaataaccctcttgcaaatctcattttatcggaaatgttgttacaaatattcaccaaatatcatgctcaatttcctgttgtttcaataacaaaacgtataaatttcccatttagtaatgataatttgaagaaaaattttacaatccattcatggttcaaagtgaatcgacaattacataattttagtgaagatcccatgacattatttactatttctagttctggtcctgttaatgggaatggaaacgagcataatggagctacattaaaaatcaaattaatcaactacacccaatttatggttgaaataaaaaataatgtaaatggttcaaaaattcgatatacatttaatcatatcttacaagaaacagaaaaaaatcaaggattcattcactttgtgctaacttatgacaattatacaaatttgaatttatttattgatggagaatataatgaatctattccatgtcctgatcttcataaatatttgagcaattggaataaaatatctattggagaaaaatccgatgacatagctttaagaaataatgaaatcatacttcgaaatttgactattttgaataataatttgtcgtatgaatggatcaatttgttatataatttggggttggggtttgattgggaggtaaaagattttgctaatgataccacactacatttacttacccaactaaatcatcaaggattatttaacgtggccctaaaatttaatgaaattaaagaacagaagaagaatattggcgttaacaataacaataacaatagcaataacatgttgtttggttcctcaaccgatactacgaataacagaaatgctctcgcaacttttggaggcaccaggtttaaagaaagaagtttccagaacattcattttaacatgactcacaagcttgtgaataaagagaaaattgccaactcattggctaaaatcaaaggtgaccatgttacttttgattctaacgattttttccaaaatcttttgtatcaaggaaagaaaaatgtaaagcaaaatgtgacaagttcagtaattttcagcaatcagagatctatttatcaagcatttaatgttattggtggatcatccgttgtattacgaattctagaaacatcactcgaaatcacaaattctaaacttcgtgattccatagtatataccgtgttatccctattgctaacattattgtctaataattggcgattagaaaaagaatttgaaagtttcaacggatacggtatattgtcagttcttttaaccaaatacaaagatttcagcaaccaattgaaatttgataaagtgttggatgatcatgaaccagaaaccaatttgcttaatgttttgcttgaattttccggtcatgattttgagtatccttatgaatccgcagttgtgaatcccatcagttatcgtatactagtacttaattttgacttacattatggaacagaatcgtttgactacttattattccagatacatttgttattatacacatcaagacataaagagtataattacaatgagttacggaaaatgaaaatactccgcaaacttgttcaatttctcaaggaactgaaaattgatgactataatatgtcacaaacgtttaaagaacagttggctcaaacattaacaggaatacttcatcttgattcgtcggttgagaccattgttttattatcatcgtatattatttttgccttatataataatgatagctcaactatgtgcggtacaataactttacaagtgctaactgattatttatgtgattcgacaacttctataaagactttaaagaaattttcaaggtcgataactgttcattggattctacttttatttagatttcaagaatccgaagtagttgtcaactgtggaattaggcttttaactaaattgctcaaagtgttaggtattcatataataagaaaattcttccaattaaatcatggattggatgtattgactctgtttttgaaagattggtgggataacgagacagttttatgctcgatgtttttagcatcttttggaattgatacccaagataccaataattctgagctttctcaaaataacgatttgacagaagtattaaattcaaacataaacaatttacagcaattgattgttcccgaatttttattgttattaaataatttggttttgaattctatgtacacgttgagtctcaaatcggggaaattacttcacagtaatccttcaactccaatcaaaagtaataaccaagaaaatgtaacgttggctttagatgttcttcatttgatcaaccaatatatcacttcaataaaaattggatttgagaaatccaaattgttacaaaaattttatctc

SEQ ID NO: 6128 - DNA, 1134 bp, Candida albicans
attaaataccaccccagaattgtatcgtttattagaagacatgaaactttggaacaatttttacgtttaccaccagaacaaattttgttgcgttggttcaattatcatttgaaaaatgctgggtcacaaagaagagttaccaatttctctaaagatgtcagtgatggggaaaactatactgtattattacatcaattacaaccagaatattgtgatttatccccattaaagacaagtgatttgttgactagagctgaacaagttttaactaatgccgataaaattggatgcagaaaatatttaacaccaaattcattagtttccggtaatccaaaattaaacttggcctttgtggctcatttgttcaatactcatcctggtttacaaccaattgaagaacacgaaaatattgaaattgaagaattcgatgccgaaggagaaagagaagccagagtattcaccttgtggttgaactcattggatgttgatccgccagtggtgtcacttttcgaagatttaaaggatgggttagttttattgcaagcatacgataaagttcttcctggatctgtgtcttggaaacatgtaaacaagaaaaacaatggagaagtatcacgtttcaaggcattggaaaacacaaattacggggttgaaattggtaaagccaatggattttcacttgttggaattgaaggatcagacattgttgatggtaataaattattgacattggggttagtttggcaattaatgagacgtaatatcgttaatactttagctgatttaggcaaaggtggtcacaatctttctgatgccgatattttgaaatgggctaaccaacaagtttccaagggaggtaaatcttctaacgttagatcttttagtgactcttcattatcaaatggtgtattcttattggatgtgctcaatggattaaaacctggttatgttgattatgatttggtttacaccggtaacagtgacgaagagaaatatgcaaatgccaaattggccatttctattgcaagaaaattaggagctttgatctggttagttccagaagatatcaatgaagtcagaagtagattgattttgtcttttgtcggaagtttaatggctgtttcagaaaaataa

SEQ ID NO: 6129 - DNA, 552 bp, Candida albicans
tccttcccccccttctttcaagggggcgcgcccaccaatatttcatccggcggttataaatcctcatctgctgccccacctccaccatcatcgacaatttctggaaactccgccacatcaccttctgttgtttcacctaaatttaagaaaccaccaccacctatcccaactgccaatagcaagaacaaaactttccttgggggtaaaacatcaggtaccacacatactattaacgatgaagaaagaactgaatttacaagacacattaactctgttttagcaggtgatccagaaattggcgatagattaccatttgatactgagactttccaaatttttgatgaatgtagagatggtttggtattatccaaattgatcaatgattctgtgccagacacaattgatacaagagttttaaatttacctaaacctaaaaagactttaaacaatttccaaatgtcagaaaatgccaatattgtcattaactcagcaaaagctattgggtgtgttgttgtcaatgttcattcacaagatataattgatgggaaagaa

SEQ ID NO: 6130 - DNA, 1323 bp, Candida albicans
cgcggttctgtcagtcccgggcctaagaaaatggatattgttgctcatttaaaaggatttgatgaagaacgtagacaattgacattacataaaacattgattgatgaatgtcttgatattaatgccctgagaaaattggcagaatttgctgctgattttgaacaaacttgttgtgctgaaggagttagttttgaaggagaaagaaataaacatttacacgatgatttaatcattttattagcacgtgatgatttacatatcaatgataaaatgagacttgtattgatatatgcattttatcgaggtggattaattagagctgattttgaaaaattgattcgatttattggcgttaatgataaatatattactggattagtagaaaaatgttttaataatgttgaaaaattggggtttcaaattttcaaaaaaaatgttaaagataaaccatttcataaagaaatgtatcatgtgattaacaatgaaggaacatataatacttcacgtttcacccctgggatcaaaagaattatgcaaaatgctggtaaatattctttagatagagaatggttcccctatttccgtgatcaaccattagatgaagatataccaaccaataatactcgtatttctagcaccaccagcaccagcaccagaaccaccaatagtgctggcaaagatttacatactagtggatcattacgaaatcctagaataaaagctgcttgggcatcttcttcatcaacattatcatcatcaagaaacatcaacactttgggttcacaagccaaaaataaacaacgtatattctgttttgttgctggtgggatgacatatagtgaaatcagatcaatttatgaattatcatcttcaatgaataaagatttttatattggatcggaatcaatcctcaaaccccgtgatttcttaataggattacaaagtattgataaaaataaaacccctgaaaatttagatttaaatatttatcaagaattaaataaaccaactgatcctccattacatgtttttgaagatggaatacctaaaccgaaaaaaatcattaatcaacctcaaaatcaatttcaacaacaaatacaacaacaacaacttatgtatcaaaatactcatccaaatgccaataatggaggaaatgaacaatcatcaccatcatcatcatcatcatcagcaccaccttcacattatcaaaaaagacaaactccaggaggaaatcttgataatataggtaatatagggtcacctacatctacagttgattcaaaagagaaaaagaagagtagattgaaaaaattcttcaaataa

SEQ ID NO: 6131 - DNA, 2919 bp, Candida albicans
ccaatcaatcaatacattgaacacagtatccaacccaacccaatcaatatcatgtttgatttaaatgcaagtgatgaagaattgaagtctaaatatggacttcgaaatatgcatcctactgatattggtgatgtaacttattttgatacccccataccagaagatttatctgatttgactcctcaacaacaatatgaattacttattaaacttgttgatttaaatcaaccatcaccaagccaagctggggatgctaatattttattggatttaattattaaacaagacacatctaaatctcaagccatacgagattccaagaaatctttatctcaatttgaacatcaagttcataaatataatgaagatttgaaaaaaataattgaatctaattctatacattttattaatactaaatggaaaatcgataatgccatgattgattttatgaaactgaaaactaaagctcaacaagatcgtgctagtagtagagtgtttaatccccaaagacgaaatttaactaataaagaaggacttacagctgaacttgaagataatattaatagtttacaagccaatacatcatcaatgattcaacctattattgaaagtaaagctaaagaagataaagttgttaaaatgattgaattcactaaagccaatcaaaatttttttgatttacccaatagtttagttcattcattatcacttaataataatgaaaaattcattgatgattataatcgatatattcatgataaagatcgatttttaagtgtacttaataatagatatcgagatcaagttttaaaattgactcatgataatatcaatggtaaaaatgaccaagcacttcgaaccatagaagatgatcggaaattacaattaacattaattctgaaagttttcaaagaaattgatactatagctcataattataggaataaaatttatcaagaatttttatcattagatcatgaagctagtaaaactcaatcaacatcaaaatttatgtcattagtagataatttatcacgattaaatcttgatgataaaatgaaaaatcctattgctgattttttgactaaacaaattgaagccattgataaagattttgaatatcaagtggaaaaatttgatagtaaatttttacttatgcaaaataaattaattgattatattggttcattaaatcccgaaagaagagaaggttcacatatcaattatattaatgaaaaatatgatacttataaagatgaaatcaattctgctactataaatggagaaaacaaattaatgattattaaagaagcatttgaaagtaatgattcattagatttaagtcttattaatgaagcatggttagtattatttaattttataaattatttggataatatggttttatcaaatcttttaaaatttcttaataattatgttcattatattaaattggggatagacagtcaggggaaaatcagagattcagccattgaattgattaataaagttgttgtaatcatgatggctttatttgatgatgaagataataataataataataataataataataaagaaaagaataattctaatccattggaaagttcacctaaaaattataaacaatttgttccttattatacaaattctttatcaactatatatcatttaacaaaaatcaatcgtattgttaataaaattatcaataattttgggaattttgttggtacaataggtaatattagtcaatattctgaaactaataaagtgatgaaaagtttgaaaaattcatcgacaaaaatcaatcaaaaaattcttgaagcaatatgtgccacctgggttaatgattgttcacaattttatgaattagaagattggactttagataaacaaaataacaaacataataacaacaacaataagaataagaataataataataatagtggtaatgctaaatgtactaaattaatgaatgtcattcaatgttatcaattatatgttttgttgaagatttctaatttagtaattcatgatcaatcatcggattataatgttgttgccgtttatcctagtaaaagaatgttagtttctattgaaattcaatttatgagaagtttaaatattattgttgattctatgatgaagaaatataatttagatcgtcaaattagtcaacaatcttcaaacaatatggatgattctaatgctaaaaatttacaagttttcaaaattttgacaatgaataattttgataaattatcaagaataatttatccggaattattattacaatttgataaatttttcgataaagatttactgaaacaaaatttgaaattatttgctgatattgataaagcaagtttaaccataattgatgatattttaaatattgaaaaattatatattgctcaaactgtcaataaatttttccataccaccactggtgccaaagccaaagccaaaggaactaatattagttatacttcaccacaagttttaaaagttgatggatttgtttatgagattttaattcattttgttaaacttatcaataagatcaaaccattaactaatgaagaagtatttgtcacaattattaatgaattacaattgaatttattgaaaaatattcttgataatactcgtcaaatacttttaaaactgtcattagcttatgttaatttaaaattagatgcaaattttattttacttgtatttgaaaaatcaaaacttttacaattaaatgattcaagttataaaattttacaaattttattaaatgaaattgataataaaaataatgaattatttaatgataaaaatcaacaatttaattattctaaaaaagattttgatgaaattttacaattaaatatgcaagattctgccaatgaatttagttgcttctag

SEQ ID NO: 6132 - DNA, 1596 bp, Candida albicans
caagtattgccaaacatgagagtgaagaagccaacatccaaaagaactaccactcgtatgagagaaggtatcaagaaaaaagctgcagctaaaagaagaaaagataaaaaaatcgcaaagaaagacgttacatggaaatcaagaaaatccaaggatccaggtattccagccagttttccttacaaggataaaatcataacagaattggaagaaggtagaagaatcgaaaaagaaagaagagaacaattaaaattacagaaacaacaagaaagacaagaagctttggcaagaggagaaattgttgaagacgatgatgaaatggatgaagatgaccaagaagaaggagatggagctaatggattagctgcattattggaatcagctcaacaagctgctaaagattatgatggtgaggactatgaagacaatgaaaatgaagacatggttgattctgaagaagatgtggaatatgaaatcagtgacatcgaagatactcaagacgaagagtttggggaattggagaaatcacgtaaagcttatgacaaaattttcaaaactgttgtcgatgaagctgatgttatattatacgttttagatgccagagatccagaatctacgagatcaagaaaagtagaacaagccgtgttgcaaaacccaggaaaaaggttgattttagttttgaacaaagtcgatttaattccaactcatgctttgaatcaatggcttaatttcttgaaatcatctttccctactgtgcctgtcaaagctgcacctggtgccactaattctacatcgtttaacaaaaacttgacaaactccatgacatcggatgctttattgaaagcattgaagagttacgctagtaaatctaacttgaaaagatcaattattgtgggggttatcgggtatccaaacgtaggaaaatcatcaataataaatgcattaaccaatagacacggaaacaattccaaagcttgtcctgttggtaaccaagctggtgtcacaacatctttaagagaagttaaaattgacaacaagttgaaagtgttagactcaccaggtattgtgttccttgatgaaattgtaaataccaaaaaacaatcaaagacacagcaattagcaaaattggctttattatcagcaatcccaccaaaacaaatagttgaccctattccagccattacaatgttgttgaaaaaattttccaaagacactgagatggctgatggattgaaaaacttctaccagttgccaccattgccatcgagtgatttaaatgaatttgtcaaacatttcttaatccatattgccagaagcaaaggaagattgggcagaggtggtgttccaaacttagagtctgccgccatgtctgttttgaacgactggagagatggtagaataattgggtggactttaccaaaagcatctaaaagtgctgctggtgtttcctctgaacaaattgatttggatgctcctaagagttcattaagaggtgaaaaagagccacctaaagttgaacaaactactattgtttctacttgggctaaagaatttgatttggatggtcttctaggtgataattttggtcttcaatag

SEQ ID NO: 6133 - DNA, 1008 bp, Candida albicans
gatttaattaattctcaaccggggaaggagaaatattcccggatagattcaaaaccgtggatgtttctgtggttttcaagaatttttaatcggtcatatccctcacttaggcctgtaccacgggagagacatattgacgatgcagaaaaagattcaaaacgtttagccggttatatcccagcaaaccaaatacctgaaatggttattgtttctcctagttgcattagtgttaaatcattcaatggaccaaatttttacaatatttattgtgatggacgtggagtttattactgtcaatgtccattcaacagtttttcaatggattattgcaaacacatttacttgtataaacgttatcaaaaattgaaagaagagggagctattattgtccaacaaccaagtattgcaactaatattcatctgaatgctactcctttggttgaaggtagaagtgatccagccaattcagtccaaaatagtattccaagaccattgaccggtaatgtagaatctggtgcatcactgctggccgatgacgaaaatgatgttgtttttgtaaaggaaagaacgattcctgaatcatccaagagtgaagaaagtgaaatcatacagggggtttatagtgagaaggttgctagaaatatccagcaatgggaagagaataataatagtcttgatgcggaggtcaaaaaatccgaggataggttgaaaattcaaagggaaaagtatgaaaaacagatcaaatatgctttgaaacaaatggaattagctagaaaagaagaacgggagtatcaactccaatttgcagaaaatcataagattcgaaagaaacgtgatacggcaagaataaaaactaaagagcataagcaaacgttggagaaaatacgaaaaatagaggaaatgatccgaagtaataattgcaacgagatcgataaaaaggcaaaaattcatgaaatcaaacaattgtataattcaaccgccccagatccagttacagcatcaagttga

SEQ ID NO: 6134 - DNA, 1971 bp, Candida albicans
ataacacatatcggtgttatggagtattcacattacccatcggcccttccaccttccaatacgaattttggtacagttaaacatcgtatacttgttttgtgtaaaaagaattctggaagaatgcaactacaaaaggggaagtatcaagctgataagaatttctaccaaattgggagaacatgggatctatcggaactacaatatattaaaaaagttggaccagaagggttgattctacaattaaacaaagtatattattggaaatgtgacgaggatgctaaccgtgtgtggaaatttgctcgttacttaactcaacattatgggatgtttatggggaaataccctaggcttgaagggttttcgcttgatgatttcatgttacctacaatccccaaatctccaacaactactgtacctagatctccttcattaaatgagccgaatcctgatcctcaattgttaaagtcacgttcattgaaaagaaagaacatgccgaacccagtcttaccacaaccacctactgcaccagcaacgaaaaccccaccaatgccttccaaaccggaagaattatacaaagatatggactttacagtcaatggtgcgttgcctcaaaaacaaatgaaggtgatactgcgtgagtcgaatgatagaggctttgctagcaaacttgaccctggccgatccgttcatgaacaacaaaagccccaaggcagtcacctgcaactgggctttaacagcccaagccaggatggtactcatcaagcacctccacctaaaaaacacagtcaacatccatatttccaaaggtcaccaatgaatggaaccgattcttccagtgttgttagtaatgattctcatagctttgtttttggttcaaatgatgataaaaaccaatcgcgagaaagactggataatagctcaaggtcttccagacaacaacaaggatccataggaactggttcacagtccacaaataccaagggtctgcaaaccaatagctatgcgagtaaaaaacaagaaagggaatctgttgcgtctcaaaaatctgcagaagatgttgtcaaggaattttcagaagcgatcccaccaaaaagaaaaatggctgcttcagcaacagttcctgattttggtgttgaagagattaccgatgacagtgaagatgatcaacgacctgctcctacatttagtatccgtaagcgccagcagcaaataaaggctcaggataagaaaaatgaagagacccagaaagttacaaatgaacaaccaatacgccaccaccatgaagatgcaactaccagttttgctgacaaatccagtcattatgacgagaaaacttttgcgtctcaaaagggattgggaatttatccagctggatccgggtcctttattgaggaatctacgaaattggaaggtcaaaacagtgctagttctaatcttcaagatttacaagatttattatcgtcacatattgatagagcccaagaggattcttttgattttaatgatgtcagtaacgaaaagagtgctgatgacttgaatgaaattcctgaaattcgtgtagctggcccatcaaacaatttgaatggtgacacaaatagttttgaaggcgaaccccttgaaaagggtttgaatatagttagaaagtcggaaacaccagagaacgaaaaagtcaacccatcgtctatcattccaaaagaccaaagagatgttgaagtagacacattaattaatcagattgggtggtcggtcaaagataccacagatactttgatgaaaaagttgagtaaggaattgaataatagtaaacaggatattgtatcgaaattggtgtcaatagacttgaccaacaattcaggaaatgatatagggtctgctttgaatgaagtggataatatgactcagattttccagaagatggaggtgagattgaaacttgtacgaaatgagctacaaagttctgctactgcttga

SEQ ID NO: 6135 - DNA, 1269 bp, Candida albicans
ctttttttctctcgacaaaaaaaaaatatacacttcaccctttacccaaccatggacgaaaactacgacgttattgttttaggtactggcttgaccgaatgtgtcttgtccggtatcctctccgttgaaggcaaaaaggtgttgcacatcgacagacaagacttttacggtggcgaatcggcatccttaaacctctcccagttatacggcaagttcaaaccaagctcccaaaaacccgaactcaaaggcagagacagagactggtgtgttgatcttatccccaagttcttgatggccaacggcgagttaaccaacatcttggtcaacactgatgtcacccggtacatggaattcaaacagattgctgcgagctacgtctacagaaacggcagaatcgccaaagtcccctccaacgccaaggaagcattggcttcgtccttgatgggcatttttgagaaaagaagaatgaagaggttcttagagtttatccaaaactacgacgaagccgacgcatcgacccaccaagggttcgacttggacaaaaacaccatgaacgaaatctacacttattttgggttggaaaacggtaccaaagactttattggacacgccatggctttgtggtcgaccgacgactacttgaacgaagtcgcccgtcctacttacgaaagaatcatgttgtatgcttcgtctgtcgccaagtacggcaagtccccgtacatctatccattatacgggttgggcgagttacctcaagggttcgccagattatcggccatctacggtggcacatacatgttggataccccaattgacgaggtattgtacgagggcgaaggtcccgacaagaaatttgctggtgtggtcacaatagaaggtaccgccagagcacccattgttattgctgacccaacctacttccctgaaaacgttatcaagaccggcgctaaagttatcacggccatttgtattttggaccaccccgttccgggtgtggagttagactcgttgcaattgattatcccgcaaaaccaagtcggcagaaagcacgacatttacgtagccgtgttgtctgacatccactgtgtccttccgaaggggtactaccttgctattgtttcccccatcattgaaaccgacgcaccgcacgtcgagttagaaccggcattccaattgttggggcccagactcgacccattaatggggattgcccgattgtacgacccatttgacgaccgtacccaaaaacgggatctacctcccccaaga

SEQ ID NO: 6136 - DNA, 240 bp, Candida albicans
  unsure (85): Identity of nucleotide sequences at the above locations are unknown.
ccggcattcaaattgttgggcccaagagtcgacacattaatgggaattgccgagttgtacgagccaattgacgacggtaccaaanacgggatttacttctccaagagctacgacgcttcgtcacatttcgaaagcactacagacgatgttaaggatatttattttagaattactggcaaaccagtggaattgaagaaaagacctactgccgaagaagaagaggctctccaaggtttatag

SEQ ID NO: 6137 - DNA, 513 bp, Candida albicans
  unsure (21),(404): Identity of nucleotide sequences at the above locations are unknown.
cgaatttacacaacaccatgngagagactcgattcaataaaggggagtattggggaggtgcaccaagtgcatgatagtacgattggggaggtgagggagtacgatacgatcaagaagatgactatggtgaaccagtttttacaccaagtggggagtttgtatgaggatatttctgggttcaagagatttgttgaggcattgaacgaggagatccaaagggagttgcaggggttgcagaatgacttgaagtacccgttaccgaactttgttaggatccaccatgcatatactcacgcaaggaattttgttgactatttggaggtgtactcgacgaggttgtcggacgatttacagtcgattgtgtataaggttgtttcgccaatcaagactacgatcaacttgtntgatgagttgctcaatgaacggatccagagtctgactgaggtgaccaacgaaggcaatttcgagtgttttttcaatatcttgggagtggtcacatgggaacgagaatga

SEQ ID NO: 6138 - DNA, 1152 bp, Candida albicans
agactgtattataaccggttgcacgattttaccatggaccttattaataccgacccgccagccgaagacttgctcaagatcttgctgtatgactcgaaatatggtgcgtttgtgtctgagtttggcgttaagcaaaagtcgataattggcgaagagcttaagaatagtgtgttggacgattatttgaataatattacgaccaaaatgaaggagtggaatgataatttgattcgacaagagacgaaaacatttaccgaaagaccgaatgcgccggacatttaccctattgagctgacgattgaagatttggatgctgataagaatgaggtgcagctcacgatcgaccttaatgtgtatgttatgccagatttcaagattgcgttgacgatgcttaaagagcaggctgatgttgctgcagagtccaagtactcgaggattttggtggaggtaattgagagctggtcagaatgctatgtcaagcgtattgccaattttagggaagtggttgaagacgagatggaccggtacatgtcggtgtttaacaatgaagggtacttgattaaggagagtaaggcgaaacggttgttcaggaagaagccgccggtggttgacattgacagtttgtcgccagaagagcagagcaagctcctgagggaggggttgattgagtacttggcggcgttggcgaactcgttggacattagtgatgatataatgaacgacaaatttgccccgacatacaaagagaaagtgcacaccaactaccatgcacggattggtaaggcgtttgatgtggcgtcggagagttctaacgcgttgatttctgagatattgagtgcaatcaccgacataatcatgaacgatttgacgccggcgttgtgcaagttgtttacgaaaaagtggtatgaagatggacactcgcaaacgggcgagccgacgcttggtaagcttgtggtagagacgattagcgagtatttgggagagatgagacagtactgtgtgtacccggtctaccacttgttggtttgttatttttttggggatattttattcctacgtatattagaaatgggctatgaaaaatatcttgcatgggcgatggggaaaaagaatggatcccccgggccacccaaaaattataaatccgtttaa

SEQ ID NO: 6139 - DNA, 1839 bp, Candida albicans
ttaaccaccaggaaacatgaagtggagaatggattgaaactattacaagaggttagtgaaaatgccagcaagatcaatgatttagagaacttattaaataattcaattgaaaactctccaggagggataaaactgtatttaataaacttgaaccaactgaaaaatttattgtcacaaattaaaactcaatccaaattcaaacaattcaaaggcattttatataattttgaaaacttgattgatcgttcagaaaccaaagtacaaaaatattatcaagatttaattaatggaaaagattctcgtgccattatcgacaaacgtgatgaaattaaattaattttccaatacttctccaaccctcagaccaaatctaccagcaatagtggtggcaatgaagagtatgtcacaaagttgtatgtgcgggcaaggtcaaaacgattgattgagaaattgaaaccaattgaatcatcaacaaagccagcagtgaaagcaaatgctaatataccttatgaaaagggaaccaatggaataactaaatatacagatgttttaagtggagaaattgaacaagaattgataatcttaaacgaatgtcaattatctacgcatttgattggacctatagtagaagaatcaatcctgagatataatggcattatcaataagtacaaccaagtttatttcaagactcctcaagagattgttgacaatgtaatattgatattagaagttttgaataatttgattgatttcaaagttaaattgaaacaaattgggttgaatagaacattggagcagtccaatttcataaacacgtttgaacaatatttagaaacgaattctgtaattttcaaggaatttattcaagctatagacaacagatttcaaaacttgggcaagttcaatgaaattaacactcaagaagtgattgttgaattaatgagtaaattacgtcgtttgagtgaattcaagttggcattattacaattgattaagaattactctattggacaatggctagtgtcacaaccgccaatgagatttgttaatgttttctcctcggtgattcccaactctcaaccacaagctaatagtgatggagaggaagatgaagtaatacaagaatatttgttgtcgtcattttactcagatgtcattgatgccataatgataaacattgaaattggattaaagaagaatactagtggtggtgattcattgccactgtcctcttcaacttcagcatcgacaaatgcaacatcaggaacatcatcattgagtttaaacaaaaagtcaacccaagggtttattttgattaagaatttatttatgttggaatcaatagttaaccgatcacagtatttgtatcagagtttaggaagtgtgggagaagacagaatattacgattaaagaatcgatttttggaaattatttcccttgatgattggagtcacgcttcctatattattattcgagacatgacaacaattgctactcagctggcacagcaccaacaatcacaacaacaactgagtaataccataggaactggtggtgggactgttacgaatttgtctaacaaagaaaaagatcaagtgaaagacttgtttaagaactttaatgaatcgtttgaggaggcattatttaattatcaaaagtacaattttggtgatgcaatattaaaaaagtatttgagtaatgaaattaagaaattaattttgaacacttatttcaagttatatgacaagtatggtaattctgatttcacgaaaaataaatcaaaatacgttaagtatgataaattgaattttgaaaagttgttgaacgagaggttatag

SEQ ID NO: 6140 - DNA, 1569 bp, Candida albicans
ggtaaatcttgccgacacaaaccaaaccaaacaaaccccatttcaagtccttacactatcatgctaaaagaaaatgagattatatctcgagcgcttgttactattgacaacttcaagggaagtctaaaggcatttaaatcatctattactgatggggggtacactcaactccacatgcccaattgtttttcccgaacattggtgtggaaagtatgtttgatcacagacagtttcaagatcagtacctgggaatccaaactcaacgattccatagttgtttttgaccagctaatcatcagatatgatatgaaattaccttggaacaaacttgatctggacagcgtattctatcattctggggatttgtccataaaatcgagtataacaaggaaactgtcatcacgggattcaaaagggttacataaggtgtcacttcttagagtaaacactacagaggatccattgtcttcatcagctcaattgctgggttatgtcaacaccggtgacgatcttgagttgcttcaaacaatcatactagatatcgatcgtttatttcctggcgaagactttttcagcgaatccaataaatattccattcatcgcaaaaaacaattgattgagatactatatttatggtcaaagtgtaaccctcaagtcgggtacaaacagggtttacatgaaatcttggggttgatatacatgaacttgtcacaagaatctgtggatatttctcagacaaacacgttttctagcgatgacatgaaaatactcagtctttacaatgttcactacttatgtcatgacgtttttacaatattcaacaaatttatgttacagagtggtaatataacacatttttatgcaagcgaagatgcattgtggaaatcaattgaaaatttcaacgtttatttgatgaaaattgaccaattcattcattataccttaaacacaaagctaaacttagaaccccaattatggataatcagatacctaagattattgttgctacgcgaattaggaagtgatttggaaaccacaatgttgttgtgggacaaattggtatcactacaattaccgataaatctgggaaacagtatttcttcaattcctgacatattaaactttatgatcattcagttgcttatacaagtcaaaacagacatattatcaagcgatttcagcgaatgcttatcaatattgttgcattatccatttaaacccacaactcagatagaaaaacacgagtttgtgaaaaaactattcaaagatgcagtaaagctttatgagaagcgaaacgatgatttaaaactttatgagtatggtatacggttaaacaacagatataatccaaatttgaaaattctcatgaattatacaaacggtgaaagaagcagtaccgagtcagtgaactccagtcgtgctgctagtccagcacctggcagcaatcctccacctacttctgcaccaccatcactttctagctcacgtaatgacaatatgaaatttgaaaagatgagattagaaatgagactaaagaaaaaagctcaactgatgattaaccctaagtag

SEQ ID NO: 6141 - DNA, 1752 bp, Candida albicans
cagaaaatggtgttaacccattccacagcaacagatggaactcatattttctacaataaagtatcagggaattatcttattttaacactgggaggtggtgttgaagtttctcaaaccattccatttgtttatcaaaatcttgccaatgcaaaaaccatttcttgtattattggtgtaatcagattgaaattcaattcttatgtcattattgctgataaacattccgtcactggatcaattttgggtcatgatattggatttattgaatcatttcaaatcttacctattggaatcaatgatttggcgaaaaagaatttagaagaattgagttatttgaagttattaactacacatttgaataatgctacattatattattcaatcgataataaatatgacgtgaccaattcattacaaagacaattcaataaaagtaatactgatggagtggtacctgtcgatgatagattttggtggaataaatatttgacacaagatttagtaaataatcatgttggtaatgattttgttcatccaattatttatggatatttcaagtctcattccgctgttttcaatgggaaatctttacaatttgccttattgactagacgttctactttaagagctggaacaagatatttccgtcgtggaattgatattgatggtaatgtagccaattttaatgaaaccgaacaaattttcatttctgatgataatcatcttttttcacttttacaaactagaggatcagttccagtttattgggcagaaatcaataatttaaaatataaaccaaatttggtcattagttctcaatcttcattagatgccactgaaaaacatttccatcaacaagtttccttatatggagataattatttggttaatttagtcaatcaaaaaggatatgaaaaacctgtgaaacaagcttatgaatctgccgtgaataatttaccagaaaaattgggtcaacatgttaattatatttattttgatttccatcatgaatgtaaggggatgaaatatcataaaattaatttattattagacagattaatttccttagggtacactctgaataattattttgaatatgatttaaatgctaataaaattatcagattacaagataaaatcgttagaaccaattgtatggattgtttagatcgtacaaatgttgttcaaagtactattggacgttgggtattacaaaatcaattgacagaaactaattatttatcatccaataatgttactccttttgaaaaattgaatcctcaattcaatttatttttccaaaatttctgggctgataatgccgatgctgtatcttgtgcttattccggtactggtgcattgaaaactgattttacaagattaggtaaacgtacttacaagggaggattaaatgattttcttaattctgtcactagatattataaaaacaatttaactgatggtagtagacaagattcttatgatttattcttgggtaaatataaaccattccaagattcagttagatcaccgtttattgatagaagatctccttataatcaattattaccttatttaatgggtacatcatttttgattttattggcaattatttatttccctaaaggttcaatttgggattggaaaaatttattcattatggctttttgtattttatttaatttgaaaaatttatcatatattaatagtcctggtcatcaatttgttgattatgagacacgaccgggctag

SEQ ID NO: 6142 - DNA, 2385 bp, Candida albicans
ccacacatccccacttgcccaccaaggatgagtttttctatttatgaactagatgagaatataaagaaactactaacggtagacaactacctcaatgggttgtcggtcaacgattttattgaagaaatcagtaaagatcattttcttaaaggtgctgaagtcaacaacaaggcgtaccttgatcccaagccatacatcagaacttttgaaagtactttgagagaattgaaacaattacaagcagaggccaatgaacagcgagtaaagaatgagagacaagtggactcgtatgagttgaaacattcggagaacgttttggagttgaaccaacaaattgacgaggcgaccaagaaatttgatatattggacacccagatcctggacgtttctacgaggattaacccattagggaatacgttgaataaaattaccaattctcgagatcgatcgttggagaccatttttttgattcgtgcgtaccatgggttctttatgaaagagcaatacttgccgttggagacattgaagaatagcaaaaagcttgacgataagttgaagtgtgccaagacagttaggaatttgctcaatttggccaaaaaagtatctgacgagaaactgccgaaatcaatgaaatgtataaccacaattgaacaatttggagagactatggaaaaggagttactccggaagtttgagattgcttctgaagatgaggacgatattgattttgatatgatgaaccagattgcccagatattgtttgagtataacgaagggataaatgtgattcagacgtttgttattaagaatgatattgttattgagaatgaggaaaagtcgttggacgaacaagagtgggcgttgttggcggattcgcggaggtcagatttcaaaatcgacgagcaggcaacatttgatactttaaagtttgaaatcaagtcacgagcaagaattagtaagaaagtgtttgctgacccaacgcctgttatcaagatatttatccagagaatgtatgcccagattattaggaacaaggtgacatcgttgttgcagaaatcgttgtcggtgagccccttggcgcacgtgagggtgttgcattcgttgtacacgttagttggagatttcactgagcaaattaaggattacttgaccactgaagagttggataaggatcaggaactttcggccattcttgaccagtcacacagcgacttgtttgttgagtatattggggacaatgtatatttcaaccgcgaaaagaagaacctcgaagagactatttatgggatcattcaccaattcaacactgccaacgagaatataattgccaataagagtttggctgcgcgtttggagaatctggacaatgtccagaaacccgaaaaggataggtttagttttgcttcagagaaaaagagaatgaaccagtttaagcagtatgtcaatgccaagtttaaggaccgcacgagaaactctgagcgtgaaccgacatttatggagtgcaagtcgttgaatgttggcaatgttgagattgtgctcaaatcggtgattgagtctgtggctaggttgttggagttggtgcctaccaagtcagccgattatgctttggaggtgttggagattttgattattgatttcggtaagctttatattggtgccgggcttgaggttgtgtatgatgagtgcaagaagaatgcgagtttggataacttgtcgtcgttcaacactattagtgagttgttgttcctaatgtcgtcgtgcatcaagaggattatcttgccaattgccacaaatatccccagcataaagacaagaatgagcaatatggtcaatgggtttgttgctcagtgtgagatctccttgaatgttattcttaacgatacgttagaccattttcgagtcaagcttcagtcgcagttggccaagccaaagaagagggattttaattgcaacaatattgaagacgacactgaagcatgtgagcttgtgagcaactatttggtggaaatacatagtagtatcgtgtcggcgatgaatggggccaatctcgaaaagatattgatcaagatcgggatggaggtgttgcaccagttgttggagcactacaaaaagtttactgtcaattctataggggggattgtgctcaccaaggatgttattcggtaccagtcggtgattgacgggtggaaaatccctgaattgtcggagcagtttcaaatattgagagagattggcaatttgtttacggtgcagaccgatttggtaaactcgttggtcacagaaggtcaattggccaatatgaagccatacacggtgagacaatacattaccaaaagagcagatttcaatccaagctatgcagataaatttttcaagttcaaatag

SEQ ID NO: 6143 - DNA, 387 bp, Candida albicans
ttcaatagtgacactatatcaacaactatgaaactttcatcggtgacacctttattgttgactttacttctgtttaccactgctcatggtggccatggtcatgaacaagaatcattaaaaatcaagccacaagatttatcatggcaggattggcatatgaaggaagaacatgggttagaagaatatgatgggaaaacatttttcatattacatgatttgaataataatggtatacttgaatccaaagaaatattgaatttgtatggattggtacataagatcattattggtgatgggtcaggaatgggacaagataaaattgaagtgactcctgaacttcaaaaacaagttgttgagaatattttccaattgataccccatggcaac

SEQ ID NO: 6144 - DNA, 285 bp, Candida albicans
agacaaaatggtggcagattacctgatttgggatatggaccaggccaccatttaggatttgaggaagaatatgaagaacatcattggagaaaataccatgctaatgatgatcctgatgtcaaaataaaacataaagaagatatcgaacatgagttgttacatcatcaacaagagattgaagagactcacgatagatcgagtcgattgaaaaaatttgctggtgattactggtcagagatcaatatcgacaatcttaaaccaaaatatagaaaacaacagaaatag

SEQ ID NO: 6145 - DNA, 576 bp, Candida albicans
tcccgcgcggatctgccattccgtggtcaatacgaatcggtaacttctgcgaatgctagtatccgtcaaatttgtacaaatgctattggtatggctgcacaatacggaggagatggttatgcggaattttgtctttcattgttagaacctatgttcaaaatggcaatggttcctgatgctagagcggatgagaatgtatatgccactgaaaattgtgtttctgcaatcgctaaagtttgccacagattttcaagttctgttccaaacttggatagtcttattgaccaatggatttcattgttgccaattgttcaagacgaatcagcagctccatttgcatacatgtttttgagtgagttaattgatagaaatcatccatctgttttgaaacaagttccgaaagtagtggagtctgtgattcaagctttagcccatgcatcaatatcaggaaacactgctcaaaaagttgtaatttcaacaagaactttattgggatccattcctcatgaagaagctgttgcattgttacaaaagaatccatcagatttggatgttgtacaaaagttttttagttaa

SEQ ID NO: 6146 - DNA, 1710 bp, Candida albicans
accaaagaatattttaaagtcatgacagtgttaccgaacgaatatcattctgcactcacacagcttttagagaatttgctttctactgacaatacaatcagagctgaagctgaaaagtcactcgaccagaactggacatccaaagacaatgttgaattattattagtatttttggctgaacaagcatgtcaaggaaataatgacactatacgtgcttttgcttcagttatgtttagacgtatggccataaaatccccgaaagaattgcaaagtgtcactgatagaacaattggtgttattggagagccagcaagacaacaaattagaggcattttgttagctggatttacctcaccacaatcaaatcaggtcagacacaaactttctgatgcaatttcagaggttgccaaagaagatgcttctcctgcaggaacttggaatgagttgatacctgctttatttgaagccaccagaaacgaagaccctagtttccgtgaatccgcatttagagttttttctgcatcacccgagttgattgacaattcctatattgatgaagtcttgcctgtgtacaatgctggatttgaggatgcaaacgatgatgtgcgtattgctgcttgtactgcctttgttgcatttttcagaaaactcccaaaaaatacttggaaattgttgtcaccattattacctaacttgttgaactcgttaccaagatttttgcaaaacggacaggaccatgcgttggcttctgtattagaagctttgattgatttagtggagttggcaccaaagatgtttaaggatatgttccctactattattgagttttgttctgcagtggcaaaaaataaggatttagatttgaactcaagaatggcagcattggaattgctcagcacttttgctgaagtttctccttcaatgtgtaagttaaccccaacatacactgagcaaatggtactcatcacattatcaatgttaaccgaagtctgtatagatgacgacgatgcagccgaatggaataacaaagacgatagtgaagacgaagacgaagaacaagaatatggtgccgccagacaggctttggatagagttgctttgaaattgaatgggcaagctttggcaggacctttatttcaatatttacctgctatggtactgtcttctaattggagagaacgtcaagctgctcttatggctctttcttctgctgcagaaggttgtgctgacgttttaatgaatgaaatcccaaagattttggacatgatattgccctcattagaagacgaacacccacgagttcaatacgctggctgtaatgccttgggacaaatgtctactgactttgctgacgttattcagagaacatctggcgatagaattttacctgctttgatttcaaagttgacaaacaaatctgttccaagagttcaagctcatgctgccgccgcattggtcaacttttcagaggctgctacgaaggaagttttagaaccgtacttggatgacttgttaaataatttgttgattttgttgcagtctccaaagagatacgtgcaagaacaggttttaaccactattgccataattgcagatgctgcagaaaagacgtgggttgaatactatgacaccttgatgcctttggttattcatgtgttgagagccgatgtggggtgcaaaaaacaaattgttgaaagcaaaatgttttga

SEQ ID NO: 6147 - DNA, 690 bp, Candida albicans
  unsure (683): Identity of nucleotide sequences at the above locations are unknown.
gcgcggtctgtctatccccgtggcgatgattttggggaaagatgtttgccttatttgccatctgttttgcctcccttaatgttgacagcaaaggcctcacaagatatttcattattagaagaggaagatgcagaggaattgaaactcaatgaggaatgggatgttattaatatatctggtaaatggatcggtgttcacacagttactttagatgagaaggtcactgccatggatcttcttagaacatacgctgttcaattaaaggaagactttatgccctgggtcaaggaaatagccgaggagattgccattcctggtttggacttttatttacatgatggtgtgcgtggatcggctgcgttgactttagcttctttgcttagatgttgcgtagcagccactggtaacaattcaactgaagcattaaccctttggtcaaaaatttgcaataaattaagcgaactgttgtgctcagaaccggttccagagttacttattgcatattatactacattggttgaatctattaatgtcttagcacccaacgctgtctcgggtatccaattgcaagctttatcaaaggcagttaatgccaacatgattgaaatctataatagaattaaagaacgtgataatgctgaagatgagttcactgaagaccttgaagaagacgaagaagattnttcttga

SEQ ID NO: 6148 - DNA, 924 bp, Candida albicans
  unsure (43): Identity of nucleotide sequences at the above locations are unknown.
atttgtttttggggaattatatttatgaacctgataaacccanattatgggaattacaaaatgattatgctcttcataatgattattcaggttaatgggttacatggtcctcataaaagttatattaattggtataacgaagcatttttattggattcacgatattctttctcagggaatgagtgtaatgaagttttacgattagaagcatttcctgattgtaatgagaaatggtttaatgaatgttatatcccaagaaaatatcaatcatttacagaacttttccaattcaatatgaactcaaactcaagatatttcccacctactgagaatactgagaatggtaataaatttgattacagcccttttgaatctcggaggaagaaatataagacttttgaacacgaatcaaaagctaaacttgagatcaaaacaccacgttctaagcgaattcaaaaattcttaccattcaaaaatgaccacaataataccagtagtctaatcagtagcaaaagaaatcttgatttaattgaagataatgatgaggaggacagatcaattacgcctgatccagatcaagcaaattctattgtcactgtgaatgaaaaagatattgaattatacaattcacaatgggattatgataaaatcattaagcatcaaacaattaatactcaagattattcatttaatcctcgagttaaaacaaatattgaagataaagaaatttattggtataacagtaatgaaattttttctaaatttagaaatggtagtgatggtgatggtgatgcccgtcgggaagatttgattagtcctcaagatttgaaaacatatttgacttttgatagtattgataatgaaatgataacaaattttaataatcaattagatttaaataccgacaataattattttttttaa

SEQ ID NO: 6149 - DNA, 954 bp, Candida albicans
  unsure (902): Identity of nucleotide sequences at the above locations are unknown.
tgtggccaaggaaattggaacagaaccaattgttcagggacatgcttattaacttcgttccatgacccaaaatatgggttatacaacaacccaagatacaatagtttggttcggcatcgagggtcgataccattatattggactccagacatgaatgaatttccgaaaccacgtatacagattaatgtggatgatccattttatcaaggctcagcattgcatttcaacgatttgtttcaccgatatgggctgccaataattgtgttaaacttgattaaacaaaaggaaaagcaaccacgagagctgaaattaaaccactatttcatggcttgcataaaatatcttgatcaatttttacctgaaggtaagaaaatccaatattttagctttgatatgtctagacattctaagaaaaacttggatgtgattggaccaatacaagctatagcagctaatgcgatgagtcaaattggatttttccataatgggatcaatttgtctactacaaaactacaaaaggggattataagaacaaattgcatagattgtttggacagaactaatgcagcacaatttattatttgtaaagaagcattaactcatcaactacggagtttgaagattatttcggaaacccaaaacttggactatgattcagatttgatcaatgtggttacagaaatatttcatgatcatggagatactattgccattcaatatggtggctcaaacttggttaacacgatggactcttatcgacggatcaatcagtggtcttcgcatacaagagatatgttgaatagtattaaacggatgtattctaattcatttatggactctatacgtcaagaagcaataaatttgtttttggggaattatatttatgaacctgataaacccanattatgggaattacaaaatgattatgctcttcataatgattattcaggttaa

SEQ ID NO: 6150 - DNA, 477 bp, Candida albicans
cgagaacggggtaatgagaatgaagaacaacaagacgattatggggatgcatctgaaagtaataaacgtatcatattgcaaaggttcacaatttacaatgccacaagtacaatgtacatagttggaagctactcaaaagacagtctttttcgtattatggaaatcagcaaagacgaagaaaacgattatgttgtttccattattggagatagcaattacttttacaccaggaaagatatgattgagttattaaatggattagatgagtatattgaaggaggtatacacaaggttgcacaagggtacgggatgttaggattaattagattcactcagagttattacttgtgtttaatcacaaaatgttctcaagttgctattttgggtggacatttcatttatcatatagacgaaaccaaatttattccattggcactgttcaccactggggaagagcagaccggccttataaaggga

SEQ ID NO: 6151 - DNA, 780 bp, Candida albicans
aaagatcaatcattattacttgataataataacaacctaaacgggatgaataataccattaaaactcatccggtacgtgttagttcaggaaatcataataattttcctttcactttatcttcagaatctacattacaagattttttaaataataataaattttttgttgattccataaaacataatcatggtaatcaaatatttgatttgaatggtcaaggtcaatctcctcatacattatggatagggtgtagtgattcaagagcaggtgatcaatgtttagctacattaccaggagaaatatttgttcatagaaacattgctaatatagtcaatgccaatgatataagtagtcaaggggttatacaatttgctattgatgtattaaaagtgaaaaaaatcattgtttgtggtcatactgattgtggtggtatttgggcatcattatcaaagaaaaaaattggtggtgttttagatttatggttaaatccagttagacatattcgtgctgctaatttaaaattattagaagaatataatcaagatcctaaattaaaggccaaaaaattggctgaattaaatgtcatttcttctgtaacagcattgaaaagacatcctagtgctagtgttgcattaaagaagaatgaaattgaagtttgggggatgttatatgatgtggcaactggttatttatctcaagtagagattcctcaagatgaatttgaggatttattccatgttcatgatgaacatgatgaagaagaatataaccctcattga

SEQ ID NO: 6152 - DNA, 552 bp, Candida albicans
agaatcagcaaaacaagaagtcaatctaatcatacatcaattatgcaacatacaagtgctggcggaggattcttttccaagataaaagagaactatagcagtaaattagcaggattatcactagctggtggaccctatgttgagaaagatggctcttcagaggataacacactaattcacaatgcattcgtcaagtattatgactttaaaggcttaccctacccggactggttaggcgtaaagacatttcaatcacaacaacagcaacaacagcaaggatacggcagaactcagcaccaacaagattattcccaatccaaataccaaccagtacgtcaagacaacacttttaacaatagttataatgccagacaaacacaacagcagcaacagcaacaatatcaacaacaaacaaatggttctgatagacccaactcaggtggctatcaacgttcttcgagtcgattacaagacttgtataacaaatctcgtcaacaatctataccaggccagggatataatacaagtaactcttggagtcataatcgttag

SEQ ID NO: 6153 - DNA, 1575 bp, Candida albicans
aaaatgtatcagcaccaagatcaaactcagcatcagtattaccaacagtataattcatacaacccgtccatagaggatttgattgcttcatcagatgataaacggtatcaaaatggtggtatcggtaacctgttacaaagacctccagtagcaggtttaccttatatttcgtcacaagttaacccaaacacttcatcagccaacttatccaagctaacaaacaatattaacaactatgggtacaacaacaataacaacagctacattcaattacacacaccaccattatcttcaaacccatctttcacttcgttccagaatttgaactacccattatcaccactcagcaaggcaacgtcacccgaacctatactatctgccgcatcagtaaccacaagcaactttttagcgtcgtcttttttcagttggttgcctcctattgatgttaagattgtttcgttttgtattggttggtatttatgctccattatttcgtcgaactcaacaaaattgattctaaatgatttcaagttcccggtaacattgactcaatttcaattttctgctagttttactttttgtctagtatttcttaacatagttaaagtcaacccagagagtattagcagtaagttacccccaggatttataccgtcaatgactgataccaacagaatcagtctttcagaatttatcacaccaacaagattgattatactaaccactttgcccatgggtatgttccaatttattggccacataacaagtcacaaggcaacttcattaatcccagtgtcaatcgttcacacaataaaatcattaagtccaattatcacagtattgatttaccgattcttatttggaaaatcgtacaggatgagaacctatgtcactttaattccattatgttgtgggatcatgttgacttgttataaaaaaagccatactagtaatcaaaacaatgtgccgggtgctggtagcagtgttattaataataatcttgacaagatcaacactaacaataattattctactggcttaatatttgcatttatttccatgattatttttgtcagtcaaaacatttttgccaaaaaaagattaacggttgaatctactaatgctattccaatgaacaacaaatcatcgctcagaatcaattccaataaagtagataaattaactatattgttttactgttctataattggatttattttgacatgcccaatttattttgtcactgaatggatgaattataatgcctttggcgccatatcacttttgcaactcaattcatatgtgatgagtttagttttattgaatggattgagtcattttgtacaatcattgttagcattccaaatactaggaatggttagtcctatcaactattctattgccaacattttaaagagaatatttattattttgatttcatttatttgggaactgaaacaattctctaatagccaatcaatagggttagttatcactttgtttgggttatactgttatgatagatggggcacagtctcaaactcaggcagtgccagtaatccaggaaaatactaa

SEQ ID NO: 6154 - DNA, 567 bp, Candida albicans
atcatggtatcattatacgatgtgggaacccgttgttggtatcctgatgaaaaactaggctggatcagtgctactgtaaagtcaaacaagaaaaatgggaacaagcacattatagaatttgtacctgagaatgatgattctcaagtattcactattgaaactgacaatttatcagaagaaaatgacaaattacctccattaagaaatcctccaatattggaagcagcagaagatttgactagtttgtcctatttgaatgaacctgctgtcttacaggcaattaaattacgttactcgcaattgaacatttatacttattctggtattgttttaattgccaccaatcctttccaaagagttgaacaattatattcacaagacattatacaagcttatgctggtaaaagaagaggtgaattagatccccatctattcgccatcgccgaagaagcttacaggtgcatgaaagaagatggtgaaaaccaaactatagttgtcagtggtgaatccggggctggtaaaactgtttctgctaaatattatatgaagataatttgctaccgttga

SEQ ID NO: 6155 - DNA, 3783 bp, Candida albicans
agacataccaaccaaggtggaatgcctcaaatagaaggaatcgatgacgctgaagaattccgtatcactaatgaagcattatctttaattgggattgataaatctaagcaatcagaaatctacaagattttagcagcacttttacacattggtaacattgatattgctgctaccaaaaacgatgcacacttatccagtgacgagcctaatttgactaaagcgtgtgaattattgggtattgatgcggtatcattcgccaaatggtgtgttaaaaagcaaatcacaaccagaaacgaaaaaatcaccagtaatttaaaccacaaacaggctttagttgccagagactcgtttgctaaatatatttattcggctttgtttgattggttagtcgactatgtcaattctgatttatgtccagacgaagttgctgccagagtcaaatcatttattggtgtattggatatttatggttttgaacatttcgaaaagaattcttttgaacaattctgcatcaattacgccaacgaaaaattacaacaagaattcaatcaacacgttttcaagttggaacaagaggaatatattaaagaacaaattgaatggtcttttattgactttgccgataatcaaccttgtatcgatgtaattgaaaacagattaggtatattgtcacttttggatgaagaatccagacttccggcaggtaatgatgaatcatggattgagaagatgttccagaatttggataaagaaccaactaataaagtatttaaaaagccaagatttggtcaaaccaaatttattgtttctcattatgccttagatgttacctatgatattgaaggtttcattgaaaagaatagagatactgttggtgaaggtcatcttgaagttatgaaaaacaccaccaatccattgttacaatccattttggaaattattgataaaaatgctgctgccttggaagcctctaaaccagaaaccaaagcaccaagagcaaagattgctaataagaaaccgactttgggttccatgttcaagaattcgttgattgaattaatgaaaactatcaactccacaaatgttcattatatcagatgtattaaaccaaatgaacaaaagaaagcttgggaatttgacacattaatggtgttgtctcaattgagagcttgtggtgtgttggaaacaatcagaatttcatgtgctgggttcccttcaagatggacttatgtggaatttgctgacagatatcatattttggttccatcacaagattggattagagtcatgagtggtgacactacgcaagaatctgtgtctggattatgtaaccaaatattgacgaccaatattgaaaataaggagaaataccaattgggtaacaccaagatttttttcaaagctggtatgttggctcattttgaaaaattgagatccgataaattgttcaaatcagcagtgatgatccaaaagaacatgagaaagagattttacagaaagaggtatctcgaaaccagagcttctcatattcagttacaaggtttaattcgtggttatatgtccagaaaacgcgtcagagaagaacaagaaagagttgcagcaactttaatccaaacttccatcagaggttacttggccagaaagcaatttgctcaaacagttttatcagtggtcactatccaaaaatctgtcagaggattgcaagcaagaagaaattacttaaaattacgcgaattaagctccgccgttgttattcaaaaatcttggaaagcttatcaagccagatccagttatcaaactcaacggaaatctgctgttattattcaatcagcatttagaagacaatatgctattcgtgaattacagcaattgaaagttgaagctaaatccttgaataaattgaaggaagtgtcttatcaattagaaaacaaggtgattgatttgactcaatcattaactgccaagatccaggataataagaaattaatggaagaaattgccaatttgaaggctttattagaacaacaaggtcaagcacatgaaactttgaaaactcgtgaacttgaattcaacgagaagtttgactcccagaatgctgaacatcaacaagaagttgaaaacttgaatcgtgaattggagaccatcaagaatgaatacgcttcagctggtgccaagattgaacaattgtacaaagaacaagctgaattgaaacaagaagttcaaaggaacattgaagaattgaacaaggctaaagatgatcttgttaagcgtgataccattgaagttgatttgaaatcacacattgaacaattaaagaccgaattagccaaattgcaacagcaacaatcagaagccagaaatggatctgctgttcttgtgaatagcaaagccagaaatgtcaacaagcgtcacagtagtgccgtggcctggaactcaccaaactcccttgacaatagcaacagaccagtatcagtcattgccgtttccaatgatgaagatgcaaatattgatgatatcaatgacgaattattcaaattgttgagagattcacgtcaattacatcgtgaaattgtcgatgggttattgaaaggtttgaaaataccaccatctggtattgccgctgatttgaccagaaaggaagttcttttcccatcaagaataatcatcattattttgtcagacatgtggagattagggttaactaaagaaagtgaagatttccttggagaagttttgtcatcaattcaattgattgtttctgctttgaaagacgatgacgttattcctcatggtgcattctggttatccaacacccatgaattatattcctttgtttcatatgctcagcacactatcattgctaacgacaatttggcccatgaaatgagtgaagaagaatttgatgaatatcttaaattagtagctgtggtgaaggaagatttcgaatcactttcctacaacatttacaatatgtggatgaagaagatggaaaaagatttggaaaagaaagctgtgtcggctgttgtattgtcacaagcattacctgggtttatggcccctgagagctctccatttttggccaaagtattttccggtggagttcaatacaaaatggatgatattttaagcttcttcaacactgtttactgggctatgaaatcatatttcattgaaatggaagttataaatgaagttattattgaattattaagatttgttgatgccttgtgtttcaatgatttgatcatgagaagaaatttcttgtcttggaagagaggtttacaattgaataataatgttacaagattagaagaatggtgtaaaagtcatgatatagaagaaggatccaattatttgagtcatttgttacaagctgataagttgttacaattgagaaagaatacccctgatgatattagcataatatatgaaatatgttttgctttgaaaccaatccaaattcaaaaattgatttcacaatattatgttgctgattatgaaacaccaattgctcctaatgtgttacaagcagttgctgataaagtcaaagaaagcgattccagtaattccgatgatttattcgaattagtttcaactgatggacatttcaatgatcctttcagaaatattgcattgagaccattttcaagagttgaagcttatgttcctgcttggttgaatttaccagttattagaagaatagttgaattagttgccaaaaacgcttccgtacaagaatcacaatctacaataggtgttgaagaagaagccaatggattgtga

SEQ ID NO: 6156 - DNA, 2439 bp, Candida albicans
gatgatggattgcgtccgtcgtgtcgaaaactgatttcggaaggatccaaaacggcagaaaaatataatttgtggtcattaccggcaatgaatgggataaaaacatatcttgaagagcagtctaacaaactatttgatatgattattgatgaactacagaatgagatctatttgaaatacaacagaaacccacaagaaggagccattgcatggcagaatattattcattccagtaatccacaattgacttcctttgtgactttgttagatctgaagaatttagaacaatttattttcaattcagcaaatttggatatatcggaagtggtcgattttttgacttctccagtgaaaaattttatagttaatcaattgcctgacctccatgctcataatagtaagaatgatggagtcatcgattacaaaatcttgttagattcaactctgaatccaaacacagagtcattctattacatttatatgcttttgcttacagcatccaaactcaacaggttgaatcaagcagttgaagttttacttgacactaatcaactggaattgcatagtctaattaacagaaccacagaggcagttaagctgcgaaatgggcatgcgttatcgaagttatctaaaatgcagcaccttgatcatggctcattgtttgacgttattgtgcatggttcatttagtgattcggctgttgttcttttgcaagacttgtttggatcaatctttatcaggtgtttggctactttccaaagacataaagtaataactcaaattgtgacattattgcaagaaggaaaagcgctgtcaacaccaaaggctgttgctgaaagcacacctacttttgatagtcctcaaatggggagaccggatactttccatgcacgtaatttgtttacaatttggaagacaatccaaaaggagttgaaggcattaatgttgaattacatttatgacgaccacaattataagttacattctttggcagacactactggtgccaccaatcgtaataagatttcaaatgcattagggaaaaaagagttgttcaaatttgaagatgtgacttataacccttctaataaaacaacaaaagaaattcttgatgttttggccgatgtgtttcccggatatagtatttcggacgataataacaatggagctattatagaaaccgctactccgtatgtcaaacatgagtcatttaatgcaactgttgaagtgttggttcccaagaatttgttcaatatgagaatcattttagaattttttttaattttcattgatgggtcacaaagaattttttttgactttgaagatgaaaaaaccagaggtgttcatgccagaacatcatttcatttctttgaggattttatgaaaatatcctttttgtcatatttacgaaacactattgagttcaattttggagaacaagttggtggtgcttattctatgaaaattgaacaagcaatgccggtgaattcaggattaaaactagatttaatatctttaagtcaagattcaaatttcaaaattcttggtaatgcagttagcaatgttgaatccaatttgatcatttatgaaaatgcatataatttcaaaaaaatgtttcttgaattgtgtttaatattaaacacttcattgtcatatcgtgagaatttctcaggggccgtcttaaagacgttagagaatttttctaatgagtacaacaagttgtatcaagagttattgtccactggtgaaggtacaaacattgtgcgaccacctctgagagtaagtaaatggatgaagatacctgtgttaactgagatcagtggtaaaattcttcaacgtggagtacaaggtgaaactgctaacgaattacaagaactaattgaatcagaatctaaagttgttttacatgatgaaaccgtgacacaccaagaagatttgttagatcacgaggcatatgctcagattgtgtatttgttgttaactaccacctggatactttcttggttacctttggttaaaaaggaatccaattatagcatttatgatgatgagcaaaacaagactatcaaagtttcgacagtggacaaattaagatacaattggtctttcttagaaaacggaagacaggcaatcaactttaccccagatggaactgatattgtacaatataacatttaccttgccttgaattcagaaaaaattggtgagtttaataatattatccataactttgaatcgattagagacaaaaccttgttggccttgacatatgaattgaggtgtaaagcagtatattttgtcactatgtcttttaaacacattgattggtgtcctgtaactgaaccaggcgatgctgatcatttcattgtcaatttgaatcaagaaatatttgccatggataataagttatctaaaactgttaatgaacttgaacaataa

SEQ ID NO: 6157 - DNA, 378 bp, Candida albicans
agtttattcctcgggttttctccattccttaatgatttgataatcactagatccaaagctgtgagaaagattaatagcaatggtattaagagaatattgttaaacatttcaacagtacaacaaatgttaagaaacttatcgtctaatccagagacaattgatttcacaaaggcatctgaatattttgaaatgtttactatgaatgaattcaatttacttaaatttatcaagagcaaacgagacaactacactaaagacgcataccatacattggcaagattgatttatagtgaaaaattggctgatggtaatggttcactgttcaataaagggaaatataatgatttgattaagaaaattgacggaatatttgattag

SEQ ID NO: 6158 - DNA, 444 bp, Candida albicans
  unsure (81): Identity of nucleotide sequences at the above locations are unknown.
ctgttcccttggctgccaccaccattacccaacatgacccacaaatccatttttgctgtatttgccgcagcttttggtctnttgacttcatcttattacgggttctttgcttacttcgttgcagcatttgctgggccagtgattttgtttgtgtttgacttcttgaactttgttttcacttttgctgctgctacagccattgctgctggtattagagctcacagttgttctaaccaagattaccttgatgacaacaatattgctcaaggttcaagtggaagatgtagaaaagctcaagcttcaactgctttcttgtacttttccacatttatctttattgcttctgctattttcagtgccatttccctttccaaaggtggtttattcggtcactcttccagaccagctccaagaactggtgttccaaccatgtcccaagtttaa

SEQ ID NO: 6159 - DNA, 918 bp, Candida albicans
gcatttttttatttattcagaagaatatttccaattatgccagatcgtcgttcattgatagctgaagctgaaaagcttcttaaaccacagctgggattttttctgtttctttcagtttcttccgcttccatgagaaaggaagatgcaactgatctttatattcaagcagccaacctgtatcgattaaaaaaagatttcaatttagcaggtgctcaatttgtcaaggcagccgaaatacaagagagtttaggcaatcataatgatactgctaaccatttagtagaagcttacaagtgtttcaaaggagtatcgccaacagacgctatttcgtctttgtcaaaggcaattcacattttcttaacccaaaatggtcagtttagaagagccgcaaacttcaccatggatttagccgagctttatgaatcagttaatgattatgaaaatgccagcaaaagttatgaacaagcaggagattacttcactactgaccatgctgaagcccttgccaacaaggcatttttaaaatgtgcagacttgtatgcattgaatggcaattataaaagagctgtggaattatacgataacatcattaaaaacctgcttgggaattctttatcaagatggagtttgaaggattattttttcaaagtggtcttgtgtgttttgtgtatggacgatgtaattgaagctcacaagagaaaagatcagttccttcaggatgatccaagctggggacaatcaagagaatacaaattagttgaaggcatacttgaaagtattgatcaaggggatgttgaaggtttctcggacaaagtatttgacttcgatcagtttagtaaacttgacaaattgaagacccagttgttgttgaaggtgaagaattcagttgttgcaaaggatgatgatgatttgttgtag

SEQ ID NO: 6160 - DNA, 489 bp, Candida albicans
agagcgtggtccttccaccgcgtggtgaagactgctccagaaaagatcttggaaggtcataaaaagggggttttatccttaaattggtgtaagcaagatccaactttgttactttcaagtggtaaggataattcgactttcttgtggaatcctattgaaggtatcaagttaggagagtatccaactacagcaaattgggcatttgaaaccaagtttgccccagctgctcctgatatttttgccactgcatcatttgatggtaaagttgttgttcaaaccattcaagacacctcaccttctgtgtccactaaagtcgcctcaactgacgacaatgaattttggagtgaattatcaactactgagacccagcagccggtatttgaagtcaaacaagcacctaattggcttaaaaatccaagcaacgtttcatttggatttggttcaaaattggtgataatcaatactgactccagtggtaaatccactgtc

SEQ ID NO: 6161 - DNA, 558 bp, Candida albicans
tcaagtatagttatctacatgggattaacaatttcaaaattatttgccagtctcttggggagacgtgaaatgagaatattgatggttggtttggatgctgctggtaaaaccaccatcttgtacaagctcaagctaggagaaatcgtcaccacaatccctacaattgggtttaatgttgaaaccgtcgaatacaagaatatatcatttacagtgtgggatgttggcggacaagataaaatccgaccactatggcgctactactttcaaaacacacaaggaatcatttttgttgttgattcaaatgaccgggacagaatcaacgaggccagagaagaattacagctgatgttgaatgaggatgagttgaaagacgcagtgttgcttgttttggcaaacaaacaggatttgccaaatgccatgaatgccgcggaaatcactgaaaagatggggttgcattctatcaggaataggccatggttcatccaggccacttgtgccactactggagatggtctatatgaggggttggaatggttatctaaccaagtaggaaaatga

SEQ ID NO: 6162 - DNA, 321 bp, Candida albicans
ttagtcatgggtttatcattttccaaattatttgctaatctctttggtaacaaagaaatgagaatcttgatggttggtttagatgctgccggtaaaaccactatattatataagttgaaattgggtgaaattgtcaccactattccaaccattggtttcaatgttgaaaccgttgaatacaagaatatttcattcactgtatgggatgtcggtggtcaagataaaatcagaccattatggagatattatttccaaaacactcaaggtatcattttcgtggttgattccaacgatagagatcgtattgctgaatctatataa

SEQ ID NO: 6163 - DNA, 1350 bp, Candida albicans
gttaattttaatggattaaatgaattggcagaacaaattttacaagaagctaatattagtgaaaaagatgttgaattacccgaattgggtgatgttgtccccttacctaaaccaattggtgaacctgttggtaattggccattgaaagattcagaattatcttattttgaaacggctttaatcactggaaaaattgaaaacttgtcaatcaatgaagataatcttactactggtgctgaaggttttgagtctggtgctaccaatattgatgagaaccttggatttgacaataataataatgatgatgatgatgatgatggagaaggtggtgcttttggtggtgaagatgatgctgaagcatgggatttggacgacgaattagatattggtgatgatgatattgttgatgaaaatgttcctgaatttgtcaccactgagaatgaaatcggtgattggttacgtaatgccaagacaccagctacatatgtagcagcgggaggatttgaacaagcagcgtcattattaaataaacaaattggagtggttaattttgaaccattaagaactcgattcaatcaagtttatggtgcttccaaattatatttaccaggtatggatgaattaccagcaatgaaaacttatattagacatgataatgatgaagataatccacgaaaatttaaaccagttgttcctggatatgataaattggaagaattattatctttaggtttcaaaaaattcaaagccaataatttagaagaagcgattaccacatttagaaaagtgatttataccatcactgtcttaaatgttgatgatgaagatgacgaaaccaaatgtcatgaaatcttgagattatgtcgtgaatatattcttggattatcaattgaattggaacgtcgtaaattaccaagtctggatgtgaaacggaatttagaattggccgcttatttcactagagctcaattacaaccttctcataaattaaatgctttacaagttgccatgactcaatcatttaaaaataaaaattatgcttctgcttcttattttgctgaagaattattgaaaatttctaataatagtggacctagagctgaacaagctatgaaattgaaaaataaagctgatacaattgctaatgataccattgaaattaattttgatccttttgctgaatttgatatttgttgtggtagttttacaccaatttatataggtgaaccatttattaaagaagcattagttggagctacttttaaaccagaatttaaaggtaaattatgtaatattattgatattactgctgttggagtacctgcttcaggtttacgtatcaaaggttaa

SEQ ID NO: 6164 - DNA, 2187 bp, Candida albicans
ctatctatcatgaagatgttaactaaatttgaatccaagtcttctagggctaaaggtgttgcctttcatccaaagagaccttgggctttagtctcgttacattcatcaacaatacaattatgggattatcgaatggggacattaattgatcgatttgaagatcatgttggaccagtaagaagtgttgatttccatccaactcaaccattatttgtttctggaggtgatgattataccattaaagtttggtcattaaacactagaaaatgtattttcaccttgaatggacatttggattatattagaggggtatcatttcatcatgatttaccatggattattagttgttctgatgatcaaactattaggatttggaattggcaaaatcgacaagaaattgcttgtttaactggtcataatcattatgttatgagtgctcaattccatcctagtgaagatttaattgttagtgcttcattagatcaaacagttcgggtttgggatatttctggattaaggaaaaaacatagtgctccaacttcttcagttcgtgcatttgaagatcaattacaaagacaacaattacctcaacaagatatttttggtaatattaatgctgttgttaaatatgtattggaaggtcatgataaaggagttaattatgcttctttccatcctactttacctcttattgtttctgctggagatgatcgagtagttaaattatggagaatgagtgatactaaagcttgggaagttgatacttgtagaggtcatactggtaatgttttaagtgctattttccatcctcatcaagatttaattttatcagtttctgatgataaaactattcgggtttgggatttgaataaaagagtccccgtgaaacaatttagaagagaacatgatcgtttttggttgattgcttcccatccaactattagtttatttgctgcttgtcacgattcaggtattatggtgtttaaattagaaagagaaagaccagctcatactattttccaaaataaattatattatgttaatggtgaaaaacaaattcaaacttttgatatcaataaacaagaaaattctttaccaatgttatcattgaaaaaaattggtaagacttggtcatttatgagaactttatcttataatcaaagtgataattcagtattagttgtccatggtgaaggtgataatgggaattatgctttgattactttacctaaacatgtaactggtgctattgaaccaactgatattcgtcaaggtgaagccaattttgccgcatttatttctcgtaatcgttttgttacttttgttaaatctactaaaactttacaagttaaagatttgaataataatattacgaaaacggttcaattagatctgtcaattgttgatgtattaccggggtctcctggtcgtattttattggttaaagctcattcagtgattaattatgatgttcaacaacgtaaagaattggcagaaattagtgttaataatgtcaaatatgtttcttggtcgagtaatggacaatatttggctttactttctaaacataccatcactattgctgataaggatttaaaattaatcacctcaatgcatgaaactattagaatcaaaagtgctgcttgggatgatactggggttttattatattccactttaaatcatatcaagtacactttattgaatggtgataatggtattatcaaaactttagaaaatacattgtatattactaaagttcaaggcaatttaatttattgtttgaatcgtcaaggacaagttgaaacaattactattgaccccactgaatatagattcaaacgtgcattagttaataagaattttggtgaagtgttaagacttattaaaaattctactttagttggtcaaaatatcattggttatttacagaaaaagggattccctgaagttgcattacattttgttcaagatccagaaacaagatttgaattggctttagaatgtagcaatttacaagtggctttagaacaagctaaaattttgaataataatcaaatttgggaaaaattaggtgaagaagctttattacaaggtaatattgaaattgttgaatatatttatcaacaattacatcattttgataaattatcattttcatatttatataaaggtgatgatgaaaga

SEQ ID NO: 6165 - DNA, 204 bp, Candida albicans
ttaccacaaatgtcgaatgaatatgaattaagagatgcattgttattattgtttgctaacaaacaagatttgccaaatgctatgaacgccgctgaaataactgaaaaattaggtttacattcaatcagacaaagaccatggtacatccaaactacttgttgccctactggggattgtttataccatagtttggaatggttatct

SEQ ID NO: 6166 - DNA, 1245 bp, Candida albicans
aaatttgatctttcaaccaatccaattcattacattagtcaactaatcaatataatgattactcatactactcgtactagattaattaatcgaattcttcttctacctaaatataatcaattttatcgattaaattcgtccaagaataaaagtaaattttcatcaattgaaaatttcaataaaaataaaacaacttataatttcggatacaattttgatgatttaaaagatttagatgataaaatcaatcctcaaactaccaaaacatcttcaaatggaaacaaccaaaaagaagccatcaagagagggactgacgacaacgataaacctattgatataaatgcactcattgaaaatgatcctcgtttacttaaattaaaacctggtacaccagaatatcgaaatgagttaaaaaaattacatttagaatttgaatcaaatcaaaataaacaacggtcacgtcatgaatttaatcaaagaatgaaaggaatgatatttggattattggcattaattggaatagtatcaactcatcaaatattatttaattatgaatcgattaaaaatcgattattatcaaattataattatcctgatttaaatgaagagaaagtcaaaactattaatgataaaaatgttaaaagtacaaaatatatgttggagaaattatctaaagaattaaatgatgagaatttaaatcaagttcaagattcgaaaactattagtggggtttatgtttttggcgatgactttggtaagatcccattaagaatcccatttttcaataatatgtatttgaaagatgcttatattgaaaaaggtcatttgattgctataactgataaaggtaaagtttatgaatgggataaagattggtcagatgttagaccaattaatttacctttcaatattgaaagagttactccaactaaagattatttctattttttaactaataaaggagaaatcgtttatataccaagaagaaggattaattctaattcaaattctaattctaattctgaatttatcccattacaaagaagaaattggtttggacttttgaaaacacaaatttataataaattaaatgtgaaagacatcacaaaaatatcttctggagattatcatttattattattaaataaactggggaaaatctttgtggtaaattgttccaataatcctataaatcgtggtcaatatggtccatcgttttccccctttgccgacatcaaagaataa

SEQ ID NO: 6167 - DNA, 1548 bp, Candida albicans
aacaagcaattcaaagaatcaaacaaaattgaacatattaaagttcctgttaagttttcttaccacccaactttagaagccgaagccaaaaagaagaaggcagctgaggctgaagcaaaaaaggccaaagaaaccaaagcaacagttacaagcactgaagccaaggatgccaaagaagaaacagaaacaaaggccgaaaaagttgaggaaaaactcgagactgatgctaaagagccattgattgaagatgagaccaaggaagaagcaaaagttgatactgaagccaaggaaccattgattgaagacgaagacaaacaagaaccggccaacgaagccgaggaaaaagaagctgaacttgaagacaaggccgaagaaaagcttgtcacagatcaaccaaaagacgaagaaatagaagttgctgaacctaaagaagtctcagctgcatccgaggtagaagaacaaaaacttgaaaaagatgctgctgaaccagaaattcaagatggagaagcactcaaaggcgatgacaacattgaaaaacaaatcaaagaaaacccaattgaactagttgatcagccatctcagttcaagtatgaaccagttgaattgccaaataaggaaactttagataaattgcaagataagcctgtattattgaaacattatcaagaattgaatgctattggcgttggatctattgccaacagaatcgaggatccaaacaaggttattgaattgggttcaggattaagaatgacccaacaacaattgttggatattgctgctaaaagagttgccccagtcattactaacatcaatgacgaagtttccaaaacaagacaagaagatgaaatcaaaagacaacaggggttggacaacaaggtcaagaagcatgaaagtaaattgcaatccgattttgaaaagtatcttggtaaaattggtaagaaaaaggacaaattcaataaagaaattgaagaaaagttggctaatttcgaaactatgattaagaaatcaaacaacactgccattgagtttgaaaaaactaccaaaggtgaaattgaaactgccaataaggaatacgaagaacgtgaagccaaagcagtagaacaacatgctactgacaaggaaactattgagaaaaaccacgaagaattgttagctacaaagaagcaagaattggaagatgctaaaactggtcaagaaactgctactcaagaaattgaggaattgaaagacaagaaaactgaattagatgacaaaaactctgaattggctgacaaaattgagcaattgactgcccaattgaatactgaacttgccaagttagatgacttgaaggctaaccacaaggaacaccaagattctattgatgccaacttgaccaagaagaaagaattagatgataacttgacaatcatccgtaaagatctttctgataaaaaggagaagcacaaaggtttactggcagaagttggtgttttggctggctctgctgctgcttatgctgctcgattaaccagcttgcactccgacaaagaggacagagcctag

SEQ ID NO: 6168 - DNA, 1020 bp, Candida albicans
agtacaattatgggaaagaataaaaagaaacagaacaattcatcgctgaaaaaagcaaccaaagaagatgtggaacaaagtaaacaaacgattgacaatgtgaataaggatgaagaaatacaggaaacagaaccttccgaagatactacaagtaatgagtcagaagaggagtccaccaaatcacaaaaaatagatcaaacaggtcaaacagagcaattagatccgtcagcgactagttcaactgaattgctcgagaaattacaacagacagaacgagaacgagatgaaatccaacaatcttatgataacttggtcaacaaaatttcatcaatgaagaccattttcagtaaaatgaaacagtcagaagcggagctagaagaaaaaactgaattggtagaaagtttgaccagtgaaaacgaggagttgaaaagacaattacaagacgcagccaagagtaaagttgactcagacactattactaaattacaagagcaaaatactgacttaaacaacgaatgtgaaaggctaagtgattcattgactaaatcgaggcgggaatacaactcaactcttcaagcattacaggatgagaattacaatttagaaaatcaaaactccaagttatccaaaaaagttcaagaactaaatctggaaataaatgacttgaaaataaccttaaatgaattaacaatggatcaaaaggattacacaaatgccattgaagaattgacagataaactcgctttgaagactgacgaagtaactgaagccacaaaaaccatagaggatttccaagcccttgtttcattgaaacagtcgaattttgacaaggaaacgacttcattaaagagtactatcactcagttggaagaaaaaatagcaaaacaagaaaaggaaaacgaagatgtaaatcagtcacttgataaaagtcagcaagaactacttgaactcaaagaagaggtcaaaaaaatagatgaattgaaatcattgattcacaataaacaattatcgataggttag

SEQ ID NO: 6169 - DNA, 2535 bp, Candida albicans
ggtacaacttatacaatccctatgatagaggtgttaataactgtagtacctgcagttctatggcttttatacagattttttctggttctacaaacaccagtagaaaaattgattgaagatttgaatatcgagattcctcataccccaatattatgtatcgattccatttctgaaagatctattgtgattcattgggatattgaaattaaattcgatgaaaacttgtattatgtgattgtggtgaatgaacaagaggcagcgacattgacttctacgtcttgtagattgaataatttgacaccccatcaactatatcagattgaaattattgctgtgaattcaataaccaatttcaaatcacaatccaagccagtatttgttcatacctccaatgacaaagaactagatgggattgtcaatgttgatcatttggagaccgagatcaaagagatcgaacctattagtgggaccttagatcaatcagcattggaaaccataaccatagaccaaatcaagaatatcaaagattcaaatttgttgaatgattatattgtcaaatttcaaaatgaattggccaagaccaacactgaatataaacaatttcaatcgagtatttctcaagaacatgaaactttacaacgagatttgagtcatcacaaacgagaatttgaagaggaatcggataacaaactgaaaaaagaccatgatttaaaatcattggaaagaaagaaagataatctttcatttcaaaaatcaaaactaacgactcaattaaatgcattaaaaaataccctttcattatttaatacaaaatttgaagagaatgaaaataaaatcaaaaaattacgtgaaaagaacactcatgcgttgaatacagaagatcaagaaaaaacaaaaattaaacaagaggttgattcaataaaacagaaaatatccaatactaaatcggatatagaaaaaactgaagaaaatatgaaactcattgcattagaaagaaaagagttaatttctatcttgaaccaattaaaaccacttatagatgcattcaatcaagcggggagctccaatacacaatcagataacaatggtgtatcccaattactgccttcgtcattatcatcgacaacaacagccaacaccacatccgtttccaacacttctacaacagcaacagcaacaaataacactgccacatcagttttcaatagagacggctcgttgtccaaaaatgcatttgatgcaattgtaaagataattcaaattgttccttcctggcaagatgaaattatgcatgagatcaatcaataccaagagtttgaacagaattggaaagaagcatttagagccgagatcaagaaatttgtatctattcatcaggctttagaggttgcaagaatgaatttagatcaaaattatcaaccggtaaagatgacagaatatcaagcttcaatagaatttggaggctttagtaatgctttaccaaaaccaaaatttaatggtaaaagaaacttatcgccaactgaagatcatttgaaacaaaataacaatttctataattactatggcaatgtttattcaaaagaggaatcagatggtgaattgggatcaccacattctcaacaacaagtactcttgaagcaacagcaacagcagccacagccacaacaacatcaaccactgccaccgccaattgctcctcaagtattatccaacaatgattatttaccaaacaattcatttggtcatcaagaacagccatatattagtttggatcagattaatgctgcccataatttggatttgaatagtgggaatacattgatgccgatagatacttccatatcaacaaataatcttgcatcaacccatcttaacggattcccatatgacgataatatttatactagaggaatcaattcgccacttccgttgcataacaatgcggctttgaattatggtgattataattcgttattgtacagatacagctcaccttctttaactcaaagtaacagtaatttagctgatggggtttggggtactatgacaaataatggtaacaatttaagtgctaacgatttattgaatccaactcaacaatctggttttttgatttctccatcacaatcaacaaatatttggttagatgataagagtcaaaactcattgttaaatccaacaaatggtacacataccagggcagtttccagtaactcacagatttggagaaatgatgctaccagccttaatggaggaggaggtagtaatccgatccgtggttttgattttggtggggtatctacacaaggcaatggtgatttttcaccatttggtaacaatattagtatccacaaccccactgatagcttgtacggagtcaatctgtcgaatacacaagtgaatgaccaacagctacagtcacagccgcagtcacactttcagcaacaacaaccacatccaaatttgacttctttcaagagtgataatgatgaaaatgattcggttattggaggaacagaacagtttttcaaatag

SEQ ID NO: 6170 - DNA, 480 bp, Candida albicans
acagcacagagatcaccaacaacaggaccatcaccaccaccaccacctacactctcatcaatggagtatataaataatattttggggctgctgaatcaagtacagctggtggaggaagcaattcctacattatgcaatcgtttacaacatgcaacaatgtcttccgatagaagatcagcagtacttggattgaaaagtttcagtagacaatatcgagaaaacgttgttgaacatggattgagaccattaatctcaacttttataaaatatattgataatcctcagattgtgaaagcaatattagaaactttactcattttatttattcgtggtgaaagtgatgaagatttgactagaggttggatctctcaacaatctcggcttcaaaatggtaaatacccatcaccattacttatggaatatatttctctagatcaattatcattatggattgctgacgctttgattcaagacgaataa

SEQ ID NO: 6171 - DNA, 723 bp, Candida albicans
atcttgcgtctactcattgaaaacctttctgaaactaacgattatcatgccaagttatacacaattcaattattggaatcattggcatcgagtagaggatcaagaacaaaagattgtttattgaatatccccacatccatgtcagtattgtgtctgttgttacaagattcaaatgaaccagtaagaaacgaagcaattcttttactcatggctgtagccaacgacaatttcaatattcaaaaattggtggcttttgaaaatacatttgaaacattatttgacattatagcagaagaaggaggtataagaggatctattttggttcaagattgtctcacattaataaccaaccttttacaatttaatgcatccaatcaaaaattcttcttagagacacagtgtgttcctagattatcaagtttattaggtgaaccagttgatgaaaccggtgatcctgatatgctagatgaaaatgggtttcctgaaattccacctccaattgtctggacagaacaaagaatacaaaatatgattattgcattagaaatttgtcgattattagtttccgaggatacagagtatgtggcgcaaaatcaggataaattatttcaatcaggaatccactacatattgctcaaacttgtgttttctcccttgacagaaaatattgtcagatcagttgcattacttaccactggtgacaccatttgtggggaaccctaa

SEQ ID NO: 6172 - DNA, 1893 bp, Candida albicans
gacgcggatcgtacaccttgtggggaagatgatgtcgttattttacaaactgaattaaaagagacgattctggaagttgaaaaagaaagagctatgcttagtgaaaattctgaaactgtcattaaggaatacagtgacaaaataaagagtttagaaagtaagatcaactcaataaaggagaatcattcaaaagagataacaactcataatgaacaaaagacttctttgaaacaagatattgcaaaactatctcaagatcatgaactggcgcaaactcaattagaagataaggagaatcaattgaaggaattgaaagctagtttagagaaacacaatactgagtccgcaacaagcattgaagaaaagaacaatcagataaaggaactctcggaaactattaagtcattaaaaactgaattaaagacaagtggtgatgcattaaaacaatctcaaaaggaatacaaaactttaaaaactaaaaattccgacactgaactgaaattggaaaaacaattggaagaactagaaaaagtgaagctggatttacaaacagcagatgaaaaattgaaaggaattacagaaagggaaattgcattgaaatctgaacttgaaacagtgaaaaatagtggattgtctacaacttctgagcttgctgcattgacaaaaacagtgaaatcattggaaaaagaaaaggaagaattgcaatttttatcgggcaacaaatcaaaggaattggaagattacattcaaaagcacagtgatatttcggaaaaactaaaggcattaactgatgagcttaaagagaagaccaaacagtttgatgattctaaaaagaaattaactgagttggaaaatgatttgacttccactaagaaggaattggaaactgaaaagacacagacgagtaaattcaaaaacctcgaggaaaggaaagacaaagaaattgtgaaactcaataaagaattagagttattgaaaaatgacaatagtggtgctaaaaaggaactactggaaaaagtatccaagcttgagtcagaaattgagattttatccaaagagttagaagacaaaaaatcggtcatgaaacaacatgatgaattgaaagaacaaacaaaggaaaaaaatcaagagctacaaaaagttacaaaggattattctactaccaaactgaaattagatgaattgcagaaagaattagatgctgcattgtcattcaaagataagtttgaaacagcttcagccaagttaacacaatctacttctgatttggaagcagcaaataagaaattgaatattttgattagtgaaaaagaaaaaactgaacaagaacttgaaaaacttacaaaacaacacgctgaacttgaaaaactgattgatgataaaaatgctgattccagtaagacaaattctgatcttgaaaaagccaacaagaaagtattggaccttgaaacgcaacttgaaaaacttaccaaagaacttgatactaataaactggaattacaaaaacatgaaaaattgaacaatgaattcaccaatttgagtaaatcacatgaagaaattaaaactaaattagacaaaattgaaaatgaaaagaatgatcttgtcaaatcacatgaaaaactcaatgttgaacataaagaaacgtcaacaaaattacaaaatgttgaagaagaaaataagaaaatcacagcaaaatatgaatctgaactcaagaaattacaagataaacttaagaattgtgttcctaaatccgatttagatgatttaatgttgttgatgtcagatttagatgaaaagaataaagcatataaatcaagattgaagaagttgggtgatgaagtttcaagtgatgaagagtcagaagaagaagagtcagaagatgatgatgagtaa

SEQ ID NO: 6173 - DNA, 2454 bp, Candida albicans
atatattcattctccaagatgtctcattcggcctacaaagcttccggcaagccattgtcagcagaagcattatatcatcaacgagtaaaacaaggtgtgttccaatccccaagtggaacaattgttggagtcaattcaaatgcatcagatacggctgccttgttggcagcttcctccgacttgagtgtccaaccttcttatgttcgttcagttgcaccagaagcacacaccgccgctttagcagctaagcaacaagaaattaaagcttgggaaagaggtcaagaagacccagatgccagtgcagcagcatcaaatgctaaaagaaccaatacattgtcatcaacaaccccttccactactgtcaaggttggtattccttcaatgaactcaaacactatttacaaagccgccagtgccaactctactagcaccatgacatcgagaataaatcccgaaaaagacattagaagatccggtattcaatcaaagcaaggggccacttcattgaacattgataagattaacaaattggccactaaaaactctacaaaatctttgagttctcgttttaatcctgacttggattacagatcgggtttgaaaaaacaggctccagctgaattcttaaatcaagatgaagaggatttggctgcttccggtgcagctgcttctttaaagcacggtgctggatttactgatcaagtttcatcccaaaagagaagtcaaacttttacagctgcttcagtagtcaatgcttctttgttaaaggcagccaatgaaaaagctgaattaagattgaactcattgaaatccaataatccagctactttgaaagctcaagcacaattgtacgctaatgccttagcccttgcacaaaagagatccgacgaaagactgcaaagtagagctgctggtttgatcaatttgggtggtggcttgactatcagtcaaagtgaattagacaaattagcttccacatatgtccaaccaattttggatgatattgaaggtaaagcagaagctaaaagacaaattgacatagaaaagaaacaaaaagaattggaattgcaacaattgcacgagaaagctaaaaaggaggaacatgaagccaaagaaaaagagaaacgtgatattgaaattgccaagttggaaagaaatgctcaaaatgataaacgtaaaaaggctgaagatgagaaatatgccgagtaccaagctggtagaaatgaagaagtccaaactaagctccaagaatataaagacgttgaagctaaacatgctgaagagaagcaagttttgttggatgaaaagaaagagaatcaagatagaatcgataccgaggaagcagaaaagattgctgccagaaagcaagaattggaagaattacaagcagaaaaggatgaaattttgaaaccaactttggatgaattgaaagaagagtcagctaaattagaagaagtaaccaatgcaagagatgaattggctaatgaggttaaagcttcagaagatttgaataaggaatatgaagaaaaattggccgaattggaaagcaaattgcaggaagccaagaatgatattgaaaaatacactactgacattgaggaagctactgctaaacacgagtctactgataaggaagtagctgaattacaagaattgcatgataaagaaaaggccgatgctgaaaaggaacatgaagacttggatggtaagttggaagaattggaaaaacagaagcaactgcacctagaagacaaggctaccaagaagaaagatattttggctgccattgatgagaaagtcaaggatgaacataagataaactctgaattacctgaacatttgagagaagaagtcgatgaaggtaaaataagagacacttcatcaatattttcgggagaagaaccagaaatcaaacatgttccattgatcaaagaaagtgaaaccactgaacctgaaaagaagactgctaaagctgctgaagactccactgccactaaagctgctgatactaccgcatccactgccagcaagcctgttgccactgctgctactgactctacatccaaaagaccagtgacaccatctgctgcacaatcaccaaccaaaaagaagtcatcattttccagaagattgagctcaatattcaagtacacaaataccgaagagaaaccaaaatcaaccacaactccgtcctcagcagttaagaaggaaacgaaacctgccaaaaaggctactgaaaccgaagcagaaccaaagaaaacaactgaaaccgcaaaggcagcagaaaccacaaaagctccagctaccaagcaagaacagccagcagcaaaggatgctgagaaagaagcaaagagtgtaaaggatggagatgtatctgaatttgctgattttgaagatgaagtttctttgaatagaaaagaaaacaaaggtggtgtattcactgaagaaatctaa

SEQ ID NO: 6174 - DNA, 1827 bp, Candida albicans
tttttcgtttttatttattcattaccagtacttttgtgtttgtccattagaatcatgcccagtacgtcaaaagttactaccaataaccatgcacaagactctgattcaaatgaattccaacagctcaccacgcaaatagactcaactatatccaatttaaaacaaaagagggattatttacaggatcaactagctcaatttgagtctgttcgtcaaggtttgaagacgtcgggtgattcgacaaccccaatcaagtttcagttagatgatgggacgatgattgaaaaaaccacaacagaagcaattgaatttcttgataaaagggttacagaaattaaagaggcattgacacaatttaacacgaaaataaatgaagcagagtcaacaaaggagaaattgaatcaatttaaccagtttgtacaacaaggtggtaatcatgaagaattaaaacaagagaaattgaatgaagacgggcttccatttgttgatattcaggaagagcttgacgaagacgggaatgtgataaatgtccgattcaaagatgctcaggaagatacaactattgataaaaatgagaaggatagtcgtggcactcctaaagttgaaatattaggggaagagatagacaaggcaaagaaactggacaaagtatcacaatctgaaagtgatgaatttcaggcgttgcttgaagatatggaagttatttctaaagacaaaaaggcacaagaattaaattttgatcaagatgatttattagataaaatagacaaattgcaaatcagtgctgaggataagtttaaattgaaacaagtatgtgttgaagaatttaagaatttggagccagaacatgacaccgataaaacacaagaaaattctgcaagcgataaagttattggtaattttgaaaaccttgctattgacaagaatgatttgatagagttggaattattggctgatgattttgacgattcggagaattttcagggagaaaattacgacgatgatgaagagtgggattatgaatttgatgacgacgacgaagaagaagaagaagacattgcagatgaactattgtatggtggaggcaaggctaagattattggaagtgacgaaaaatcgaacaatatgttatgggatcaaattataaatctaagaaaaagcaaacttgttgccactgatcaagtggccgataagattgaagaaagtacagttaatgagaagaaacctaaagcagtcaggtttgctgagcatttagatattaatgaagtggaaaacattagtgagagtttaagaaacccaccaccagaaactggtaaaatgtccttgtttaagcaaaaccggatgtcttcccaacagaaaaatagatcagaggaaataaaggagacagttgaaaatgattctgtcatgacagatattttggagaatgatgtgatgagtgatatagttgaaaaagagccagtaatgacggatataattgagaaagatgatgatgatcagatatttgagaataatgatattaccgaaagctccattattgaacgtgagccagttgcaacaataaacgaatctacaccagaaactaaaacaggaactagctctcaaaaaccagtttcaagattcaaagcaatgagatctagccagcccttgaaagatactgggaaattgaatactcaagcgcctgtgaaaattcctataccgggtgacacagagaaagaggtagtaccactggaatcaccgactagcttatcggtttcaaaactacaagatttacaactggatatggacaaaatggctcaatcttcaccacagggctggaaaatccgcgtg

SEQ ID NO: 6175 - DNA, 1977 bp, Candida albicans
tctgtgttaagttggatcccatatccattttacaaagtcagccatatgtcgtcaaatttttttaaaaatacgcaaaacaataagggggtgagtatatttggaaacactcaatgttctgatgaaactggtgtgtcttctttcaaaatacgaccatcgccaaacattgacattgatagttccttgggctcagagtttgaaatgggcttggattttaacaaagaagatttacatgagaaatttctggatctggtctttgaaccaaagaaaaatgttgataagtctgaactctccttggtaacaactttcacggagtcgtccaaatcaaatgaaacaagagctagtttgaattcttgtacggatgccagtataattgagcacgaaacagagcctgaaactaagaagggattggatattcgtactcataagacaaatacattatgtttatttaatcaaccaaagtcgaataaatcgaaaaagactgaaaatctgacttcaactacaaaaatggaaaccaaaaaacttattacaccaagggtttttgatggtaaaacgacgatgcagttggaagaacgaagcaaggctaagactatcagtattctgcgtgaaggtgtatcaaaaactcagccacagtcacaaatatccagcaactttctggcagtgtcgttttcagaattaatcgggcaggtagaagctacaaaatgcaacttggaaaaagaattggatcttactcgaagaaagttactgaaggtggaatcagaaaaactagagagggatcagaatataagaatcttgacagatgtgaatgctcgaactaaaagccaagttgaagcattgttcaaacatgtaactagattggactctgattttaatgatttaaggcatgagaaagacaaagcaggaaagaaataccaaaagattaaggatgacacaaatcgttataaagctaaagtaggtgagctttcttctatccttgatgaatcaaagcaaagtttgaattccatgagaatgcaaatgcaagtacattttaaggtcaaagagttggaaatacaacagaaagatgttcagcttgatgagatatctggcctattgtctgaggagaaaataaaattagctgaaatgcaaaaaatgtcatttgacttgtcacaatgggaatctaaaatgttggaaatgaaccaaaatttagcaacagatatatctgatcggttttttaactcaattaaacagttcataggatccgaaaatttgaacaacattttggaaagcaagtttcaatttattgagaaagagtttaaaagttttttgtcaaacgaaatcgggtcaaaagtagctgagttgggagcagcttcacttgataaaaatcaaagattaagtgttttggtaagtactgaatttgagaaagcagctatggctgggattgaaaatcatgcaacaactagagactatttgcttaaacaatttcaggccaacattggattaatacaaaaaggtgctttggatgtccaggacgtaagacttgaatacgatcaaaaatttaaactgttggagtcgaagattactcatttggaaacaaggaaaacgcaattggagagagagctttctagtcataaaagtttatcacacgataaaatattacatttaactgaaaagctgcatggattacaagaacaattagctattgctaaacaaaaactcattgattgtgattccactgcagaaagactggcacttaatattttacaagctcaagaagaattagaagcaaaaaaggtcttgttgcatgaaaaggatactaaattttatgagttgcaaaagaatttggagttccaactgtttgccttgcagtcaaaagtaaatgaagaaaacaagaaccgtttattctttatcgaatcgagaaattcattgtcaaaagaagttaaagtcttagagttggttattaagaatcttaccagagattatgaagcctgtcaaagagtatag

SEQ ID NO: 6176 - DNA, 1347 bp, Candida albicans
atcctcagctcgtttacgatgtcattttctacatatgttataatcattggttgcgccattggtagtatttattactacttgaagaatcttgaattggcaaaattacgagacgatcatgctaaattagcatctcatatcgaaactatacaacggaatttagacagtaatcgtgataaattacaagtagttgaaaaattgaattctgaattaattgccaaatcgaaagcttcagcatcaattgaaactcgagctattgctgaagataaagctaatcaagaaaaattaaaaacacaattaaaagatataactaaaaaatataatgacttgatagaagagaagattaaattagaatctcaatttaaagaaaaacaacttagtattatttccgaacataatgataaaattaaagaattacaattatcaaaggaatcatatgaaagtgaagttaaaaataaattggagaaaacttttgattttaaattaaatactgccatcgaacaagtcgtagcaggcagagatttacaaatccaacaattgactgatgaattgagtgaacttaaaaaagtcttagagcaagaaattaccgatcataatgaatctaaagttaccaacgaacgtaaacttttagaattacaacaattgaaagatgaaactgaaaagaaatatgacgatcaaaccgtattatatgataaattacaattggtgaataaattacaattagaagagaatgaacaatacatcaaagatataactgctaaagaagaagaaatagaatctttacaaaagaaattaaaggaaatgaatgcagatttgactcaagtaactaaagatttgaaagattcaaaggcaactattgttgaaattgaaaacactactaaagatttgaaattaagtcaagaattattgcataaacatttatcactggaaaaagatttgaaagatgaacttgtggctaaagttgaaaaattagagaaagatataacttcaaagcagtttatattagatgaacaagacaagaaattatcattaattgaacagccattattagttttagaagattatcttgaagttttgaaagaaaccgatgataattttcctcattcgttattagatcgtgagaaagatgtgtcaaaatctattgacaatgattctgatgttatcaaagaagaagaagtaacatttgatgacgatgtattttctaaaaaatcaatcaaagtcttatcattggcacataagtatattgacattttaagacaaaaaactgttagtaaacgccaattgattgaacaacaaaataaagatattgaagattataaaacaacaattgatgaaagtgaattcaaataa

SEQ ID NO: 6177 - DNA, 2241 bp, Candida albicans
  unsure (5),(28): Identity of nucleotide sequences at the above locations are unknown.
aagtnggggggggtgggtgggtccggtnatctgtcaacacaggtcataccaaagatgaaaccaacccaaaagattgagacgttttatgatacagataaaacccaagtcattcctaaactcaatgatgtggaaagttggttcacctcaaaagatcaaactcaagaggatgcagataatgtgatatcgtcaaaacctttatccaaagaagaacgagaagctaaaattgctaaattggccgaacaaaaacgtcgtgaaagacttgaaaaggaaagacaagaattggaacaagatttaactaaaggtaccataactgatgaagaagaagaattgaatcaagaagctaatgatacagttgtttcgtcacataataaaagtgatggcttatctaccaaggagttggaaaaggctcaagagtttttgaatattcaaaaaagacatgtagatattcgacctgaatttcaaaaaaaagttgtctttacaaaagataaattgttatcagagttttcagaagaagaggattgcggtaccaacgagagaaaaaccaccaaagataaaccaccttcatcgccaacagttgaggaaatcttgaaatcgagtccatttacatctccagtgaaagatgaccataatgacgacaatgttttagatttatttaaaaaaccaagtgaaaatactaagaatccattggaattatatgcacaaagattgaaaaaacaacttttcagttcaccacaaggtcaaactgatactgcaaaaaacaatactaaacattctaagaaattaatcaatttagattctgattctgatattgatcttgcatcttcatctccaacaaagaaacctccaattgccacgagtactggtattattggttctggatcaaaattttccaatcatgctaaagaattggataatattcctgaactcagtaaagaacaacgattattaataaaacaaaaattttcgaaacggaaattccagaattccaaaatcaagactaatcaactgaaaaatcataatgttagtcataaacaagataatgggtttatgcaaaaattgcgtgaaaaacatattaatcaattgaaattgagtaaattaaataatcctgatcatttaattatggaagaattggaaaaagatgaagaaacaatgacttcattattggaaagagaaatggaaagggttagaaatattcgtaaacgagaaaaactacaagaacgagccaaattagcattattagaagggaaattagggattaaatcaaacaatgattccgagaaatatggtgatgaaattcctgaaagtgatgtagctgattctgaagtccctgatagtgattatagtatggataatgatgatgatgatgatgacgaagatgacctggagaatgaatcaccgaaaagggctgaaattaatcctaggagtgatgatagttacatgtttggtggtggcgacaacgccgatggcaatggtgaagatgaaggagtaactactactttatccacacaacctcaaccagttttcgataatacatcttttgttgataaaaccgaaggacttttccaaaatttacaaccaagaacatcaaaagaagattcatttatatccacacaaggtgaagaaagtcaattgcaaattagacttccactgttccgtgaccttacacaagtgccaacacaaactcaagttgatcaattcactcaagtcgacgaacaagccactcaagccgatgatgtggcaactcaaaagattctagctgctacccaaaaaataatggttcctactcaaaaaatcaaaaatgatactcagattattaacaaaccaatgctgcaacgtccagccaatagtagcacgaagagagatgatgatgacgttgatgatgacgatgatgatgatataattacacctgcaaatgttcgtcgtggtcgtaaaatgatccggaataataatatgattaaaatcgaagaagacgatgaagaaactccatcaaagaataacaatgatcataacccaaaagaagaagaagaagaagaaaatgattctgatgatccagaagaaatacaacgtcgtattaaagaatatgaattgaaaattcgtaaacgagaattaaaattacggaaacgtagaaaagaaatggaacgtaaaggaatgaaaaatattgttgaaggagaagcagaagaatctgaagatgaatggaaaggattaggtggtattgatgaagaattttcccgacgttgttaa

SEQ ID NO: 6178 - DNA, 2433 bp, Candida albicans
atgtcatcacgatcaaattctccgtcgaaaaccttaacggaaaacattgacaagtcattttcgccaataaaaattaatcttactgctactgatgataattcaccaaacaaactgattatccatcacaaaactccgctgcggatcgtccatcatcctcatggattatctgcaaaacatgaagcacgtagaaatactattggttatagtaacagcattaaacgaaggggattagttcatacaccattaatacctccagggtcagttaggaatccaattacttccccaaggttggccgttagaccaccaataaatttagaaagtataaaaagaaccaatcaaaaaatggctcagcagattaaattggcatttcctgctaataacgacgacgataaagaaaatgaattgcatttggatttatcttctgacccagacgaagattatagttctccgataaaaaggcacacaagacctcgtaatgatggtgacgatgacaatgaacatagtgaacatttgagtaaaattccaaaattgtcaagacccagcgaagagaaacaaacgttaccggaaactgatacaaatgaagttgaagaaataaagtcaattgaggacaatctgatagaagaaaacaacagatctaacttagctattgaggaagaaaatgacaatgacagtgataatgaagaagatgatgatgatattacaaaagagagtcgtggctctactgtgtatcatcagaatcaaaccctcgataatactcaaataagcaaaattattcgagaagatctcaagcttgattatattactcctgaaagagcaactgaagcggttgcacaaagtccccatccacatcatcaacacattagacttatagaagaagataaaactgaagattttgggaaatttaatgatactactagtcctttgaaaactagaaaccaagacgagaatgaatttgatgacgaaactgctaatctcactttgctgcgacaacttgaaaatgaacctacaattaattttttaatgtcaccaaactcaaaaccagtcttttcaaaagatcaagttaataaaattcaaaaggaacacgaatccaaagtagatacattattgcaacagttgaattcaagagatgataaaattaaacaattgtatgatgaattagcaaaagtgaatgaacaattgatttcaagtcagaaagaacaaagagctttaaatgatgaaaaaagcaaattggccaattcggaaaacttgttaacaattcaattacaccacaatgaaagagaactagcttcattgactaaaagttttagactcaaagaaagttcacttaataatttgaaacgtaaattgaatgaacaaaaagtgagcattgatgaaacacgtcatgaaaatgatactttgaaatcaaaaataaatgaattacaatcacttgaaagagacttgaaggctgaaatagtggaaacaagcaattccaatattgaaagtacattgaaattagatcaagtaataaaggaaaaagaggaattgtggattaaaaatcaagaattgaatgagaaattacaaagttttgaatccaattcaagttctaaatatgataaattaaaggatgagtatgaagatttactggaaagaaatcaaactttggttgatgataacaaaagattagaaacagacaaatttgaattagaagacagaaccaaaaaactagaagcagttaatcaaaaattaaaggatgataataccaataatgaaaatttgattaaagaatatgaaaaagtggcaacatcgagaattgaagagttggagtcggaaagagattctacaattgaagaaatttccaagcataaacaaattgtacatgatttagaaacacaagttgaaaacttaaaacaacaatataatgacaaagagaagaccaataaagaactcgaattgagaattgaggaacttgaatctaaatcagtttctaatgatgagttacaagaattgaaaagaaaaattgatgcaaaggataaagaaattgaaaccaaagaaaaaaccattgaggattatttatccaagatggatgatttagtggatcatatcaaaccattgaaaaaggaaaatgaggacttgaaacaagaacaacaaaaacttattcaagaggtttcctcattaaaagataaattagaaaagagtaagatacaagccgatgaagacttagataaattgagtaaatatttatatgctgaatatgccgctaaacatatcaaaaaattagaagggattattaaagagaataaaaagttggaaagagaacttgaattttataaaatgaaattggaaaaagctaataaggaagcagaattgttatcggaacgtaaagtttcatcatcatcaaaaactgctcttagtcctaaaatcacagcagcacctaaaaaccggggcaaacattaa

SEQ ID NO: 6179 - DNA, 477 bp, Candida albicans
  unsure (7),(23): Identity of nucleotide sequences at the above locations are unknown.
ttcttcnagcaaatcacggatcntaggctccttaggagaagacatttggtcgactcgcaaaattcaaatctatgtgaaaaagatcgtgataatttgaaaaaatctcatattgaattacaattgaaatatgaaactatagaaaatgattataatttagctaatgaaaccattgaatcattaaaacaagaaaaattagatttacaagaagctcttgatgaaatgacacgacaacaacaacaacaacaacaacaggagaaagaggcaaaagaaagagaagttcttaaattgaatgggaataaatcaaaagaacttttaaatgatgaactggttgtaagtgaagcaattaatggatttattcaagatctttctcgaactccttcagttcgtgataatatgaagaatttagaatcttctggaacaataaatagagatacaattaaattaactcctccagtgtccgacaatgaagaacaataa

SEQ ID NO: 6180 - DNA, 1152 bp, Candida albicans
  unsure (46): Identity of nucleotide sequences at the above locations are unknown.
cattcatttaagtacattccacggggaattattctatttattcaantacaacgtccacctatgttgaagatgaaacggaccagaatcaaaacaaactttcttggtgaaaatgacgatgcaaacaatttagattcatttatttcatcacaactaaacaaacctaattatcttaatttgaaaatattgattgaaaattcaatatttgataccaataaaatcactcaaacttcaatattacctttgaatgaagttcgtatactcaaacaggtgatagatgaaaaacaagatttacaacaatatttgttatcgaaaatagcgatatcacaatcatttttcaatgatgttattgttagtcaagaccaagatattgaaaaggaattattaataaaattaatgaaaactcaatcttcattacaatcaaaattaatttcaacaactactgaacttgaatctttaaaagaaaaattggctaatcacaatatttcatgtttagttttaggttatattgaagatgtcaaagcatctaaaaatttaagtgccaatacaactttaaatcaatcaccaatcagttctcctggtaaaatacccaataatagagatccaacttctccaaataaataccatttccctgatcgtatgagtcaatctcaaaccatgcaacatcttgatagtttatttgctcatgttgctagtgtggcagctcaacgtaacattcccttaccttcaccaccagctaccgatggatttgatgccaaaataacttgggttcaacaatgtattgattccatattatctgaagaaaacactagtaccatgagtactaaacaaactaaagcattatcaagggcagcaagtaaaactagacaagaatataaaaccgcattaaatgatttaagattttcttatgaatatttatctaaagaatatgaacattcacgagattcatctaataaattgatacatgattatagaaagaaaataagtcaattggaaagagatttaaagactagatcagccaacgttgaagaattaatgacaccaccaacaacaacaactggatccattggatcaacaagacctatcaccaccaccacctcaacatcaacatcatcaacctcaccttcaatttcatatgatttactagaaagttaa

SEQ ID NO: 6181 - DNA, 3237 bp, Candida albicans
ccgtccatcccccgtggtcgaagaccgatttgtgggaaccctaatattcaatttgagttttctaaagtggatgtcccatatatggatccatctttaccaacacaaatccaaccatacgatcgaccaatcctggtcccactttcattgctcaattggtgtttatacataaactcagtacacgcttttgacatcagagttgcttcagcattttgtttgaattcatatttcaaagataataaagactcgaaacttgcatttttaaacgaccaaatcaaatcatacactgatccaacttatttcactagtttacacaaggaagaagaagaacaacaacaacaacaagaaattaatggcaacagtgttccaaccccctttggaaatatatttacaacattgatggattatgacgcagatcttaaactaaacccttacacggcatggtttgcctccttaatcatggtaaacttgtttcttgaggagccagaaaataaagaaattgccagaaacgtgaaaactggagacgaagaggctggagaagaagtaatgaactcaattcaagcaatgtctggactcttggtaacgacactcgaatacaaggatcaaagaattgccatgggatatttaatgcttttaacgatttggttatatgaggatttcgatgccgttaatgattttttgagtgatcaatctattgttaaatcaattctagcattcttatcaaataattcatctgatcaaaatgtgttagtacatgggatggctactattttattgggagtttgttacgaattttcatccaaagattcaccattaccaagatcagatttacatgctttattggtgaaaagtttagggaaagacaattactctttgaaagttaagcaatttagatcgaatccagtatttgctgattttgaagaggcactgactttgacttttagtcaagatgcaactggtcttccaacggtatacttaactgatgtttatgtgaatttggtgaaagacaatttcttaagaatcaaaagagcattgtttcatgatccatcatcagagcctcgtggtaaaatatcatacgaactatttgaggagttagataccaaagttttaaacttgacaaaggaattacaaaccgaaaaggaaaatgccgaaagcaatgataaagaattgaatgaaaagattgagaaactaactaatctttccaccaaactcgaaacaaagctcgaagacaaggaacaagaattggccaaaatccaagaagatcacaaactgcttaatgaaaagttcttggtcactaccaacagtttatccgccatgaaggcttccaagaaagagtttgaaactgcttcacaaaagtatcaaaaagaactacaagaggctttgaaaaagggtaacacttctgaaagcacattgaagcaattgaaagaaaaacttgattccacagaacaggccaaaaagaaattagaagatggtatcaataatatgactagagacttattccatcttaaaaaactgaagagtgaagctgaaactcaaatcaaacaacgtgaaagagagtttaaaaatttgacttatgaattggaaaacactaaaaaggattatgaattacaaattaataatttgaataaatcaaataatgaattcaaacagaaaataaatgaattgagtaagaaaatcgaatctttgactgaagataataaatctaatgccaagcaacttgaagagaagttaagagatacagaagaaaacaatgaacatttgatggataaattgagatctgcatcagttgcatacaatgacttgaaaaaggcgaaatcagaatctgaagaagaaacagttaaagccaaagaagagttggaaacacttaccagtaagattgataatcttgaaaaggaattgaaggaacaacaatctaaaaaaaatgaattggaaggacagttacaaaatattactgattctaccaatgaaaagtttaaggaattagaggatgaattgaagagtatcaaaaaatccaataaagaaatctcctcacaaaattcagaattaattcaaaaattggagaaaactgaaaaagatctccaagcaaaagatgaagaaattgataaattgaaagctgagaccaaatcaaatattgataatctaaattcagaaatctctagtttacaatcgaagttgaaagaagcagaagaatctcattcaagtaccaaagatgaacactcttcactttctgaaaatctcaaaaaattgaaagaagagtatgaaaatacaaaaacttcaatgatagccaaactttcagcaaagattgaggagcacaagaaggccactgatgaaattgaaactaagactaaacacatcaccgacttacaagaagaacatgcaaagcaaaagtcacaatttgagagtgaacgaaatgatatcaagtccaatttagatgaagccaataaagaattatcagataatagagaaaaattgtctaatcttgaaaaagagaaaactgaattgaataataaactcaaaacacaggaagaaaagatttctgatttggaaacttcagtggcaatctctgaagataagtcaaagagcttgaaacacgatattgaagatttgaagagagagaaaatcaagttagaaacaacattgaaggaaaatgaggaaacgatgtttgagaaaaaggagcaattgcaagttgtaaatgacaaatgtaaagagcttgaagcatgtttgaaaaaacttactgaaacaaaagagaaagaaattaatgatttaattagaaaattagaagcagcaaagtcagatcatgatactgagcgtaagaaattgtcactattaattgaagacacgaagtcggagtctgaaaagaatgtcatcaagttgaatgaacaaattgagaaactcaaaggtgaaagagagaaggaagtcagggatattcaatctcagttggcagccaaaactaccgattgggaaaagattaaaactacacttgacaaagttttgaaagagaaaagtgatctagaaaagactaacaaggaatcagttgacactttgaagaaagaagtcgaaaacttgaagaaagaaatttcgttgttggaagatcagaaaaaggacgataccaccaaatataaagaacttgctgctcaattagaaaccaaaacatcaaatttagactcaaccacaatggaattagaaaagacagagttggagttgaaaaaagtaagaaatgagctaactgaagtgtcttga

SEQ ID NO: 6182 - DNA, 516 bp, Candida albicans
aaattgttggacacaaaatcttgtcaatcattatgtacttccaaatattctaaatcagattcagtatttgtcaatagaaatattagagctggttatacttacaattggattgttgatggattacctgcctcaatgatactttatgatgccactacttctactgaactttatggatctgggttccgtattggtaaagttgataatgaaaataaagttgaattttacaatcattttgaaattactattgaatatcataaaagaaaagaggatgaatatcgagttgttggggttacggtatcaccagcttcattggatagatcagaattgaaagaagatgtcaatggggatcaattatgttcattagatttgaaaccagttcaattgagtaagaataaagaaactgaagtattattcacttatacggttaatttccaagaaagtgatgttgcatgggccactagatgggataaatatttacatgtttataatcccaagattcaatggttttcattataa

SEQ ID NO: 6183 - DNA, 1215 bp, Candida albicans
gaacatatcgcggattgtcattcccgagcgatgatcccggactggagggataactcggaaagtgcaggtgcaagtgcaggtgcaacaacaatttctaacacgctgtcaaataatgtgaacactaaagggccatcaacagacattttgaatgatttggaatctgcagaggataatcaaacaactgtagttggtgattctataaaggatttcgagcctgacaaggaggatcgagtacctgttactacatcttctactgaaagtaatggtcaacaaactgaaactgttgaattggcaaagtctcaatctgatgaactaaatacgaaagaaaatgagaatgaaggctctaacgaaattgattggaacatacaagaaccagattttgcattgatggatgatgaagtgccgctgcaagagccaacaccaacgaatgaaattgaagagatgaatgaaccccatgaatcatcctcacacgaggatgacatcactcctcccttgactaatacacaagaaggtggctcattatcaatggccaaggaccaggtcactcccgaaaacttgtttatctccgatcaacagttgatagatgaagaagctctggatgcatcagagaacgaaattattcaagacgaattttttgttgataacgaccaactggcgtctatatttgaaggaatagacgacgacattgaagaagatgaatcaactgatgataatgatcaagaatttggacttgaacccggtaaaagcaatagggtacacttaactcgaatcataccacagaaaagaaaacaatctccagtatcatcaactggtgtggatgttagtatcagagatgtctcatatattgtgaaatccattcaagcacataaatctttaaacacaaacttacccctgagaaagaaatttaaaaagcctaaatcattgctgagagaaatagtaaaatcaatacaggaaaaatcaaatgagtttctcgacacattaatggatgatttgaaaagttatgctgaacatcgacaatcgcaaacagtggatatgaaagatgtattattatatttacaaagaataaactttgctggcaaaggtagttctacaaatgaaactgaaattgaccgtatttctgaattggctcaaaaatttttgcctctagaaaacttaattgcattggataatgatttatatgatactatttctccacaaaagaaaaggcaaaaataa

SEQ ID NO: 6184 - DNA, 540 bp, Candida albicans
gaacaggttaaactaactgacgactcagtgagcgtaatatcagcttgttttgaaggagagggaacggatcgtgaattggaagtacaagttgtgagagctttgatgcatagtattcttttaatgccatgccacggcgcatctttgctacaagctgttagacagatttataatgtatctattttttcattaacagccagaaatcaagctgtcgctcaagggattttgacccaggtcattggaacaattttccaaagagttgaagagtcagtgaagaataagagtaaaagaaacagtactcatagattaacgtcatcttcttcagatgataatttggaaatccaagcatccgatgaaacagagaaccaagagaaacttacgttgaaacgcttggaaaacttgaatgatgttattaatgacaatgatcgcttacacgaagccaattttgccaccgaaacagatgaagatttagcagtcaaagatgcatttttggtatttcgagcaatcgcatgtttcagtgctcaaccgccgcaaaaatcaatg

SEQ ID NO: 6185 - DNA, 1938 bp, Candida albicans
caaagcttatcaataatgtcacttgatgtaagtttacgagataggcaaatttctattttgcaaagaatgcttcatttgaacaaagaaggttctgcagatttgacattggcatccaaatcagaagaaataatttggaaggtcttagtattagatgctaagtctcgatcagtcttgtcttcagtattgagagtcaatgatttgttgaaatgtggtattactgttcattccttgatcaattcgaaaagagcaaatttgcccgatgtccctgtcatttactttgttgaaccaacaattgaaaatattttgtacattattgaagatttgaatcaagaccgatacgatagtttttacattaattttacgtccctgataaatcgtgaattgttggaagagtttgctaaaaaagtttcaatatctggtaaatcccaaaagattaaacaagttttcgatcaatatttggactatatcgtcaccgagccaaacttgttttcattgaacttacctgaaattttcactcagtttaacagctcaaatactgatgaagagaaaattcacaagttggttgatgtcattgccaatggattgttatccacaattgtttccatggatatcattcctgttatacgagcacaacaaaatggccctgccgaatttgttgcccaacaattggacttgaaattaagagaatatttaagtaacactagaggcagtacagtggccacagcttctatccaacaacgccccgtcttaatcttattggatagaaattttgatttggcatctatgttttctcattcatggatttatcaatgtatggtcagtgatgtattccaattgcaaagaaacacaattaaaattaccaagcacgcagcaaaagatggagaaaaggactcaacgaaaaattatgatgttgatcccaaagatttcttttggaacaagtactctcagctcccattccctgacgcggttgaaagcgctgatgctgaattgaatgcatacaaaaacgatgctaaagaagttactgcgaaaacggggattagttctttggatgatattgaccccaatgcaaatgcaactgctaatattcaacaggcagttgaaaaattaccagaattgacggctagaaaggcaactttggatatgcacatggacatattgtcatcgttaatcaatgaattgcaagcgaaaaacttggacaagtattttgaaatagaacaaaatgcgacggatcctaaagtcttaaaagagtttttggaattattggtggttgattcagaaagagatagttctttggacaaattaagaacatttataattttgactttgttggtggatttgacacctgaatatattgaaaaagttaaatctattttcaaggagaaatacccccaagttgacttatccagttttaactatatcttgaaattcaaagaacactcaaaattggctaatttatcaactttgaacgagaccagcaataatttcaccaatcaagcttcacagatgaattcaagtgccttattgagtgggttatcgtcaaagctctacggtttgacagaaggtaaaatctcagaaggattaacctctattgccacaagaattaaaagttttatacctgaaaagaaactacttccaattacaactatcgttgaagcaattatggatccgattaatgcttctcagcaaagtgttcagttgaccgacgaatacgtatatcttgatcctaaatcaagaggtggtcactcaaaaccaccaaaaagacaatcttatcaagaatcattggtgtttgttgttggtggtggtaattatttggagtatcagaatttacaagaatgggccaatgatcctaataaagcccataggaaggttatatatggtagtactgaaattacatcagcatccgaattcttggaagagtgtagcgtgttaggtagctaa

SEQ ID NO: 6186 - DNA, 2889 bp, Candida albicans
accaacatcaaattgaataaacataggatcatgagtgacagtggttatacattaatctatgagcctaatacggctacgaaagtatctgtcaatgaatttaaaaatttgttggaaaagggtaaagatgatgtgaaagtagataccatgaagaagattttgattaccatattaaatggagaccccttacctgacttgttgatgcatataatcagatttgtcatgccttccagaaataaagaattgaaaaagttgttgtatcattattgggaggtttgtccaaaaatggatgaatcaggtaaaatgagacatgaaatgattcttgtgtgtaatgccatccaacgtgatttacagcatccaaatgaatatattcgaggcaatactttgagatatttgacgaaattgaaagagccagaattattggaaactttagttcctaatgtccgtcaatgtttagaacaccgtcatgcctatgtcagaaaaaatgctgttttcgcattatggtctattcataaagtcagtgatcatttagctcctgatgctgacgagttaatttacagatttttgtatgaggaaaacgattctgtttgtaaaagaaatgcttttgtttgtcttggagacttgaatagagaagctgctttgcaatatattcaggataatatttcagttattgagactttggatccattgatacaattggcttttattgagtttatcaaaaaggactctattcaaaatccagctttaaagcaacaatatgcccaattaatgacagaaattattgaaagctcttcaaatgttgttatgtatgaagctgctaacacgttgactgttttgacttcaaacccacaatcaattttgttggcaggaaacaagtttgttgaattggctactagagagtctgataataacgttaaaattatcactttagagagaataaatcaattacacaagcaacatcctggtgtgttacaagacttgtcattagaaattttacgagttttatcttcccaagatttggatgttaaaaagaaagctcttgatgttactttacaatttatcaccaccagaaatgttgaagatgttgttaagttattgaagaaagaattgcagtctacagctttatccaatgatgacaagaatgcagattatagacagttgttaattaatgccatccatcaattggctattaaatttgtggaggttgctgccaatgtcattgatttattgttggattctatagccgatttgaataccactgccgcctacgaggttatcacatttgttaaagaagttgttgagaaattcccagatttaagggacgctattttgagaagattgattttggctttgccacatgtgaaaagtggtaaagttttccgtggtgcattatgggttattggtgagtatgccttagaggaatcattaatacaagaatcttggaaatatattagaggaagtattggtgaagtaccaattattgctagtgaattgaaactgaaaaagcgtgatgatactgaggaatcacaagaggaagaaaccgagtatgatggtaaacctcgcagaaagggtccagttgtattgccagatggtacctacgctactgagtcagcattgacaagcgaaacaactgactctttggaaagtgacagcaagactcctatcagaaagcaaattcttgctggtgatttctacttaggtgctgtattagcatcaactttggtgaaattgattctccgattgcaaagtttgaaacaaactcaagaaaaaattttgaacggattaaaagcagaagcattgttgattatggtttcgattttaagagttggggaatctagcttggtttctaagaaaattgatgaggattctgctgacagaattttgtcttacatcaagattttgaacgatgaagaagaccttcaggaaatcaagacaagcttccttgaagatactaaagatgcatttaaagcacaaattaataatgctgaattgaagaaagcagaagcattggctaaggatttgcatgataacgctgaacaaattgacgatgcaattgtttttagacagttggataaagataacaaaaagagtaaagcttctgtggatgatgttgctgctgcgtcaggaagcaatgaattaaagaaagaaaatttgtcgtcgagattgaacaaaattatacaattgactgggttttccgatcctatttatgcagaggcatttgtcaaagttcatcaatacgatgttgtgttagatgtcttgctagtgaatcaaaccacaactactttaagaaatttatcagttgaatttgctacattgggtgatttaaaagtggttgataaaccaactaccgcaaatattggacctcatggtttctacaaagttcaaacaactattaaagttacttcggctgatactggtgtcatctttggtaacatagtgtatgacggtcaacactcggacgattcacgtatagttattttgaatgacgttcacgttgacattatggattacattaagccagccacttgttcagaaagtcaattccgtaaaatgtggaacgaatttgaatgggaaaataagataaccattaaatcacctattgaaacattgaaagagtacttggatgaattaatgaagggtacaaatatgcaatgcttgacaccgggtgcggtaattggagaagaatgtcaatttttatcagcaaacttgtactcaaggtcaagctttggtgaagatgcattggctaatttatgtatagagaaacagagtgatggaccaataattggtcatgtcagaataagatcaaaaggtcaaggtttggctttgtcattgggtgatagagtagcttccatttcaagaaaaggtaagaaggcaactattgctcgtgtttaa

SEQ ID NO: 6187 - DNA, 1956 bp, Candida albicans
aaggtttcagaatacactaggggaagatttatagaatacacatttttacaagttagaaatatagacagtttttcccttccttccacttatttcaaacaacaattggaactgattcaagcattcaacattgacaaagatcgtagccagtactatacagttatggaaatatctaaaccttctactccactaagtattgttgggagaccaccacttaaaaatgccaatgtacaccatcacaagacaactttagttagtgttgatccaatcactttagcaatcaatgaatgcatgataatggcatcagctatgaggaaactgaatcgttgggctcaaagtggtgcagcagctttattttcatcaggtgatatatttggcgatgatgatgaacaagaggaggggcatgcagaagaagatgaagaagatgaaggtgctgaaggcgagcaaaatggatcatcgaataatttaggtgtcaaaccatctaatcttgatcgtaccaatgctaatacaaatatcgcagtttcatctcgcaagccttctactactcaaggaaatcctttacttgcatcatttttacaattaaaatctatattaattgacaccaaaaacatttatgatattgatagtttaacattattacaaccttttttaatggttattaaatcttcatcaacatcaggatatatcactgaattggcattaaataccatttcaaaatttttaaattatgacattatatcatttaaatcgaaaaatttacaaacatcattaattcaaataatttcatctttaactcattgtcgttttgaagctgctgatcaaaattctgatgacgctgttttattgaaagtgttaagattattggaaagaatcattgaagatgaattatcaaggttattacctaatgatgttgtttcggaagttgttcaaacttgtttatcattggcatgtaataagaaaaggagtgaagttttacgaagagcagcagaaatgtcaatggattcaatgacagtggaaattttcagtaaattaaaagatattgatccagaattagataatggtgatgatctacaaactaatttttctgatacaatattacctgaagatagaataggtggtactgatgttccaacagaaataaatagtccaagaaatctgatttccgggagagagaatattttggtggatgagatccatgaaattaaatcagaagaaaagcaccaagaaccaaaagacactcgacaagaagatgatcaacaactaaaggtacaaccagttgaggacgaaacgaaggacatgattgaagtgcaaaatgaaaaacaggaaaatccaccaatcgaaaacatcccatcatcatcatcattgaaagagaaaacagaatttgatgtatattccaatgaagaaccttatggaattatttgtattaatgaatttttggggattttagtatcaatgatttctccttctaatcaatatcaacatatggaaagtactcgagtttttgcattatcgttaataaataccgctatagaagttgctggagtggaaattcctaaacatccttctttattgaatttagtcactgatcctatttctaaacatgttttactgattataactacaacggaatcgcctgctctattgagagcttcattgaaattgtttactactatcacgatagttttagatcaacattgtaaacctcaatttgaattatcaatatcattaattttccaatcgattctcccacaatcagaaattcaaatgaaaggatcatcacaaatgtcatttagaaatccaatttctaaagaaattttgattgaatcattaagtttattatggataagatcaccaagttttttcaccaatttatttattgattatgattgtgattttgaaaaatcagatttagcaatcaatatattacaatacttatgtcgattgtcatttcttcaccac

SEQ ID NO: 6188 - DNA, 684 bp, Candida albicans
tttcttgagtattttcttctcacaccgataagtcagacagcaactcaactacttataattatgaataacgaatacgactatttatttaaattattattgattggtgattcaggtgtcggtaaatcctgtttgttattgagatttgctgacgacacatatacaccagattatatttctactattggtgttgattttaaaatcagaaccatcgagttggacggcaaaactatcaaattacaaatctgggacactgctggtcaagaaaggtttagaactatcacttcttcctattatagaggggcacatggtatcattatcgtgtacgatgtgactgaccaggaatcatttaataatgtcaaacaatggttacaagaaatcgaccgttatgccacaggtggtgtcatgaaattattagttggtaataaggctgatttgtctgataaaaaaatcgtcgaatatactgctgctaaagaatttgctgatgccttggacattccatttttagaaacctccgctttatcatcgaccaatgttgaacaagctttttacactatggcaagacaaatcaaagcccaaatgacaaacaatgccaatgccggaaatgctgccaatgccaagggcaaatctaatgtgaatttgagaggtgaatctttgacttctaaccaatcgaattcctgttgttaa

SEQ ID NO: 6189 - DNA, 504 bp, Candida albicans
attccctatagtttcttggtgtttagactatacatgttatcgaaacgactatttccttattccaatttgttcccacgtctgagaaaatataaatttattgtatattttataatatgtttgacaataataattctggcattaggagtatatttgtatagtataccaatagtttcaccaaatcaacctcaatgtgatatggtttggatgtcaccttcttatgcacgaatacgagcatttgatgaaactcatactaaatatgcatccaaatataatctatatttatatcgtgaacaagatgttgataagatgcccaacgagaatgaaaatgaagacggaaatgaggggtttacttcattagatggtataccagcattatttattcatggtaatgctggtagttttgaacaagttagatctatagctgcccgttgttcagaaatgtattacaatgatggtagatttaaagacaaatacttttcaccacgattgcaagagcagcaatag

SEQ ID NO: 6190 - DNA, 642 bp, Candida albicans
caattcatcatgagcggtaaaggaacatcatcaagagcatatgacatgattatgaagttattgttggttggagattccggtgttgggaaatcgtgtttattattgcgttttgttgaagataaattcaacccttcatttataaccaccattggtattgatttcaaaatcagaactattgaaagcaaagggaaaagaattaaattgcaggtttgggatactgctggtcaagaaaggttcagaaccattactactgcttactaccgtggtgccatggggattgtcttaatatatgatgtcactgattcaagatcatttgaaaatgttgaaaattggtttcaaacagttactcagcacgccaatgaggatgcacagatatttttagtaggtaacaagtgtgatgatgaagtaaacagacaagtttctaaagagcaaggtcaagaattagctgctaaattaaatgttccatttttggaagccagtgccaaaagcaatgaaaacgttgactctattttttacgaattggctagtattatccaagagaagcatgttgaagagaatattggtggtgttggtggtgccagtggtgctggtggtatagatgtttctcagaataattctggagcaaagaataactgttgctag

SEQ ID NO: 6191 - DNA, 423 bp, Candida albicans
gtttatgacgttacgaattacgagtcagtactaagtataagagattggtttaatcgatttatggagcattgtcatgtcgaatttcctggtattgtgattgtgggaaataaatcagataaatcaaccgaccgatgtgttgatttgaacgaaataaaagatattgttacgacaaatacaacttttgccaatgtgggtgattacattgatgattgggataattcattaatggaaataagtgctaagcgtctagaattagtcgaagagttgtttgtcagagttgcaaaaattggtgttgacttgttaatgggtaataaaggtgataacaaaagaagattgcaacaatttgataagattgatttgagagaaacacataatagaataaatgacaatactactagtacatcgtcgagctgtgcttgttga

SEQ ID NO: 6192 - DNA, 1767 bp, Candida albicans
ttgttactttactattattataatttttattatctgatttctaccatggttgttttatctgcttctatatgtacccgtggtggtaaagctcttttatctagacaatttagagatatttcaagagacagaattactgcgttgttggccaatttcccaagtttaatttcaaattcatcggggcaacatactagtgttgaggatgaaaatgtcagatacgtgtatcaacctttagaagaattctatattgtgttgattaccaataaaacatcgaatattttacaagacattgatacattgcatctttttgcgtctactgtgagcaacttattgagaaatattgatgaaagagaaatttttgaatcatcatttgaaatcattgatgcatttgatgaagttattagtttgggatataaagaaaacttgacattgactcaagttcaaacatttttggaaatggattctcatgaagaaaaaatccaagaaattattgaacgtaacaaggaattggaagccaccgaagaaagaaaaagaagagccaaagaaatacaaagaaaagaaatggcaagaaagaccatggatcaattacatctgggtgccagtgccggagttgggacttcatcatttggttatgatagttatcaacacaatcatcaacctacttataaacgtacacccgttgttgaaaccactcatagtgctggatccaacaccacaagctcttctactcactctttgttatccaaaccaagaggtggtggattgcaattgggaggtaaaaagactactgctggtagaaccttgccatcgggtaacggtgctcatgaaccattacttgctactaatcaaccagtgtttgcccataaggcagcagtagaatcatctcaaacctctgttgccgctggtagtagtggagtgaaatctggatctgtgtctagaactggatcacccgccccatccaatgctgctgctacacgtgtaccaaataatggtatcttgatcacagtcaatgaaaaagttagtgctcaactttctcgagatggttcaatttcatcttctgaagtcaaaggtgatttgcaattaagaataaaccaaactgaattagccaacgctaaaatattgttaaaaatcgctggtgataaaaaacaattcaaaacccatcctaatgtcgatcgtaacttatttcaactggaaagtcatattagtgtcaaagataaatcgaaaactttcccatctaatgatcaaccattaggtgtgttaagatggagaagtgttggtaaacaagatgatactctgctagttcctattgtctttaccatctgggtgagtatcaatgaagaaggacaagcacaagtcaccgtagaatatgaattaactaatgaatttgtggaaacccatccaaatcatccaaacgtggagaatttgaagattttggttccagtgttgactgataatgttcatttacaagatggtggtaatgatactgtttcatatgaattatatgatggtcaaggtgttgtattcaatataggaacaattgctattgatgatccacaaggttcatttgaatttactatccctgttgttgatgaggattcattattcccaatgcaagtgcaagttgatattattaatcaacaagtggttgaaagcgatatttcattgggtggtgtatctataaccgatgttgtttcaaataatgacgatgaagaatcattaccatttgatttacattctaacatatcttttgaaaattatgttatccaatag

SEQ ID NO: 6193 - DNA, 1359 bp, Candida albicans
gttacacgtccacacacaacaacaaacaacagtttccaacacactgagaagggaaaaaaaatttttttttttttatttcaatccaattcaattcaattcaattcaattatctttttatcaaatcttttctttctacttctttttacttttatagaaagatctatcttctcttttttcttttctttcctttcctttcctttcctttcctttccttgccttcccttcctactaaaccattgtatgggagttatactgttttatttaataggacaattattatatttaatcagaaagaaatacactactacttatagacaacaacaacaacaacaccaatacaatatggattcaaaacattctacttcttcttcttcttctggctcattagctactagaatttccaattcaggtcctatttctatagcagcctattgtctttcatctattttaatgacagtcaccaataaatatgttttatcgggttttagttttaatttgaattttttcttattagcagtccaatcaattgtttgtattgttactattggttcattaaaatcattaaatatcattacttatagacaattcaataaagatgaagctaagaaatggtcaccaattgcatttttattagttgctatgatttatacttcttccaaagctttacaatatttaagtatccccgtttatactattttcaaaaatttaaccattattttaattgcttatggtgaagtcatttggtttggtggtaaagttactactatggctttgagttcatttttattaatggttttatcctcggtcattgcttattatggtgataatgctgctgttaaatctcatgatgatgcctttgcattatatttaggatatttttggatgttgaccaattgttttgcttcagctgcttttgttttaattatgagaaaaagaattaaattgactaattttaaagattttgatactatgtattataataatttattatcaattcctattttgttgatttgttcatttatttttgaagattggtctagtgctaatgtttcattgaatttccctgctgataatagagtcactaccattacggcaatgattttaagtggtgcttcatccgttggtatttcttattgttctgcttggtgtgttagagtcacttcttctactacttattctatggttggagcattgaataaattaccaattgccttatcaggattaatattttttgaagctgctgtcaatttttggtcggtttcttctattttcgttggttttggtgcaggattagtttatgctgttgctaaacaaaaacaacaaaaagaacaatctcaacaattaccaaccactaaatag

SEQ ID NO: 6194 - DNA, 414 bp, Candida albicans
gggtattatagacgaactgttggggctttgattgtgtatgacattgccaagaccgaaagttatgaaagtgtaagtcgttggttgaaagaattgaaagaacacgctgatgctaatattataattgaattggttggtaataaatctgatttggatcatttaagagcagttccaactgaagaagctaagaattttgccatggaaaacaatttgctattcaccgaggctagtgctttaagtagtgataatgttgatttgagtttccatcaattattaaagaatatctacgaaatgatttcaaagcatcaattagaaaacaatgattccaaacaaaccaacactgctggtggaccaactatttccttaactcccgctcctcaagaaaagaataataagaataacggtggttgttgttaa

SEQ ID NO: 6195 - DNA, 639 bp, Candida albicans
gaacaatccatcattagacttgagaacaattttacaatgaagtcattatttgtttcacttttccttttttttatatcatcaatttcagcccataatgtgttgattgctccatatggtatacaatgtttttacgagtcattgaacaaaaatgatgaattggcaatcagtttccaagttgggtcacgtaatccttataattccgaacaatataccattgatttctatatcaattcacctcaaggacaaaccgttttaaagaaaactgggttggaccatggtgacgaaaccattactgccacatccagtgggaaatattcgtattgttttagcaatgaaagaaccggtgttgttgacttggatgtcagtttcaatattcacggagttgtttatgtcgatgtgaacgatccaaaactgggaactttggactatgctatccaaaaattaagccaattgaccgatgatgtcagagccgaacaaggataccttgttatcagagaaagaactcacagaaatacagctgaatctactaactccagagtcaaatggtggtcagttttccagatctttgttgttgctgccaactctattttccaaatctattatttgagaagattttttgaagtgcaatcagttgtatag

SEQ ID NO: 6196 - DNA, 492 bp, Candida albicans
gaaattattagatttgtggctataatttcatgcattattttattcttggttattttggtgattgttgtttggtgtgcttggttacatcgtgattatcctgattggatcaacgtggccaatttgatcatttccattgttagttttgccattgccacaattccagaatctttaccggtttccattgcctttgttttacttttaactgcatcaaagatgaaacaacatcaaatcttggtgaaatcattacacatgtgtggtactttggcctcctgtagtgttttatgctttgacaaaacaggaacattaacccaaaataacatgaaagtgacattgtcttgtattggtgataaattacacgaggaaagtgaaaaggaagaaaacaatgatatttttgatagttgtgctgccactcaagtattcacaattggtgccttgtgtaatgaagccactatagttaataacactgctcttggtggtaatgcaactgaatag

SEQ ID NO: 6197 - DNA, 1005 bp, Candida albicans
aaagttgtggagtggggttatatttgtaacaacgccagatattttactgagagtgagaaatacgtggggaacccaagtgatattgcccttgttgaatgcttgccccattttggtttggaagatatgagaggacagaaacaaagactttatgaattaccattttcttcaaatagaaaatacatggcagtttgtgtgcatactggcgacattgaaaaatccgaaaccattgccaaaggtgccaccgagaaaatattgcaactttgtgatcgttactatgacgaaaatggatccgtgaaaccattgacagaagctattgaggagtccattcacgaaaagtctcgttcgttggcaagagatgggttgagagtgttagcgtttgctaaaaacaataagaaatttgacgaaaagacaacagaacccacagatttggtgttttgcggtttaattggtatgaaagatccaccaagaccaaaagtgggacaatcgatcgcaaggttaatgcaaggtggtgtgcatgttattatgattactggagactcccctacaactgcagtaaatattgccagacaaatcggtatccctgtggttggagaccatgctgtattgacaggtgaccaaattgatagtttgagtgaagaagcccttaccaaagctattcacgatgtttcggtgtttgcgagaaccactccggagcacaaagtcactattgtgaaagctttgcaaagaagaggcgatatcgttgctatgactggggatggtgtgaatgacgcaccagctttgaaattggctgacattggtatagcaatgggtaaaaatggtacagatgttgctaaagaagctgcagatatggttttgacagatgacgacttttctacaatccttagtgctattgaagaaggtaaaggtattttcaacaacatacagaatttcattactttccaattgagtaccagtattgctgcattgactttggttgccttatctactttttttcggtttgcctaa

SEQ ID NO: 6198 - DNA, 225 bp, Candida albicans
aaccagcccactcttctgatccagcagttacagatacaaccgacattgcgttcatgggtacattggtccggagacggacatggtactgcgtatgttgttgcaacaacaggtcgaaccgtgtgtgggtccctgtttgaaatgaagagcgacattgaggtacccccaaccccactgcaacaagcaatggatacattgggggaacgacttgtccatgttcaagtttaa

SEQ ID NO: 6199 - DNA, 1158 bp, Candida albicans
  unsure (1086),(1099),(1153): Identity of nucleotide sequences at the above locations are unknown.
aagacaccacgcagacctcttttttttttaatctctttattaataactttttctattttttttttcattaacagtttgattgtcaacaccgaacacattttcaaagttgttttttttttttcaggccaagccttctcctttttttttttcgaatttctttatacaaagcccaattattatagacatattgtatacagttcaatgagtgctaatccatatgatatagagcataagttaccaccacaacgtgcaaacaccccatcactcaagtactctcaaaaatcaattgaagaaactgcagcagacttacaaaccgacatcaaattgggtttaaccaatagtcaggacgtgttaaatagacgatccattcatggaatcaacgaattaaatggagatgaagaggagagcctattgtggaaattcatttcatcattctaccaagatcctttgattttgcttttgattggttctgctgtgattagtttttggatgggcaataaggatgacgccatatcgatcacattagccatcactatagttgtaactgttggatttgttcaagaatatagatccgaaaagtctttggaagcattaaataagttagtccctgcagaggctaagttaacaagaactggaagcacatccagtgtgttggcccaggttttagttccaggtgatttggtccatttctcacaaggtgacagaatccccgcagacattagattgacagaggcggttcatttaaccattgatgaaagtaatttaactggtgaaaacaggcccgtgaaaaagaccgtagacacggttaactcttctgatccagcagttacagaaagaactgacattgcattcatgggtacattggtcagagacggacatggtagtggtattgttgttgcaacagcaggtcaaaccgtgtttgggtcagtgtttgaaatgatgagcgacattgaaaagcccaaaaccccattgcaacaagcaatggataaattggggaaggacttgtcgattttcaattttattgttattggtataatttgtctcattgggatataccaaggacgttcgtggctaaacatgtttcanatgtctgtgtctntggcggttgctgctattcctgaaaggttacctattattgttaccgttaccttancatag

SEQ ID NO: 6200 - DNA, 1443 bp, Candida albicans
attggagaatattgtggcgatctgtgcaccttcgaagtgaagactgaagggactggtaggatcttgtcccatttggttttcgaattgtcttcttttgaccagaggattaaagcaaaatataaatacaatccattcataatagactttgaaactgtcccggaaaacatgtggctaggaatcacaagtgatatattgttgaatgatctgaatcatgctgctaaaaagtggttagaatttgaaaacagattggcattgagaaggtttgacaacgagattattaacgcatcagacgcattttcaattgaccacgattaccaaggtcttaatcatgacaaagaaattaacttgcatattttgaggccaacatattctgcatatggtttagtgaaattgataagcaacttgaattcgcatttccaaacattaaatatagtcaaataccagttacagtttgtgtcacgaattcaattggggttgatagacaaatactatgacattatcaagaagcattacaaagaatacaataacaagtacagttttaaaaatgcattgaatatgattcccggagccatggttgatggaagtattaacaaaaacaaacctggaaatgacagtactattaatgaacacaccaaaaacggtatcactttgttaactgaaattttttgttctgccaagtacataagtgatgcattagagaattggagtaatgaattggttttcattcaattatggtctacatatacagggttatcagcagaattatctgaggataaaagtatatttgattctgcattgaagcaatatgatgatttggtaaataaaattttcaaaagttatgaagagctttttaaaagtgaaataaaacaattgttgaaaaaatatgtcaatctaagtgaatgggactcgccaagtactgctacacggtcggacaagaatagcgaacttgagccatcggcatatctaacacccttgatcaccttattgccacagtatttggacattatatctagaagcgtatcacaattggattattttataatcagcgataatgcagtttcatctttgtgtcagatattgtttgaatatgttttaacaaataacgagtttaaccgaaatgggatcgatcaaatgcttgttgattttgaatacattgttaaatttttgcagtactcgttgaatttgaatacactggatacttacagtgaagcttatgagtattcaaatgatactaattccgattatgtcaagattgtacaagcaattgatttgctagattcagttgatcctgatatgataaccaatttcaaacaagaaacactggacaaaaatactgcccaacttaatgaatttgtcacaaaattaagattgaaatatcaacacgaacttaaagaattgactaattacgatatacagaatttattaagtagagtaatgtattga

SEQ ID NO: 6201 - DNA, 1728 bp, Candida albicans
  unsure (1711): Identity of nucleotide sequences at the above locations are unknown.
aaattgaaaatgaaattggatgttgttaaacaattttcaactcgctccgatagagtgaaaggaatagatttccatccaactgaaccatggattttaacaactttatataatggtaaaattgagatttggtcatatgccactaattcattagttaaatctatacaagtcactgaattaccagtacgtgctggtaaattcattgctcgtaaaaattggattgttgttggatctgatgatttccaaattcgagtttataattataatacgggggaaaaagtgactcaatttgaagctcatccagattatattagaagtattgccgttcatccttctaaaccgtacattttaacttcaagtgatgatttaaccataaaattatggaattgggatcataattggaaattagaacaaacttttgaaggtcatcaacattatgtcatgagtgtgaattttaatcctaaagatcctaatacttttgcttcggcatgtttagatagaaccgttaaaatttggtccttaggttcatcacaaccaaatttcactttaattgctcatgaagctaaaggagtcaattatgtagattattatcctcaagctgataaaccttatttgatcacttcttccgatgataaaacaattaaagtctgggattatcaaactaaatcatgtgttgccactttagaaggtcatttatctaatgtttcatttgcaattttccatccagaattaccaattattgtttccgggtctgaagatggtaccattagattttggaattcaaatacttttaaattggaaaaatctataaattatagtttagaaagagcttggtgtattggaatattacctaaatctaatgttattgctgctgggtttgattccgggtttgttattatcaaattaggtagtgaagaaccgttattttcaatggattctaacaataaattgatttatgctaaaaattccgaagtttatcaatcagtgattaaaccttccagttctgaaggtttaaaagatggtgaatcattaaatttacagcaaagagatttaggttctattgaaattttcccacaaactttaaatcattctccaaatggtagatacgctgccgtgtgtggtgatggtgaatatatcgtatacaccgctttagcatggagatctaaaagttatggtagtgccttggattttgtttggaatagtcatgattcatctgctgcttgtccatttgccattcgtgaaagtggggttagtgttaaaattttcaaaaatttccaagaatatttaacccttgatttgatttatcaagccgataaaattttcactggttcattattaggggtcaaactggaaggttgtatttccttttatgattgggaacatggtaaattagtgagaagagtggatctagatgatgatattatcgatgttatttggtctgataacggtgaattattagccattgtcactacttccaatttgggtgaaatcagtagtaccgttggagttaaaaagaataatgaaacttatttcttgagttataatcatgaattatttgaagaagcattggctaatggtgaattggatgctgaagaaggggcagaatctgcttttgacgttttgtatactttacctacttcggaatctattttatcaggtaaattcattggtgatgtatttgtttataccactggtactacaaataaattgaatnattttgttggggggtaa

SEQ ID NO: 6202 - DNA, 834 bp, Candida albicans
ctcagcgtggttccttgcagcggccttgtgaagactcacaagactgaattgaatcaattatcgagatttttcgaaaaattgggttatttggcattatcattttcattatctcaagatttcgattccaaattccaactttctttatctactggtaatttaaaacaagcttatgatttattatcagcacaagaaaaagaaactccatcattatcattggccaattcaactaaatggaaaaaattgggtgatttagctttaaataaatggaatataaaactagctcaagaaagtttttggttagctaaagattattcatcattattattactattatcatctacacaaaataaatcccaattaataaaattagccgaagtttgtgaatctaaaggtaaatataacatagcatggcaatcatggtggttagtgggtgatgttggtaaatgttttgatttattaattacaagtgaaagatatactgaagcagttatatttggtaagaattatggtgttgatccagaaaaattgattaaagccattgaattatggaaacaaactttacataaaaaaaataaaagtaaagttgctaatagattaattgatgattttagtaatttacaaaccaatggatcaacaggtgctccattgattgacttggaaagcaagcaggatgcagatcaagagactacaacacagccacaacaagaagcaaaagaaaagattgaagatgaagctggtgcttcagaatttcaacgtgaagaagtggagaatgtggaggctgaaatacaacaagatgatgaagtgacagcagaagaagaagaagaagatgcttag

SEQ ID NO: 6203 - DNA, 732 bp, Candida albicans
ttaccctgtcattattttgaaaagaaagaaagaaacaacactagaataaacacaatggctgacaaatttccagaaatagacacacctgctgcaggtggtgatgatgattacgaaggtgatttcttgtcccgtgaaaaagaattggtgggtgacgaattcaccacagatcaagataaacaggtgtttcaagatgacgaagatgaagaaataaacgaattcaaagaacaatttcctgaagtcgacactaaagcgcaaccatcaggtatctcagtaactaaaggtgccgataaatatgatgatgatgatgatgagtttgaaggattcgaatcctccaacggtgcagccaaagaactaaatttatcagaatctcaagctattaaagaatggaaacaacgtcgtgatttagaaattgaagaaagagagaaattaaactccaaaaaaaaggaggaaatcattgaaaaagctaaatcaactattgatgatttttatgaaaattacaattccaaaagagataaccaccaaaaagaaattttactggaacaagaaaaattcattagcaaaagagatgattttttgaaaagaggtaccttatgggatagagtaaatgagttagtcactgaagtgggtgaattgcctggtgatgagagcagagataaaactagattcaaagaattattgacgaaattgaaaggcaaagaaaacgttcctggagcaggaggatatcaagaataa

SEQ ID NO: 6204 - DNA, 483 bp, Candida albicans
tatttccaaatacttcaaaaaattgccattatgagttttagatattcaactgcaggcggcgcccatcaacgagatttaagaacacaattatttagcagtccatcagtgggaatacgtacaccatcgaaaactccaccactgcgaacagcatcaccatacgatccatcaccgaataacaatcaagccaaatataacgaatcattattaaattcattggaactgcagaataatgaagaaatggatactatgggtcaaaaagttgccatgttgcaaaatttaggggaagaaatgggggtagaaataaataaactgattaaattaaacgatgatataactaatgggtttgaaaaaggaaaaattactttaaagaatacatataataaaatgatagttatgagccaaagagcaggtataacttggaaaatgtggggcatggtatttttgattgtattcctatggtttttctatgtttggttattttaa

SEQ ID NO: 6205 - DNA, 402 bp, Candida albicans
ggattgattgaagaatttctcgcaaagacagttattagacgatgtcaaacatttaaagaaacagcagaagttatatctaaattgggatttagaatcttcttgaatatacaaccgatagtggaaaattggtcaaacgacggcaaatcgtgttctttaattatacctgaacctaatccattaaccgagtttgttgaattacctattactgctgataataagatagccaaagaattatggtactcgcaaatattatgtggagtgttacgaggggccttacaaatggtacagttagattgtgatgttagctttgtcaaagatgtattgaggggagatgatagaactgaaattagattgaaattgaatagaatattaaaagacgaagtgcctgctggtgaggattaa

SEQ ID NO: 6206 - DNA, 570 bp, Candida albicans
  unsure (563),(567): Identity of nucleotide sequences at the above locations are unknown.
ttcaagtgtatatccattactatttggtggcaaatgtctacgtctattcagaacagaacaatagagttccagcaatgtgtttctacatatgataagattaacaaaaagcataataaacatgtgaataatagtcctgccctatccactcccaaaaagtcatacttcagccaacaagctggtcttatagctaaggacatatctcatgtgactgaattattaagtaagcttgcagtattggcaaagaggaaacctattttcgacgataaaccaattgaaataggtgaattaacctacgtgatcaaacaagatatctttaaaatcgaaaccaacattcaaaatttgcaaaaatacttgaaaggagacacttcagtgtcaatagatgcccaaaccactcagttttccaagaacgtgttgactttattgaattctaaaatgaaaaatgtatctggcgaattcaagaatgtgttagaaattagacaaaagaatgaaataataaacaaaaaccgtacagaaaatttttatcttcagtctcggcatcaagaagtagtaaatcgtgccccacngggntaa

SEQ ID NO: 6207 - DNA, 750 bp, Candida albicans
ctcccagtctccttactaatgaattcaatatataatcatggtttaaaacaaacccaaactataactaaagatttaactcaattcgagaaaaacttatccacatcaccattatcattacaaggtgcaatcacaacatcattaactgcattcaggaaaactatcaaagaatatagtgatttattggaaaaaaatgtcaatgatacatcttataccaaacatgaaaatagattaaataaattcaatcaagatttaaatgaattcactctgaaatttgatactttaaaaaagcaacgtgatattcaagttcaagaagctaataaacaagaattattaggaagaagacacatatcaacaacagcaacagcagcattgggatcgacatcatcagataatccgtatgaatctagctcaaatccatctcaacaacaacaacagcaattacaagatgaacaaaacaccatgtcttatagagaaggattatatcatgaaaagaattctctagagagaggatcagaacaattggatcgaatcttagaaatgggacaacaagcttttgaagatattgttgaacaaaacgaaatattaagaaaagttcaaactaaatttgaagagagtttaatcactttaggtgtaagtcaaggtactatacgaagtgtggaaagaagagcaaaacaagataaatggttattttggttttgtgtggttgttatgttagtagtgttttattacattgtgaaattgtttaggtaa

SEQ ID NO: 6208 - DNA, 726 bp, Candida albicans
tatcgattctttggtggtgacaattggaaattgaatatgtttttgacaccagttttagtaccagggattttgtctctggttttcgttgtgttgaatttctttttaatttcagtacaatcttctggtgctattcatatggggacaatgtttgccattgtcttaatttggttcattatatcgattccattaagtgttattggatcaattttagctagtaatagaccattattatcggtaccagtgagaactaatcaaattccaagacaaattcctactcaaccatggtatttaagtactatcccggtaatgtttatttcgggaattttcccatttggatcaattgctgtggaaatgtattttatttattcatcaatttggtttaataagattttttatatgtttggatttttatttttctgtttcatattaatgattttaactagtagtttaattactattttaatgatttattatactttatgttcagaaaattataaatggcaatggaaatcattatttgttggaggaggttgtgcaatttatgtatttattcattcattttttttgactggtggtgaaaaatttggtggatttagttcattagttttatacagtggttattcagctgtgatttcattattagttttcctttgttgtggatcaattggatttattagtagtttaatatttgtcagattaatttatggtcaaattaaaattgattag

SEQ ID NO: 6209 - DNA, 213 bp, Candida albicans
cctggtgttgcaccaaccaattataaaaagggggatacaattccattatatgtgaatcatttaacaccatcattccatcattcatctaaacaaggtaaaactgccacgtatgtttattcatatgattattattatcctaaattccatttctgtacaccaaagggaggtgctaagaagcaactggaatcattgggatcaattatttttgggtga

SEQ ID NO: 6210 - DNA, 843 bp, Candida albicans
agtctaaccattccccgccttcaagtgatccattgtaccttaactataaactcaaccactttatacacatatgaaaactcgaatctagtacacctcgtgaacaacagtaatatcaattgctcagaaatagtttcgcaagaattgggtttaatcaatgcgtctaaaacattaattggatcaataccaatttcgtcgagcaacactataaaactctcaatgtatttcatgaaaaagttgctatcaaaccaagatgggagccgtgacttgattactgttgtggccattgctcatgttcatgccaataagacattggtcttgaatgttttaaagaatataatggataaatatatcgaatacaaacgagaattcgattccaacaaaagtgtttcaggacagctgtccaaagcaaaattgggggaattcaaattatacatgaatcaaataataaaatatgaagaaatgaattatgattccaaccaacatatatataattatggctctaccaatgaaaataatgaagatggacatccagcagatcagatcaaccccaaccaattattattagccaatgaagaagtcgacgaagtgagacagttaatgttggaaaatataaataaacttttgagccgaggtgataaaattaactcgttagttgatcagacagacagattgaatacgtcatctctggtgtttcaaaaaagggctcagcagataaagaggaaaatgtggtttatgaaaacaaagtttttattatcgattactggcggtgtattgttgattttgtatttatttattgggtcagagtgtgggttcccagcgttttctcattgcattagaaactga

SEQ ID NO: 6211 - DNA, 912 bp, Candida albicans
ttcgatgtttgtaaacactcgtatccatgtggaaaagtgtgtgtaaagcttaccaatttttctgcttcaattattgtggtttttttttttttttcaactgcacgaataaatatgaacacgtccttttttttttgttggctagtagtacacatttgtccagcaactggaacttttgacagcataaattacaggctaactagcaccttccttcaatttgaatatagacaaaataaatattacaacatggtgacaattgggaatgcacatgacgatttgattcatgatgcagtattagattattatggaaagcgattagctacttgttcttctgacaaaaccatcaaaatatttgatcttgacggcacggataattataaattgattactacattaacagggcacgaaggaccagtttggcaagtatcctgggcacatcctaaatttgggtcaatattggcttcgtgctcgtatgatgggaaggcattaatttggaaggagcaaccagaaactcaacagtggtcaataattgccgaacatactgttcatcaagcaagtgtcaattctgtgtcatgggctcctcatgaactaggggctgttttattatgtacttcatccgatggaaaggtctcagtggtggatttcaacgatgatggtactacttcacatgtcatatttgatgcacatgcaattggtgccaattcagctacttgggccccagtatcaacctcatcaaaggattcggcagcattaaagcagcaacgtagaatagtcagttgtgggtctgacaatttagccaaaatctggaaatatgatgctgctaacaatacctatgtccaagaaaccaaattggaacgtcatactgattgggtaaaggacgtagcttggtcaccatctaacttgatcagatcttaa

SEQ ID NO: 6212 - DNA, 228 bp, Candida albicans
attgctactgcatcaccagatcgcactgtgttgatttggaacccggacagagatggcaaatggcaaaaacaattattaacagaagaaaattttcctgacgtctgctggagatgctcctggtcattatcaggaaacattttggcagtgtccggtggtgacaataaggtgagtttgtggaaggagaacttacaaggaaaatgggagtcagccggtgaagttgatcagtaa

SEQ ID NO: 6213 - DNA, 414 bp, Candida albicans
aaacttcaaccccaccaactcctaaccctaatatttcccctttctttttttgcatataagactcccacaatgagttcagataaatcaaatttactaaaaaaatacaagattgtctttcttggtgatcaaagtgttggtaaaacatcattaatcaccagatttatgtatgatacatttgatgaaacttatgctgccacgattggaattgattttttatcgaaaacaatgtatttagaagaaggtaaaaccattagattacaattatgggatactgccggacaagaaagatttcgatcattaataccttcatatattagagattctcatgttgcagtaatatgttatgatataaccaataaaaaatcatttgataatcttgataaatggattaaagatgttaaattagaacgaggt

SEQ ID NO: 6214 - DNA, 345 bp, Candida albicans
gtaataaagccggactttatgggttcaactccttggataattttttaccaaaaaacaagaaaattattcaagatcaacgtggctcaatctaatttggaccaattgaataatgatttaattgatgttaaaaaggtcatgacaaagaatatcgaagatctattatataggggcgattctttggataaaatgagtgatttatcaagttcgttgaagcaagattccttgaaatataaacgaagagcccaaagaataaattttgaagcaatgttgagacagtatattccaatcgttggtgctggtttgatttttgtttttatggtttactacgtactttttagaagataa

SEQ ID NO: 6215 - DNA, 378 bp, Candida albicans
ctattaaatacagcccttccattatgtggatcagtggacgatgaaaataatccaaatttaacagatcaaaagaagaaatgcaaaatattgatttctaggattaccccgaattcagaaacaaaagctagtatagaatctggtgatttgtacacaattcattatttaattgacaattccattatttatatctgtatatgtaacaaaagttaccccaaaaaattggcattttcgtatttgctggaaatttctcatgagtttttcaacagtcatggtaacgaagctttaagtaataaagccggactttatgggttcaactccttggataattttttaccaaaaaacaagaaaattattcaagatcaacgtggctcaatctaa

SEQ ID NO: 6216 - DNA, 723 bp, Candida albicans
  unsure (33): Identity of nucleotide sequences at the above locations are unknown.
gtattctattcaactaaatgtcagtattgtttntggttcattaagataaattcacgtggaaagtacacaaaccatgcaatcatttattcacatatattgcgttggtgttctgcggttttggttagttcagcaattggattacatttggaagttcctgctcttcctaatcctcagcctgtttgcatccgtgattttgttcaagaaaatcaaatggttgttgtcaatatcaaaaccgatggtagcaagggcgatggacaaagattggatttgaaagttacagatctgcttggtaatgaatatagaaacaagaaagatgtggtaggacacgctaatgttgcctttacatctcaacataatgcagcaattgatatatgcttgaccaattacttggacaacaaatggtctaagcatcaacaaactgttagatcagttgaattggatattgaaagtggtgctgcagctagagactggaatgccttgcaagcaagcgaaaaattgaaacctgtcgaagttgaattgaaaagaatcgaaagtataacagaagagattgttgaagaattgcgttacttgaaagcaagagaagaaagaatgagagacactaacgaatctacaaattctagagtgaaatggttttctattgtcgtcattgcatctttggtcggctttggcgtttggcaaatacaatatttgagacactattttaaagtcaaacatattatttaa

SEQ ID NO: 6217 - DNA, 459 bp, Candida albicans
ttaatttcaatttcaatgtcaaaacatcgtttaacaaataacaagaataataccaatggcatttcgaaaccatcctcaaattcagtatcagtggaaaacagcagtacaaataacccaaaagctggtcctacaccgacattgaaggttgttttgttaggagatctgggtgtgggtaaaacttgtttgagatctcaatttgtacatcatgtatttaccaacgcatacaaggcaactattggaggtgattatttgacaacatcagttgttctaccccagcaaatacaacaatcacaattatcgtcatcgacttcatctttggacattaaatcaaactttgcaactaccaaactaccgagtacgaatacaaaagtcaatttacaaatttgggatacagcaggtcaagaacgattcaatagtatatctcaagcattttatcgaggcacagatgtatgtgtttag

SEQ ID NO: 6218 - DNA, 1425 bp, Candida albicans
aaaaaaaaaaaaacggaagtaaacaccatatacaataaatcgaccacaacacaacaattaaacaaagcaagacaaaccatgtccactctgtcgtataaaaaacaggatgcttattcaagcaatgttggaattcctgataaaatggcagttttccaggaatgtcttcaacagtttaatgcttctccggttaatgcaaagaaatgtcgacaactattagccaaattattgagattgatttataatggtgaatcattccctgctcaagagtcaaccactttgtttttctccatttcgaaattgtttcaacataaagatcaatctttgagacaattagtgtatttgactatcaaggaattatcatctatatcagatgatatcttgatggtaacttcttcgatcatgaaagatattcaaggcaatgatgctgtttacaagccaaacgccattagaactttatctaaagttttagacccaactactgtaaatgcagctgaaagattgttcaagaatgccattgttgataaaaatccagttatttcttctgctgccttgatttcatcttacaatttgttaccacatgctaaagaagttgtcaagagatttaccaacgaaactttggaaactattcaatcttacaagctgttcccaccaactcaattccagttgcatgaatattacggaagctcgacttcaaacttgccatcaactagttacatgtatcaatatcatgctttgggtttgatttatcagttgagaaatcacgataaaatggcattaatgaaattaatcagctctttgtcggaaggatcttctttgaaaaactctttgtcgattattcaattgattagatatatcaacaaaattttgaatgatgatcaatcattaatttctcacttgtacccgattttggctggatttttaaagcacaagtctgatatggttgaattagaagcttgtaaaactttgatcaacttgcaacacttgatcaaagacgatcaatttatggcaattgtgaatactttacaaaaattattgggtgtcccaagaacagcaaccagatttgctgccattagattaatcaacaagatttctatcaaacacccagaaaaaattattgttgttaacttggaattggaaggcttgattaatgacactaatagatcaatttctacattggcaataaccacattattgaagacaatgggtgctggtactgtcgatactggatctgttggtggtgagagtgtcgatagattaataaccaaaatgacatcattaatggatgaaataactgaagatttcaaaattgttattattgaagcaattgaaaacttggcattgaaattcccggctaaacacaagaaattagtatcatttttaactgatttattgagagatgacggtacattagaattggaaaagtag

SEQ ID NO: 6219 - DNA, 1209 bp, Candida albicans
aattggaaaagtagtattgttgacgcattatttgatttgattaagtttttaccagatgcaaatgccaaacaattgatcttaatgaacttgtgtgaatttattgaagattgtgaatttacagaattatcagttcgtattttgcacttgttgggtgacgagggcccacacacttcaaacccttcatactatatcagacatatttacaatagattggttttggagaattccattgtcagatcttcagcagttattgccttggctaagtttgctgcagtttgtggtggtgaagtatcgaagaatattgttattttattggaaagatgtttgaatgatgttgacgacgaagtgagagatagagctgccatttccttgaatttcatcaacaatggcaagaagaatttgattgtcagcgattccaaatatgatttgaatgccttggaaagtaaattagttcattacttgaacaatgaagagaacttttctgttaaatttgatatttcagaaattaaagttatttctagtgaagaattaaaatcaattgaatacgacagaaagattagcaaattagaaaattccaatgttgaaaataacgatactcccgaggttgaagaacaaaaggggggtactaaagttgaatctgctggtgataatgttgctaatgacttgttaagacaacaagaatacgctcaagaactagctgctattgctgagtttgaatcctatggaaaattaacaaagtcgacatctgttcctatatatttgactgacaaagaaaatgaaattgttgttagtgtcgtcaagcatttgtttgctgaatcacaaaaattggtgttacaatacaatatcaataacacattaccacataccgttttacaagatatttccgtcattgctcaaccagataatgaattataccaagaagattttattgtaccattggccgagttaaaacctgatcaaaccggtattgtttatgtttcattctcagccccagctatagaagatgaagaattgctttcggcatttggtaacaccgttgcttacactaacaaagatttggatgatgaaggtaatgttgacccaacagacgatggttggtctgatgaataccaaattgatgatttggaattgttggctggtgactttataattccattatacaactccaatttcacatctatttttgatcaattacccaatcaagattcc

SEQ ID NO: 6220 - DNA, 561 bp, Candida albicans
  unsure (277): Identity of nucleotide sequences at the above locations are unknown.
tgtgtgcagcaacaaaaaattagaaaaaaaagacaactcacttcttcaatgaccgacttaacaccattattccgtcagtgtgttgacatcgttcagcaagagtacaagactcagccaaccacagccaaacaaccttactaccttaacgacacatttattaaggagacgaccgcctttttccatgtcttgaccaacttgaaccagttcatcaacgaaaccaaatcaagttatctagccataaacgatgacacgaaactagctgggtcgattgacgacnaaaacaagatcgacgaagatttcaattacaaggtccagcaaatgtacaagcgattaaatcatttggagacatacgaaacaaagaggcagtcgttactaccaaagactagcgggtggttcagtttcctagacgaatccaacgaccaggacatatactttgagacattggcgaatcatcgtatgcagatattgcggttcctcatggagacactccaccatgtaaacaaacgctttgaaaacttccaacaaaaaagattgggctcgtggaagaccactaaacttggt

SEQ ID NO: 6221 - DNA, 513 bp, Candida albicans
tcaaaattattcaaaaaccgtgaaatgagaatattaatgcttggtttagataatgccggtaaaacaacgatattgtataaattgaaattaggtaaaacttcgaaaactgtccccacggtcgggttcaatgttgagactgtgaaacacaagaatgtttcctttgcagtatgggattgtggtggtcaagaaagaattagaccattatggagacattatttcactgggaccaatgcattaatttatgtagttgattccctggatgttgacagattagaagaatcaaaacaagaattatttagaattgtcactgataaagaattaacaaattgtttattagtggttttagccaataaacaagatgttgatggtgctgttaaacctaaagatttgattgaaagattccaattgaacaaattaactggtgaacacacttggtcagtgattccaaaaattgcaattgatggtactgggttagttgaaaccttgaaatggatttcatcgcattccaagtaa

SEQ ID NO: 6222 - DNA, 564 bp, Candida albicans
ttatttacagttcaagatatattatcatcattaggattatggaataaacatgccaaattattatttttagggttagataatgctggtaaaactactcttttacatatgttaaagaatgatagattggccactttacaaccaacattacatccaacttcagaagaattggccattggatcagttagatttactacttttgatttaggtggacatcaacaagctagaagattatggaaagattatttccctgaagtcaatggtattgtctttttagtcgatgctgctgataccgaaagatttgctgaatccaaagctgaattggaaagtttatttagaattgaagaattgagtcaagttccatttgttattttgggtaataagattgatgttcctactgcagtaggggaaatggaattgaaaaatgcccttggattatataatactactggtaaagatactggtaaattgcctgaaggtactagaccaattgaagtgtttatggtttccgttgttatgagatctggatatggtgaagccttcaaatggttatcacaatacatttaa

SEQ ID NO: 6223 - DNA, 777 bp, Candida albicans
tatcaacaatatgcaattgctgatgatacagttggtgataacattcctattatggaagaagatgatgaagatgatgcagatgaacaatctaagctacagaaacaaaaagttaaagaggcacaagaacaagaattgaagagaaagcaggaacaacaacaacaaaaagctgcagcaaagaataacaacaatagtggcggtggtggtggcaaattcttaagcttattcggtggtggtggtaataataagaaacaagataatgatgctaaagtttataaagctcatttaggacaaaagaatacttttgtttatgatgaaaaattgaaacgttggatagataaaagtaaaccgttagaagaacaattacaagctaatcttccacctccaccacctccatcaatgaagaaaaaacccaatcctgtctcaactactacaaacagcaataatagtagtggaccaccaccaatggttacacctaatccaactccaattccaggaggtgatttgtctacgactacaacagggggaatatcaactcctattccagcatcagctccaccatcaagaatgagtaaagatactactaaaccaacaccatcaataaatagaccaaagagtagtttagctacagcttctggattagatgatttattatcactaacagataattatcctccaccaaatggtagatcaagaggtgtcggtggcggtgctacaccaggaggaagtagaagaaataaacctaaacgtcgtggatatgtgaatgttatggagaaataa

SEQ ID NO: 6224 - DNA, 570 bp, Candida albicans
aggcaactgaatttttggatagaatttgggaaatttttgaaccaacaaggtaattttattgatagtgaaattgcttacatcatggctggattaccttttggccatcagaactttatggtgttggcatctggtcataattccatgtacactgaagtttatgaatatgctttgaatttacacaaggcaatgcatttcccacacttgttgtccttaaagttgaaacatgcattgactttagctgattatggattgatcaatgaatcacagagatatattgatcatattaattctagtatcaagacattgggtaacaaatcaccttttgtcacgcctaatttgcttcatgagtttcagaatttgattatgagaatcactgaagttggatctggagatgatcaaaacaactggttttccggtaagattagtcgagtcaatcttgataagatctggggacaaattgataaatttattgttggtggagatgaactgaaaaatggtaacaataacgatggtaatggaactggcaatggaagtggtagtgttttcaataaatttagcccttccgtgtca

SEQ ID NO: 6225 - DNA, 2640 bp, Candida albicans
caacctgattttgagcaaaatcaagatttagaatccgagaaggcaacaatctcaattgacaaaaaagacgaagatcctgttcttgaaagtctaaccactgaatcagatattcttgacaatgatcatgaatcaacgagtgaagctcctggtatctcaactgaactggaagtctttgaagaagaagcagtagtggaggaagtgcaatcaactgcagaagattcgcctgtggatgccactcaaccatcagagcttggacctttatcaacagaacagattaatcttgttgatgaaccagaagctggtgctccaaatactgaagaatcgcaaacagaatccaaattagatcaattctttactgagtcaaatgaaggagatttctttgaaaacattgccagggataatgtagaacaagaagtatccaatccatcaaagacagaggcggatcaaaaactcgaagatcttttcgccggtgctgataacgaaaatggcgaggatcttgattttcttcaacaaccacagcataatgttgcagaggtaaattctgaagctgccgtagctaccgaatcaatcaatttagatttatttggtgaggatgatacagatttccttgatgaattaaactccaaaaaacaacaacaacaggaagaagaagtgagaccatcatcaagttcaactacaaatcctgaggacaaattagcagcattagatttagatgacgatttattattagatgatgattttttggaagaaggttctgtacaacctaaagtagagagttctttaccagaaaataagctagtgaaacaccatcattcttacattcctagcggtccttctgccaatcaaaagtctgtatatgcaccaccacaagtttctggagttaataagaatgattttattaaaaatttagaacaatctaaaaaaaaacacgatgcatacgatttcccagatacattattggtaaacaaatcaagaccagctgctagacatgcaccttcatcaaacaagtatggtccaccatctgtatcacaaacgagtatcccatctatctcatcaacaagtagtttaccacctgcaagagatgtaaaatctagctcactggcacctcctgcagcagcacctccaactggtacaagcacttcaaaagttgccaagaaatcatttttcgaggactttccagatgacgaagaaattcctaaacctaaacgtgcaggcagagcagctgcaccagttaaggcagtgaatcaaattcactcaccacaagttttgaatcagcaggtgcaacaacaacaacagcagcagcagagtcaacagaatgcaccaccagcaccaccaccgtcaaaggtaaacaaacaaccacctgtcaatccatatatgccaaaatctggcacatcgccaatcttacaacaacaaacccctgctgttcataaaagtggtattgcagcaccaaatgtgaatgttccacatgcaaacaattatgctccaccattgaattcatttgcatttccaccacgtcaaccaaatcaaaagactaacgattactccccacaattacagtcttctccggctccaccaccaccacctactagtttgcaaccatttcctctgattggtcagtcacaatctgccccagtttaccacaatcgacaaccttccaactcaattaacactaatgtgaataaagtgccatctattaacagtccatatgttcctaatgctggtccttatgctccactgacacatcagagatctcattcaagagcaagttcattggttggaggtaaaggcaaagaggtcaatccttatgcccctgcattggagacagtggcaagtggcgatattaatcagatccaacagcagcagcagcagcaacaacatctttcaccagcaactgcggttctcccaccagccagagctcgtggattttccaacgcaaaaagcaacatctataagtctgcgccaaaagttgtcaatccggaacaattggttttcagacaatacccaattttcagttttagtatcaattccaattgttcagtcataattccaaacactgggtataaccagggaacaagtattaacattggaccaatctctaatttattgaaagataaagatttatatgccactttccctggtcctttatccaagagtaaatctaaaaagaaagatgttgaaaaatggttggaactgtcatcagggtatttacgcagtttagggaaaaatgatgaacttgtgttaaatgatattttgttgcatttgatcaaacatgatggtgatgtgaaaaatcaagaatttttaagatcagcatgtctgattctcaatcctaatgtcaattttgatgttaataatcttccaacttctggattagccattggagctactaatgctcataaattggacaattccggtatcaacactgtattcactttgattcaatcgggtaatttggaaaaggcattagaatattgtgtgtttcgtggtgattgggcattagcattaattattagtggtcctgaaaatttcaataagattgctgctgaatacgctagaaatacattcccatttgctaaaacgaacaataaagtgttacatattatgcccataattttgaaagttcttggtggtaatgtttcttag

SEQ ID NO: 6226 - DNA, 354 bp, Candida albicans
ttgcaaatatctacgatgtcattaaatatatctttatacactatatctgctgttctaatattagacaatgaaggtaatagactatttgcaaaatattacaagtcatctttaggtgaagattcagctaatccatcaagtaaattccctcatcaatttgacactcaacaacaacaacttaattttgaaaaatcattattttccaaaacctacaaggtgaatcaagacatattattatatgataaccatttaattgcatacaagcaaactaacgatcttttattgtatttggttgcgccattaaatgaaaacgaaagtttgatttattcaaccatgaataatttatttgaagcatag

SEQ ID NO: 6227 - DNA, 264 bp, Candida albicans
actatattattggataatactgttgataaacaaaccattttagacaaatacgatatggtctgtttagcaattgatgagactatagatgacggaataattattgagtatgatcctgcaactatcgtgagcagagttactaatccaccgtctgcagtttacgagaacgtgaacttgaagaatattgatattagtgaaaaggggttgttcaacgctttatcgtttgcttctaagaaattgggtgaaagattacaacaaggattgtag

SEQ ID NO: 6228 - DNA, 498 bp, Candida albicans
aaaaaagataaagtcttctttatattctcttatcagaaaactcctatgccatcaacaacaatcgagcatctcgatattgaaaatttattatcagagaataaacctataattttaagatgtccttttaaagaatgtaatactagaataatcccttattccaacaaattgattcacttgcaaatccacaacgcacctaatgccataagggcagttcccgataactcaccagaattgtcagataaattgattaatttctatcagataaatgatgtttgggattttgataacataggagtcagtagaccatccagtgagatttctcaggatccaataattagccacgataacgagtcgacgattcatatagaacggttgattgtgtgtagtgaatgtgatcgaggtccattagggtttgccgggatacccaacggaaaagagacagatcataaaaatctagtttatttcctaagccgtgacagtgtcatttatgattactaa

SEQ ID NO: 6229 - DNA, 864 bp, Candida albicans
caatattcaataatggattttgaggaagctgaagatatcaatggtattagatttgcatggaatgcatttccatccactaaagtggaagcaggaaaggttgttgttcccactggtgccttgtatacaccattgaagcaacgtgaagatttgccaattgctgcttatgatcctatttattgttcgaatcaatcatgtaaactgattcttaatccatattgtgcggttgatcctaatgggttttggcgttgtcccttgtgtcaatatagaaaccctttaccagctcattatcatggattgaatccagagaatttgccccttgaattacaaagtacttcttccacaattgaatatattaccgctagaccagttcaaaacccacctattttcacttttgttattgatttgtgtcaggatgaagataatttacaagctttgatcgaagacattattgttagttttaattatttgcctcctaatgctttaattgggttgattacatttggtactatgattcaagttcacgatttgggtagtgataaaatcaacaagagttatattttcagaggtgataaggaatacaccgataaacaaatatcagagatgttgaatcgtccaatttctacccaattgatgcaacaacaacaacagcaaccaggacaaatgaacccacaacttgctaattgtttgacaagattttttttgcctttagaggatgttgagtttcagttaaccagtattttggagaatttgagcaaagatccttgggcagttgccaatggtgctagacgtttgagaagtactggaagtgccttgaacattgctgtcaatttgttggggttgacttatccagggcctggtgcctga

SEQ ID NO: 6230 - DNA, 1956 bp, Candida albicans
aacggcccaacatcaatctccgttctagaccaaaattgtattattagttgtcgaacatgtcgagcagtattaaatccttattcacctataaataactcactttggacatgtcaaatatgtaattcatctaatcaactcccagcaatggttgactctgaaggtcagccatgttaccctcccaatctcaatccagaattaacaacagtagagtataaaactggtagatcaagtgctttacctccaatatttttttatgttgtcgataccatatttgaaaatgatgatattgaaagtgctttccaacaacttaaagaaagtttaacagtgtctttgagtcttttaccagaagatgcattagttgggttcatctcgtttggtaaacatgtgagaatacatgatttgggtagcaatgacaatttaagttacacatttaacgggaacaaacagtacacattggaacaacttcaatcttcccttggattaatgagttccggattgagcactgctgggttaaaacaagctaaagataataatgggtatgatcaattgattggtaatataggtaaaagattcttacagccagtaaatattgccgaatatcaattgacaagaattatagaaaccttggtaccggatagatttcctcataatgaatatagtgaacgtccagaaagagccactggtgcagcaataaatgttgcttcgttattgctaaaaaccattttaaataatctgcatcatttgactggtggtcatttaatggtgtttatcagtggtgtatgtacttttggaccaggcaaaattgttgataaattgttaaaagaaccactcagatcccatcatgacattataaaagcgcaaacaactaccatacaaactccatcgacatctcatgttgccaaaagtgatattaatttattcaaacaagcaaaaaaattttatgaaggaataactaaaactcttgttacgttggggcttagttgtgattttttcattggaagttatgatcaagtgggactttatgaaatggatgaagtatgctataaaacaggtggtagtgttgttttaagtgattcttttagtactgccattttcaaacaaagttttataagatttttcaaaaagcaagaagaagacgaacaagatggagaaaattctgaatatttggatatggggttcaatgccactttagaagttaagactggagttgatttgaaaattgaagggcttattgggaatgcaacatcgttaccttttaataaaactgttcctgctaatgaaagaatgataagtaccaatattgttggagaggggaaaaccaacagttggaaattgtgcaatgccaatccacaatcaacttatgcattatattttgagaaactagatagtgttgctgctgctacaacaatacagtttcttttccattatcaacatccatcaggtgagatgagattacgtgtcacgacaattcctgtaaatattattgctgattccgataacatcaacttggaattagggtttgatcaagaaactgcactagttttggttgcccgtgactcaataaataagttacaaccaggaaatacaaaagtggcaacaacagctagtattgtcaaacaattggacaatacattgattgatttttgtactcgttttgcagtttatactgctggtcagattgaatcttttagattggcacagacattttctttattcccccaatttctttaccacttaagacgatcaccatttataaatgttttcaacagctcacctgatgaaaccagttatgttagacatgtgtttatgcacgaagacaccgcaaactcattattaatgatacaaccaacattattgtcctatgatgtaaatacatgggggtcgttagttgatgaaaccactggtgaaacaataaatgaacctgaaccagtattattggactcattgagtttatga

SEQ ID NO: 6231 - DNA, 273 bp, Candida albicans
gaatatcaatatttcaaagaattcttggaagctccgaaaagggaagcaatgatgctattaatggatagattccccttgcctagattcattgattgtgatgaaggtggatctcaggcaagatttttaatggccaagttgaaccctagtacaagctatgctacaaatgtcaatcatctttatggtattggagaccgaagtgacgttttcaccgatgataccaacttacaactgtttatggatcatatacaaagagtagttacagctaaaaaatag

SEQ ID NO: 6232 - DNA, 1176 bp, Candida albicans
agaccagatgccttcaccacttctattttcaaaagatcgttcttgagattgttcaacaaggatgacgaagggtaccttttgatgggattcaatggtaatttggaagtcagaacttccaaagaattgaaaatcagtgggttgattggtaatgcatcgtcattacaagttaaatcagccaatgttctggagaatgaattagggttgggaggtagttcaagttacaggttgtgttcaacgtcaccaagacatacttacgctgtattctttgatgttgtcaacaatcaacaattaccaccaaatgctcaaagctatattcaattcataacccattaccaacactcgagtggtacttacagagtcagagtcactactgtatcgaatttcttgaccagtgatgaacaaactttgaccaactcttttgatcaagaggccgctgctgtgttgatggcaagaattacattattcaaagctgaacaggatgatggagccgatgtgttacgttgggttgacagaatgttgatcagattatgccaaaagtttgctgattatagaaaagaccaacaagaatcattcagattgggacctcaattccaattatatcctcaattcatttattatttgagaagatcacaattcttgcaagtgttcaacaattctcctgatgaaaccgccttttaccgtcacgtgttgttagtggaagacaccaataactcattgattatgattcaacctacattgacatcttttacattagatggggaaccagaagcagtcttgttggacagtgtttccattaaggatgatagaatcttgttattggacacattcttccatatcttaattttccatggtaaaaccatttctcaatggcgtaaggcaaattatcaagatttaccagaatacagtaatttcaaagaattattggaattccctaaaaaggaggcagcagagttattgcacgatagatatccgttgccaagatttattgacaccgaagaaggtggatcacaagcaagattcttgtacagtaaattaaatccaagtgtgacttacaataccaatgactttattggtggtggaggtgctggtggaggtgctattgtgttgactgatgatgttagtttgcaagtatttatgagccatttacaaaaattagtagtttctgggtcttcataa

SEQ ID NO: 6233 - DNA, 2586 bp, Candida albicans
atgagtcgagcacaagaagaaacagaacaccattctgtgaagtttaattggaatgtgtttccagtcacaaggctagaagaatctcaaatgtcgactcctttagggtgtgtgtatactccattcaacgactccaatgtaccacctcaaaccaaaggcttacccatttcttgcacaacttgtcaagcttttttgaacccgtttatcaaattggataggaaaaatggaatgtggtggtgtccattctgtcaaaagggaacttatttaccagagtcagtaaatgttccggaaattgcaacttcagttgaagattggccaatagaaatgagagaaacaagtactacaattgattacgagttgccccatgatattaccgagaacacaaccacggcttccccgttgacttattattttgtaattgacagatatcagcattcagaagaagaatctttgaataaattgctagcttcgatagtgtcaacaataaaaaacaacatccccttaggaagcatgattgggataatgactttcaacaaatcagttcaattacataaaattagtaccaagaaaacagtcgaaatatcgagagacgacattcccaattgtgacaaatactggaagttatttgaaaaactggacattgagcaattactgaatagacttgggttgaccaatactctgtcagaattagattcaaacaaccttttgagaaacaactacgtaatagagctatcggagaataacatggattcaattatcaattatatattgaatatcaaaccgacttataccgaaaaacacaagccttcaagatcaacaggtcttgcccattacatttattcaatcatgttttctcaatcaagagttaaaaactttattgggaaagttttgtttttcactagtggtgcatgtacagaatttcctgggaaaatagtggatgaaaactctccaattagatcacataaagatatttatgatctagaagcaccgttttttcctgaggcatcaaaattctatacggttttgtcttacattgcaaatggtcaatcaatagctcaatcagttgaaattgtgaaatcgtcatcatccaaaactacacagtataacatcgatcaggcatctccagtatggtctgtcagcttgtacgccggatctttggaccaggtaggtgcatatgagatgaaaccactcgtagccaacactatgggctcttttttcttgactgagacacttggctcttatcagattaaagacatgattacgagggctattggtttgagtcatcacaaagcacttttggaagtgtctacatccattgggttgaaaacgtctaagttgatatttaatggtgggtatgcattaccatcatcctaccataaatcctctaaatacaaccatttatatcacattaaaattgatgacgaacttggtgaattcgattccccacatgccaaaaaagcatttactaatagatggaaattcaacgaactaaaaaaggatgacactttatcgttatttttcaaaatggagtcagcaaaatctactgaagatcttagcaacggttcaatcactgagattttcattcagtttaaattgaagtcttgggatgtggttaaaaataaatgggttactagagttactaccattcgtaaacccacaactttatcttacgtgaaaacaagcacaggaaagaagaatcatcaaagcatgattttaaaagaacaaaaatttacacttggttttgatcaaagagtttggacgattttgctaactaggttgttaatcaacaaaattgatacaaaccttgggtattcttcttttgacgaactagtggatcttattgatagtacaatagtcaaactacttcattattttggagggatttcagtagccaacagtcatactcaatcttcgaacccatattaccgcttacagacaatgtatgaattgaaccaaaaatttaaagagttaccatcattaatttacagtttgagaaagaattccgatttaatcaaaattttcaattcaagtccggatgaaacaacatattatcattcatggtttttaaggatgaacatgcctttatcaatcaaagttattgagcctgtgctaatcaacgtagcagaccatatcactcgcttaccgttagattcaacttgttttgatttggcacctgctgattcatttttaatacttgataccgggtttaccttaacattatattataaatgtcacaaccaaaacaaattagacttgcatccttctgataatgattttatgatagagaacaaggaatcaaaactaccatggaatattattgaacaatatatttctgaacgtcagattgttccaaaaattgtcataactcaaaccaatcattcacaagcaagatttttagtgtcacggttaaatccaacaacctcagactcaacaaaagaaaatcagccacacttggacaacaataaagctgggttttggtcgttttggactagcaataatagaaagagctctaaattaattcccgaagatctaagcttaaagagatattatgacgatttaattgaacaagtacaaaaattcaaaatctag

SEQ ID NO: 6234 - DNA, 933 bp, Candida albicans
atggatttggcttcacttatttttagtaatcgcgttaatacgtgtgctgatatctctctccagctccagctgaattctcttttttttttcccgtcgtttcacaaatcaaatataatttggtcctccctatttgttattcttttttttttcaagactaaattgaacaaaaccttgacctcgtccacccacctcttcattattatttcatacaatacaattgatattcgaaagatgagtgacgggaaattgtttactagatcaaaaactactgaattacgcactgagcttgagcaagcattcaagaaatcaaaacctgtcgttagggttaaggtggttctcaaaaaagttttggcaaacataattttaaataaccatgaagtcacaaacttaatgaaggatattatcccactaatgaaaattgatgatttggaggttagaaaactatgctgtgagtatatatctacatatgctaccacaaacccagatgccgaagatgcaataccctttttttcccggtttcacagtgatccaaaccctttactacgagtattatcgttaaaaactatggtgtcaataaatcggaaagagtttttaaatttatctattacttcatgcaaaagactgttttctgataaagatcccgacgttagaaaatcggcagcatacgcagctggccaaatttatcaacatgatcccgctagagccgaaagagagggtttaatagaattacttaatcaatcattatacgacgaaaactcctcggtaatttccagtgcattagcatcattagggaccgtgattgaaaatagcaagacattgaatttgaaaatagataaaaaccatgcattaacgttaataaaattgctacgtgcaaccaatgcctggcattcttcacctaccaagccgacagatcagcaattattctccgggaga

SEQ ID NO: 6235 - DNA, 864 bp, Candida albicans
agatcctatattgttcaagaatctgcaattgtaattaaaaatatactacgcaagtatccgggacaatttgaatttgcgatcagtgaattgattaaacactataagttaatcgatgagccagatgcgaaaacggcatttgtttggattttgggacaatattgtcaaaatatcaaggaatcgaaatctattttagaggactttattacttcatttaaagatgatccgctagatgtacaatatgccaccttaacagcagttgcaaagtattatctaaaattcccggaacaaggagagtcggtaatattgcgagtcttgaaatgggcaacagaagaggttgataatccagatatcagagatcgtggctacatttattggagattgttgtcttcggaacatgccagtgggcccaacggagagtttcaattgaatactaagaaaatcatattgaatgataatcctgtaataacatccgaaaatgacaacatcaaccctgttattttagaggaattggagttaaatatagggacgttggcttctatttacttaaaaccagtacagacagtgttccgattatcaaaacacaaagaacttccatatagtcctgctcttcaacgaaggaatctgtttcattcgggggtggctacgccacagccccaaagtagaaacctgaaggaacattctccaggagcaggtgcgggagtttccaggcgaatgtcctatagaagaactaatagtgataatggaagtcaacgaagcacccactttgacgaaaccacaaacactcagcaacatatgccaagagagaatttagcacaaaagttttcgcgtaaggcatcatttattacaaatagaatcaaaagctaa

SEQ ID NO: 6236 - DNA, 507 bp, Candida albicans
ttttaccaattgatccgactacaattcaaattacacattttcttatacaccaactacaacccatttcttatgtcaatacattttatattagttcttaatcgtcaaggaaaatcacgattagtcaaatggtttgacaactcatatacaccacaacaaaaacaacaatatattctggatattcatcgattaatcagtagtcgagattctaaacatcaatcaaattttgttgaatttcaacaaaataaattagtttatagacgatacgcaggattatattttttatgtggtattgatttaattgattcagaattaagttatttggaaagcttacatttttttgtcgaaattttggatgtttattttgatagtgtttgtgaagttgaccttgtatttaatttttataaattatattatatattagatgaaatttatcttggtggagaaatacaagaactactgaaaaagaaaattctaaatcgattaagttatttagatggattagattaa

SEQ ID NO: 6237 - DNA, 807 bp, Candida albicans
tcggaccttccagccgcgtgggtgaagaaaattaatttggaattatctagcaatggtggtagtggtaatagtcaatattctaatttattacaaaaagttttagaattggctactaaagaatgtgaaaatgctgatgttagggataaagcttatatatattggagattattatcatcttcttcaagtgaagatcaacagaaaaagattttgttaacaaaattacctcctattgaaacaacaattagttcatttagtccaggtttattagaaactttattagatgaattatccactttatcatcagtttattataaaccagcaaaatcatttattgatcctaatgcatattctcgagttccagtggaaaagaagaataaaaccaagattgaagatttgaaaaatatggctaaagaagaaatcattactaatgccagaaatgataatttacttgattttgatgatgatgatgatgaagaaggagacggagttagtggttccaatggtgatagtggtaatgttggaaatttgttagatgaattaaatgacttgtttagtactccaccaccaccaccttcttcgtcttctcaaaacagtcaactgcaaattgctggaggacaaacttcaaccaatgatattttaagtttattcaataccattaacaccaccactactactactactactcctcaacaatcaactcaaagctccacgactcatggcattgaaaacttatctgtatcaagaaatgcttctacaactactaaaaaactataccatgttaacaatgatctattagatcttttttga

SEQ ID NO: 6238 - DNA, 903 bp, Candida albicans
ttatgtcttaatgaatgtactgaatgggggagaatcaccattttgaatacattggctgaatatgacactgataattctgaagaagctaatcatattatggaaagagttatacctcaattacaacacgttaatccttctgttgttttaagttcaattaaagccattttgcatcatttaaatgctatccccgtcacagcacaaagaagtaatatattgaagaaattatccgctccattggtatctcttgttagtacttctataccagaagctcaatatgtggggttgaaaaatattagaatcattttagaaaaatatcctaatgtattatctaaagaattgcgagtttttttcattaaatattctgatccattatatttaaaattggaaaaattggaaattatgattcgattagcaagtgaacaaaatagtgctcttttattgggagaattgaaagaatatgctatggaatttgaaccagcattagtgacaaaagccattaaatctattggatcagttgccatcaaacttcaggaaagtgcggttaaggcaattaatcttttacatgaaattattgatgaaagaggtggtgatttgattatcaatgaatcagtaactgtattggtcaatattttaagacgttaccctgcgaaaaatgatttggcaactttgattataccggttatttccaatcatgttaatgaattaaataaaactgaagcattatcacgttatatatggttaataagggagtatccaaaatattttcctggtttagataaaaaatttagtgatttattcgatggattttggaaaaatgattcagtatttaccattgaatattttatcttacaattgtttaaaattaatttggcactttatctacccatggggggtaatgggtaa

SEQ ID NO: 6239 - DNA, 372 bp, Candida albicans
ccaaccatgtcgtcatcttataaacaaacaatcaacaaaaatttcaataaagtcaatagtattcttgaacgaaaattacggaaataccttgttggtcctaaaaaaggtgaaacttttgaattgaaaaatggattagtatcacaatataaacatgaacgtaaagatgctattcaaagagtgattcaagcaatgactgttggtaaagatgtatcatcattatttcctgatgttttaaaaaatattgccacttatgatttagaacaaaaaaaattggtttatttatatttaatgaattatgctaaaactaatcctgaattatgtattttagcagttaatacatttgtacaagaatatgaaaatccaatcctttaa

SEQ ID NO: 6240 - DNA, 552 bp, Candida albicans
gggctgagaacaatgttgtaccatatattgctattgatccatgtggctttggcagttgttccaaacatccccaaaatatcatctcaattgctgcccaacccacactattcattaccaaatttgttgtccatagaatctaaagaagacatcaacaactttgacatttccaataatattcaatttgacaacggtagactattattaggagagttaggttcaatctgggggaaatacaagatccccactctcaataagccatggactatcgaattgatcttcagatcaacaggaacaaaagaggatagaaaatatgaagacaacagtttaaacgtatggctactcaatgaagataacaacaatttgccttttgatagttttgatggatttgagatcagtataaataacgaaggccagattccaggagtaaaactctataacaatgatggactgcaaaatatcattcatgatgctagtcatgtattgggaacttgtaaatttcaatatttggactctgatgtacctttcacattaagaatttcttatgacgctaac

SEQ ID NO: 6241 - DNA, 390 bp, Candida albicans
gaatcaacagtcatggccattcaatttttatttctcatatctcgacaaggtaaaaccagattatcaaaatggtatcaaacgatcctgcaaaaggagaaatccaagattatacgagaattaagcacaataatattatcaagacgagccaaaatgtgtaatgttttagaatataaagatttaaagataatttatcgaagatatgctagtttatttttcgtcattggggtgaattctgatgataatgaattgattggattagaaataattcatcgatttgttgaacaaatggataaaatatatggtaatgtctgtgaattggatattatttttggatttgataaggcatatcatatattggatgaattgttgattgatggatatttacaataa

SEQ ID NO: 6242 - DNA, 324 bp, Candida albicans
aacaatcacagtccagtcaaaaaaatgctgaagaagaatgataatataacttatgatgttgaaaagatatctattgaaaatccacttcctgctaaggagtttaatgatttccatgacaaattagatgttgaaaaatatggagaaactaaaagaaaattgaatctgcgtcacgttaatttattaatgattggtcaatctattggatcagcattgtttgtcagtataaagaaaccattacatgttagtggttcactgtcattttttttagcatttgcaatttgggcttgttttaatgatatacccattgatgcaagctattggtga

SEQ ID NO: 6243 - DNA, 855 bp, Candida albicans
tcaagattatactacaaaatgtggcataaagagaaaagcagagaggcagaaaaaggtgaaattcgagaagatgagttattcaacaccaaggtagatcgccagacatcggcatattccgaatcatctttagttcacgataattcttccgttgatactgaccacacacaaagaaaactttataacagacatttacaattaatcgctattggtggtagtattggtactggtcttttcgtcactattggtactacggggttgacagtggggggacctttaggtcttcttctttcatactgtctttcgactttacttacgttattgcttacatctgctgtcggggagatggtttcttatatgccggttgattctcccttcttgaacatggccggccgtgttattgatccagctttcgaagcagctgcatctgtcaacttttgggtgatgcaaagtttatatatcccattcgaaatcactgctgtcaatggtatgatccatttttggcgtgatgattattccccagcaatcactttttgtattcaaattgccatatatgctgcaattaacttgtatgccgtgcgtgtatttggtgaatgtgaattttggttttcattggctaaattgatactttgtattgggttgttgtttttcacattggtcacaatgtgtgggggtaatcctaaacatgatgcctttggtttccgtaactggcatgcagctggtggccccatcgccacgttatataccactggatcattaggtagatttccaggtttccttggttccttcagatggagttcttcattcacatgtgttgggtcagaatatcttggtatggaccgctggtggatgtattaa

SEQ ID NO: 6244 - DNA, 873 bp, Candida albicans
ccctcgtcaccacttaccccattgcattcaggaaccgtgttgtatagattggtgttgttctacattggcggtgccttatctgtttccattttagttgcctacaacgatcctaagtatcttgagttaacctcagacacatctaatgctgcatcatcgccatacgttgtggctatgcagaacttgggaatcaacgtgttgccgcacattgtcaacgccgtcattctcacatcagcattctcagcagggtgcctgtacacttatacttcatcccgttgtttgtacaatttagctaaaaaaggatttgtgcctaaatttttcaaaaaatgtaccagtcatggggttcctgtcttttgtgttggtctttctatttgtttctcattattatctttgatgcaattaggaagttccggtagtaaagtgttgaactatatggttaacttgtgtactggtgctcaaatcttgaattatgcatttatgtcaatcacctatattgggttctatcatgcatgtaaggcgcaaaacattgatcgtcatcagtttacctacagatcgtggttccaaccgtattccatctactttgtttgcttcatgtattggtgtcttgtagggatcttaggttacaatgtgtttatgcccggaaaatggtccgtcgacacattcttatacaattatatcatggtgtttgtttcattagcagttttcattgcttggaaactctttagaagaactaaattcatcaaaccaatagatgctgatttgagaactgggttagaagaaattgaaagacacgaatatgaatattatgaacaattggaacaatcgagtaacaagccagacaataaatttaaaagtattttacattggatattctaa

SEQ ID NO: 6245 - DNA, 225 bp, Candida albicans
tgggacacaatgtttttcttttcgagttatgggtcaataatgatattcacagttttatacgttggttacagatttattaaaggcacgtcggtgcccagtttagataaattagactttgattcggggcgaacagagatggaccgatacatttgggatggaggtcgaagctataataagagaaatgtcaaagaagttgcacataaattagtgtcgtttcttgcatga

SEQ ID NO: 6246 - DNA, 1341 bp, Candida albicans
cgtttcactatagtagggacattggttttatgtacaataatgtcattctgtgaaatggttacttttgtttcagtgattgatggtgtatcgggactttcatcacgatttatagacgacgcatttggatttgctgctggatggctatattttttgagtttttctacaggggtggcaggagaagtagttgctggggttattatgttgtcatattatcctcatttgaatactgcaacaaatactggatccactgctggatttgtcacgttatttctagctttgattttgggaagcaacttggtacatattcaattctttggtgagttggagtatatctcgagtctagtgaaaatgatttgggcgattattatgatgattgtaatggtggttttgaatcgaggaggatttcctaataccccagtgatgggattcaaatactggcagtacctgaagtctgattttgcaaacaacataatctttggattgttccgaccagcatttaatcttcatgatgatggcacaagttctccaagtgaaggtattggtggagataaaggtaggtttatgtccttgttaacagcaattttggttgtttgttacgcatatagtggaacagaaattgtttgtatcgcggcatgtgaagctaagaatccaagaaaggcattgccatcagctacaagaagggtgttttggagaatcattatattctacgttttatcagcatttttggtatccctcaacgtttatgctggtgatccgcggttattacgatactatctgggttcgacagggattagcccgtctgagtttgctactaatccagctgtcattcaagccggtggagaacattgttctatagactacaaagttgttgctgggtatgggagtggtgctcaaagtccatggatagtggcacttcaaagctctagtttgtgtcaatttagttccataaccaatggattcttggtattttttgctgttagttgtgggaatgctcaattatacgttagttcaagaacggcttattcgttggcattacagggtaaagcccccaaatttctcacatactgcaatagatttggaataccttataatgcggtattatttgcaggatcatttggattattggcattcgcttgcgttaatgaatcggcaacagtggttttccaaaatcttaccagtttaattgcatcatcgggtatatttgtgtggtttacaatgtgtttaacatttattagattttattatggattgaaaagaataccgacattttggatagaaatgataaatcatacccttataaatcacctttccaaccatattcagctattgttggatgtataa

SEQ ID NO: 6247 - DNA, 384 bp, Candida albicans
aattttcccaaaattatttggatttggaatttggattttgttgatgagaaaagtttggataataattttatccccacccgggagatgaagaaaaagaaacagatcgaaataaaagaaggttatttacgtaaaagaagtaagaaaaattctttaggaatgtctgctgattcaaggacggcgacaatgatttttttggattcatatcaatcatcaagttcagatgttgttagtgatgacccacgttttcttcaacgtaagttatcagttcgacatttacaaatgatatcctttggaggcacgattggtgttgggttgtttttgaattcagggaaagcgattgctatggcaggagggtttggtgcccctgttagcgtttcactatag

SEQ ID NO: 6248 - DNA, 1191 bp, Candida albicans
tctttttgtttgtttgttttaccctcaaatatatttgataccatgtttaaaaaggaagaccaagctgtttccaaagaggttcggccagaggagttgggaagctttaccggctccgaagaaaaatattctagcaatgaatttctaaataccgaaagtaaaactgggttccagaactttattgattctttcagaagaaaacaagctactgaagatgaaagtgcaggacagcaattggcaaaaggtattagtaagcgtcatttgattttaatgtctttggttactggtataggtactggtcttttggttggtaccggtcaggttttgcgtaaatcagggccattgtttcttgttgttggttatgccattgccgggtcatttgtgtaccctacattgcaagctgctggtgaaatggccgttaattattctgaattgtcgggtggttataattcatatacaagaatgtttgttgaggatagtattaattttgccatttcatggaattattgtatccaatggttgagtgttattagtattgagcttgttaccgctgccatcaccattgaatattggatcagtgaaacgcgagtgaaccccgatgcatgggttgctattttctatgtcgtcattgttgttattcattttatcggttccaaggcctatggtgaatttgagtttatcattggactgattaaagtttgtttacttgttggtttcattatcatgggtattgttgttgatactggtggtggtccaactggtgaatttattggtggtagatattggagagacccaggtccaactaagaatgggttcaaggggttctgttcagttttcgtcactgcagcattttcatatggtcagtctgagtttgttgctttatctgctgctgaacaaccaaacccacgcaaggccattccaactgcatgcagacttatcttctggcgtatcattgtcttgttccttgggtcccttaccattgttggtttgcttgtgccatcgaactcggaccatttgatgagtgaaggtggtggctcaaacacctctccatttgttctttcggctgcccttcatggtgttaaagcagttccttccattatcaatgccgttattcttatgtctgttacatcggttgcttcttcgtctttgtattctgcttcaagatcttcaccaaggacggcagatccgcaataa

SEQ ID NO: 6249 - DNA, 1731 bp, Candida albicans
gtttttacctcaatcatgtcttcatcatcaacggcatcagaagttcacaaggccccagtggtcaaaaatattgaaaagcaggacatggacatgtactcagcatcaagttcatcagcaccaaaaacaacatggaataattttattgattctttccatagagcagacggtaagacttctgctgaaagtaaagaccagcgtatatccaagactgaattgcgtattatgtcattatctactgggttaggtactggtttacttgttgcatccggtagtaaacttagagctgctggtcctgccggtgttcttgttgcttattttatcaccggtatttgtatgttggcgccgaccattaattctgtttctgaattggccattgcttatccgggtttgcctggtgggttccaatcttattatgccaagtttattgatgaaagtcttgggtttgccttgggttggaattatgctttccaatggatgtgtgttttggctttggaattggtcacaagctcaatgataatcaaattttggacaaccacagttaatccagatgtgtttgttgccatattctttgtttttgtcactttgatcaatatgggtggggccaaagtgtatgccgttttcgaagcaagttttaactgttgtaaaattctacttttagttgggtttgttatttttgggttaatcatcgacgttggtggtggtccacaaggttttattggtggtagatattatcatgaccctggtgccttcacatctttcaaaggtttagcttcagtgtttgtcactggtgccttcagtttgggtgggtcagagtttattagtttatcggccagtgaaacaagacatccacgtgcttctatccgtgctgcttcaaaattggtttatttcaaagtcattgttcttttccttggttctttgacttttgttgggttattagttgcttataacaatgatcgtttgatgggaactggtgatgcagcaagtcatgcttcaccatacgttcttgccgctgaaatgaacggtatcagagtcttgcctcatattatcaatgctgttattttgatttcagttgtttcagttgccactgctgccatgtatagttctccaagattggttcaatcgttggctgaacaaggattgggtcctaaatggttagactacattgacaaaaagggaagaccaaccagagcttggtttattaccgttttggctggattgtttggtttcattgctgcttatgaaaaacaagaaactgttttcgtctggttattgtcgatttcaggtatttcattcatcatgtgttggttatttatttgtgtgagtcacattcgtttcagagctgctttgaaatacagaggtatcacattggaccaattggcttacgtttcaccaactggtgtttggggttcatatctttcagttcttattaattctcttattcttattgctcaattctggatctcattgtggccattaggaggtgacggcaaaccaaacgctaattcattttttgaaaattacttgggtgctcctgtgttcttggtttgttacattggtcataagctctggactagaaattggaaattgttcaagaaagttgaagatattgatattgatacccatagaatgatttgcgatccagaacttttggctttggaagatttggaagacaaagaaagatatcaaaaagctccaatttggaaaaagattttgatcaaatgttttgattag

SEQ ID NO: 6250 - DNA, 1728 bp, Candida albicans
tgtcaacagaagaatagaaaagaaaacattatggagaaaagtaataatcaaatagtcacaagtgaaaaagctcaagataatatttcatgttcagctgtaacaacaaactccaaacaacatcttgggtttgttgatagttttattgattcatttagaagagcaccagaatcaaatacttctgctgagaataaacgacaaacaatttctaaaaatgagttaagattaatggccatttccactgggttgggtaccggtttgcttgtggccacgggtggtagacttagagcagctggtcctgctggaatggttatcgcttatgccatcactggtcttgtcatgttggcaccaacagtcaactcagtagctgaattagcaattgcctaccctggattaccaggtgggttccagtcatactatgggaaatttattgatgaaagtcttggattcgctttagggtggaattatggtttccaatggatgtgtattttggcattagagtttgttactgtatctatgacttttaaattttggactacatctgtacacgctgatgtatttgttgcaatttttttcattattgttactttggtcaacttgggcggagctaaagtgtatgcagtcactgaagctgcattgaattcaattaaaattgtgtttttggtagggtttattatttttggaattattattgatgttggtggtggtccaaatggattcattggtgggaaatattatcacagcccaggtgccttcacttcttttaaaggtttggcttcagtgtttgtttccggggctttcagtttaggtggatctgaattcattagtttatctgcaagtgaaaccaaacaccctaaaactgcaattagagctgcttccaaattggtgtatttcagagtaattgttcttttccttggatcattgaccttggttggattattggtgcctcgtgattctgataacttgatgcatggtagtggctccagtgtgtcaccttatgttcttgctgccaaattgaatggagttaaagttataccccacattataaacactgtcattttactttctgttacttcagttgcatgtgctgctatgtacagttcccctagattgatccaatcattagctgaacaagggttaggacctaaatggttagattatattgataagaagggaagacctacaagagcctggtttatcacaatactagctggtgcctttggatttattgctgctttcaaagatcacgaaactgtgtttatgtggttgttgtcgatatctggtatttcgtttgttatgtgttggttgttcatttgcgtttgccatttacgtttccgttctgctttgaagcttaatggaattgatgttaagactttagaatatgtttctcctactggtatctggggttcatatatttccatcattatcaatagtcttattcttgttgcccaattctggatttctttgtggccattgggtggtgatggcaaaccaaatgctctttcgtttttcgaaaactttttaggtggaccagttttccttatttgttacattggtcacaaactctggactaaaaattggaaattatacaaaaaagtagaagatattgatgtaaacaaagatagagttgtcaaggataccgaaatattacatttagaaaacttggaagataaagagagatacgaaaaggcaccattgtggaaaaaaatattgattatttgtttcgattaa

SEQ ID NO: 6251 - DNA, 639 bp, Candida albicans
aagactattattttcaatttcatttttttttttggaataaaaaaacccttaatttatttaaatagaaagtttctatttttgttatttttactggtttcacacttgtcatattactataatcaaatgtctgaaccgactaaaaatttagaactgatacggtcacaagaactagatagtgaccactcaatatcgtatgactcgaccactggtcttaaacatggattaaaagatcgacatctaagtttaattgctcttgctgggattattggacctggtatcatgattggggcaagtttggcattggcttctggtcctgcagctttattgttggggttcggaatcattggtatagtggcattttgtatgatgcaaagtcttggtgaaatcgccaccatgtacccaacgggagcaacattttccaccttgggagcaaagtttgttgattattcttggggtggtgctgttggttggaattatgtgattatctggatagcagttttagctaatgagtataatactacagcttctgtgttgcaattttggggaccacaagtacctctttatggatatgtgttaatattatgggccgtgtttactgctttccaattcttgggagtttcagccatggggagcgtttga

SEQ ID NO: 6252 - DNA, 615 bp, Candida albicans
  unsure (39): Identity of nucleotide sequences at the above locations are unknown.
gatgtgtgcccccatttgattaatgccttaattattgtngtctgtattctggctattagttcttcaatttacactggttctagatctatggttaatttggcaaatgaaggatgtgctccaagtattcttaaacgagtaaatggtcagggtgttccctatgctgcagttatcttaatgagtacattagggttaatctcattaatgaatcaaagtacaggtgctgccaatgcttatcaatacattgtcaatctttctggtgtcgctgtgtttattgtgtggggtaacgtttgtttttatcatattagatttagacaagccatgaaattacaaggtcgttcattagacgaaataccattcaaagggatgttgtatccttatttaccaatactagggctagctttaaacgtcattttagctttaattcaaggttggtcatatttcaaaccatttgatgctggaaattgggtagatgcatatatattgttgccatttttctttgtattatattttggatttaaactttggcataaatcgaaatgggtcaatttggaagaggtcgatttagatgaaggtaggagcgaagacgatgagatgagagtgaccgccacggactga

SEQ ID NO: 6253 - DNA, 1311 bp, Candida albicans
gtgaagacacagggtcgacatttaggcttgttttcaacagttattttatttgttagtcgtatattaggcagtgggatattcagtatcactagtgggatatatcaagattgtggtcaatcagtagcactattttttgcggcatgggtcattgccgcaatagcatccttcggtggactttacgtgtttttggaaatggggtcgttggttcccagaactggtggtgccaaagtgtttcttgaatttatataccctcgaccaaaactattagccacagtagcatttctggtttactcagttatgtttgggttcaccatatccaatgtgttagtgtttggtgaatatttgatacatgcattaggcttggaaccatctgatttcaaaacaagattcactggattgatctttttatattttgccgcaattctccatggtgttagtgtgagccatggggtgcgaatccagaatgtgttgggtggtttgaaattagttttagtggttgtcattgtggttgctggaatttatgtgacagcatttcctcagtcaatcactggaattgaaaatcaacttgaatgggatagagttttcgaagtcagatcaagcgctagtgtactgacttttgcatcagcaataattaaagcatcatttgcgttttctggttggaactcagttcatactgttgccaatgaaattaaagatccagtgcgtacactaaagatcgctggtccagtatcattgaccattatggcagtcacatattttattgctaatttggcatatttaatagtgataccaagcgatgaacttgctaatgggagtacccttgcaggatcaatattgtttaccaaaatttttgggcaatttttagggaagaaattgttgacactagctgtatcattgtctgcaggtgggaatatttttgtcgttatttacactatttctcgagtcgatcaagaagtgtttcgtgaaggttatttgccattttcaagattcatgtcatccaattggccctatggtgcacctttgaggactttgttattaagtgtggccataaccaccacagtcattgtgttattcccaggaggcgatatctatagctacatggtatccttggaaggttatccacaacagttggctattgcattaatagcaattggaatatttataattcgcaaacggtacccagaattacattcacctattaaagcaggtgttgttggcacaatagctgttttccttatcagtttatacttgttaattggtccatttgtgtctagtaagatcatgtgtcgcccacgggtgaaagatccgcgt

SEQ ID NO: 6254 - DNA, 1455 bp, Candida albicans
  unsure (21): Identity of nucleotide sequences at the above locations are unknown.
gtggcgacgagtcgacttttnaaaacagtgttaagtgatcaaaaatatagtaatatactgtcttggttcacaggatggtttctattgattgggaattggacttatgctataagtataatgtcttctggggcacaatttattttatcgatatttggaatgaaaaatgtttatatttataaagaagatcgatttttggtattatcagtatatttcatattattgggattttgtggatttataaatttcaaatattcaaaacatttagaaaaaattaataaagcttgtatattatggactatttatactgttttagccattgatttcttattaattttttcatcaactagaactaattcaattaaagatattttaacaaaatttgataattcaagaagtggttggcctgaccctttagcatttataattggtttacaaagttcttcattcactttaactggttatggaatgttattttctataactgatgaagttaaaactccagaaaaaaatatgcctcgtggtgccattagtgctgtatttatggcaattgttactggggttattttcattatccctatattaaccatattacctgaattggaaatattattagatgaaactcccaatattatgcccattgatttaatttttaaattatctacagaactgtatttaatatcatttttaatggcttgtttaatgatcggtaccatgattttccaaagtattggttctttaactacggcatcaagaagtacttatgctttggctcgtgatggaggattaccatttgctgatttatggacacaagtgaattctattgaagattataaattacccaaaaatgcattatttttatcaatggttatatgtgccatattatcttcattatcattaatttctcaatcagcttttaatgcatttatgggtgctgccgtcatatcattagcattagctaatggtgtcccgatattatgtttaatgattaataaacggaaaaaagttcgtggtgcagcatttaaattagggaaaattggttggattataaatggtttatcaattttttggatattattatcagtatttatattatgtatgcctccagtgattaaacatttaacttggtcaaatatgaattatgccattttggtgattatatcatttgctataattgcaagtttgggttataaaacttggggggaaaaaagttttactggtccagttattgataatgattattttgaattgaataatttggaaacaaatgtaatcagcatccgtcaggctggtgctggtacggctggtgctggtggtgccagtactgctagtggtgatgttaatgatgacgattttgttataattggcaatgatgaggaagaagaagaagaagaagatgatgatgatgatgaaccagatactaacagtagtaagtccaaaaccaaagactgggattaa

SEQ ID NO: 6255 - DNA, 525 bp, Candida albicans
attgtcttaatcatgtcttcattttctcctgatattaaaaaaactattgaggttgaagttgatgcatcttctttccatagtgattctgttgatttcactaaagatgatatacaagatgctgaatctattttccataatgaaaaacaattatctgaaggattaaataccagattaattggtatgattagtttagttggtgtttttggaaccggattatttttaagttcgggtggtacattagctacagctggtcctgtggggatgatacttgcctttgtgcttgtgggtattgttgttgctgctaatcaaattagtacgttagaagttgcttgtttaatgccggttactggatccaatattagacatgttgaacattttgttgataaaagttttggatttgctttaggatatgtgaatgtttattcagctattatccccagtgaattagctgctactagtgttgtggtttcatattggacagatattaaccctgcggtattcatcacaatttttggagtagtgatt

SEQ ID NO: 6256 - DNA, 765 bp, Candida albicans
gaacatctttcattgattgttccttataatgataaatcaattgcttcacccacagggaatgctgccgggtctgcttgggttattgccgtgcaaagatcggggattaaagtattacctcatattattaatgctgtggtgttaacttcggcattatcagcagccaatttaggtcttattcatgccagtcgttcattatttggattggcatctaatggacaagcaccaaaaatattcttaaaaactaataaacatggtcttccttgggttggagttgtatttgctgcattatttttgccattgtcttatttgtcagttagttcaggtacatcccaagttttcagttggtttcaaagtataacttcatctaatcttttagtcaattggagtgttttcgcccttgatcacatagcattacatcgtgctcttgaagctcaaggttatagtagagaaaatttgccttataaaattcctggtggacaatatgctggtcctgtatcattatttttttcattattatttttatttacaggtggatttgctgtatttattaaaggtcaatggaaatttgccaatttctttagttcctatttcgttatcccattatttttcgggttatacatattcagcaaactttttttcaagaccaaatatgttaaaccaacagaagttaaattgaaaccacttttctatgatgttattgatcgtccagaacctccaataaagaaattaaaaggttgggaaaagatcagtttattatggggatag

SEQ ID NO: 6257 - DNA, 381 bp, Candida albicans
caactccttactaacattatatcacttgtgtacagttctggaggaacattagcaactgcaggtccattggggatgatcatttcttatatttttgttgccacagtcatcggtgcaaatcaaattgctgtcactgaagtcacttgtttgatgcccattaccagtggttatatcagacatgcagaacattttgttgatcattctctcggatttgcaatggggatttgcaacatctacctggcagtgattccaactgaattatccgctgttgttcttatcatgacatactggacagatttgagccctgcagtgtttgttactatatttggaattgttattgttgttatcaactcttgtaccgttcgatgctattttcgaccgagc

SEQ ID NO: 6258 - DNA, 402 bp, Candida albicans
tcgaatcttttagtcaattggagtgttttcgcccttgatcacatagcattacatcgtgctcttgaagctcaaggttatagtagagaaaatttgccttataaaattcctggtggacaatatgctggtcctgtatcattatttttttcattattatttttatttacaggtggatttgctgtatttattaaaggtcaatggaaatttgccaatttctttagttcctatttcgttatcccattatttttcgggttatacatatttagcaaactttttttcaagaccaaatatgtcaaaccaacagaagttaaattgaaaccactattctatgatgttattaatcgtccagaacctccaataaagaaattaaaaggttgggaaaagatcagtttattatggggatag

SEQ ID NO: 6259 - DNA, 1044 bp, Candida albicans
  unsure (769),(779),(788),(939),(942): Identity of nucleotide sequences at the above locations are unknown.
atggtatttggctacaatagcgacaaaggtcttctgaacgaagaaaaaagatcatcaactgccgacttagaatcggttattacccaacatacaaacaattacgatctctatattgctagatccaatccctcagctcataatgcagaagaaggacaccaacttagacaagaattacacgcacgtcatgtctcattgattgccattgggggtgcattgggaacaggtcttcttattggtactgggctggctttaaaaactgctggaccaggtgctatattggtagcttatggtgccattgggtttgttgtctatatggttatgactgctttaggtgaaattgcctcttttattccattgcctgggtttgcaaattatgggaaaagatacgctgacgaagctttgggttttgcttgtggtattgtctatcttattaaatatttagttcttcccgctaatcaattgacagctggtgcattaaccatgcaatattgggtttcaagagatcgagtgaatccaggggtttggattacagtgtttcttgttgtcattacattcattaattttcttggtgtcaaagtgtttggtgaaatcgaattctggatgtcaatattaaaagtcttgacttgtttaggattaattcttttgttgtggattattgccttgggtggtggaccaacacatgaaagacttggtttcagatattggaaaaacccacgggctttcattcattattccaattccgcccaaaatgtggctattggtggttcanaagggagatncgttgcatntgtttcagttttagttactgctgtgtttgcttatcttggatctgaattagttgctgttacattcagtgaaactagaaatccaagaaaggcgtatccaaaagctatcaatttgacattgtaccgtatccttgttttctacatcttgtcgatnttnattgttggtatgtgtgtctcatctaaaaaatcattattattgggtggtaaaggttacaatgccggaactaatccttttgttattgccaataaaaaagcctaa

SEQ ID NO: 6260 - DNA, 564 bp, Candida albicans
cttgctggtgagtcagaatatccacgaagagctatttatcgtgctgcaaaaagagtgttttaccgtattgccatactttattttaccaccgtattggttttatcaatgattgtttctcacactgatccagcaatcagtaaacccgatggaactgccagaggttcggcctttgttgttgctatacaacgttcaggtatcaaagtgttgccacatattgttaatgcagtggttttgacatcagcattgtctgcagcaaatttggatatcattcgatcaagtagaattatttatgcccttgctagcaaacgtcaactccccaaaatattcctcaaagtcaataattatggattaccttacgtcgctgtggcattctgttgctcatttttgccattggcatacatgactgctaatgctactctggcagcagttttcagttggtttcaaaatatcacatcatcgtgcactttactcaattggagtattatttctataaatcatattagtatgagcagagcattacgggctcaaggtagtattcgccacgggcgtggaaggaccgcactt

SEQ ID NO: 6261 - DNA, 1143 bp, Candida albicans
acagcacaacgtcataatattggtatttcccagaatgacgatgagtatttgaacaaagtttatcacgaggaagtcatgggacagatcaataaaattgaagaacggcgacgtaatttgcaagaagaattccaatcaattggacgtgtattggatgttagtgatctggagtatcaatttctcacgttattggcatcgtcattttcaagcgtttcaatcagatggcaaaagggagcatgtattggacgtggtacttttggtcaagtgttttcagcagtcaacttggatactggtggggttatggctgtcaaggaaattacgttccatgatagtcaatcggttaaaactattgtgcccctgattaaagaagagatgacagtattagaaatgttaaatcacccaaatgtggtacaatactttggtgttgaagtccatcgtgataaagtttacattttcatggaattctgtgagggtggatcacttgctggattattgactcatggtagaattgaagacgagatggttattcaagtttacgctttacaaatgttagaagggttggcttatttgcatcaatcaggtgttgtgcatcgtgatatcaaacctgaaaatgttttgttggatcacaatggagtaatcaagtatgttgattttggtgctgctaaagttatagctagtaatggaagaaccattggtggaatgactaattcttcactccgtaaatcggttaaacgtgatggccataataatttgaattcaatgacgggtacaccgatgtatatgtcaccagaagccattacagggacgtctactgatagaagtggtgttgttgacatttggtctttgggatgttgtgtgttagagatggctactggaagacgaccatgggcaaacttggataatgaatgggctatcatgtatcatatagctgctggtcacaaaccacaattaccgtcacctgaacaattgagtgaaccagggagaacctttttagcacgttgtcttgaacatgatcctaccaagagaccaagtgctgttgaattactagctgatccatggatggttgaaatcagacatatggcatttggaaattccgatgttacaactacaccattatcagaggttgcgggtccggtttcagaataa

SEQ ID NO: 6262 - DNA, 2619 bp, Candida albicans
tataattatcttataatgtcagatattcctccaaccaatgaatctaatctggattctactttgattaatcaaaaaaataatgacaataatgacaataaagagactggtaaagatataagttcaactcatacccatcatagagtcacgtttgcggaacaacaaccaatttccacctcaagcaggaagtcttcacttttaagaacacattccctgaataatacatcttcagacagtgataaacgaccatctattatatcgagaaatagtaatccggacattcatagagattctttacctcctcttaatcgaggaccaagctacaacggtaattatacaagaagtcatagttcaagaaatgttaatgccaacaacaccatcaatactggtgttacttccgatagtaactctaataacaatgtggattcgaatgcccctattagctcaccaacgacacccgcaataagttctccaccagccaacggtaagtattttaacttggtgttaccagcaggaaaatcaagagagaaatcgccaggtcgtcattccaaagagggacacactaggtcaagatcatttactaaacagcaacatggtataggcagcacaagttctcaactgagctcacagtatttagctcaagaaaaggcgtatttacgtaaaatgagaaatcaatcagttgatgattattactcaaaaggtatacctggtgcccatgaagtctcgaaggcagatgataacgatgacgaagatgatgatgatgatgaagagcactcttcctttgacggtggtgataatgctaatttgttagcagctatagatgacgataaatatcagattgactatagcatggctctatcattaatgaagaattccaatgttaatttgagaaaaattgccaatttaaacaccgatgacactgatgatccagcaattattgaaagaatggaatggcaatcaatgttaacttcagtgttaacaggtgatgtagttcgtagtgaaaaaacgaaaatcatcaatattaataatcccgacagtacacaagaatcttatttgcatgccactttcaaagagaatttatggtttggaattagagccaaaatctttaaccgaactgaagatgaacaacgtaaaatcgtcgcttatagaagaactttggtagatcagttgattgatgatgtgatgaaatttgaaattgattatgaaaactctaccgacaatccaattagagatcaagtcaagactattttggatagatatgatcaggcatgtagcttgtggaaaacattggaagatatgtatagtgataaaccagcatgccgaagtgaagagttccagaatagaattgatgccttgacagcatggttgactattactgatgccataagcagagaaaccaaatctttacgtttatggataggaaatgatgaattggacattactaaatctcccgtggaagtttcatcttccaatgctgctacttcaactagtaagattgtgaaaaaaatatttgatgaagataacaaatcattagcagaaagattgatgaaagaaaaagatgtgcaaacaattttcaggaaaagaatttttaaaccaatagccccatggatgattaaatctaaagacacttatattagattaggtgtcatatttgaaaatatgaaattgcctgattatttgcatgatttgttgcaaatatgtattatccccgttcgattaattaaagaaattgttattgtgagattagggtacgctatgaagttacagaaccccacattaatgatgattgatcaaatgcttgatgattttaagagttatataactgttgccttagaagttaaaagtgggatcctggaatataaagagcctgatgaggataggaaatggttgatcagtgatttatttgatagcgaacttgaggattttgataacgttatattacgatgtgttcgttactttttggtgttacttaatagaaaattattagatagttcgcgttcgccaacaacgttccgaacatttaaagaaccagaggagttggaagaagcatggaattttttgaaaccattaggacactatgttgatggtggtagtgtagtggtagctgaagagatcaccatgcttgccctgagattgattcaccgattgatggcatattttaatcatcagattagagagcctacttataatggagtcccacaagacttgatccgttggtacagttcaacgtcggagaattttggtcaattacgacgtaagttggctcgttttatgggagaaatatcccgagatttcaaaaactcggtagtgtttgatataccgtctcaatcaaactgcaccaagacattgttagagattctccgtagttccaatcattttttggtctatactgggacggttgaaactcaggggacttatttttttgccagtcctgagctattaggtaacgaacaagagattttgaaaattttaacgggatcttgtgttggattggatccaagtactgataatctgcatttcactgatttgttgcacttgatacgttctggtagtgaagagcatttacggtataatgatcacgatcttgatgttttcacaacgcccggcgatccagcatcgatg

SEQ ID NO: 6263 - DNA, 774 bp, Candida albicans
agcaaaaaaaaaccatttatatattcattctcatcgtcgcagatgagagacaagaaacaaacaaagaaaataaattctttttttttcgccacgcacagtaccatgtcgcaacaaccacatttacgtgtcggatctaccgcacctgatttcaaagctgatacaactaacgggcatattctgtttcacgaatacattggtgatagatggggtatcttgttctcacatcccgctgcccacaccagtgtgtgtagcaccgagctttctgcgttcgcacgactcgaaccggagttcacgaagagaggggtgaaattgcttgcaatttcagccgaccctgttgaagcaaattccgactggattgatgatatggaagattttagcggatccagggtcaaatttccaattatcgcagaccctgagagaaaagttgctaccttgtacgacatgatcgatcaccaagatgccaccaatctcgatgacaaagggcttcaattgacaattcgtgcagtgtttatcattgatccaagtaagaaaatcagattgatcatgacctaccctgcctcgaccggtagaaacaccgctgaagtattgagagtactcgactcattacagcttgttgataaacaaaaggttatcactccaatcaattgggttccaggtgacgatgttcttgtccatatgggtgtcccagatgatgaggcaagagttttgtttcctaaatatagggctataaagccatatattagattgactccgttggaaaaggaagacaagtaa

SEQ ID NO: 6264 - DNA, 1359 bp, Candida albicans
  unsure (631): Identity of nucleotide sequences at the above locations are unknown.
agtgttcaagctgttggagcaggtactattgctgatttatttattcctcaagaacgtggacaagctatgggattatattatttgggccctttggcaggaccgtttttggccccaattttgggtggagctgtatctcaagcttgggggtggagagctactcaatggttattaatgataatttctgcttgtagttttgttctaattacatttttcctaccagaaacattaagaagagttgatactatacaagttgctaaagatttgatgaaaaaactggacaataatggtctgcaaaatgaaaaaattcatgatgattttgccggtgcggacaattctagcgtacacgatatagatggaaaccccattcctggtactgaattacatcaagtggtttcaaatttgagtagaagatcatcaaatgctcgttctattgtaacttatatggaagaacaagaaaatgaaggtccaataattgatccagtgatgcctagtatatctcggttaacaacaaatagatcagcttattctcaaagaatacatcaaaattacgtaactgatgaattaaggaaaacaacatctaatttaactcaatccaaccatccacaatataataataacaacaacaacgacnatgataaatggtcatcagtgaaaaccaattgttatgatttaataatccgtccattacattcaataatattattaaaacatccacctgtggtccttgtcatttcattttcagccatttcctttgctgcaatttattttttcaacatggcgatttcttatgaatacgcacgttcaccatttaatttctcatcagtgattcttggattaatgtatatccccaattccgtgacatatttcatggcttctataattggaggtaaatggaatgatcgattattaaatcgatatgctcaaaaacatggagaattggttcctgaaagtagattatcttggaatatcgtcgtggcaataattttatatcccatggcttgtttgatttttggttggacaattaaatatcgtgaattttgggtcataccattaatcggtaccgcattatttggatttgcttctatgcttgttataggtgctaccgtgacttatttggtcgattcattacctgggaaaggtgctactggtgtggcgttgaataatttaattagacaaattttggcggctattgcgacttttatagttgaaccgttattaagagcgattggagcaggtgttttatttagtattattgctgggatattattggtttcttcattggttttgttatatttgaagaaacgaggagcttttttcagagaacattatgatgtcatggatttatatgccaagttgtaa

SEQ ID NO: 6265 - DNA, 1560 bp, Candida albicans
agtttaattcttttttcgatttgtctatcaattatttttcaaatgaatagtgtcactaatccagagattatgccgaaaaaggaagagccaaagcaaaatgaaacagaagcagaaacagaaaacaaattatcaacagctgaattgaaaaacggcaaaagtgtcagtaattctgaaaaacaaaatgatttagaaggacaaacttctcaagattcaccttattgtgcgttatctttaaaaaggaaaacaattattattggtattgtcactatagctggttgtttaggtcctatttcaggaaacatttatattcctattttacctcaattagagaatgaatttcatgtttccactcaggtgatcaacggaacagtatcggcatttatgtttgtatttgccatagcaccattgatttgggcatcctgggcagattatggtgggaggaaaaccctatatttgataccattaatatttttcatattggctaatattttgttggcagcaactccagcaaacatcgttggattatacattttgcgagttttacaagcatttggagcatcaagtgttatatcagttggtgctgggaccgttgctgatattatagagccaaaacatagagccaaggccatatcggtatttatgtggggtcctcagttgggtccagtattgggacccgtattgtcaatcattgcctctaaaggacaatggagatggatatttggttttttagcgcttttcggctttgcagtatatttgatgattttattcttcttaccagaaactttaagatatcttgttggtaattgtgcctgctataaagatacttcaattattgtcaagccacatttgcgacaaaagaaaattgttgaaggatatcccgttcctccaaaaccaagtttcaaaaattattggatcttgataaaattcaaaccagttttgttgtgttcaattaactcgggattactatttgcaacattttatggattaatggtgacttttgcccatgttttgaaaattgagtattcatttactgatgcacaaatcagtgctagctatctctgtcccggtatctctttaataataggttccacgattggtggttgggcttctgataaaatacgagcggaaataatcaaacataatcctgacatatatgttcccgaataccggttctcattacaatttttgggattaataatatctatgactggtgtgattggctacgggtggacagtccataaacatacaaatgtagttgctgtattcatatttacttttttgggcggttttggcatgacatgggtatttgttgcaaataccacttatttgacagaatgcactactggacagccagcgacaaatgttgcaattggcaattttgcacgaaacatatctgctaccatatgcacggcagtaatagacccacttatttcttccatgggatttggttggtgtttaactggattaggtttaaccaatatattgggaattgtatttgtagttatcttattaaaatggggaccaagctggagacgacaatttctaaataaaagtacgtag

SEQ ID NO: 6266 - DNA, 378 bp, Candida albicans
gtgggaggcggaatcctcacttcccgttctgggatattacatcccggtgtaacatcaggggaggggcgttttgttctgatcgggtccgcgctgatgtacacaatccatcctcacagcagcgcaggaaccatgtacggttacagtgcgctgattggtataggagcggggatgtacctccaaataggccacgccgtggcgcaagccaaagtcaagcttgagaagatcccagccgccgtcgcttttaccaccaccgcgcagctgaatggactgacgtttgcgttggtcatttcacagtgtgtctttgtcaatgaggctgcgaagcgtaagtttgcgttcccctttgcattgtgggctgtgcacttacggttctgtctctag

SEQ ID NO: 6267 - DNA, 1464 bp, Candida albicans
aaaatacatctttccttttcttcaataacacctgtacatgcaatggttctaccatcatcatataaagaatcattaaatgatttcccaattcgacaaatgattataatttgtataattcgatttgctgaaccattagcattcacctcaattttcccgtatatatatttcatgattcgagatttccatattgccattaaagaagaagatatatcacaatattccggttatattgcatcatcatttgccatttgtcaatttttatttgctatacattgggggaccatgtcagaaaaattaggtcggaaattgattttaatcattggattattaggcacatcaatatcattattattatttggatttgcgaggaattattattgggcattaattgctcgttgtttagccggggttttaaatggtaatgttgctgtgttaagaactatgattggagaaattgctgtagagaaacgtcatcaacctttggcatttctgactatgcctttattattcaattttggggcaattataggtccagcaattggtggttcaacttatttgactaaaccaaaagaaaaatcaccatatgaagagaaagaagataaaaatatttaccaggtggtggatgattgggatatttatcaaatttatcaacaatttcttgatagatttccttatgctttaccaaatattgttgtggcattgatactttggtttagtttaggttgtgggatattatttttagaagaaacccatgaaattcataaatatcgtcgagattatggtgttgatttaggtgattggttattaagtaaagttgggatttcaactccatccagaccatggcataatagaaactatcaccacccaatttcacataacaattttggtgacaatgttggtgaaacaacagcgttattacaggaaattgaaggtgaagatgtatttcctgaagctgatccagaatctatcccattacctgctcctcctccacaacaacagccgttgtccaaaccttcttcaattgcatttacaccaaaagtaattggtgtaattactgggaatttcattatatcattacatagtgtagcttataatgaattcttaccgatctttctagcatcaagatttcaaccaaaatctttaaaatttccatttcaaattgttggaggtatggaattagatacaaattatattggaacattattttcctcaacggggattatggggatgttaattgtcttggtattattcccattaatagattccaaattaggtacaattggtggatatagattgagtgtatcgattttccctttaatttatttaattatccccttgacaatattcacattacatcaatataacgattggtttcctaattggactacaccaattttactttattcattaaccagtttgaaaacattggctaattctacgggaatgccccagttacgattttaa

SEQ ID NO: 6268 - DNA, 918 bp, Candida albicans
ccgaagacagtcagaaaaaaaaaactacaatttaaacttcactttcatttcaataatctttatcttttcttttcttcatttttctacctttggtctttcatttatcttgtctcaaaagaaacaagttaccgctttacttatatccacttgaagaaacaaggacaaccacaagccaccatgacaaaaaaaatggcaaagatctctttccgagaacaaatgaaaggtttcccactttggcaaatgtttgtcattagttgtattcgattttctgaaccaatagcattcacatcattattcccctatgtctattttatgattcgagatttcaatatcgctcctcattcgactgatatcgccaaatattctggttatttatctgcgtcatttgcgttttgtcaatttttctgttgtgtacaatggggaaaagcatccgataaatatggtcgcaaaaaaattttattaatggggttgttagggacagcagtatcaatgattatatttgggttttcacccaatttctgggttgcagtgtttgccagatctcttatgggatgtttaaatggtaatatagcagtattgagaactgctattggagaaatcgctactcataaaaaccatcaatcaattgcattcagtacattaccattgctttggaactttggtgccgttattgggcccataattggcggatctaaatattttacccgccctaaacaaagaaatgatattgataattatcaactgggggagttactgagattaggaaagatttttatgttaatggctcaagatcctcagctgccaagtagtaatgatagtgacaacttatacaacagattcatgaacaaatacccatatgcattatctaatattgttattgctggaatattaatgtttagttttataaccggggtctat

SEQ ID NO: 6269 - DNA, 372 bp, Candida albicans
gtgtttacccaccatgtatataatagtgccaacccaccgtggttgacaaagacattactttacgtgttatgttgtatcttaactgcttcaaatgccgttggattccccaatatcatcgtattaattcatcgttcatcaccagaacagcatcgtgcattcataaatggaacatcattaagtttaaattcattagctcggtttttaggaccaatgctttgggggtatgtcatgaccattagtgaagttttagaaattggggaattatcatggatattgttgggtggattatcattgatttgttgtacttatgcgtttatcatgaaagataatgaagatgatgaagatgatctaatcgctgaagataatgtatag

SEQ ID NO: 6270 - DNA, 942 bp, Candida albicans
atcttttgttggtggggaaaggtggtgttggtaaaaaccaccacgtcatcatctattgcatttcattgggctttgcaacacccaaacgatgaattttttttgatttcaaccgatccagcccataacttatcagacgcattttgccaaaaatttggaaaagacgcaagaaaagttgaaggtttgtccaacttgtcatgtatggaaatcgatcctgaagctgccatgagtgatttgcaacagcaagctcaacaatacaataacgatccaaatgatccattgaaaagtattatgaatgatatgactgggtcgattccaggtattgacgaagccttgtcttttatggaagttttgaaacacatcaaaaaccaaaaagtgaacgagctggatgattctaaagacaagatttcttacagaacaattatcttcgatactgccccaactggacacacattacgtttcttgcaattaccatcaacattacaaaaattattaggtaaattccaacagttgtcagggaaattgggcccaatgatgagtatgcttggcgggggtggccaaggacaacaggatatgtttgccaagttgaacgaagtgcagaaaaatgtcgaggaagtcaatgagcaatttaccaaccctgatttgacgacttttgtgtgtgtttgtatctccgaatttctttcgctttatgaaactgaaagaatgatccaagaattgatgtcttaccaaatggacgtgaactcaattgtggttaatcaattgttgttcgcagatgatgacgaaaacccatgtaagagatgtgtggctagatggaaaatgcaaaagaaatatttggaccaaatggccgagttatatgaagattaccatttggtgaaaatgcctttgttaggttctgaaatcagacgtgtagagaatttgaagaaattttccaaattcttgataaaa

SEQ ID NO: 6271 - DNA, 849 bp, Candida albicans
tgggcgagctttgtccttccattgcctggtgaaggtccgatttatgggcatttgggtgagagcttaaacggtatcgacactattcgtgcctacgaccaaaaggcccgatttgattttataatgaatgcaaatgttgatttcaatttgaagtcggtgtatatgttgacatctatcaacagatggcttggttttagattgcaaacgattggtggagtcggcgtgttttctgctgcgatattgtccatttggagtgtacacacggcacgtccgttgtctcctgccatggcagggtttgtcatgacgtatgctatgcaagtgacttctgcattgagaatgcttgttcgaacatcggctgaggttgaaactagcatagttgctgtggaaagatgtcttgagtacacaaagctacctgttgaggaggagcctcacctaaaattgatcaaacctcctaaacactggccacaaaagggtgtcattaagttcaaccaatactcgaccaggtatagagaaaaccttgatttgattttgaaaaaaattacgttttccataaactcagcggaaaagattgggattgtgggaagaactggcgctggtaaaagttcattggcgttggcagttttccgaatcattgaagctgttgaagggagcattgaaattgacgggataattaccagtcaaatgtttttgcaggatttgcgacaccgattgagcatcattccacaggattcacaattactaaagggaacaattcgaccaaatttggatccgttcaactattatacagataaagagatatggcatgcattggaactacctcatttaaaagatcacatcgaagaaactacctaa

SEQ ID NO: 6272 - DNA, 1716 bp, Candida albicans
tggttagaacattggtcagaaatcaatactaaatatggatataatcctaatgttggtaaatatcttgggatttattttttgttgggcattggatattctttagcttcattgattcaaaacacatatctttggattttttgtactattcaaggttcgaaaaaattacataatagtatggctgttagtgttcttagagcaccaatgacatttttcgaaactactccaattggtagagttttaaatcgattttctaatgatatttataaagttgatgaagttattggtcgagttttcaatatgtttttcagtaattccattaaagttttccttactattgtggttatttcattttcaacttggccatttttattccttattttaccattaggagtattatatatttattatcagcaatattatttaagaacatcacgagaattgagaagattagattcagtttccagatcaccaatttttgccaatttccaagaatcattaactggagtttcgacaattagagcttatggtaaagaagaacgattcaaatttttaaatcaatcaagagttgataaaaatatgagtgcttatcatccggcaattaatgccaatagatggttagctgttagattggaatttttaggatcaataattattttgggagccgccggattatcgattttaacattgaaatcgggtcatttaactgctggattggtagggttatcggtttcatatgcattacaaatcactcaatcattgaattggattgttagaatgacagttgaagttgaaaccaatattgtttctgtcgaaagagtattagaatattctcgtttgaaatctgaagcagcagagattattccagatcatcgaccaccacaagattggcctcaacaaggagaaatcaaatttaatgattattcaactaaatatagacctgaattggatttagtcttgaggaatatcaatttagatattaaaccaaaagaaaaaattggtattgtgggtagaaccggtgctggtaaatcatcaattactttagcattatttagaataatcgaagcttttgatggtaatatcaatattgatggtatagatacatcttcaattggattatatgatttaagacataaattatcgattattcctcaagattctcaagtttttgaaggtacgattagatcgaatttggatccaactgatgaatataccgatgatcaaatttggaaagccttggaattatctcatttgaaagatcatgttttaaaaatgcataaccagagggagactaccgaggaagaagaagaagaagaagaaaatggtgaaactaatccattgttggttaaagtgagtgaaggtggagctaatttatcaattggtcaaagacaattaatgtgtctcggtagagtcttgttgaaattaaattattccaatattttagttttagatgaagctactgctgctgttgatgttgaaactgatcaaatattacaagaaaccattcgaaatgaatttaaagataaaacaattattactattgctcatagattaaatacaattttggattctgatcgtattttagtattagaaaaaggtcaagttgctgaatttgatactccatcgaatttactcaagaataaagattcattattttatgccctttgtgaacaaggtggatttataaatgatgaacctaaggtgacagcaatagaatag

SEQ ID NO: 6273 - DNA, 2250 bp, Candida albicans
gttgtaatacccaacgaagatggttggggtccattatcttctacttataatgatttgactccatgttttttacaaggtattttatttggtatttcagcaattttaatgatattagttgggatttatcaaattatttatcttataaataaaaaaattactgttggtaataaaattaattggaatttttatttgaaattatttttagttgttattcaaattggtttccaaattggattaattttagtgtttaataatgatattggtattattaaattatctttaatactcaattcaattgctactatggttgctcttggtattcattatttagaacaattcaaatcgactattcctaatggtgtattattattttattggttattccaagtgattttaaatttagcaagaattggtaatctttatttaagaaatagttttggcaaaaataatgataaaggttttgcaaatttagtcattttatccacgataaatgcttttattattttaattgtggaaatcctgtttcctatacaaccattaaataattattatcatcgggtttctttaaaagaatcaccacttgatcaagctaatgtattttcaagaattacatttgattggatgggtggattaatgaaaaaagggtatcataaatatttaactgaagaagatttaccttcattacctaaatctttaaaagccaataaaactactaaagatttcgatcattattggaatgctcaatctactaacaataaatcattaacttgggccattgctcaagcttttggtggtcaattcttgttgggtggtatttttaaaggtgctcaagatgcattagcttttgttcaacctcaattattacgtttattaattaaatttgtcaatgattattccaaatcagttaaaaaaggtgatcctatacctttaactcgtggattattgatttctgtttccatgtttattgtttccgtagtacaaacagcttcattacatcaatatttccaacgagcatttgatttaggtatgaaaattaaatcatcattgacatcagttgtttataataaatctttagtgttatcaaatgaatccaaacaagaatcatcaacgggtgatattgttaatttaatgtcagttgatgttcaaagattacaagatttagtacaaaatttacaaatcatttggtcaggtcctttccaaattttattatgtttatattcattacatgaattaattggtaatgccatgtgggccggagtagccattatgataattatgattccgttaaatgctgttattgctagaactcaaaaacgtttacaaaagacacaaatgaaatataaagatgaaagatcaagattaattaatgaaattttaaataatatcaaatcattaaaattatatggttgggaacaaccttatttaaaacaattgaattatgttagaaatgaaaaagaattgaaaaatttgaaaaaaatggggattttcatggcatcatctaatttcacatggaatttagctccatttttagttagttgttcgacatttgctgtgtttgtatggacttcaaataaaagtttatccactgatttagtgtttccagcattatcgttatttaatcttttatctttccccttggcagttgttccaatggtcattactaatattgtcgaagctcaagttgccattggtagattaacgaaatttttaactggatcagaattacaaaccgatgccgttataagatcacctaaagctaaaaatattggtgatacagcggttctgattaaaaatgggacatttttatggtctaaagccaaaggtgaacaaaattataaagttgccctttcaaatatcaatttaacttgtaaaaaggggaaattggattgtattgttggtaaagttggttcagggaaatcatcaattattcaagccattttaggtgatttatataaattagatggtgaagtcaatttacatggtaaagtggcttatgtttctcaagtcccatggatcatgaatggtaccgtaaaggacaatatattatttggtcatagatatgatcctcaattttatcaaattgtattaaaagcttgtgctttaacagttgatttaagtattttacccaagggtgataaaactgaagttggtgaaaaggggatttcactttctggtggtcaaaaggcaagattatcattagcaagagcagtttatgcgttttcacacagacgggtcgaaggtccatgcaag

SEQ ID NO: 6274 - DNA, 1191 bp, Candida albicans
acgcggattctcacccttggggaagaaggcgctgcttatgttattgaaattatcagtctcgtcaacagctttttgattttcgtatttgaagttggttattacaaaccaggatttgaaattacaaatgaaaaatttttagacacggtcaatttgttttcttattttacattttactacctccaacccctcatcaataagatttacgctactgatgacgtccagttaaccgatttacctgacattttgggtaatattacttgcgatgataccaaagccaaagttgctaaagcatgggaagaagaattgaaaagaactaagaaacctggtttagtttcaaaagtttggagttttgtcaccagaagaaaggtcaactctaaaccacaaatgtttttagctattgccaaagctttttttgataaatttgctatcagtatcactcttgcaattattgtaactgggttgagtttcttgcagccattccttttgaggaaatttattcagtttttcagtacctacttttacagtgttgagaaaccaccaattatcattggttatttttgggcatcagtaatgttcttgacatcagtcgctaatttcattgcattcaaccaggccttcaaaactcaatttgatcttgggtacgagatccagagctcactcacaaccttgatatatgaaaaggcattaagattatccccacaatcaagaaaaaacaagccaactggtgatattattaatcatataactatggacattgatattattttttggttttgctggcaacttggtgagtatttggcgtcgccattgaagttggctgtttgtttagctgcattatacaagttgttttcaaatgctacatgggctggtgtaataactgccattatcgtggcaccgcttgccactcttgtgaacgcttccatgtccaagaactatatacagttgatgaaagacaaggatgaaagaactagtttgattacagagattttaaactcagccaaaagtatcaagttttattcatgggaaaaaccgatgttagctcgattgagtcacattagaaatgacagagaattgaacaatatcaagaaaattggtgtggtcagtgcattggcacaatttttgtggtcttgtattccatttttcattagttgttcttcaccacggactgggcgatccgacttgcaatgcagg

SEQ ID NO: 6275 - DNA, 1464 bp, Candida albicans
  unsure (1461): Identity of nucleotide sequences at the above locations are unknown.
ttagtcgttacccccccccccccctttttcatttaccacatcgaaatggtgaaaaaactgcaacaaaatacatctaaatcaacatcattatttgaaattagattgaaaaatcttgatcatgatgtattagtattgaaaggaaatcctcaagaagcagcatcggctttattatcaggaactatagttatatcagtaattgaaccaatttcaattaaaaaaatttcccttcgtttattttctacattaaaattagatggtgaagttactggtggtgctagtggtagttctagaataatcaatttttctaaaaaaacttatgaatatatttggaatagtcaagaattttctaattatttaaataatcacaataataaccttagtcaattgagttcagggacaaattcaccaaataatcgatcatctacttcattatcatcacataataacaatcatcatggggcattttctaaattgacgagaaatcattcatcaacttcattattgggattaagatcaaaatcttcattaagcctttcaggattaactggtggttcatcaacaaatttagtatcagcattcacatcaagtaatactaacaacaacaacaataataataataataaattaaatcattctttatcatctactcaattacatagtggtagcactggtaacactggtggtagtcatttattggtacaaggaaattatgaaattccattcagtgtaattttacctggagatttacctgaatcaattgaagggctacctggatgttctaatgtttatcgattagaagcaattattgatcgggggaaatttcatagttcaatgattgctaaaaaaagacttcgaatcattcgtacattaacttctgatgcggttgaattatcagaaaccatagctgttgataatacttggcccaataaagtagaatattcattaagttgtccaacaaaagctattgctattggttcatcaactcctataacaatgactcttgtccccttattgaaaggtttacagttaggtgatattaaaattgaattgattgaaatgtattcatttgttgggagttatccaccaatgaaaactgatgaaagaataattgccaaaaagaaaatacccaaacgaaagaaaaataacaatggtgatgaagaagaagaagaagaagaagtggatatgtttgatcaatggcaaatcgatacaattattaatattccatcaagcttatcaaaatgtactcaagatgttgatttatctactaatgttagagttcgtcataaattgaaatttaatattggattaattaatcctgatggtcatacttcagaattaagagcaactttacccattcaattatttatttctccatttgttactgttcgtggtaataataataattctaatactggtgaggataataatgatagaaatattgatccaaatgatgatgatatntga

SEQ ID NO: 6276 - DNA, 1773 bp, Candida albicans
gtgaattgttattatgaatacatggacaaagtcagtcatcaacaatacttggataggttgtgtgttctaaaagttgactggggcaatttattgagtaatgacgaagggaaagttgtgtttggtaactatggtgacagaactattccgatgtataaattaaagaatttgaaaaatggagaattggggtttagtgcatctggatccaatactgggttgaacacaccatcgcctggatcgacttctggtattgctacaccaagtagacctcaggcactgcgtactaaatttacaccaatttttttcaaggataaagatactgttaattcaaaaatcttaaaagtccccaacagtggtatcgatggaacaccattcaaaaacgtttacacgtcttcaaaccattcattcttgttaccaaagggaaattacaatctaccattcaaagtatatcttccaacaaacatcccagaaaccgttgaaagtttgccattgggtacattattatacaaactacaatgcaacattgaaagaggcagatttgaaaaatctgttaacgtaagcaaacatattagaattgttagaacattgaatccacagaatttgaatttaactgattcaattgatgtaagcaatacttgggttggaaaattgcaatacaatgtcaatatgaccaagaagggggttgcgattggttctactattcctattaacattacaattattcctattgttaaaggtttaagcttaaaagcaattaatgggtgtatcgtggaacattaccatgtgcagattggtaatgaaagatctccagaatatgaaagggtgatcgggaaacaagatttagatgcgccaaactcggatgacttgccgtatgataaatgggagtttaggactcattataaagtccctgagcatttgaaaaaaataacgcaaagctgtgaacttcgagataacatgattgttgttaaacatagattgagagtgtcgatacaactcagaaattctggtggacatgttagtgaattgagagcaaatttgcccatatttgtgtatatcagtgcaaactctgggcatgtaattggaagacattatgatgtcgataatcaccacggcaccttccagttggattatcagaaagaagatatcttatttcatcatcaggatagaagagagccatcacgcatacctggcgcctcggctacagagacagaagaagagaatgaatcaggagatctggatggagacgatttagatcgtgaagattctgctcctccaatgtatgaaaagcatgtttttgacaaaatatatgatatgaatttacctcagactccattagaacagtttagatcacaacaagctaccccattacattggaataataattcttcggtgaatgtttcgggctattttgatattcccttttcgcaggctttggagaataatttgaaaaaaaaacaagtgcaaacacctatttttgatatagattacatgtcacatatcccttcatatacggaagctttggacgacgatgatgatggtgctggaggagaagactttgcacctggatattctgatagtggtagtgaaagcttcagtgttgtttcgggtggcacgacacctataaaaatcaagttgccaacgaataacagcactgggcattttaagttttcgagcaagaataattcattgcctaacacgaagagtaattctagttctaaactggatcttgaatctagtttgaagttgagattcttccatcacagcaaaaagaagtaa

SEQ ID NO: 6277 - DNA, 249 bp, Candida albicans
aaagtcaataatttgattaagaaacattcgacagcaaacaaattacccagtagcatgtttcagcaccacctaaatcttgcattatttgacataaaattgaaaacagctaataaaaatttgctattaatcaaaggaaatgaacatgaaattgaatcattaccatttgaaggaagtgttaaactatctttgaatgaagatatacatattaaaaagattacttggtcattagtaggtgaattgttattatga

SEQ ID NO: 6278 - DNA, 705 bp, Candida albicans
aaagtgcaaaattgtaacacacagtccattccaattattcatggtttacttgagactattatcatcactagtttcaaaaccattaatccagacgcaactgagattttgttaaatagcatattcattgaaatctatagcacaattgtttctgacgtggatttagtaaaatcatctttggatttatttaccacaattcttgaaaagcgaccagctttgttattgcaaacgccattttttagcgatacaattatcccatttgccattcaaccattgtatttacacgaaatatttgttgtcaagtcagtgacaaagttctggaatactgctataacattgaagaaaggcaatagtaacgatcaccaacaaatcaaggacatcatcaacagcagtatacagaatactacaattggtgttttgttgattgaagctttgttatcagggtttgttctggcacccaggtcagccattgagtattatttcccgttgtttcggacgttgatagcgaggatgccattggaggtaaagaattggatcaggcatgtcttgcttaatagttcaatgggcaaggcacctttggacagcaaggaatcagagacattccttaataaactattgttaacaagaggacaaagacaagcgaacgatgtgcttcgcgattattggctacaagtaaacaaactaacaaatttcataaaatatatataa

SEQ ID NO: 6279 - DNA, 441 bp, Candida albicans
tgtagcaaagttcgtggtcaaatgcttgacactggtttgcaataccacgctaccagctcggaaatgttcggtagatttttttttttcttcgatgttttgttttccttgcatgatcttgttttccacaagctagttcccctaatgtcagatgaattgaacatcgaaggagtagcaagagatattgaattattatactcatctagcaatgccttggaaattcatgagttacaagaaagattgcagacttatcaaaaaagtgaaattggataccagctaggattcaagttgttggaaaatagcaataagaatgtaaagtattttggagctttgacaattactgtatttttaaacacccatgactcatcagttatatttgaattattgtttcaatggacttcttgggttcttattcttaaccagcgggctggaaaacccacgtcc

SEQ ID NO: 6280 - DNA, 774 bp, Candida albicans
aaagaagagccaaaaaaattaagaaaggaaacaggaaacgacaagataatgactgaaggacaagctacagcattgtcatttaaagaaatggtaaatgaatgtttgattagaccattaaaatttgttgtaacagaaccattattggatttggtttgtgcttttgttgctttaatttatgcttatttatatgcttttttctttgcttatccatacatctttagtacattgtacggatttggtgatgataaaatcggtttaatgtttattccaattcttattggtgcaggctttgctgttatcacaacatatgttttagaagtcgaatattcaaaattggtgaaaagaagaaaaccagaaccagaagatagattatggggtgccatggttggagctcctttcccatgtattgcattattcattttaggtgctacatcttacaaacatattatttgggttggtccagcctcatcaggtattgcctttggttacggtatggttttgatttattactctttaaataactacatcattgatacctacgccaaatatgcagcttcagctttagccaccaaagtgtttttaagatctgccggaggtgctgcattcccattgtttgttactcaaatgtacgaaggcttaggtttacaatgggctagttggttattggcctttgttgcattagctatggttttgattccatttacattttacaaatggggtaagacagtgagactgaaactttgtaaagaggattattttgctgccttgatttaa

SEQ ID NO: 6281 - DNA, 936 bp, Candida albicans
  unsure (682): Identity of nucleotide sequences at the above locations are unknown.
ttgggacctgtgtgcggtccaattttcggtgggttgttgtgtgactatgccccaacatggagatgggtatactggacgtttttgatcgttgcagggtttttctatgttgtgtttattgttgtggttccagaaacccaccacggaatattgttgaaaaagagggccaaaaagttgagaaaggatactggcgactctcgctatagatcgttcaacgaattgcaaatcagaacttttgcccaagtcgccaagacctccctcttgcgtccatttgtcttgctcagcgagcttattgtctttttggtcaccatgtacatgtcagtgttgtacggtttgctttacatgttctttttcgcttatcctatcgtctaccaagaaggcaaagggtggtcagcctcaaaaactggtgtcatgtttatccctattggtgtgggtgtcattgcttcgtcgttggcagcaccttttttcaacaaggactacaatagacgtgcccaggaatacagagacagaggagagttgcctccagctgaattgcgtttaattccgatgatgattgggtgttggtttgtccctgctggtcttttcgcctttgcctggtcttcataccaaagactttcgtgggccggtccgtgtttctcgggtttcgccgttgggttcgggttccttttgttatacaacccagcanacaactatatcgtcgactcctaccaacactatgttgcatctgcattagccgctaaaacgtttgtcagatccatctggggtgcgtgtgtacccctcttcactatccagatgtaccacagattaggcgacgaatgggcaacctcccttatggcattcatctccttagcatgctgtgccatcccatatttgttctacattttcggtgcaagaattagaaccttttccaaatacgcatacgctccaaacatggattaa

SEQ ID NO: 6282 - DNA, 939 bp, Candida albicans
aatgccacattgaattggtatcaagcattggctagtggttcaaatacgtttaacccaacaaattcattaatggaagttgtatatgaaaccggaagagattataatgctgtcaacaattatatcgtcacgatcattggacaaatcttacgtggttattataagtttattccacaaagtggattggttgtcaatatgttgaaaacattgaattgtactcaagcaaatcatgtgatttataatgctcctcaattgatttctaccattcctacatgttcaatccatgatttacatccagttcctaacccagtattttctgctactatgcaattagctggtgtttaccttattgtgcttacatttttcgcatttgtattttctattcaaatacaaatgtatattgcatctaaagttaagggcattaaatatgtgatatttagaatgatgtctaatcaagttgcttattttattatttcattggcatttgttgttttgaacacggcatttggtttaccattcaatggaacttttggtcatgctgggtttttggtgatttgggtgttttcttatttgttaatgtcggccattggaagtgttattgaattttttgtattgattgtttttgctttgaaaccaccaatgattggatttgttttactattcacggtggttctcaatcttgcaccaacaatttcacctattattttatgtcccaaattctatcgttatggttatgccatgccattgaagaatttttatgatcttttacaagtagcttattttaatgcttggaaaggtcatatggggagaaatattggaattttgtttgcttggatggttgtaagtaatgcggcgttaccatttgtaatgaaatggttggcaaacaagaaagccaaagcagaagaacaaaaaaccaacttgggaagaatcacaggacaataa

SEQ ID NO: 6283 - DNA, 525 bp, Candida albicans
aagatgactcccataataaatggactaaaccctgtcttcggtgacaatttgaaagaaattttacagacccctgaagcaaagaccaagggcaattggaaaatatacgattcaactgaatttgctcagatagcgtccaaatccaaccggactgcggaacaagaaattatgcaccaaattcatcatcaaaagtattgggcatcactccatgtgatgccaaacgcctcatacaactatttcaatgccatgtcacagggggatgccaattatgatcctgttaaaaacacagtccattcgatttatgaaacaggaagggatttcaatggaatgactcaattcgtcatcccttccatcaatggcgtggaaaatatatggctaagcagacaacccaagatgactttcgatatagttcgcaatgtcactatcgattccgccgtaaaactgaaactacttgcccagccaattagatttgaaattgtcgatccagtaccatggaacgaccctattctaattggaccttttcaatga

SEQ ID NO: 6284 - DNA, 270 bp, Candida albicans
ctcccaagcctcatccccaacattaattatggtcaaaagaagttaaacaagggctctcttttatttagtagaaaattgcaaaaccgaaaaaatgaaattgcatttaagtatttcttgaactatttaatcatgggagttggtgttctagcaatattctcgatctactggggctccttttatggaataaatggcaggataaaaaatttgaaaatgttagtggtaatagaagatgactcccataataaatggactaaaccctgtcttcggtga

SEQ ID NO: 6285 - DNA, 702 bp, Candida albicans
agagtcgccactaccgggtcggcattccaaataattgatatgagaccatctactagtggagttttagttgcagctttacaaattggtcttctttatcttgtcattgttagttttttcagtttcaatttttttgtcgatatacaccgatcagtggcattaatggtgaagcaaagaaactttttactttatcgagtttttgcatcaatcatatcgtattttgttatcagtttaatgtttggtttggttactttagcgtttcaagttgattttgctgttacatttggtaaatctggcttcttagtttactggatggtaacatttttaacaatgtggagtgttggattggctaacgaattggccgctatgctcatacttactatctatccaccaatggttgggttttggttgatcttctgggtaattataaatatcacacccacattcacaccaattgctttgttacctgaattttatcggtatggttacgccatgccattgcataatgcttttgaaatttattctgttatttttttcaacacgtataagggattaataggaagaagcattggaatcataattgcatgggtggtatttttaacattaatggcaccaatagtggtggtttactttggtagcactatgagtaaaaaagctgctgctgccgctgctgctgcaaaaaaggaaaaggaaaagtcaaagtaa

SEQ ID NO: 6286 - DNA, 1074 bp, Candida albicans
  unsure (1036),(1037),(1039),(1048),(1058),(1060),(1068): Identity of nucleotide sequences at the above locations are unknown.
aagaaatttttacacatcactatgggacaacgaatgccatcgccgccatcttcacatataacgaatccatggaaaactcccgaacaaaccgcatcctcatcacatggtcatgatgaggtaatttcaccagagacaaatacatattccccagatttttcaaactacacacgtaacagtagtagttatagacatgttgataaaaaatcagctagtcccccaacaacaacatttgataatcaaacttttcaggaaagtaatcacgacgacacaaataatcaacaatatgtggaggctgatgcaggagatgggacgaaagctcatgaacaatatctcactggtttcccactattcttaaccatttcatcatgtattatatcgttatttcttgtagctttggatcaaaccattgtttcgacaattttaactactgtggggaataaattcaatgcatttgaaaaaattggttggttaacatcaggtttcatgttacccatggcatgtcttgttccttcatatggtaatataagtatagcatttggtcgtaagtggacattagttgcggggattataatattcgaaattggatcattgatttccgctataagtaattcaatgagtttattaattggtggtagagtcattcaaggtattggaggtggatcaattcaagctatagtcatggttatattgaccgaagttgtccccatgaatagaagatcgttagtgtttgccctgatttctgttgtctattcgacatctagtgttcttggtcctataattggaggtgcattagagaaaataacttggagatggtgtttctatataaatttaccactcggaggagcagcattggttatcttgatgctcggtttccatcctcccaaaccacaaggtaatgttcgtgaaaaattactgaaaattgattttattgggtttgttttattgacttccggtttagtattggtgttgttggccttaacatttggtggtgtaaactatccttggaattcacggatgcggtccattgctttattcnnanttttggtcnaagacggcgntnaaaaatcnatattt

SEQ ID NO: 6287 - DNA, 630 bp, Candida albicans
ttatcccagtcttctaggcctgtgctcaagattgagaatgtgagtatttctcagactactttagccatgtcaacttcagaaatgggtggcccatcaactattaaaaacttaaaggaaaaagaatattattatgaagccgatgctggtgatggtactcatgccactgaacaatatgtcactggttttagattagttttaacacttttcagttgtattgtttcattatttttggtagttttagatcaaactatagtaacgacaattattagtgatgttggaaataactttaaagcatttgataaaattggttggttaacttcaggatatcttttacctatggcttgtttatcattattaaatagtaaaattgccgttgcatttggaaggaaaaattgtcttttggtcgggattttaatatttgaaattgggtcattagtagctgctttagcgaaaaatatgcccatgttaattggtgctagagtaatacaaggtttaggtggtggtaccattcaatcaatgatttctattatattaactgaatctgtccccatttcaaaaagatccttatcgtatgcattattgggaatcacttattcatgtagtttcttgggtccaattgttggtgctgca

SEQ ID NO: 6288 - DNA, 540 bp, Candida albicans
  unsure (532): Identity of nucleotide sequences at the above locations are unknown.
gtatggacatttaaatatgctcctaaccccatgattttatcaattttcattaaaaatttcacaattttttgtgcttgtatttctgcatttgccaattttgccgtgtttattgccttgatcacttatttggcaacttatttccaagttgttttcaataaatccgctttcaaatcgtctattgccattttacccatgattgtatcggttgttgttgcttcaatgttgaatggaccttttattcgccggacaagtaatgtaaaaatccccatggtgatttcgggaatttgtgctcctgttggtgcagcattcttattaatgttagataaagatgctaataattccaaacaaattggttgtcaaattgttattggagtatcgattggattacaattccaagcatcattattgtcggctcaacttgaagttcctaaagatgttgaaggatcacttataatgatcacggtgtttatgtcatttttgaaatctttaggggtactttgggtgtggttcctgcccgacctgtatacaaaanttgtctaa

SEQ ID NO: 6289 - DNA, 1014 bp, Candida albicans
  unsure (932): Identity of nucleotide sequences at the above locations are unknown.
tttgccggccggctattttttttttttgctagcatgacatcttaccagtcttccaataatcattcttcagaagaagataaacacttgtccggagatgaaaagacgttttcgccatccgatatagttgaaaaggctatagtagaggaaaaatccattggggttgaaaaagcagaaatcttagctaatcaatggaaacatacattttggttcaaattgcttttagggttttctgcatttctttgtggttatgcttacggtctcgatagtcaaactcgatatgtttacactgcttatgcaactgccagttggtcagaacacagtttattaacaaccgttaacgctattactggggtggtggcagctgccagtcaacccgtctatgccagattgtcggatgtccttggtcgtttggagttgtttattgttgcagtgttgttttacgtggttggtactattattgaatgccagctgccaaccattaatgcttatgttgctggtgctgtgttgttccaaattggatacagtggtatcattattatgttgttattcattttgtctgatttctcaagtttgagatggagattgttttttacgttatgtccatcattcccgttcattatcaacacttggatttccggtaatgttactgctgccgttggtactagatggaaatggggtatcgggatgtgggcttttatactcccattgtcatgtattcctcttgtgtgctgtatgattcatatgcgttggctagctggtaagacagaagaatggagagttttcaagcaacgtaaaacaaagttccaagaattgggtgtagcaggattctccaagtacttgttttggagattggatgttattggattgttgttgtccactgtatcattgggttggttattgggtcccatggaaacttggtggttggttcaaanaaacttggaaaaaaactcctttcatggtgcccataatcctgggaggtgtttgaatcccggtttcccctttatgggaacgtta

SEQ ID NO: 6290 - DNA, 426 bp, Candida albicans
acaatggtggcggcacaaagccaagcaaaaaaatcagaaagagcagttgtaataagttgtcgaaatgtcattagatctttgggtggtgctgttggtttagcggtggcttcattaattattaccaatagtttgttgaaggaaattaccaaacaagaaaaccgccaagacatatcttcaacttcgtcggtgccaacagggtatttaatgtatttgaaaactcatgtttattccaaagtcgatacaactcaattgacggccgatcaagtattgattgtcaggcaaatgtacatgcaagccattcgtaatttcttttatttgacaatacccttgttggcattgtgtttgattagcagcttatttgtcaaagataaaggactccagtgtatagatgaagaacctgaaaaagacgaaaaggagttgcaataa

SEQ ID NO: 6291 - DNA, 378 bp, Candida albicans
acctatagaattggatacgctgttggttcgtcagtagcaggtgcaatttggtcccagatgttgtattcaagattagtcaaataccttggcgattctactttggccacaagcgtttataccgatccatacacatttattgcacaatatgtttggggcactccagaaagagaagctgcagtcaaagcttatggtgaagtacaaagagtattaatgagtgtttgtattgcatttgttgctcctatgatagtatctgcacttttcatgagagaccacaaattaaccaatgaacaaagcttggaagatgtagaaaagcaagaagagaaggactcgttggccaatttcttcggcaatttcaagaagaaaagagtagctgtttag

SEQ ID NO: 6292 - DNA, 1494 bp, Candida albicans
ggaagtagtgatgaagacgatttagagttggggaggaggcgatctggcaccatgccaactgtcattagtccccaggaagacttttttaatttaaaaaccgattataatctagagtcaaaaagtttattcaaaaattcgttgccattaatattaacatttatcttggaacatatattttcgattgtatgtttggtggttgtaggaaaattgggtacaaaacaattaggggccgtgtcgttggcaactatgacttcaacaattacgtttgctatctttgaaggaacggcaactgcgttagatacgttgtgtccacaagcttacggtgcaggcaactatgagttgatgagtatttttgtacagagatgtaatattttttccatgattttgtttttgccatgtgctttattttggtggttttctggactgatcctaaaatatgtcattgacgatcctgaagtggtccatttaactcaggaatttttaaggtacttgatattgggggcaccaggctatattctttttgaaaactcaaagagatttttgcaggctcagggtatatttgaagctggcacgggtatactattcgtcagtgctccaatcaatattggactttcgtggtttcttgtatggaatgagacatatgggattggctatattggtgcacccattgccacagggattaatttctggttaatgatgatattgttagttctttatgtcagatacattgatggaggaaagtgttggtttggattagcgtctatggaagagcttttcagtaactggaatcaaatcattcatttggccatacctggtattgttatgatggaatctgaatacatggcatatgaaataatgaccttgtttgcatcgtactttgggaccgttcaattagcagctcagagtgccgtttccagtattgcatcacttacatatatggtaccattttctgtgggaattgctgctaccaccaggattgctaattttattggtgggcagaatatggttggagctatcttagccactagagtagccatggtggcggcagtgattgtttccaccataaactgtttagcattgttttcgttccgatacgagattgctcggattttctcagatgatcctgaagtgatttcactcattgtcgatttattgaaccctttggtgagtgttttacaaattttcgatggtattgcttcggtcaatagtggtatattgagagctcaaggttcacaaaagataggtggctatataaattttattgcatattacgcatttgcattgccattggctatggttttgagtaaaattgttggcctacaagtctttggtttatggattggtgttggcagtggaatggctgtgattgccttgagtgaaactgccgttattatgtttagtaattgggatgacatattaatgaaggcaggtataatgaatgagtttggttttgatgatagtgatgacgatggtgaagatgatgatatattttag

SEQ ID NO: 6293 - DNA, 1074 bp, Candida albicans
ctttttaactttttagttgtatatttttattttcattcatttaaaactcatacacccaccaacatatctatcatgtcatcatcacatccagatagaactcatcaattcactcattctaatactaaaagaagagcatcaattgtttatggatcagtaggtaaaggagggttatatttaccttcagatttcattcctacaaaggacaacggccataacaatacatttgacaatgaagatgaagaagcagataataataatgaaactcaaccattgttacctgatagttttggtaattctccttcaacattattatataataagaaaaaaattagaaggaaactgagtgttatcaatcatgaattgattgaagaagaacgtgaattattagaagataatcatattcctattcctgaaaccaatggttctactaatgcaattcaagatgaagctgttgctcaggaagaagaagatcaagaagacaacattatcagggatacgtttgaaaatgctattattaataaagaaattcaatcaactacatcaacaattgagttgaaaaatttaattaaatcatcaatcccattagttttaacttttcttttacaaaattctttatcaacagtatcagttttcagtgttggtcatttaggtgcgactgaattagcagcagtttcaatgggggccatgacggctaatattaccgggtatgctaccattcaaggtattgctactgctttagatacactttgtccacaagcttttggagccaaaaaatataaattagttgggtcatatcttcaaaaatgtactgcattaatttcagttattatgttacctattttcattatttggatatttttcgggtacgatttaatttgtgtaattcttcctgataaggaaacagctaaattatcagctgtttatttaaaatatcttacatttggtatgccagcttatattttatttgaatgtggtaaaagatttttactagctcaacggatttatcatatttctacttatgtgttattaattgctgccccttccaatttaattatgaatttattatttgtttaa

SEQ ID NO: 6294 - DNA, 720 bp, Candida albicans
agattcagtattaaagatgctttccatgattggaaaaaattgattgttttagctattccaggattaattatgttggaagcagaattcttagcatttgaaatcttaactttaatggcatcttatttaggtactattgctcttgctgcacaatctgtcggtacaacaatggcagctttaacttatcaagtaccatttgctattgggattgcttcatcaaccagaattgccaactttttgggtgccggattaggtgatgccgctaaaattactacaaaagttgcacttttatttggtctcttcatttcagtattcaattttttggtattatttatattccaaacccaaattgctaaagctttcactaatgatgaaaaagttattagtgctgtcaccaatgtcatgtggttaattgctcttatgcaaatatcagatgccatgaatgctaattctgctggttgtttaagaggtcaaggtcaaacaaaaattggtgggattgtcaatttgttctcttattatgttgtgggattaccattatcagtatatctttcattttattcaccttggaaaggttctttacatggtctttggatcggtagtactgtggcattaacaattattggttcagttcaaagttattatgcattgactgttgattttaataaactctgtgatgatgcaagaaaaagaaccaatactgaaaatcatcacaatcatgtataa

SEQ ID NO: 6295 - DNA, 1023 bp, Candida albicans
aataactccattactcccatttacatctcatcgatttcgaagtatcaggtaaatgttcggacatcgatgaaaatgaaattgtatcatacgttcaacaacggaacacaatcaatagcttcagttggtcatgataaaattccaaaatcatttgctttaccagttacaactgctgcaactggtgtgacctctggtggtgttggtgttgtcactggtggtggtaccaatggtgtcgcgtcgccacgtttagctcggtcaatttctctaagttcattaatttcaaggaaatcttattctattaatgatattattgaaattcatcaacaagaaattgatcctgaaccgaaaacaacgatactcaatgaaattaaagtcattatcaaatattcattacctttaattgtcacttttctattacaatattcattaactgtagcatcagtattttctgttgggagattaggttcaaccgaattagctgcagttagtttgagttccatgacagctaatattagtggatatgctataattcaaggtgtttctacttgtttggatactttatgtgctcaagcttttggaagaaaagattataattccgttggagttcatttcataaggtgcaattatttattattattactttatatccccatggcgatattttgggttttcggagctgaaccattgttagtcacaattattggtcaagattccattgccatgtgtcaattggctggaaaatatcttcgaatattgacgataggattacctgggtttatattatttgaaaatgctaaacattttttacaaactcaaggaattttccatgcatcaactttagtattgattatatgtgctccattgaatgcatttcttaattatttattagtatggaataaatcaattggattaggttttattggtgctcctatatcagtagtaattactaattggatcatgtgtttcatgttatatggctacattttttgtattgatgtcttcaccacgcggaggaaggaccacgct

SEQ ID NO: 6296 - DNA, 1452 bp, Candida albicans
aaactcttcctcacactaacaatgaataccgaagaaaccttactaattactccggtcgataattacgatgctatcgtgaacgacaccaaatactacgactccaccccgaaactggaactcaaacatcttacgagatctagtttcccattagttgtatcatttgtcttgcaatacgtcttttccatcacatcagtatatgctgcagggcgattgggtgccaaagagttggctgcatgttcgttggccatctgtactttcaacatcaccggattagctgtgttccaaggcatggctactagtttagacacattttgctcccaggcatacggatctggtaacaagaaaatggtaggagtatatttccagcgcgcaacccttcttatgctcgcaacaatggtacctttgatgcttgtgtggtggtactctggcagtattttgaaccagttggttcctgacccagaattggttagcatggcgcagcttttcttgcgaatccacgcgtttggtgtaccgggcttgattctttttgaaagtggtaaaaggtttttacaggcacaacacctcttccaagccagtacatatgtgttggttgttgcacttccatttaacttgttattgaattggttgttggtatggaatcccaatacaggaatgggatacacaggaattcccttgtcgataggaatcacctactgggttatctcgctcttgatgtttggatatgtgattttcattgatggcattgaatgctggggcggtatcgactgggaaaaagcatcaagcaactggaaaccaatgttatctctagccgtccctggtgtaatcatggtgatttctgattttttggcttttgaaattttgactatttttgcatccaggtttggaaccgaggctttggctgcccagtcaattgtgtccaatgttgcaactttatgttttcaggttccgtttgcgtttgctgtggctataagtacacgaatgggacactttattggtgatggaaacattgccagcgccaaaatcctcaacgaccttacggtaatcattggcggatctattgggctactcagtttttgcttgttctatttcggaagacacgtgttgggagaatttttcaccagcgacaaaatggtattggaaatcagctccaaattacttatcttggccggtatcaatcaaatttctgactccttgaatgttgtggggacaggtgtgctcagagggcaaggtagacagcgaattggatccattctcaacattatatcgtattacttccttgccatacctttaggatacgtgcttgcatttaaatttggtatggagatgagtgggttatggattggattgactattggtgtttttgttcttgctgtaacacaatgtacaagtatctgtttaagtaattgggaaaagatattagaacattcacatagaattcatgatagtgtatag

SEQ ID NO: 6297 - DNA, 1593 bp, Candida albicans
aataaaactcaagtggttcgcctttttttgttctttttatttggccaaacatcatccaagatggaagaaatagaaaaagaaaagaataaagatttgctcgaagatttcacaactacagataatagagatgttctagaaccagagttactcgaaaagacaagtgacccttacttagtaatatttgatggaagtgatgataaagaagatgcgtctaggttgtcaagaatacataaatggacgatagttggaataatatctattggatctgtgtgcgttacatgtatctcatcgtcggtggcccttgctaccccacagattatggagcatctccacgtgagtcatgaagttgcaattttgaacatttcctttttcatattaggattaggaacaggtggttgttttttatccccaatcagtgaatttcatgggagaagaatagtctatattggaggtttaacaaccatgatagcgtttgaattcctaacagcttttacaagtaacattggagctatggtttttggacggtttatgtcgggcttttgtggactgagctatatgagtgtggccagtggctcctttgccgatctatttaaagctaggaaaaaggaaggcaaagatgctaataaggaattgagtcttgctttgattctttattctgttgccccttttcttgggccatctttgggtagtttgatatctggtttcatcaatacctacttgtattatcgttggacgttttacgtatttataatttggtccggtgttttgctacttgcggttgtattgtttgttcctgaaacatacgaaccagtgaatctacaaagaaaggctaaacgattgaggaaaactacaggcgataatagatactatgcagcagcagataagcagactacgagtttgtatgagagtgttcttacttcatcaaaaagacccatattgctattactcagagacaatatgaccgctttgctaaacttgtatactggcttcacattggctgtagtatatttgttctttgttgcgtttccatatatattcagcacggtttatcatttcactataagtgagcaaggaatgtcgttccttggtttggttgtggggatggtatccacctgtttgatatcgccatactttattgacaaaggatacgttgctttacttcgaaaaaacaatggtgttgctaaacctgaatttagatttatacctttgatggttggtgcttttgtagtaccaattgggttgtttattattgcctggacatcgtattcgcatatccattggattgcgcctattattggatctgcagtttatggatcaggaacaattcttgtttttaattcaatatttgcctacacagtggaagcttatcgactatatgctgcttctgctatggctacaaacagtttaactcgttcagtattgtcgtgcattttccccttatttggcctacagatgtacaagggattgggtattcagtgggcgacaactttacttgctttatttgcttgtcttatgattcctataccatttctattttttaaatatggagaatatcttagaagtagaagcccttatgcttggagtgttgattag

SEQ ID NO: 6298 - DNA, 372 bp, Candida albicans
ccacgggggttatttaatgaagtagtggtgctgatcatattaacttttgggaaacaacaattgattgctccttggatggtgtttaatattgttgccaacgtgtcgacaacgtttgctccatttgttttaactccagggttcttccgattcgggtatgccttgccaatgtataatgcttatgaagctgtgaaagttgtattttttgatacttggaaaggtcatttaggaagaaaccttggagttttgataatttggattgttgtgggaaatgtgtcattattatttgtcagtcattggtctacccaaagagctaaaaagatagcattagcagaaaagcaaaagaagaaggaacaacaacaagtagacaaatag

SEQ ID NO: 6299 - DNA, 1188 bp, Candida albicans
cagaagctaccggggaattgggaaacaacaacaacaactccaagagacaggattacaaattcggactcggtggatccattatccacagaaagtgctcaattttacgatgcacatgatgcattggaagctgatggagtatatgccacggctgtgcaaaaagtccaatcgcaaagattagaaacagaacatcgacaagataatgtaccgggaacatcaacaacaacaacagttcctcaaggtgatgtcaaaggtgaaaagcatgaagatcaacatgatacacaatcattaaccatcaaggaaagggatcatgaatatttcaaaatgattccacaattcttttttgtttatcttcaagtcttctgtatatttttaggatttttatcaatgtattgggggtcaatatatcatcgtgaccaacgttacaggaatgttggttatttagtggtcaatgaagattcacaatttcaagtgcccaatgggtcaggctcggcatcgtcatcaacagtagaaccctatttgggtaatgctatgctcaatatgttaactaataacaaaacaattgagaatcttggagattttcaaattgtgaatttgacagatttcacccaattagcaaaaaaacacaataataccatattagaagaagttcaacgacaagtacatcatcaaaaatattggggtgccatatatattgccccaaatagtacccaaaacatatatcaagggttttcaacaggtaatgcatcgtatatgcagaatgtgaatcaatcaataactgttgtttatgaaacaggacgtcatttttcagcattaagtcaatatcttaatcggaatttgaatcttgttagtgaagcatggattcgtgattatgcatcatcccaagtatatcaaccaattttaggtcaattgaattctactcaacgagaatatttattgagtaataatcaaacaatcgctattttcacaacgttacctacatttaattttattgaccaaagaccatcacctagtcctgcagttttaggaccttctgaaattcaattgatttattgtttgattatatcattttacagttataatttttctaaagatatttatgcctatatgagaaagaaaattaaatatcgatcttatttattttataaattcttgatatctcaattgcatgcatttgtgttggcattagtt

SEQ ID NO: 6300 - DNA, 291 bp, Candida albicans
atttctgctgttcttcatttcaatccatttggtaaacaacatgtggttccagaagatgatgaaagacatgttggtgatttaggtaatatttctactgatgttaatggtgttgctaaagtacccaaacaagatttattgattaaattgattggtacagattctatcttgggtagaactattgttgttcatgctggtactgatgattatggtaaaggtggttttgaagattctaaaactactggtcatgctggtgctagacctgcttgtggtgtcattggcttgacccaatga

SEQ ID NO: 6301 - DNA, 480 bp, Candida albicans
catattaaaccttttcttttcttttcagtcgctgttgtcagaggtgattcaaaagtccaaggtaccgttcattttgaacaagaatccgaatccgctccaaccacaatttcctgggaaattgaaggtaatgatccaaatgccttgagaggtttccatattcatcaatttggtgataacaccaatggttgtacttctgctggtcctcatttcaatccatttggtaaacaacatggtgctccagaagatgatgaaagacatgttggtgatttatgtaatatttctactgatggtaatggtgttgctaaaggtaccaaacaagatttattgattaaattgattggtaaagattctatcttgggtagaactattgttgttcatgctggtactgatgattatggtaaaggtggttttgaagattctaaaactactggtcatgctggtgctagacctgcttgtggtgtcattggcttgacccaatga

SEQ ID NO: 6302 - DNA, 2445 bp, Candida albicans
tgtttgctttttattctctttcacccactactgaaccgaaacaacaacatcatgggtaaaccaaagaaacatatgtcatttacagctaccaactatgtcccaacagacgaccagtctcccgactcgtcaaatctacgcaatcacgcaaacggaacaaaaaacagcactagctcattagaccaattaatcaattcaggtacttttatagaccatcggaagtcttttgattgggcaaatgcacactcatcacccacaaacagaagaagaaaaaaatcaaatggttccttccgaaaccagaaatcaaacaaagatccaccaagtttaccgttaacgaatagaaatttacaaacacttattagaagatcctcaacaattgaggacccgatctcaccaactgcagttgctattgatatagacaagttcaccaacgaacagagactgtttgctaaatcgaatacttggcaggatcattacgaggatcgagacgatgaacagtactcgtattctgagtttggagaatctaacccttcctcggaacattcaagcgactcaacatctttggatgatgtatgcttccctgatttcagagaagatgtgaaaactaccagtgcttggcctgacttgcatgttttagaagaatttataaaggaagaattggaggaagtacagacagacttggaacccacagtgaattttggaggcaatgttgtgcacagcgaaaatgaagatgccacagagagtacacctttgatagacagcttcaaggtgaacgaggttgagtccttaggtctggaaaataacccttttcaaatccgaccaaccccaatacaaccatgggagagatcacagcagaatataccacccattttaaaggatgtgaacaaggggaaagttgacaaagagatttgccggttcacttatttccgtgaagacttgtctaaaacaatacactcgcctacaatgctggggttgatcgaggacaactcaaaaatttacgatagccttgaagattttttcccacccaccagatcaaaaccaccatctatccatatgaaaccggattcagtgtcttcaacaaacttaccaccgttgaacaagtcgcggccggaaacacccactccgtcatctgtgaatgatagcttgtctcgccgtgaaccattttggctcgatgttttcgacccaacagaagaggaaatgaaagtgctttccaaaacatttggtattcatcctttaactacagaagatatatttcttggtgaggcaagagagaaagtagaattgtttaaatcatactactttgtttgtttcacttcatttgatgtagtgtacgaaaaaagacggcaacgagcaaaagaacaagaaaagaagttgaacaagttacaagacatgtacgaaaacggttctgataacgggagcacattagaatcgaaatcgcctttcaaattgctaaagtcccttttcagtcgaaagaggagactttcatcgtatttagaaaaaccaactagcacatcgattaaatcgcagggcaaaaaaattcgagatggggagcttctgccgttaaacatgtacattatcgttttcaaaactggtgttattacttttcatttttcggcaacccctcatccaattaatgttcgtagacgtgctcgaatgttgaaagattatttatcggtaacttccgattggatatgctatgctttaatagatgacatcactgattcttttgcccccatgatagaaacaattgaaaccgaagtgaatgcgatcgaggatgcaattttgaagatgcattcaggagaatctgattctgaagatgaaagtgaagaagaatccgaccatccagaaaatgtatttgttttcagaaaacggtcgaaatcaatggtagaccataaatcggggcccagattagcgaaatcggtatccagttccagtggaactaactcatctcgaattcttggctggaagcgtaaaggtgatatgttgagaagaattggagaatgcagaaaaagagtcatgtccgtgatgagattgttatcgtcaaaagcggatgtcattaaagctttcagcaaacgattcaacgaactggaaggatcgctgctggaaattggaatgtatttaggtgatatacaagatcatattgttaccatgttgcaggccttggcccattatgaaaagttgttagcgagattccattcgaattacttggctcaaataaatattgatatgaccaaagtgaacaacgatacaaatgatgtgttagggaaaatcacaatattgggtacaatcgtgttgccaatcaatgtggtaactgggctctggggtatgaactgtttggttcctggtcaagattatgaaggcttagcctggttttggggaattgttggatgtatggctttgtttagtcttgttgcttacaattatgcgagaagagtaaccggtttataa

SEQ ID NO: 6303 - DNA, 1455 bp, Candida albicans
actgttgttgttgtctcaaaaaccatgataacaacaacatctatatcgtcggtgatattgacgatcctcaaaccccttgtatttatatatcaattcatttatcgagtttattggtcaggattaaatcaacgtaatatattacaattgattctaaatttttgtattaatttcagtccagttttcatttggttattaatatttaaaaatgctggattgatccctcatgaaatacgtcctaaaattcatgtcaaattagcatatcatttggaccaatacatttttgaaactataattggtggcatagttaatattttgggattagcatctctggcttggttattatatcgttttgtttatcaactgaaatcgagtaataacaatagcaacagaaacaaccatcaccaaagtcaaatttctggtgagtaccctcctagcaataccaatgacatttattcattgtacaagataccacaaaattatgaattggatatcgacaacgatagtagtagtagtaatagcagcaataatagtgatattgaattagaatcatttcctaaagaattgttgaaaccttcttataatcaattaccaccaataaatttccaagacaatgacgatcaaatacaagactcacaactagataacaatagggtccattatggcaattcagagaatactcgatttgcaccaatggtatttatcccacaattaactctggttgaagttggtcaaatggcacaatcaatcaataataaaattcttaatcatattcaaccaaaaaattcaaattctgggttcaattataattattcccccatcaattcatgggatttttgtccatcattattattagccaccagttggtttttattaaattttgttcattatttacgtgaaccaatacgattatggcaagattatttagcatggacaagttatgttttaggtcatatcactgtgcccattatcactgctgtatggttatatgttttccatgctcctggttcacttaaagcatacagttttgcccttggattacaaaatatttgtggagttttaactcatttactattccccaatgctgcaccttggtttattcatatgaatggagagaatgctaatgctgattatgatactccaggttatgccgctggattaattcgagtggatatagcattgggtactcatttaacatctaatggatttcatgcttcccccattgtatttggtgcattaccttcattacattctgctatggcagtaatgacatttttctttgttggatattattcaagatggtattttattaaatttttggcatttatgtttgttatgattcaatggtgggcaacaatatatttggatcatcattggagattagatttattggcaggattgatttatgcttgtatttggtttacgattatttataaattggttattaaatatcaacaa

SEQ ID NO: 6304 - DNA, 1902 bp, Candida albicans
cagtcgtctgttactactcgtgattcaataattataactatgagcggaaaaaagaaagaaaactcattttcaaatccagataatgcggaattacaggcaaatgcaccatcgacgcctcaaaatgattctgacagctcggtgatagtacaaccaaatatccataatgatattgaaaatcaaccaacggcagaacaaaagggattcaaagaatcagacgctggtgatggtaccaaaaaagaagaccattatttacacggcgtacaattaatcttatgttttttatcattgtttttatgtttattcctttttgccttggaccaaaccattgttgttacaatcttaactacagtaggaacaaaattcgatgcattttccaaagttggttggctttccagtgggttcttattaaccatggctgttttcattcaattttttggtaaactatcaattattattggtcgtaagtgggcaatggtgattgctattattttatttgaagcagggtcgttgatgtgtgcattggctaatgacatgaatgtgttgattggaggaagagtattagctggtattggaggttcgggtatcaatagtctggtttttgttattgggtctgaagttgtcccaatcaccagacgtccattggcattgagtattttttctattacatttgctgttgcttctgtggtaggtccacttattggcggtgcctttacatctaaagtgacttggagatgggctttttacatcaatttaccaattggtgggtttgcaactttggtatttttgtacgcattccgtccaccaagaccaaaagtgaatgtaaaacaacaattgaaacagtttgattatttcggtacattcttgttgattgctggctctgtcatattattattggctataacatttggtacatctgatttcccttgggattctgctgcagttatttcttgttttgttttgggcccagttttactcattgcatttgttgtatggaattttgggttttcaaagaaccaagtgattagtaccgaaattgtcaaggtcccacaaattattgcttccacacttgcaatctctggtatattttctgcatttattatgttcatgatttacggggcaatctattttcaagttgtcaaagatgcatctcccctcagtgcaggtcttcatttgttaccaacaatcatagcggttgtactttcgtcgatgctctccggtttattagtgcaaaagttcaaatttgttaagccatataatgtgatttcaggaattttaggaccaataggttgtggattgattacattattggaagttgactcaaatttttcccaacaagttggattgttaattatacttggggtgctggctggtttacaaatgcaaccatcgtttttatcagctcaaattaaggcaccaaagactccatcaggaatgattatgacaactacttttatcaatttctcaagatcaattttatcagcttttggtgcagtgttggccgatgcagtttatacaacatcattaaagaacatctactctaaagccgttaaaaaggtcacaaatccagtcattttacaagatttacagaaatttagtttaagtcaattgacttcatcaacagccttattaaagacattacacccagagactgaacattttgttaaaacccaaatcatgaatgctattagaaatgtgttttatatggctattgggttttctgctattacattttttgctgcattctttgttaccaatgaaagattaccgaaaaacgtcgaaaaaccagaagaacaatctaatgaaaaagaaacaaaagaaagtgattcatcagcttctgatgtatctcaaccaaaagaaactgaagaagatgaggtaagaaatgaagagcctgagagaatttaa

SEQ ID NO: 6305 - DNA, 1323 bp, Candida albicans
attcaacgtacacaaaccagaaacttaattttaacaaaactagagagtcgagtagaagataacactaataattacagcaacgataaccacgagcatgaggttgaatgtcaagatactataagtgtaattcctgatacaaatattgagattgctcaacatggtaaagagttcgataccatagacccagaattaattacatggaatggacccgatgacactgaagacccgagaaattggccaataaataaaaagatatttttactaggtttcgtatcattatatgccttggttgctcctatgtcatcatcaatgttatctccagcaatgacatttatagcagaagatttccatatatcatcacccataataaagtcaatggtggtttcaatacaaatcttggcatgggcatttggaccattaattattgcccccttatctgaacatgattatattggtcgtaaattggttcttgacgtgtcatgttggatgtcattatttttcaatcttggatgtgcattttcacaaaccacggcacaaatgatggtttgccgattcattggtggcttgtttggttgtgtccccatgaatgtatgtgctggagtcatttccgatatgtttgatgcccaatcccggaatgcagcattagctggatattctttagttccattgttaggaccagtaattgctcctgtgatatcaggtttcatagtcgatcacaaacaatggcgttggacattttatgtcttgtgtatcttcaatggatttgttgatattacggatacttttttatttaaagaaacttattcaccaaccttattgaaacgtaaggccaaaaaattgcgagaacaaacggggaatgtcaatattcacactatctatgaaattgctgacggggaaacaaaattaggcaaaatttggctttgtatggttagaccaatcaaattattgttcactcatcttatgattgttggattggggtcatttatggcatttacatatgggttcatgtacttgatgattgtgacattcccagaaatattcggcaaccagtatggctatagtaaaagtgtgactggtttgatgtatatccccatgggtattggctttattattggggttatcttttggacatacatggttggtaatgtttatgaacgattaaccagtagaaataatggggttgccaaaccagaatttagattgccttgtttaattgcatcctcgatatttatccctgtcggattaatttggttcggttggtctgcgcaaaagaagttgcactggctcatatcttaccctcgggactggacggatccgcgctaa

SEQ ID NO: 6306 - DNA, 1266 bp, Candida albicans
gctgatatgatgcaaatttatcatattggtcggactccagcaactttaaccacgtcattgtttgtttttgggtttgcttcgggtccagttatttatggtccattatcagaattatttggtagcaaattagttatggttccttcatgtttaggttatgtgtgtttctcatttgccgtggcaactgctaaagatattcaaacaattatgatttgtcgtttctttgctgggtttattggtgctgctccattggttgtggctcctgccgttatggccgatatgtttaataatcgttatagaggtacggcaattgccattttctccatgttattgtttggtggacctatgcttgcaccaattttgggagcattcactgtgaaaaatagtgctttgggttggagatggacttcatatttctgtgggattattggttccttggcattatttatgaatacattcttattacaagaaactcatcatccattgattttaacacgtagagctgaagaattaagaagaagaacaggtaattgggggatttatgctccacatgaagaattgaaattaagtatgaaagaaattgttgaaaataatattgctcgtccacttaaaatgcttttcaccgaaccaattttgtttttggtcagtctttataatgcttttatttatggtatgctttatttgtttttaactgctattccattgattttcttgggtgaatatcattttgttcaaggtgtagctgaattaccatatttggccatgttgattgggattttgattggtggtggtatgattatgttgtttgaaaaaagatacattaaagccatggaagataatggtggtaaaatcatccccgaaaaaagattagaacccatgatggttggtggattcacatttgttattggtattttctggcttggttggactggtaattacccacaacatgtccattggatagtccccgtcattggtgctgcatttgttggtaatgggttaatgttgattttcttaccatgtttcaattatattattgattgctacttgttatatgcagccactgccttggctggtaacacatttattagatctgcatttggggctgttttcccactttttgccagacaaatgtttaccaatttaacaattaaatgggcaagtacacttttagggtgtattggtattttacttttgccaatgccatttgttttctattattatggtaaatcacttcgtcataaatccaaatttgcctttgttttggaatag

SEQ ID NO: 6307 - DNA, 585 bp, Candida albicans
attgatagaacaatgaataacaataccaacagcaatcacaacgatattgctcctgaagcaacaatcactcaaaatactacaacttccgtttctaatgacgaattacaacatataactaataacaataatgtcaatgtacaaagctatgttggacctactgattcagttgaatccagtagtaacactgctgatgaagaaaatgaaattaatagttttaatgcacaaaatgtcaaagattatgaagctaatgttggtggtgaattacctcctgatgatgaattgagtagaatagaatcaaatactgaattatcgagaagagccaccagaagtattatgaatactgaaagtttattacgtactgcatctcaatcgagtaaaccattgccaccaatgggtggaggtaaagaatatcctccaatgcttggttcacgagatccttatgttgttgcctttgatggtcccgatgatcctgatcatcctcataattatccaacttggaaaaaaattttatattgtgcatctgttggtcttgctgccttatcggtatccatgggatcagcaatgttgtctcaatcaagtgctgat

SEQ ID NO: 6308 - DNA, 1701 bp, Candida albicans
ctatcaaccatgcctgcctcaggatccatatcaagcgaagaaccattgatgaccctaaaaccatatgaaggtatacctacaattgaaggcgatgagcaatacttgcaaaactactccacagcccaagcgggtgaaaatgaacttttacgaattgaatccaatgtccaagcatcaaaagccttgtcgagaataatatcagatagtgatcctgttttacaacgttcgttattgttaaacgaaccactacctctcatgggtggcggaagaccgtacccaccattattaggatcccgtgacccgtatgctgttacctttgatggtcccgatgacgctggattcccgcaaaatttccctttttggaagaagatggtgtacagtttggggccattatttaccgcattatccgtttcccttgggtcagcaatgttttcacaagccagtcccgaaatcatggcaatctatcacattggcgtaacaccggccgcgctaactactgcattgtttgtgtttggtttcgctagcggcccagtcatttatggacccttatcggaattgtttggacgaaaaatcattatggtgatttccagttttttatatgtgtgcttttcatttgctgttgccacagccaaagatattcagacaattatgatatgtcggtttttctctgggtttgttgggtcagcagcgtttgttgtttctccagctattttttcagatttatttctgaccgagcaaaggggtaccgctatttcgacatttgctggggtgctttttggtggtcccatgcttgccccgatatttggtggtttcacggttaaaaactctagtttgggctggagatggacagcttatttttgtggtatagttgcctgcttggggttggtgttgaacgtgtttttacttgacgaaacacaccacccaataatccttgtcaaacgtgctgaagagttgagaagaagaacaggaaactgggggatttatgcgccacacgaagaattgactttgagtttgaaagaaattgttgaaaacaacattgctcgaccacttaaaatgttgtttactgaatcgattttgtttttagtgagtatttacaatgggtttatctatgcaatgttgtactgtttattgacagccatgccgttgattttccaagaggggtacgggttcagaagaggggtggccgagttgccctatttagctatgcttctaggtgtttttatcgggattgcagcacttatcttatttgaacagagataccttaaagcaatggagaaaaacaatggtaaaccaattccagaagaaaggttgccgccagtttttattggtgggatattttttataatcggtattgtaatactcacagtagctggtgatttcccgaaaaaagttcactttatggtacccactgtgggtgctgggtttgttgggtttgcgttgatgttgattttcttgcccacgatgaactatgtgataaactgttatttgtttgttgctgcgtctgctttggccgccaacacatttttgagatcagctatggcagctgtgtttccgttgttttctcatcaaatgtgtgtcaacttgacaaacaaatatgctggcacaatcttggctggtcttggtgtgttgcttttgcctgtgccaattgcgttccgtgtgtatggtaaaaagattcgtgaaaacagtaagtacgcgtataagtaa

SEQ ID NO: 6309 - DNA, 909 bp, Candida albicans
aactataaagacagaacccacagtttgaaagatattgatttttcagtagccacaggtcaactaagctgtgttgtgggtaaagttggcagtgggaaaacatcattgttgtatgcattattgggacaattgataacaacacagggcaaaaatgcagaacttccgcctttgattgagataaggggcacagtggcatactgtgctcagcaaccgtggatcatgaatgcgtctgttaaagagaatattgtttttgggtataaatttgacaaagatttttatgaagaaaccatagaagcttgtcaattacttcctgatttggcaattttgccggatggcgacgagacacaagttggggaaaaaggtgtgtcgttatcgggaggacagaaagctcgattagccttggcgagagcagtttatgctagggcagatgtatatcttttggatgatatcttgtcagctgttgattcaaacgttggaagaaatattattgagaaagttttgagtaagggaggattgcttggctctaaaacaataatattgtgtaccaactccatctctgtattaaagtttgctgacaacatcactttgattgaggatggatgtataatagaaactacaacatatgccgaaacaaatgctgacagccatccaaaattatttgaattgatcaagaattttagcaaggatacttctccaataccatcagacctagctacagtgtcaccttcgcacgtgcatagttacaggaaagcaagtatagagagtttccactgggatccattgaaaaaattactacccaatttgcgtaccggtctgacagaagatgtaagccagaaggggaaagtcaagtgggaagtttacttggcatatatcagagcctgttctatttatgggggtgcgctttggtttatt

SEQ ID NO: 6310 - DNA, 2019 bp, Candida albicans
  unsure (93),(131): Identity of nucleotide sequences at the above locations are unknown.
gttgttatgtttgatgaatttgctgagaccaacatgtttagtaaagagagacccagagcctatgataactctatttattcgttcattgtgaangacgcaacatttgtttggtcagaagaaacacaacaganacagtataccgacgaagagagtgaagttcaagaggtaccagctagtaacgttgcattgaaacatatcaatttttctgccagaaagggtgagttggcatgtattgttggtaaagttggaagtgggaaatctactttgattaaggctatcttgggtgacgttccaatcaaaattctttcttattctgatgattcgacaaatccaacaccaagcgtggaaacttttggatcaattgcttattgtccacagaacccttggatattgaatggaactgtcaaggagaatattttgtttggtcacaagtatgatgcagaattctatcaaaaaactattgatgcttgtgaattgatttctgatttcaaaaatctccctgatggggaccagactgttgttggtgagaaaggtatttctctttccggtgggcaaaaggcacgtatttcattagcaagaagtgtgtacacaagagctgatatttatcttttggacgatatcctttcagcagtggacgctcatgttggtaaaaatatcatcaagaaagtgttaagcaacgaaggtctcatcggaaatcgttgtagaatattagcaacaaattccgtgccagtcttgcatgaagcaaacgatatttacttgattgctggtggtgcatttgttgaacatgggaaattcaaagaagttatgaaaagaaatggtgatttagccaaattgattaaagaatatggacgtaaaaaagacgaaccaacagaggaagaaacaaccgaggcatcaactgaacctaaagaagaagaccattctaatgggaaatcagatactgctgttcatgacgagcttgatacggatgaattggttgacgaaattgtcgattatgttggcgagcaaaatcgtggtgttgttgaacaagcaatattgcgtcgtgcaagtgttgtttcatacggtcataattacgaaaatgatgaagcagacaatggtcaaataagaaaaactagacatgaacaagaggagtcaagaaaaggtactgttccatgggatatttttaaacaatatattattgcctgtgattacaagtatttttcattctatgttgctgcaactttctcagtggttttaatttcagccggagaaaaatatttattgagttattggtcacagcttaatagtgaacagaatgacacagttgaaccagtatttttcttaggtacatatgctactcttggtgttgtttctggtttcttgacttatatgggtgcacttgtcatctggagctattgtattgtcaaaggttctacttacttccacaataaaatggcagagtctgttttgagatcaccaatgtcgtttttcgatactacaccaattggaagaattttgaacagatttactgaagacattggtaagattgatatgaatcttccatggactattatatcatttataacaactttacttaacgggtttgtcacctttggagtgatcttgtcatttttaccattaatgttagttgtaatcgtttcgttattatttgtttacaattatttccgtatcaggtttgttccaactactagagaattgaaaagattagaatccattgctaagtcaccagttttggcaacaattcaagagtcgatcaatggggtagaaactattaaagctttccaccaaagagaacgttttgtttacaagagcaagaaacttattgatgaaaagacattgattggtgttgtgcaacaaaattgtaatagatggttatcaatgagattacaaaccatttcatctagtatcatgtttttcactgcattgttagccgttgtgacgttgggaggtaaacaccctatacttcctagtattttgggttttgttatgacatcttcaccacgggtggagatccgacttgga

SEQ ID NO: 6311 - DNA, 207 bp, Candida albicans
aaacattatacaggcagagcattcagaagtcagttcaaagataaaacaataatcacaatcgctcataggttggaaacagttatggacagcgacaaaattgtcagtttggacaaaggagagttgattgagtttgacactccgcagaatttattgaacaaaaaggatggtgtattctatagtctatgtaaacaaggtgggtatatttag

SEQ ID NO: 6312 - DNA, 489 bp, Candida albicans
gttttaactctaattcttgtttggaaagtgttggaattggcacatttgaaagaacatgttgccaaaatggaaactgaccccaccgaagaagagaagaaggcaagtaaaaacccagacgaattgtcaaagaaggtgggacttgatgctcaaattgaagaaggagggtctaatttatcttctggtcaaaaacaattgttatgtttagcaagagcattgttgaatgaaactagtaaaatcttagtgctagatgaagccactgctgcagttgattttcaaaccgacaaaattattcaagaaacaattagaacggaatttaaggataaaactattttgacaattgctcatagaattgataccattatggatagtgacaagatcttagtgttagatagtggaaaagttgcagaattcgattcacctcaaaacttgttgaagaacaaagacagtattttctattctcttgccaaagaaggtggatacatagattag

SEQ ID NO: 6313 - DNA, 627 bp, Candida albicans
ttaattagtcacatacatagatacactactacaaaaatggctccagtcgttcaacaaccagctccaagtttcaagaaaaccgccgtcgttgatggtgtctttgaagaagtcactttagaacaatacaaaggtaaatgggtcttgttggcctttattccattggccttcacattcgtctgcccatcagaaattattgcttattccgaagctgtaaagaaatttgccgaaaaggatgctcaagttttgtttgcctctactgactccgaatacacctggttggcttggaccaatgtcgccagaaaagacggtggtattggcaaagtcgacttcccagtcttggctgacaccaaccactccttgtccagagactacggtgtcttaattgaagaagaaggtgttgccttgagaggtattttcttgattgatccaaagggtgtcttgagacaaatcaccatcaatgacttgccagtcggtagatctgttgaagaatccttgagattgttggaggctttccaattcactgaaaaatacggtgaagtttgtccagctaactggcacccaggtgatgaaaccatcaagccaagcccagaagcatccaaggaatacttcaacaaagtcaacaaataa

SEQ ID NO: 6314 - DNA, 252 bp, Candida albicans
  unsure (134): Identity of nucleotide sequences at the above locations are unknown.
caacgtataagaatagatatcttaataatgtctgaagtgtctaaaaaatatcattttgacgtaacaatgtcatgctcagggtgttcaggagccattgaaagagtattgaaaagattagatggagtatcatcatntgatgtttcattagataaacaaattgttgatgttataactactcagcattatgaaactatttataatactatagctaaaactgcgaagaaaataaatggtggtaaagaaatttcctaa

SEQ ID NO: 6315 - DNA, 1515 bp, Candida albicans
atgctatcaacaacacaatcagtcacagaacccactgaggtaacactgaaaaaagttgaagacattgaaaaagaaaatgacgaagaaactccctattcaatattcacttcctacgatagattagtattgatagtaattctttcattaattggattttggagtacgatatcaagtccaatttatttcccagcattacctacattaacatcatatttccacacaagttcatcaatcatgaatatatcagttgtggcatatttgattttccaaggcatcgctccgacaatctcatctaatttagcagacacatttggcagaagaccagtgatactagcgagtataatagtattctgtgcctcttgtgtcgccatttcacaaacaaatgtttattggctactagcggtattacgatgcattcaagctgcagggatagcagcagtcatttctataagttcaggtgtagcaggtgatgtgtgtactagagccaatcgtggaagtatggttggagcagttgctggtttacaattagttggcaatggaattggtggattggtgggtgcagctttgatcagttcattcaatagttggagatcaatatttatatttttaactattggaggtggtgtcacatttatattggcgatttttatattaccagaaacatcaaggaaattagttggaaatggatcagttgtacctaaaaacattttaaacaaatcaccatatatttaccttccacatttcaagaaaagaatgaataatgacataactacaatagtaccggcaactaggtttgatttattaggtcctttgaaaatttttttccaaaaaaatgtcttttgcacactattacctgtgggaatacattttgcagcatggacgatggttttgagttcattgtctactgagttagagtctaggtgtcattacagtgtcatgcatgtaggctcgatttatctccctcaagggattgcttgtattggtggttatttggtagtagggaaatctttggattggtattaccgatacagaaagacaatatctgacctagaagttgaatgtttaccattggacgagagaccacaatttaatatcgtggctactcgattaaccataagtgttgttcatgccttgttaatgatcattggattggtgatatttggttggtgcattcaatataaacgacatataatatccattataatttctactattttagtatccttttctgcatcagtctttatagctatttgcacaaccatgttggttgatttatatcctaataatggaagcggatctactagttgtcttaatttgatgagatgttggttagcagctttgggagccggggttttagatagtatgatcaatgcaatgaatgttggaggaacatacactgtcgttgctgggttttgcattttatttgatctagcattgatttacgttttacataatgccaaaaagaagtttagtaatagtgggccaaccaccacgaaatccccacccaaacaatag

SEQ ID NO: 6316 - DNA, 1194 bp, Candida albicans
actgaaaaaaaagcaccatatacgttgtgtgaaagcacagataaactactactaattatagttttatctttggttggattctggagtgctatttctagtccaatatatttcccagctttaccaacgctaacaaaatatttcaataccacaccttcagtgatgaatatatcggttgttgcttacttgattttccaaggtattgcaccaacaatttcatccaacttggccgatacatttggccgaagaccagtaatattagggagtattattgttttctgtgccgtgtgcattgctatatcacaaacaaatgtgtactggctattggcattattgcgttgttttcaagctgctggcattgctccagtatttgcaataagttctggtgttgctggtgatatctgcaccccagctaaccgtggcggtatggttggtgcagtttctggtttgcaattagctgggaacggaataggtgggttggttggtgcagcattgatttcagggttccatacttggagagctatatttatatttttggctatcggtggaggagtcacttttatttttgcctttttagttttagcagaaacatcacggagaatagtggggaatgggtccataaggcccaaaaatgtgttgaacaaagcagtgttgatttaccttccacattttaaaaacaagataacaaatgattactcaacattgcaaccaaagggaccatttgatattttgggaccttttaaaatatttttccaaaaggaggtgttctgtactttattgccactgggtatgcattttgccgcatggacagtatccttaacttccctttctactgaattagaatcagcaaaatataactattcggtaatgaaagttggtttagtgtatttgcctcaaggtatcgcctgcttcattggctctttaataactggtcgctgtttgaattggtactatcgctacagaaagaatttgtatgataaacaaatgaatgacgtgcctttgaatgatcgcccaccttttaatttggttgcatctagactaacattgactatcgtgcccttagccatgatggttattggtctttcagcatttggttggtgtctcgaatataaaaaacctattatatcaattatcatttccaccattttgatttccttttctgcttctgtcatgatgtctatttgtacaacaatgtga

SEQ ID NO: 6317 - DNA, 360 bp, Candida albicans
ccttatcaaccagatccaaatcttcaaaactattttaaccagcaccaatctccaaaactagtcaacattttttttttgtttttgaatgtcaagtactttcaccaaccctcagttatgaatgaccttgactttgttgtgtcgcccgttcaaacaaaagtggaaatcaatgatcagaataatgaggactttatacctggaacactcaatatctattccttggaagttgactctgaagatgaaaacgtgagtcattacgatgcttccagtcgaccaaaagtgaaaacaaaaggcaatataatcctcttcccacagccatcgaattcatgcaatgatccattaaattggggtcttcttcaccta

SEQ ID NO: 6318 - DNA, 798 bp, Candida albicans
  unsure (798): Identity of nucleotide sequences at the above locations are unknown.
ttccttattttgtggtgtttctattttttactaactaactatttcaagtttttatcaccagttgccgctggctatatcactgccaaccctcatcttggctggagatggtgcttttatgtccagataataatatatgcagtgttgttcatattcatgttttttgtattggaagatacaacttttacaagagattcgaaaaaggaagatgagtttgaagaacatatccttcagcaagtgcaatccatgaggtcgaaagataatgttgatgttattctcagttcaagtgcatccgtgaaaactgaagagaatgagtctgttgacgagtccactatacccaaaaaaacgtattgggaaagaatgaagttaattcacactgaatatggtgaccgtcgatcatggttgcttatatttgtgcggccagcatttttggcatactttcctgccatcatatggtcaagttgtgcttatggggcccaaatgatgtggttgagtttaatgggaaacactcaaacattattctatgctagtgagccctataatttcacagcagataaggttggtttgactaacctcgcaccttttgttggtgttgttttgggtatgttatatggtggtagatttgttgattggttttctttacaaaaagcaaaaagaaactttggtatcctggaccccgagcataaattatggactatgattgtgcctttactttttaatgccgctggtttgattgcatatggaataagggcatattacggtgctcactggggcatttcagttattattggccaagggtgn

SEQ ID NO: 6319 - DNA, 615 bp, Candida albicans
atgtttgataaggagattaacgaaattcctgagtatgagatggtcacaggtaccgttcaattagttgatgttacggggaccttggaagtggaaaagaacggtgacaaatccaatatcattttgcaaccaccaccttcgaaaaatattaacgatccattgcgctggagcaaacggaaaagaagaatccagtttttcttgttgtttatttggtctttccttcaatcatcaacatccaacttcactggaccgttgtacgatgcatttgttgaagctttggatgtaacttaccaggatatcagtaacactgctgcattgtgttttacaggattggggttgggagttatcattattcaaccatgcgcagcaaaatatggaaaacgtgtggtgtacttgacttgtaccttaattgctataataggatgtattgttggtggcacaggtaaaaatttggccctgttgtatattttcaatttcttaagtggactcggtgcgtctccagtggacagtattgccgaagtatctgccaatgatcttcattttcaacatgaaagaagtacagcactttcagtgatcatcatggcgttgtatttcggatctgtacgtaagactttttga

SEQ ID NO: 6320 - DNA, 1788 bp, Candida albicans
aaaaaatttccttttttttttttattttttgaaatggcttttgatactactgttcctcaagaatattatgatgaaaattttattcctggtactaccaatattttaactggtaaaaccaccattgatgaatcatcatcaataactactcaaaaatcattaaaacgagatcccaaaactggattagtgttaatgcctcaaccgacatcatcacctaatgatccattaaattggtctccatttcgtaaatttgctcaattgacattattatcatttataacggcattaacggcagcaacttccaatgatgctggtgctactcaagattcattgaataaaatatatggtatttcttatgattcaatgaatactggtgctggggtattatttatatttattggatggtcatgtatgtttttcgcaccagcttcttcattatatggacgaagaataacttatattatttgtttattggcaggaactttaggttgtgtatggtttgctctttctaaaagaactgccgatactatttggtcacaagcatttgtggggatgagtgaagcttgtgctgaagctcaagtacaacaatcattaactgatttatttttcgctcatcaattgggtacagtattaacaatttatatttctgctacttcgataggtacttttttgggtcctttgattgctcaatatattgctcaagctcatactttccgtagagtcggttggtggggtgccattatatgtggtgccactttgatagtaatcattttcggttgtgaagaaacagtatttgatcgtcaattatataccaaagtattagaatctgaaaatgttactcaaattccagacccatcagaagaaaagaaacaagataacccacttacaaataatatcattcctcacgagaagaaaaattcaatggaacaagaattatctcatgaatatatcactgcaaacaataatgaacatgacgttgttccaattgatcctgaaactttaaatgaaaagaaaaaatcttattggcaaagaatagcaatcattacaccagcaccttatttacaaggtttaggatttaaacaatatttagaacgtttcattatttatttcaaaattttcacattaccagcagtttggttttccggattattatgggggttacaagatacttatatgacattttttttaactactcaagacacgtatttttataatccaccatggaataaatcaaatgctggtgtagcaattatgaatgtagctacattaattggtgctgttattggatgcattgtttctgggttattttctgattatcatgttatttggttagctaaacggaataatgggataatggaagctgaatatcgattatatttattagttatcactttaatcatttcacccgtagggttaattatgtttggtgttggtgccgctagagaatggccatggcaagtgatttatgttggattaggtttcattgggtttggttggggatcaattggtgatacttcaatgtcttatttaatggatgcttatcctgatattgtcattcaaggaatggtgggagtaagtattattaataatactttggcttgtattttcacttttgcttgttcttattggttagatggatcaggaacacaaaacacatatattgccttgtcaattattgattttgctaccatagcattggttttcccctttttatattatggtaaaacatttagaaggaaaactaaaagactttatgtttcaatggttgaattgactcaagggatgggataa

SEQ ID NO: 6321 - DNA, 1353 bp, Candida albicans
tgcggtaccttccaggcccctggcgtgatgatccgaaaaataacatactttatatgtatctttcttggtttattaggcgctgtttggtttgccttggttaaaagcacttccgactcaatttggtcgcaattgtttgttggtattagtgagagttgtgctgaagctcaagtacaattaagtttatcagaactttattttgcccataaccttggttctgtgcttacgtcctatattgttgcaacttccgtaggtacttacttaggacctttaattgcagcctttattgttcaaaacattggttttagatgggttggttggattgcagcaattattagtggtgcattattgttcgtaattgttttttgtttagatgaaacctattttgatcgagcaaagtttaccaagccattcatcactggtatagctccttttgactcgagttacagcaatggtaaactggactccaaaaactcaattcctgaaaagcaaaacagcgttaacattgaactgaatgttgaaagcaaagaagttgaacaaagtgacgacgacatagcaaatgaaggagagaatgatcctccaatttcctattggaagagaactgcaatgattaccccagccacaaatctcaaaagtactggttttaaacagtatataaatcaattaaagttattgttgaaagtatttctttatccaccagttatttattcgggtttctgctggggcattcaaaatgcattattaacattttatcttacagtggaagatgatcagtactatgatccaccttacagttatggtaatattgctgtggggttgatgaatataccatgtctaattggggccattattggttgtttttttgcaggtactctttcagattatttcacgatatatttggctaaaaggaataaaggaattcaggaagctgaatatcgattatggtgtttattgccaccggctattatcgcccccgtggggctcatattgtttgcagttggtacaaatcaaatgtggagctgggttcctacttatatagggcttgggtttattggttttgggtatggttgtgctggtgatgtgtcaatgtcgtatcttatggacagttatccaaacgctgtcattgaaactatgacagtggttgctgtaatcaacaattgcattggctgcgtgtttacgttcgcatgcagtcctttcataaacgctttaggaaatactaaaacatttataattttggccgttatagagtttgttataatggcatcagcatgctttttcatatattacggcaagagaattagaatttggacaaaagactggtacttggaattctgtgaagcaagagatggtctttga

SEQ ID NO: 6322 - DNA, 1329 bp, Candida albicans
caacacataaagatggtaaatcaagttgttgaaaataatgattatgaaatggtaccaggtacggtacatttgattgatattaatgggaatttggatgtacaaaaaaatggtgatatcattttacagccacaaccaactaataatccaaatgaccccttgacttggtctaaactgaaacgactcattcaattttctcttgtctggatctggggtttatttgttgccgttgctatcaattgggttggaccagttttcggtgtttgggaaaaagatttgaaaaccactataggagatttatctaatgcagttgccgttgggtttctatttttgggtgttggagtattacttgtacaaccaacaactttaaaattaggtaaaaggtttatttatattgctgggagtattttcacaataatttccttagcagttggatctcaagcaacagaagtggggtctatatttgcattcaaggcacttgttggtcttggtgctagtccatgtgatagtgtggtagagcttagtgccactgaccttttctttcaacatgaaagatcaacagctatttcttcattgattcttgcattgtatgcgggttcatttgttggaccaattattgcagggtacatcactgattcaattggttggaaatggtgcttttatgtacaaatcattatatatctgacatttttgattatccaaattttctttcaacaggaaacaacttttagaagatccttaagtgatgagacattagaggaggaaattttgcagcaaatcaagtcaaccgaaatcaacaatgaaaaacaaattatttctgaaccgcttgcaaaggaaatagtagatgaagagctgggatcttcaagtattgagtcatacaaaaagaaaacttatttccaaaaaatgaacattatacataccgatcaaaatgattccagaagttggttgtgtattttttatcgtccattttttgtactttattatcctgcatttatctttggtgggattgtgtatggaagtcaaatgatgtggttactgttgacatcaaccactcaaaccttgatatatggtgctgaaccatacaatttctcagctaacgggattggtttgactaacttgggatgtttggttgggtcaattttgggtacattttatggtgggaaatttgttgattggctttctattaaattggctaaaaaaaacaacggtatcttggaacctgagtatcgattatgggccatgattattccaacgatactaaatgcaggtggatattggcgtactatcttctttgtgccaacaaagcatcatgggctttatcagtcgttttag

SEQ ID NO: 6323 - DNA, 438 bp, Candida albicans
gtatcgattatgggccatgattattccaacgatactaaatgcaggtggatattggcgtactatcttctttgtgccaacaaagcatcatgggctttatcagtcgttttaggacaaggagcattgggttttgcaatgagtagctctggtagtatatgcattacttatgccattgattcttatcctaaagtcgccagtgaaggaattgttttaatgttgttcattagaaatatgatggggatggggttctcatatgccattctgccatggattaacagaaatggccttgtggttgttacgtggttgatgttcatgttgtcgattattataaatggaagttttatagtaatgttgctgtttggaaagaggttcaggcgttggactgccgctcattatgaaaaagtttctgagcctagatatggagaattctttaaacgttag

SEQ ID NO: 6324 - DNA, 795 bp, Candida albicans
ttggtggatggtagcattaagaccatttgtattgtactgctatccttcagtattatttgggtccttgacatatgcattagcagtggtatggttgattgtcatttccgaaaccattggagaaattttagacatccaccttatggttataaccagcagacggttgggttattttatatttcgccatttattggtgggattttgggttctttgacctgtggtttattatctgatcgaattgttcgataccttgtttctaaaaataagggggtttatgaacctgaattcagattagttatgattattccatcgactctctttattgctattggacttatgggatatggatggtcatcacaagtacataatccatgggtagcgcctgtgattttctttggcgctatgtcttttggcagttctatggcgtcaaccacagcaattacttttgctgttgactcttacaaagttttcgctgccgaatctttggtgtcatttaattttttgaaaaatttattagggttttgcttttcattatttaataataaatatgctgatcgtgaagggtaccgcgcagcttatgttacctatggggggattcaaatatttgtcagtctttttgctatcccactttacatatatggcaaaaaacttcgaagatggacagatgaaaaagaatttatgagaagcttgtatcacgaagataatgttcctccaagtgtggctccttccaaaactagattaagtgaggaattccttcatagtgatactacgactaatgagaatacgattactaaatga

SEQ ID NO: 6325 - DNA, 1197 bp, Candida albicans
ccccggaagttattgacggaagttaatgagtcaatgaaaaaatcagccactggtattatattgagcccgcaaccgcatgattctcccaatgatccattaaattggcccgtctggaaacgtgacatttgtttattgattattgggttccaaagttttattggtggtgggatgtcgccccttttggctgccggtatgaatactttggttactgagtttgataggccgttgacaacaatttcttatctagttggtggattcatgttgtcattaggatgtgggtcagttatagctagtcccactgcggtattatttggtaaaagattagtttatattggaggtatttttatatttatgatgggtgccatttggggtggtgctgccaaagattttggcaatcttatgggtgcaagagtcatcacagggtttggcgcatccccaactgaatgtttgccaagttctaccattgccgaaatttattttgctcatgaaagagcatatagagttgggctttatacaatgttaatgttgggtgggaagaacatcatcccattgttatcaggattggtatttcagagtttggatagacactggttgttttggattttggcgatgtttttagggtttaatttgattgccacatttttatttgtcccagatacattttgggatagaaacccaacaccttcaaaaagatcattagaggaaacaaaaatggctcaaagtgttgccacctatcacccaccatcacaaagaccaaatgcttttgcattacatcgtccttcacaaatgaacattacagacgttcacagtttgtcgtcatctatcaacgaatcggctgagaaacaacaagaagttggtcaaactccagtggggattaccgaacctaatgatatatcacaacaacaacaacaacaagcaactcctcaaacgaagaactcatatttaaaagaaattagactttatcagggtagattcactaaggatagttggtggatggtagcattaagaccatttgtattgtactgctatccttcagtattatttgggtccttgacatatgcattagcagtggtatggttgattgtcatttccgaaaccattggagaaattttagacatccaccttatggttataaccagcagacggttgggttattttatatttcgccatttattggtgggattttgggttctttga

SEQ ID NO: 6326 - DNA, 249 bp, Candida albicans
caacacataaagatggtaaatcaagttgttgaaaataatgattatgaaatggtaccaggtacggtacatttgattgatattaatgggaatttggatgtacaaaaaaatggtgatatcattttacagccacaaccaactaataatccaaatgaccccttgacttggtctaaactgaaacgactcattcaattttctcttgtctggatctggggctgtcttcaccatggggacggacatccgcataatttt

SEQ ID NO: 6327 - DNA, 507 bp, Candida albicans
tcgtggctcgctctatatcttaggcccacgagcgctcgtccttccagccccgtggtgaagactcaccatgtttcaaaatttattaggcctaatgaaaaaattttcagtcgttcacattcaaattatttagctcaattacaagttgaatcattcaattccaataataaaatcaccgaaatgttttctaaaattactttgattgggacaatgttagttccattaaatttagtcacgggactttttggtatgaatgtaagagtccctggtgaaggtgggaaaaatttaggttggtttttcggaattgttggagtattaatatttataattattggatcatttatatttgctcaatggtggttgaaaaaattgaataattcaattgaaggacaaaataatggtaatcgaccaatttttaatcattcatcaagaagatcaattagaagtttaggtttaaaaaaacatggtggtaataaatcaattattagtttccccaataaatatgaataa

SEQ ID NO: 6328 - DNA, 2358 bp, Candida albicans
ataaatataattaagagtatatctccccttttgttttttttcttcccagccatgtccgatagtgaaagttattatcaaaattcaactactaatcaacctattcttagatctgatgaagtattggatgatcatagaaatcaaatcactaatgattgtgccattagtgatagtgaagatgagttggaattaaaaccagaattagaatcagaagttgcaaaaagcgaaaaacaacaacaacaacaacaacaacatcatcaagagattacatcagataatgctaaaccattgactcgtaaatctggttcttcaattaagaaaaaatctaatcttaccgataaagatagaattaccaaccctatgagtttatctggtggtgatgatactattaacagcggtcacaaaaatcgtaattataacatgagttcattacgtaaagatttttatttaaaagataatactgacgacaattctactaataatcatactcatcttgcaattccaattccaattccaattccaaccccaattattactaatgctaataaatcaagaagaaaatctcaattggaaaatttacctccattaattaaaaagaaaactattggtcgtaataattctaataattttgaaaatgatttagttagtcccatgacaaaaatgaaaactaatgatagtgaagatattactaatactactagcaccactgctaatcatatgaaacttggtattggtgctacaacccttggtgttggaactggtactaccgccactgccactgccactgctactgctggtggtggtggtagaagaccatctcgttcatctattgatagtgaagctgattctcatgcatcaagatcatctcaagaaactgaagaagatgcttgttttcctatggttggtgatcatattagagttaatggaattgattttgatgaaattgatgaatttattagagaagaaagagaagaagcttatttacaaaaacaaatgattgctaaaaatattctgcgtattgatgaatttcaaaatctttccaaaactaatactactagtggtgcatctcgtcatccatatcatcatcacagtaataataataaaaaaaataatggtggtgatggtagtagtggttctagtatggcagcattaaaatatactccaaaaaatattttaaagaaaacattatcaagatttgaatttactcatgaaaattcttcatcttcagaagaaatttatgaattgaagactaaacaacaaccaccttacaaatatgatgatcaattatcattaacttcatctacatcttctacttctggatctggatctggatctgggcaggtgaaatttggtggagcaagaatttctgatgggattaatggaggttcattacctgatagattttcacttttccattctgaatcagaagaaactattcatgcccccgatattccatcattagtatcaccaggtcaatctgttcgagatttatttagaaatggtgaagaaacttggtggttagattgtacttgtcctactgattcggaaatgaaaatgttggccaaagcatttggtattcatcctttaactgccgaagatattcgaatgcaagaaactcgtgaaaaagttgaattatttaaaagttattattttgtttgtttccatacttttgaagctgataaagaatctgaagattatttagaaccgataaatgtttatattgttgttttccatgatggtatattaacgttccatttttcaccaatttctcatccagcaaatgttagaagaagagttcgtcaattgagagattatgtcgatgttagtgctgattggttatgttatgccttaatcgatgaaattaccgatggttttgcccccgtgattcatggaattgaatatgaagctgatgccattgaagatgccgttttcactgctagagatactgattttagtagtatgttacaaagaattggtgaatcaagaagaaaagtcatgactttaatgagattattatcaggtaaagctgatgtcattaaaatgtttgctaaaagatgtcaagaagaagctaattcttcttctggttattatcaacgtcaatataacttacaacaacaacgacaacaacaggccccaccaccaccaccacctaaccctattattacttcaccaattaattcaactttgaatcttaatagtttaggaacttcaactggtggaggagtacgagtacgacgaattaattttggtccccatccaactggaaataatactaatactaatactaacactacgggttcaccttcaccacctcaactacaaacacatggtatcactaacaaatctttccccatcccctga

SEQ ID NO: 6329 - DNA, 927 bp, Candida albicans
atattgctatataacaacagatcaagaggtaaaagtgctttcagtatgggtttttttgggacttcaaaagaggaagaatctcaacttagacaagcggttttaacaacatccgaaacaagacagtcatattcgtccaacacagagtcatctgtttacgaaactgctgatgaaatggatagtcaagtgtcaccaaacatcgacattactgaccacgaaaaagacaatcaaggtataaatactgatgaaaccaacaataatcatcataccgctgctaccaatgtcagtccccaaggagatgacgatagtaccgttcagggacacgaatatagtgcgaatccaataagtgattcaaacgacgattcggatagctccgttcctaagaatttttctggcattgatggcgacaacgaagaagaagaagaggaagaaaacagattaaaccgagaatatacaattgagagaattaaatctcataaatcgcttgaggctgctgctgaagagcagattaaagaagaagaatcatttattcatcctcattcttcaagtagcaccacgtttgacaaagaaaagatttataccgtcgacgaattactgtatgatggaccagatgataaagacaatccacataattggccaaaatggaaaaaatggatgattacttacactgcagctatattatgtcttgtgtgttctttgggttcttcgatgtacactggtagtgtcccggaaataatgaagcgatttggtgcctcacaagaattgtgtcttgctgggcttacattttatttacttggtttagcatttggtccagctttatcgggccccttatccgaagtgtttggtcgtaaaccattgtacatgttctccttaccaatagccatgttgtttaccactcttcaccatgtggatggctgcccgcgattatta

SEQ ID NO: 6330 - DNA, 1083 bp, Candida albicans
ggcccaaaaagatggtgcggtttgcgggggaaaattaaagggtggccaaggggatgtggctggggggtaatagagttctatcggggccagtgtgcccatttagtatcattcttccctgaaacttacaaacctatcattttagcaagaaaggcgcaaaaaagaggcatgaaagtggaagtaccaaaattgaatattgcttttgttaaaaaagttatcaaattcaatttgtttatgcctttgaagttgctcattgaagagccaattgtgctagtgttgtcggtgtacatctcttttgtgtttgcagtattgtttggattctttgaggctttcccagtcatttttagaggcgttcatcatatggaccttggtatttctgggttgcctttcatttcagttggaattggtttattccttggagtagtgacgtacgtcattttagataagactatcttcttcccaaagaatccagatggatctcgtggtaaacgtgatgcagatggtaactttatctggggtgtgccagagaaaaagttgttgaacggtaaaattggagcaccgtttttgccaattgcattgttttggttgggatggagtggaagaagcgactcgattcattggatggcaccaacagctagtggcgtgttttttggttatggattaatcttggtgtttttttcagtcgtgctgtacttttccatgtcattccctccaatttacgttgcttctgctattgcggccaataatttattaagatacacattggcatctgtttttcctcttttcacagtacaatgttttgagaatttgggtataggctgggcaggatctctttttgcattcattgctttggccatggttcccgttccatatgtgtttggatattttggtccgcatcttagagcaagaagtaagtttggttatgctgcttatttcaagaaattggaagaacaaaaggaattgcaagctgctgctgatgccaaaaagaaaaacacaaatagaacacaagaacaatctgttaatagttccgctgtcgaacttgaaatgtcatcagaatccgagaaagctgttgctgaaaaagtgtga

SEQ ID NO: 6331 - DNA, 1191 bp, Candida albicans
atcaccggcggtgcaagaatttgtcgtgcttggcaaggtattggatttgccctcttgataccgtgtggaatgggtatcttgggaaacatatatcctaatggtgaacggaaaaatcttgtgtttggttgtgtgggtgctaatgggcctgcaggagcattctttggggcattcatagcggccttgattgcacaattgtggtggtggccatggatattttggctattaagtataggttgtgtcgtgttgacgataatttccatgatctacatcccaccaataactcatcacaaattggaaagctatagtgagttctttaaaagaatcgaccctctagggacattaactgggataataggattgattttatttaattttgtatggactcaaggtcccgtggtaggatggaatacggcttatataattgctttattgattattgctgtattactgattgttgcatttttcattattgaactatatattgccaaatatccattagtgccgaaatcagttttcaatcttaaaatcggaatggtcttggcatgtatcagttgtggttgggggtcatttggaatttggcaatattattactggaatattattttgaatctacgaaaatatactcccattgctggttctttgacttatgttccatttttggtcatggggataattgcagctattgcctcatcaataattatttctcatacaaaaccatcgtacataatttccttttcgacaatttgctttatggtgggatgtctcatgttatcagtgacaccaatacaacaatcctatttccgattaacattgggacaaatgttcatattgtgttgggcgatggacatgtcgttccccgctgcttccattatcttatctgactatttgccaaaccatcatcaaggtatggctggttcattggtgtctacggtgataaattactcggtcagtttgtttttgggtatgtctagttgtgtggagaccgaaattaaactcagtacgcacaatgtcttgcttagttatagaagtggattatactttggaataggtgttgctagtttgggtatcttctgttccttaatttctatatttgtccaaagaaatgacggcaaaggtacgaatgctttattagtagatctggatgaagagattattagggaatcaactgaagatgtcatggagaaaaagtga

SEQ ID NO: 6332 - DNA, 426 bp, Candida albicans
cattcgtctattttaaattttttttttctagttttatcaaagaactcattgattgtacctcatccttacttgtttgaattctcacaaaccatagcatatacacatacagcatcacttactatggctgtctcattagatccacgacctacaatattcacatccagtcatcatgagatcatagtagtcacattgatttgtcttgcccaatttttcactcaagcgggaatcacattatcattgtcgaccatgaacataattctaaaatccttcgataccatcgattcagcaaaacaagtttggtttatgggatcatatgcattaactgtggggacattcattctcattagtgggaaattaggtgacttattgggattaaaattaatttttgttattggatggagttttcaccacggggctgcaaggaac

SEQ ID NO: 6333 - DNA, 1650 bp, Candida albicans
ttcgacaaaacttttttttctttctttaagactacaaaacaaacttcatttaattgcattcattcgatcttcaataatcatttcatcatgtcagattgtacttcgtccaactcagtgtcagtggaagagtttaacccagacccagtgaatgagcttgagaaaaaagagtcaaatgtcaccgtcacgaccgtgtctcagctacctgaaccaaactatgagaatatatctgtcattagggagattttattcatgttttttatgtgtatgtcacaattattaactcaggcagccgtgtctcaaacaatgaacacgcaattaaagattgctgacacgtacagtattcaagacgacccaggagaaatgtcttggtttgctgccagtttttctatgacagcaggtacctttattttagtttcagggagactaggcgacatgtatggatacaaactcttgtacattattggatatttgtggtttggagtgttttcgttgttgtgtggatttgctggattaacaaagtcaaatgtttttttcacaaccatgagaggtttacaagggataggtccagcattaatgatgcccaatagtcaagctttaattgcatctttttacccagaatcattcaagaaaaatgtctgtttagctttgtttggagcaatagctcccagcgggtttgtggtaggagctttgtttagtggattgttggctgaccttgcaaaatggcaatggacattttggttatgtggaattgtgagtattggcttagcagcattggcgttttttattatcccaaaaaagattggtctcaagtctagtgggaaattcgacttttggggctctcttttcggagtttctggcttagtcttgattaattttgctttcaatcaaggtcccaacattggatggcatgtaccttatgtttatgtgttgttaattgtcgggtttctttgtattgtggcattccattttgttgaagaaagaatacaatatccattggtgcccaaagaggccttacagggagacactggatttattttaggctgtattgctgcaggttggtcatgctttggtgtttggttattctatacacttagatggtcacttgtggttgacaatgacaatgcagtgatgtctggtgtaaagatgattccatgtggaccaatgggagttgttgctgcaattggtggtgctatattgttaatgaaagtaccatcagcagtagtaatgtttcttgctatgatggcatttttcattggcatagtaataatgggaactcgtccagttgggcaaatatactgggcgcaaaaatttgtcagtttgttaattcagcctattggaatggatatgtcattcccagcagcctgtattttattaagttcctcattgccaagacatcaacaagggatagctgggtcattggtctcaacatttgtcaactactctatctctatcgggttgggatttgctggtactgttgaatactacactacaaagaataaagagccaaatttgagtaccagtatatttggtatgagaaatgcttttacaatggggaatggtctggctggtgtgggtgttgtgctttcttccatatttatgttgctccaaatcatcaacagaaaaaagctgaacccgtcacaagatgtataa

SEQ ID NO: 6334 - DNA, 1554 bp, Candida albicans
  unsure (745),(947): Identity of nucleotide sequences at the above locations are unknown.
aacagtcaactcagtttactatactcaaaagaatatctgattatcccattccattataaatataagtttaatcgatctttctttcttgttcttcttgtttttgcaataatgtcgtcttcgagccacaatgataacaaaattccacccgaaaaaactactacaccaccattgctgctgctgaatgaagacatatataatccagcagattcctcaaatgtcttatcttcaaatcagacattggtaagcaccaacaacaacaacgacaacaaccaaaacaataaccaaaacaataaccaaaataacgatggtaaagatactatggatcacttatcttatctctcaactattgattcaaaacgacgtgaacaatcatatttaaaatcattttatcaaagatttatcattgaagatgttgtcaaaaatttcactccagcatattttgttagtgttatgggaaccggaatatcatccagtctactatataatttcccctttccagcatattggttacaaatatgtggttatgtaatgtttggtttgacgtgtactttctttattggcaatatcattttactcattatgtcatgtgcatattaccccaatagatttagagattatcatgttgatccatctcgagcagttttcatgggtgcattttccatggggtacataacgatagtgaatttcattgccctcataaccaaaggtgaacatatatattttgtgtggacactttggtggctancagtgttttcagccatgtacacttccttcttaatcgtgtacttgtcattcatgtcaaagctaaatgaatcggatgtggaagccaaactaaatgctacccttttgttaccaatagttgccattacagttgtttcttcatcagggcactcgatcgaattggatttgcctcatgtacatcaaactgttctcaccatgattgttanctttatgttgtggagcttgtccatatcaatggcatttatggtaatgacgttatatatggggagacttataattcataaaattccaccaacaaatttaatcatgacaagtttccttcctgtgggtttcttgggtcaatcatcttatagcatttatcttttcggaaacaatttaaacaagtttatccccgaagaattactttacggcaaaatttcattgtgtctttcaggatttgtttcggtgtttttattatcatttggatatttcatgtgttttgttgccgttacttcagtcttatctaaaataagaccatttgccaaaaatccaaatcctctgcatacaaaccggttcggtcttttgaaactcgaaaaaagcttttggtcaatgactttccctatgggtacaatgtctttgtcaaacacggaaattggacatggtggtgttggaaactatcccttattgacatttaaagtgatggggagtatattcgctgctgcgtgtattttcattactgtggggtgttctattggtgtcgtggtgtattcattcaaaaaattgagagaagatatgacaaacaaaaataagtatcgtaatgaaagcatggtctaa

SEQ ID NO: 6335 - DNA, 948 bp, Candida albicans
attcttcggatacacaacattccgagtaaaagtaccgaacctcaattgactgtaacaagaacagaaaccaaaaaatcccttcacgacttgggattaacatcatctatacctcatccagaattaaatggtccaattattgaaaatcctatattccctgaagaatatactttggaaaccactaccgggttggttccagtggtgacgttacaatccataggaagagtgaaaactattcaagaagaagagaaactagcaggcttagattcagaaatagaatttgtcacttttaaagtaggtgatccagaaaatccacacaattggccaatgtggttgaaatggtggtacacctttataatttccatgtttgtcatttctgctgcttatggttcatcttgtttatctggaggactttccactgttaataacaaataccacgtgctgactgaagtttctactttaacagtttccttaatggttattgggttctgtgttggtcctttgctttgggccccaatgtcagaagagtacggaagaagacccacttactttatatcattcggtttgtacgtcattttcaacatcccctgtgccttgtctccaaatattggaggattattggtttgccgtttcttgtgtggtgtttttgcatcatctgctctttcaattgctggtgcaagtttggtagatatgcataacgataccagaggtcttgccttatcatttttcagtttttgtccttattctggtcctgtcatttcattgatcgtcaatggatttattgcaactgacaccgaaagaatggatttgattatttgggtcaacatggcctttgctggtgtaatgtggattatggtgagtttaatgccagaaacctatgctccagttatcttgaaaagaagagccaaaaaaattaagaaaggaaacaggaaacgacaagataatgactga

SEQ ID NO: 6336 - DNA, 1788 bp, Candida albicans
agagatttcccagtagttgttatttgctctcaccatccaaacatgtcacacgctacagactccacattagataacgcaagtgttgattcagaaaaagttagagatttcggtgacgacttacaaaaccacccagtccaaccaacaagaagcatcctcagcaagatccgctcaagagatgacgacgctagaagcttggtgtccaacaacaaaggggtagagagaatcatctcagacttacaagaaggcgcaggtcaattaagaccattagaacagccatacgatataaaaaagatcgaaacccatccagacccccacactgactacaatgaagccgacccttggaagtacccaatcgacctggaatctggtttacgtttggttgaatgggtcgatggcgacaaacacaacccaaaaaacatctccaaagctaaaaaatggttatacaccttggtcttgggtgcagtttgttttgttgtggccttggggtcagcaatcgttactggggatatggaacgtccagcagagtactttggtgtttcggaagaagtgataatcttggcttcagtaacagtatttgtcattggttttggtgttgggccgttggtgtttgcccccatgtcagaagaagttggtagaaagcctatttatgtggtcaccttatttattgcagtggtatttatcgttccttgtggcgccgctaaaaacatcgccacattaattgtttgtcgtttgatcgatggtattgcatttagtgcaccaatgacattgattggtgggtcgttagccgatatctgggaaggtcctgaaagaggtacggccatggccattttttctgctgctccgtttttagggccagtatgtggaccaatttttggtggtttgttatgtgaccacgctccaacttggagatggatatactggacattcttaattgttgctggtgtattttatgctatatttattgccatagtcccagaaacccaccacggaatattgttgaagaaacgtgccaaaaagttgagaaaagagacaggagactcccgctacagatcattcaacgaattgcagatcagatcatttggagaagtcgccaaaacctcccttttacgtccctttgtcttgctcagcgagctcatcgtcttcctcatgacaatatacatggccatctgctacggtttgctttacatgttcttctttgcctacccagtggtctaccaacaaggtaaaggatggtcagcctccttgactggtgtcatgtttattcccattggtgttggtgtgattatcgctactattgccgctcctttctttaacaaagactacaacagacgtgcccaggtctacagagatagaggagagttgccaccaccagaactcagattaatccccatgatgattgcatgctggtttgttcctgttggtctttttgcatttgcctggtcttcatacacttgggtatcctgggccggtccatgcttttcaggattggctgcaggttttggcttctgctgtttgtacaacccggccaacaactatatcgtcgactcctaccaacactacgctgcttctgcattagctgccaaaacatttgtcagatccatttggggtgcgtgtgtgcccctcttcactatccaaatgtaccacagattaggcgaccagtgggccacatcccttatggccttcatctccttagcatgctgtgccatcccatatttattcttctttttcggggcaagagtcagaacattctgtagatacgcctataccccggaaactaataccaaatag

SEQ ID NO: 6337 - DNA, 1173 bp, Candida albicans
ctatcaagcatgtcagataacactactttagacaatatcagtgtcaactccgaaaaagtcgtcgactacaccattcaccatgacgaccgcaaagaactagaaagattagtctcccacaacaagggggtggaaaagatcgtctccgagttagctgaaggtgctggtcagttagggccattggaacagccatacgatattcacaaagtcgagactcacccagatccacacactgactacaacgacgccgacccttggaagtaccccattgacaaagaaacaaaattgcgtttagtggactggaccgaaggagacaaacacaaccccaaaaactttggtaagggattcaaatggttgtgcacggtcttgttagggatgatttgttttgttgtggctttaggttcagctatcgttactggggatttagaaagaccagctgcagatttcggcgtatcagaggaagttatcattttggcttcagttactatgtttgttattggttttggtgtagggccattggtgtttgccccaatgtatgaagaggtgggcagaaaacctatttatgtggtcaccttatttgttgcggtggtgttcattgtcccttgtggtgccgcccaaaacatcgctaccttgcttatatgtcgtttgattgacggtacagcctttagtgcaccaatgacattgattggtgggtcgttggcagatatctgggaagggccagaaagaggtacagccatggcagtgttctccgctgctccgttcttgggacctgtgtgcggtccaattttcggtgggttgttgtgtgactatgccccaacatggagatgggtatactggacgtttttgatcgttgcggggtttttctatgttgtgtttattgtcgtggtccccgaaacccaccacggaatattgttgaaaaagagagccaaaaagttaagaaaggatactggcgactctcgctacagatcattcaacgaattgcaaatcataacttttgcccaagtcgccaaaacctccctcttgcgtccatttgttttgctcagcgagcttattgtctttttggtcaccatgtacatgtcagtgttgtacggtttgctttacatgttctttttcgcttatcctatcgtctaccaaaaaggtaaagggtggtcaacctcaaaaaccggtgtcatgtct

SEQ ID NO: 6338 - DNA, 582 bp, Candida albicans
gaattgggtaaattatattataatggatttgaagatattgtcttgattgataaaaaatatggattagaattatttgctcaagcagcagcattaggtcatttacaatcagccgccattttgggtcatcattatgaaattggagaaattgttcctcaagattctaatttatcaattcattattatactcaagcagcattaggaggtgatccaaattcaatgttggcaatgtgtgcttggtatttagttggtagtgaaccatatttacctaaagatgataatgaagcatttgaatgggctaaacgtgctgccaattgtaatttaccaaaagctcaatttgctttagcaaatttttatgaaaaagggattggatgtattaaaaatattaatgaagctcaatcatggtataaaaaagctgctgaaaatggtgatgaaaaatctttgaaacgattaactgataaagaattggttaaaaccattcaaaaacaatggaaaaagaaacctccagtaattcataatgaagatggaacttctacaactaattcaggatctcttgctcaagaaaaagattgtgttatcatgtaa

SEQ ID NO: 6339 - DNA, 555 bp, Candida albicans
acaaattcattatctatgacaagcaataatcgtaggtcagtttatatagtaagcagattcctggtttgcttttcatttacttacaaccaaaagtggttgcaaaccaaacaaaacaaaaccaaacaaacaaacaaaaaaagagaactgtcaactgttaatcccacttctccatcaactactcttgattccaaccacatgatttatactgctgaacagattagacataagaagaaattgaagaaaggaatcaatttcaacttgttagttgtaggagtaaacgacttgggaaagaaaacatttatcaatacattaattaatcaaccatattatcaaatcaaccaaccaattccaaatacatcacattcaagcatagcaggcacaagcaatagtgaattttctgaaaactcttttaataataatgaattttcaattgaaaccaattcatttggtatgtgtttgtttattttttttttgtcattttgtttatcaaacaaaaagaatgaatttattaacagttcctccttcttgtccaatttggtttggtcaggttggtga

SEQ ID NO: 6340 - DNA, 1122 bp, Candida albicans
ttgattcaaactaattcaaacacaagtgttcttataagccaaaacatcatgtccatcgaagaacctagtacacagcacattgctcaaccacaaaaatatgttggtttcgataccattactacccaaattgaaaatagattgttgaaacgaggatttcaattcaacattatggttgttggtagatcaggtttgggtaaaagtactttggtcaatactttgttttcatctaagttaactacatcccaaggaagaaaactgccaagtgaacctattgaaaaaacaactgaaatcaaagttgcttctcattcattgttggaaaataatgtaagattgaatattaatgttattgacacaccagggtttggcgaccaaataaataacgaaaaatgctgggaaccattggtcaagtatgtaaaagaacaacattctcaatatttgagaaaggaattgactgctcaaagagacaagtttttggcagacaccagagttcattgtatattgtactttattccaccaaacggtcaaaaattgaaacagttggatgtccaggcattgaagaaattgagtgagattgccaatgttgttcctattattgctaaatcagactccttgactttggatgaaagaagtgaattcaaaaaattgttacaactggagtttatgaagtataactttaacatatacccttacgatagcgaagatttgtacgaagaagaaagacaattgaatgaagatataaaatcattaattccatttgcaattgctggatcagagactgaaattgaaatcaatggtgaaatggtcagaggaagaaaaactaaatggggtgctatcaatattgaagatgttagtcaatgtgaatttgtctttttgagagactttttgactagaactcacttacaggacttgattgaaactactgctttgactcattatgaaactttcagatccaaacaattaattgctttgaaggaaaatgcgtctaacccaaatagacaatcccaacttcaaaaagatcaagggcaaacctcacaacaatcaaaccaagatttgaagaacgcctctggtgtgccaaatgctcctatgttccaatcaactacaggtactgctgctgctagataa

SEQ ID NO: 6341 - DNA, 687 bp, Candida albicans
tgcacaatcactgagcagcaaatttgcaagctcaacaccattaggtttgtgtgcttttgctataactactttggttttaagtttgtatttattacaagctcgtggcatcaaaaccatcaatgttgcagtttcattggctaccttctacggtggtgtcgttcaaacaatagctggtatttgggttttcttttctggagataccttgagtatgtatatatcaaaattggaaatcaatttataaaacaaattagcttactaaccaaattgttattagtttttactgctttgacatcgtatggagcattctggttatcctttgctgctataaacatccctacttttggtattctcgcagcctatcaaaaggatatgacacaactttccagtgccttggcattttatttgattgcctgggcaattcttagttttatctttatgttgcttactttcaagagtacggttttattaagtgggtttttcctttgtcttactgcacttttttcattgttgtcggcatcatattttgttggttcggttgcattaaccaaagctgctggtgcctttggtgtaattgcagttgttgctgcactttatgatactttcgccttattggcaacaaaacagaactcttactttacacttcctgtgattccattgccaggaagtgaggcaaaacaagagaaatag

SEQ ID NO: 6342 - DNA, 408 bp, Candida albicans
gtaatggtatctgcatctacagctgagtctaaagacgttgattctgtcggcagccccaatggcaacaacgtcaccaaagttgagatttctggtgatggtggtgagtttgttattttaggaaacaagaagtattatagacatgagataatgtctgtccttgcccataatgcacaatcactgagcagcaaatttgcaagctcaacaccattaggtttgtgtgcttttgctataactactttggttttaagtttgtatttattacaagctcgtggcatcaaaaccatcaatgttgcagtttcattggctaccttctacggtggtgtcgttcaaacaatagctggtatttgggttttcttttctggagataccttgagtatgtatatatcaaaattggaaatcaatttataa

SEQ ID NO: 6343 - DNA, 330 bp, Candida albicans
gcaacacaatatactataccaaaatttcttatgtcaagtggagattctgattcaaattcaatcacatcactcaaagatatcgatggtgctgataccaattcattaaatcaaccagtcagtatagttagaactactggtgatggagatgagtttgttattattggtaataaaaaatattatcgtcatgaattaatgcaagcatttggtggtacatttgatgttggtttacatccaccaccaaaattaaaaattggtaatccttcaccattaggtttatgtgcattttcaataactacttataatcatgagtttatatggattaaatgttaa

SEQ ID NO: 6344 - DNA, 192 bp, Candida albicans
ctacttataatcatgagtttatatggattaaatgttaaagatattcataataataatgttgtagttggtatggcgattttttatgctggcacaatgcaaacattagctggtgtttgggaattttttgtgggtaattgttgtataatcgtggcattcgactcaaataaagaacagattgcattaccaatttaa

SEQ ID NO: 6345 - DNA, 528 bp, Candida albicans
tttcccataattaaaatatataactatataaaatatttgacatttcttattccttttataccaaactcatgtttcacgtccttccggcatatgtttccattcttggacatacagttcaagtgtaagagaacacatgtcgtgcaaagtagctcaaataccaatcattgggaagatttgttgctactatacgacagtaatacatttgcaactacaacaatgattagttatggaacattttttttaagttatggagctctttatattccttcatttgggataatgaaagcttatgcaaccgttgatccaacattaaaagaattacaaaatgccattggattctttttaatagcttgggctattttcagttttttcatgcttttatgtactatgaaatcagtcatttctttatttgttttatttgtattcatttttttcacattttttttacaaggtattgggtttttacttgaacatcatggtttaattaaagctggtaatgtttttggaatattggtcactgctgctggt

SEQ ID NO: 6346 - DNA, 927 bp, Candida albicans
tacacggctataaaaggccaaccatctatccatatagataccagctttaattaccactacaaatccaacaaaattaatcaaatgtcttctttagaatcaatatcttctgaattaaaagctgtaccaatagccgatgaaattgaaaatgtggtattaccttacaaaacatgcacaataactggtgaaggcaacgagtttgttgttattggtgaccacaaatattatcgccacgaattgatgcaagcatttggaggtacgttcaatccaggtcttgcaccttatcccaaacatagttttggaaaccctgctgctattggtttagtttcaacgggaatgaatattttaatttttggattattctttgcccatgcaatgggtattcatattccaaatgatggaattgggttatgtatgtttatgggagggttggtagaaatattagctggtatttgggggttctttgttggttctcaagtaggaacttttgttttaactgtatttacttcgtatggtgcattttggttaagctttggagctatctttattccttcatttggtattatacaagcatacgaagaagaccctgaacagttgaatcatgctataggattaatgttgattgggtgggcaatatttaccaccatgttgcttatgtgtgttgtgaagtccactttatcgttcttttgggcattgctcacatatgacttaaccattattctctttgcagcggggttcttatcagataatgacaaagtaaaagtggctggtgggattatgggagtcattaatgcttttgctgattggtttgaagcttttgctggggtagctaatagacaaaactcttacatggttcccagagaaattcctttaccagatctctcagtctggcttaaacgtaaaaaagctgtcagcaaaacatcaaattaa

SEQ ID NO: 6347 - DNA, 735 bp, Candida albicans
aagaccctatttccctattacccaaattttattaaaagccaagttaacaaaacatacaaaacaatgtcttcatctgcatcaattacatccgatattaaagctcttgaagctagtagtgaaatcgaaaatgttgaaccatataaaacgtgtacgataactggtgatggtaatgaatttgttgttattggtgatcataaatattatcgacatgaattaatgcaagcatttggaggtactttcaatcctggtcttgcaccatatcctaaacatagttatggtaatcctgctgctattggattagttgccacaagtatgaatattttcatattagggttattttttgctcatgctatggggattcatgtccctaatgttgctgttgggttatttgtattcatgggaggagtagttcaatttttagctggaatatggggatttttcattgggtcacaagtaggaacatttatttttattgttttcacatcgtatggtgcattttggttaagttttggagcaatttttattcctgcttttggtattggtgaagcatatgctgaacatcccgaacaattaaatcaaggtattgggttaatgtcagtaggttgggcaatattcactaccatgttagtgttgtgcgttatgaaatctacgttgtcattcttctgggctttatttacattagatttaactattattcttttgtcttcaccacggggctggaaggaaccgcgattg

SEQ ID NO: 6348 - DNA, 948 bp, Candida albicans
ataactaactactacaactacaactacaaccactacacttatcaaatcatgtcagctgatttagaaaatcaacaaccacaagatcatcatcttattattgaaaacaagggtgataacagtagcaaccaccaccaccacaacaacaattcaacatcaccttatgatcctcatcatccaattactaaaattgaaactgatggagattatgttacttttggtaatgaaagatatttacgttctgatttagttgaagcatttggtggtactttaaatccagggttagctccaccacctaaaaatgattttgctaatcctgctccattgggattatcggcatttgctttaacaacatttgttttaagtttaattaattgtgaagctagaggggttactattcctaatattgttgttggattggcatttttctatggtggtgctgctcaattagttgctggtatgtttgaattggccgttggtaatacttttggtggtgttgctttgagttcatacggaggattttggggtgcttgggctgctattcaagttgattcatttggtattaaagctgcttatgctaataatactgaagaattacattatgctgtggggatatttttaattggttggtttattttcacatttttcttgatgcttttaaccgtcaaatctactgtggcattctttttaatatttttctttttaagtattacatttttattattggcaatttctgattttactggtaaagtggcaattaaaaaagccggtggagtgtttggtttaattactgcttttgttgcttggtataatgcttatgctggtattgctaatcctcaaaatagttatattactgttaaagctattccattaccagatttacaagatccaacaagaaaacataaagtcttcactacgagctgcaggatgcgcgatatatattatgggggg

SEQ ID NO: 6349 - DNA, 963 bp, Candida albicans
gtttatgatagatttcatcgtcgtctcccttatattcttttaaattataaataccttccagtttttctttgtatatccaagttggccaaattgctgatcattggttttagctataattttgttcgttctacgaagaatcttattattgatctactgttaaagaatatgccttccacatcttctcaaaaatctgttgggtcttcagttatggatccaaatgaaccgccagttggaaaagttgaagtttccggagatggtggtgagtttgtggtaatcaaccgtcacaaatattacagacatgaattgatggctgctttcggtggtactttgaatccgggtgccgtgccatggccaaaaattaatatcaatccagcacctcttggtttatgtgcttttgcattgagtacctttgttttgtcacttttcaacgctcaggccatgggtattaaaattccaaacattgctgtttcacttgccttattttatggtggattagctcaattcctcgctggatgctgggaatttgttacgggtaacacttttggtatgacagctttgacttcctatggtgctttctggttaagttttggggctatttttattgacagttttggtatcgttgctgcttacgaaaagtcagaggaaactgttccacaattgaagaatgcccttggattctatttacttgcttgggcaattttcacttttattttatggttgaacacactcaagtctactgttgcattttgtgctttattcttctgtttatttgtcactttcatcctcttagctgctggtgaattcagtcagaagactgctcttgctcgtgctggtggggttcttggtgtgatcactgctatcatcgcttggtatgttgctttagcaggtacagccaccacaacaaactcctacttcagaccaatttccattccaatgccaggaaatgttgcttttaaaaactaa

SEQ ID NO: 6350 - DNA, 279 bp, Candida albicans
cagttcctccttcttgtccaatttggtttggtcaggttggtgataaattatatagaatgttgtccaagatcaataccaattaaacttaaaatctcagttactaataattttggatttaatgttcataatgattctcacggtgatactttattatcatttattgaaaataaacatcgagcaattttacatgaagaattgaaaatttgtcgaaatccaaatttacaagataatagacttcatcttggattatattttattaatgccaatgttaaacggtga

SEQ ID NO: 6351 - DNA, 558 bp, Candida albicans
ttgtataacaagtcattaatgtcacgttttgattatagaaatacttcaaaaaatactagtgttgttgatcctgatcatagttcaccaataatcaattatcggaaggatgccaaaaaggggatcaaatttacatttatggtggttggagaactgggtactggtaaaactacatttattaatagtttattaaataaaaaagttttgaatcatcgttatgaaaaattgagtccaactgttggtgataccaaaacattaatgtttaccctggccaaatcagtggcattaccaaacacgtctatattgacaaagaatgaatttaatccaagaactataaatgaagaaccaggtattgccttgacggaaactcatattgaaattattgatgatgataatcaaaaattattgttgaatattatagatacaccaggatttggagaaaatttaaacaatgaattgtgttttattgaaattgaaaattatttaaagcaacaatttgatttactattagctgaagaaacgagaattacaagaaatcctcgttttgttgatactagagta

SEQ ID NO: 6352 - DNA, 1611 bp, Candida albicans
aagcgcggatccttccagccccgtggtgaagacttatccatgggtatgatgccctttgcatcttcgatggcaggacttgctccacctccacctcctgtatttgatggatctccttccgtagaaccaatgatgatgaactattctaatccaatgttgtcacaaaccactgagtatagtggtgcttctacaccttcgaaaagaagacaaagtgtatccactttcgataccagaccacgttcaatgatggttgatacgccaacaccaaaagccaacaaaagaagtagtgttcctgtttatacttctcaacaaaagcaacaacaactgcaactgcaactgcaactgcaacaaaaaattgcaccagtagcaaagacaactacttcaacaccggtcaaagttcaagattctaccattagtaagaagattgatgaatttgttagattacgttccagaattgctgcagggaataagacacctgaatacagattacattgggtcaagatgttgattgttgccacaaattataaattgtactcttatattaacatcaagggagaacctatttatcaagaacaagcagtatcaaataaagctcaatttataaaatcctctgtgacccatattttgaaacttattaaagaactttcttcagggacatatgaagcagatggggtcaaatgtgaggcttatttcatatacgcaaatttattgaaacaagattatttggtatcttataatcaagatttcaatatggagaaaaacattgataaggcaattgattattatgatagagtacttgaaatcaattctaaagatttcaaagcattatataaattgggtgaaatttatgagtatgaatttgataatgaatttaacaaggcagtagaatattacactgcggctgctaaatttggttataatcgtgccatattgaagatggctatgctttatttgcaagaaccacaaatgagatcaatcaagtatatgaagtatttgaaggatttgtccaatattgatttgaatgaagttcgtttggatgaagaagattctagtgaaatggaagaagtcattggattagcatgttatgaattgggtaaaatatttgaaggcatctatcctggtgatttgactcaagataatgaatttattcagaaatcgttggatatggccccagtcaattatgccaaaagtttgacctactacaataaatcagcaaaattgaattgtttgttagctcaagtaagattgggtattgtttatgaacgaggagaattgaatcgtcaacggaatccaaacaaatcgattcaatggtacatcaaggcttcatcatcgccattatctttcaaaagacatcctgatgctatggttgggttagccaggtggtgcttgacaggtagtgagggtgctagtaaacacattcccgtacctgtccctgatagagcagttatgtggtgtaaacgtgctattgatgaatttagttctccagatgcaatgagttttatgggtgaactatgtgagatgggacttgctaagggtcgtccgcaatattggtatgagaaagcatataaaatgggaaaccgagaggctggtaggaaattaggatactcaaattaa

SEQ ID NO: 6353 - DNA, 840 bp, Candida albicans
agactgctgcataggtctatgtcatcatcatcatcgatattttcatctattactgggggcaaacgctcggtgagatcagcaccgtctatttattcaagctccacagccacaataccagaggatctggaacctgtttctaccacagtcgagcagttggtcaatgatattgtattgcatgaaaaccattatagggcggttgcgttagagaataaccaccgaaatgcgaatgttgacgttgaagagatgtacaagatatcgcttgggtcggacttgcagtatcagaatgtacctgaatcgttgattgattggaacttgaatgtcactaggtgcaagttgatattgacgcagttgcctcagatcacgtctacagatataccatataaccagaatgcattgccgcagttggtgggcgacttggcaggtgtgtgtcacattatacttatacaaccgcatatttccgacaaggaacttatctacacattactttcatccaatttatataaagagcatgacttggacgtgaattttaaaaaatcagttgctgagatttctgtgaaacaaagccgcttattacaaatcaataatggtgcaggctcatcgtcaataaaccccgaacatttatttttgaaattcaaatttaaagagattgctattcgaaactatttaatcaaccttgctgctgctgcgacgaccgcacatgagtacaaattgaagatggagcacttgaagggagttttgaaaatggagcagcctgacaagaaagtcaagttgtcgaaagaagacaaaaaagtattgtgggaacaagtacgactggatgtattccaacgagctggtttgtag

SEQ ID NO: 6354 - DNA, 2121 bp, Candida albicans
  unsure (1757): Identity of nucleotide sequences at the above locations are unknown.
gtgcggggaaaacaaatagttgatatccatcggacagttttatttgaacccttattgaaaattttaattgcagaggggaaattcattaagaatttggtcggtatagggcaaacttatagtgattgggcatttgaagtcaagccacatttaattaagtacatgagctgcatgccaatgattgaagaacttctagggatcgaaacaataaaggcgtttattgacaaccgtattagtactttgcccagggtgagggatttgaaagtgaatgtcgggattttgtttataagtacttttaattcaaggtatatgcagttgccattgcagttggaggatatctacaagaagtttgacgttaatgatcccgagcacatatcgatgcttaaagcagctaacgatatcaggaaattgggggtaagaataaatgattccaaaaaactggccgataataattatgcaatatctgtgatcaaggaccagttattatggaaaagtggagtgacacagatcaatttgaacttgaactcgccaaatcgaaaatttgtttgtcgtggtgacttgacgagaaaaagtgttttgtcaaagcttcaaacagcaaatatcaatcatattatactacttgataactatgttctaattacggatcgcgcaagaaatagacgtggggggttggcttataagattttggaggatccaattcctgttgagtatttgattgtggaggaaaaagtagtttcgacgagtacattgctttctaaccaaaattctttaggtacaactcaactgggcacagctgatgctgaaaatgacgacagtgatgcatttcagttaaagttgaggtatgctggtagaacaaagagagcttatactttttcatgtggtacagaaagagaaattagagattgggtaaactattttattgcggcaaagtctaccttgtgcaagcgtttggctcattctaacccttatagagttgtcctggtgtcaaatactgtatttggttacgagaatagtcatcgtgttaccaagcttcaattacttgctcgttatgatcctatttatgatatttgccaagactccgtggaaaaaactaagaaattgaatctctggagtgatttgtacaacccaaggttgtctcgcaatcgtattgtttttagcaaattgcaatgtatgtgctggtttgaatataagggatccaagtacaaccttgttgctcttgaagctgggttgtatatgtgcgagtctaaaggtagatggaagaagatcataggtggtgataattacgttcaaatgcaagtggattcggaaattggtattgtggtggtattgactgagaagcaattgggttactatcctatacatcagattttgaatgtctacaacgaaacgaaactgaacttgacatgtattcctttgtcaaaggatactgtattgttttttgagatgggtcgtcacaagaatgttaaaatgttattttatgccaagaagaagacaaatggtagtattcatttcaaggttatgattccacaaatagataacggaggcatctttagtaggttcaaggaccatgccagattttatatagaagctgaatgctttgggatatcgatatttaattcatcctttgctgttcatactgataaaggatttgagattttgacgttggataaattgatccctagttcagtccctgaattaccacctcctgttgaaactgaaaaaaagaaggctgatccttatgcaacaaggaaaagtaagcntacatccctggtggaaaccattagaatgttaattaatgccaaatataagccaatggggatgtacaaattgaacaataataaagaattcctattggtttacaaagaatacgccatatttataaacaaacatgggaaaccttcacgagactttattatccatttcaaggcacaccatgtttattttgaaaacaactatttatttgttgtcaatgatcaattgattgaagtgtggcatataggcgatcatcccaaaaaggcccaagtaatcattgggaaagatataaaacatttaggacaaaacgggttttccatggctaacccgttggtgcccggattgcaactagtatttcgtttggtagagtag

SEQ ID NO: 6355 - DNA, 336 bp, Candida albicans
atcataggagtaatcgtttggtatattatggaaaatttcactattgttcatccattccttttggcagataatcgtcattatgcattttatatttataaaagattattaagtcaatcatatttaaagccattgatattgatggcatatcatttttcaagtttccaaatcatatcatcgttaattaaaggtggtcaattatcattcattggcatatttagttatttaatagctgttggtttgacattgattccatcaccattatttgaacctcgttattatattacccccttgattatattcaatttatatataaatcatcctcataatttattataa

SEQ ID NO: 6356 - DNA, 786 bp, Candida albicans
ataaacaacaccccatttctctccctaacctcattatcaatgccgttgattattccttctaatgatatttatatatctataataagtaaatatgttgccatagtgatattccttatatttgtcattattatgttcaataatattactcatcatttgactcaaccttatattgatgaaatatttcatttacgtcaatgtcaaacatattgtcaatataatttccatcattgggataataaaatcactacaccaccaggattatatatattaggatttatttattctgaaggtattaaaattttaactcgtagtagtagtactggtggtggtggtggtggtggtcatttaacttgtttcaatgataatgtattacgatcaattaatttaattggtggagttgttatattgcctagaatattacaacaattccataatgggtggtcaaagaactcaaagaatcaatttttttggagtattaatataatttcacaaccattattgtttacttattatttcttgttttatactgatgtttcgtcaactattttaattatattatcattaagtttgattaattataaacttttacaatatcctatgttaagtgcattattggggtttatgagtctatggtttagacaaacaaatattatttggatagcatttattgccagtaatttcatagatcgaccaattaaaattaaaactggtgtcattgatagaattcgacaatttaataatgaaatcattgacaaattggaaatcaccaatagggtatattgttaa

SEQ ID NO: 6357 - DNA, 945 bp, Candida albicans
gcacgctgcgattttccagcccggtggggcaagactggtaacaatgttgacaatcaggattcttgggtcccaatcattgattttattgatgatcaacacgaatcttatatgaaacaagaacaacaaccttcaagaaccgctaaaaaggatttgagagttcacgcttgtctttattttattagacctacgggacattctttgaaacctttagatatcgagattatgaagagattgtcaaccagagttaatcttatcccagttattgccaaggctgacactttgtcgccacaagaattggatatttttaaaactagaataagagaaatcattgaagctcaagacattagtatttatactccaccattagagttggatgatcctgctagtgctgaacatgcaaagcaattgatcgaatcaatgccatttgctataattgggtcggaagaagaagtggaagttggaccaggtcagtttgtaagaggtagaaaatatccatggggtgtggttgaagttgaaaacgatcaacattgtgattttaaaaagttgagaagtttgctattaagaacgaatatgttggatttggttttatctaccaatgaattacatttcgagacttttagatcagttaagttgggtggtgatgaacaagaaaatggtgaagagaatggaaccgaggaattaactaatgaaaagggtgaagttattaagaaaccatcaggttcaaagaaaccaagaagattacacaatccgaaattcaaggaggaagaggatgcgttgaagaagttcttcactgaacaagtaaaagctgaagagcataggttcagacaatgggagactaatattattaatgaaagaaatagattgaatcaagacttggaagaaatgcaatcgaagttgaagtccttggaagaacaagttaagaggttgcaaattgctaaacgttag

SEQ ID NO: 6358 - DNA, 858 bp, Candida albicans
accaatcaagttgatgtcaataaagtcaggaagtttgaaaagagcatatctgaagcattaaaagagaattgtactcatggcatgattgtgagagccatgtattgctatgggaaattgagtcatactagcaagccagaagctgttacaagcacttcagtgataaagtttggaattgtatctcttttcaaattgggtttgggtaaggcgtttagcaaggcatatagctttgccgttaaatctttcatcaaaccatttcaactagtggttttgttgctcaaaagcttaaggatgaatgtatttttggtctttattatagttcttttatcatttttgaatttgtttttggctgggaagacagctactagttactggaatactaggagtgctagtaaattggcacaagagtatgtcactaaagaacctcggatgttgcaaagatcagtttatttgaaagaccttgagagcatattgaatgaaaacatttctattgcagaaagtcgtccctttagtttgttcaaacagaattcgtttattttcaatttggacgccgatagtgactggagtaattattttggttccaacgctagagatgtggccaggctgttgaagagcagctttcaagacatcggaataaaacgccacgagttattagtgaaattgaaaattttgaagagtatggaagaagaaattatccaggcagaatggcagaactggcttatgagtgaagctcagaaatgtgattatgtaatggataatgttgttgggcaaatagatgaagtggacaactatcaagaaggcgttgataatataatcgagtattgtcatgaatgcaaaaagatcttagcaaatttggtttag

SEQ ID NO: 6359 - DNA, 1416 bp, Candida albicans
catatatcttctactcttcaatcaacatctttaccaatgtctaatcctcaacaacaattcatatctgatgaattgtcgcagttacagaaagaaataatttctaaaaacccgcaagatgtcttacagttttgcgccaactatttcaacaccaagttacaagctcaaagaagtgagttatggtcgcaacaagctaaagcagaagccgcaggcatcgacttattcccatctgttgatcatgtgaatgttaattctagtggtgtgagcattgtgaatgatagacaaccaagttttaaatcaccttttggtgttaatgatccacatctgaatcacgacgaagatccccatgccaaagataccaaaacagatactgctgctgctgctgttggtgggggtattttcaaatcaaattttgatgttaaaaagagtgcttctaatcctccaaccaaggaagtagacccagatgacccatcaaaaccatcgtcatcaagccaaccaaatcaacaatcagcatcagcatcatcaaaaacgccatcatcaaagatcccagttgctttcaacgctaatagaagaacatctgtatctgctgaagccttgaatccagcaaaattgaaattagatagttggaaacctccagttaataatttgagcattaccgaagaagaaacattagccaacaatttaaagaacaatttccttttcaaacaattggacgcaaactctaagaaaactgtgattgctgctttacaacaaaaatcatttgctaaagatacagtaattatccaacaaggtgatgaaggggactttttttacattattgaaactggtacagttgatttctatgttaatgatgctaaagtaagttccagtagcgaagggtcatcttttggggaattggctttgatgtataattcaccaagagctgctacggcagttgctgccaccgatgttgtctgttgggcattagaccgtttgacattccgtcgaattcttttggaaggtacttttaacaagagattgatgtacgaggatttcttaaaagatattgaggttttgaaatctctttcggatcatgcacgctcaaaattggcagatgcattgagcacagaaatgtatcacaagggtgataaaatagtcactgaaggtgaacaaggagagaacttttatttaatagaaagtggaaactgtcaagtttacaacgaaaagttgggcaatatcaaacaattaacaaaaggtgattattttggtgagcttgcattaataaaagacttaccaagacaagctactgtggaagcattggataatgtaatcgttgccacattaggtaaatccgggttccaaagattattgggtcctgttgtggaggtattgaaagaacaagaccctacaaagagtcaagacccaactgctggtcattaa

SEQ ID NO: 6360 - DNA, 1263 bp, Candida albicans
aaaataaacaaacccctaccctttctttctttaatccccaacaccaaaccaatcatgaattattctactgaaaatgtatcatctgccgctttgagaaagagaaaaacattgaagaaatcaatcaacttctccatcatgataattggcgagagtggttcaggtagatcaacattaataaacactttgtgtggtggtaactcaatagtccctacttccctgacagctacacaggacccattcaccaagaaattgactttgagacatgaaaacgtcgagttggaagataatgagggccacaagatatcccttaatatcatcgacacgcctaactttgccaacctgatcaactgtgacgacgacttcaagatcattgttgactttataagacaccagtttgatgaggtattattggaagaaagcagagtcaagagaaaccccaggttcaaggacggcagaatccatgttttgatctatatgattaaccctactggtcatgggttatctgatatcgacgtaaagtttttgcaacacgtcaacaacttggtcaacattatccctattatatccaaagccgactcgttaacgcctaaggaattgaaattgaacaaggagttaatcttggaggacttgaacaactacggaatcaacttttacaagttcaacgaatacgactacgagcaggactatatcgacgaagagattatcgaatacaacaagtacttgaactcgttgatcccatttgccattattggcgctaacgagtacagatctaaccccaacggcagcgaggacgaggacgatatcttgaaattgagaatattaaacaaggactttaagcctatcgatatcgacaatgccgagatcaacgatttcacaatcttgaaaaatgtcttgttggttacccacttgaacgaatttaaagacatcacccacgactcgatctacgaaaactacagaaccgaagccttgctgggtaaacagttccaatacgtcaacaaggatagtgcaaaacaggaaatcagcgaatccgactaccttatgaaagaagaacaaatcaagttggaggaagagagattaagaaagttcgaagagcgtgttcaccaagacttgataaacaagagaaaagagttgttggaaagagaaaacgaattaaaggaaatcgaaaagagattgttggccgaagggttaaagtttgatgaaaatggtgatgtagttaaagtacacgaagaggtcttcaccacggggctcgaaggaaccgcgcta

SEQ ID NO: 6361 - DNA, 1440 bp, Candida albicans
ctccaaagggaacaggaattaagagaaattgatatacaatgtatgaaaagattgagtaaatatgtcaatattatcccggttattggtaaagctgattcttttactttaaatgaattgcaacattttaaacaacaaattagaattgatattcaaaaatttaatgttccaacgtttcaatttgataattctttaaatgattatgatgaagatgaagattatgatttgattcaagaatgtaaatttttaactaatttacaaccatttgctgttgtcacgtcagaagatgtttttgaagttagagaatcaactactaatactaaaggtaataatgataaaccaaaaattataagagccagaaaatatccttgggggttagttgatattaatgatactagatatagtgatttccccattttgaaatctgtattgttggggtctcatttacaagatttgaaagatttaactcatgatttcttgtatgaaacttatagaactgaaagattgactaaagttactgggaatggacaagcatttgatgatgaagaaaatgaagatgctgaatttcatgatacagttgaacatcaactcaatgattccaatagaggtgttggcggtgatgataataataataatacttctacaatcccatcaatgtccaatttggctcaattgacaactagtaccaatgaacatgatgcaagtcatattgataataattcaataacatcgactagttcatcaataaagaagtctacttcaatgttgatagatgatcatccttcatcatcaccaaaattgaaaaatataagttcttttacatcatcaacttctactgtctcacttgaaggtggcgaaaaagaaggtggtcatcatgacagaggggctaatagtaccagtaccaacaacaataataataataataataatgcctttaaaagattatcaattggacctcaacgtaatcaattgcgtcaaatttcagagactgtaccttatgtgttgagacatgaaagaattttggaaagacaacaaaagttggaagaaatggaacaagcaagtgctcgagaattggctaatagagcagcacttttagaaaagaaggcagctcaattgaaagctaaagaaaaagctttgagacaattagaattaaatagacaaaagcaagaagaactggctacttcaagtttacatagaaaagatagtgatattagtggcagtgttcaaagtggtggtgttgatgatggtaaatctgaactgaccaataataataataataatagaaatggatatggatatggacatggtcatggacatggacaaagtcatgagtatgataattcagaatatcatcatgatgatagtacaccaaattatgaaacttcaagattgcaaaaggatgaaactttgactgatttacattggattgtaagcaatcattaa

SEQ ID NO: 6362 - DNA, 780 bp, Candida albicans
actaaattaattatcaccggttcaaaaactattgatgatgaatttttaatgaaattgggacaatttaaatgtggtgataatttacaaattttagatttacgtgcttgtgaattaattactgattttggtatttatcaattaagtttatattgtcgaaatttaacttttataaattttggtcgtaaacctattagtagtggtaatggtaatggtggtggtaatggtggtggtagtggacgatatattactgataattcaatgattaaattgattaataataatcgaaaattactgactataggattagcaggatgtcatataactgataaatgtgtttgggaaattgccaataaattaccaaatatatctcgattatcattaaataattgtcctaaattgactaattctggtataaatcaaatattcaccctaacaaatactcccaactccaattattttaaatgtctttcagttttggaattaagatttaatcatcaattgactgatttaacttcaattataaaatttaaacgacgacaaaaatttcaatttaatattatattattattagaattatgtgaatcattaatgttaaaatatcgtcaacaagaatttgaattagataaattgatttctttaaagattttccaagatatttctcattgggttaatgattataatgataatgatggtgatttactgtataatgaaattaaacatttgataaataacaacaacaacaacaacagcagcaacaacattagtgccagaagtttttag

SEQ ID NO: 6363 - DNA, 1281 bp, Candida albicans
atctattccagaaggaccattttggaaaaattgagaatcattgatataacgggttgcaatgccattactgatagattggtagaaaagcttgtttcttgtgctccaagattgagaaatgtcgtcttgtcgaaatgtatgcagataacagatgcatcgttgagggcattgagtcaattgggaagaagtttgcattatatccatttgggccattgtgggttgattactgattacggagtagcagctttagtgagatactgccatagaatacaatatattgatttagcatgctgttcacagttgacagattggacactagttgaattagcaaacttgccgaaattgcggagaatcggattggtcaaatgttccatgattacagattcgggaattttagagctagttagacgtcgtggtgaacaggattgtcttgaaagggtacatctttcatactgtacgaaccttactattggaccaatttatttgctattgaaaaattgtccaaaattaacacatttgtcacttactggtatatcttcatttttaagaagagaaataacacagtattgtcgtgaaccaccttcagattttaacgaacaccagaaatctttgttttgtgttttcagtgggcacggtgttaaccaattgcgtaattatttgaatcaagttgttgaagaaagaacatatcaaattgaccaaggtgatattcacactttgttcaatgaacgtagaaggagatttttgaatggagatattgatatggatgaagaagaaatgaatatttgggaacgaagacgtggattaggtgtcactgcagatttagggcatcctgatatggcagaaataaatcgtgaaatattcagagagcttaacgaaggcaacatgggtcctgatgaaatgagagagcacttccaaagactaatcacgaatcaccatcaacagagattactagagcatcaaaatagattgaatctacaattggtgcagctacgccaacaacagcaactgcaagaaccacagctagagcaagaaaatttacaaaatcgtggtcaagttgaaacccaagctccagatctacttccaaatgaaggccagttgcgattacaaccacctcttccacaacaaagagcacagaatactattattaataacccacagaatgcaccccaaatagaacagccagcagtatttccgaatggagaaaaccaaacactacctttagttgtaaatgaagacgaagatgtcgatatggaaccggtcgatttatttcctagaaatacttga

SEQ ID NO: 6364 - DNA, 807 bp, Candida albicans
tttatatcatcaatgagttcacctaccagtctagacgacttgtctaacatgcctgagacaggaaacacaattaagacactacacgagttgaaacaagaatcgtcaccagatagcaacaacgaaatgaatatcgatggtgaaatgagcaacgacaacagtaaccatagccatagcaaccaccaaatgcacacatatgctggtgattttgttatggatgatgaatataatgattacgaagagttaagaaagtccgtagtcaacaaaagaagattatcaagcattaaacgccctcacggtccatttttggatcacaacaaccaaatcgataagcgttgtcttttgagattacccacagaaatattattacaaatatttcactatttagagagaagagactggtattctttattaacaacatgctccgaaatcgctgatttgatcattgaaatgttatggttccgtcctcatatgcagaatgattctgcattcaagaagataaaagaagttatggaaataaacaaatcagttactcattgggattatcgccaatttatcaagagattgaatttgtcatttatgaccaaattagtagatgacgagttgctaagtttgtttataggatgtcctagattagaaaggttgactttagtcaattgtgctaagcttacgcggtatcccatcactcaagtattaaatggctgtgaaaggttacagtcgattgatttaactggtgtgactgatatacatgatgatattattaatgcattggccaacaacgtccacctggcagtggccggacaacgctag

SEQ ID NO: 6365 - DNA, 1458 bp, Candida albicans
gaactctatttcattatggagggggaagtggaattctggaacaaagaaggtgtgatagaaatccccattggagaggttattaaaagtggaagctattttgggagaaaagtcatttttaaactatttacaaaaacaagccccaggatacgtactgcaactatagattcagtcacttattgtgagcttatggtgataaaatcagagtatttggaaaaactatgtgacgactatcctaccattattgaggacatgaaaataaccgccgaggaacgaaaagtggtcaaacctgcgcaaggaatatttagacctaattggtcaataaacccaacaagaactattcctccacaaaagagacaacgagaaaatgaaaatgaaaatgtagattatgtcccatttactaagaggatgagaatggcatcaatgaaaagaagacgatcttctgctcttgccattgttgaacctttacctgaaactattttgatgaagatatttggatatttgtcattgccagatttaatgaaattgagaagagttagtaaaagatggagaaaaatggttacaacaacagctccactagaggttttggatctaagtcaatatagcaccacaattgataacaaggcattgatcgcaattactgattttgctggctctcgaccgagagttattgatatatctggctgtttccatataactgatgaagggttttcacacatggtcaatgaaatagggattggtgggagattggaagtgttacgaatggcgtctgtatgggaagtcactggtatggcaataatggatttatgttttccaggagaaaaattggaagaaattgatttaacaaattgtcgtaaagtcgatgacaatgtagtgcaacgattactacaaaaatgtcatttaaaagttttaaatttgagctactgtaagggtatttcagacagcgtggtaccatacttcaataatttggaaagtttggatttgactagatgttctggtataactgatgccgggtttgcccaattaccgtttctgccatcacttcgaaagttgagtttaaagcagtgcagctatttgaccgacaatgcaatatactcaattgccaatgctgctcgaaatcttgagattttgaatttaaatttttgctgtggtttgaccgatggctctcttctggcaatagccatggggttcccctatctacgggagatcgatttgtcgttttgtggactggctgtgagtgactcgtctgtggcatcattgtcagtgctttattacttggaaagagtattggtccgagggtgtgttagattaactcgtgctggtttggatacgttatttggaggaccgtgtccgttaaattttattgatataagtcaatgccgtaatgctcatgtgtatccagggaattttcccgccccaccttttcaaagcaatttggtaagagtatcaaataaaataatt

SEQ ID NO: 6366 - DNA, 444 bp, Candida albicans
aaaacaagaacttcaacaaagatgttgctccacctcaatccactggctaccaaacactccaagaaaccatttgatcgtcaatcaagaaccggtaaaaccgattttaaaaagaaattgcaacaaggatggggccaaagtgacaagagagaattagaaggtgaagttgaaggtactgaagatgctgaagctgaattggaagctgaagctgaagaaaacgatgaatctgctaacgccatcccaaagaaatcattgcaagaataccttgctgaattggaattgtcgaaacaagaattagaaggatccaagaaactcagacaagctaacgaaggtgctgaacaaaaatggaccgccgaagaaaagatcgaaaagcaacaagaagttttctttgcttccactcacaccaagaaagctaaatccaaggcccaaaaggaaaagtctttttag

SEQ ID NO: 6367 - DNA, 1431 bp, Candida albicans
gtaactcaaacctcgtgtgttttagaatgggataaactaaacttgggcaccgccacattgaaaaatcttattttattcaaagatggtaaaaaattaggctcaattcctcagccattaaataatcgaacctcaaaattgtctggattgccaattgacaaatcttttaaagtacaattacgtttggataccactgctggtactttcttgtcgaatgaaattgaggtaacaacccacaaaatgactgatttgtcaggaattactgtgtgtcttggtgaccttacacctaatgatcaattcaacaaggaggacattgaagaggcattaaagaatatgggggcaaaatatccagtgcaacaacaagtcaaagtcgacactacacatttcctctgtactagagaaaacaaacaaaatcctgaatatgtgaaggcaaatgatatgaacattccaatcattagaccagagtggttgaaagcctgtgagagagaaagaaggatagttggtgttagagacttttatgtgaaagattgtgtcttacccgacatatttgcaaaaaactattggcaaaagacaacttctcagaccgcaggtaatttttctgctcaaagtttaccaaaggaatcaccagcagtgcctgataaagagggattaccaaagacagatttgaataaagaactggtcaaggacgaacctactgaagtggatcatgccaaagaggattctgttacccaagaacccgctatagaggaaatttctgcagtagtttctgagaatatcattactccagatatcgcaaatgaggaaacagatattgttgagggtgaatcaacaaaaattgaactggtaccaaccgatgaaatagacaccaaagttgaatctactcctgttgcggttgaaaccgaagatgtcgttgcagaatctccagctgaccaagacgcagctgtaacactagaaccaacctcagtggatgaccaagagcttcaccaatcagatgaaacattgaaacaggtcaatgacggccaacaagagattgacgtaggagatgcaacagaacaaccagaaaaggaggaaattgatgacattagagagcaagtgaatagtactgtcaataataccgagagacaagaaactgcaacagatgatgcttttgatacagttccacttgagggagatgaaaacattgcaactgctgcaaaagaaactgagccaacatttacagaaccaacagagtccgtgaatgttactaatgttaacaactccgcaagtgaagaagctggaaaagacgacaatgatgacgaagatgatgaggatgaggatgcagacaatgaagggaaatctaataaaacttctgaacagtcatcagaaggaagtgcaactggttcaccatccaagaagaaaaataaaaagaaaaagaagaataataagaaaaagtaa

SEQ ID NO: 6368 - DNA, 1665 bp, Candida albicans
ctatattatatttttttcttacatgggagaaaattggaggaacttataataatgtcgagtaatagttcttggtctaacaacgattcttaccaactgaggaacaatcctaataatggtaataaccataacccacatttaatgtcacaacaacactcacaatctgtaaatattccttctcatttgttgcctcaagcatttatagaacaacaacaacaaccaccacaaccacaaccacaacaatatccgcaagacggccaagctcataacaaaaacccaccaatcaataatcgttttcatcaatcacaaccaccacaactgcgccatcaatacatcccatccaaacaagaacaaatgcaacaaccttacccaactgccgaacaaaataatcaacactttcctccaccacaggaaagatcatatagtttttcatcgactatggatcctggctcacctagcaaaatgacgccacctaatttttcacaaaggaaccaatcattttctggctaccaacaaccaccaccacaacaacaacagtatccgcagtcaccccataaggcatataaccaacaaacccacactcaccaaggtggacttcaacagccatacattgcgcaaagacaaaacatgccacctggatatattaaccagaatccatattctcagcaaaatagatcagtatcatctttgactcaagataggacaggagcaccagtacaacaccttccttatcctgtcaacaatgatgatcctggatatcaactacaaccactggcaattcaatcacaccacccaccacaacaacaacaacaacaacagcctccactccagacacgtagacaacttcgtaaggccccttcgagcaacttgcccccaattcaaactgatcaagtttactatagccctgatgctagaagaattgtttccacacctacacaccagcagaattttcccactcccataccaccagaagctagaacaaaatcacttacttcggcatcattaaaacaccagaaacaaccactgcaacctctgcaaccatatttccaacaaatctctgaactgccaggtaaagacagcaacgctcgtaattcctccagcagttcccttcatcatacattttccttaacctcaaaatcgcgatcatttacatctatcagtaaattgtcgtctttatcaactaagaaattcggttcctcttcatccgtcaataccaacaaattagatcgttatcaatccagtggaactattagaaacaatcacaatcataaccacaccaaccaaactagccacaacattcattatgctaaaccatcagtatatcccgcaattttatctgaagtggccaaattgtttaaagaggcgattattttgacgatcaacaccaaggatggtttggaataccatgatacttttaccgggaaaatggcagttgatatattatgtcgcattattcgaacaaatgatcgtaacttggccttgttattgggaagatcattagacgctcagaagtttttccatgatgttacttacaatcatagattaagggattcggtacatgaaatttatgcctttaacaatgtttataatgatgttgattttttcaacgaagaaaatggaggagctggtctggttagcaatggggaaaatagtgcattaaattccaaa

SEQ ID NO: 6369 - DNA, 2046 bp, Candida albicans
ctgatttctacattatgccgttacgaaatcctgccaataatattattcctgattaccaatgtagaaacatttattcaaactgtgtttgggggagtgcctgatttgttgagattggccaagagactcagtgaagcattaactcgaagacaacaacaacaaaagcccgttattgagaccattggtgatgtatttttagattatgtcggtgattttgaaccttttgtgacatattctggaaataaagtgtttgctacttttgaacatgaaagacaacaacaagttaatatgaaatatgctagattcttagatgcgattgaaaagaaaccagaatcgagaagacaagatttatcatcttttttaattaaaggggttcaaagaccagcaagataccagttattgttatcgggtattttgaaacataccaagccagagtcacccgactacaagtatttgacgaaagcaaaagaagagattgagaaattattggtgaaaatcaatatccaaactggggaatgtactgatcgacacaaagtcatggttttgcataggttattgggcaaacaaactttggaaaataggtttaatttcaaattatcctacaataatcgtattatctatcaagtgactttgaatagaaagagggataacgaaaaaattgatttatacttgtttgaacatgcattgttattagtgaaacacaagattcaaaacaagcgtgaacaacataaagtatttgaaaaaccaatgtatttaccattgttatttgtcaatagtggtatggagatccccactaatagaacaatcatgcctcatagataccatggatccttggtatctgatactagtataagacctcaaagagcagaatctaattatattggtaatactttgaattcttcatcaacacctaaattccaattgaatttttttgggttaggtagtaatcaagttcacgcctcattatttgctgatgacttgactattcagaaccaagtgttgctgcaaatatcggcccaacagaagaaattaattgatgctaatgacattttttcattgtgtaaatttgaaacgagaagattcactgggaataataaaatcaattgtgctgttccttgttatggtgggaagaaattgttgtatggtactgattcacgggtatgggttagtactgtccgttcaattagtgccacatctaatgaaaaaatctgtagtgatcccactatggtcatttccaaaacttatgtcactcaaattgaagtgattgttgaatactccaagttgttagtattgagtgacaaatcattatatgaatttgatttatcttgtaccgattctttggatcatgtgaagaataccaaactggggaaattgcttttgagtcatgtgtcatttttcaaagttggtgtttgtgatgggaaattgctagtgattggtgctagaacaggtagtctgcattcaatttgtatatttgagcctgttaatccatttgataaatcgaataagaataagaacaagagattagaaattcaagaaattaatttcagttctgatccaatttccatctcatttttgaagactaaactttgtattgggtgtgctaaaggttttgaaattttatcttctcaaacaggaaccaaagaatcgattttggatgaagcagacccttcattagattttgcaacacaaagagaaagtgtgacaccattagcaattcatcgattaggacgtgatttcttattgtgttattctgaatttgtatttttgatcaatcgaaatggatggagaacaaatcatgattgggggatattttgggaaggtaatccacaaaatgttgcgattttcttcccttacttgctatcatttgaacctggatttgttgaaattagagatttgcatacaactaatttattaagagctttaacgggagagaatattagatttttgcattcgaacgaacatgaagctatgtttgcttgtgaagaaaatggatatgatattattatttccattgatttcttgaatttgaaaccaaagtctccaacataa

SEQ ID NO: 6370 - DNA, 549 bp, Candida albicans
gctttgaatgaccatatatccgattatcatacctcacaaagcagtggatcattaactaaaattgctagtagtgccactgataatggttcagtaggtgttgctggtaaggagttgagtgcaagtcaacaaacaggtgttaatggagttttcactattttgacagaatgttattcgcccacatgtagcagagatagtctttgttacagtattgcctgtccaagaagattagagcaacaagctagattaaatttgaaacctcaaggtggtttgcaacgtgctgtttcaaaattatcattgcatgatcaggaagaaaccgaaactttatggcacaagactgtacctcaatcagttttagataaattagacaagcatgaaaagactcgacaagaattgatttatgaatttgtttatactgaacgtgactacgtcaaggatttggaatttatgactgatttctacattatgccgttacgaaatcctgccaataatattattcctgattaccaatgtagaaacatttattcaaactgtgtttgggggagtgcctga

SEQ ID NO: 6371 - DNA, 420 bp, Candida albicans
gcgaaaacaaagagtattaccggtgaattccagatcaataaacaggttggtatgatccaggcacaccgtggtggattgtttaacactcttagaaatttgggggtccaattagaatcaggcgaagggtattacactccgttgaccgaagaaaataaattgagaaccatgagacagattgttgaagatgctaagaagcccgatttcaaattgaaattgagttatgagtattttgccgaattgggatatgtttttgccacgaatgcagaaaacaaagaaggcagtgaattggctcaattgattaaacaatacagaagatacggattattagtcagtgaccaaagaatcaaaactgtggtcagggccagaaaaggcgaaaccgatgaagaaaagccaaaggttgaagaggttgttgaagagtaa

SEQ ID NO: 6372 - DNA, 696 bp, Candida albicans
atacaactccaccaaggaaatgtcagataccgaaaagacacagaaacagattcagaggtaggatacctcgatatatatcttagattcaacgatgatatggaaaaggactactgtttccaagtgaaaaccaccaccgtttttaaagatttatacaaagtttttagaacattacccatttcattacgaccaagtgtattttatcatgcccaacctattgggttcaagaaatcagtctctcctgggtacttgactcaagatggaaattttatttttgatgaagactcacagaaacaagcagttcctgttaatgacaatgatttgattaatgaaacagtgtggcccggtcaactaatccttccagtttggcagttcaacgactttgggttctattcgttccttgcatttttggcatgctggttatacaccgatttacctgatttcataagtcctactccgggaatttgtcttaccaatcaaatgacgaaattgatggcatgggtattggtgcagtttggcaaggacagatttgccgaaactttacttgcagatttatatgatactgtaggtgtgggtgctcaatgtgtattttttggatttcatattatcaagtgtttgttcatatttgggtttttgtacaccgggggttttcaacccaatgagagtgttccgtttaacacccaagaagtgtcaaattag

SEQ ID NO: 6373 - DNA, 1110 bp, Candida albicans
acagtcccagttttagagcttcttatgaatcatttggatttacaaataaataccattgagcagtggttgacagcattggctagttcatttaagaagattccaaagtatttgaaagaagtgcaaagctattctaactcatttttagagcatttggttcatacttttatacaagatggaattatagatcaagagtatacagtgaccggcttaaatactactttggatggcttgaagacagtgtggggtttgagtattcaagctttgagcgtggacgcaaagaacttgaaatccattgaattatttaagcgtcaccatgtcataaagtacaaagaaacaagaaaacgatatgaagattatcaggcaaaatacgataaatatttgagtatttatctttcaagttcaaaatccaaggatcctttaatggtaatagaggatgcgaaacagttataccaagtgagaaaagaatacatccatgcttctttagatttagtgattgaaattcaaaatttatccaaaaatttgaataaactattggtgggagtgaatactgatttatggaggaacaaatggaatatatttggctctcgtggtgttggagatgctataaaagaagaatgggataagatacaacgaatacaatcttggaatgattcttatacgctagcaatcgaaaaattgaattctgatatgcttgcagctagaaaccaagttgaagagggatgtcatatacagttccaaccctctactaatgtcaacgattacaaatcgactataataaataaccgaacattacgtgatattgacgagcccggcgtcgaaaaacacgggtatttgtttatgaaaacatggacggagaaatcatccaaacctatatgggttcatagatgggctttcatcaaaaatggtgtctttggtttattagtcgttagtccatcgcaaacatttgttcaggaaactgataaaattggaatattgttgtgcaatgttagatacgcccctaacgaggacaggagattctgttttgaaattagaactaatgattttacagctgtgtttcaagctgaatcgttagttgaattaaaatcttggctaaaagttattgaagaatga

SEQ ID NO: 6374 - DNA, 729 bp, Candida albicans
attccggatttccggccgttggcaagatctttatttgaaggtgcagtggaaccaggtgagtactgtgttttatcatatagctgtatctggtctcctaattcgaaacaagaattgagcggacgatgttttgtcacaaactaccacatgtatttttacatgcaagcattaggttttgttgctttatttaaaggattcttgggacatttggtttctgtggaatttgtttcgcagaaaaactatgatttaatgaaggtttacaatattgatggagttataaaaatgaaggtatttttggatgatgctatttgtataaaaaagaaattggtttatcttataaacaatattgtcagcgataaaccaaaaagtttagaaggggtattggcagatttttctgatatagaaaaagaaattgctgttgaaaagtcagatcaaaaaaacttacgagagattatccaactttcaaaggggctttctagtaagagcttagcaagtgagaaacttttattgagtggtgaaacatcgtcaatccttcccggtaagagtggccgaatgatcaaacatacagttaattttacaccatactataatttaattagtgatcggacttaccctgctccaccgaaagctatctttcatgcacttttaggtgacaattctgtggttttcaaaagtcaattatcttttgctaataccaagtattttttacaaaaaaccatgggcaacctctaa

SEQ ID NO: 6375 - DNA, 447 bp, Candida albicans
ggaaaaaaaaataataataacaacaacaacaacaacaacaacaacagaatgagttccctaaaagattgtaaactttcgaaatctaaacgagaagaattaaaagcacttaataatgctgggaaaactccacgacgagttaaagtatatctactaaatggagatgattggatagataatggtacggggttttgtgtgggagaaatagatgatgacaccaaactaccttattttcttgtccgtaatgaaactgataacaataatatcatactaaaatcatttcttgaagggtctatacaatatcaaagacaacaagaaacattaattgtttggaccgattccaatgggactgatttagcattatcatttcaagaaactgaaggatgtgctgatttatgtgattttataatacgcgtacaacaaggaaatataattcccggaatttcctga

SEQ ID NO: 6376 - DNA, 1212 bp, Candida albicans
atatctgatgatatgacgttaatatcaatattaagtaaattacttgtcgaagataaaaatattggattaaaaatgcaagcatttgaagctttaaaaacattattagatccaaatattgctgctagtagtagtggtggtagtaatggattaagtcccaccaccatgggaggtatgggaacccctaatgggtcagggtcagggtcaaattcaaattccttatttaattcatccaatgccaatgccaacgccaatgccaacacaaataccaataccaattcagttaacaaatcaataggtattaatactaacaatattgaagaattcaaatttactagtgaagaattccaagaaataaatactagtacttatttcagagctttttatgagcaagttgctcccaaattatttgaaaaattaatcatactagccaatcacaacctagaatcaaaacaattacaaattaatactaaacatgaagaattattatatcaattattatgtgaattgatatcattttgtacattagaacataaaatgatatcattatcttcattatcctcctcctccttttcatcatcgtctttatcatcatctttatcatcacgatcatttttcattgaaaatcatattccattaggaattgccaaattattaatcattgatgattgtaaaccaatattaaaattaacatcaattcgatgtttaaaaaatttgattttattaaatgatgaattttatacaagatattttataaatcatgatttatggttttattttttcaaatttttcaataatgtaattgatgaaaataatttagctaattcaacttgtttagattttattgaaattgttattaaaggctgtgatattggtttaaacaacaacaacaacaacaacaataataataataataataatagtaaaagatcaaattatatcttattggcaaaacatatttataaaaaatatggtgaatttatcgaaaagaaattgaattatgttgatacagggaaaagattgattgatttagtaactcattcccttaatagtaatagtaatagtaatgttaacaaattaaatggtggacaaactttcaatgaaaacaacaaagaagaatatgatgaagaagataatgaatacgacaatgaaaatgaagattctgatgaaaatattgctacaaatactgatgatttaggtttatctgaaagatga

SEQ ID NO: 6377 - DNA, 528 bp, Candida albicans
  unsure (7): Identity of nucleotide sequences at the above locations are unknown.
ttcccgnaggtgaagattgctcagtttacaagaacaaatattctggaatttattattgaaaatgattatttcactaaattaataaatgtatctaatgaagcagaaaataatgaaaatgccaatgtattatataatatcagtgatattgttaaatcattatttctttataatgaatccctgattatagaatacatattatcatcagaagagaaaattttggggttagtaggaatattagaatatgattcagaatatccaaattataaggcttcacatagaaatttccttgctagtcaatcatatattaaagttatccccgtcgaaaatattgaaatttttaaacgagatttttatttaaatcatttgaaagatgtcgtatcggcaagatttttagatgattctacatgtaatttgatagcgtctttgatttattctaatcatttggaaatttgcaattatattaaagattcagaaattcttgaacatttattcagcatttatgataattgtaacgatgagaaaaacgaa

SEQ ID NO: 6378 - DNA, 564 bp, Candida albicans
atgtcagaatcagttagaagaaagctagttattgttggagacggagcgtgtggcaaaacgtcactactatatgtgtttacccttggagaattccccaccgagtaccatccaactgtgtttgaaaattatgtcactgattgtaggattgatggcaaaccagtacaattggcattatgggatactgctggtcaagaagaatatgaaagattacgaccattgagttataacaattcccatgttattttgattgcatttagtttagatacaccagattcattagataatgctagaagtaagtgggttgttgaagtgaaaaaatattgccccaatactccttatttgttatgtggtctcaaaaaggatttgagaactgacgaatctgatcgtgttaattttgtgcaattcgatatgggacaagccatggcagatgtaattggagctaaaaaatatcttgagagctcggcattgacaggcgaaggtgtcgatgatatttttgagtacgccgttcggactagtttgctaaagaatgataaagccaatacaggatgttgtaccatactataa

SEQ ID NO: 6379 - DNA, 207 bp, Candida albicans
ttatttgccactttagatgtcgggttcttcactttggcatcagcaaatatgactggtaatgccacttgtactcaagttggtggtatctttgttgttattagttctatctgtggatggtacggtatgatttctggtatggcagataaattcaattcttatttcacagttcatccacttccagtccctcaatttggaaagaaaaattga

SEQ ID NO: 6380 - DNA, 876 bp, Candida albicans
ctatcatacgttctatactcagaccatccatcctcctataacatgtcatcaagttcagatccatcaattgataaagatcaatgttctattgaaaccgatggcaataaccatcatcatcatcatcatcatcatcctatccgaactgtctcttatgctggtgatggtaatgaatacatcattttagataacaaaaaatattatcgtcatgaattaatgacggcttttttaggtacaatgaacccaggttatactcccatatcaacccataaatttggtaatgcttcagcagttggattagcagcgtttggtctatcggcatcagtattaggattatattatgctggtgccaaaaatatctccattcctaatgtttcaatttcacttgcaattttttatggaggattagttatgtttgtttcaggaatttgggaatttttcattggtaatacatttgcctatactgtgttttgtagttatgcatcattttggcttgcttttggaactatgaatgtaccagcatttggaatgctttctgcttatgaaaattccgtagaattgggtaatgccattgggtttttcttgattggatggggggtcttttcgataatgattacattattggtttttaaagcaacagttttatttgttgtgttgtttataactttagatgtgggattatttactttagcagcggctaatatgacagggaatactacatgtacaaaagtaggtggtatatttgttgttattagtgctatttgtgcttggtatggtatgtttgctggtattgctgatagatataattcttattttactatcaatccagttccaattccgcatcttgggggtaacaaaaaacaaaaagagatgagatga

SEQ ID NO: 6381 - DNA, 768 bp, Candida albicans
aaggaaacaactatgacgtcttcatcttctcaaaaatctgttggatcttcaatcatagatgcaaaccaaggaccaataaaaaaagttgaaattgctggagagggtggtgaatttgttattatcaatcgtcacaagtactacagacatgacttgatggctgccttcgggggtactttaaaccaggtgcttctccttgggccaaagatcaatatcaaccgtgctcccctcgggttatgtgggtttgccatgaccacttttgtcttatccctttacaatgcccaagctatgggtatcaaagttccaaatgtggtagtttcacttgcatgtttctacggtggtgcagctcaattttttgctggatgttttgagtttgtgactggaaatacatttggtatgactgcattgacatcttacggtgccttctggttgagttattcagcaatcttggttgatagttttggtatcgttgcagcctacgaagcttctgaagaaacagcttcacagttaccaaatgccattggatttttcttacttgcttggggtatctttacatttatgttgtggttaaacactttaaaatctacagttactttcagctccttgtttttcttattgtttgtaacattccttttgttagctggtggtgaatttagtggaagagtcggtgttactagagctggtggtgtttttggtgttatcacagccattgttgcttggtggaatgccttagccggtactggtacgtcgtcaccacggatggaagtccgc

SEQ ID NO: 6382 - DNA, 843 bp, Candida albicans
tttttttcgttttattctggttcgattaaattaaattctgcaatttttcaccatttcaatagtactagagcaacaccatatttcggcatacgtacaaccaccatgctttccaggaccattatctattctgtgagacaattgtcatgtacatcagcacttttaaacaaatccacgaaaccgaaaagcaaggccccaaagaagaaactgcaaaaagaggtgatatatggtccactttcagatgcccaaaaggcatatttagatagagttatcagagttgaccaggctggtgaattgggtgccaattatatttacatgggacaatatgccgtgttggcttctaaataccctcatttgaaacctgttttacaccacatgtgggaacaggagatccatcaccataatacatttaacaaattgcaaaccaagcgtcgtgttagacctagtttgttaactccattatggaagttaggcgctattggaatgggtgtcggcacagcattgatcgggaaagaagcagctatggcatgtacagttgctgtggaaactgtgattggaggtcattataaccagcaattaagagtattactgaatcaatatggtgtacctatatatgacaaaaagaccggggctttacttagtccagatacagttgagaaaacagcacagacttctgaagaattaaccgagttgaagaatcaaataagtgaattccgagacgacgaattggaacatttgaacacggcacttgatcacgatgctgaaaaggctgttccttatatgctaataacagaagggataaaattgatttgccgtggtgcaatttggactgctgagagaatttaa

SEQ ID NO: 6383 - DNA, 1734 bp, Candida albicans
agtagtggagttaccattattacagataataccattacatttacttcacccagtatttaccaccaacaaactaccacaagcagttataaaccaaatttaaactgtttattaaatggatatatgttaaaccatgaaattcggtttatcagaaaaattggtgctggtacctatggtttgatttaccttgtggaaaatatctacactaaacaacaatttgctgctaaaatggttcttgaacagccattactcaaacaaaagcaacaacaacaacaaagtcatcatggacataaaggagaatctagtatgaacaaacaaataatactgcaagaattttatcaatattttttaaacaatagtatgccacaaccacgaaatttggacttgaattaccttcgagacaacggacatgattgcccctttttgactgaaatctcattacatttaaaagtacatcaacacccaaacatagcgactattcatcaagtattaaacattgaagattttgccataataatattgatggatcattttgagcaaggagatttgttcactaatatcattgatagacaaatattcaccaataatagtcatagaaaagttccaagaacagattttgaaacccaattattaatgaagaatgccatgttacaattgatagaagccattgaatattgtcacgaaaataatatttaccattgtgatttaaaaccagaaaacattatggttagatataatccatactatgttcgtccaactatcaataacaataataacaatggagaagatgatttatgctatgccaacagtattattgactataatgaattacacctcgtgttgattgattttggtttagctatggactctgctaccatttgttgtaattcatgtcgtggatcgtcattttacatggcaccagaaagaaccaccaattacaacacccatcgtttaatcaaccaattaattgatatgaatcaatatgagtcaattgaaatcaatgggacaacagtgacaaaatcaaactgtaaatatttacctacattagctggggatatttggtcattgggagtattgttcattaatatcacttgttcaagaaacccatggcccattgcatcatttgataataatcaaaataatgaagtgtttaagaattatatgttgaataataacaaggctgttttgagcaaaatcttacccatttcctcacaatttaatcgcttattagatagaatttttaaattgaatcctaatgatagaatagatttaccaactttatacaaagaagttattcgttgtgatttcttcaaagatgatcattactactatgctcaacatcaacatcatcacaatcacaatcaaatcaataatgcttacaatcactatcagaaacaacctaatcaagcaagacctattgcaaaccaacaattatatacaccaccagaaaccaccacttataattcatacgctagtgatatggaagaagatgaaattagtgatgatgagttttattctgatgaagaagatgaagatattgaagaatatgaagaggaagaggaagagtattttggtaatgagcaacaacaacaacagcaagtcacaacagtgaatggtaattttggtcaagttaaaggtacctgttattacgataccaaaaccaaaacaactacatatataaaaccaccagctgcatatactttagagacgcctagtcaaagtgttgaatactgttaa

SEQ ID NO: 6384 - DNA, 858 bp, Candida albicans
ccttcctttctgattttgattaaaagagaaatcaaatctttatctatcttcctatcacttaactatactattatgaatcattccaacaccactaataccgatagagatgcctatttacaattaggtaaatcattgaatgaacaacattcaaaccaattatcaacccaattacaagtatttcaatcggcattaataaattttgctaatgatcatggtgatgaaatatccctgaatttagaattcaaaaataaattcactcaaattgttcaactgataggtattgaccctttagatttattattatacacatcacaaaatgatagaaacggtggtactagtaatagtaatagtagtagtaatagtagtagtaattacaaaggaagcaatgttgttgcgacaaatttcggggttgctttagcggtgaaaataattgaaatatgtcaacaaactcgtgatttgaatggtgggttgatatcactaaaagaattaatttccacattacagaattcatgtgaaacagaaggaatatcattggtagtactggaaaaagacattgaaagttcattaaataatctaaacactttagggaaaggttatgaaatattgattataaatgggaagaaatggttaaaattttcatctacagaaaacttatctaatgatcaattaaaaatttatgaactttgtgaatttatgggaggttatgtcacttatagattattaagagataattatggttgggataaagtgcgatgtaaaactgtcattgatgaaatgattatgaatgggtttttatgggtggattcacaagacaatggcgaatggcaatattgggaaccatcttggatatccaactaa

SEQ ID NO: 6385 - DNA, 606 bp, Candida albicans
ctagttcaaagaaaaattgtcattcttggagatggtgcgtgtggtaaaacatcgcttttgaatgttttcactagaggatattttccccaagtctatgagcctacagtgtttgaaaattacgtgcatgatatatttattgatggtcaatccgttcaattgtcattatgggatacagcaggacaagaagagtttgataggttgcgatctttatcgtattccgatacccattgtattatgttgtgtttttctgttgattcaccagactcgcttgaaaatgttcaaagtaaatgggtaggggaaattgcagatcattgtgaaggggtaaagttggtattggtggcattgaagtgtgatttaagaaataatgaggatatagaagatcagcaacaatcaaatccttactcttcacaaaagagattgattacatacgaagaagggttagctgtggctaagaaagttggggccttacgatacttggagtgctctgctaagaagaacaagggtgttaacgaagcattttctgaagctgcaagatgtgcccttaatgccaaacctaaaggtgccaatgacaatgaaccacaaaagaaaggttgtgtagttatgtaa

SEQ ID NO: 6386 - DNA, 606 bp, Candida albicans
acttacataatggttaacggtccagctgaacttcgtagaaaattagtcattgtcggtgatggtgcttgtggtaagacttgtttattaattgttttttcaaaaggtactttcccagaagtttatgtcccaacagtttttgaaaattacgttgctgatgttgaagttgatggtagaaaagttgaattggcattatgggatactgctggtcaagaagattatgatagattaagaccattatcttatccagattctaatgttattttgatttgtttttcagttgattcaccagattctttagataacgttttagaaaaatggatttctgaagttttacatttctgtcaaggtgttccaatcattttagttggttgtaaatctgatttaagagatgatcctcatactattgaagccttgagacaacaacaacaacaaccagtctcaacttctgaaggccaacaagttgctcaaagaattggtgctgctgattacttggaatgttctgctaaaaccggtagaggtgttagagaagtgtttgaagctgctactagagcttctttaagagttaaagaaaagaaggaaaagaagaagaaatgtgttgtcttgtaa

SEQ ID NO: 6387 - DNA, 1239 bp, Candida albicans
atgtcatcgtcatcatcttcacttggtgttccacacgaaaacccaattcgtcatcgttcttcatctgttggtagaatagacgttggtgacacatctgcatctttatcaaccatgccaaccacgaggtctctgagaagaagatctattgccagattgaaagaattacaagacaattcaactacagattcagcaattgttcataaattatatgttgggtttagagaattaacttatagacacacttggattattcctttgattgttttactcatggcttttggtacatattatctttcatcaccttcaggaaaagttcatcaagtattagaagatatgattattccatcttatcatatccctggtactgatcaatatggtaaaggaggtaacgatttcaaatttgttggattttatgctatttttttcacttttttgagagaattcatgatgtgttgtgttttacgtccaattagtgtttggtttggtattaaaaaagaagccaaacagaagagatttttagaacaaacttatgccatgttttattatggtattactggtccatttggtttatggattatgagaagattaccattatggtattttaataccactcaattttatataaattatccacacaagactcatgatatttatttcaaaatttattatcttggtcaagcagcattttgggtccaacaatcagtagttttaattttacaattggaaaaaccaagaaaagatttcaaagaattagtcttgcatcatattatcactatagcgttgatttggtgttcttatagattccatttcacttggatgggattggctgtttatattactatggatatatctgatttctttttggcattatcgaaaactttgaattatttggaatctcccattaccggtccatttttcgttatatttattggcgtttggatttatttgagacattatatcaatttacaaatattatggtcggttttaactgaattcagaaccgttggtgatttcgaattgaattggatccctcaacaatataaatgttggatctcacagccaatcacttttttcttgatttttgccttacaattagtcaacttttattggttagtattgattttcagaattttatacagatatgttttcactggggttagtaaagatgaaagaagtgatgatgaagatgaagatgaagatagtgaagattctgctgatgaaaagaaaaaggaacaatag

SEQ ID NO: 6388 - DNA, 1263 bp, Candida albicans
ttatcaatgagattttcacaagctactgttttagcctttgcagctttatcgttagctgctccagcttttgaagctgacaataaaaacatcaaaagagaagattgtgacaaaacttcttttcatggtcaccacaaacataagagagctgttgcttacgactacgcttatgttaccgttactgttgatgggaacggtaatcctgtcactactgtcagtccagttctttctattgaaacaattgctaaatccgaagaaacttcatctacttcaacttcaatttcttcaactaccaccatcgttcaaaatgattcattgacttctgatgaaccaaaaaccctttcccttccatctggtactattaaaccatcctcatctgccaccgaatctcaatctcaatctcaatcatcttcaactggtggttctggttctggttctaccaatggtattgaaggtgatttggcagcttttgaagatccaactgaagaattccaagacggcgttttatcttgtagtgatttcccttcaggtcaaggtgtcattcctttagatcacttaggttttggtggttggtccggtattgaaaactccgatggttctaccggtggtaattgtaaagagggttcttactgttcttatgcttgccaaagtggtatgtccaagactcaatggccagaagatcaaccaagtaacggtgtttccattggtggattattgtgtaagaatggtaaattatacaaatccagtaccagatccaattacttatgtgaatggggtgtcaagaaagctaatgttgtcaacaaattgagtgaaactgttgccatttgtagaactgattacccaggtactgaaaatatggttattccaaccgttgttggaggtggtagtacttctgtcattaccgttgttgatcaaagtacttattacacttggagaggtggtgctacttctgctcaatattacgtcaacaatgccggtgtttcttgggaagatggttgtgtttggggtactccaggttccggtgttggtaactgggctccattgaattttggtgctggttatgctaatggtattgcttacttgtccttgattccaaatccaaacaaccgtgattcattgaatttcaaagtcaaaattgttggtgaatcaggctctaccgttagtggatcatgttcttatgcaaacggtaaattcaacggtaatagtgatgacggttgtaccgttggtgttacttctggtgaagctgactttgtcttgtataattag

SEQ ID NO: 6389 - DNA, 534 bp, Candida albicans
cttttattaacagtcttatcaactgctttggccactccattgcaacatcaacaccaccaccatcatgaacatgccagaagagctgaagtaaccaaagttgtttacgtcaacggcaacggtgacgaagttcaaagtcaagtcactgaaaacgcttcttctggtgcttcttctggtgaaactgccgaaaccattcaaactcgttcttcaagtgatgtcagcagtagtagtgacagcaacccagttgcttcaattgccagctcagttgcttcaagtgcttcttcaatcctcagtaatattgaaggtgatttaagtgccttctctagcccaagcaaaaaattcgaagatggtgtttacgattgtgattccgttccagttggccaaggtgttattggtgttgactggatttctggattaaatggtggttggaccactattatgaacgaaaacggtgacacctctttaaactgtaaagatggttactactgttcttatgcttgtcaagctggtatgtccaagacttcaatggccatctga

SEQ ID NO: 6390 - DNA, 1302 bp, Candida albicans
ctagacttcttcccacaaatgagttcaggatcaattgcaactacaacaatacccagtacaccaatgtctattgaatcaatagaagatcatcaatatcataattcttttttagccatggttgaaagaaatcaaataccgttatctagaaatctattaataattttatatttatcacatttattattacaaaataacaataccactattactccttatacatccaaatttatacacattcaaaattgtgttggtattgatgaattcactgggaaatcaatatatgatattgatattaatgatacatattttgtgattcattcattagtcattgttacatttcttcgttcattcttgatgaaatggtgttttgaaccatttgcatcgaaattttgtcatattcattcgaaaaaagccaaaactagatttgctgaacaaagttggtcatttgtttattattcaatttcatttatatttggcgtggtattatattgggatagtccttattataataatttagatcaagtttatatcaattggccaaatcattacatgtcatgggaatttaaaacttattatttagtaagtatgggattttggctacaacaaatttttgttttaaatgttgaaaaaccaataaaagatcattatcaaatgtctagtcatcatatcattacttgtttattgattattggttcatattattattattatttccgtattggtcatttaatattgatgattatggattcagtagacatttttttggcagcagcaaaaatgttaaaatacgctgggtttagtaatgcatgtgatgccatgtttcttttatttttagtcagttggattgtattaagacatggagtatataattatatcttttatcatgcttggtataaatcagttgatttaatgaaaaatggacaatgtgttgaaggattgatgcaaaaaagatgttggactccagttgttattgatacatttttgggtttactcggaggattacaaattataacttgtatttggatgtatttgatattaaaagttgcttataaagttgttactggatcaggtgctgaagatgttcgaagtgatgaagatgacactgatattgagttggaagaagaagaaaaagaagaagaagaggaggaggaagtaggacaaccaatatttgtggaaaaaaaggaagaagaagttgtattagaaattgaagaagataaatactcttttgaaagagattcatttagttcatcatcagaatcaactttggacgagaaaaaggatattaggaaaagaaaagtataa

SEQ ID NO: 6391 - DNA, 984 bp, Candida albicans
acagagatctcgaaaaatccattacatatgatggggtttaagaaaatattcaaggttgaaaaccaaaactcagagtataagttttccagaaatgatataaagtctagtcaactagggaaagggattaccggatcagttgacttgtatcaatctaaaacactaccacgtttccaatatgctgtgaaaacataccatactaaagatattcacgaatccaaaaaggattacaaaacccgagtgttgtatgaatatctaatactatcggaactatcacactgcaacattattaaaatttatgactatgatgtatcgttctttggatcaacgataaaactattcttagaattgggtactgccaatctaaaccaattgataatcaaacaaacaaacaccttcaacataaacgaaatgttgtgtatctggaaacaaatcaccaacgctgtcaattacttgcatgaattggatatatgtcatcgagatctcaaattagaaaatgtggtatttgatgttaattataagttgatcaaagtgattgattttgcaactgctcaaaaactcaataacgacgaattatcccatggcttggtaggatctgagagttatactgctcctgaaacatactcatcaatacagtatgatggaaaatcaagtgatgtatggtctttgggtataattttgtgctatctaattaacaagaaacaaccatggaaactggcaatgtggagtaactctgactatcagcaatttattaatcaagataattttctgcaagaaccatattttgttgattttccagttgaatcgttgttattgacgagtcaaatcctcgaacaagatccgttgagacgaattaaaattaatgacttctttagtgataaatggtttagtcttattcagtattgtggttgtggtgttgctggtggtggtattgacaacaaaacttgtgggattgatcatgggaaatccttcagagtcaaaacttag

SEQ ID NO: 6392 - DNA, 2706 bp, Candida albicans
ctttatatatatattttttttttaatttcctatatttacattaattttcttaattcatattcaagagacaccggattagtacccactttcagattgaacttaactttttggaataagaacatgtcagggttagaacatctacagaacttatctatccagccgtcaaatcggagtactcagcagcaacagaccaattctcagccacaatcacaatactcacaactggcggccaaacgaagatcagcaagagactatcaatttggagcgaaaataggagaaggatcatattccacagtatactctgcattggataaatacaccaatagaacttatgctattaaagtgttatcgaaacgacatatagtgaaagagaacaaaattaaatatgtcaatattgaaaagaccactttgaacagattgggtcaacaacatcccgggattgttcaattatattatactttccaagatgagagtagcttgttttttgttttggattttgcagaatatggggagttgttgtcaatcattagaaaatttggatctttatctgaatccgtactgaaattttacatgtgtcaaataatagatgcagttaggtttattcatctgaaaggggtgatccatcgagatttgaaaccagagaatattttagttggacatgactttaatttaaaaatcaccgattttggagcagccaagttattaggcaatcacgaagagttcaatggcgagaaaatagactataattcagtagatgccagtccagaggtatctgatactgatcgaaagggatcgtttgtgggcacagctgaatacgtttctccggaattacttaagcacaatatatgcggttttgaatctgacatttgggctattgggtgtatattatatcaattctttaatggcgttccgccgtttaaaggaagcaccgagtacttgacttttgaaaagattataaatgtggactattcatacaaatcacccatacccttaccgccagacgtgatccaattgattgatctgatacttatttctgaaccatctgcacgagcaacaatcccacatatcatgtcatcaaggtggttttctgacataccttgggacgaccaaaattttatatggcataggaaggttccccggtttgaagcatttggtgccattacaccgtcaccagcaatgcctccaatgatgaagaacggaaccaacagaaatgtcaataaatcatactcttaccatcaattgcagtcacagatactggcctctgagtgtggatttattccttcaattgcagcaaaaaaatcgtacaaaccaccaacaatgataaagaataacgtagcaatgcctgcgttgaatcaaactacatataatcataactaccaacaacatgtaccgctccctcctccagtatcgtcacaaccattaacacaacagaacgtaccgcaacaaattcaaccgcaaagaagtggttctgcacaaacgccccagtttgcaccagtttcagcttctagccgacaacctgttggtaacatgcaaactagacaagctgcaccacaagtattggtacaacaaaaaactccccctttcccaaaggagaagaacagtacaccaaatttaagggacaatacatcttttgcacaaatggctcccagaaggaatggggagatacctggacaacctcaacaacaaataccattgccaaaatcgcaacaatcaccacaaccacaaccaaaagctcaatatcaactacaacagcaaaaacaactggaagatataaggggttctaaaaatacatcagcaaatgcagcagccgcagcttttgctacaaaaaatttaccacagccaaatcacaaaacatctaaggactcatcaacaccgccaccaccaccaccactaccaccaaagatcaaaaaagtgcaggaaaatttcattaaatttaatgaagtctctgggctattgaagccggatgaaaagattttaaaaatggacaatttgatcaagctggtattgagcaagagatatctaaataaacccgaataccaggttttagatgattctgttttggatgaattgacatccaagtacgccagtatccttaaacaagaatctaaagcagttatcactattgtcactaacatggctcgtgtattctttatagatgcatttttgaatgtcatgctagtggacttgaaggcaaacaagggggcagactatctgatgtatgattatgaatttgaaaatacagttgatgaagatggtaatttactttcgaaacaggatgaaacgtttggatacttgataatcgaattgatcaaagatggtggggatttggtattcctacagagagttagcgacgagcaaagattaagattgaccaatgctgtcaaggttttagataaaaaaggcgaagaagtagttgttggatcaagtcatggatggattgactgcttgttaatagctcgagagatatcaatcgagcaaagcgaagataacaaaaagccacgatctgtgagctcgtcatctaatgtaagtattaatgaagttaaatcagagaaagccaaaaaaaagaaactgtcattatcaaataaaaagcccagatccaagaagaagggaacaagctctaatgggactcctcaaacaacaccaaccccaactcaacattcaaactttgcatttgcagcagcagcagctgtgcaccaccaaaaataa

SEQ ID NO: 6393 - DNA, 810 bp, Candida albicans
cttataagaatgcataaatttagatattctttgcaccaacactatagcaaacgcaattcaagtgacaaatccaaagacagtccaattagccaaaacagcaatgaagaaaatgattcgactaaattaagttcaagtagtcttcaagacttacatgatgatctcgatgatatttataacaactatactttagcacagggtaccaataacaacagtgtagatacattggattctgaaaataatcaagctataaataagtttattgataaacctccagcaattcatggtatggaaccacaactaccggtgatgcacgtttcttcacgattatcttccttaggtaataccaccaatgaaaccggtgaaagcatcgccaaaagtgcaccaggaactccgttatcttcacattcatttgatttcagaccgcatcatcctcgtgcagtaacaaactcatccctcaatgtattgttagacacccctaatgtcagttccgaattcaatcatttagtggatcaaacaccacccaatgagtcggtagaaaggtttgacgacagtaataatactgtggacaatacagaagaggaagaaaataatgatgatacagacgaaataccaaaatccgaaacattgaaacaaaacgaggagaattgggaaaaaaagggtgctgcagttaaaactatcaagactatggatggagaaatgaaaactattcggcgaaatgttactgatttcaaatttggtaaagaattgggtgaaggttcctattccacggtggttattcgaccaagccgctggaagatcattgtcgagaga

SEQ ID NO: 6394 - DNA, 1080 bp, Candida albicans
acaaaatttatatcaataatgcaacattctagacaaccttcgatatcgtcatcgattatgtcccaatcaaatcataatcatccacagaagatcggaccttggaaattaggtaaaactttaggaagaggtgccaccggtagagtcttattagctactcatcaaactactggtcaaaaagctgccgttaaagtagtttccaaatccgaattacaagacgaagaaaccgagaaaaatggagatggattaccatatggtatagaaagagaaattattataatgaaattattaactcatcctaatgttttgagattatatgatgtatgggaaacatctaaggctctttatcttgttctagaatacgttgaaggtggagaattatttgatttattggtggaacgtggtccattacctgaagtcgaggttatcaagtatttccgtcaaatcatattgggtacggcttattgtcatgctcttggtatatgtcacagagatttaaaaccagagaatttgttactagattctcaattgaatgtaaaattagccgattttggaatggcagctttagaaagtaacggcaaattattagagacttcttgtggttcacctcattatgctgctccagaaatcgttagtggattgaaatatcatggagctgcttctgatgtttggtcttgtggggttatattatttgccttgttgacaggtagattaccctttgatgatgaacatattagaaatttacttcttaaagtccaggctggtaactttgaaatgcccgttgatgaagttagcagagaagctagagatttaattgctagaatgttagaggttgatcctatgagaagaatatctactgaaaaaatcttaagacacccattgttaaccaaatacccaatgtcaaacgaagatttaatcagtgaaaaatcattaccacatccacaaactggttacaaatctttagggtcagttagaaacattgataaacagattttatcaaacttgacaattttatggaatgatagacccgaagaggaaattgttgattatcttttgaaagatggatccaatccggacaaaacg

SEQ ID NO: 6395 - DNA, 1575 bp, Candida albicans
gctactgtccggccagtgccgtgtgtgaaaacggatgagattgttgaagaggaccaaggccgtgtcaacaggagatcaacacgaaacacttactatgaaagggaaagagactatgaattaccagaaccaactgtggaagattccaacttgactgatgactacatgacagaaatcagaaaatcaagacttttgaacagtcagttaaatgttagggatccacttaatgaaaaaagaaaatctgaacccaagactcttattagcaatgttcaaataccgagtgttactagaaaatcaagaaatttcactacttccaacaaaaggttgtcggtattgtctatgtattcaacaaaggaatcataccgtgatttgaattctataattaactcaccagatgaaaaccccgaacagcatcaaaacatgaacaagccagcgttacgaaccagtattgctgatcgtttggataaagctggattggctgaaccagaatatgaaactgagactgatggtgaagataaagtgtctgttattgatttggatgatcatttagctgatagaaggacttcctattatgatggatctggaaagagagcatcaagagcttcaactactaaacgttacaatgttcattccagttcagggcaaagaccaaaatccaaagttcctgatttgccaaagaatgattatgatgacacatttgtcagtaatagtgatgaagttcataagcgtcagtataaatcgatggtttctgatgagtctagtgcatctgatgatgtatttgataagattaaattaccagatggtaaatcaactaaatcttccattgatgaattggctaacggcacgtctacaagtggtcatagaaaaccaaagataagacattctcaaccgggcccagaaatgttgattcctcatttgaatggaggtattgagtcgtctcaaccaatgtctaaagttcgtggtaacaattcaagtggtcatgatgatagtgttccaccaccaccgccagctcacaaggtgaataaaaaaccattggatgataagacgaatttccctccaccagaagtggatccaaaaagaaaaggttcattttttagaaaactttcttggggatccaaaaaaaccattgaaaataatacaaacgccgccactaataccacgactcaacaacaattaccaagtcctgctgaatcaaaagaggagaaaccaaaaagttcatttttcagatggttttcgtcatctaatactccatctgctgctgaaattagaaaattcaacactattttacccaaacatgaaatgtctactgctttatttgctttattgaattcttggtctaattttggtttgaaagatttacggaatgatcaagttggatattatattactggtgctatttctaaacataattcttttaatttaaagagttgtaaatttagaattaagattaatcaaagagattttaatcaaaaatcagaaattgtttgtgttagagtgaaaggatctaaagttacaactgatactttattttctgaaattgaaaaggtcttactcaaagaaggtgtcttagataaataa

SEQ ID NO: 6396 - DNA, 951 bp, Candida albicans
atcggacgtacatcgccttctaagagatattcatataatcaatccccaactaaatctccttacggaagaagatcaaattcacaaagacaatttgaaaatgaaccattaaaggcaaagccaagaaatatttacaatgagattgttgatgcacaaagcaacttttctctacctccatcgcttccaccttccttaccttcaaaagattctcgttatatgatcgatgaacccaatcaaccccagttgcaacaacctgctttaagtcaagtccctgaaaatcctattgttgatgaatcccctgatttaatgcagtcagcaaaaatttctagtggaaagagaaattcaataataggaaagaacaacaacaacagcaacagcaacaagagaatgtctaagagaaaatcaattcgtgcatctatgaccacgggattgaaaagaaattccataaccatgaaattgttatctacttatgctaaattatcaggtgatgacgactgggaatacatggataaacaaacaaaaagaacatcggctacttttgcagcattgtgtgacaaaatatttaatcaagaagactatgacgaagaagacgaacaattagttgatcctgaagaaaaggaagccaaggaatatgaaaggttaatggaattggaaagaaagaaacatgaagctgagttgaaagctagaagagaattagaaaagaagaaaagaagacaaaagagacgttccattttgagttctaagaaattaagtattattgtcaagaatgatgctgatccaaataatagtgaacaagagttggtcgatgaaggtataaaacaaccaaaacgtcaatccaaaaacttgaccgctttaagagcattatctgaaggaaatcatgcatctgaagaattgacattggaagacgttgagaatttgttcttcaccacaggggatcagccgatccgcgattag

SEQ ID NO: 6397 - DNA, 771 bp, Candida albicans
agactatataaaaagcaaccaaagaagaaaaaaaaatacatatataaatgtagattttcccctaattttgggttttcgcttgttctcatcaacaagcacacgatgaccaagacaggcaagtttacaccttgggatgaaaccactggaaacaagacaacgactgccaacaacacttcctatatcttatccaaaaagcctttgggagatggatcatattctgttgtatttgagtgcaaaaacacatctactggaagacactatgccgcaaagaaatacaccaagaggttgatgtatgggtttgagaatatgcttaaaaacgaatttaaagttttaaatcgaatttctttatctcatagtcatcttttgtcactcatagatttttttgaaactgaggagagcttctatttagtgacagatctagctcgcggcggagatttatggaacaagatagctgaagaagaaaaattaaatgagcaaaccactcgcacgataacaagacaattggtggaatctgtcgagtttcttcacaagcaccaaatacttcatcatgacatcaaagcagaaaacgtatttttccaaagtaaacaccaagatactatcttattaggtgattttggtctcgctaaaattttacagccgcaggaaaaattgcatgaagttgcagggactttaagtcatatggcaccagatatgtcggactacaacatggggtacgatttccccatcgatgtttgggcacaaggtgtgtgtgttaatcccatgctatgttga

SEQ ID NO: 6398 - DNA, 687 bp, Candida albicans
  unsure (458),(459),(569): Identity of nucleotide sequences at the above locations are unknown.
accatgtcaactcaatcaggtattacaatttcatcacaattgaatgatgcttataaaaacttgtctactaattcagcattaattattaaaatttcatctgattccactgaattgattcctgatcaaattatcactggatctgataatactacatcaaccactaaagatatcactattcttgaacctatatttgaaaaattgattaatcaaatatctcaagaattccctcatccttcatatattgtaatatcttataattctaatcaatatttcattagttttatacctgatattgctcctattaaacaaaaaatgctttatgcatcgacgaaaaattcattaattacaagtttaggtggtaataaattgattaaaaaatttgcttggacagaattagacgaattgacattaaattattttattaaatcaattgatgatgaccagggatctaacattannaaagaagaagaagaagaattaaatttattattgacagaagatgaaatcacattacaaaaattgaataatttatcactttattcaacaacaaatcatcatcatcatggatntaagaaaaaattgccatcaatgaccaatgatgatggttctactactggtaatggtaatgctgatcaagatatattatataaatttacccacaaattactgaacaattacaatcaataa

SEQ ID NO: 6399 - DNA, 573 bp, Candida albicans
atttacccacaaattactgaacaattacaatcaataattgagaattcttcacctgaatccagtaatgataatgatcataagaaatcattaatttcttttaatactgataccacaaaagagttattaactttaaaatcaattgatactcaaattgaaattaatcatttaattgatactttaaataaccatacttcttcaagaatttctccacaatatattttatataattatcaaattggaaaattggcattcatatattcttgtccatatggatcatcagttaaagatagaatgatttatgcatcatttaaaaatagtttaatcaatcatctgaatcaattgataaaatcaaccaacattgatgatgacattatcattgataaaaatattgaagttggtgatttagatgaaattgaattgagtcaattacaagatgccaatgaattaattcatgatactaatactaatggtaataataatagtagtagcaattctttatcttctaataattcatcattatcttctaaaaatggattgaagtttaataaaccaaaaggtccaagaagaagataa

SEQ ID NO: 6400 - DNA, 909 bp, Candida albicans
tccattatcaacccagtcatgacagatcacctaattgctaaagtacaagaacatgtacctaacattccattgaaaataatatcacaaggtgcagaagcactagtttttgaaacatcagttcacccgtactacaactacaattcgagtgaaaaacaccatgagtcaccttctttgcacaatcatacaacatttataataaaatatcgtcccacgaaaccctatcgtcaccctaaaatagatttgcaaattaataaatcacgaactattggcgaagttaagtttatgtataaactctcaaaattaaacattgcctgtcctaatatcattctgacagattttaataacggtatcatatggatggaatgtcttggatcaaaattgcccaatggcacaataagttcatttaagaattggttatggtatttagaaagtcaagagaaagaggatcccagtataaacctccatgacgatgaccaagtcgaattggtttgtcaaaaagttggacaattgataggtcgattacatttaaacgatatgattcatggcgatttaacttcatcaaacataattttaacagaggtggatactaagaaaaatgaagatacagatgccaataatagttcagtttattttgaaccggcgttgattgattttggtttatcttcattttcaggattagcagaagataaggctgttgatctatatgttttggagagagcaattctaagtacccattcaaactatgccgataaacttaatggctggctattagaaggataccaacaaatccatgattctattgaattcaataaaaccaaacaacaattaggtaaactgaaattaaaagatacgattaaaagactagaagatgtccgtttaagaggaagaaaaagaagtatgttgggttga

SEQ ID NO: 6401 - DNA, 1263 bp, Candida albicans
ttctttaatatcattcccttacaatctttaatggtagattttgcaaaatcattatttggttttggtaattataaaaaggaatcatcattacaatctcccactccgccaccaagtgctcattcatcacaagaacaacaccacaagtcaaacacagaagaatatcctcaatctcatttatctcaacaacaacattctcatcgttatcaaccgccgcacatgtctgaacaatcacaccaatttccacaacaacaacaacaacaacaacagtcaggcacaaacaaattctttccgaaaacactagtgagtgcagcaccaaccacggcagttgccaaccattcatcggtttacggaacaacaagcacaacaaccaacaattaccctgaagcatatttgaaccagacattcaagaataatatttacaacccacagcaacaacagcaacagcaagcacaacaaccaccaccagaacaacaacaatcttctgcaccatatcaaaactcagcaaatatccaacagccatatggcaaccaatggggttcctcacaagaccaagatgccaatatcatcacaatcgataaaacaggcaacaaactcagtcctgcatctagagactcgcccattaaaggcaaattaaaagtcacgatattggaagccaaagatatttttgccactcagccttatgttgtctgtagttttgagagttcagaatttgttaccaatgctcctgattcatatgggaaatctccagtgtcatcgtttggtcacaataacaatcaaggacataatggaccaagaaacatgtacaattccaatcatggaccttcaccaaaggcattacctatgaaaaatagtggtaatctatttggacaaagaccttcaatgtatcaaagacaattatctactcctcatttgaatttacccaatgattcttccaaccccatttggaatcatgatactatatttgatgttgtgggactgaaatctgaattggacatttcggtttatgatggagctcgagatgatgcatttttgggtcatgtaagaatatctccttccactgataaaaataataaaaatgaaagtgaatggttgcaattgggtgcgagaataactggtgagacggtttcttcaggttcaatattaaaattaaatgggaatatacctcatttgataataacatcaaaagatcatatggaaccacatgatttccatttcttgagaattataggtaaggggacattgggcaaattttcaagttcgtaa

SEQ ID NO: 6402 - DNA, 1131 bp, Candida albicans
aaaaaacctaatagagtttatgctatgaaaatcttgtcgaaaaaagttattgttaagaaaaaggaaattgctcatactattggtgaacgtaatattttagttcgtacttcagcagcgtcatcaccatttattgttgggttgaaattttcttttcaaactccatcagatttatttttggtgactgattttatgtctggtggtgaattatttttccatttacaaaaggaaggtagatttaatgaagatcgatcaaaattttatacagcagaattgattcttgcattagagcatttacatgataatgacattgtttatcgtgatttgaaaccagaaaatatattattagatgctaatggtcatattgcattatgtgattttggattatcaaaagctgatttaaatatggatggcaccactaacacattttgtggcaccaccgaatatttagctcccgaagtattattagatgaacaaggatatactaaaatggttgatttctggtcattaggagtgttgatatttgaaatgacttgtggttggtcacctttccatgcagaaaacactcaacaaatgtataaaaacatagcctttggtaaagtgaggttccctaaagatgtattaagtccagaaggtcgatcctttgtcaaaggattattaaatagaaaccctaaacatatattatgggcctcagatgatgctagagaattgaaagctcatccattttttgccgatatagattgggatttattaagagctaaaaatattcctccaccatttaaacctcatatagtatcagaaactgatatttccaattttgatactgaattcacatcagaaaatacttcagcattgaaaagacaaatggaaatggccacaactccattatcaccaggaattcaagcaaattttaaagggtttacatatgttgatgattcaactatggatgatcattttgctagatcatatagagctaatgcatttagacctcctgggtcatttataccaggagatcctaatttacctccagatgaagaagttttagctgaacaaattgaagaagaagatgaaatggaagttgatgaagatcaacatatggatgatgaatttgtcaatggaagatttgatctttag

SEQ ID NO: 6403 - DNA, 4140 bp, Candida albicans
aatcctccctgtgttaatacctctttccatttttccagtgcttatcaaagaaaacataaagtcaaattgctgcatccatataatcattttaacccttcgaaggaaggcatcgataacgtcaataacaggaggtctgttagctatgaaactcaacgaatcaaactaccgtttcaagcgatgaaactgcaaagcacagatactttacagccacgaatatcgtcagatagtctagtttattcttcttcttcttcttcatcaaacgtatatctgcagccgaaattaccatttgcaagatcatattcaagtatacctgaacaagtacatgatccgggttctagacaatccctgaaaaacagcaataccaactttagcttttctgaacacgatgactccatccaagaatttctaatatcgccaatccagtctgacattttcccttattccaaaaagccggtaataagtccagttttggagtcacctgaagctggtggagattctacaatagtggagacatcttcaccttcacccaccaagtctggaacagttagtttaaattcaaatgccattgggtcaattattggaagctatgactatagcaaaagctccttggaacttgaaaagccaaagcctgtagaggagcctgttttccaaaaagatcatgcccgagatcatgcccgacaaggatcagatgcatctactatatcgaatgggtcagaacaagtaagtaaggacaaaagatttgtgagatacgcaatgaacacacaatctcctttggtcaatgcttctaataaatggcaaatatctaatgtgatcaagtggttggataagaatcaatttaacaactcttggaaagaaacttttagaagaaatgagatatctggtaatcggtttttagaattagagaattttgataaagaatcaatgatttggaaacagttttcaaagtttttacaattagatgatgatttgaattcggtcgataggtttattgagttattacggaaagagtcctcacacgaattacagacaaggaagtcgctaggtggtggcgaaatatcacctatcaatgtgaaacacgaaaacagaaagtctactcctatatacaccaagcacatgtccacatcttcagtctcctcatcaaactcatcgtcgtcgatctcaagacctttatcgtatgtcgattccaaaccaaaagagcagttgtcatcaccttcacaccatctgtttttccgtaaacatagtcgtagcacatcaaatgaaagcaaggatgccaaaaagagatacagttcttttgatgataatcgcgttaaaagtgtccctaaaaatgataagaaaagcaacggtattctaagcacgttaaggaaatatggtggtgataaaattgcaaaaaatacaaagcaaaggagttcaacgtatttcccgtctttagatttacctccacctttagaatcagatcctcccgcatataatgaaaggaaaatctctgtcgatagtgagttgtcaccaaaatctattaaatccttttcagacgatttaagtattgatccaaaatatctccccactcaacatcaagaattggacttgcgaaaatttcacgattgtgaaccaataacgattttagccagtaaggataacatcctgtttgtgccgattgttataacagaactttcaaatgccaagtctcatatcattaaagctcttggattaattgatataggatcaatcacactacatttaaccgacttcttccacaaagaaggtgaagctattcctgattttttaataccaaaagttttgaagcttgatggcttgctcaagttttacgttcgacaagaattaaaatctcctgagggaacaaccactactttttcaacgacatcatccgactcaaaatcatatattgctgatgggaataaaacctaccctgaaacaccacagtacttgttacaggcacaacacgatagtcgagtggactattggaactttaaagatttaacaagtatatcagaagatccatcaaaatctctagctggggctaaacaaaacattgattcaaaacacaacgacacaaagcaaaaaccaaaggaattcccattgaagttcccatttgctaacgcacccaaaaagggaaataccgttccacaacttcagattgatacgtctggtgtcaacaatatttcaaaaccacccacactgacgggttcgacattccaagttcttcgtaaaaaaggtcatgagattgattttgataaaagacggaaatcaccctatgaaagcaaaactccaaaaattattgctaatatttattcttcttcagtggcaaatacaaagaaatcaccaatatctgcatcaacggtcatggcattaaaagatgatgtagtggttcagaggccggagacaatcagtcgaagcaattcaattatagctaaaagggctgctccgccaccaccaggtgatcggagagtacaaattcaaagacacaactcgattcttagacgcaaacctggattgaaatcgaccaataatgttacttccggaagtagtgaaggaagtaaaaagaatatttcggattctactgacgacaacgatagtgaggatgcattttttgtaaagccattaaagaaaaaagagaacgaacttggtaataatagtgataataattctgaaaatgatgaggacaacgactctgatgacgatttttttgtcaagcccatcaaaaaagaggttgctgatgtttctgcaggaaaggtagagttggatgattcagaagaagatttctttgtcaaaccaattcacaaaaaaccatctcacatgaatgtgagaccacctgttgaggaagtttataacaatttggaaaagtatttcccatacacaaatttagacaagcctattattgatgactcgccagcatcaccatcgcctcaacgaagacctaccatctccagaactttttcaagtgccaataaatcaccagtagctcccacatcggcagattccaaaaacacgaacgacgagcaaccatcccttagagtacgtcgtatgaaaaccattagaggtgttgccaatgaggctcgtcgcaaagttcttcaaatgaaacaagcttcacctcctaatacttttgctaatattacccgggaaaatagtgccaaattgactagatctaataccaaaatgtggggtcaaagagttgttgaagtgacatcacaagagatagaaaagggatttgtcagtaaacttcgtaataaaaatggattataccaagaatatgcatggattaaaggtgagttgattggaagaagctcctttggggatgtttatctaggattaaatgttaccactggtgaaatgcttgctgtgaaacaagtggtatgtggacgcaacaacaaggaaggcattgaggccttgcataaagaagttgaaaccatgaaagatgtgaatcatatgaatattgtgcagtatgtgggctatgatcaacagaaaaacatctacagtttgtttcttgagtatgtggcaggtgggtccattgctttatgtctaaagtcctacgggaaattggaagaaactttaataagggttatcacaaaacaggttcttctaagtctaaaatatctacactcaaataacattattcatcgagacttgaaagctgataatcttttgttagaggttgatgggacttgtaaaatatctgattttggtatatccaagagatcaaacgatatctatgctaataatgcgaacatgtccatgcagggtacaattttctggatggcacctgaagttattgatagtatggttgaaggatacagtgctaagattgatatttggtccttgggttgtgtcgtgctcgaaatgtttgccgggaaacgaccttggtcaaatgaggctgccattagtgtaatttataagactggtaaggaaaaacttgctccaccaatccctgacgatattgcccatttggtatccccagtggcagaatctttcattaatcgatgcttcactatagacccaaaagatcgtcccactgcaggagagttgctcaatgacccgtttgttaatacattagatcatgattttaattttgcaaacactaaacttgctgaaatgataagatataatagtaaaagattatttacatga

SEQ ID NO: 6404 - DNA, 972 bp, Candida albicans
atctacttcaatatgagtagaaagcctagacgtcataatgaaaccaagtcaaccccagacaatggtagtgatggtatagaccttttccctttcactacagaggattgtatggagccacagaaaatcattgatttatttgaagtttgttttaaacatgttttagaaagtcccgatttacaggaacatattcaagttgtcaagggtgatctatacaatcgagattatctagcagcattcaataatgacgataacagatttgcctatgcatgcagatggtcgcctgccagagcattggcttatagttctgttctagcatcattggaacccatcaaaactctattagaagacccagaaacagtcagaaatgtgctatgtgttggaggtggtgcctcttctgagttggttgccttgggatctgttttttgtcgattgaaagagtatcatcctaattcaccttcacaattaaatatcaaattgattgatatcgccgattggtcaaaagtggttagtaatctcacaacatacatgaaggacagttgggtttatcattctgaaaaattaaattcccaattcatttgcaatgacatcttaacttcttcccctgaatcattaaacttagaatcgttggatttgataacgttactattcacaaccaatgaattgtttgcagaaaaaagaaaggaaaccatcaagtttctacaattattgaacagtaactgtcgacaaggaagtttgctattgattgcagaaagtgctggctcttattcccatataaagataggtgataaaaacttccctgtacaatttttaattgatacaattcttgttggaaagccgggtctgaataacggttcctgggaaattataagccaaagcgatagttcttggtatcgtataaatcagaaagaagtggattatcctatgaaattagaaaatatgagattcttctatagattatatatcaaaaaatag

SEQ ID NO: 6405 - DNA, 519 bp, Candida albicans
ttgcggatcttccagcggcgtggtgggccaataatatttgaattaattactggggattttttatttgatcctcatgatggtaaatgttttgataaagatgaagatcatttagctcaaattgttgaattattaggtgatttccccaacgatgaatatttattaaattgtaaattgactgggaaattttttaaattaaatccgaatccagaccttaaaggaaatctgcaaattatgtttaaaaatattgatcaattgaaaatttggaaattaaaagatgttttagttgaaaaatataaatttaataaaaatgattatgaagttgatttaatttgtgatttgattttaaaatgtttaaaatatgatttaaatgaaagatacgatgctaattctttattaaaacatccttggtttgatagtgataacaatagcactattagtcctggattggaagatagattgaaaaatttaccaaattgtcatgatgatttaccgggttatacatgtgaatgtaaaatataa

SEQ ID NO: 6406 - DNA, 1731 bp, Candida albicans
cggatgaaagtcaccactagtgatattcatcatccaggtcatcaacatgtcatacaattattagatactttcactcataaaggacctaatggggttcatgtagtgatggtttttgaagtattaggggagaatttattaggattaattagacgttataaacatcgtgggatccccgtagtatttgtcaaacaaattgctaaacaattattgtcggcattggattttttacatcgacaatgtggagttattcataccgatttaaaaccagaaaatattttaattgaaattggtgacgttgaacaaattgttaaattagttgaagaagaaaatttacaacgtaaattacaaagaaaattatcaagaacagcttccaaaacatcaacaccaattagtgctacccctaatagttcattttcaaatcatgccaacacaaccaccacaaccacaactactactgccaagaaaatatccattaacgactctattatttcacctaacacttctagtacagcattaacaagtagtaattcatttattaaccattccccttcattaggtagaagtggaagaagaactagacgaacaacattaatcactggatcacaaccattaccatcgccattaagaagtttcaataaatcatttaccaatgtttatggattatcatcatctactactaatactccagttcgtaacatttccattaatagcaacaactttagttttattaacaacagtaacactactgccaataccaccactaatgggttggctactactactgaagatcatgaggaagacggtgaaaaccaaacattaaacaattctttatcttcaatgtcaattaccaattcccattccaactccaatagttatcaaccaactgctacaaccaatgttgatccagtacaaattccacaagaatcaaattattcattggatgattcatcagctaatgttgttgaagatataatcaatgataatgaattaatatctgttaaaattgctgatttgggtaatgcatgttggacaaatcatcattttactgatgaaatccaaacaagacaatatcgagcccccgaaattttaattggttattattggggtgccctgagtgatttatggtcatttgcctgtttaatatttgaattattaactggtgattatctatttgatcctagagatggtaaatcatataaaaaagatgatgatcatattgcccaaattattgaattgattggaccatttcctaatcaaatgttaaaagaaagttattatgctcgagaatttttcaattcaaggtatgaattaagaagaatcatgaaattaaaaccttgggggttacaagatgtattaattgaaaaatataaattccctttgaatgatgctattgaaattagtgaatttttattgccaatgttgaaattaaaaccagaagaaagagctgatgctggaggaatgttgaatcatccttggttaagagatgctttaggtttagaaaatgtggttttggaacgaccagttggtggttcaggtgaagatattcctggttggtcaagagaaatttctactactacccaacaatcaatgtcttctaacaatcataatcataataatactcataataataactataatcatcaatcagatcaggaattacaactgcaacaatcacgcaaatattccaatgcaagtagttttggtcataaaagccaacctttctatcattag

SEQ ID NO: 6407 - DNA, 186 bp, Candida albicans
tacacagcaccaatcgaatacatgccgattgatgatgttgagacgctcgaccggtatcgtccaggaggataccatccggtaactgtcggagggcagctgggtggtagatattctatcgtccataggcttggcttcggttcatactcaacgatctggctggcaagaaaccaggacgccggacgatag

SEQ ID NO: 6408 - DNA, 2367 bp, Candida albicans
aacccagagcatatattattagatgacacaatgagaattcaaattacagattttggtactgcaagattattagagcaaaagaatgatgaaagtgaagaatacccagtggatgtaagagcaaaatcatttgttggaaccgctgaatatgtatcccctgaattattagaaaataagtattgtggtaaacctggagatatttgggcttttggttgcatcatatatcaaatgattgctgggaaaccaccatttaaggcaactaatgaatatttaacgtttcaaaaaattacgaaattgcaatttgcgtttagtgcaggattccctacaattattagagatttaataaagaagattcttgtgttgcaaccttcacgacgtgccaccattccagaaatacaaaaacattactttttccaatcggtcgactttaaagattttgatctgatttggttgtctgatcctcctgaaataggaccttataaaatgacagcaaaatccatgatgaaagtaccggaattgaataaggcacctataaccacagtcattaagaagaatgtgaagaaatccacaaactcaaattcaaataccaacaatgtcgccactgctgttggtggtggtagtagtaacggacataaagggtcatcaccgactcctgagaaagagccgagcccagctactattaataacaagtccacagaaaaagttagtgccgctagtgtagctgcatatgttttaaacaaaccagctacaaaccaaaattccagtacatccgaggattcatctaagcgtagcagcaactccaatgaaactcgcaaactttcatattcacaacaggattatattccgggaacaaatattttacgtccacagattagtactagaccgtcagtaggatcttatgtgaaaaccacaccatcaaaggatagaaaaacattaaccaaggtcccactgaatatccatcaacaacaagaaaaagtgaaaccgaaagtaatggaagtgaagccagcaactacattggaagctgcatgggaaccatatttaacccatccagatgaaagaatacttcgtattggcccagttattgctcataaggaaccaacagaaccatttgaaaagaagaataaagcgtctttacatatatcacatttggatataaataaagaacaaagaagtagatccaatactagtttacttacacaaattgtaaatgaagtaaacaataacaccagtgaattgaaaaaagtggaaaatgctgatgaatcacttgccattattgaaccacaatataatatgaagagaagtccaacttctgatagtaagaaaagtatggatattgaaagatctgcatctacttctggaagtagaattagtaaaaaggcaattttcaaaaaattggggtttagtcatttagaaaaaaatgatactgaagaatcgaatggtcctagtttaacggaaaaacctcaaacttgtacattggttgttacaactcatggtcgagcattacttttcattagaaatgatatagaatccaattatcttttaattgctgaaatcaaattgaaatatccatttattcacttccaagaattagtcatatcacaaaataaattttctaaattagtaccatcagttggggtgtttgtcattagttcaattgataattcattaatttttgaagtggaaaaatttgaagtgaatcaatggactgaagcattagctaaatctaaatataatgaaattgaaagaggtaaattagctgcatatgaaagtcaagtatcattgaaagaaccagttgtgattacaaaacagtcatcatctacttataatagtacacgttcatcaccaaaacttttagatgctccagcatttgattcttcagttgcaaaaactaataatcataaaaaatcacagcagcattcttctccaacagttaggaagtcatttgaaacatcaagtccatcatcacattcaccgcgtacagctgccacaaatatgtttaaaatgaaattacaatcaggtactccaaagaggaaaccaccacctccagtgagtccacctcaagaattaaattctcatactggattacctagaagatcaactgaaaatggaactttacatgctgctcaattggcagtttctcaagtttccccgaaaggatattcaaataatagacgatcaagttttacaaaagaagatggaagcaaaattgatccaaataaaatgagaaaagctgcccatacttataatcacagtcatagtcataatggtaacaacggcaacagtaacagtaatagtaatggtaataaaagtggatctggggtaactgcattaaattctaaatttttagctagaagtactaggaaaaaatga

SEQ ID NO: 6409 - DNA, 846 bp, Candida albicans
  unsure (40): Identity of nucleotide sequences at the above locations are unknown.
atgtcattgttctcattggcccaaagatgtggggactcanagacgaaccaaaaattttatgagtttaaagttcttaaagatatgggggaagtggcttatgggaaagtggtattagctcaacatacacaagatccactttacaaaattattattaaatgtatcaacaaggaaaggattttagttgatacttgggtacgtgatcggaaattagggacaatacctagtgaaattcaaattatggcttatttgaacagtgaacctcatccaaatattatgcgaattattgatttttttgaagattccaaatattattatttagaaacacctatttttggtgatcctccagctattgatttgtttgactttattgaaatcaaaaaagatttgagtgaagttgaatccaaatttatttttaaacaaattgtttcatcaatttatcatttacacaaaaatggaattgttcatcgagatattaaagatgagaacatcattgttgatgaaaagggtgtaatcaaattaattgattttgggtcagcaggatatgttaaacaaggtccatttgatgtatttgttggaacaattgattatgcttcacctgaggttttaggtggagaaaaatacgagggaaaacctcaagatatttgggcattgggaattttgttatacacaatgttatataaagaaaacccattttataatgttgatgaaattatggaaggggatctaagaattccctatgttattagcgaaacaagtttaactttgattaagaaaatcttggttcgtgatgtggatgaaagacccacaattactgatattatggaggatgaatggttacagatctaa

SEQ ID NO: 6410 - DNA, 2799 bp, Candida albicans
  unsure (1904): Identity of nucleotide sequences at the above locations are unknown.
gattcaaatgcccggccaaatcgttcttctcgcttgtttacgtcatcccccacttttgccaactataataataaacctcctacccccagtgccaatggcgatgacaatggtaatagcgatattgaggatatattaaagtttcctatagagtcatcccatgcatattcatatgctcatttatcaccaaactctttagcattgagattaaatgtgttgaagcgatctttggaaattctaaaggaccgtcctgaattattcaagtcattgacaactactaatagtgcaaccaatagccctgttcagtctagtgctccacctactgctactagcataaacatctcaattgatgaagcatccccacttttccgatcagcttcacatccagttgaaatcgatactaatatgtcaactgaggatttatcactacaacctccaccattaagaaagacattatacatgcagaccaatcatagttctgattatatacatgacgtttcaggtgcatcttcgttgtctgctaatgaacacaagaactataaattgcgttctaatgcctcgtcagctgcattagctgcattgtttagacctactatgaaaagatcagatagtttgccattaaataacaatactagtattccagttacaggacgcagagtttccacacctccattagtacgcgaattaccaacgtcgcggaaaacctcttcaagcaaaaataaaaatgatgattttaaagacattatagatttattagagaacgatttgagtgcattattagacaattcagaggtagcaaccacattacatgatttatcattgtctacacctgataatttggacgatacaaactctaatcatgatatactaaagcataaattgttgcatgcattggctatgccatttatagagaattcagttcaaccaacttcactcttggaatttgatggaacaagcgatccatctttaaactcctcgcatgtgcgtccttcaaccacagcattaaacctactaaataacaattatgatgagccacctgcaaaaaacagatttaacaacaacaacaataataattttaaaaacagtgctgctagtcgaccattccattctttgttgactactaagcatgcacttcctcagtctgtgtttacagtggataaagatttaccattttcagtcaaagcagcaaatgatttagcatgtttaatgtttggtgtcctgaaaaacactatcaaagccttaactttaatggatttaattgctccacagtttcgagattttgttttgaaaagaatcacgggtgtacaaatcatggaaaacaagaaaaatagagatagaattttgtttgctggtgaaattgttgccattgttagacccggtgaccaaaactattcatggacctcactatgggctaaacgtaaaggaaatttgattatatgtatgtttgaccaaatcccttgtgatgcatttgacgttgtgatactgagtgaaaaagatgttatcgattacaaaatcgattctatcaatgaaatcgctggaagtttaattgaagattatggaattcaaaatctcagcagtttgaatagcttgagttattctttaaataaggaattacttgagttccatcacaacaacgaagcggaacaagatgcaattgatgaaactgaccaaacaaatcataccaataacaccaatcgcgacagttttgatattgacgagtattatgatgaagatattgaattgattaatcaaaccagatactatacattgcaattggaagatgaaaataatgttccatgtgcaataacttcaactccattagaactggaccaagagaaacacgagattaagttgaaaattcacaccatgccgtacattgctggtatttttgttattgatagtaatgnatacaagatactatcatgtaacaatgccattgctagagacttatttggcaaatcatttgacgaattagaaaaccatagtatagatgaattgataccaaatttcaccaaaatattacatgctggtattgaagccacttcaaattatgcatatcaattgtctccagggttggttttaccagaacattttttcagaaaatacgatgcatttattaaaaagcaacaaaatcctgagaatgaccaagaatctaaggaaacgatattttttaattcaaaaggtattgaggctgttcatcgtgatgggaaagtggtttacattgatgtgcaagttagagtttcaacgaacaatacgttagtggtctgggttacatattccagaactaacaagaaccgaaccaatatttctgaggaattggacaaattgagctctgcatcaacgtcttcttcgatttctttggcttctagtaataaatcggcagtttccttatcttcaatttcaaaacctcgaacttattcaagtggcctacaacttagtgatttaaaacagcaacaacaaccacagcatctgccgctgctgctgctgcaatttcttaccaaaccttcacagcaacaatcggcaaatctgttacaaaatattggtggccatgaacggaaactaactacaacatctactgttccatcgcaaatgaaattgtttaataatgaaaaagaaaatgatttattagaattctcacctcgtgagattacacgagccctgagtacaagaaaaccaaagaaagaaacttcattgggaattcccttgactagattggacagtcatatatatgacaagaatggcagagagcaactaaatctacaaaggaaagaagataagagaccagcagaagatcttctgaat

SEQ ID NO: 6411 - DNA, 1086 bp, Candida albicans
tccctttacttaacaatgtcaactgatcatcattcccatccagttgaaggacatcaattcaaaaaaatctttaatcgtttaagtggacaaccagaatcatatagtcgtaaacaaaattatacttttggtaagactttaggagcaggatcatttggaattgttagatatgctagagataatagtactgatgaagaagtagctgtgaaaataattttgaaaaaagctcttaaaggtaatgaatcaatgattattgatgaaatgcaattgttagaacaattaaataaccctcatattgttggatttagagattggtttgaaagtaaagataaattttatttagtgactcaattagccactggaggagaattatttgatcgaattgttcaaaaaggtcgattcactgaacatgatgcttcattagtagtacttcaaatgttggaagctttggaatatttacataataaagatattgttcatcgtgatattaaacccgaaaatatattatatttaacttcaaaagatgattcccccattgtgttggcagattttggtattgctaaacgattacaaaatcctaatgaaaaattgacttcatctgctggatcatttggatatgctgcccctgaagtcatattaggtactggtcatggtaaaccttgtgacatttggtcattaggtgtggttacttatactttattatgtggatattctccatttagatcagaaaatgttcaagatttcattaatgaagtgaaacataataatgctgtgattttccatgctgattattggaaagatgtctccaaagatgccagaagatttattatcaaggcattacaattcaaccctgataatcgccctaccgccactgaattattaaatgatccatggttagtttctattgctaaagaatataaggaaaccgatttattacctaatttcaaacaaggatttgatgccaagaagatattcagacaagcaattgaattggtgaaattgaataatagaattaagacattgacagaatggcaaactgatgaagatgatgatccaacggaaattaatttatttaatgaacatggtagt

SEQ ID NO: 6412 - DNA, 1458 bp, Candida albicans
ttatttatatactcatattcatactcatactcatactcattccattcctttattcatttacatatatatatatatatattatcttatttgggatttaccattagtttgtacaggatatacttttttctatggatcaatatttattaccacatgccattcaaaaatatattcacatcgtcttcttcatcatcttcattaaatgaagataatgtaattaaatcaacatcatcacatcggacaattcttaaacaaagagatacttcttcattactggcatcacctcaatcaacatcttctaggattaataataataataataatcatcctcgaaatagcaacaataataatatcaacaccgatcacccaatgcatattgctcctagtataaatagtaatatgagtcaatcaagtctaagcactgctggaactactggaactaccaccattaacaacaacaacaacagtacaacaacacattctcctacttctactaaatcccatcgtggtccttcattaaggagattctttaaaaaattcaaaccacgtgaccaccacgataaatcactgtcatcccatcaacaacaacaacatcatcatcatcatcatcatcattatgaaaagcaaaaacattttggtgctggtaaaccggctccaattaattctaatgccacaaatttatttgctaaatatggatcaccagggaaattattaggtacaggagctagtggatcagtcaatttattaacatctaaaaatgatcctaccaaaatatatgcagttaaaaaatttcgagcacgaatgactaatgaacaagaatcagattataaaatcaaagtagctaatgaatttaaagtgggagaaatgttacaacatgaaaatatcattaaaacttttgaattaattaaagattattccaatactactaaacaaattattgatcctgattattatataattatggaatattgtcaatatgattttttcaatttagtaatgagtggattaatggaaactaaagaaatttattgttattttaaacaaattataaatggagtagcatatttacattctaaaggattagctcatcgtgatttaaaattagataattgtgtggttaataaatttggtatattaaaattaattgattttggttcagcagttcatttccgtaaagaaattccaaaaggttattatataacttctgatgatattatgttggctccaaattataaattgattcgtgctagaggtgtagttggatcagatccttatttatcaccagaagtatttgaacctttaggtatgggatatgatcctcgtggtgctgatgtttggtcaattgccataatttattgttgtatgattttgaaaagatttccttggaaattacctaaattatctgatccttcttatcgatcatttgctggtcctcaattaaacaatcacaaccaccatctc

SEQ ID NO: 6413 - DNA, 1401 bp, Candida albicans
  unsure (1236),(1237),(1241): Identity of nucleotide sequences at the above locations are unknown.
atcctttctccccctccctcctgttatttgctttttccattcatcatgccagatagacataaactcaaactatttggaaaaaataaacacgacaaagatgacgaattgtccttgtcaacgtcaaaccattctcacggaagtacacggaagtttttaggatttcatattggaagacatgaatcgggcgactcgttgacttctccagttatgagcaattcatccgaaagtcatcatcacagccatcaccctcatcaagccaattcaagtgcaaaccatcgtaacccttctccagttcattccaatactggtactgccactaccattccatcaatacaatcaccacaacctcaagcatctggattacaccgcggggactccgataaaaaatcatctggctcagttgttgatttgaaaaaattcttcaaaacaaagaaaacttcaaatccaagaaaggaaggacatagtattttgggacaatatagcaatcagctccattcaccaccaccaatggcgcaggttcattcgcctggtgcagggtcggggaacggcagtgccttgcaatcacgtgaacaatcatctacgtcattagccactttaatcaatcaaacatcttctcaacttttgtacaatgcttcacattctgtcaatagcaatcgagatcccttcacggacgacaactctccattggtgaaaaagtatggtaagatcgggaaagagttgggcagtggagccggtgggtccgtcaaattaatcaccaggcccagtgactccaagacgtttgctgttaaagaatttagagcgaaaagatctactgaatcattgaaggattacactaggaaatgtactgctgagtattgtattggttctactttgaggcacccaaacatcattaaaaccatcgatattatccatgagaacaatcgttattttgaaattatggaatatgcacctatagatttctttgctgttgttatgagtggagagatgtctcgaacggaaatcaattgttgtttaaagcaaattattgaaggtgtggcatatttacacaaattagggttggcccatcgtgatttgaaattggataattgtgttataacgaatgaaaggattttgaagattatcgattttggtagtgctgtcattttcaagtatccctacgaacagtttggtaacaacaattctattcagccgtgtcatggtattgttggatctgatccttacttggcccccgaggtnntganatctcctaatagctaccacccacaacctgtggatttatggtctattgccataatttactgttgtatgactttgaagagatttccttggaagatacctattcgagaaaagggatacagtttccgactttattgcatgtatgaagataattcccaggattaa

SEQ ID NO: 6414 - DNA, 858 bp, Candida albicans
agacgcttctccactttatcctctccatcaattataataaataacaacaaataccgcatcattagactattaggcgaaggtggattttcgtatgtctacttggtgtcttctcaaagccaaccgtcatctcaatatgctctaaagaaaattcgttgtccctatggaattcaagatgagagttttaaaaatgctgttagagaaattaagaactaccaccgattcaaatcaccatacatcatttcaagtatcgacgaattaatacaactggaaactgacgggtcaaaaaatatttatattctattgccatttttccaaaagtctttacaggacatcatcaatgagttggttttaaataattctaaaatggaggaatctgaaattctaagagtttttattggtacttgccgtgggttgaaagttatgcacaaccacaaaaaaactgcaacttcaacaacacgattggatgatgatgaacaagacgtgttattgccaactagtgaggatgacgaatatgaagattttaccaacagcaccgacaacaacaacaacaacaacgtccagatgcaagagttggttccatttgctcatcatgacttgaagccagcgaatgtcatgttatccgctgaagggttgccagtgctttgtgacttgggatcgtgttcaagagcaagaatatcggtccgcaatcgtcaacaagccttgactgtacaggagtttgcccaagaacactgtactttaccgtatagagccccagagttggttgatgttgccactaattgtgaaattacggaaaaaaccgatatctggtcattaggatgcttattgtattgctgctgctttggctattctccattcgag

SEQ ID NO: 6415 - DNA, 1317 bp, Candida albicans
gatcaatatatcctatcgttatcctcctccttctcctttcaacttttgaaaaaggtgatattattcaacactgtttctgttttatcaaccaaaaccaggatgacatccatggaaccagcagacacaagcatcaggtcattaaacgacatcaacttacaagaacttgccaacaaacaacatcaacgaaatataaatgctcaaggatcacatacactagaagattcaataacatcaaatggtaatgatattaataatcccaacaataatataaataaaaccaataataacagtaattcaagtctttccttgaccaagaaaacatcaagacatatcaataaagacactacaactaaaggcaaatatacattaaatgattttcaaatattacgaacattaggaacaggttcctttggtagagttcatttaactcgatcgattcataatggtagattttatgctatgaaagtattaaagaaacaacgagtagtacaaatgaaacaaatcgaacatactaatgatgaaagaagaatgttaaaattagctcaacatccatttataattcgaatgtgggggacattccaagattgtcataatttatttatgattatggattatatagaaggaggtgaattattttcattattaagaaaatcacaacgattccctactccagtagctaaattttatgctgccgaagtatttttggctattgaatatttacacagtttagacattatttatcgagatttaaaaccggaaaatatattattggataaaaatggtcatatcaaattaactgattttggatttgctaaagaagttcaagatgtgacttatactttatgtgggactccagattatattgctcctgaagtggtggcaacaaaaccttataataaatcagttgattggtggtcatttggtatattaatatttgaaatgttaactggttatactccattgtatgatcctactccaatgaaaacttatgaaaacattttaaatggatcaattacttatcctgattatttacctccagatatattggatcttctacaaaaattaattgtcaaagatttaactcaaagattaggtaatttacaaggtggttctgatgatgtgaaaaatcatccgtggtttaaagaagttatttgggaaagattgttgtcacgtgatatagaaactccatatgaaccacctataacttctggtgttggtgatacttcacaatttgatcgatacccagaagataaagatttggattatggtataagtggagttgaagacccatatcgtgatcaattccaggacttttaa

SEQ ID NO: 6416 - DNA, 1212 bp, Candida albicans
ccttccccctttttgatggtgaatcttttaaagaaacttcacatcaccaagctgcatcaactgaatcattccaattcggacagtaattccttaaactcaaacacatcaatggacaatcatcaacaacaacagcagcttcagcaatatcagcaacaatttcaacaaccgcagcaacaactttatccaggcgaacaaatagttcaccctgctgcagcccaaactggacaaaatactacaaatgtaacagcagtgtcgagctccaacattacccaatctgctacctcatcactccattcacagcaattgcagcatgtagatgtttccaaatcggctgctgaagaagccatcagaagatcgttgttgcctgaacgttctactgtttcaaaggggaaatactctttgactgatttctcaattatgagaactttgggaacaggttcctttggtagagtacatttagtgagatcagttcacaatggtagatattatgctatcaaagttttgaagaagcatcaagttgtgaaaatgaagcaagttgaacacacaaatgatgaaagaagaatgttgaagttggttgaacatccatttttgattagaatgtgggggactttccaagattccaaaaatttatttatggttatggactatattgaagggggagagttattttcattgttaagaaagtctcagagatttcccaatccagtagccaagttttatgcagcagaggttaccttggctttggagtatttgcacagtcatgatattatctatcgtgatttgaaaccagaaaatatattattggatagaaatggtcatataaagattacagattttggatttgccaaagaagttagtaccgttacatggacgttatgtggtacccccgattatattgccccagaagtcataacaaccaaaccctataacaagtcggtggactggtggtcgttgggggtattgatttttgaaatgttggcaggttacactccattttatgattcgactccaatgaaaacttatgaaaaaattttggcaggcaaaatacattacccaagtttttttcaacctgatgtgattgatttgttgactaaattaataactgctgatttgacaagaagattgggtaatttgatcaacggaccagcagatatcagaaatcatccctggtttctggatcttcaccacgagtgccggatcccgcatatttag

SEQ ID NO: 6417 - DNA, 2856 bp, Candida albicans
ctgcacaatttaatgatttttatttggaaattacttcaccgaaaaataagtcaaattggcaattataaaatcatcaaagaaattggagaaggagcatttggtaaagcatatttggcaactcatatactactaaatattaatgttgtattaaaatgtggattaatcgatgatcctaatattgttcgagagatatattatcataaacaattgaaacataagaatatagttagtctatatgaagttatcaaaaccgaaaatcatttatggattgcattagaatattgccaaggtggtgaattgtattattacatatatgagaaaaagagattagaattagatgaatgtcgaaatatatttttccaaattgtcctaggggtcaaatacgttcattcattgaatttgagtcatagagatttgaaattagaaaacatacttttagctgatcaaaaaagaactattgttaaattgactgattttggatttattagagagttcaacccgcaaagtaggaagtttttgtcaactatatgtggtactacggtatatatggccccggaattgttgacaggtcaaaaatactccgggtttgtaatagatatatggtccatgggggtgatattatacactatgcttaatgggatgttaccatttgatgacgatgatgaaatgaaaatccaacataaggtcattaatacggaaccgatgttttatgatcatgtccccattgacgtcaatcaattaatttcaaaaatgttactgaaagatcctaatcaaagacctagcttgaatgagattttaaattcatcttatttgattgacgtttacaataaatatttagaaaagggcaccaaaagaaattccagtggtagtggagatgccgaatcaattatatcgattaatcaacattacgattctgtggatagaccatttgaggccaagatagaaaaagatttactccgcaaactacaaagaataagttttgataccgaagaattaaaggcaactatgtataataatgaaattaatctgttgactgcattttatgagttattactcacccaggagtattccaaaaagaaacagaaatacatgcgagaaaagaaacggaaactatatgaagccaaaaaatcacttaaaaaatcaagaaaaagagtgaaaagcgtattatcattatcggatcaagcactgggatctcaaccgttagaaagaatcatgtcaagtttgagtatagcatccaataaaaattcatctagacatactctgactattgccaggaaatcattggataaaaacgatactactcaaatcccgccactgcccaaatcatcacaaactagtcgacttaatattgaaataccttctccaagagctaccaacaccagtattgccttaccacctaggtcaagacgtggctctcgagaaatttcaacaacaacggcagcatcgagcattaccgctgatttgaatacgcctttacgtcgtactgtatcatttgttcctgatggaagaaggctatcacaagtaatatcatcagaacctaaagagacaattaaaaagacaaacaagagtggcaaaatactacacaagcttcagttttggaagaaaaataaaggtgatgaatatcaagatgataccatttctcattatagtactaaatcaaatcacagtaaatcaacaaatgatgtgatgatagagtcagatggtgaaaacccattagaacttattgtcaaaggaggtaataacagtccaataaaatttgacaatactatgaatagccaccaaaaaatgaatactgtcccaccagaagttttggaacaacaaagactagataggtttcacaagaatgatgctacacggagacaacgagaaaactcaaattcagatggacaatctgggaaattggaacgaccgcaacaacttcaacttcaacaccatcgccagctactgcaactgcaatctttaaatactggtttaagtacgagtggtattgattcacctcatacaccaccatctgcagagaattcacgatttgctcggactcgaccttcatccatgatatcacaaataagtcaattgagtaaattgagtcaaatgtctactatgttgtcggaatctgagttggatattcttgacgaaaccgatacaatggacgatgatgatgattatgatgatgaagtatatgaatctagtataaacacatcacaagataataagttgactggacctaatgctacaccatcatcttcaaatcaaggagtaaaaacttctagcaagaagcgaccaacttatagacgaggagttgcctctgatacttcgataacatcaacaccttcagcttctggtggtggtgcaggcggtggcagtggcattatttccactataccgaaaaagaagaattcattatcgaaattgaggagcaattcgtcagaagacatatctgaagattcatatcgtttcaatgatgagaatatgcctatgggtagatcaggatctcctgacctcggtaaaaagagaagtttccgagctttacagcaacctatccctttggtcaatggtactacttctacttcgattgcagaaaaactcaatgatgctacaaaaatgccatatgttcgagctccatctccacctatcggatttaaatataatgctaaagcaaacaaaaagatgatgacaactgctattaatggaaataacaacaataataataataaccagcaacaacctccaggttatcaagacactaaacaagttgaagattggattcataatggtactacaggaaatacaactacgtttaccaaatcaacaatttatcaaccggttatcaatgaagaggaagaagaaaatgtatag

SEQ ID NO: 6418 - DNA, 546 bp, Candida albicans
gataaaaacgatttgatgaaaaccagttgtgggtccccctgttatgctgcacccgaattggtgttatcacaaactgcatacgaaggaagaaaagtggatatctggtcattgggggtaatattatatgccatgttggcaggttatttaccatttgatgacgacccagaaaatgaagatggttctgatattatcaaattataccattatatttgtaagactccattgacattcccagaatatgtttcccccttagctcgtgatttgttgagaaaaataattgtttctgatccaaaaaagagaattagcattgatgatattagaaatcatccatggttgagctcccatgccaatttgttatcaattagacaaccagaatgggataaagttcacagtgaaaaacaacaacctattgccgttgaaccaccacagccaaataagagatactcaatgatcaatgaacgtaccaattcatcgtcattgatgtcaccagcaccaagagttactcatacccaaccactttcatcgcatgcaagatcatattcttct

SEQ ID NO: 6419 - DNA, 2574 bp, Candida albicans
aaccactcattatatcttaatatcaacaaatccaaaaccatggaacatccaccagcagctctcagaacattttcaacccaatcaacttcatctttgaattcagtaagtactgtttcgtcttcaagaattgtttctctgggcccagtcaatataaacaatttcaataaaccaagtactcccaaagaccatttattctatcgatgtgaatcactaaaacgaaaactacaaaaaatccctggcatggaaccatttttgaaccaagctttcaatcaggctgaacaactcagtgaacaacaagcattggctttggcacaggaaagaagcaatggaaatggacatagtaatggcaaacgtcatcaatcattagacggtgccatgaatagactttcagttggttctgatagtagttcgatccaaggttcattgacacgaatggccaccaatgcgtcaacgtcatctttaatcagtggtatgccaaacaacaacactttatttacgtttactgcaggggttttaccagctaatattagtgtcgatcctgctacccatctttggaaattgttccaacaaggggcccccttttgtgtacttatcaatcatatccttcctgattcccaaataccagttgtcagttctgatgacttgagaatttgcaaaaaatcagtgtatgactttttaattgccgtcaagacgcaattgaattttgatgacgagaatatgttcactatatccaatgttttctccgacaatgcccaagatttaatcaagattattgatgtcattaataaactacttgctgagtactcaaatgctagtgacctgggcggtggtgatgaagatgtaaatatggatgttcaaattaccgatgaaagatcaaaagttttccgagaaattatcgaaacagaaagaaaatatgttcaagacttggaactaatgtgtaaataccgtcaagatctaattgaagccgaaaatttgtcttcagaacaaattcacttgttattcccaaatttaaatgagattattgattttcaaagacgattcctcaatgggttagaatgtaacatcaatgtacctattagatatcaaagaattggatcagtatttattcatgcttctttgggccctttcaatgcttatgaaccttggactataggacaattgacggcgattgatttgatcaacaaagaagctgctaatttgaaaaaatcgtcaagtctacttgatcctgggtttgaacttcaatcgtatatattaaagccgatccaaagattgtgtaaatacccacttttgttgaaagagttaatcaaaacatcaccagaatattcaaaacaggacccccatggcagctcgtcatcgacatcattcaatgaattattggtggctaaaactgcaatgaaagaattggcaaatcaagtcaatgaggcgcaaagacgagcagaaaatatcgaacatttggaaaaactaaaagaaagagtaggtaattggcgtgggtttaatttggatgctcaaggagaactattattccacggacaagttggggttaaagatgctgaaaatgaaaaggaatacgttgcttatctttttgaaaaaattgtattttttttcacagaaattgatgataacaaaaaatctgataaacaggaaaagaagagcaagttttcgacaagaaagagatcaacttcatcaaatcttagttcatcgactactaatttgttggaatcaataaacaattcccgaaaggataacacattgccattggaattaaaaggaagagtttatatatcggagatttataacatttccgctccaaacactcctggctcaaccctaatcatctcatggtcaggtagaaaggaaagcggctcattcactttgagatatcgtagtgaagaagccagaaaccaatgggaaaagtgtttacgtgatttgaagactaatgaaatgaataaacaaattcataagaagttacgtgattccgacctgtcatttaatactgatgactctgccatatatgattacacgggtattagtacgtcaccagtcaatcaatcaactcaacaacaatactatgatcatcggggctctcacagttcccgccatcactcatcgtcatccactttgagtatgatgaagaataatagagttaaatctggtgatttgagtagaatatcttcaacttcaacaacattagattctttcagtaacaacttgaatgggtcaccaaataccactaatccatctttgacgtcttcagatgccaccaaaacaattccaacatttgacgttgcaattaaattgctttacaaatcgacagaattgtcagagccattgattgtcaatgcacaaattgagtataatgaccttttacagaaaattatctcccagattatcacttcgaacttggtggctgatgatgtcaatattagtcgattgagatataaagacgacgaaggagactttgtgaatttgaattcagatgatgattgggggttagtgcttgatatgttaaccagtgaagacttttaccaaacatcaagcaatgaaaaacgactggtgacagtgtgggtttcttga

SEQ ID NO: 6420 - DNA, 408 bp, Candida albicans
atgccagtcgaaacccactcagattttcaagttattaaattagttgtcaacgttaaaggaaaagaaccttttgatgttccagtcaaaggtgcagacagcatcactgtcacgattccaggtggtgtcaagtatcacatgaccatgcactttcaagtcaagaacaagaaatatgaagacctccgttacattcaagtagctaagaaagcgggtatcaccattagaaccagagaattagaaattggtacttatgaaccatcagaagaaaccgtttacactaaagaatttccagaagatgaaactccaggctcttggttggcaagagggatttactcttgtaattcgacatattacgcgggcgatgaggaattgttttctaatgactggaatctcgaaatagttgcaaagtaa

SEQ ID NO: 6421 - DNA, 621 bp, Candida albicans
attgaaaagatgtccaattctaacgttgatgatgatttagttcctgaaaaagttgaaggatacactgttggtgaaaagaaaaccattgatgaatacaaaaacttggatgctgaagatgaaagtttggctaaatggaaagcatcattagggttaactgctgacactaaaccatacccagttaaaccaggtgacaagagaaaagttgttgttactgaattggcattggaattccctgaacaaccagatttacaaccaattagaatcaatttagaagatagtgatggaaacaccatcgttgataaagaaataaaattcaacattaaagaaaaatcaatttatcaattggtggttaaatttagagttcaacatgaaatcatcactggattgaaatatttacatctggtcaaacgtggtggtataagagttgaaaaagttgaagaaccattaggttcttatgctccaaacactattgataaaccattttatgaaagaaaatttgctgaagttgaagcaccaagtggtatgattgctagaggtacctatagtgccatcagtaaattcattgatgacgatgataatgtgcatttaacagttccttggagtttttccattactaaatag

SEQ ID NO: 6422 - DNA, 600 bp, Candida albicans
tatttggtgaactgtgacttcataaaacaattcggcatcggcaacaattacaacatttacaagatgagttcgactcttcagaacagcataacggttgcgcccgttggaaagaaaactagagaagaagttttagctaattttgaaaatgatttagtaagatttgaatccatgtctttgaaactatatggacatgaccaacctttgcaattttcgagagatatggtcccctttcctcagagacttcattttcgattacccgaatactccatttatcttttgacgataaggtttaaggtgaagcagaggccactaagaaatttgacttatcatcagacagtgaagaaaaagaggataccagtagatgaccgaaatctagaaatgaaagaagaagcctcggttaataatcttgacgatgaagatgactatcatgaagtgacatttgctccttctggtgtaccggggggaacgtttttgagaggcaagtataaagctagaagtctggttaaagagaatggagtgttaatttggagttataaatggactttggaggttatcaaaaagggatccactcctgaaattggtggttttggtgaccaataa

SEQ ID NO: 6423 - DNA, 915 bp, Candida albicans
cccaagaagagaagttatttcccatttagaacaaagactaattcatctaatgatgaaccagaagatcaacacagtcaacatagtcatccagataataataatcatattctgttgccacatacaggaatgataaatagtcaaaatacgtatacacaacagcagtacctacaacaataccaaccatctggatatccaaatggacatcaacaacaacaacaaccatcttcttcaggattttcaggttcagtagataatatgcaacaatatttaagtcaaatgaaacttgatgaagattccgccaagaaaatatttggtagtgaattagaaattgcatttgaattatcaaatcatgaatttatggggaggaaaattcctagtatttgttatcgatgtttagattttttaatgaaaacgggagcaatttatgaagaaggtatatttcgattatctggatcagcatcaagtattcgacaattgaaagatcaatttaatactcgatatgatgttgatttatttcaatcttcattaaaaccagatattcataccgtttctggacttttcaaaagttatcttcgagaaatgcctactccgataattggtggtaatgctgtaaatcatttaagtgctttagtttcccataatacttatcaacaacaacaacaagcaacagggatgtcgaattcggatttggcaattgtatttagagattattttaatgatgttaataatgttgatcaaattcattatgatttatcatttttggtgtttagttttttgagacaaattattcaacaaagtgatattaatcgaatgacattgaaaaatgtgggcattatatttgaaccaactttaaatattaatgttgaagttctttgtatatttttggttgaatttgatactattttcggtgtatag

SEQ ID NO: 6424 - DNA, 825 bp, Candida albicans
agacataataatcatctgctgttgccaaatacaggaatgataaatagtcaaaatacgtatacacaacagcagtaccaacaacaataccaaccatctggatatccaaatggacatcaacaacaacaacaaccatcttcttcaggattttcaggttcagaagataatatgcaacaatatttaagtcaaatgaaacttgatgaagattccgccaagaaaatatttggtagtgaattagaaattgcatttgaattatcaaatcatgaatttatggggaggaaaattcctagtatttgttatcgatgtttagattttttaatgaaaacgggggcaatctatgaagaaggtatatttcgattatctggatcggcatcaagtattagacaattgaaagatcaatttaatactcgatatgatgttgatttatttcaatcttcattaaaaccagatattcataccgtttcgggacttttcaaaagttatcttcgggaaatgcctactccgataattggtggtaatgctgtaaatcatttaagtgctttagtttcccataatacttatcaacaacaacaacaagcaacagggatgtcgaattcggatttggcaattgtatttagggattattttaatgatgttaataatgttgatcaaattcattatgatttatcatttttggtttttagttttttgagacaaattattcaacaaagtgatattaatcgaatgacattgaaaaatgtgggcattatatttgaaccaactttaaatattaatgttgaagttctttgtatatttttggttgaatttgatactattttcggtgtatag

SEQ ID NO: 6425 - DNA, 453 bp, Candida albicans
  unsure (398),(441),(447),(448): Identity of nucleotide sequences at the above locations are unknown.
tattatatttgtcgatttttatcattagattttgttaatccgttagaagatttcaaaagaggagctagaaaggaaggtttccttgtacgtcgtaataaaggtttaggagcaacatggaaaatacgttggtgtcaagatgatggaccgaatatggaaaaatatgaaaatcctggaggttctatattggaacaaattcaattaactggtgctcaaataggaagacaatcatcagatgccgttgctgaagataaggggtatcgtcatgcatttttaattatggaatcactgaaatcttctaaattacattcatcagttcctaaacatttcttttgtgctgaatctaatgaggaaagagatgattgggtcactgcattaattgcatttacgcgcggatttanttacacgtccggaacgcgacagatccgcgaattattgtatgtnacccgnnacggc

SEQ ID NO: 6426 - DNA, 564 bp, Candida albicans
ctatttttcattttgatctacccgtgttacttctatagattctacatgaaatgtgttttgtctgtacgattctactatctacaacaatcgtttatactaactatcaactttataaaggctgaaaaattatcagaacaacaaattgctgaattcaaagaagcattttctttattcgataaagatagcgatggtaaaataactaccaaagaattaggtacagttatgagatctttaggtcaaaacccatctgaaagtgagttgactgacatgataaatgaagttgatgtcaactctgatggttcaattgatttcccggaatttttgactatgatggcaagaaagatgaaggatacagactcagaggcagaaattgcagaagcattcaaagtatttgacagaaacggtgatgggaaaatcagtgctgccgagttaagacacgttttgacttcaattggtgagaaattgtctgatgctgatgtggatcaaatgattaaagaagctgataccaacaatgatggtgagattgatatccaagaatttactctgttattagcagctaaataa

SEQ ID NO: 6427 - DNA, 924 bp, Candida albicans
tatcgatattatcaagatttttatgatttacaagtgaaattattagaattatttccttatgaagctggaagaattgaaaattctaaaagactaattccatctataccaggacctttaattaatgtcaatgattcaatatcaaaattacgaagagaaaaattggattattatttatcaaatttaattgcattacctagtcatatatctcgatcggaagaagtattaaaattatttgatgttttagataatggatttgatcgagaaactgatgctattaataaacgattttctaaaccaataagtcaaaaatcaaattctcatcaagatagattatctcaatattccaattttaacgttttacaacaacaacaacaacaacagcaacaacagcaatatgctcatcattcaagaggttctgataattcacatactaatgaatcatcaggttcaaatttaattaattattattctcataatgattcatcattatcttcatcaccaccaccaccacaaactgtcaccaccacgaacaccaccataaccactgactcctcatcaaaacaaccaaaagtcaaagtgaaattttattttgatgatgatatatttgtattattaatcccaaccaatttacgattacaagatttaaaatcaaaattatttaaacgattagaattggatattacttataaatatgaaaaacctgatcaacaacaaaaacctacatcagaatcaattcatttatttttgaaaaatgattttgaagattttttaattgaaaatgaaactagcaacaacaacaatctggaaattgatttcgaaaatgaaattattaaagaaaaattaggagaatttgaagttaatgatgatgaaaaatttcaaagtattttatttgataaatgtaaattaatggttttagtatattaa

SEQ ID NO: 6428 - DNA, 978 bp, Candida albicans
caaatgattaagacgtttgggaaaagtaaaagattgtcgagtaattcaagttcacccaagaaaacaatatctcgagtatcatcaacttcaagtaatcacacatctcatgatggaatattacaatcacctaaaaaagtcattagagctctatatgattatgaacctcaaggtcctggagaattgaaatttttcaaaggagattttttccatgtattagatgatgttgatgatgaattacataaagaagcggaagctaatggatggatagaagcaacaaatccaatgactcaacttaaagggatggtccccattagttattttgaaatatttgatcgatctcgtcctacagttacagcatcatcaaacagttttacaaattccattgatattcaacatcaacatcaacatcaacaaggaattcacaatggaacaggaaatcgaaatttaaatcaaacattatatgctgttacactatatgaatttaaagctgaacgagatgatgaattggatataatgcctaatgaaaatttaattatttgtgcacatcatgattatgaatggtttattgccaaaccaataaatcgattaggtggaccaggtttagtacctgtttcttatgttaaaataattgatcttttaaaccctaattctcattatacatcaattgatacatcaaggcgatcacaagtcatacaagtaatcaatggatttaatataccgacagtagaacaatggaaaaatcaaactgccaaatatcaagcttcaacagtcccccttggttcaatatcaggaagtggtactccaccaacatcagctaattcacaatattttgataatcatactatgacttcaaatcgatcatcactgggttcatcaatttctattattgaagctagtgttgattcatatcaattagatcatggtcgatatcaatattcaataactgctcgattaaataatggcagaataagatattaa

SEQ ID NO: 6429 - DNA, 1113 bp, Candida albicans
aaaagggaagaaagagaggaaagaaagagaaaaaggacggagaaacaagacctccccccccttccctttcccttcccacttcctataatgtcaaaattaagacaacattcaattacaacgagtcctttaattatatcttccccgacattttctgctcctattagatctttaactatatcaaaccctcaacaatcatctacaattctgtcaaatttacgtggtaatgttattttagtcactaaatatgatttcgttgctgaaggagaaaatgaaatatcagtcaataaaggagatttagttaaattaattgatcgattaggtaatggttgggtattagtcaaatatattgatcgagtacaacccccaggattaattccggcatcatatgttgatattgctgttaatgatcaaactaaccccataactttaacttggttacaaaaagatgatgatgactcggaacaacaaccaactagtcaagctcatattgataatattattgatgaattaaattatttggatttacaatttaataaagtggaatcgaaatttgtcacaataaataatcgtccttatccgattcaagcatcaatatcaaatttcttattatttaatggaagaatatggtatcgattagatattgaatatagtgataaatcaaaatcttatatttgtcgttattatcaagatttttataatttacatattaaattattggatttatatgaaatattgtctaaaattgaagcaagaaattctgtttctaatagtggtggtggtggtggtggtggtagtcgtggcgatactatcaaattacctaaattacctgaaccaattcctactcaaaataatgatgatgaaaataaagaaatttcaatgttgttgaaaagatgtaatgaattgaatatttatattaataaattgatattaaacaaatattatcaaacttcagatcaattaagagattggttagaagttagagatttacctggatttattattaattcatttgataatgaagacgaaaaagacgaacaaattgatgaaatgactaatgatgaaattaatgaaaaaatattacctggttcaattaatattgtgaagaattattag

SEQ ID NO: 6430 - DNA, 465 bp, Candida albicans
ttttaccttgaaatgggtacaaccatggatgctatatacgtggtatattttcaacatcttcatgagtatattaatggggaaaataacaccaaggggggggttgtaccagtattagaccatataaaactggaagcatcagtacaagtgtggtggagaacttatacaccacctagctggatcttgggtagcaattcaactgaaactacacatcttggtgaaaaattgaatgacaatatatttattaatattgttgattgtatgggtgcagatagcaaagaggtccaacaaatccttcaaacgatctcaacaaataaaccagtatatttaattaccccaatagcttctttcaaacactttgatgaatcccgatttagcccagtttggaactacacttttcatttggatttagaccatttagactttgcagatatccaacctggtttaggtgtctatcagttattatag

SEQ ID NO: 6431 - DNA, 582 bp, Candida albicans
  unsure (540): Identity of nucleotide sequences at the above locations are unknown.
gcgttaatcatcatccccttagttatgatcaagatcaacttcaattggagaacgttttatcttcttacaattgtatttcgatttgtgtttactctatcagactcgtacattcaccctgacgaacatttccaaagtttagaagtactcaccaaccgtatcttaaactattccactaacattccctgggagtttcaagatgatccagcaagaagtttagctccattgtactttatttatggacctttgctttatttcataaaatttttcaagttgaacttgactgctttgcaaatatggtatattgcacgattacagataagtatactaagttggattatcaccgatttctgcttgtattggatgttaccctctaaaccagaacgtatcaaagctattttcttcacactgacatcgtatatcacattagtttatcaaaaccatttattttccaatagcattgaaacattattgttgttagttacaattttactaattgatgacttacgatatgttcaagaatccaaagatcaagatgttcanaatttaaacaaaaacaagaattattctatactggggtgttga

SEQ ID NO: 6432 - DNA, 810 bp, Candida albicans
aatatgtctattccatttggtgttgatttaggtaacaataatactgttattgcttgtgctaaaaacagaggaattgatattgtggtcaatgaagtttcaaatagatcaactccttcattagttggttttggtcataaatcaagatatttaggtgaaagtgctaagaatcaacaaacttccaatattaaaaataccgttgataatttcaaaagaattgttggattacctcatgatcatccagattttgaaattgaaaaaaaatttttcaccattccattaattaaaaatgaagttgatggtggcgtttctggtaaagttaaatatttaactaaaaatcatgaattcactgctactcaattattagccatgtatttagataaaattaaggatactgcccttaaagaaactaaaggtaatatttctgatatttgtttatcagttccaggttggtacactgaaaaacaacgtcgtgctgctgctgatgcttgtaaaattgctggattaaacccagttagaattgttaatgaagtcactgctgctgctgttggttatggtgttttcaaagctggtgaattgccagaagatgaatacaaaaaagttgcctttgttgatgttggtcattcatcttatcaagtttctattgctgctgttaaaaaaggtgaattaaaaattttgggttcagcttatgataaacattttggtggtagaaatttcgattttgctattgctgaacattttgctaaagaatttaaatctaaatataagattgatgttcatgaaaatccaaaggctttctatcgtgttttggtt

SEQ ID NO: 6433 - DNA, 510 bp, Candida albicans
  unsure (503),(504): Identity of nucleotide sequences at the above locations are unknown.
ttagaatggagtgctactgccaggttcttgttgaatttctttgccattgttccattggcgtcagtgttggcatttgctacagaagaaatcagtgaacacgttggtcaaacagtgggaggattattgaatgccacttttggtaatgctgtggaattgattgtctctatcattgctttaaaagacaaccaggtgagaattgttcaggcttccatgcttggtagtattttgagtaacttattgttagtattgggatgctgctttgtcgctggtgggattacaagagttcagcaaacattcaaccaaaccgttgctcaaacaatgtcaagtttgatggcattggcaacagcatctttgttgatcccagctgctttccatgcctcattacctacaccaaagaagggtggtggttttcctgaaccggggagttccgatgaattgattttatcgttttcccgtggtgtttccgtgtcttgtcttcacctcgggtatgggccggaccgcgnnaaatga

SEQ ID NO: 6434 - DNA, 1365 bp, Candida albicans
acattattacttatcctcatatttatatttatattccgtactatggctccaagaacaccagccgataagcttggtcatgcatgtacattacaactccccacatacgacaatgatgatcaatcttcaaccaattcaactacccctttacataaagatacaccagaagaaactaccgatacatcgacaacaactaatgatgttgaaccatttcatcctcctaaactacttagtaaaaccactacttcaccatccataaaacttacatccatgttatccaaaacttctactaaacaaaatccaaatttcccaataagtttacaatcattaagtgaacttcatgatcctaaatctttgaaacaattatatgatttaggtggaattgataatttattggctctgttacatacttcattcgatggtcttaatgaacataatgaaactgatttatctcaacggaaacagtattttggtatcaatagattacctcagaaagttcaaaaaagttttcttaaattatgttgggaagctttaaaagataaagtattagtcatattatgtattgctgccattgtttcattagctttaggttgttatgaaagctttggtagtgggactcattatgatgatgaaggtttaccattaccaaaagttgattatgttgaaggtgtcgccattttagtagccgttgccattgttgttttagttggtgccgctaatgattatcaaaaggaacgtcaatttggtaaattaaatgctaaaaaagaagatcgtgaagtgattgttgttagaaatggtggtgaacaaaaattgatttctatttatgatttaatggtcggtgatgttataaatttacaaactggtgatgttgtccctgctgattgtattttaatccagggggaagtcgaatgtgatgaatcagctttaactggtgaatcacatactattcataaagtccccgttgctaaagccatgaaagtttatcaaaatcatttacctactaatgaagatatcggtagtactcaaataaaattccgtgatccttatttaatttctggtgctaaagtcttatcagggttaggtaacgccgttattaccgctgtggggaccaattctattcatggtagaaccatgatgagtttaaatcatgaaccagaaagtactcctatgcaagtacgtttgaatgatttggcagaagggatttctaaatatgggttccttgctgccattgttttatttgtggttttattcattagattctgtgttgaaattgctcctaatggtaatatgaatggtgctgaaccagcagataaaggtaaaagatttattgatattattatcactgctgcgacaattgttgttctttaa

SEQ ID NO: 6435 - DNA, 1350 bp, Candida albicans
aaaagttgtggaaataatggggggagcaaccgccagtttgttagtgataaaatggtacttttaacagaaaataaaatgagaatagtaagaggatttttcggattaaataaacaaggtcaaccattagaatttaatgataccgtgggtaatcaacatgatgaaccaacatcaatagatattattaataatgaaattagcagtgaacaaaaagtttatcttaccactaatattatacttaattctactgcatttgaaaattccgaatatgatgaagaaaaagctaaacttgcaagacaaaaacctccaaaacaaagttttttcagtagtcttttcaagaattccaagaaatcccaatatcaacaaatgggattagttgatgaaccttatttaggtaataaaactgaatcggcattacttacattagccaaagataaattccatttattcgataataaatcattagaaacttgtcgacaagagaataatggtgatgtgattcaagttatcccatttgaaagttcacgtaaatgggctggtatcgttatgaaaatccctaatggatttagactttatgttaaaggagcagcagaaattatttttaaaaattgtggatttgaaaataatattaatgatgaattaatcaaattggatcgatctaaacgtgatgatgtattatcgaaaattgatgaatatgctaatgatgcattaagagcaattgctttggcccatcgtgattttgttggtatttcatcatggccaccatcagaattaagttcttcctccgagaataagaaaaccacaaccactgcaaaggaagctgatccagcaaaattaattaatacttcatctagtgctagtgaaattcataaaatgtttattcttgatgcattagtaggtatacaagatccattgaaaaagggagttgctgaagccgtattacaatgtaaacgtgcaggagtcactgttcgtatggtcaccggggataatatcaatactgctaaatccattagtaaagaatgtaatattcttaccctggatgatttatcaaatgaatattcatgtatggaaggaccacaatttagaaaattatctattcaaaaaagacgagaaattgtacctcaattgaaagttttagcaagatcatcaccagaagataaacgtatacttgttgatacattaagaaaagctggtgaagtagttgctgttactggtgatggtactaatgatgctccagcattgaaattggctgatgttgggttttctatggggattgctgggactgaagttgctcgtgaagcttctgatattattttaatgactgatgatttcactgatattgttcaagcaatt

SEQ ID NO: 6436 - DNA, 225 bp, Candida albicans
ttcatttattcaccaaatatgtcagaaacattgggagacgaatattacccatcatttgctccatttttagggtttgctggctgtgctgctgctatgatattatcctgtgcaggagctgctataggtacagcaaaatcaggtattggtattgctggtatcggtactttcaaaccagaattgatcatgaaatcattgattcccgtagttatgtcgggtattttatcg

SEQ ID NO: 6437 - DNA, 1380 bp, Candida albicans
atgttatttcaaacaacattaactccagaacaagaagaatgccctataacagtgcgattggaagccagtgcatcttctattgtacgagggtgtccggggatcccgcgaagcatcccgagaattgaaaccgtgctaaatatcagatcaattaaccattctccatttccactccggtcggttagcataaaactaatgacaaaacaaaaagttatgattccaactaaatttggaagtagcgaagcattcaaggaatttatcatctacgaagatcctttgacttatcagccacctatgggtgagttttcgcagctactacatggcctagatattccaatactaataccaatcccaaaagatcttacaccaactggacattcacctactttgggggccacaacaatacacaatttagtagtttttgtatccctaggaaattctgcttccacggagtcaacgtttgtcgactatttccctgttgatattaaaatgtacgacacattaccaatatatcgacaatacaatgagccaatagtggaatcgagatactcctcggataaccaaactttggttgaagttgcaataccagtgacttcaattggtcctggagataatctaaaggttatgtgcacggtaaagacgaattcagccaataataaagtgaaaaaacacattgcattgaaacagttgacatttcaagttaaagagatacttgagtgttttgatggtgggcttccccctcggaaagaattcaaattgcacactgagtcaaaagcgtttgccaaagaaataaatacccaaggcacgtcgcagacgtttagtatccagtttccttatgaaaatgagtatttggagatgttcaccccaaaggaagatgggtcctcaaataatacagatattacagagagtttttcaacgacaattatagagtcgaaaaatatttcaaagctcaaggttttggataagctacctgatggggtgcctttaacacatatacaagggtttacattactggggaaattctattcgatatggtttgaaattgttattaaagtgaaactatctcatgctaaagatattgacatacatatacctataattgtgtgtccctttaacaaagagtcaagcacatatatactcaattggataatggcggaatgtgaagttgcaaaacgtgaatttgggaaagaattcaataggatttattcttcaacctcaaagtatctggaaatggtaaaactaatagaccgttttcgacaaccaccggtggtttgcgacaacgggaaaatcaaagggattaccgatcctattcccaataagctgttgccgaatattagctcgaactcgaattcgaattcgaattcggggttgtgtatagattaa

SEQ ID NO: 6438 - DNA, 1344 bp, Candida albicans
acttataaaacaatacacttaagcatgtcgggggtgtctgattttttatccaaaggtatagatcttgtacaaaaagctattgatgctgatacggccactcggtatgaagaagcctataaattgtattataatggattggattatttaatgttagcaataaaatatgagaagaatcctaaatccaaagaattagtcaagagcaaattcactgaatatttaactcgagcagaacaattaaaagatcatttagaaaagcaagcacaaaacaaatcaacggcagaaagttctgtgaatggatcaaccaaggcgaaaaagtctaatggtgatagcaatggaagtggtgatgataatgatgatgctgacacgaagaaattacgtggggcattagctggagctattcttctggaaaaacctaatgtcaaatggtcagatattgctggattggacgctgctaaggaagcattaaaagaagcagttatattacccgtgaaattcccgcaattatttgttggtaataggaaaccaacttcaggtatattattatatggaccaccagggacaggtaaatcttatttggcgaaagcagtagccacggaagctaattcgacatttttcagtgtatcatcatcagatttagtatctaaatggatgggggaatcagaaagattagtgaaacaattatttactatggcaagagaaaacaaaccctcaattatatttattgatgaagtcgatgcactttgtggacctcgaggagaaggtgaaagtgaagcttctagaagaataaaaaccgaattattagtacaaatgaatggggtgggtaatgattctcaaggtgtgttagttttgggggcaaccaatatcccatggcaattggatgctgccgttagaagaagatttgaacgaagaatttatattgccttaccggatgtcgaagcaagaacaagaatgtttgaaataaatattggtgacgtgccctgtgaatgtaccccacatgattatagaacattagcagaaatgaccgatggatattccggccacgatgttgcggtagtggtaagagatgcattaatgcaaccaattcgtaaaatacaacaagcgacccatttcaaaccagtgattgatgagactgatgggaaagaaaaattaacaccttgttctcctggtgatgaaggtgctagagaaatgaattggatggatcttgccactgatgaattgaaagaacctccattgacaatcaaagattttataaaggccattaaaaataatcgaccaacagttaatgaagcagatattgcacaacatgttaaattcacagaagatttcggtcaagaaggtaattaa

SEQ ID NO: 6439 - DNA, 264 bp, Candida albicans
atttccgagcgatgtggctcctgccgactggtgaaaacatgtggatattgtgaaggtcctgataaagatattaaaattttccaaggtattacagaaggtaaaattgttgatagtagaggaccgactaattttggatgggattcgattttccaacctaatggatttgaacaaacttatgctgaaatggataaaaaagtgaaaaattcaattagtcatagatataaagcattagataaagttagagattatttgttatcccaataa

SEQ ID NO: 6440 - DNA, 789 bp, Candida albicans
gatcaaaattcagacagcaaaagagattctgaaccgggccaaaactataccgtaacttatcactcagatgagactttaggtataaaccacgagacatatcaagactcgaacaaggagaaattggcaagagggtcacagatttctgctgtgaagagggatatatcaagaacaaatattgtgattttagatgcattatcatatataaagggatttcgataccagttattctgtgaagcaaaaggtaacgtaactccgcattgcattgttcatgttattgctcctattgagaaatgtatccaatggaatgacaccaaggaactgggaaacaaatgggatccagttttgataaaacagttgcagatgagatatgaagaaccaaatagcgatacaagatgggactctcccttatttactatactttctgaagatccacaagagaaaataccaattgaagatatctggaatgctttggttttgaaaaaagcggcacctcccaacgcagctactttagttaagccaacttcgggtaattcgtttttgcaagaattggacaagaaaacacaggaagtggtaaccaaaattcttcaacaacagcaaattacccctggggatgtagtaatagataagaatttagtagtggccattcctacaggaactgccagtacagctcaactccagagaataagaagatcttacattggtctaaacagaatgagatcgatagaagttgatagaattgtgccattgtttgttgaatatctcaatagaagcctaaatagtgaagactaa

SEQ ID NO: 6441 - DNA, 1695 bp, Candida albicans
  unsure (704): Identity of nucleotide sequences at the above locations are unknown.
ctactcaataatcttattctattacagctagctaatacattcaataaaaattgtataataaaaattgtggctagtttatcatattttcatacagataacaaagaaaaggtttcaaagtctgctttattccatccaaatagagccttcaatatgtcgaattcaattggatttgaggaggaaaatgatacagcttgtgatgcaacgtccaaagtcaagcaactgcgctcggcactgagtttgaactcatcgtcgtcaagacgcaattcattagaaagaatgtcacacgatgaaggtatctcgtcaccaaccagcagcattaattatatgtcatcttcatcaacaaaatcaccaccaccttcacctccgaaatctccacgtttggaaaacaccaaaaagatgttcaaaatgatgtctattacatcgcccatgggatcgctgagcgagtcagtggtgctctctgattcagacgaaagaagttctttggaattacaagagcgaggtactatcactccatcaagacatatggagataaatcagagctccgatgaagatgatacagaatttgattccacgagattgaggttttcggcccgcaaaggtcgtagaaagagtgggactgacgaggagagtcctagcaaacgatctataaaactctcaaggggggcatcaccagcacgaaaagggcgcagaagaggtagcagtcnttctcctcactctgatacaaacacccaagggaaatcatcttccacaagtaaacgcaagttacgtagaaaatcaaaggagagtgataagtctcataggtctgaattttttggtacaggatatacatccatgccaacatctgggaaagtatttagaaatttgctaatattggaagagaatcttagagagcaggtgatacagcagcgagccatgagacgcaaatatttgacatttttaagtatattgtgctccatcattgccgcattgtcacatcatttatttttcttagataactcatctacgggtactttgaaagtcattttgcaattctgcttattggcgacaatagtaacattgatgttgtaccatttatcaggggaataccagaaaactattgtgctaccacgaaggtttttatcactgacaaatcaaggtttgagacaattaaatgttaggttggttaagataaaaacgccatttttcgacaagttgaccgatttgattagagaaattctgttggcaattgtcaattttaatttaagtgttttccacaaattgtcacctgaatcgattcaaaataagaattcgaaaatagaagtatttttagtgacttgtcaatctcaatgccaacccagaataggtgttactgacgttaagttagtgttgaatgcaagagttttcaatactgatatcagagaaggttgggaaatgtaccgaagtgagttttggataaatgaaggtataagaagaagaaataatatgctttctttcatttctggctctcctgtagccaagcctgttggtttgaagagaagaaaaagaaaatctgaaaataatgactcgtccattaaaccaaagagcatccctgcttcattaagtgaacaaaacttgcaggtacttagtagtggatttgagtataacaatgacaataatgttgatctcagaagtgaaacaagcagcccattaagatcggatactttggttagtgattaa

SEQ ID NO: 6442 - DNA, 747 bp, Candida albicans
gacaaaattttgtatagaaaaaaatatacactttttctttttttttttacaaccaacctcacccctatgctgtctaacgactctgctgattaccgcaacaagttctggtcatcgaccagccgacaagtaggcacttcgttccagccgctaggcaaagaagaatcgtatgccaatcggtaccccctagtcagatcagaaaccttcccaccaaccaaagatgaaacaccatactcctcaatcgatagcagcgccaacaagtacatgaaaaacaccatgatcaacgcccctagctatatcccgtactaccgcaaagacgactccttcgaaatgttgcaggaagactataacaaactcaagggcgagttgatcttgaaaaaccaaatcatcaaaaacttgacggaccagataagtatcatgaccaagaccgaccagccaccaacgtttacggcaccgaaaaaccactaccaactattccaggatttgctgaaaacattgcaggaaaagtcaacggagttacaggaaaccaaccaacgactcgaggcagtgttagttgcaaatagcgaaaactatgacgtcgaagagttgagccacaaattagtccatcgtttaacacaattgcagcaggaaaacgaaaacttgttgaaaattatcagtttcggcaacaagacaaacttattgattgagattggattgttaaagcacgagatcgagttgttgaaaaagggaaaagacggttttgtcttgtga

SEQ ID NO: 6443 - DNA, 297 bp, Candida albicans
  unsure (6): Identity of nucleotide sequences at the above locations are unknown.
gtgaanactaaattgaaaattattggtggtgctttagaattgattggtaatattaaagaaatttctttaaaaaatttaaaattagttaaaggaagtgctatagttaaatctacttcatcaatttttgattgtaaaaaatggtctaaaacagaaattatgttggtggttagaggtggaagaattgaatgcactgattctaataatgaaaaaattacttcaagaactaaagaagatggaactggtggtgaattgataactactccaacttcaactactactactattaccaatatctaa

SEQ ID NO: 6444 - DNA, 603 bp, Candida albicans
agagttaaaaatatttccggtcgtgaagtaattattggtaatattatcattagtgaatttgattatcctattataacattttcaaatttagaaaaattattaggtaatttaactattttgaaaagtcctgatacagttagaattgatgcacctataatggaattaattagtggaacatttaaaatgattgaattgacttcattagcattaatatcatttccagctttaaaatgggtcaatacattacattggaaaattttaccaattttaagtaatgttcattttaataatgaaattaaggggattgataatataattatatctgatacttcattaactgggttttcgggatttcttgcagaatcaattgaaaatttagatattaataataatcgatttttagatacgattgaaagtaatgttgaaaccatttctggagaattacatattggtgctaattcaaatgatgttaaagtatcattccccaaattgaaacaaattggattattaaatattaatgatgttgaaaaattaaatttaccagaattggaatttattgatgattccttaattttaaataataataattttcaacaattaaaa

SEQ ID NO: 6445 - DNA, 1542 bp, Candida albicans
agacaagggtgccaatcgtcaattgtcaaacaatttgtggaattgttcagaggtggccgaaaccaacactggcacccagaatgttatatggtacataaattttggaacgtttgtattactccagattcagttggtctccaaaaattgtttgatttaccagatgatgttctcaatggattaaagttggtaaaagatgacaacgaaagccacatttcggttgattctgccatgctcatgtctattgaacaacaaatcgaacaagtggtgttgaaatgttgggtcacgctttctggatatgaggagataactgccaagtgtatatccgatatgttattatgtgcttgtactggtaacaaattcaacggtatagtggtaactgggaaattggttctaaatgtcgaagttttgtttaatgcgttggattatgtgattcttatgtgcaaaagttcacatgagttattgcataaaaagtttggtactcctcctaataaggatgacctggagtcctcaagtacagaagaagagtattttcaaatgttgaaaaaagaaccaagaaatatcacgggtaaaattatgagttatcttgccatattgagaaaatcagaccacatagccaaatcagggagcctttccgctgaactactttcagtgattaccgggtgtgcccattacttgaagctattaattcgacttggattatataatgcattgaaattgaacagattgtacgggaccactaatgctatagaaaagtttttacaattaacatcagaacacgaagctattagtttattagctggtgatagcaagactcaattgagtttgatcaattccaaattgacgattccagcaagttcgacagatgcatgcagctcatgtgctaagagtattgaaaaatcgtgtcttaaattagataataatcgttggcacgttagatgttttgtttgttccttgtgtaagagaacaattccctcaatagaagccagtgaaaccaaatttgatgtaattcatcaatcgattgtttgtcgagaatgtccatgtgagcattttgataccgggttccatttggtgtctgatttatcacaattgatatacttgttgaaaatagcattgtttagatcacgttcagtcatgaaagtggatttgacaaaagtacccagaagctatctttcggactcacaatcagacactgatactgttgatgttgctcaagataattattcacaaaccttgaatgacgtgacaagtttaagaagcaaacgacagagtcaaaaattatccaaatctatcaaaaagaaagctagaaaatcaatcattgtggaggcaccagaagctgacaaggcaagaaaggaagatatcaaaacacatcctttaggtatgaaaagtagtggtgtgggaaccaatgacacatcaaggtctagcggtatcaatgatgaaactaccatcgctgacgagttgaatgatttaagttttgatagttcacacatcaaaagcaaccaagattcaagaaaaacaagcagtgtcttaacagctatcatataa

SEQ ID NO: 6446 - DNA, 1164 bp, Candida albicans
attcactccaaaatacgaggtgaacatcaaaggcaaaccacaaatactcctcttgataggacatctgatttgttaaagaatgagaaatctttaactttaggtgatataccaagaattgttgctgcagaacaagcaagagtacacgcaccatatgctttcccacaccataatagtttataccgacgtcagactgctcctcaccgactcaaagttattggtcatacttctactgttattaccccaactggtgtattggataatattttgtacacatcacaaccacatcctgaagaaccagttgctgtcagaaagcaaaagtattattcagagttgaccaaagatgagcatttcattattcgtcatatcgcagtggaagctcttagtcacataagtaagagttattccaataaagaagagttgttgtcattgattcaaacaaaaaagcaacctacattttgggacaagttcaagtttggaggcggcgatggtaaaaaggataaagttatggcagtgtttggagttgatttacaagtattgacgaaaaagtatggtattgattcacatttaggtgtaggaccttcgaaactaaggattcctattgttgtggacgacattattgctgcattaagacaaaaggatatgtcagttgaaggtattttccgtttgaatggtaatatcaaaaagctccgtgaacttactgaacaaatcaataaaaatcccttgaaatcacctgattttagtattcagaatgctgttcaattagctgctttaatgaaaaaatggttacgtgaactacctaatccgttgttaacatttggtctttatgatatgtgggtttcgtctcaacgacaagtcaaccccgtcttgcgtaaacgagttttacaattgacatattgtatgttacctagaactcatcgaaacttggttgaagtattgctttactttttcagttgggtcgcctcattttcagaaattgatgaagaaactggttctaaaatggatatccataatttagcaacagttatagcacctaacatattaatttccaagcaatcatcaaactcatcatcaggaattcttctaattccggtaccaataattcagattcacaacaagcatcaggggataattatttccttgccattgaagttgttaatcaattga

SEQ ID NO: 6447 - DNA, 411 bp, Candida albicans
catattaatttccaagcaatcatcaaactcatcatcaggaattcttctaattccggtaccaataattcagattcacaacaagcatcaggggataattatttccttgccattgaagttgttaatcaattgattgaacagcatgaagagtttagtattataccgctggatattcttgagttttacgagaaatgtggatttgacaaatttgattcaacgaaaaaagaaattacaactagagatgtaatgataaaaattgacaaggaattgaaagaaaaacctgattattttgataattttgaattgaaaaaccctaccggtagtttaactagtcaagaagttaaacgaaactctgtttctcgaattgaatccaaaatccaaaatagagaattaaatggtattagtgagagataa

SEQ ID NO: 6448 - DNA, 903 bp, Candida albicans
cagttggtctcattagctccctttgcgattttaaatttgaatcaaggggtgcaaaaggcaggaacaattgttttgagtgatactgcattgactaatttgaacgggttggctagtttcaacaccattgattccattaatatcaataacaataaaaacatttccaaaattgaattcagtgatttacaaacagtcaccgatagtttaatcttatcattcaataacgatgatgccgaagttaaattggactcattgaaatgggccggtaatttaactattcaagatgttagctctattcaagctagtaacttgactagtgtcaacggatctttattgatcagttacaacacttttgacgaattggaatttccaaacttgaaatccgttggtaactctatgcaaatttttgctcacgatgaattaactaaaatttcattcccaaaattatctgaactcgatggtgaattggaaatgttcaataatactcaattggaagaaatcgattttggcaatttgaccactatcaaaggtgctgtcaccatttctggtccatttgataatttgactatggaaaatttgaaattggtatctggtgatttccaagtcaatagtacttctgataaatttgattgtagtgcttttgataaattacacgaaaaaggtaagattgaaggtcacaattatgtttgtactcatccagctaatccttcttcatcctccaaatcaggatcaagcacacaaactggtaaatcagatagtaaatcttcagatggttcatcaagctcaaattctagtagctcatctaaaaaaggtgctagtaatgtattggttgttcctggtatggtattgactacagccttgggtgttttattggcattaatttacaggagagagataaaactctag

SEQ ID NO: 6449 - DNA, 1239 bp, Candida albicans
tttcaatatactaacagcttattattagactcaactttgactactgctactccaagtgtcaaatctgaatgttcattcaaagatttcaccgctactgcttccaaccaagttcaacaagttgctgcttgtgccactgctgttggtgacatcaccattcaaggtgaatcttttggtaccgttgaattgactggtgtacaacaaatttatggtagtttacacgttaaaaacgccaccaaggccactactatcaatgctgcaactttacaattagtttctggtgttttggaattcaacgccaacaccatcttgtccgacttgaacttggctcaattgaccactgtcggtagtttcaatttgaatgctttgccagctttggaaaagactggtttgactgctggtatcacttctgctgaatccgttgttatttccgacactggtttgagttcattgactggtatcaatgttttcaaattgaaagttttcaacgttaacaacaatgacaacattgacacaattgattctggtttacaagaagtcactgatactattgacatttcttataacgctgaaaaggtcgacgttattttgaaacaattgagcagtgctaagaacattgttttacaacaagttaactcattcagtgctccaaacttgaccattgctaacggttcatttgctgtttcatcttgttctgttgaaaaagtcgaacttgctgaattgacttctattggtaattcattgactatcaacaaaaatgatgacttgactgaattagatttccctaaattgaaaaccattggtggtgctttacaaatctccgacaatagtgaattgagatctttctcaggtttccctaaattggaaagcattggtggttccgtcaacattaacggtacttttgacaatggtacttttgaatccttaaagagagtttccggtggtttcatcttgaagactgacggtaaattgtcttgtaatgctttcaacaaattgaacaccaacggtgatattaaaggtgacaaattccaatgtgaagacagacaaaccacttcttcttcttcatccaagaaatctggttctgctactgaaacttctggttcaagtgaaactggttctgattcatcctcatccgcttctggttcttcttcttcttcaaagaaaggtggtgctgcttccaacaatggtaagttagcttccgtcgttgctgcttttgctgctgttggtgttgctttattctaa

SEQ ID NO: 6450 - DNA, 1431 bp, Candida albicans
atgcacaactggagaaaccccaaaaattccaacaacttaggtggtagtaataatactagtaataataataataatggattattattgaataaattaaattcaaattcttcacctagtttatcgaattcaataacagaagagtttaaaactcgactggaaggagtaccgttgaatcaattatttagtattagttcattagaagtttatttaagacatatggcaaacccagataatagtattaacaatagtggtggaggtggttcattgtatttgaattttttcgataaattaataacatcaaatcaaataacaccatttgaaacatttaatcatcccataagtcaaattttcattattgattatgaaacggattcaattgatatattaagaaaattaattgttgaatttagaaattataatttcccgaaatttttccaaattgatgatttattaattcatgtatttataatttatgattgtgataaatttgctactggagatattattaatttccaaaatgaaattaaaaataaattgaatgtaaatactactgttttccccatgtcatataataataataaagaaaagtccctgggtggaggaatggaaacaaatactatatcattagttgaaaatagtactattgaagaagaattacaaagaatttcttggaatgatataaacaattcatttgaaatacctaaagttgttgattacactatacggacaaaattatacgaatttattaataaatttttaatacctcatatgcaatcaaaagttagatattgggatgatcaaatcttacaacctaaaaaatctataacggggagatttttccaagtttctaaaaaattttttaatagtaataataatagtgatactaatttattaacaaatactgctaaatccttcaaaaatggcgttactcatgggaattcaaattcaaattcaaattcaaccttcaattataatgaaaattattattataaatcactgctggaacaaatactaaggaaattggctgattggtcattaatgttaaaagatttcaaatatgcttattccacttatgaattaattaaaaaagattatagtaatgatagagcatgggtttatgttgcatcaactcaagaaatgtgtattgtttctttattattagttcaaactcaacaacaacaactgcaactgcaactgcaactgcaactgcaactgcaattgcatcagcaaaatattaaatcattaattcctgataaaaatactttaagaaaaattaaacatgatattattgaaccttatatggataatttatgttatacttttaaatcaagattaaatttgaaaacatttagtttcaaaaccatgattattgttattgaattgttactttgtattttcaacagacggtcgaaggacatcgaacggcagcca

SEQ ID NO: 6451 - DNA, 504 bp, Candida albicans
ccccatagattatcaaaatttgatatttctatgatgacaaagatatgtcatcgaatcaatttattaccaataattgctaaacgagatggattaactgatattgaattaattcaatgtaaacatgccatcaatagagatatactggaaaataagattcaaatattcaatttcttatctaaactgaatgatgatgctggtgctgatgctggtgctgatgctaatgctgatcatcattataaacgagatggtgatattgaagaatatatgactttatcagctaaagaatataattatcttagtgaattgaataaatcaattccatttgctattattggatcgaattcaattgttggtgacccacaaaatgagattgttagaaatactaaatggggaagtatccaaattgaatataaaaatatttgtgattttaaaatattgaaaaatataatatttgagactcatttactacaatttaaatatgttattgttgataatatatattaa

SEQ ID NO: 6452 - DNA, 1557 bp, Candida albicans
tttttttttcttgttttctttatcgaaactatgaaatcgtcttcgagtttatcgttgaattcaaatacaagcagtaataccactgttgatacagattcatttgaacaaaagaaacaacaaatagtgaaacaagatcccaaaacaatttatgaatgtattcgtttgatatataccagaaacaattctgaatttttaagttatcgctgttataataattttgaagttggcaatattttcaatgtaatttccaaaaatgaactaaatcggagatatttccaaaatggtttgactcaattgaaaattgatgatgaaagctatttttgggaaaagcaggctgaaccagaaatttggcaaggattgattactattcagtttgatgttagtgattttgattattggtttattaatttgttggctactctggctagagtttattttcaaaagcatcaaaatattaatgattatgatgtgtatacaaaaatggttgcaaatacttttgctagtgagttgaaacacactgttgaaaatgatcaatgggaatcagtgggggaagcatttttcagtaaaagtattgattttttcacttcacgttggcaaccactagaagctgtattaccagcgttcccatgtaaatcatctaatattgaaaaagttgctggagatatgccagataaaggagaagaattggcactttctcgattgattcaatttgctgattcgattgcaaaaatatatcctcccggtattattatttggattgttagtgacggtcatgtgtttagtgattgtattggagtcgatgattctaaggttaatcgatatttccaagggttgcaaaatttgtatcagaatttaaaaccaaaagattctaaccctatacgtttttgttctttgccagaaattttcaagtgttttggaaactctggttttgatgttggttgggttgagaatgttactttgggacatcatcttcacactgaaattgatgaacaatctgaattttgtagaaagatattggtttcttcctgtgatactgattgtggaaaattaagacaagatataacaacaacgggacatcccagattatctttatttagagggttttccaaatttatgacggaggatttggcccttcatccgacaacatctcatttgacaaggaaaaaatttaaaaaaattgttgccaaaattgcttttgaaatgattaagcgaaatgatgcctattctaatttggttgaattaatgttcccatttcatttaagattttcaattcatgctcattgtaattcaggtcctaaatttggtatttctttgttatctaaaactggtgataatcaatgtcgtcctattaataccatccaagaccataaagaacctagaaatacagatttgttacatataccaaccccatggcataattcagttgttaaaattgataattgcgatatttatttcattatcaaatcaaataaagttgaggaagaaatacgtaagggtaatggtagtggtgggtgggatcctaataaccttcattatattttctttagtaatcaatag

SEQ ID NO: 6453 - DNA, 1140 bp, Candida albicans
tggatccacataatgagatcaaaagtaaaaaattccagtgttagtccaacaactattaatgatatctccacacaaagtagtccaggtttaagtacgcttgtaatttcattaccagagtcgccacataaattctctaatccaattgatatcatttccaaaaaaagttctattaaaagctttaaaagtgtcaaaatcatcaatactctggaaataacaagtcccattttgaatagtgccaataaatacttgaagccaacaacacaatccaatcattgtacatctgacttggaagattctaaaaaagctggtttaaattgtttgccatatcaatgtgaaaagaattcaaatgtcatgggtggcaaattttctttaatggtggcgggtgctagaggtactgggaaatcaagttttgtgaattgtttatttggtaatgagttgttagttgagaactgtgacactgccaatagagagtttctcgatatcaatcattttgaattaactgagaatggattcactttaaatttacaaataattgaaactgtaaattatagtaatttctttgacaaggggttcaaatcggattcattatgtgcttttgtggatgagaaatttaaggctttcctttatcaaagtaggcagccaagaagagaaagtttaattgactcaagagtgcattgttgtgtttattttttaacccaaacagtcaactcgatatcagatttggatatccagaccatgaagaagttatcaactagaacaaatttaattccagttgtagccaaagcagatatgttaacagaaattgagttacacaactttaaaaatctagttagaacaacattggaaaagcatgaaatagaaacttgtcaatctatctcgaatgaaaaattagtgcaagaaattaatatgaaaatccccttgtcagtcatttcctcatcttcctcaccactggaaattaataacaatggaaaaatcgatagagttcgaaaatatccttggtgtttattagatatagaaaatgaatcttggtgtgatttccattatttcagaaaactcttgttagaagagaacatgttagaatttgtggcatcgactgaagtgtactatgagcaatttaggaacaattttactaagtggtaa

SEQ ID NO: 6454 - DNA, 627 bp, Candida albicans
  unsure (67): Identity of nucleotide sequences at the above locations are unknown.
tttagttcaagatgttttgatattccgggaaagggggaaaaatttttaaaattcaaaaaattggaangattaattaaccggtggggaaccggttccacaaaccttaagttttttatggctatttataaatttctgaacattggaattcgcagaagactatgtatagtattaccaatattacatttccttaatccttttagtgattatcaattgagattattaattatatttttaacatttgtgcccacatttatcattttaacaatttcatttgaattattattttacgttggattttcattaattttattacaatggttatcaattgaagaattattaaaattttctcataaagatttagttgaaacttttgaaaaaactgggaaattgcccaaaggttattggttacaagttattcgtattactattattggatttttctttttacaattggcatttttcgggactgggaatattgcttcaatttcatcattttcattagattcagtttatcgattgattcctattttcgatccattttctatgggggcattattaatgattaaattaattattccttatgtattattatcgacttgtcttggaataatgaatcatcaattataa

SEQ ID NO: 6455 - DNA, 270 bp, Candida albicans
attaaaaaattcaccattagtacgttgattatttctacaagtgatttcttatctttgaattttttctttttggttagaactgaaggtagttggttagatattggcgtttcaatatcgaattattgtttagctatattgagttcattatttatgttgattttagaattgattagttcggttgtattgagtggtgtggaatataattccgacggtactaaattagattttgaacctataagttatatagttagaaaaagaaaagttacatag

SEQ ID NO: 6456 - DNA, 852 bp, Candida albicans
tcacgggtattgaatcattcgttcatgggatttctaaaacaacaaaatttcttgatcgttgagtcatttattggaatgtatcgaggtattgcatatggatttttcgaaagagtaatgttttccataattttgataatcattggactttatccattattagttcatggggcacataaagtttctggattaatgaaaactatttggtttattacttgtttgttaatgtgtactttcaccaatttggatccagtgaaaatagaaagtttatttcaaatcaatgttgggacaattttagcattaattgttagtattatggggacaaaacaagtttttaaaagaacccaagtgggacccattcaaaaacaattaataattgcacaaattgccattataccaataattttatttgccactaatatctcagtattatcattacaagctagaactgggttaccattatattcccaaatattaggttggataacttttatcgtttccctaatagtattaccaatattacatttccttaatccttctagtgattatcaattgagattattaattatatttttaacatttgtgcccacatttatcattttaacaatttcatttgaattattattttacgttggattttcattaattttattacaatggttatcaattgaagaattattaaaattttctcataaagatttagttgaaacttttgaaaaaactgggaaattacctaaaggttattggttacaagttattcgtattactattattggatttttctttttacaattggcatttttccggactgggaatattttttcacacacggggcctggaaccatccgcgattgc

SEQ ID NO: 6457 - DNA, 1722 bp, Candida albicans
aaaattaattcatatattactagctttttcttttacttattcttcattcattcgttatcaacacaacttcaaaaccttttttgggacaactttttatacatattcataatggatagaaatcgtcaattgttattagtaataggggttttattccattttttttatttatggtcaatctttgatatttattttgtttcaccattagttcatggtatggatcatcataaatccacttggaccccacctgccaaaagattatttttaattgttggtgatggattacgtgctgataaaacatttcaaaaattaactcatcctcgtactggtgaagaaaaatatttagctccttatttacgtagtttagcattaaataatgggacttgggggatttctaatacgagaatgccaacagaatcaagacctggtcatgttgccatgattgctgggttttatgaagatgttagtgcagttactaaaggatggaaagaaaaccctgttgattttgattcatttttcaatcaatctaaacatacttattcatttggactgccagatattttaccaatgtttgcctttggtgatggggttgtcccagggagaattgatgtttgtatgtatggacatgaatttgaagatttcactgctagttcaatcgaattagatgcttatgtattccatcatttggatgaattgatgcataatctgacgactaatgcaaccttgaatgaagaattgagacaagatggtaatgtgttctttttacatttattaggaccagatactgcgggacatgcttatcgtccatattctgctgaatattatgaaaatatcgaatatatcgataggaaattagaagaagtgataccacaaattaacaagtttttcggagatgatcaaacggcatttgttttcactgctgatcatggcatgtctgattttggatctcatggcgatggtcatcctgacaatacaagaactccattgatagcttggggtgctggtgttaagaaaccaatacatttgcaagatgtttctaatttagaagagcaattattaaagcaatcaccagaaaatagtggatttgaatctacttattttgatacttgggaacttgatcatcttgttagaaatgatgttaatcaagcagatattgcatcgttaatggcatatttgattggtgctaattatcctgctaattcagttggggaattaccattgggttacattgatgctgatccagtgacaaaagctcgagcattatatgccaattcattagctattgttgaacaatattttgttaaagagcaagaagtttataatcatcaattcaaatttaaaccatacagtccatttgaagagaaaagtattcaaaaatatcaacaggaaattgaatctttaattgatcaacttgaaaaaagcggttcagggtctaaagatgaaattgagaaaaaagttatcgcaaaaattgaagaattgatgaaaacaactttggatggattgacttatttacaaacttataattggttattacttcgttctattgttacattaggatttttcggttggattgtttattcattcaatattttcttgaaattatttgtattaaatgaagatgaattgaaaatccctccagaattttctgtaactttagtcgggatatttggagcattagcaatttctatcaattatttattattttatcaaaattctccatttaat

SEQ ID NO: 6458 - DNA, 1311 bp, Candida albicans
ttttctatcgtcatgttatcagctgaattaaaaagaagaaagaaattgctactcccattagcattaatttctggtatcattgtgttgttatttttcacaaattacaattattcatttaccacatcttcccatccagtattgtcttcatctcacaagagtaataatgctttcccaacattggatcaaacttcttcaaccaaggcaaggccaaatcctggtaatttaattgccaatcaaaaagataaatcccaaaccggtacttatttcaccaaattcattcataaagatcctcagtttgattttacaaaaataacatacacttcaaccaataagaaattcaaaaccaataatatcaaagttgacgaagaaaccggtgacaccactgaagttgttaataaaccaacagtattaatcatgtctgtcattggaaacaatgaaccatatggaagtgataggcattttgacggattcatgctcacaatattatcccttgttgaaaatcaaccagactacgaattttcattagggttattaaacaataatgaagaagaattcatcaagattcaaaattattttgaaaaaaacttacaaaaagaattatctgaaacgttatcatcaattttcaaatcgattagtttaatttctgctccattcttagatcaaaacacgggtttttctcgtgaacaaagacatgatgatcatgttcaacgattaagacgtcgattaattgccaaatcaagaaatttcttattattaaatactttgaatcttgaacaatacgtgttgagtttggatgcagatatgattagatttcataatcctgaaaaatttattaaaacttttattgattccaagaaggacattatagttcctagaattcaacgtcttgacatgcaagattatgataaaaattcttggcgtggtcaaagaacaaaaccaacaaaagaacaattggagaaaatggataataatcaatgggatcaatgggattatgttcctcgtgatgtaaaagatcacatgtatcatttccaaacatatatggataacaaagataatgaatatgaattacataaagaggaatacgattatgtggtacctttggattcagttggcggtgctgttttgtttgccaaatcaattgttttcaaacaaggtgttattttcccaactagtttgattgttggaacaacttgggatagacaagaaggttatgatggtatagaaactgaaggtgtttgttatttagccaaacctttggggttctcttgttggggtatgcctaatgttgttgctcaccattctggaggttaa

SEQ ID NO: 6459 - DNA, 318 bp, Candida albicans
gtatcctacttggaggggcacatttggcaaacatacgggatgcttaatggtgatcctcgagaagtaattgatttagacggtgttggtggtgtgtcgatattggcacgagcaaagatttttagacaaggggtacatttcccagcatttacatttttaaaccacgctgaaactgaggcctttggtaaaatggccaaaaaaatgggattcagtgttggtggattgcctcattataccatatggcatatttatgaaccaagtgaagatgatttgaaagaaattgcgagattggaaagaaagaaaagaagacagaagtcataa

SEQ ID NO: 6460 - DNA, 933 bp, Candida albicans
ttctgctcagtgatgattcaaaatactgttagaggatctattcttagatcagcaaaatttactgcaccaagatcattgctttcgatttcaagatcattgacaaccgaaaacacatcgagcaaacctacaccacctccaaaaaatgatgaaaccacccattttggtttcaaaacggttaacaaagatgacaaggaaaagcttgttggaggagtattctcatcagtggcatcaaattacgatgttatgaatgatgtcatgtcaatgggtgttcacagattatggaagcaccactttattcaaagattagatgctggtatgagaccaggatcaactcaacctttagagttcttagatgtggcaggtggcaccggggatattgcctttggattattagatcatgctgaaaagaaatacggtgataccatgagcaagatgaccatcgcagatattaatccagatatgttgaaagagggagaagtaaggtttgctaaaaccaaatgggccaatactgaccgtgtcaactttttagttcaaaatggtgaaactatggatcagatccccgataattcaaaagatgtatacactattgcctttggtattagaaatttcacagatatacaagccggattaaatactgcttaccgtgttttgaagccaggtggtatttttgcatgcttagaattctcacaagtggaaaatcctcttttggactatgcttaccaagcttattcattttctttgttgcctttaatgggtcaattaattgctaatgatagagattcgtatcaatatttggttgaaagtatcagaaaattccctaaacaagaagaattcaaaggcatgattgaaaaagcagggttttatgtccctgaaccaggttacgaaaacttgacctttggtgttgccagtattcatattggtgttaaaatttaa

SEQ ID NO: 6461 - DNA, 780 bp, Candida albicans
cctcccacgtttgtccgtccagtcggctggttgaagaaagtggtgcatgttgttgccttttgcttttcgagcttattgttgatagttatttttgggctaatcataatactatttttcaaatacattaagactaagaaggacctagaaggtatacaactcaacgatagtctgcatgaaataaccatacactctgacgaagaagataacaacaacaacaacattgacaatacaaatcataataacaaaagggcaagcgtaaccattaataaaacaatatttgatttaactccttttttaaatctaatgttagtgtttacttttttttcagtgttaactacgttgttggcttttttagctgatattttattgtttaccccgaacttgtcataccttggatggcttcaattaataccgattgtgctgatggctttagtcacatcgatgttgtgtttcatcaagcgatcaatttcttcaagaaagttttttgaaagtgaatatcgatatgctaatgatgatatgagaataatgagaaaaacttatgttgatgagttttggaacgataatgccagtgacgatggattctatgtttacacagatggattttacactagaaatggcgacaatgtccagcaacctacttccaatacagctggatcactactatctgagcaccacgatgtcagcattgtagaaccaagaactttccttgacactgatgattctagacgtggaagcagtccacatgagttcatagaattacaaaatttacgaccagtataa

SEQ ID NO: 6462 - DNA, 471 bp, Candida albicans
tcatatatttcttgctattctttctttctttctttcttttgttttagaatatttattcgtatatatatatatatatatatatatataaataataaagatatcttttcaaaagtcatgccaaatacattagatcaatcatacgttgaaaaaggagcttggaaacaagatttattcaaaggtaaagtagttttcatcactggtggagctggatcaatttgtcgagttcaagctgaagcattagtattattaggtgccaatgctgccattattggtagaaatcaagaaaaaaccaccactgcagcaaaagaaattgcttcattaagatcagatgctaaagttcttggaattggtaatattgatgttcgtaaagttcaaaatttaaaagaggcagtcgataaaactgttgaagaattaggtagaattgattctcttattgttcttctaccacaaagggcgaaggatccgcgataa

SEQ ID NO: 6463 - DNA, 936 bp, Candida albicans
  unsure (434): Identity of nucleotide sequences at the above locations are unknown.
aatatttattcgtatatatatatatatataaataataaagatatctttttaaaagtcatgccaaatacattagatcaatcatacgttgaaaaaggagcttggaaacaagatttattcagaggtaaagtagttttcatcactggtggagctggatcaatttgtcgagttcaagctgaagcattagtattattaggtgccaatgctgccattattggtagaaatcaagaaaaaaccaccactgcagcaaaagaaattgcttcattaagatcagatgctaaagttcttggaattggtaatattgatgttcgtaaagttcaaaatttaaaagaggcggttgataaaactgttgaagaattaggtaaaattgattttgttattgctggtgctgctgggaatttcctttgttattttaatcatttatcttcaaatgcatntaaatcaattgttgatattgatttattaggatcttttaataccgttaaagctacttttgaacaattacgtaaaaataagggagccattttatttgttagtgccacattacattattatggtgtaccatttcaaattggggttggtgctgccaaagctggtgttgatgccttgagtaatgctcttgccgttgaattgggtccattaggtattagatcaaatgctattgccccaggtccaattgatggtactgaaggtatgctgcgtttatcacgttcaagtaaagatgaaacaattaaaaatgttccattacaaagaatgggtactactcaagatattgctgatggtacagtttatttgttttctccggctgcttcttatgtcactggtgatgttttagttgttgatggaggtagctggcaagtatcttctggtgttggtgctaaagattatccggtaactcttcttaatgccattaatgctccaaaaggtggtaaattgtaa

SEQ ID NO: 6464 - DNA, 879 bp, Candida albicans
atcaaaatgccaaataccttagataaatcatatctcgaaaaaagtgtttggaaatcagacattttcaaggggaaagttgccttcattactggtggtgcaggtactatctgtcgtgttcaagcagaagccttagttttattaggagctgatgttgccatcattggtagaaaccctcaaaagacagaagatgctgccaaagaaattgccacattgagaccaggtgccaaagttattgggattggtaacgttgatgttcgtaaaatccaaactattaaagaagcagccgacagaactgtaaaagaattgggaagaattgatcacgttattgctggtgccgctggtaatttcttatctgatttcaaccatttatcatcaaatgctttcaaatcagttattgatattgatttattgggttcttttaacactgtcaaagtttgttttgaagaattgagaaaaaacaaaggtagtgtcatctttgtgagtgctactttacattattatgggttaccaatgcaacttcatgcaagtgctgcaaaggctggtgttgatgccttgagtaatgcccttgctgttgaattgggacctttgggtattagattcaactgtattgcacctggtgctattggtggtactgaaggtatgctgcgtttatctcctcctaatgaaactccattggaacaaaaaatcccattgcaaagacaaggtactactactgatattgctgatgccactatttacttgttctcaccagctgcatcatacgtcactggtgatgtgttggttgtagatggtgcttggtggcaagttggtggtttcctcggtgatctttacccaagccttgtaattcaccaaaacgaagacccacaaggaaaattgtag

SEQ ID NO: 6465 - DNA, 954 bp, Candida albicans
tttcatttatcttccttcttttttgcactcttatacctttttcattctttttttgtaatttttcgcaacctaaaaaataataagagaaacttgctaataacaaagttcatggcgtcaattcctgaacttctttctttcctattactagtttgcttccttaccgtgctagatattttaagatcccttatcaccatcatgtctgctaacaataataataacaataatcacaacaacaatagcaatgcattgcaaaatcctgtttcaccaaaacctactgaaggaaattccaaacaagaatctgagaatacagttaccaacgagttacccactttccaacatttgaaacattatccacttgtgaattcaacaaaatcggctattgaacttattcctttgagtaaaagtgtattttcaatcatggggaattcattttcatttgtcagaagttatcaaccaatgaaatatattgtgggtagaagtgacactttgacaaatcgagcacttgatgaaattgataaatggttaccaagtttacaaacggttgaagttcaagacattactacaccaatcaccaaaccagtaaatgataccgttgaaactgttcaaaatactatcactgccgttaatggttccgttaataaaaattttgttgatccaacaaaaagtgcactaggttcagttaaagaagaatttcaaaatcatgtgtatgatgctgaaggtaaagggataatttcaagtcaagctgatcccatggtagctccattaaatcatactttggagcaatttgttgataatcatttccctaatactaaaaaagttccaactgaaggtcacgctagtgaaatatcgagaacattcaagattgtcgggaatttgatatcaagaggcgaaaaggagaaggaaaaagagaaagagtctctggataaaagtaaaccagaaaagacaaaatcataa

SEQ ID NO: 6466 - DNA, 1167 bp, Candida albicans
tctcctcaaaaaatatacgcccatacaaacacaagtgttgccaacacatacaactttacaaaattccatttttatacaacaccaataatgccatcgattgaacaacaattagaagatcaagaattatatttaaaagatattgaacagaaaatatttcaaacattatccaaaataaacaaaacaacccttgaaaatgataatgatttccgaaaacaatttgaagaaattcctcaagattcaaataccactgaaagtaacaatttaactgatttaacaattactgaattgaataataaatttgaaatcgttactgacaatttacaacaattgaatgaattacaagagatcaattctaaattaaaagaaattgaaacgtatttggggaaaccgaaaacattacaaagtatattagatttacaatatttaaataatttatttaaacaaatcatcattgatacaaattctcaatatataatatataaacaaatcaagaagcgagtcgattcactttatgaaaattttgttaatcaattgaatgaatatttaactattcttttaattcctgatccattgactattactaatatagcaattttacaagatttcaatcggtttttattgaaaaatggacataataatatgaatgcatacgataaatataaggaaaattgggataaattagtggattcaatattgggggactccacccccaccccttcaaaacaacttagtttgattgttgatgaattggaagatactattaaattagaaattgtatcagacaacgaggacaacaatttcattaaatcaattactaatttaattagatttataaatgaattacaatatcctataatcaaaaattatttaaattctaaaatttctaaaaatttaattgataaaatttccatcaatataaatcaaattattaatgataaacaacaattgaatgatttagatgaattagtgaaattatgtcatgaaactaattggaatatattatcaagaatggaaggaataagaaatggtggtgatgattctttacaagaaaaattgaataaattacatctggattggattgttgataattatgttgataaaattaaaaaaatttataaatctgatgccataaaaaaaactgaattgattgattttgatagtggttaa

SEQ ID NO: 6467 - DNA, 705 bp, Candida albicans
ccaatttcatcaccaaccacaaacgtggagacatcaagtgtgttcaaagcatcaccactttcaaatggagtgaaaaataatgccgacacagttaccttaaactctgtgaatattcctaaaactattagcggaactgcgatcgatttttaccagagagagttattattgtacaaaaatgagttagaattttcaagatacatgaaacatttgaacaagttttattatttgaaattaaagcaaaataaacaacaagaaactgtcgaagcaagagttgatactaaatatgagagtttaaaagttgtattggatgagacaaaagaaaagttgacaaaattatccactgatcatgacgaggaaaagaaaatattgattaaaagattggaagatttgaacttggagaaagaaaaattgaccagagagctcaatgacaccatcagcaagacatcttctgatttactgaagtatgatctattaataaaggatgttatacccaccaaagattatgagattgaaaatttaaaattgaaattatcagcattggaagaaaaattgaaagagagacctgaagaaatgcataccacagatagtgagaccacaactcagtcacatgtagaagttgatgttaccgtctacgacttgagaacaaagttgcaacttgtcaatgaaaaatataaccaaactgcacaccagattatatcatcctag

SEQ ID NO: 6468 - DNA, 429 bp, Candida albicans
gatctcagtctagggagagagtttactgcaatacagactgacacaaacagggtaaagatatttggcaagtcttcaatcaagaatatccccgagtctacagtggctagagtggcagccatgtggtcttctgttcatatactactggaaacaaacgtgctccagtcatttggtaacaacagtcatgagcagttgtttccaaacaattcgagtgttgcagttgaggaatatgctattggcagtgagcatggattggtcacatcagacaacatagtttatgcctggggatggtcagagcacgggaattgtggtacatcaaatgcttctgataaagtgacgttcgattatcttaacaagttgtacaccgggtctgcaaaagtggtgcttattggtgctggctgtgccacaagttgggttgtagttgaaaaatag

SEQ ID NO: 6469 - DNA, 318 bp, Candida albicans
  unsure (313): Identity of nucleotide sequences at the above locations are unknown.
agcgcaccaaaaagtttgacagatgagtccgaagcggaaatgtatcaactactagcatgtggatcaaatgggaactaccaattaggaataaacaatgatgaggatcagaattcgttgaaggtgactttgtttgatatagatggcacgatgtcttcagaggtccctggaaagccaatgaaaatagctggtggaggtaaccatacaatggtaattctagataatggcgaagttttcacttgtgggagcaacgagtttggtcagtgtggattacccagaggtgagagtttgggtggtcccgaccaagtacctgtcnattaa

SEQ ID NO: 6470 - DNA, 3078 bp, Candida albicans
  unsure (26),(33): Identity of nucleotide sequences at the above locations are unknown.
ctattcgcgggtccgtcttctcccgnagtgaanactaagggtctcgacatccgtgatgcaaatagtttattcaatacttttgaaatttttatgccttgttttgatgggaaagaaacagaatcaaattggaaagtaagggaaaaaaatatcttgcaaatgagatcgattttacgtgggaatagtgctacacagtttagatcagaattggttcagtgtattcatactatagctaatggaatgtgcaaaggagcaagctcgcttcgtactacgttaagttccaacagttgtcaattaatcaaagaatgtgccgtgattttgaaaaaatcattagagccagtggctgagagtcttttccccacgttgatcaaactatgctcttccaccaaaaatattgcctccaccaatgcaaatatgtcggttgctgcgttatacgctaacttgccgtatacttcaaaaatgattcaacgtatcaccttggcatcagaggatagaaattatcaacctagatcgtactctttgatttggttgcatattttattgttaaagataggaatagaccgcagttatattggacatcacgattccagttttattgaagcagcaaacaaggtgtttatgaaacttttgaaagatgctaatcctaatgttagacaaacagccaaagaatgctattggtgtttcactagagttttccctgaagacgcagaaagacttttaaaacgactagaaccaaatattgttagggcacttgaaagatctcaaagagaaagtggcgggtcaggaattgcacccatcagaaccctcagcagtcgcccatctcggccatccttgaaagaggctatattagagaagaataaggaattgcgtcaacgaagaccgccttctcgtaactcgggtgagcagtcaacaaaaataaagtctgtgcctttgccaaggccaactaaaagcagctcacgtttggagaagtcgttactcaggccagatgttgggcataagagccagccagcagtgagagcatctagttggacatatcctagcacccaaagtggtcccaaagccactttcaagcaaagagaacgtagtaaaactgaggtgcataaaaaatcgccacttgaaatctcgaggccgtcgagtcgtttggacaccggtgctgtttcttctttcaataacaagaacgatcccatgatcaactttttatcgtccagtgatagtgacttgataaaggagggtataaatttattaaaatatgcgattatagggaaagaaaatctaccatctgaaatcaactccttgcttaagagcatttctgaaaagcatgttcaatttatgaaaccacttttcacgtcaaatgattatacttttaaaaaagcagcactgttgttacttcctgatgatttcttaagagtttgtgcgttggtttttgatgaatttgatgaggctgttatcagcttgattattcaatgtatcgatgttctgactttttatgagtcagcttgcaaccttttaacattggtggcagataccccaaacatacctggaagtcatgcccttgtaatgcagatatctaaccaaaagttgactataacgaaactgattttacaggcgttgctgatagctttgagtaaacatgcagttactgacgttcagtttggagaaatatttcaagagcttgtcaaattgattattgtattgaaggcaactgattattattcgctcctttgtcagttgtttcgtcagttgtatactattgacagtaacaagttcagtttgttggtagaagatgtcgagggcaagcttaaggaagaagtggagtttatagttggtattgagagcactatgacacttgaaagaccgtcaagcaaacttgattatgatttgactgtggttaagccaacactgaatttaggtactttcgttctatcccagaaacccagtgctgatgattttactatgctattacctaagagaagtgagtttttgggtagtggagaggtatataattcaaagatggtggcaaagatagaagctctggattcatcaccacagaagcagtcgcaaatggaccaaatctctctgaaaagatcaaactcagaacatcaatcggaagtattggtggatgattttgccaatgtttccatagcagatggtggtggttccaaattaaatcaatcgaaaaatgatgacgataatttgaaacagtttatggaaagaattgatccattgaaaccaatttccaacaagattagaaaaatctccatatacgaggatgctaagcagaattcagaaaaacccaaattagaaagaaattggggtggatttcagtatgccaaattttcaagagcaattcgtgttaatgcagtcgcagagaatatgagtttgactagtcaagaatttgaaagttgttgctcaaaattagtggaaacgccttctcagtctgcgttattgaaaatgacttggtttgttgattcattgtcagtttccagctatgactaccaagaattttttcttaacaaggggaaacacaagttggagaaatcgttatgggaatttttcagtaaaatcgataaactggatcattcattggttatgaatggattattcttgttgaaacaattgttaaaatttaatgacactcccaatgttgataaattatttgcacttttagttgatacttgctctcaagaagaattggatagtgaattatactttatatggaacgaaatgttgttaagtttaaaccatgatgagttaatgaaatcatttgagaaaaatgccttgaactatttagaaggagaagaaaacaatttgactattctgagtttatgtttgaactatttagccaaagtgttggtcgatgataattgtttggatgttgcaaaaatttatcgcttagatactatatttgggaaactatttcatgaacgtgaggtgatgtttcggaaatcagcaacaatctgctatagtaatttattgaaaaacactaatgtttctcctgaagtgaaagatactttggataaagtcaaatcaagataccctgcttatactcagaggttaattgagttttacatgaagaggtaa

SEQ ID NO: 6471 - DNA, 2652 bp, Candida albicans
  unsure (2455): Identity of nucleotide sequences at the above locations are unknown.
cgagtccggcgggggcggacatggatctttacggcttgttgcagatctgcattatatgattacgataaacaaacggaagaagaactttcatttaatgaaaatgacaaatttaatgtctttgatctcaatgatccagattggattttagttggtgacttagcaaaggagaagtttggttttgtcccatcaaactatattcaacttgattcaacagcagagccagcacagcatcaacagcaacaaccacaacaggttttccaaccaccaccacaacaacagcaggctattccacagcaacagactcagattcctatcaacaattttcctccacctcctacacataaagatagaacaccggatttccctgcaccacctgctcatagggatagatcaccagagcatccacctccaactcctgaaaaggactatcctcgtatgtttgaacaagagccaaggtctttgggttctagatacgaccgacaaccagagggtagagaagaggaagaagatgaagcacctccaccaatgccatctagaccaactgggtcaaatatcgtggcaccagaaccagttgtaggtcgttccaacacctatgaacaagaagagaatgttgaacatagtgagcattcgtatgatggagaatttttcacttggtacattgacgaggttgatggtagaaagaaaagagcaatcaaactttcaattggccaaggattagtaatcattaaaccaaacactacaaaccctaagaaattgaggatgagatcttcatcttctcttgacaaccaatggagaatcaaagacttgatcacatttaataacgagaagaaacacgtatttttagaatttaagaatcctgctgcatcattagagttacacgctggatcaaaagatgtcgctgaagcaataatggcaatcttgggtgatttgaaaggtgccgaagctgcccatggtttgagagaagtcgctaaagcatcaaaggcaagtgccaatgaaagaaacagaaaaataggtagattactttacgatttcgaggtacagggtgatgatgaattggattgtaaagaaggtgacgaagtgtatatcattgaccaaaagaaatccaaagactggtggatggtggaaaatattgcaactcgtcgtcaaggtgttgttccatcaacctatattgaaattattagtacatccaatttggataaattgacagatggtccattgagaagaaaatccacgaaatcaaagggaagagtcgttgaaacaaaagacaaacgcagttcccatcatagaaccagagaagaacgtgatagaattagagaaaaggatagagctcaaagagataaggcccctacttcacaaactgaacaagacaagtcaatgccaaatttccacagagtaagaacttggattgatagttctggtacgttcaaagttgaagcagaatttttaggatgtgttgaaggtaaaatccatttacataagacaaatggtgtcaagattgcagttgctgccgacaagttgtcagtggaagatcttgagtatgtcgaaagagttactggtacttctttggaacaatataaagaacaagtaatgaaacaacaagcaaagagagcaaaatcaaagagcaaatcaggtgctactgcgactccttcaagtaccaacgaaacaaaatatgcatcatcggcaactgcagcaattaatgacattgctccacctaaacccacaagaccacaaacaacaacacaagtatccaataatggtgccccattgtatgactggtttgactttttccttgaatgtggagtcgacattggtaattgtcaacgttacactctcaattttgagcgtgaacaaatggatgaaaatatttgggaagacatttcaccatccttgttgagaactttagggttaagagaaagagacattatacgagtcatgatatatttggatgcaaagtttgatcgtaagaaaacaccagaagcaccacaacagaatggtggtttgtttattgataagaatggtaatttgaaaaacaacagctcttcaactgaaatatccaaggtctcagccgatgccttgccatctccagttaagactcaggtcacttcttttacccctgttaatgaatctactcaaaataataacaagattgaagatgacgcatgggcaatgaaaccagctgcaagatcaagtgaagatcttctcaaaccttctcctcaaccacaaactcctcaatacacaggagctttgtccgatcttgttaacatcaaacctgttggaactagcaatgaaaacaaggctaaaacagagcaaataccagttgaaccatcagcaccagcacttcaaccaatgaagacttcaaatactgctgccacctcttctattcctcctcagggccctggtgtaactccacaaagaacaggaactttggttcccgtccagaagacaggcggtttantgcctgttcaaagaactggtgctggattagtgccagtgcaaacaggtggttatttgcctgctcaacctacagggtgtgttccaatcactgctcaacctactggttttattccaattcaagctacaggaattttgcagccacaattaacatttggtattgttcccttgcaaacaagtacaagtactttcaatgcaaaa

SEQ ID NO: 6472 - DNA, 1113 bp, Candida albicans
  unsure (1006): Identity of nucleotide sequences at the above locations are unknown.
aaaccccatcaaagtgtttttagtgcgccagttagcaaatctgcatttggtcaaactgggtttggtgggtcggaagccagctctgggtttggaactacaggacttggacagaaacccgaagctacctccgcgtttggaactacaggacttggacaaaaagttgaatcaaaatctggttctggtaactctgctgtcatacaaaatccccaagctacctctgcgttcggaactacaggatttggtcagaagcctcaagctacctccgcgtttggaacaacaggatttgggcaaaaagcccaaacaaattctgcatttggcagctctggctttgcacaaaaacctcaagcaagctctgcatttgcccagtcaagtggaagtcctttttctggattcgcaaagtcaggatcaacaagctcaggatttgccaaacttggatcgggtggtccttcaattttcggcgacaagacctcgtctccagtttctaccccgttagctgatgaatcaaaggaactggaagaagaaagtgaaatatcattacccgaagaaagtgattacagcgatgaagaggaattggctacagatgatgcaaacacatccaaggatttggaagaggtagaaggagaaaatgttacagaaactcaagaggagaaagtggagacagaaatcccaccccctaccgatccaaagccagtacagttttctttctttagtggcttcaccaggatttccaagccaagttctaacgaaatcaaaaacaagatcattaacataattgaaagcacagaaggtaacttacaagttatggatgcaaacagaaaccaattgggagactttatcggccaacacgaaaaaatcgacaagggcatagatagtcttaaattcgccgaggcaagggttccactccgtgataccaccgagactttaaaacgagaattattagagctaaccaacttatctacaaaaattcaaaaatgttttgggggaaaaagtgaaactcgaccgtctntacagtcaattgggcatggcagcagaccaaaactctgccaacaaagatgtcctcaaatcccggccattggatttcaaaaacgatttgatgcaaacaaaattgcgtga

SEQ ID NO: 6473 - DNA, 345 bp, Candida albicans
ctaactactttgtacaattataaaactcccaccaacatagagacaatgctgtctatatatataggtgtttacaaggcattgtatgattacgctgcccaggcagaagaggaattgaatataaaacaaaatgatcttttatatttgttagaaaagtcggatattgacgattggtggaaagtgaagaaacgggtcgtcgcaactggagaagaaattgttgatgaaccatctggtttagtaccatcaacttatattgaagaagctcctgtaattaaaacagcgactgcattatatgattacgacaaacaaacggcatttcaaacaagctatagcaggacagacttgtga

SEQ ID NO: 6474 - DNA, 822 bp, Candida albicans
cgcggatccttccaggccgtggtgaatatcccaacagttgccaactcaaataactggtggtgcacaccgcaaacatcctttaaccaaccagcattagttccaacacaaagaacaggcggtcaaattactggtggatttgtaccacaatccaattttggtaagcaaattactggtggatttatggacactaatacgttgtcatttggacaacaaatcactggaaatgcacaacaacaaccgccaccatcgacttcatttggacaacaaataactggagggttgccagcaacttcttttggacagcaaattactggaggtttcccacaaacgtcatttggccagcaaatgactggtggagcaccacagacttcttttgggcagcacataactggtggtaatatgccaaatacctcatttggccagccattttctcaacaagctacatctaacccatttcctcaaatggctaatcaatttacacagcagcaacaatatcaacaacaacaaccagtaatgaaccaatttcaacaacaaccgcagcaacagcaacaaccattttacaatcaatttcaactgcaacctaatcttaatcaaatgacaaatatgtttcagaatacttctatatcttctcctgctacgttcaatcaacaaattccaaccacaacttttggccaacaacctcaatttgaaggatttggatcacaaccattacagtcacaaccaactggtatgggctttggaaatgcaccattgcaatcacaacctacggggaagagagctaatctacaagcagcaacaccagataatccctttggattctag

SEQ ID NO: 6475 - DNA, 1257 bp, Candida albicans
agtttggtgcttagcaataagaatatgaaaattagatgtgaaaatttacaatccaactctaatgccaatattgctgaatttgaaagattgaaaatcagttatgacgcgttaattgcttctcaaatggaatataagaatcattatcaacaagaattaaacagtttacaaactgcttttgataactataaattggaaaacactagacgatttgaggaattacaaacttctattgtcagtaatgataaagatattgacactttattggattctttaaccaacaaacgtaaggctatggacaatatttatgtcaataaaaataacaaagtattacaattgttgggaaatttagctcatttggccaaattacatggacaagatactaaatctcaagttgaacagaatgtaagtgttatagagcaattattggctaagcatcctgatttgcaagaaaagatattggaaaaggaaaaaattgaagttgatttagctgagattatagctcatagcaatgatgtgttagcaaatagttcattcgatgaggacacaactttaatcaattctccagatttggaaaataaccaaaatttcaatactactcacagcacttctggttcggctactcctaacagcaacagtcattctttgcaatcgaaaaagaggaagaactataaacgtaattccttgattttgaaagaactgccaccaatcatactggaaaatgttccaagttctttaccaaagaagcctcaggttaataataatcttatcaacatacctaaagctagatccaagtttaataccccaccaacaacacctagacaatttacaaaccacaataacgactttgaagtaacacatcaatggaatggcaacaacaacatcaacaaccatcgtcgtaacaacagtgttgattctagatcagataacggtcaacatcgtcgtaacaatagctacgattccagatcagatcatggccaacaccgtcgtcaaccaagtcagcaaaataacaactataacaacaacaactataacaacaacaacaataataataacaataacagcaataatggttttgttaaacgaagtggttctgttagaaatgttaacaattataataacaataatgggaatgctaacaataatggtaacaaccatggaaataaatttaaaagaagatcaacctataataacaacaacaacaacaacagcaaaagaaattcgcaacttttcgataataactttgcattaaatgcatag

SEQ ID NO: 6476 - DNA, 309 bp, Candida albicans
ataataatgacagatactccaaactccccactgaagagtacgacaaagtctgccagctcatccactaaagttattgattctttacattccaaaatagatgaattaactgatgaattaactgcgttaaagcaatcacatcaagagttgacgaaaaaacattccattacagctaagaaaaatgattcctttgttgatcaattagctaatgccaaacatgaaaatgatatgttatcggcgttattaaaaagaaaagaacgtcgtattttggatttagaagaccaatttaatgagttaactagttcaaaatga

SEQ ID NO: 6477 - DNA, 1152 bp, Candida albicans
ctagttcaaaatgaaagtttggtgcttagcaataagaatatgaaaattagatgtgaaaatttacaatccaactctaatgctaatattgctgaatttgaaagattgaaaatcagttatgacgcgttgattgcttctcaaatggagtataagaatcattatcagcaagaattaaacagtttacaaactgcttttgataactataaattggaaaacactagacgatttgaggaattacaaacttctattgtcagtaatgataaagatattgacactttattggattctttaaccaacaaatgtaaggctatggacaatatttatgtcaataaaaataacaaagtattacaattgttgggaaatttagctcatttggccaaattacatggacaagatactaaatctcaagttgaacaaaatgtaagtgttatagagcaattattggctaagcatcctgatttgcaagaaaagatattggaaaaggaaaaaattgaagttgatttagctgagattatagctcatagcaatgatgtgttagcaaatagttcattcgacgaggacacaactttaatcaattctccagatttggaaaataaccaaaatttcaatactactcacagcacttctggttcggctactcctaacagcaacagtcattctttacaatcgaaaaagagaaagaactataaacgtaattccttgattttgaaagaactgccaccaatcatactggaaaatgttccaagttctttaccaaagaagcctcaggttaataataatcttatcaacatacctaaagctagatccaagtttaataccccaccaacaacgcctagacaaacaacacctagacaatttacaaaccacaataacgactttgaagtaacacatcaatggaatggcaacaataacatcaataaccatcgtcgtaacaacagtgttgattctagatcagataacagtcaacatcgtcgtaacaatagctacgattccagatcagatcatggccaacaccgtcgtcaaccaagtcagcaaaataataactacaacaacaacaacaacaataataataacaataacagtaataatggttttgttaaacgaagtggttctgttagaaatgtttatgtcaccacggggctggaagacccgcgt

SEQ ID NO: 6478 - DNA, 1482 bp, Candida albicans
gcgtatttcctaaaaagcacatcaaagagactaacacgtcagcaggagtcagaggttgagaatgagaatgaacttgccaagaagcatttgttgaagtccttgcgcagatctgcaactccagaagcgggcacaacagagactaggtctcctggaatgagtccaataatagacaattcttaccaagagccatccaacgaaattgaagagtcaattagagcacaacgtcaacaagtcccagtaacatcaaggagaaagataaaattactaaagagatctgataatgaagcatctgcaaatttgttggagttattaggtccgaaaaagacagagagtgtggatacagcaaataagaacccagatgcaggcaacgaactattaggattacttcataagaagcaggaacaaaaccaggaactgttgcccaacgtagagagatcatcgacaagaaaagaagagctgcaaaacacctccaacgaattgttaactatgcttaaaaaaccaactgccgcaaaagaatccacatcagagtcacgatcccaaaatttgcttaacttgcttaagaagccagaatcacaaaatgcaccaggaagcaaggggaaggatcaagcttctggcgaccagttggctgacactcacctaccaagctacacacaaaacaacttgcaacctcaactcagcaatttaaaccctttaccaagccccatgaacttcttgtcgagtccagagcagaagccacaacaagcatcacaagtatcttctgcgaaccaattattgggcttgcttcataaaaatggtaccgaaagaaataaaagtataacatctccgaacgagttatggggaacaagtactcctggttccacaggggggcccagcgttggagaggccaataaacattccaatgccaccaccgggggtccgttcagaagtaacgtgctttctccaaatctagacatttggacgaatgatacaaaaacatcaagcttgctgggcagccagtttcaaatcccagagccaagtagaaggagcagtcagttattggatttattgaacacgaatagagatccagtgcaagatgctcaatattcgcaatctaattcgaataactacaacaatggaggtatagaaattgctagaagagattctccatctgataagtttgaaaattttgaggatttcgaggactataacgatggatatcagtttaatgatgaacttcttgataaaacatacaggaattttgatatcgctagtgacgaagaggatgttgattatttaattgaccctttgattacacataatgacaagctgctgcatcaagacaacgaaatcaaaccttcgctggtagataaccagaatgatcaaccaaagaagataagaattttgaagcctggtgaaaacattgacaatcttttcggttctcaaggaagtaacgagcctggaaaagggttattggctttattgaatggtggaaaggcacagtag

SEQ ID NO: 6479 - DNA, 1284 bp, Candida albicans
gaggagacggaccaaaggaaatttgaagaggagaggccggaaagtgaacgtatttacaatgaacgtaaggccaaggaaaaggaagaaaccgatagattgttgaaagaaattgaagacttgaaagctgaaaaggagaaagctgccgagttagaaagagaagaagcagaaaaagttgcacaagctaaattggcacaaattgaaaagttgaaacaagaacacgaagctaaaaccaaattgttcaacgataaattggaatttgaaaacttacaaaaacaaagattagaggaggaagttgccaatttgaaaaagattagggaattgagagaagaaaaggcaagattagccagcgaacaatacaaagacccagaattggaaagagtcaagaaattgattcaagaaagagaattggaggtggacaaattaaccaaagtgattgagtttgaaaaaccagaacagacatcatctgaaggtggtcattttttaggaattagcaatgatagtaagtctggagccattcctgttattaaatctaaggatgttgttgttggcaacaatgaaaattctcattcaaagagtgtaaacactggcaatgaagctaaaacagaaaatgaaagtgatgataagaagaaagatcatcattatggaggagcagctttaggaatcgcaggaggtattttagcagctgccggagccggagccttggcagccggtagtgctggaaagaatgctgtttcaggtattgctagtggtgtttcaaatgctgttccatctggtaataaagatgtgcaattaccaagtaatggtagtggcactcaaggtaatactactacttctgcaccaggtcaaagtcaatctctgtctccccttgcaactactactgaaccaagtggttctgctgcaagtattcctacttcaagcaataccagcacaatttcttctaaaaaaaatgctgcaagtgttacccctactccagttgaagcgcaacgaaccaatagtcttagtgacaaatttaaaggttggggcagaaagttaagcaagaaggataaatccaaagacgttaactctgcagcaggagaaaccactgcggaaactggtgttatagctaaggatgacgataaaccagttggtggaatcacagctttggatgcagagaaaaacactgttgttgctagagatgctaaaccaattggaggagtcacagctttagatgcggaaaagaatactgtcgttgccagagatacaaagccaattggtcttcaccacggggctgaagatacgtctcag

SEQ ID NO: 6480 - DNA, 1920 bp, Candida albicans
ccgcacctaggggtggtcctggtaccagtaatgataacgtcactggaaacggtgttagaaccaccaatggtgttggtggtggaggcagtcaattcttttcagatgatttactgggtaatagttttcctaattttcaatccaacttgttgtcttctttcggcagtacaccgacagaacaattcatctcaagcgaatttgtttggtaatgatttcatgaaactggacccatttgccaatccattgccgtctattaacccaacaggcgcgacagggttcactggctcaaattttggtattgatacattcaatcagcatactactgcttctagcagcatggatgcatttaaccaaagtttggggttcccttcgatgccaactttgttgcaacaacaacttcaccaacaacaacaaccatcgttgtctagagtcaatagtggttggggcgttgatacatcagcctcatccattttgcattcgggaagcaatccacaaacgccaattggcggccattcggttttgaacaattcaatcagccaacctgcaccaatgtctctttggttaccagaagctgttactcagtctcattcaagagttggttctccttttacctcaagtgtaaacttaattggtggtgacgcagatccattagcctcgattcaaccagaaactgatgttgcaaaaaataacacggcagtttccatcggcggagtcccacaaaccagatctacagtcaacactaaatcttctccacaacccgaggatccagttttggatgatatccacaactctgttgtcactgatattttgaatgacgatgaacctaatgcaattaacaaccaacatgatcaagccaaatcagttcctgttgtcaatgatcaagccgcattggtccaacctacagcatctgaatcgagacaatcaatttcaagcgaaactgctgctaaagtttccgaaccagaacaacagcaagaacaacaacaagaaccggaaccggaacaagttaaagcagttgaattaaaaccatctacacctcaagtcttggctccatgggcagctgctaaagctgattctaagaaacctgctttaacattaaaagagattcaaagacttgaagccgaaaaattgaatgaacaaaagagaatcgaggcacaaatcaaaagtgaacatgcagctaaagcttgggccaatgctgccgctgctgaaaaggctgttaaagctgagaaaactccagttgctttaccatcaacttggggatctgcttctaatgttccagtcactaaaactttagccgaaatccaaagagaagaagctgaacgtgccaaggctaaacaggcagctgctaaggtcaattcaccaagtacttcatttgctcatgccattgctaattcagttccaagagatgatggaccagcttggactaccgtcaccagcaaaaagcaagcctcagctccagttgtaaagaaagctgccactacaactactattcctacttcagtttcgaaaacaactcctcaattattgcgctcagtttctgccaataaacaaactgtttctgctgtaaatgctcaagccattagagaagactttttggtatgggctagatccagtatgacaagtttatatccaactgtttctaaagatgatttattggaaattttcattactttaccaccaaattctgctgattcaagctcattaattgctgaaaccatatacagttcttcagccactatggatggaagaaggtttgctcaagaatttttaaagagaagacaaaaagttgatcaacaaattggtggtggagatcatgtatcttggtcagccgccatcatttcttcagcagacaaagttcaaactgttgatgaagatggtcggagtactagtttgaaatccaagaagaagaatggtaaaagaaactaa

SEQ ID NO: 6481 - DNA, 1071 bp, Candida albicans
  unsure (33),(50),(52): Identity of nucleotide sequences at the above locations are unknown.
catcacacatattatatccaattgacaaatatnatcatcttttttctgtntnaacaatcaaaaacatttatttcacaaaccgacatgtcatggataggaattaaaaaagctattaatcgagctggaactcaagttatgttaaaaactggtcatattgaacaaactattgataaagaatatgaatttcaagaaaaacgatatcgaactatggaagaaaattctattaaattacaaaaaaatttacgattatatttggatagtttaagattattaactaattcacaaataaatattgctgaatcattaaattcattttatggaactaataatgacaagaggagtagtaatgtatcaagaactggatcagtaaatacaggagataagattcaaacaatacatgaagaagaagaagaagaaaaagaagaagaagaaaatgacaatactactactactatcaccaccaccaatacaacatctaattataataatttaattcaagaatattatgctacaataaaacaattgaatgattcatgtattgctaatcttgaaaatccatataatcaaactgtattaaatccaattgccagattcaattcttattatattgaaattaatgaaatcatcaaaaagagacataataaattattagattatgatgctatgaaaaataaacttcgtaaattaattgaaaatccaacaacaaatatatcaccatcgatgaaaactaatataatagaatcgaatcataatcaatatgaagaaaaattgaaaatttataatcaagaattaacagaagtagaatcaaaatatgtggaaattaataatcaattattaattgaattacctaaattaattaatcatcgaataagttattttgatccttcatttgaatcatttgttaaaattcaattgagatttttcaatgaaaattatcatgtattaaatcaattacaattgaaattagatgctcaaacaagacaagattatattgaagggaaattagaagatagaattgatgatgttttacgaaaaatgaaaaagttagacatcactagtgggttagattga

SEQ ID NO: 6482 - DNA, 1395 bp, Candida albicans
gtgaagacgccaaaaccaaagaacatcaccaaggatgctggttggggtgatgctgaagacgttgaggaaagagactttgacaagaaacctttggataacgttccatcggcatataaaccaacaaaggttaacattgacgaattgagaaaacaaaaatcagatacaactagctcaactcctaaaacattcaaatctgaaccacaagaagaaaagaatgacgatgatgggcaatccaaacctttatcggaaaggatgaaagcctatgatcaaccatcaagtagtgatggaagattgacttctttaccaaaaccaaagattggacattctgttgccgataaatataaagctagtgcatctgggaatggtgctgctcctgcgtttggtgctaaaccagcatttggtacacaatcagttgattcaagaaaggataaattggtaggtggtttgtcgagagattttggtgctgaaaatggaaaaactccggcacaaatttgggctgaaaaaaggggaaaatacaaaacagtggcctctgatgagaaagaaactaactcaagtgaaaaagttgatgagccagaggaacatcatgctgccgacttggccaaaaaatttgaagaaaaggcaaatattgctggcgatactccttccttgccaactagaaacttaccaccagcaccaccagcacgagaaaccgcaattccatctaacgaaaaagacaaagaagaaaaggaagaggaagaacaagctccagcaccatctttgcctactagaaacttaccaccaccgtcacaaagacaacctgagcccgaaccagaaccagaagaagaggaggaagaagaagaagaagaggctcctgctccaagcttaccagcaagaaatctcccaccagcaccaaaagcagaagcagaagaatcaaaaaaacagtcaaccacagccaccgcagagtatgattacgaaaaggacgaagataatgaaattggattctccgaaggtgacttgattattgatattgaatttgtggatgacgattggtggcaaggtaaacatgctaaaactggtgaagttggtttgtttcctgccacttatgtgtcattaaatgaaaaagctgctgacaaagaagaggaagccccagctccagctccagcgccatcattaccttctagagaagaaacacaagcagcaccagcattaccaagtagatcagagcaaaaaccagaatcaaaaactgctacagctgaatacgattacgaaaaggacgaagacaatgaaattggtttttcagaaggtgatttgattgttgaaatcgaatttgttgacgatgattggtggcaaggaaaacattccaagacaggagaagtcggattgttccctgctaactatgttgtcttgaatgagtag

SEQ ID NO: 6483 - DNA, 363 bp, Candida albicans
aaacacttccacaactataccacttctttttcccatcatcaattgctaccaacaaaaacaatggaaaaaattgacattaatacaaattcaaacaaaatccaacaagcatacgataaagttgttagaggagacccaaatgcaacattcgtcgtttattctgttgacaaaaacgccactatggacgtcactgaaacaggggacggatcattagaggattttgttgaacattttactgatggacaagttcaatttggtttagccagggttactgttccaggatctgacgtttccaaaaacatcttgttaggatggtgtcctgacagtgctccagcaaaattgagattggtcttcaccacgccctga

SEQ ID NO: 6484 - DNA, 876 bp, Candida albicans
ttccaaatactagatacaatgtctgctgcattagttaaccgttctttaactacaatcagaacagagttagagtttttaaaggattcggatgtgatcaccgaaggattatacgagaaattactccagtcattaccaacaaaataccaaaaagattctgcaccatgggatgtcgatagaatcgctggaggctcttcaggtccaggaaaagtacaaaacaagtcagctgccgatgtattagcagatgacttctcaaaaaccaacatttttgctccacctccagcatacccaccagcacagcttccacgtagtgctgcaccaaaaccagttggctattgtattgccacttatgattacaaggcacaacaggctggcgatttagatttgtcaaaaggtgataagttggcagttgttgaacatttatcagaagattggtggaaagggtacaagagtgattcaagtcctgaaaaaactggggtattcccatccaattatgttaagataatttctcaattagaatttgaagcagatgaaagaaaagcagccccaccagcaccagtacaatcaccatcgtatgaacaaaatggatattctgcatatggaccaccagcaacttatccaccacaacaattgcaacaacaaccatcttatggaggatatgcgcaatacccaccaccatcaactaattactacccacctcaacagtaccaacaaccacagcaaccacaacaatcacaacaagtggtagagcaacagcctgagcagcaacactccctgggaagtgaacatgtaaagaagtttggaagcaagttaggtaatgctgccattttcggtgctggtgcgctgataggtagtaacattgtcaattctattttttaa

SEQ ID NO: 6485 - DNA, 837 bp, Candida albicans
attatctttgcaacatcttcctggattaaaaaactaccttcaacaatgcagaggagattagtacagactgcttcgtatttgattagacgaaacaacgtggcatgtagattcagtcgttataatggtttgcccgttgcatcttattctacaaaaacagtaccttttacggcagatacttattcccaaaaagtccaacgtgatgcaaaattcaagcaacttgaatctcaagacatcgaatactttaaaagtgtattacctgagaattccattattactgatgaagacgacttattgtttttcaacgaagactggatgagaaagtatagaggtcaatcacaattggttttgaaaccgaaaaccaccgaacaagtcgcttctatcttaaagtattgtaatgataacaagctagctgttgtaccacagggtgggaatactgggttggtaggtggatctaatccaatttttgatgaaatcatcatttccttgtcggccatgaataaaatcagatcgtttgatcctgtcagcggtatattgaaagtcgacgctggtgttattttggaaacagctgatcagtatttggctgagcatgcctacatgttctcgctcgacttgggagctaaaaggtcgtgtcatgttggtggcaatgttgcatgtaatgctggtggtttgcgtttgtcacgatacggttctttgcatggttctgttttaagtttgggacctgtcttgcccgaacggtacatgtttatactctatgcattcattggcgttaaatataatactggttttgaattggaaccattggtttttgggattctgaaaggttcttggggtatttaa

SEQ ID NO: 6486 - DNA, 393 bp, Candida albicans
  unsure (152),(179),(201): Identity of nucleotide sequences at the above locations are unknown.
gtgttaacaagtaggagtttctattccattggcagatctttacgggttagtggagaaatcaataccaggttaaatgatgctgaattcgccaggctggaagatgaatcgaaacctgtgcttgctgcattggttattgtcaacattggagatgngaatttacacttgaacgtttctgtgangaagtattctcctgaaattganactatcttggagccattgttctatgaatggatcgcaaaaaaaaatggatccatttcggctgaacatgggttgggattccaaaagaaaaactacattgggtattccaagaatgagattgaggtcaaattaatcaaagaaatcaaacaacattacgatccaaatggaatcatgaacccatataaatacgtgtaa

SEQ ID NO: 6487 - DNA, 816 bp, Candida albicans
  unsure (132): Identity of nucleotide sequences at the above locations are unknown.
agatcaaaatgcagccacaaccaccaggggtgcagttccggggcacttactttcattattactgatgctgtccgggtgtttggttttggtgatgctagaactgctggtgcttttggtataattatagttccngtacccatcacggaacataatgaaaaaatttctactccagttattactgctactcctttaattgcaccactgcttgttggaacatctaaaaatattagaatgctggctgatgaaaaatttgacccagttgttgatggttctgaaacaagcagtactcgagatggagtcaaaaaatcaatggttatcgatagtcaagaattacaatatattttcaataatcttactgatgatgaaaagaaaaatttaccacctcatttgaaatatattcgacaatttaaagattatcctaaaattgaagttgatatgaaaaaatttgaagatttatcagaagttaaattatttgttgatgaatcaatgagcaagagatcgattttgaaaagacgtaagaggatgggtggtggtggcggtggattcactgctactatgaaacaaactatgattggaggaggaggaggtagttctggctcatcatccaattctaaacgtgttgttttcaccaataagatatctattaatgaaacgtttgccagtgatatgtataagagatataataaagccgttacccaatattctttgagtgatccaaaagagattaataagatcaagaatgaattgaattattataaatgtaatgaaatgttggttcatgaaagttctcaaaataatacacatttcttttactaa

SEQ ID NO: 6488 - DNA, 555 bp, Candida albicans
  unsure (545): Identity of nucleotide sequences at the above locations are unknown.
gcaatttttgattacaaatcatattacgacgaagatttgagttttgatgctggcacaataatcaatattatttccgtagaaaatgatgaatggtattctggggaatatgacggcaaacaaggaatgttccctaagaattttgttgaagaattgaaggaaccaactactgctgagtcaagtgggaactctgatcaaccggcaattcctgaagaaccgaatccagcactgcctttgaaagttgaaacagacaacaatgatggtggttccaacaatgcacctgtggaaacaacctcacccaaaaagtctattgaaaaacctttgggaagtccaactgaaactgttcactctgcactgaaagcaattgagtctcattcatctaaagtacccatgccccaatctttttcctctaaaccggttgatccttatagtatcaaaaagcaatttgttggtgccagtgcatcgtcatatgtccctaaaatacaaccaagagacgatagttatttggttgctcgtccactccatgattctaaggcaccacttgttanggagtcatga

SEQ ID NO: 6489 - DNA, 1068 bp, Candida albicans
gttatgagttccgaaatcaacaagctttccaatttggtttcaaatcatttaaagattgtcgataagagaattacaggaaatgaacaatttcattggaatagactcaaaagaactcctcaaatattaaaacaaaaaatcaagtttgctggcggctcttacactgtcgatcaaactttcaatgaattggacgaggaacttcttgtaattgacgcttccatcaagaagttgataaagtacacaaaagtctttggtgaaagtatgaatcaagtattgtccaactccgtttgttcagcagaaagtttccagaacttaattgatccttacaccaatttgaagagcgacagtcaaatcttggaggacgcttatgccacttggtctaaaattaccaaatataagcataaagtcaaagatgtttttgttgaaaacgaaattgaccacttggtatcttctgtggagaaaaaattactggaaataactaaaatttataaagctgtcttcaagaagattgaattgcggaaaaccgcattattggattatgataaagtttacaatgaccatgagtcattattgctaaaacaagagcaaagcgagctcactttaaaacaaaacaaccaactttattccttagaaagaaaacttgacgataccaaaattaggtatacaaggataaattcattattggtgagagagctaccacttttgatacgtttaacacaagaggtaatggggtacgtccaggctcatatttattacgtccatttaactttctgttatcaagttgctgaaagaatcaaagaaactgagttcattgaaaatgatgtgaataaaattgttaccgactttatgctcatgaatgacccaattgttcaagaaatagaaacatatatattgacgtcacaccaagcagaatcaaacaatgatgataataaaactaaagaatcatactgctatgctttacatgactttgctggacaagaggagtcagacttgcgattttccaaaggggacaaaatcaagattcttgttgggaatggaacttggtgggaagggcaattaaacggaaaatag

SEQ ID NO: 6490 - DNA, 1440 bp, Candida albicans
cttcgacaaaaagcaatgccactcttcctacaattaattccctccgccccttccttttcatatactatctcccttccttcttccttctccttttattttttcaattattacaatcttatgtcatttaaaggattcaaaaagggtgtccttagggccccacagacaatgcgtcagaaattcaacatgggagaaatcacccaagatgctgtttatctcgatgctgaaagaagattcaaagaaatcgaaatggaaacaaaaaagttgagtgaagaatccaagaaatatttcaatgctgtcaatgggatgttagatgaacaaattgattttgccaaagccgtggctgagatttataaaccaatcagtggtagattatcggaccccagtgctacggtgccagaagataacccacaaggtattgaagcatcggaactgtaccaagcagtggttaaagatctcaaagataccttaaaacccgatttggaattgattgaaaaaagaattgttgaaccagcacaagaattattgaagattatacaagctataaggaaaatgtcagtgaaaagagaccataaacaattggatttggatcgtcataagagaaatttttctaaatatgaactgaagaaagaaagaactgttaaagatgaagaaaaaatgttcagtgctcaagcagaagtagaaattgctcaacaagagtacgattattataatgatttgttaaagaatgaattgccagttttgtttcaaatgcaaagtgattttatcaaaccattgtttgtttcattctattacatgcagttgaatattttctacacattatacactagaatggaagagttgaaaattccatattttgatttgtctactgatattgtcgaagcttatactgccaagaaggggaacattgaggaacaaaccgatgctattggaatcactcatttcaaagtcgggcatgccaaatccaaattggaagccactaaaagaagacatgctgctatgaatagtccacctcgtaccggtgccagctatattgcatctacaggtactggtggtgaattacgtgcatactccccaggaggttacaaccaaccatatggtgatagcaagtatcaaccaccatcttctccagcaacataccaatctccagtagtagcagccactgctcaatctccagctacttatcaatcgccagtggctactggacaacctccatcatatttaccacaaactccagccagtgctccaccaccacaagttggtagtggccttccaacatgcacggctttatacgattatactgcacaagcccagggtgacttgactttccctgcaggagctgttattgaaattatacaaagaaccgaagatgccaacggatggtggactggtaaatacaatggtcaaaccggtgtgttccctggtaattatgtgcaattatag

SEQ ID NO: 6491 - DNA, 210 bp, Candida albicans
tacactaattttggtggtgcacaaaaatcaaatgctacacaagccattgccttatatacatttaaaggagaacaaagtggagatttacctttcaaaaaaggtgatgtaattgatattctcaaaaagactgatactattgatgattggtggacaggaagaaataatggtttaactggtattttcccagcaaactatgttgaattgatttaa

SEQ ID NO: 6492 - DNA, 1020 bp, Candida albicans
ctgccacccgtggtgaagataccagaacccttgataccactagagatgtatgaagttttccgtgacccgctcagaaataggagcaggataatcaattatatgaagtataaggcagcagttgctacatcgagtatcagcagtcccaacccgcacaccgccagagcaaatggcaacaacaacaacaactcgtatttccccgatatgagccagcctctaactgaagccaatatcggcaagttgaatcacgatattgccccacgaaagaattctgaatcatcgtccaatgtattttcgcagagtgcgccaatgccattaagtgaagaggaagtcaacaccaagagcaagaagaagtcaaagagctataagaagttgactaatgatatccacgaagccattgacgagtataaacttctagtgaacgagttacccttggcatcgaagcagttgcttttctacattttggacttgctttccatggtgcaagcacaatcgaaagagaatttaatgaattcaagaaaccttgcggcgattttccagccatcgattttatcacacccgaaccacgatatggacccggtggagtatgcattgtcacaggctgtggttgagtttcttataaagtactcgtataaattgttgcccaccacagtgtctgccagtcccgctgtaaagtcgccggttgctgctcgcgacgaaagcgatgtgacatctaccagtactacaccactaaatgaagaatcacacttgtcaaaagagaattacccacatcgcgagtcggtgacttctgaaccccaagatagtctagtggcgggattccagcataatgtgacaggatcgattccctttgattcagatatagagagtgatattggttctgacttagatgatttgaatttccagcaactaaagttgaatgatgggtccccagttaaatcaagcccgccgccagcgccacaaatgcctgcagctatagtagtttctccgccgtcgtcgctgtccgttcaccaactggataagtaa

SEQ ID NO: 6493 - DNA, 849 bp, Candida albicans
atacacatctctcaacctaacaagagtttatctgatagtacactggttgtatcaagagagaattttgaatatatggaccacttgtctcctgatagacatcaaggtcaatttcaacaacatcaacaataccgacaacaatatcagcaacgacagccacagcaacagcttatagaggacgaacaagcacataaagccacacggttgaaattttggagaagaccaaaagtaggaacaacacaggttatcctgtctaatgagtataataacaatggtaacggacacaacaatggtgcaagaattccaaatagtttttccactcaggcattacgtatacctgctcataactccggtagttcattcaataacaatggagcaaacaacaataaccaacagaacaaattctcgaaatctaaatcaagtaacgtattggactcattgctttctggagactccagccaggtaccacttttcaacagcactttacaacagcgtgctgagtatgagaaaagtcaagttccaattattattaccagatgtctagctgaggtcgagaaacgaggcttagatttcgaagggatataccgtatttcaggtgggaattctgctattgtttctattgaaaatgcgttttccagcttatccaatgatcccgatgagaaacaattaaaccgagtggatgagactttggatgtcgatattcatgccgttacatcagcattgaagagatatttacggaaattacctgatccagtcattccatttgacttgtacgacgactttattaaagtatctactaaagcttcccattccaaagaagtccgtaatggcagaatagcagaagaatgttaa

SEQ ID NO: 6494 - DNA, 684 bp, Candida albicans
gacctcacctttccttattgggttgaatttgtattcaaccagttttcaatggctgttgttgataatgtgatagtagagtacttgttcacaatagaatttttttaccagggtgaagagaaagacaactcgtgggctgaggaaatgttcaagaatgttttccaaatcggtcaagaattcctcacctatatcagcaatactttagatgcttatgggatattgtttataataagattagtacaaaagtcacaggctaaattgcatgaggtgcacataccagttctcgacgattaccttaactctttgttgttgatactttggccgcatttcactaagattgtcgatgccaattgcgaggctatgaagcggaccatgttaaagggcaagaaggcaacgggactagcaccaattagtatcacacaacagtttgcccaattcttttctgcattgctagaattatctgttaatgaagcagaaccgcttatttcatccataattaggttgagaaacgagtacgagagctatttgatgagatccacatcattgagtggcaccgaaaaagagatctttttgtacaataattatttcttggtcttgagtgtccttaagaaccagaccagcaactctttccttgaagagcagattttacatttccaaacgttgacagatgcatatactaaacattaa

SEQ ID NO: 6495 - DNA, 903 bp, Candida albicans
tggtatagttctgctaaagtttatcttcaaccaatgatgtcaaccctgatgctagagaagttaattaagaaatttcccaacttgaaaggactttacatttcagggaacaattattgtaatgctgatattgaaaatatgaatctcaatatgccgctaacgattttggatttgtcttataatagactagagcacatgccaattttaccactcgtgtcagcattaaacttgtcacataattatttatccttacgaatcattaaaggcacttttcccaacttaaagtctttggacttgagggcaaatcagataaaagattggactgaaattgacaaaatatccatacatttacccgatttaaaggaactaagaattaaccacaacccattatttcaagagttgtctgtggatgacatgacgatgcagttgataggccgtatcaaatgctccccagaacacttatggaaattaaacggtagctttttaacaaatgaagagatagagaattcagaactctactttatctcaaaagtggaacaaggaaaataccacatagataatgaacaacaatggtcatatttgctttcaaaatataataaactagttgaatctagggtgtcttacacttacacattaaaggactggatgcccttaactatagtattgccagattctaaagagatttctaaaaaattcacgaaaaatacgtctattcttcaattcaaagggttgttatccctgtggatgaacgatttgtccatactaaaattctctgcctactactacactaacgaaaactcgacatttgcagaaaagcacgagttaacaaactatttaagtacgttagatagttattcattactgtacgaccaaagaatttatatttctatagaggcatcaatataa

SEQ ID NO: 6496 - DNA, 975 bp, Candida albicans
ttcaaccaactttgttttgaaggagtgatatattctttgtattccaatatggtagttggtgaatcaagggcagaattgctcaactggttaaacagtactttgggtttaaattacacgaagattgaacaatgcggatctggtgcagcattttgtcaattgatggatactatcgtgggtgatgtccccttgagcaaagtcaaattcaatgccaaaactgaatatgagtttcgtcataattataaaattctacaacatgtatttgtcaaaaatagtatcaccaagacgattgatgttgaaaaattgatacgttgcaagcttcaggataatctagagttgttacaatggatcaagcgatatgcgtccagtaataatgtccccatgaaaacaactgttgccagacagcctcccaaacaaacaacaaaacccaccactagttctcctggttcatctcccatcaatgctggtcctagcgccgctcctcttatttcaaaacctagagaaagaaaatcaaacacacctattggatcaagaaaaacttcgtccaatggtccaataaatctaacaccaacagcagtgcgttcaaccaatattgctgcctctaaaaataataaccgttccggtaatggtacaatcgtaaataatgggcatgttggggcagtctctgcaagtgaaccagaggcagttgatgctgctgctgttggtgctgctgctgttggtgctgctgctgttggtgctgctgctgctgctgctgcacctatagatagtggtgccacatcctcaatcccagaagattttgctatttattctcaacatgtcgagtcagaaagagatttttatttcaacaaatttagagcaattgaaatattagtccaacatgctaaagaaatggaaggattaagtggggatgtattgcaatttgttaatgaaattgaaaagattatgtatgaagagtatgtagaagatgatgaattttaa

SEQ ID NO: 6497 - DNA, 960 bp, Candida albicans
caaggattccaaatcacccattctgtgggtggtggtactggttctggtatgggtactttgctgatttctcccattagagaagaattccctgatagaatgatggccactttttctgttgtcccatcaccaaaagtttccgataccgttattgaaccatataacgctactttatcagtccatcaattggttgaaaactctgatgaaactttctgtattgataatgaagccttgtacaatatttgtcaaaacactttgaaattaccacaaccatcttatgctgaattgaacaatttggtttcttctgtcatgtctggtgttactacttctttacgttatccaggtcaattgaattccgatttaagaaaattggcagtcaatttggttccattcccaagattacatttctttatggttggttatgctccattgacttctatgggttctaaatctttcagatcagtcaccgtcccagaattgactcaacaaatgtttgatgccaaaaatatgatggctgcttctgatccaagaaatggtcgttatttaactgttgctgcctttttcagaggtaaagtatctgttaaagaagttgacgatgaaatgcacaaaatccaaaccagaaactcatcttattttgttgattggattccaaataatgttcaaactgctgtttgttcagttcctccaaaagatttggatatgtctgctacttttattggaaactctacttccattcaagaattatttaaaagagttggtgatcaattcagtgctatgttcagaagaaaagctttcttgcattggtatacttctgaaggtatggatgaaatggaatttactgaagctgaatctaatatgaatgatttggttagtgaataccaacaataccaagaagctagtattgatgaagaagaattagaatatgccgatgaaatcccattagaagatgccgccatggaataa

SEQ ID NO: 6498 - DNA, 1101 bp, Candida albicans
  unsure (155),(1093): Identity of nucleotide sequences at the above locations are unknown.
attatcatctacactagatacaaacacgtattgctaatgtcccataaaacaccaacaagagcaagatcttgctatgctaatagttctactacatcaatgaattcaactccttctagaaactcattcagaccgccatcaagattatcattaattcntagatcatcttcacctatccaaccacctagatctcgtccaagttcagcaatgtcaattagtcgaccatcaacaccatcaatgaaaagtcaagagccgtatactggtgccattaccgtttcaataagaccaaaccctaatacaatcgataacaaaaattggagtattgatgaatttaataactcgataataaataccactgatggtacaagatttgtgtttgataatgttttccctatggatagacaattgagtaatatccaagtatataacaaatcatgttataatgttgtcaataagtttcttgaagaaggatataatggtactatatttgcttatgggatgacgggatcaggtaaaacattttctatgaaagggtgtgaaaatgatcctgggtttgttgaattagcaatcaatgatattttccaaaaaattaatgataataccactaccaaaaaatataaaatggatatttcgtatcttgaaatctataatgaaaagattatagatttattatctggatcagcatcatccccaacaacctctcagagtaaccaagatttgaaaattagagacgatgtggattttggtaccaaagtagttgggttaaccagtgctaacattagttcaaaaccacaattattacaattgattaaatatggagacaccaatagaaaaaccagtgccactgatttcaatgctagatcgtcgcgatctcattcaattttacaaataagattacaagtgattgatttgttgactgaaactgagttgaaatcaacgttatccttatgtgatttagcagggctggaaagagcagcaactagtttagaaagcagaaaagaaggttcattcattaacaaatcactattggctttatctaatgtcatcaataaactttcaagttcaactctagaacatattccctatcgagactcanaattgaca

SEQ ID NO: 6499 - DNA, 2148 bp, Candida albicans
agatgcaataaaccacaaacaagagaccaattaacaagatcgtttacccttctattcctttccctgttgttctttcattgcttttgttccatcaagtttttcctttcgtttatcattatcatctacactagatacaaacacgtattgctaatgtcccataaaacaccaacaagagcaagatcttgctatgctaatagttctactacaacaatgaattcaactccttctagaaactccttcagaccaccatcaagattatcattaattcctagatcatcgtcacctatccaaccacctagatctcgtccaagttcagcaatgtcaattagtcgaccatcaacaccatcaatgaaaagtcaagagccttataccggcgccattaccgtttcaattagaccaaaccctaatacaatcgataacaaaaattggagtatcgatgaatttgataactcgataataaataccactgatggtacaagatttgtgtttgataatgttttccctatggatagacaattgagtaatatccaagtatataacaaatcatgttataatgttgtcaataagtttcttgaagaaggatataatggcactatatttgcctatgggatgacggggtcaggtaaaacattttctatgaaagggtgtgaaaatgatcctgggtttgttgaattggcaatcaatgatattttccaaaaaattaatgataataccactaccaaaaaatataaaatggatatttcgtatcttgagatctataatgaaaagattatagatttattatctggatcaccatcatcccaaacaacttctcagagtaaccaagatttgaaaattagagacgatgtggattttggtaccaaagtagttgggttaaccagtgctaacattagttcaaaaccacaattattacaattgattaaatatggagataccaatagaaaaaccagtgccactgatttcaatgctagatcgtcgcgatctcattcaattttacaaataagattacaagtgattgatttattgactgaaacagagttgaaatcaacgttatccttatgcgatttagcagggctggaaagagcagcaactagtttggaaagacgaaaagaaggttcatttattaacaaatcattattggctttatctaatgtcatcaataaactttcaagttcagctctagaacatattccctatcgagactcaaaattgacaagattattacaaccggcattaagcgggtcttcattggttctgattctttgtaccatccatatgggaggaaatcaacagaattctcaacaatgtgttgccgagacatataaaactttaagatttgctgcaagagctaaagatattgttataaatgttgaaaagaacatgagtcataagcttgatggtggtgattcaagtaagatgattcaagagttgaatgagattatcagtaaacagcgacaagaaattataaaactacaatcaaatacgggtgtatcatcgaaagaatttgagaattcaaggattgttcaattggaatcagaaaatagagtattgatagagaaattggatcatttaactagactaacagatctacaaaaaacagaaacggcaataatcaaaaatgatatattgaatgatattttatcttctggtttagacaatctgcaaattctcatgacaaatattgaagatttctataaaaaaatgacttatgaagccaatgaatacaaatcatatatttgtcgtttagaaacacaattaagattagaatcaataaatagtacccaacaacagcaatcatcatcaccaacatccagtataccaatgacaaacaccactaatgattcatctgaattaatggatgctttgaaagaacaagaagaagaaattcttatgttaaaagaacaattaaaagacaaagatcaaataataaagagtttatctcaaacgacaagattacgtcgattagttggtaataatagcaatagcatcgctaatagtcataacacatataataccttggataatgatttcaaacgacacacaacaatagtcaattttgataaagagaattatgaacccgaattacgtgatttcaagttaagtccaaagaaaccaaaatcaaattgtgatattctagaaagtttttga

SEQ ID NO: 6500 - DNA, 987 bp, Candida albicans
tattatttttcaattgtccttctttttttcttattttactttcaagttatggcaatatcaagatcattgattacagaaacaagtaaccggttcattccttcgtcgtcatcaacactggtttacaaaacgaggcacaaaaatgaattacaactgtcgtatcagtctcatgaaaatttggataacaatattccacatgcaaatttatcaatccgagacgattccttgtttactcattcaacttcaagcatttcttccaatactcactttcaatcttcttcaagctccataggttcgtcttctgcaattaaacgtgtgacgctcggtagtaccaagccatcagatctacatcaaaagattgttgccgaggcattgaattttgttctgagctccaaagtattgaaatttgataataaatcgagatctaagaaaatacagaacagaatcgacgcaaaactcgttgaatcattaaccattgctgaaagagaagtttctgttgatgcaggcaaatcacgatcaacgtcatctattaaaacaataattgcgactgatattttacaagcacctggattgcgaaacgattactattcaaacctagtaagttggtcattcaaaacaaaccgtgttgcggtagggctaggctcaaaaatatatctttggggagtagataataatgtaacgcaaatcaaccactctaatgaggatttggtgactgcagtttcttgctcaaaagagtattggattttggtagccacagcaggaggaaaaatcatcttgatggaccaacaaagtaattctgtggtttccgaatatactaacaacgaagggaaatgtatattttgttttgcctggtttgacaaatcaaacatgtttattgctggtgatgactttggagaagtgtacatattcaagattcacaaattattcaatgttcaaattgaattggtaagagtattcaaatgccatcaacaacaaatctgcggtatgtag

SEQ ID NO: 6501 - DNA, 609 bp, Candida albicans
aatacaggtcttgctttgaatggtaaaaatgacgaaattgctgttggagctaatgataattgttgcacaatttggagcattaaggattttagtgcccctgttttgaagttcgtattgcctcacaacgccgctataaaggccctatgctattgtccatggactgtatccttattggcgacaggaggcggaagcaaagacagaaaaatcagattttggcacacatccagtggcaccttgctaagtgaatactacactgacggtcaaatcacatcacttatttggtcacgattcagaaaagagatagttgctacatttgggttcggtggaaccagcaagtccaacctattatgtgtttacacatatcctcaaatgcagcccattttagaagttaacgcagcgtgcaacttgagaatattaagcgctactttactgccagattattgttcggtgtgtgtggccactaatgattccaccattagaatctatcagctatgggaagggtcattagaaattttgccatctgcaactcaaagaatcatgggggcgtttggtagcgacataattgaactcttggaaggaatatctaaaaccggtgacgtgattagataa

SEQ ID NO: 6502 - DNA, 1053 bp, Candida albicans
tctaccctgttatcttcccgtggtggcgactttgaatatagttcgacaattagtacccaatcatcatctggctcatccagtattccaaattctcaattgtttagaacaagttttttgaccaaatcaggaacattaaccccatcagcggctgcagctagagctaataaaatacctaatgcaccagaaagagttcttgatgctcctgggttaattgatgatttttatttaaatttattagcctggtcactgacaaatttattagccattgggttagaagatgcagtttatgtatggaatgcctctactggatcagtgggacttttatgtgaacttgctgataaaactttggtgacatcattaagatggtcacaagatggttcatatatttctattggtaaagacgatggattgattgaaatttgggatatcgaatcaaacactaaattacgaacattaaattgtgataatcatttaactagaattgccctgcagagttggaatcaacatgttttaactagtgggtcaagaatgggtcatatttatttttctgatgttagagtggctaatcatttagtgaataaaaatcaagaagctcattcagcagaagtttgtggtattgaatatcgtcctgttggaaatggtactagttctactactagtattaatgattcattacaatttgctactgggggtaatgataatttagtatgtatttgggatgctagaaatgttactacaccagtattttcaaaatctaatcataaagctgctgttaaggcattatcttggtgtccttatcaatcatcattattggccactggtggtggatctactgataaaacaatcaatttctggaataccaccacaggtgctaaagtgaatactattgaaactggttcacaaatatcttcattgaattggggttatgctcatggtacgggattagaaattgtggctactcatggattccctagtaatatttttcattatttaatttaccaacgttatcaaaaactggtgagaatattaatgctcatgatacaacaatattaa

SEQ ID NO: 6503 - DNA, 492 bp, Candida albicans
cgaccacaattaccgccatcgttacggccaccaattaatagtagatcgaaaacagcagtcttaccttctcttagcaaatcaacatccagtttggcaactacacattcactgacccaatcattatctaatcctttcattctacgtcgagccaattccctcataagtcaaggcggttcctcatcattatcggacttgcatcaacaacaacaatcatcaacaacatcttctgatcgatttatcccatctcgatacaattcagtcactggtaaactagataccaccaatgaagtaccattacctagtgcggcaccagaaatacatataaaagcccaaacatccaaaatttatcaacatcatgtagctgaagcatgtggattagaaatgaattccagaatattattatatcaaccattaccaccagaaagaaaaaaaccagtgaatttagttcgacaagtcttcaacaggcggtggaaggacaacgttcgcgggtca

SEQ ID NO: 6504 - DNA, 1242 bp, Candida albicans
tcaagagttgaacatctaaccaaaaacatggacaaaagagattctaatagaccttctaaggacaatgctatccgtaatccttttgttctgtttgagactcctaggtcgccatcacgatcaaccagaagtctaaatcctcccaagttgaacgaaatgggtgctatacaatcgtcaccaccacgaaggagaaataataacacgattttcagtgatcgatatatacccaatagaacaggagttgatctacaggctgcctttagtttgactaatgaggaaatactaccggatttgagaaacactagaaacgctgataatgaaatagaaattagaagagaagaggaagcaaatcgaacattctcaacagttcttaaagcagaattatttggtgataatgtgccgatggcaacagcaaacttgtctagtgccactgccaattctaatcttgcaaacaatcgatcgaaaacagggagaacaaatactggtattgttaacggtgcatctgtttctggggctgctacatctacatcaagtctctccacaaccccgccaagatcatctaattctggtcagaatttccctggatctactggctcatccttgcctggtaacaataatgcaattggtaataatgatagccataacatcatatcagcaaatgctaataataatatttctagtgatattgatgatattactagcactccacgtcggaaaactaacttattcacttaccagtcccctcaaaaatcaaaaccaatatcaagagacttgcaacaagaattgtactcattgtcacccgtgcggcaggattcacagaaactattgttgtcgccgcagaagaagcctcgaacaatatcaaaggttccatatagagtattggatgcaccagaactatctgatgatttttatttgaatttagttgattggggtcaacaggatgtactagccgtaggattgggcgacagtgtgtatttatgggatggcgccacacaatcagtggacagattgtgtaatttaacaaacaaggacaaagtcacaagtttgaattggataggtactggtacccatttggcaataggaacatccaagggtttggtggagatatgggatgcaactcgaatcaagtgcatcaggacaatgacaggacactctctacgggttagttcattagcgtggaatgaacacatattaaccagtgggagtcgcgatcgaaccattttaaattcgcgatgtgagaattga

SEQ ID NO: 6505 - DNA, 588 bp, Candida albicans
gaattgaagatcactttgttaataaaatttgataatcataagcaagaagtgtgtggactcaagtggaatgtggaagaaaacaaactagctagtggtggcaacgataataatttgtttgtatgggatgggctcaatcctaaaccgttgcatcaatttacagaccacactgctgccgttaaagctattgcttggtcgccgcatcaacgggggattttggcatcgggtggcggaacagccgataagactataaagacatggaatacgttgactgggaatttagtacatgatgtcaatactggctcacaagtgtgtaatttaatctggtcaaaaaattccaacgaattggtttcaacccatggttattcaagaaatcaaattatagtgtggaagtatccatcaatgcaacaaattgcacaattgacaggtcatacatatagagttttatatttgtcgttgtctcctgatggtgaaacaatcgttactggtgctggtgatgagaccttacgattttggaatgtatttgaaaaaaataggcataacgaatcacctgcttcggttttgttaggagcatttctgcagttgcgctaa

SEQ ID NO: 6506 - DNA, 546 bp, Candida albicans
cttagacctaagaaaaccaatcctcgtggtatcccaaaagctcctttcatagagaaagtagaaactgtgatcaaaaacccagaaacagaatttgataacaccatgtccatgttccaacaaagattacaacaatataaatatatggaggcatcgaaaaagcaacagttggctgacttgcaaacaaaaatccctgatatagaaaagaacttagatgtgatcaaacatataaagcaaagaaaagaggaaggtgatgataagatggtcacaaactacgagcttaatgatacattatacagtaaagctacagttgatgttcagaatctaaattcagtgtatttatggcttggtgccgaggttatgcttgagtacaatttagaagatgccaccgaattacttaatgagagattgaaaaagaaccaagaacaattacaaattgtcaaagaagatttagagtttttgaaagagaatataactacaatggaagtcaatactgctagattgtataattgggacgtagaaagaagaaaaaaagctaaagcaaattag

SEQ ID NO: 6507 - DNA, 834 bp, Candida albicans
tgggcaaatacatcaatcatgagtgaggatataccgccaaaagaaactactcaggaagaaaacaataatcatgaagagaatcagaatgttgcagaagaagtagcaaccagccagcaaccagctccagctccagctccaacagaagaagaagaaccagaaacagagaaagttgaaccaattgaagaagataaagaggaattaccacatcaagaaacaaacgtaccagaggtgggtaatgacctggttcaagaggatccacatacttcgtttctacaacctccttccgataaacaacaatttgctacaccatctaaagatttgccagcattaaaagatatcgaaaccataacaactccaaaaacatttgatgtagctaaagatgacgatattgatgatgatgcaacaaaggggttagctgatattgttgcaagttctccaataaaacataatattttggctgaacttcaacaacacgaagaatctctcaatgaagatacattaagaatcatatcaggatacttgtcattggatgaatctagtatcaagtctattggtgatgcaaatgttcttcacgcattagtgtcgaaatctgttgaattccaaaatatatcttccgaaaatgaatttctcaagttggaaatggaaccaaatgctcaaagcattagtaaacaattaccagaattacaaccaaagtattcaaatgctgataatttattccaagtctttaaccagaatcggaaggataaattagaatatgagaatatacgtcaaactgaaaagattcaagaactggaacctgctaatgattatgacaagccggacaattccatgcga

SEQ ID NO: 6508 - DNA, 1419 bp, Candida albicans
  unsure (1080): Identity of nucleotide sequences at the above locations are unknown.
caccaatcaataagaaagcgtcaatcagcacaatcggcaccaccaccgccagcaacaaagttttcgtcatcaatcccacaaaaacctactttgctgctcaagaaattggcaacttcaccaacaaaaaactacactgatcacatcaatcaattacgatcaggtccaaatagtcctaagaaatatcaagatgatgaaaatatccgatcattaaagtatgaaatcaaaagattaaaacaagaacagaatttaaaattggaaaatttacaacataaaattgattatttaactaatgaacgagatgaattacaaaatcaacttacttcaatgtcgtttgaaaatgataagttgactaaaaagaatcgttcactttctcatgagaataatcatttgactttggaaaactcaaaattgaaaactaaagaatattcaaatgaggaactacaactggagaataataaattacaaagagtaaatagcacattgagaaatgagcgggatgaattggtcaaagatttcaacataactagagataagttgaagaaatattatgatttatatctacactgtcaaaaagctcatgctaaagaaatgaaaaagaggatagaagtagatggggataagccaatatctgataaaccaatggcagataactcaactaatcaggaattagtcgatgtattgaaaaaactatcagaaatgatgatagagcaaaagaaaatactggaacccagtgcagctgttgaaaaagatacaacaagtgaagataagacaccacctatacccaacacagccaactcaagcgatacaccacgtatggtttcagactttttagaagatttcattaagagggttttcgaagaaatgctgtccaataataagaatacgctatctcctaaacaagctattaactcacaaacttattctcaaccaaacaatttttcaaataatactgtacctccttctcaatctgctgcatataatccttcgaatagtcaaccagctccaccaccacaaccagcaactaatttctatagctcttcaacacctaatacaaatggttacaatcagtcactgcagtcngatgagcgaccagagacatttgaattgcctcatgttgcaaaagatcattggctacaaagacccactagtgaacgatctacccaatctacaaaatatatgaagatggatccggaagacataaggaaattggtactggttataactgatcaattgaaaaaagaacaaaagagtgaaaaaccatcaaatgttgtggaaatggagaccccagtggaaaaatgtcaatgttgtcatggtaatccaagaaatgttactgacactaataataatcagaaactatgtcagagttgtttgaataaaggtgatttcacaatgtcggaatttatgggtcgttctaactga

SEQ ID NO: 6509 - DNA, 2592 bp, Candida albicans
cctgtgaaattcaataaatgtgaagatatggctgaactaactcatttaaatgaaccatctgtcgtttacaacttgtatcttcgatatttagacgatttgatctatacatattctgggttgtttcttgttgccatcaatccctataaactgttacccatttataatcaatcaattttaatgaaatatcaccaatataataacgtgacaacaaacaaaaatgactacaaatctaaaaacgcctccaacagcaacaacaacaacaaaggacaatcgccgccacatatatttgctgttgccgaatcgacattcagaaatttattatccaacaagaaagatcaatcaattttggtaactggtgaaagtggtgctggtaaaactgaaaataccaaaaaaattatccaatacttgtcatcaataactagtggcagccataccaataaagttgatcatgataatagtatcgatactaaaattcttcaggctaatccaattttagaaagttttggtaatgctaaaactatcaagaataataattcttccagatttggaaaattcattcaaatttatttctcaaatactggtgaaatatcaggagctaacatcaattattatttgttggaaaagtcaagagttataagtcaatcgaatcaagaaagaaattatcatattttctatcaatttttaaaagggtatgaaaacttacctagtttgggtttaaacaaagacatgtcaacttataattacctctcaggaggaaaattaactataaataatgttgatgatttcaaagaatttaatttattagtggaagcatttaaaatcatgggattcaccaccaatgaaatgaactttatttaccaagtgttggcgataattttacatttaggtaacatcactttcacgtcatggaaatccgaacaagccaatttcacgaatgattcccctattgatagaatatgcgagttgttagcagttgataaagatttatttgttcaaaatttattgcgacctaaagtcaaagctggtagagaattcatcacaaagtcaaagaaaccaaacgaagtcaaatttgccatcgacgcctttgctaaatatttatatgaaaagttgtttcaattcatcattaccaaaatcaatgagaaattggatcaaagccataatggagacgataacaccgccaacaataacaacgataacaattttttcattggtgttttagatattgctgggtttgaaattttcgatattaatctctttgaacaattatgtatcaattacactaatgaaaaattacaacaatttttcaatcatcattcatttattttagaacaaagtgaatatttacgagaaaatatcaattgggagtttatagattttggtcaagatttacaaccaacaattgatttgattgagaccaagcaacctatgggtatcttgaaattgttagacgaagaatgtttgatgcctaaatcatctgatgcatcttttatggaaaaattatcgaaaaatttctcaaatactcataagaaattttctgagaataaattcaaaaatgggtttataattcatcattacgctggtaaagtagaatataatgtggaaaactggttacagaaaaatactgatcctataagtgaaagtattttgaatttattgcctgattcccaaaatgaattgattgcagatatgtttataaacgatcctcatattaatagaccacagacaaatggtggtggtaattccaaactcaaaactgcttcacaaaagcataaagatcaattaaaaacgttaatggatcagttagaatcaactgaacctcattttgtgcgttgtatattaccgaatctagagaagcgggccaacaagtttgataaaaatttggtacttggtcaattaagatgtaatggggttttggaaggtattagaatcactagggcaggataccctaatagaatgatgtttgacgaatttattcaacggtactcgatcatttgtgataatgaactttcttctccacagaacaaaactaattgtgaaataattttgaaatttgtcaaattaaaccctgaagatttcaaagttgggcttaccaagatttttttcaaaaatggtatattagggaaattggaaattattcgtgatttagcattgaagaatattttcactgatttgcaaaaagttataagaggtaatttaaccagattagttttgaaacagaaaatcaaagaaattcaatccgcacaaatcatttcaagaaccatggtgacgttagatgaaatcaaatctaatagtccttggatgagattgtttttccatgtgaaaccattacttgaagattctgctaaagtattagattctaaaaaattacaagaaaatttgcaaactttaactgtgaaattgaaagattcagaaaaacttacaaaaggtcttgaaacggataatgaaaagctacgagaacaaatgaataatttacaggatgaaatgattaatattacttcaattgcaaaggaaaaagatgacaaattatctcaattgagattaacagaaaataaatcaaagcatcttcaccacggggctggaaaatcccgcgct

SEQ ID NO: 6510 - DNA, 2169 bp, Candida albicans
gaatatcaaccaccgaaccctcaatttatggaagagtttacccatatgaaattgaaagtgaatgaacagactgcatcattgaggaaagaaaagtttgaaaacaagaaattactggaggaattacaaatgttgaaagaacgaatcatgaatgggtctttaactagtatggacttaacaccaaagagaagatctttggccattggtgataaatcaatgataactaacacggtagattcttttaataaagagattgaaaatttgaaatttcaattacagcaagaacaaggcaatttccatcgtgcagagaattatgccattgaattacaaaagaaattaaataaattattgaccacacgaggattaaataccaatactgattatgagaaaaaatataatgattcgcaaaagagaattacacaattagaaactaaaattgggagattacttgccaattctggtggagattatgaagatcaccatttagatgataacgacgatgattgggaatcacgttcttctaatggtggtagcggtggtggaagtacctcttcttcagctagaaactcgttagtgaaaagtgaaagtataactgcattccataatatgcgtggagtatctcaagattatattcaaatatatcaagacataacaaagactttaaaatccactagagaagagttgaatggatcaaaaacagaaattttaagattgaaagcattattgcgtgaatcagaagatgaattgtatcaagtcaaacaagagaattataaaaccagtgttcatgattatgaacaggatttggcgcaattgaaagttaagcacgaaactttattgtcaagaaataaggatatcaatgaaagtttagagatatacaagaaacggtcggatgagtactataagaaattagaattagctgaatcggccattgcaatttccaaacgacatgaagaacaagcaactaaagaaatgaaagaatctagaagccaattgttattagttagagaagaattaagaacaacacagattttgattaaagattttagaattaaagttgaaaatttagaggcaacaattgaagaaaaaaatcatcaattagatgcaaataaagaggaaatcaaacaaatacaagacaaattaaactatcatttgaaaaattttgagaataaggaacttaatgagaaactcaaagaagaaatcaagaatttgaatagggatttagatttcaaaactgatattgagactaaattaattaaagagaataaaaagttacaattggattatgaagatgttttattagttaagaacaatttacaaaatgaagttgaagaattgattcttcaagaggaaaaattacagaataagattgatgaattaactaataataatcgacaattggaaaatgagaaattgataaatgaaaggaagatagtcaattgtacgaaacaaatttctgggttgaaagaattggttgatgagatttccattgaaagagataaattattgaaggataaggaaactttacaaaatgatttacaaaccatgaccaataaatttgatgcaacaactactgaattaaaacaagcacatggagaattagatttcttgaaaaaacatttagaaaatcaacgagaagattctgaagccattaaaactgaattaaatcaactgaaaatgtctacaagctttgatattcgagatcaacaaaaattaagaaatgaattattagtgacaaatgaagaaaatttcagtctcgtaaagactaataaagaattaaatcttaaagtttctgatttagaagaaaaattatacagtaatgaacaattaagatattgggaatctaaagttgatacattatccaaggcattagatggagcattgaatgaaaaacatgaagctgataaaacgattaaaaatttacaacgatcaattaaacaattggaaattagagtggaaaatgaatcacaattgagtaaacgttataatgatgacaattttgattatcaaaataaaattaatcattataaaagtactatcgatataattcataatgaaaatattgaaaaagatttacaattaaaatcaatacaacgagaaaacatcgaaatgaaagaatcaatgttaatgttacaaaaagaagtattggaattacgtgaacgattactagtttaa

SEQ ID NO: 6511 - DNA, 1884 bp, Candida albicans
tttgtttcatacttgtttcaacaaatgacaacaccatcatacaccaagaacttgaatatgaacacgaaatcttcaaaagagcaaacaagatcgaaacgaccactttctgaaatatcacccaatttaagacgagatccattgaaaaagcgaagaaattccttaggttttgaaatggccagtattcctctgaattccataaaatcttttccatcaagaattcctcctccaactgcatcaaagtcagccactatagcttcttcttcttcttcttcatcatcatcatcgatgctgtctttatcatctattccacaaggtattctatcgattcaagaaagactaagacggaaagcaagtgttaatgacaataatggacaatcatcatcgagttttgctgcgagacctcaatcaactgtatccagatccaatgaactccaagaagaatattattcactaaatgaactatacaaacaacaagctagtctgtatgaaaaattagaggttgaattgggaaaactaaaagagatttataaaaattactattataaaattgacctaattaatgacttggttcatcaaaagcagagtgaatttgaaatattggagcatgatattatcaatgatgttgaacaagaagaaaaattaacgtattccaaattgcatgaaaataaaataaaactagatggacaatttaaagagttggagtttgaaatgttaaatcaattggaagatgccaaacaatttgactttaaggaattattaaccaaaattgaaagtttaaaaacagaaaagatgacagtgttgtctgagtatgaaaaagttatgtcagaagtgaatgccaagttgaatgctgatagagaacaatttagcaaagatttagaggataaacttcatccattaaataaaaataaacaattgataaatgatcaattgattaataaaaaggatgaattgactaaacttgaaacaaattacaatgagcttaaagaccaacttgctgaaagaaatgattctatagactctattaaacatgagattgctaacatcgaacaagagatgaataattatcaagcaactaggaaaaacttggaattgaaactatcagaagccgaactggaattacatgaagcattggctaaagataaacaggagcaaagggaatatgacaatgttcgttctgaatattcagtactacattccaaaattgccaaacatgacgaacatcgacgaattttggagaattcaatcatgaaaatacaaggaaaatttagagtgtatgccattggcgaagatcttgacacgtataacaaatgttttgcgaaagatactccatcttcatttataattgatgaatttcaatgtttagtgcagtcaacattaaaaggtcacaatgtagccataattaacaattatcttcgtgggtcacaaattgtcattgactcgtataagaacattcaaagacaacagaaatatatttaccaatgtatatcgattaaaaatggtgataaaaatactgatatttgtgatttgttgaattctaatgccccagtcgactcgctattccagcaccaacaaatggtcattgacgattttgaccaatttaaacaaattgtcaaaaaaattgatgccacattatcgcaagaaatcgccattcatataatttcaacagataagtcaaaattaatgattattgattgctcaagaattgatccagaccaacaagacaagattcttgaaaaattcaaatccaatagctcgcttgggtttttggaaaaattacttacttggatataccataattgttctacattattcttatacgaaccaaaaacttctcaatcaaatagtctactaaaatttatcaattctatagattcgcctatttag

SEQ ID NO: 6512 - DNA, 492 bp, Candida albicans
tacgatgttccttggcgcggcgtgtgtgaaaacaaacaagaaatggttaaattacaagaagaagttcaaaattataaaaaccaacaagaactgcatttgaaaactattaaattactagaagaatctaataataattatcgagaagaaattgaatcagtcaaacgtgaattatctaatgaaaaaagaaatgccaccattactactaatcataaggatacccatataaataatttaaaatcagaacttgaaaaggcaaattatagaattaaagatttggaacaagaaagagaaattaatcgattacaacaactgaatcttgcctttgaaagaagtaacattagtagtagtaattccagaaatagtttttataaacctagtcctaacaaatttgcaccaagtgatattagtactggagttaaacgattatcaattggtggtgaagaaaataatcattttggtggtggtggtggtgctagtcctaattttcacaac

SEQ ID NO: 6513 - DNA, 648 bp, Candida albicans
catattacatcaatggacaaatttgattcatcattagacttaatcaggagattagatccacgttccataaccaccaatttatccaacatctgtgcattaatttctgaagacgaggaattggttgctgatctattatcttctgtggatactccattaactacatcgacatgtttgaaatctggtaaagattacttgtgttgtgattataatcgtgatggagatagttatcgttctccatggactaatgtatattaccctgagttatcactgcaagatgtgaatgacgcaccatatccttcctcaatattgcgtgatttggaaatcaaagctaatgattcattcgacatttatcgagacttgtattatgagggtggtatttcaagtgtctatttgtgggatacttctgaagaagacgaggacgtagactccaccactgcattacaaaatggattcgctggtgttgtcttgttcaagaaagaaacagaagacaaatcgggtaactgggataatattcatgtctttgaagttgttccacaatctaaaaataaatatgtatacaaactcacaacctcagttgttttaaacttggaaaacaagaagcaggtggatggtaatttgggacttgctggtaacttgaccagacagtga

SEQ ID NO: 6514 - DNA, 1941 bp, Candida albicans
aagcaaataccaaaagggtcaatagcacctatacctgttttgcagttgcgtaatccaacacccactatgattgagattcaatcatttgctgattttttgcgaattgcgccggtaatttgtgtttcgttggacggggtgaacttttcagttgaacaatttaaaatcttgctctcagcaatgagtgccaaaaagcagttggagaaacttagtttgaggaatactcctattgaccaaaaaggctggtccttattgtgttggtttttatcaagaaatacagtgttgaataggttggatataactcaatgtccctcattatcagtgaatactctcaagaagaagaagaagaaaactgacagcaaatttgacgaaaccttggtaagaatggtatccaataaagacaatcgttcagatgttgattgggaattgtttgtggctactttggtcgcaagaggtggtatagaagaattgattttaactggttgttgcattacggatattgaaatttttgaaaaattgatatccttagctgttctgaagaagacttcgagattagggttggcgttcaaccagttaacttctcgacatatgaaaattattgttgatgaatggctttttaaagattttgccaggggtatatactttggttacaatgactttctgagtgttcatatgttgaaaattcttgttgactattcaaaacgtccagattttgatcaaatattgctgaagtcaacattatcatttgtgagtctaaattccacaaatgtaagtcttggagatatttttaaggaatcttttgaacgagtgttgatgaaattgcctaatttgaaatatgtggatttttccaataaccaaagattatttggaacttttgggaaaagtgataatgaagaggcagatgccaatgaagttgccagtgtgaactattttatatctaaacttcctcttttccctaaattggttcgacttcatttggaaaatgagaattttagtaaatcgtcagttttacaaattgcggaaatactaccattttgcaaaagcttgggatacttttctattttgggttccaaacttgattttacttgtggaagtgctttggttaatgctgtcaagaactcacagagtttaattaatgtggatgcagattccgacaacttccctgatattttcaaagaaaggatggggttatacacaatgagaaatatggagagattgttatactctgccaaaaaggcagatgtgaaaactccgttgttgtcagaagactctgctggtaatgtatcgatgacagaacaattacatgagatcctccgtttaaaatcacaacagaaacttgatttgcaactgccagaaattacaaaatttattgaacgtgcgaaatcaattagtcatggattgagacaaactattaatgaactattgagaatgcagttgaaaaatagattagatctagatgggaaggaaactttgattagattgatatttatagattccagtattgaaaaggggttgatgttaattgacccaagcttggtagatgataacaataaaaacgcaggatatttgacgagtatgattggtaccagagagggtaatgaagaaacccaacaatttgagcaatctgatcatttagatcctcaaccagcagcaagtgtattggcaaataagtctccttcagtaatgtcaagatccgattcacgcacaagtttgaataatttaaataaagaagaagggtctgttttgaaattagcaaagcttcgagatttccacagtccaaattctccatacccggaatcaacaggtgaggaattgcgaaacaaattgatgagtgttgaattggctgatttagacaaagtgattgactttttgagtgacttgaaacagaaagggagtttcgttggaaaaagttttccagtgtcacgagaatcacggtgcacatga

SEQ ID NO: 6515 - DNA, 2085 bp, Candida albicans
acagcatatcttccattccgtctgttaagacagagaaatgtttgcgttcatgagttgggatggaagtatttgtgtgaatttttggcgacaaataaaacagtcaagaaattggatatatcacaacaacgtatcaagcctgataccccagacacaagcattcgtggtaatatgaactgggacttatttattcgatcattaattttacgtggtggaatagaagaattggttatcaatggatgtaaactatccgacgcaatatttgaaaagttgatcaatcaagcggttaagaagtcaacctatcgattaggtattgctggtattgatttgaatgttaaaaaatcagaaatggtcacatcgtggttaactgatggtaattctcaatgtgttggtgttgatattgcttttaatgatttgagcaagggacaattacgtccattcattaatgcgtttaacactggcaaagtcaacaatttagtgtttttttcattgaattcaaccaatttactgaacattgaagaaacttctgacttgatcaagtcattaattaatgttaaaacattacgatttttagatttaagttccatacctaatatcttcccgaaaataattacccatttggacaaatacttgcccagatatcctaatcttcgaagaatacattttgatcttaatgaattaaccgcacaagctattgggtcattggcggggtgtttactgaaaatgccccaattagttcatgtctcgttattgggtaataaaaatttgtcaactacgtcagcagctacattatacggagcagttaaacaatccaagaccttgtttgctcttgatttggactacgatttaatacctgatcaattatcacaacgtattgccttttatttgatgagaaacttggaatacactttgaagccatctcatggcggcaatattgaaagcaatccagaaaaaccagaggatttgatgtatgatggatcgttattaatggaaacagctgaaaaattattagttgaaatagaaaagggtaagaaagaggatatcaaaatgcaaagaattatatccgattcagtattggaaagaacaagatcgattcgtaaggatattcacaaaaccattgatacattattcgaacaaagaaatttaggtaaattatcatttgaaggtaaagagaatttagttcgattttgtttattagattcgtctttagaaaaattggttgttatggttgaggaacatgccaacggattattattaacaccaacgacctccacggacgatttcagaagtagagccatgtcgccatcggtcactgttgatacaatccatgaaagtgcaaatgagttgattactgctggaccaattttatcaccacatgtcaataggaaagcagaacaaagctcgtatttcccagtgtttgccaataatgataatttgacccctcatcaagttgtcgttgagtcaaatgatgaaggtagagatgttccaatagataaaatgacaggacgaccagttttgattcgatcaattagtcaaacttctgtgcatgcaaaagagcaagaaattgaagaaggggagcttcataaatttggattctttattcaacaaaaagagagacaaaaacaacaacaacaacaacaacaacagaactcacaccaccagcaccaaccggcccagctgatccaacaagaaaaccagctgccgctgccacaacaaggaaaatatgaagatttaccgatattaaatacattaccgtcaggaccagagttgagagatgctataatggcagctaagggagtagcaaatgttactgaattaattgatcgaattaataatcatcgtgttaaaatcgatgcaccatcgacaaaacaccatcatgaattgaacaaaccaaattctgacaaagtagttgaggatgaagttgaagtttctgataatgcctctattgattctactaatggtgacgatttacatcaacttggtgacggtaaacataatggtaatggtacggttgatcccatggttagtgaagtttatgacaagttgttaaatgatgctgaacgagtcagactgaatagagatatataa

SEQ ID NO: 6516 - DNA, 1095 bp, Candida albicans
attttttttattttacattttttaaaatatttacggaataaagcaaggtttagttttgtatatatagcaatgagtatgaacacacccgcagttgtcatggacaacggtactggattgacaaaattaggatttgccggaaacgattctccttcatttgttttcccaacagcaattgcaacttcctctgcatcatcaaaagcaggaaaaggaccacgtggatctagcttggcgtcaaagagaggtttggaagatttggacttttacattggtgacgaagcattggaagcagcaagtggctcccaatatggtttacattatccaatcaagcacggacaaattgaagattgggatcaaatggaacggttttgggaaagttcaattttcaagtacttgagatgtgaaccggaagatcattatcttttattaaccgaaccgccattgaaccctcctgaaaatcgtgaaagcactgccgaaattatgttagaatctttcaattgtgctgggttatacattgccgtgcaagcagttttagcattggctgcttcgtggacttcaccaaaggttcaagatagatcgttaagtggtaccgttatcgattctggtgatggtgtgacccatgttattcctgttgccgaagggtatgtgattggtgctgccattaagaacatcccactcgcaggtagagatatcactttgtttattcaacaattactaagagatcgtggtgaagccgacacaagtttacaaacggcagaaaagataaaacaagagttttgttatgtctgtccagatattgtacaagagtttagcagattcgatcagtatccacaagaaaagtttgctcaatacatggttgagtacacagataagaacaaaagaaataccgttgatgttggatatgaaagattcttagctccagagatttttttcaaccccgaaatttgttcttctgattttttgactccattacctaccgttgtggaccaagtgattcaagcatccccaatagatgttcgtaaaaagttgtacaaaaatattgttttgtctgggggatcaactatgttcgtcttcaccagccgggatggaaggtccact

SEQ ID NO: 6517 - DNA, 606 bp, Candida albicans
gcaattttttttttttgtttgttgttgttaattggaccagatatggctgaagatatggatagtgctgatacgcaagttggtgatgttgattcatcgatgaatgcctctcttcccgaaccaagcaaggaatcgtcacgggaaacaacaccagaaagtgtaccgacaaatgaccaatcagatcgtcccaaacctaagaagagacttacactccaagaaagattagctcaagcagctaaagggaaaaagaagccttcttcaacaaccccaacctcattgtcacgtaccactagcaatgaagatcagaaaccagatttagacttgcaaatggaaatcgaaagattaaagctagaaaactctgcattgaccaagaagttaaaccacaaatcaaactttgataaagaaagaaacgacttgattgccaaacttgcttccaaagatgaaaccattgaacaacttcgcaaagaaggcgaagcactatcattaaaggaactcaagctaaacgagtccattaaaaagctcaagcttgcaaaccaggatttagaggaaaatatccgtgattacagtgtgaaaagtgaagagtcgtctatgaaattagaagagttgact

SEQ ID NO: 6518 - DNA, 564 bp, Candida albicans
ccaatgactccaccttcaaatatctcaacaatgccagccacttcacgtattaaagtggatgatttatcaaatacaatctctaaaagattagatttggatccaataatggtttttttggaacacaaagttgctgcattacatgatttggccataaaatcatctcaaaatgctgcattattccatgaatttgggagaatatgggagagcgttacaaaactaatgaattctcaggaagaaaagttggagagtattctcaacgatgattcgaattctaaattagttacacgtatcttgaattccactttagaacaattgaaatccaccctatctgcattgaagagcaaccctgtaacaagtggtagccctcgagatgaagtcttaatttcattaataacaagcgagtataatgcgatagaacaggctgtgaaacttgtatcgcctgaccttcgaactataggagaactcaattctagcgggggcctacccccttcgtcttcaaaacctacaagtcaagtgtacccagttagtaccagtgacaccaagctgactacaaaaatggaataa

SEQ ID NO: 6519 - DNA, 636 bp, Candida albicans
ctacttcttttatacatttgttattatacagataacgttgtctcatatccacattttccaatgtcaaacacagagacggaatcaaagaaaacagagggaggggatacatcttcccatgtatttggtaatgcattgcagacttgggtagaaattgatttaccatcattgcaaaagaaattggatgaacaagggatagaattgaaagaggatcaaaaagcttctttattaagcagaaagaacttggcttcaaaaacaaaagagtttaaaaaattggaagattctgagaaattaaatcaattcaaatctttattgaagttgtatcaaaatgaaattgataatttgaccaataagaataaaatggttgaaaactatttctttggaatttatagaagtttggcagaagcaccggatccacgtccactacttgaaatgtcattagactcagtaattgaatcaaaagaaactgtgtcattcagaaaagaagtggatatgttgaccgatgaattggcaaaacgtgccgattatgacaatttaaaacaaagattgttacagaatgaacaaaacgcaccagagttattgagtttgaaattaaatgccaaagaagatgaattcaagttcataatagatgacaaagaa

SEQ ID NO: 6520 - DNA, 411 bp, Candida albicans
ccagagacgcagaggcatcgtaataaaatagtgtttgaattggaaaaaagaaatgaggacttgagacgtgaattgtcaaaatcacaaaatgatatcgaaattaaactgatcaaagaagattattccaaaagagtatctgaattggagggtgaaaatgtgcttttagtggccaatttaaatcaaacccgtaaaaaattacaagattctgataaagaacatgcattgaaaacagattcattaaatcgagatatctctagtatggaacttgagattaagaatttaaaggctcaattggacaaagcatctgactacgaggagatcaaaagcgagttacaattactcatacaaattgagtttggacatggagatgatgactattatgatgacgaaactggaaatgctaatgcttaa

SEQ ID NO: 6521 - DNA, 1017 bp, Candida albicans
atacctgatagctacataatgtcaacaaacgaagtagtagataaatctaccttggaacaactcaaagttaacctggaaactgctaaaccagtgaaagaagagaaacctgccgccagtgctgaaaccaaaaaatcttctaatgacgatgatttggatgatttggacgatttgttggatgattttgctgatgatgttttaagcaagccacctggtgcctcggtatcgcaacgagacgatcaatcggtcaaacatgaatcagataaggcaaaagatcctactgatccccttggtaacgactttcaaaaatccataaatgagttgatcagtgatttgaaaattgaagacccagacacccaaaagcaatttgaagatttggtaaaacaatttgaaaccaaccacagagaatcggttgaagcggaagagaaaaagcctgccaattttgaatacgttatgaaagaaacaatggaaagattgaaaaaactgggtgacgacattgatgtcaagtttaaaaatgacccattagggtccaacccagaagatctcttgacccaattgttaagtggaatgggtgatgctggtgacggtgatttcgatatgagcaaactattggtggacatgttagagcaattgagctcaaaagaagtattatacgaaccgatcaaagatttgaatacaaagtttcctgagtatttgcaacaaaacaaagacaaacttgacgaagccaaatacaagaactacactcagcaatacgaaataaccaacgatatcgtcagaatattcgagctggaatcatacagtgaagaaaataaacgccaaagagaacaagtgaattcgttattggaatctttacaggaattgggtcaaccaccaagcgaacttgttggcgaaacaggcgatttcctccccggctttggtggaggtgcaggtaagggtggcgataatccattcgggtttgatgaaaaagacctaccacctgaattcggaaaggacttacaagaaggttgtaaacaacaatga

SEQ ID NO: 6522 - DNA, 525 bp, Candida albicans
  unsure (23): Identity of nucleotide sequences at the above locations are unknown.
agcgtaggtaccttccaggggcncgttgaagaacatagaagtgtcgaatattatgatgattccatgaatagttctgggctgccattcaatttcttggctccatcacaagtcagaggatctacatttataatggattctaatatctccactatcaacaacatcaaagttatttgtcgatttcgacctgaaaatgaaaaggaactacaaaagggtaaactgattgttgaatttccaaacactcaaactgtgacattatatggaaaggattacacaacccattattcttttgacagagtattttcccctgaagcaagtcaattagatatctaccaattctccattgccgaaacagtcgatgatttaataaatggttacaatggtactgtcttggcctatggtcagactggttcaggtaaatcgtataccatgttgggtggaccacaattactggatcctaattccaaaggtattatacctagaatatcccatgaaatatttgagagaatttcggcaaatgaagccgtg

SEQ ID NO: 6523 - DNA, 771 bp, Candida albicans
tcacaatcgttatcctcattaactaagggaacatcaacatcgtcaaccaattcattaattcaagatagtattgcacaatatgcccaagagaatataattagtattgataatattattatttccaaatacaataaggatgagaattcgtctaaatatattgattatgttaataacaaattgttcaatgttgattggcaaaatcaaaagattattgatgttgaatcatatcacgacaacaacaataaaaggggcagtaattatgatgaattgattcagaaattgtctcaatatggtgatgattattatccatcaaactttgcatttacagttattcctgaaagtgaagatcaattgagagtgattattataggacaacgagccaatcatgataatttttatactggacaatggaaatcaaattatttaattactgaacaaggaatcaaaggtaatattgatttagatattcattattttgaagatggtaatgtcagattgaaattcaatgaatctatcaacagtagtaataataataataatagttcaactttgcaaagtggtaatttgattaataatgcatctagaattgtcaattttattaatgaacaagagaatgctactatggttaaaattattgaacaatttaataatttgaatcaaaaatcatttaaaaatttacgaagattattgccagttaccagatcaaaaattaattgggggtctgctattggtaattatagattaggtagtgatgtaatcaataaaaagtaa

SEQ ID NO: 6524 - DNA, 441 bp, Candida albicans
ctagttgtgtctttctttcttttttttagtgttactgttgctgacgaatccttaactgcattcaatgatttaaaattgggcagaaaatacaaatttgttatattcaccttaaatgatgaaaaaacccaaattgtcgttgaacaaacctcaactgaacaagaatacgatgcattcttagaaaaattaccagaaaatgaatgtagatatgctgtttatgattttgaatacgacattggtggtggtgaaggtaaaagatccaaaattgtctttttcacttggtccccagacaccgctccagtcagagcaaagatggtttacgcttcctccaaggattctttgagaagagcattgaatggtgttgctgctgatgttcaacgtactgacttttctgaagttgcctatgacgccgttcatgaaaaggtcagtacatgcacccattaa

SEQ ID NO: 6525 - DNA, 2949 bp, Candida albicans
aaccatttgttgcttctgcacggtttaatttctataaagttggtcagtgatgctcttgctttaattgactcatttttgggttatttagtaagtgaaaaatgtgattcagacattttgtttgaaaaaatatctaaacttgctattgttataaatgaaattgccaaccaaggtgatcgtcaaagattgggtagtaatgagcattccgtcatgttaagagaagcagttgcgtactcattaactgctacaaggtatcacgctacatataaacaattgtttcctcgttacattgtggaaaaatcaattggcgaattgaattgtatactttgtgacttgatagcagagtgcaagctaaatgagaattcaactaatttaagagtacttgaagtggaaacaaaagttcctaaaaagtccgtgaatgaagattttggtgttagaccactacgtatggccaataaattaaaggttaatcagagccaacaggagcctacacaaaaatcaaattcagaaaccagagctttacaatatgaagagcaatctccatttattgaggaaacaagagacaaaccattgaaatccaaagctaacagtgcatttacaacattaagagctcaaagagagaaagcaaaagaagaaaaatcacctacaaatgcaactcatggaacatctttttctaagggtgcaacagtcgcagctactgttggtggtgccctgattcctgcagctgctcaagttggagacccacgtacaaagaaatccacgcataatgttgcttttaacgataatcctatttctatatctccaagataccaaaactatgactctgacgaaaacgaagatgatctaaatgatgatgtacctactaatgataattttaacgctcattcaaacaaggaaacaaagtttgataggaaaccatatggaaccgagactcaaactaataatctcacttctggagctttgagtactaatactacaccaactaaagttaaaattagtcgatcaattaatgaagacagcgatgagcttgtgtctgctactaacaattccaatttccatgataacagtggatatcagcaatcaagaaacttggactcaagtaataattttgtgacacaaaactcgggaaatttgaattcatataagccaaatttggataattcaccagttcgtaaaacaagtttagattcaagtgaagacaagtatgctctgccaatgagagacaccgatcaaagttttgataacgaccaggatgatagctttgaaactgcttacacatttggcaagaatttggataatgttcatgatagtaacactagaaaggaagatgttgccacacgcgggttgggtactaacaatgaggtggtacctcagaaagaaaattttgaaactgaaggtaaaaagaagggaagcattgcactgctagcttcaaagtatgagaataatgtttcagatcaatctacttccagaaactattctccaattaagaataaatcggataaatcctcacaaggagttcaagaattagctagaagaatcacatcaccagaagcttcgccagaatctcaaaagtctatttcacaagcatcaaagatatctccatcaaagaaaggtgttcttgacaaggtgaaacaatttgagagtccacaaagagaagatgttccttcttctccatcaccaaggaaatcaccaggacaagataaagttcctttcaaatccatgagaacttcgttagaactgagtaaaccatttaaaaatgaagaagatcctgggcaattgtcagcaccatttagtgctattcatctgaagaatgaagtaggcgaagaaacatctaaaaaagaaattgaaaattctgctgctgctgaaacatctacttcatctgatacttccacttcaagttctgcaccagttaaaagtaaaggattgttccaatcactcaaagataggttcactggagaaaccaagaaagaagaagaagaagaaaaagtacaacaacaacaacaacaagaagaagaggaatcagctaagcatattgaatcttctcaatctgatgccacaatttctgataatgagaaacagaatgatactcaaaatgagaatcttatgaatactgtggaaacctccccaccaaaagatgttaatgatgaaataattagcaaacctgttcaagtacaatatcctgaacagaagactactcattctggtgaacaagaggtcgaaaaaagcaaggatttaccaattgagaggagagatgtggtgacagaaccttcaacaggaattaagcacgagccagcagaaagtaacaaaactgaacccaaactacaacaacaaaaatctttactacaaaaatcaaagcaacaaaaaccggttacacctgaatcagaagaatcatatagtgaagaagaaaccgaagaagaaatacgagcaagacaaagacaagaatacagaaaatcaatggcagctgcaactttcaatgtcgacttgtttgatattgatgatccagacaacacattaacccaagttttactttatttggaacatcaaacagtacaagtcatcaacacaattcaatcattacttgcagctattaagaagcctaatgctactagaggtgaattacgcgagaagactaaagccatcacgattgtcatatcacaaatgactgaagctaccaatacatcaatgaatcaaactcgtaatgctcaattgaaagaacatggaagttgggttgttagaagtttagaagattgttatcatagaatgaatattttatgtaaaccgggagaaaagcctgatacttcatttgctgataagaatttcaaacaaagattagcaggaatttcatttgatattgccaaatgtactaaagaattagtcaagacggtggaagaagctagtcttaaagaagatattgcttatcttgatgctagaataagtcaaaatcttgaataa

SEQ ID NO: 6526 - DNA, 1515 bp, Candida albicans
actatacatataatgagtgaaaaggatcttgtccaacattataaggtgttgaaacagtttcttgctatatcggatgatcagcaatcaagatcgaaatcaaattcatctcgagctcaaagagcaagagaaaaactattgaaattatcatcagcacaattcaaagagttaagtaccgatgtttatgatgaattaagaagaaggatagatgaaagtagatcagaaccagattatttattacctaaatcttcattccacccaaaaagaaatcaagcaagacagaaattggcatctttaccacagactagatttaaagatttagtggctgatatctcatatgaaatagagcgaagagatttgcatgtggaaagacaactgcaacattcacacaccacttcaatgtcatcaaacggaagccagttccaacatgaacgtaagtcatcgttagcttcaagtcatcatcgtaatgattctgccaatggttatcatagtcgcctggcatcacaccatttgaatgattttgccgctacaaaagaagtagatgaagagaaagaaagtgatagtagagatgatttgaacaacacatcaagcaagaatattactatgcccaatgctgaagcatctaatcaatcaataggtattcaaccttctcaagtagtgccaacaaaggccaatcttgattggtccagtgatgatgaaggtgatgatgaacaggaagaagaggaagaagaaaagggaaaagtaaagaatatctcagatcctaaacatacacaagctgagcaacaccaaaatcagcaccaacactctaattctttgagtaataataaagatataaacacaaaaagtgaccgaggtctcactcatgatgaaaaggataacgaattggccaagttggagacattagttaatgatcttaagaacaagttgcaagcatcagagtctgaaagatcaaaattgaaaggcaagcttgagtcactccaagaagattataatttttctgtcagtcagaataaatcactcagtaacgagttggagacgttgggtaaagagaaagagcgttggataacaaagcacgacaatttaacgaaatctatgagtaattctgatgagaatttgaaagagatagagagattaaaatcaataaatgcagcattgagactcgagaaccaatccttgaagaatacctcatccagtcctagaagtgttggaagtccaccttcagcaatcaatgccattactaccaattcgggaaattcaggaaactcagcaaaattgtcacaaaagagtgtcgatgaatttttagaaaaattggaaaccattcaactttctcctggatcaacttcaaataatccatctaccctagaattgaagaatcaaattaaactttggcaacgtagatacgaagattctaggtctaatgcaattgcaagagatatcaaaaaggcatcattacctaaaatggaattgaaaccatttgttgcttctgcacggtttaatttctataaagttggtcagtga

SEQ ID NO: 6527 - DNA, 183 bp, Candida albicans
gttatgtcgtttcaagatctcataccagtagtcaataaactacaagatatagttactaccactcaagtatctgatattgatttacccattttagcagttgtgggttctcaatcttgtggtaaatcctctgtgttggagaatattgttggtaaagattttttacctcgaggaactgggatcgtt

SEQ ID NO: 6528 - DNA, 498 bp, Candida albicans
cctacccataatttgtccattcatgatatcagaacagcaattagaaattctactggacctagaccttcattatttgttccagaattggcatttgacattttggtcaaacctcaaattaaattattagaagctccagctcatagatgtgttgaattggtttatgaagaattgatgaaaattgttcacagtgtttgtacagctgatattggtactgaaatgagtagatatccacgtttacaaaacaaattaattgaagttgttagtgatttattaagagaaagattaggaccaactattaaatatgttgagtcattaattgaaatcaataaggcatatattaacaccaatcatcctaattttgttggtgctgctaaagctatgagtattgttgttgctgagcgggaaaagcaaaaggaattggaactgtctagtagattgagattagccagtgaaagaattttaatattaatgaaaaaatccataatagtaattatgtaa

SEQ ID NO: 6529 - DNA, 807 bp, Candida albicans
gagaatcaagatgggaataacagtgaagaagtggttgaagatcttgaggctgatatcaaatcggttgatgatgtagtacctaaatctaatcgtcgacgtgcaacatctacaagaacttattctgttagatcagaatcaacttcaggtcattatcatcaacatcaacatcatcaaggtcatctccatcaacaatcatcttcaagttatttgaattatttccttggaaaagatccagtggttcatcaacagcatttacaaacacaagcacaattgaatccaactccattcaaattccctccaccacaagaagccagttcattacaatttaatactacttttataaatagtaatacttccaccaccacacctattgctaataacaatcataatcatcataacggtgggatgatgctgacttttgagaataattctaatttacccgatgaatttggtaataaattggcattgtcagattccactgtaagttcatttgaatcagatgaattaattcatgaattgagtgaacgtgaacaaatggaatgtgaattaattagacgattaattatttcttatttcagtattgttagagaaacaattcaagatcaagtacctaaagctattatgtgtttattagtcaatcatattaaacaagaaattcaaaatcgattggtggttaaattatataatgaaaatatgtttgatgaattattacaagaagatgaaactattcaggctgaacgtgaaaaatgcatagaattattgaaaacatatagagaagcttctgatataattagtgaagtcttttaa

SEQ ID NO: 6530 - DNA, 762 bp, Candida albicans
gaattgctgttcaaaaataagggtatcagtagttacccaatcaatctcaagatttattcacgtaatgtattgaatttcacattagttgatttaacaggtttgaccgaaattcctattggagatcaaccaacagatattgaaaagcaaactaggagtttaattttagaatatatttctaaacaaaattgtattatattggcagtatcacctgctaatgttgatttggttaattctgaatctcttaaattgggcagacaagttgatcgtactgggaaaagaacgattgggattttaacaaaattggatttaatggatcaaggtactaatgccttagatatcttaaaggggaatgtttatccattgaaattaggatttattggtattgttaatcgttcacaacaagatatttctgaacataaatctttagatgaatctttatttgatgaacaacaatttttcgctaatcatccggcatataaaactatggctaaaagatgtggtacaaaatatttggcacaaactttaaataagattttaatgaatcatattagagaaagattacgtgatattaaggcaaaattaaatactttaattggtcaaacagaacatgaattggcttcatatggtgatgggtttggatttggtgattctaaagaatctcgtggagccatggttttaactttaatgacaaaatttgctaattcatttgttgggtccattgaaggcacatcagttaatgaaactgctgctagagatattcac

SEQ ID NO: 6531 - DNA, 951 bp, Candida albicans
tgtttaataaattttaaattttggtgggtaatgccgccaatgattcaaaaattgaaaaatttaggtattattgaatcaatttgtgaaaaaggattattatcatcaaggaaaaacattaaagaatggagtgttgaatcgattttattaatgattgaaatttctaatgaccctaattctattgtggaagatattttaccttatttaactaatcgattacctaaattagtcacggggtgtgttagttgtttggcgtcaataattgaaaattttggttgtaaaataatatctcctaaaccaattgtcccttgtttaagtaaattatttgctcatgctgataaaaatgttagaaatgaaactactaaacttactattgaactatatcgatggatgggtgatgcattaattaacgcgttattttcagatttaaaaccggtacaacaaaaagatttaactgcagcatttgaaaaggaaaagggaacatcaccacaacaaaaaagatataccaaaaagcaaagagaagaaattgaaagaagagaacaagaagcggcggcggcagcagcagcggcagcagcaacaacagccgggaatggtggtggaaatggtgatgatgtcgatgatgtggaaatgtcagatgtcaatggtgttactgatgataatgaatatgatccattagaatttgttgacccagttgaagttttaaataaattccctagtgattttgactccagaatttcatcatccaaatggaaagatagaaaagaagttttagaagaaattatccccattttggaaaaatcccctaaattaattactactgatgattatttacccgtattaagaatttgggcaaaatgtatgaaagatgccaatattcaggttgttcaattagcagctaattgtatcgaatttggttttcactatacggaacctgggcggatccgcgattgcaat

SEQ ID NO: 6532 - DNA, 1164 bp, Candida albicans
aaaaatcaactcaaatgcgaaattctggatgcatttttggctagatccaaaaaaaaaataatcaacatactatcaaagttggtggcttatttacatcattcttctaaaactccctattccatgccagaacaacttcaaaaactagtgatagataatggatcatataatattaaagctggattcaatactggtgatgatgacggtaatgatacttctacaccaattaaagtaaccaatgcaatatcgaaaactaaagatgggataatacatgttgggaaccaatatttatcacataccaacaatttttctggaattcaatttagacgcccatttgaacaaaataatttaacttcttgggaaactgaaaaaccaatatgggattatactttagataatttattattacaaactaatgatcagtcccagtcgacatcatcatcatcatcatcatcactacagaaacacaagagggggaaagtcattgatcctgatgatattcatttaattttaacggaacaaccatatcaattaccacaattatcgactaatactgatcaaataatatttgaagaatatggattcaataaatattatcgatgtattgcccctagtttagttccatttagtgttgataccaatcaaattaatgatgattttgtgttagtgattgattctgggttcaattcaacttggatagtaccaatgatatatcaacaaatccattggcctgcagtgaagaaattacccattggtggcaatttattgaatgggttgttacgagagatgattctgtttcgtcattatgatatatctgaagatccaatattgattaatacaatcaaagaatctacttgttttatatcactgtcaaattatcaacaagatttgcaacataaacatgatttaatgtgtgaatttgttttacctgatttcaaattaactataacagggtttgttaaaaatgaaaattcaatgtcactgcaaaaactacctaatgatacccaagtattaaaactttatgatgaaagatttaccgttccagaaacttatttccatccagaaataatatttgataataatcgaactactgcatcaagtagtctacttaataatgctccattcaaaaatcttactgatttaatagttgaaagtattatggcgtgt

SEQ ID NO: 6533 - DNA, 333 bp, Candida albicans
agaatgggtattgaacaagataatactgttttcagagtatttgatcctgctgctaaacaagaagaagagagagctttacatgaagctaaattagccaagatggaagcagaaatgaaactggttttccaacaaaaagtgagtgaaaaggaaaagaaattacaaagatctgaagctgatttatttgccagacataaagaaatgaaagataaattgactaaacaaatcaaattattagaagagaaaaaggctcaattagaaaaacaaaaattattaccacaagacccaccagcacaaccagctccacaaaagagtcgtaaaggatttttacgttag

SEQ ID NO: 6534 - DNA, 1230 bp, Candida albicans
ctcgactccttgtatcaacccaaacatttacttgagattttcactcagtgggcacgcgaagaagcagatgataagtttgtatcagatgcatatgtcaaattgggtaatgatttcagagcagcaataagggcatttagcaataatggcatcgacatttcagatatagggaatgtgccacaagcattgaggattattttggaggctgcattgagtgaagcaccttcacaagaaaacttggacaggttcttacctagcatcaggaatataattgtaacattgttgcaaactttgaaaaccaaacaggcaaaggcgaaggcaatttctcaagaaaagtctactaaagaggaattaccaactgagaatcaacgaccttcatcacttggtgttgaaggacagcaacaacagcagcagcagcagcagcaacaacaacagagaacaggagataatgattccagtgttgagcgaagcgatgctttgtctcagttacagaagggagacgttcttcaacgtcgtgcatcaaagcggtttagtgcttatcagtatgcaaaactaacaaacttcaacaaccctacaactagtgtgcctaagataaaaccaatggagtctccagaagttcggcattcaaagattatggagacagaagaaccaaatgtcacaccaaacaaaggggtagagtcagttcaagaggatggaaatacagaagagtacgttttgctaagaattaatgcaaaaactaagaaagccaaagttagtttaccagtaacatttgcttcattgagactattgtttgtggaaaaatttgcatactccccaggggcgggtaattttccagacatatatattcaggacccacgtagtggtgttctgtacgagctcgaggaacatttgcttcccgatgtcaaatccggcactcttctttgtttaaatgaaacagatgatcaaaataaaagtataaacgaattgaatttacggttggacgacttgactaaaaaaattgatacaatggggagcaccataatagcacaggtgaaagactcagtggcatctgttgaaattccggtgcccactgttgctgcttctgcttctgctgttactgctaaaagtgggaacgcaaatgaggcaaataaaatagggcgcaaggatattaccaacctagaaagagatttccgtgccattaaacagttgcatcattcgtcatctacttccccacggcgtggaaggatccaagtc

SEQ ID NO: 6535 - DNA, 732 bp, Candida albicans
ttctggagtattctcaaaatttttaacggagtttatatggattcctgtaattctaagttgtctgatgactctgatctgttaattaccaaagttgatgatttgcaagatataatggaagaaatgagaaaggatttggcacaaagagggttccgtgttagcgacaagcagttgacacacattctcaaagatattaacttagccaagaaatctcttcatgacatgacattatatatctcgaaggaaagaccggtgtggaagaaaatttgggaggcagaattggacaaggtctgcgaagaacaacaatttttgaacttgcaggatgatttgatccaagatttacaagatgatatcaaaaaaattgaagaaacgtacaatcttattgaacaatgttccattgaacagattaaaggggcatctagcaaaaggaataaaattgttgctaacttgtatatcccagaaccaggtgaaagtttgcacgatttgaaggacgcagtgttgaatgacattgttggactcacaccaaaccatgaaagtcgacttgaagccattgaacgggcagagaaattgagagagaaagaacgagatatgatgaaacttaccaagtttcaagaagagttaggtgattttgttgaggataagaaattgaaaagatcagggggtattgaagagatagagaagcagcgacaattgagagatatcgagaatttaaaaagctcgtttgggggtatatga

SEQ ID NO: 6536 - DNA, 855 bp, Candida albicans
gagctataccagcagagaagaagaacaccggagcctctgtcagagatatcatcgaaacaaacaccagatacaaaaccagtttctttaagtaatgcaactagcaacactggtaaatcctcgagtgccggaaaacatcatatgagttttaatccattctcgcatcataaaaagcaggaaaatcagacaccaactgccccaccaattccacaaaatgtgccaccggtaccaccaagtggtccacctcatgcatctgcttcgaattctgtcaaggacgcaccaccaattgcaccacaaattgcaccaccaccaccaagtgtacctagtgttgttccaccggccccacctgctccgccagcaataccaaataccatacctccaacattaccaacttcagaatctactcaaaataacgcatcttcagtgtcaacggacataccaagcaacgacccaccttcgccaccgcctttgccatcaagttctgcacccccaccacccagaaacaaaaaagctgcagctccacccccaccaccaacacaaactacaggatcagaatacaaatcctcaagctcgacatcaagagtttcttcttctaatttcaacgatttagacttgagacaaaatgcaggaacaaacttgagaaaaatttctgcactggcttacacgataaaccctcgaaatgcaagtaatggagattccaaaccagagaaattggtaatcgatgacaagagattcaaatttgttaatgctaacgcattacccaatccaagaagatttggtgagagaggtgaaaaggagaagttgtacccaagtggtagaggctcctcggtgccacttgatttgagtttgtatgcatga

SEQ ID NO: 6537 - DNA, 294 bp, Candida albicans
tttgaaacattagaaatagcaatggctgcaccaccaccaccacctcctccaccaccacctccaccatcaggcttaggaaatttaccaccaggtcctcctccatcgatgccaccaggtagagatgcattgttgggagatattagaaaaggtgcgagattaaagaaagcaaccaccgtcgataaatccaagcccatgatcgattctaaagtatctgtatcggcagctccccctcaagcactggcaaatagttcaggagcgacaaattctttaccctcagcacctgctgtcccacaa

SEQ ID NO: 6538 - DNA, 1950 bp, Candida albicans
gtcagtaggagattcacagtacgcacttctacgaagtgttgctactacacgacagttggaagaaagaaaaaaaagttaacaacaaacaatcaacaatcaacagtccgtgagaaagagagagagaaaaaattcatcaattcatatctaactacttctaatatcttaattacatacaccatcattagctttgtctctccctttgttttttgctacattatgtcactaactagtaaagaactaaattatttaatatggagatatcttcaagaatcaggatatgatttatctgcctatgcattagaccaacaatcacaatgttctgaatatgaaaacaatcccactactcaagaacttatacagaaaataaaacctggatgtcttgttgatttaattcaaaaagggatattatatatggctgcagaacaagaggccactgattctactacaaatttatcattatatggagcattaatacaagacgatttgaacaatttaaaggacaataataatattagcaatggaagtaatggttcgaggtttgcattgaaatcagagatagaaacaaatggggaacaaaaagattcagaaaaacaaaccaataatgataaagataaccaagatatagaaatgaccgatgcattgaacaaagaggtacaacaacaggaaattattgaatttgaaacgcaattactttcaccacagcttaaatttgctccaagtttgacatgtgactggcatccaacaactgaagtgtttgcttatggcaaagatgatggtactgccacaataaatgctattcaagatggcaaaataattgaaacaagaactttaacccatccaaatcttttgaatattaaaaaccaaatcaacattgtatcatggtcacctcaaggtagtttaattataacatgtggagcaaatagtgaattaagagcttggtcaccggatgggaaattgaaaaacattgccagtactattgttgatgaagcaatttcattggaaaacactaaattaatcagtataatctcatcattgtcatggagcccaacagggaaatttttattgtcaatagatagcctgaatcaagtatgtatttgggatggcacaacaatatctctaataaaacaaatcaaaaatttggaaattaatgatgattcagtggtttgttcttgttggttgagtgaagataaatttgctgtcactactaataccaatggcattaaaatttatgatatattacaacctccatcatctcattttgggaatcaattagatgtgcaacctataggtttattgaatggacacgaacacaatatttcactcatgaaattaaaccctgtgacaaaattattagccacatgttctgatttcgattattcgataaaagtatggagtagttcttcttctcaagaatgtttggatttgaatattaatcctgaaaaaaaatacactttgaaattacatgcagcaccaatgattggattaatctggctacctgattccaattcaaatgaacgtagtttattattaagtgtttccatggaaggtattctaaatatttgggatgctaaaacttcggaaaacatcaaaagttctgaattgtttaataataaagataactttaccaatgaattgaaagacgacgacaacaacaatgacaccattattaaagatgttttggtattcaatgcagtattgtcacctgatgggaaataccttgccttgggggatgattattgtcgagtaacaatatgggatgttgacacaactcattatctaaatgaaccaaaagatcttatcagatgcaaagcagtttataaaccagaaatatccgctgaagacaaattaaaggcaactatagggatttgcgatatgaaatgggatcatgaatctaaattaatatgtgtttcctacaatggtatggaaagtgttataatcaacacaacataa

SEQ ID NO: 6539 - DNA, 1515 bp, Candida albicans
caagaccaatttgaaattagtggaaaatttgtgagagcctccaagtatcgtcatgtttttggacaaccagccaagaaagaattgtgttatgagaacttgagaattaccaaaaatgcttgggattccaatattattcaaaccaatggaaagtacatttcagttaattgggagtcttcagggggtggtgcatttgctgtcattcctgttaacgagactgggaaagctcctgatactgtttcgttatttagaggacacaagggtccagttttagatactgctttcaatccattcaatgaacaacaaattgctagttgctctgatgatggagacattttgatttggcaaattcccgatgactattcatttcacaagtatcttgatgaagaagaaaatattaaagatgtcactgaacccattaaagtcttatcgggccacaaaaagaaagtcggattgattgcattccatccatgtgctgaaaatgtgttggcatcaacatcgttggactattcagttaaaatttggaatgttgaaactgggaaagatgaaatcactttgcagcataacgattttgtcacatcaatttcattcaattacaacgggtccttattagctacctgttccagagacaagaaattgcgtatttgggatatcagatcaggtaagatcatttctgaaggatctgggcacgccggagccaaaccatcgagggttgcttggcttggaaataccgatagaattgttacaactgggttttctaggttttcggatcgtcaaattggtatttgggatgttgagaatattgacaaaggtccaatcaatggattttggcaagttgatacgtcgtccggtgttttgattccatactttgacgtggaaacctcaatattatatgttgctggtaagggtgacggaaatattcgttattatgagtatatcaatgatgaattgttcgagttatccgaatacacatcgaccgaccctcaaagaggatttgctgttgctcctaaatattcagttaatttgaaagacaatgaagttactaaaagttacaaaacagttttggataactccatcgagcctgtttcctttattgtaccaagaagggcagaagtattccaagctgatatttatccagactgtccttcgacagagccagcattgagcgctgaagaatggttctctggcaaagaggtgaatggtccattgctcataacaatggaatcattgtataatggtatcaaaccagaaatccacgaatccaaaccagtaaccgtggtaaacgaagtcaaaaaagaggccgaacaaaagaaacaagaggaaatcaagttaaagagtgaacagaaggaaaagaagtctgatagtcaatcaacatcagctgctactgcttctactactaagaaacaagaaatcgaatctactaaagaaggcactccaggaaagaatgtcgacgatttattaaagacttcagcacaagtcatcttcaccacaggggccaaggaccgccatagcgggatg

SEQ ID NO: 6540 - DNA, 1182 bp, Candida albicans
  unsure (1059),(1128): Identity of nucleotide sequences at the above locations are unknown.
gtccaaaagaatctgctggaagtaaatccagacgtcataaatgccgtggaaaatgcttttacattgattatgaataaaccagagagtttagacacgcgatttgatgggagtgacgaattcaattctgatcaattattgactacattgcaactaaaaagtgatttatttggagagtcgtcgactaatttgtcggatggcaatcactctaatagaaactctagattgtttgatgatttcttatccgatgatgaccaatctgattctgacggagactctttatactcggataaacactcccaatcgatgaataatagtaacctggaggtgcagtttgctgctcctggaaatttgaatttagcagaagagatcccaaagttgtctgatgaagttgataatttacagaaacagattactattttagaaccattattgcggaaagctgagttaactaataatttgtctgagttgaaagttttgcagaaatcaaagattggtttgattagagaaatcaatataaaagaattacagaaacaacaattcattgttcaggaaaacgataacagtttgtttgggaaatctagagtatgcatccaatcttatatcaatgataatgaaaaaaatggtcgagaatttacattgtacattattgaagttcaaaaattttctaatgaaaatcccaacatcgttaaagccggttgggttgttgctagaagatttagtcaattttacgggctacacgaatatttaaaactgaaatatcatagagtaagttatctcaagttccccaaaaagtcaattctggttttgaagtttcagcagaagcaagtcgcggaaattagaatgaaacaattggaagactatttacaagagttgattaaaatacaagaagtatgctctgatcgagcattccgatcattcttgtcgtcggagaatttcaacttgaaaaagaatcaacgttttgaagaaacaagagcaaaaaattacagtgacaccaattttcaatcattgtttggaagtaaatggtatcgtggtatttcaaattttatgacgacgacgaanaatgatgaaaaccacaaagatctgacttatattgacacccatataatggaaaacttacgagatatgganagtgaattgaaacaattcgatgaagcagcatcggcaagaactccgtttgtttaa

SEQ ID NO: 6541 - DNA, 528 bp, Candida albicans
gggtgttcccaacaattacgcggatcccgtcgtctccctgtggtgaagacaaatgtgattgatgaagttcgtactggtgtttacaaagatttattccaccctgaacaattgattgccggtaaagaagatgccgccaataattatgctagaggtcactacactgttggaagagaaattttagacgacattttagatagagtcagaagaatgagtgatcaatgtgacggattacaaggtttccttttcacccactctttgggtggtggtaccggttccggtttgggttctttgttattggaacaattatctttggattacggtaaaaaatccaaattggaatttgctgtttacccagctccacaagtgtccacttcagttgttgaaccatataatactgtgttgactacccacaccactttggaacacgccgattgtacttttatggttgataatgaagccatctacgatatgtgtagaagaaacttggatattgccagaccaaattttagttcattgaacaacttgatg

SEQ ID NO: 6542 - DNA, 1359 bp, Candida albicans
atcccatcaattgtttatccagattccatcactaaacaatatcaagccactaataatagtgaaaatgctactgaagaaatatatccaattattgaatcgaaaattgttaatttagatgcatttaattatttattaaaaattattttacaaagtgtaattgctaatcatccaactattaccattaatcaaatccccatgttattaattactcctagtttaacatggtcaagacaatcaattgaatatattactaaatatgtcattgaaaatttagaaatcaccgcatttaatattattgatttgagtctagctgcaacttttggagttggtcaactgacaaattctactgttgtttatgttgatgatgaaaatattcaaattgtccccgttgttggatatcaagcgattaaatttgcagggaaattaattaaaaatgaaggtagtataactatatctcgagaattaaaacaaaatttacctaatttaacatctcaacaaattgaagatttgaaaaattccgatatttttgaagttgtaattgatcaacaaggaatggtattagattatatcaaagatattacaaaaacaaacaatgatgaagataatgaattcgatgttgccaaaatcgtcactgaaaatcaaaatggtatcccagaagccattataagtaatacacctactgaacaacaacaaaaagaacaacaagattcaaataaaccaaataaagaattggaaaaaaattatttcattgattctaaaactcaagaaaaaatttggattggtaaagaaagattttccgggacgaataatcttgttaaattgatctcatcatcgatatattcatcattattatcaattcctgatatcgacaaaagacaagattgttatgataatattatattagttggatcaattttcaaaactccaggattgaaagaagcaatattaattaaattaaatcaagattatttagttaaagaacctaatgctattgatcaatcaattaatgatcctggtgtcaacactgccattttgaaatatcaacaaagcacaaccataaatgattataacgaaggtggtagtggtgataataacaattctaattctaattctaattcaaatcaagttcctaattctatcaaattggtgaaatatcctgattatttcccggaatggaaaaaaccaaaggaaaaaggtggatcttggcatgatgtttatttcttgggtggtcaaatttatagtaaacaaatttattctggtagttctcatcatcatggtaaagaattgtttgttggaagtgatatgtatgaagaaagagtcctcaaagtatttgggatgccagcatttaaagaaaattga

SEQ ID NO: 6543 - DNA, 1863 bp, Candida albicans
aactatatacagttaaaaataatgtcaattaaacctttgtcaattacagttccacatccatctacccaaaggggacatgcaacacatatatcttacgatccagtcaacgaaagattggcttatgtaaatgggaaatctgtcataatcagaccagtcgatttcaaatctacttcgccaactgtggttttctcgaaacatattttcccaacaactgcagttaagttttcgccatccgggtattacgttgcttctggtgacgaagcaggtaatattaaaatttgggatgcctcaccaaagtctgaacctgatttcgaacagccagttattaaaagtgaatttcaagtgatgtctggtcctattcgatcaattgcttgggatgctgataattctcgtataattgctgttggtcaaggtaaagaaaagtttggacatgcattttcatgggattcgggtaattcgattggggatattcaaggacatagttcacctatcaatgttgttgatataaaaccccaaagaccatatcgggctgccactgttggtgaccatcatgctcttgtatttttcacgggtccaccatttaaatttgacaaaagtttgaggggcaatcacaacaatgtagtaagggacgtcaaatttagtcctgacggagagtatattgtttcagtcggctccgatagagttattgcaatttatcaagggaaaaccggcgaatttgttaaaaaaattgaaaaagctcacgaaggtggtattttcgctgtagcttggttgcccgactctaagcatttcatcacagcatcagcagataatacattgaaaaaatggacattagatggtgaaaacactcaaaaatttgaaattagtagcactacatcagttggtaatcagcaagttgggttggcattgactaaagaatttgttgtctctctttcaggaaacggtaatttgaattattttgatcacgagggaaatttagtgcaaattgttcaaggacatcaatcacctataactaaggttgaatttcatgatggttttctcttaagtggcggatctgatgggaaactttttaaatgggaggtaggaactgacggaccaaaagcattgccagcattacaggatgatgatgaacattcaaattatgttgttgatatattaacagttgatgatgtaacatacacgactggatgggatgatactttaaagtcatggagagatggaaaagtggtctcttcggttaaattaccttcacaaccaaaacaattaggttcaatcaaaggtgctgtttttgtcttgtttgaatctgcattgcaattgtacacagaagttaacttccaattgattgctgagacaaaatttgatttcacagctacatatgctgcgccaactaatgatacccacattttgataaccaacactactagcaatacagttgaagaatttcaagttgggaatggggaaattagaaaaacttctaaagaatttcccaaaagtcgttcgcctccaaatttcataacagtatcaccttctcgtgagtttttcgctgttgctgattctgctggtaagtatactttgttcaatacttcagatgggacagtggtgtccactcgttgggccttccacaatagtaaagtttttgacgcgaaatggacatcagactcaaagtatttgataagtggtgggttggacagtagtttgttattgtattcagtggagaaaccttcgagggttgtcaagtatctcttagctcacccatctggtatatctagtatagattgggtggcctatgactcagaaaagaaaaccgggacatttgtcagtgccggattagatgctactattagatcttggtacatttctatttag

SEQ ID NO: 6544 - DNA, 1413 bp, Candida albicans
aaatcaattgttcattatatcgggggaatccaggggccggtaaaaaccgaagcagcaaaacaaatatgccaatatattgctaaagtttccgttaatcaagataatgttgaaatttccaagattaaagatatggttttagcaacaaatccacttttagaatcatttggttgtgctaacacattaagaaataacatttttagtagacatgggaaatatctcgaaattaaattcagtgaaggcaattatcaaccaattgcagctcatatcaccaattatttattagaaaaacaaagagttgtgtctcaaatcactaatgaacgtaatttccatattttttaccaattcacaaagcattgtcctccacaatatcaacaaatgtttggtatccaaggaccagaaacttatgtttatacttcagcagctaaatgtatcaatgtcgatggagttgacgatgcaaaagatttccaagacactcttaatgccatgaaaatcattggattgacacaacaagaacaagacaatatatttagaatgttggctctgattctttggataggtaatatttcatttgttgaagatgaaaatggtaatgctgccattcgtgatgattcagttacaaattttgctgcctatcttttggatgttaacccagagattttgaaaaaagctatcattgaaaaaactattgaaactagtcatgggatgagacgaggttcaacttatcattcaccattaaatattgtccaagccactgctgtacgtgatgcacttgccaaggggatttataataatcttttcgaatggattgttgaaagagttaacatttcattagcaggtagtcaacaacaatcatcgaaatcaattgggattttggatatttatgggtttgaaatttttgaacataattcttttgaacaaatttgtatcaattatgtcaatgaaaaattacaacaaattttcattcaattgactttaaaagctgaacaagacgaatacgttcaagaacaaattaaatggactccaattgattatttcaataataaagtggtgtgtgatttgattgaagccactagacctcaacctgggttatttgccgcgttaaatgattctattaaaactgcacatgccgattcagaagctgccgatcaagtatttgctcaaagattaagtatggtgggggccagtaatcgtcattttgaagatcgtagaggtaaattcattattaaacattatgctggtgatgtcacttatgatgttgctggtatgaccgataaaaataaagatgccatgttgcgtgatttattagaattggtgtcgacttctcaaaattcatttattaatcaagtattattcccaccggatttgttgacccagttgaaggattcaagaaaaagaccggaaaacgccttctga

SEQ ID NO: 6545 - DNA, 612 bp, Candida albicans
  unsure (32): Identity of nucleotide sequences at the above locations are unknown.
aatagacctgcttgtacaaccagtactactantactagtcatacaagtagaccagttaaaaaaacagcacctgctgctccagtgaaaaagaacgctccacctccacctccacctacattagttaaacctaaatttcctacatacaaggctatgtttgattatgatggatcagttgctggttccattcctcttgttaaagatacaatttattatgttactcaagttaatgggaaatggggtttggttaaaaccatggacgaaactaaagaaggatggtcacctattgattatctcaaagaatgttcaccaaatgaaacccaaaaatccgcaccacctccaccacctcctcctccagcagcaacagcatctgcaggggctaacggagcttctaatccaattagtacaaccaccagtacaaacactactactagctctcatacaacaaacgcaactctgaatggatcattaggtaatggattagctgatgcattaaaagctaaaaagcaagaagaaactacattagcagggtcattagcagatgctttgaaaaaaagacaaggtgctactagagatagtgatgatgaagaagaagaagacgatgatgattggtag

SEQ ID NO: 6546 - DNA, 474 bp, Candida albicans
  unsure (31): Identity of nucleotide sequences at the above locations are unknown.
ttcccatggatcgtgcgattgcccgatgtgnaaaacaaatgtggtcggtcctccaaaagattacctcgaattttcattgttacgaaaacctcaatttatatcattgccgaagtattagtggagaaaagattacaattaccaaaggaatttactattccaattagtggtataaattatcttggattatcgacattccaagataattgggttgccatatcattacattctcctacaccaactacccctgatgtatttattaatttagatttcaagactgaattagtggcactattgaaaaaattgaatcctgggatcacaataaaaattggtcctacaattgaatatcaaaaaaaaccaggtaaattccatactgtcaaatttatcattggtgcaggtccagaaatcccaaataatggtgatcattataaatcaggtactgttagtgtcaaacaacgattgcccgccagtatttaa

SEQ ID NO: 6547 - DNA, 423 bp, Candida albicans
tcatgtatgagccatactaacaacaacaacaacaaccttattaaatcattttatcttaaactttaccacattcctataattattatgggattacttacaattattaaaaaacaaaaattaaaagataatgaaataagagtattaacattaggtttagataattatggtaaaactaccattattaaaaaaatgttaaatcaagatattaatactatatcacccaccatggggttccaaatcaatacattattctataccccaaaaaacaacaacaacaataacaacaacagtaacagtaacgataacgatgaatatacgttgaatatatgggatattggaggtcaaactagtttaagatcattttgggccaattattttgataaaaccgtctcaccacggcgctggaacgttccgcacttggta

SEQ ID NO: 6548 - DNA, 1980 bp, Candida albicans
cgtggtcgaagatcctttatgatttcttacaacgggaataatgataatggaagatatcataaagtattacgtgcattggattcaataaatgagaaatcaagaatggaatttgatagcccggataattatagtcctcgaaagttgacacgaaaacctccacaaccagctaatttcaaacggtttgaattgtggttaaatgttgttgaaaaaacaattgatgcccgagggaaatttagaaattccgatgttggtgccagtgatgagctaaaatcggcatatgcgggaacacgaggcagcgtcattactacccgaaatcaattggaaaatcatttagttgaatattgcattgcaacaatgttattgattaatgttattgttggtaacggtactgattatagagtgagaatacaccttagggcccaattcagagctgcaggcttagatcgtataatacacaagtttttagaattgggtaatgaagaattggataatatgattactagacataaaattgatgccaataacgatgaagaagaattgaaatatagtgcgaattttaacaatgaagacaatgaagttgatttcaatgatccagtcaatttagttcaatcactttggcagagtgtcaagaattctgatgcagaagggtatttccttagtgcaatccaacacttgtttttgaatcaatctgagaaaagaggcaatccagaggaaatgaatagaagtttgcgtgttctagatggattgattccaaacatatcttcagttcgtaccgtaagtgaagatacagctataaatgtggcaatcaacaaattgatttcaaatatgagtaccgacgacatgtatcgtaaggcattagaagatgtcaagatatatcgtagaatagccgaagaagcaactgcagaacgtgatgatatgtctcgacagttatccatgggtgccgatggatatatcaatagtttattaaatgatgttaaggaacgtgacatggtgatttctcgattccgaagaataaatgaagacatgaaagaagaattagagcaaatgaaaactaaatacatgcaagaaaaacaggagctggaattggaaatgagagaattattgataatgctcaataatagtgaaataggagctaatgcagtgaagaaagatggaggtaaaactactatactgattagtacatctaatgaagaattggctgccagattgaaaaagcaaatacatcgccgacgtgccgagtataaattggataaccgacaactaggcaccaatgttgagccactgtccagattaagagcattaagagaccaaatgggtgatattgaaaatatggcaagagaattggaaatgacagattttgaaacttatgctgatccagaagaagaggaaaataataatgatcaatcgccagaaaaatcagaaatagatgaatcgcggtcatcacaggagagtgaagcagaaatacagtctgtggaagaagacgaggaagaggaagaaaaagaggttgttattcctcctttgcctgttccatctggtccaaaaagagctgttcgtaatgatgatttggttagacttgatcatttacggaagaaattagctaatttacaaagtgaatccaatgatattatgaaatacaatagtagttcaatgtttaacaaacagaaattccttgccatggaaagacttcaagaattagagaacaattttaaggactttaatattgattttgctgtctcggatcccgaagataaatataatttcaattcaaatgcaggttctgttgacgattccattaagaacaagacaaaggaagttttggcagaagcagaacaaatcagagaagaattgagaagacaattagcagctgctcaaaagataaaatcaccatcacctaaacgtaatactgtgctagaaagaattgaaaacaaatacgttaaaggtcaagtgaagattgatgctcctgatgtagtaagtaatctg

SEQ ID NO: 6549 - DNA, 1815 bp, Candida albicans
aacaagattccaagaccaaagaaaaaattgaaacaattgcattgggaaaaaatcgatcatagtcaagttggtaattcattttggaatgatccaaatacccatactcttgttgatgacttgatgtccaaaggtatttttgatgaaatagaacttatatttgctgcgaaagaagccaagaaattagcaacaaagaaaaaagaagacttggataaagtaacattcttagctcgtgacatttcccaacaattcagtatcaatctacatgcatttaattcattttccgatgaggaatttgtcttgaaagtattgcgctgtgataaagatgttttgacaaatcctgcagtattagatttctttggtaaagaggatattgtggagataaccaacacattggcaagaaactttgagccatattcgactgattataaaacagaagaaattacaaaaccagaaaaagatccaaatgaattgcagagacctgatagaatctatttggaattgatgtataatttacaacattattggaaatcaagaaccagagccttgaatgttgtcgttaattatgacaaggattacgttgaatatgtgaagaagttacgattaattgatgaagctgtggacagtattaagaattcaaaacatttaaagggtgtatttgaaattattttagctgttggtaattatatgaatgattcagcaaaacaagctcatgggtttaaattgagttctttacaaaggttgagttttatgaaagatgagaaaaatagtatgacattcttacattatgttgagaaagttattagaacccaataccctgaatttttggaattcataaatgaattatcttgctgtaatgaaatcaccaagttttccattgaaaacattaataatgattgtaaagaatatgctcgtgccataaagaatgttcaaagctcaatagatattggtaatctaagtgacgtttctaaatttcatccgctggatcgggtattgaaagccgtgttgccggctttgccaagagctaaaagaaaggctgaattgttattggatcaagcaaattacacaatgaaagaatttgacgatttaatgaagtattttggcgaagatccaacagatcaatttgttaagaattcatttatatccaagtttactgatttcatgaaagatttcaaacgagtacaagcagaaaacataaaacgtgaagaagaattgcgtgtttatgaacaacggaaaaaattactagaaaaaccaaagagttcaaacaatggtgatagcaatgctctggatcaagatggcgagagtaatgaaggagatggtggtgttatggattcattattacagaggttgaaagcagctgcaccaactaaaggtgaatctgcatcagcacggaaaaaggcattaatgagaaaacaaatattggaaagtcaacgtaaaaggacaactgggtctgttggctcaccaactaatgtctcacctacaagaaataatgaatctgacagtggggttgataacaaagatgatacccatggttcttctccattggatgaacaatttcatgattctattacaacacaagaagaccgaataagagatgataataggccgcctgaaggagttgctgatttcagtaatgtagaagatccagagaatccagatgtgggtgccagagcaaagaatttattacaagaacttcgtggtgcagatgaatcgtctagcaaactctctgatgctcaaagatatcgacaagaaagattgaaaaagaaaagtgttcaaatagatcttgatgaagtggctaagaataacaatagtgagtag

SEQ ID NO: 6550 - DNA, 699 bp, Candida albicans
atgtctcgatcggtcaagaacattaccgactctttggaacgaggtaaacttatcaacaaaaaggacttgcaccctgaagaacggatcttaaccaccatcagctcacccatgctaaatgccaaaaacaaaaacgcaatgttacagtcccatttgaaacgcacagcaggagagctcaactcgttaatgacgttttttggtgaaaacccgaaagatgcaactgccagaaacacattcttttacaagtttgtcacttttatcaccgaatacaagaaagcacacgttgaaaatatccaaagagaagaagagcaaagaacatacgagattaggaaaaagattttggaagataaaatcgccaaaaaggaaaagttgaaagaggaactggcagagccagaagcggtggtcgacaccgccgaagagtcgtctgcggttattgactctcttttggagaaactaaagtccagcaccccgatcaccacaaatagagccaaaacgaaaaacagacgcagcaaggctttgtcgttctacagcgagaaccccttggaaatcgttgctgacaccaaatacgaaagtgtcaataacttgaaacgacgcatgacaacaagaaaacgcaccacagacggcgaaaccagccccaaaagtgaacagtttatgctgagggcccaagcaatgttgcatcaacttagaaacaaagaagaatag

SEQ ID NO: 6551 - DNA, 3873 bp, Candida albicans
  unsure (166),(178),(184),(194),(197),(325): Identity of nucleotide sequences at the above locations are unknown.
atttttttgcccaaacacccatacccgggaaaaaaattgtttttaaaatttttgtgggtccccaaaaaacaccaaaatatttccaaaaaaataccaaaattccaaccaatgaccgaaccacctccccaaaggaaagaaggtttttgccccaagggatggaaaaaanaacacgaatccnattccntattcaattntgnggaaccaggcaaaaccaacccacccccggaaaatttttggtggttggaccttaaaagcaatctcaattctataggggtgagtcttgttggctacggtttatccagggaccacttacccccaccacgantagacaccgactctgaatcagtatcatctcgaactagctcgcccacattgcatgtcaccaccaaattcaaccccaaacaacgagtagagtcattccagaccgccaccaactttaaaaaccaaataccaccagaagagattgtcgaccagttgtttgaaaaactcttatcaatccgagtattccccgatgaagcagtctattcgctaaagaaacagccagttgaacgcaaatgggaactcttgctacgagaacacgaaaccaaccaccattttgaccttaaaaaattgtcggaacaggctaccgacaagtttctcaccaaccgagatagattccaggaacacgagtttctcataatgtcccgtagcactacccaagaacctaaaccgaaattgaaaccgctaagaattgtttctggcggcgaagactacgacgacgaagaaacacctacagtcaccaaactagtccacgacgatagcagcaccagcaaactatccatcgagtccggaggctcttctggtgcaccaacagagaccgaaagtttgttggggttggtcaacaaaaagctcaaaatcagagacgggtcccctgattggtatgtgtcacgcataatggccaacaaactctcactcaaagattgcaagaaattggaaaggaaattagtcgaaaacaacgtggtcaaaaacagcggcgtgacctggactcaggggtttatcaatgcccaaggtgaaacggcactttcggtcgttttgacaaaaatcaacaagaaaagcattaaatcgaacgaagagtttgacaaggagtaccttatagtcaaatgtttgaaacacatcaattatgaaaaacgtgacgaaaccctgtctttgaaggaaaaagtgtacgtcgtcaaggcattggtgtttttgttagtgtcgccaagactcacaacccgaatcttggtaactgaggtgttagtaatgataatgctccttcgcgacaaaaccttatggaaaagcgccctagatgggttgagcagtttgcaggacagaaacggcgactacgtgatcttccagccgtggctaaatgcatttgaggaaacaatcataaagtactcatggagccagaacaaagccggcgaattgtcgaacctcaaaaactacgccacaattaccttgattttgattaactcgatggtcgacatgtgcagctccttgaaacggcgtatatcaatcagaagggattttggaaatgctcgaatcctaaacatttttgaaaagcttgcccagatcgaggatacaagaatcgataatgaaattgagaaatacgaaatgtatgccgaagaggattacaacgagtacgtcgaaggcaagaagaaaagaaatagcaagcagttgcccaatataccccaatccaaactcaagctattgcaggtatccgacttcgtaaccacacccgaagctaacacctcactcgaggaagacgaactcacacctgaattggaagacaatttatccggcactgaatcctcgtttgacgaaaagagttttatgacaaaactcaaggaagcagaagatatcgagtccgatggcaccatgaaaagtgttctacatagattaatgaagttgaaacagagcgaacgatccaccgaggacgtacacaatatgttggttttggtggactccatgttgcagcatgtcaccaacgagtctcgtgttatcgggacagacgcccattcagtgttgaatatcaccatccagaaattgatggatcgcttatctaccgaagatatggctcgcagagccgttgccgaatcaaaaatgttgtcacgccaattggagttggtcaaggaagagaaagaattgcttgaaaaagaactagaaacatacaagatcgaaactatccgtgaattaaaaaaggaaaactattaccaggccgaattgattgccacccaagaacgccaattgtataaattacaacaaaaaatcgaacagttgcagtctcccaacaatacggcattaccggtggttgatgtgggccaacaggggtttggcaatggcaccgtagccagtctcaaagatacgtcttcgtcaagcccatcaaaaagaccacctacacctccaggattgtacagtatgcaaaagggttcattaaggggtggtatttcagcaccaccaatgctcgatttcaaggatgcaagaccagtgtccgatttacaggattctcgaccagtgctggatttacaggatgctcctcgattggtggagtctagcgcaccaccacttccagaatcaaaggatccagttgctcaaccaccgccaccagaatcaaaggactcagttgctccaccaccgccgccagtgccagactttataaagtctgctgcaccaccgccaccaccactccctggatttatgaatgcatctgcacctccaccgcctccagtgccagaatttataaagtcttctgcacctccaccacctccacttcccggatttattaccactactcctccaccaccgcctccacttccgggattcattactactactcccccacccccacctatgccggggatgttacaaccaggaaaagtcaaggaacttggcacccttttcaaggaaaaacacaaacaagaaccacaaaaaggcatcaccaaaaccaaagccgacgtcgtcccatcaatcaggcccaaaaacaaactcaaacaaatgcattgggacaagttggaaaacattgaaaaaacattctggaataatctcgaggattctgtattgtcaaataaattgatcgaacagggtgttcttggtgaggtggaacaagtctttgctgctaaaactgctaccatcaaaaagaaaacagccgtcgagtctcaacaacaacctacaaaaaaatctttcctttcacgagacttgtcgcagcagtttggtatcaatctccacatgtttgccaacctcagtgaagagaaacttgtgctaaaagtacttcgatgcaattcggaaattctcgaaaaccatagtgtgcttgaatttttcaacaatgaagcattggtcgaactaagcgatagtctatttagaaatttggcaccatactcaaccgaccctcgaacacgcaagaaaccaatgaaaaaccctgaagaattggaacgtgccgacagaatctttttggaattgtgctacaacctaagacactattggcgctccagatcgcgtgcattgttgtttctgcaaacctacaaaaaagactatatcgatttgatgaggaaactaaatatagtcgatgaggcaaacgcagcactaaaaaagtcggagagtttgcagaatgtgttgggtattatacgtacggttggtaactttatgaacgacgacgcaaaacaggcgttggggttcaagttggatacattgcagagactcaaattcatgaaagatgaccaaaactcaatgacatttttgcattacattgaaaagattgttcgtcactcgttccccgaatatggctcatttgttgacgatttaaatgttttatctaccttgcacaacatatccatcgagcaattggaaaccgactgtgaataa

SEQ ID NO: 6552 - DNA, 1002 bp, Candida albicans
atgccaaaggggatgaccaaaaatattgttggtggggataattttgaagaaaaaatttatcaattggtttcacaaatattggatgaaacaattggatttttccaaaatttaaaatccgaaaaattgaataaatttgatgatattgatgataaaattgatgctgttatcgatgggaattatcaattacaaacttcattgaaaagtttaggacaatatattgatacattaactgctaatactaatgtcattaaagttcataaaaatggtaatttagaagaattatttgatgatgaaatgcaacaaacagttgatactattagtttagcatcgaaatttttgaatgatttaatggcaaatcctcaactttataatggtaatggtgggaacattgaagttgatgaaatgttattagcttgtgccaaagccataactgatgccgttgccgaattaatcaaagcatcaataaaatcccaacaagaaattatttccaaaggtggtaccacaaagagtgatttctacaaaaaaaatagtcgttggaccgaggggctcattagtgcatctaaagcggttgctggtgcaacaaatgttttaattcatactgctgatggagtacttaaacaatccaattctcatgaagaattaattgttgcatctaatgaagttgcggcatcaacagcacaattagttgctgcatcaagagtgaaagctaattttgtttctcaagctcaagataatttagaaattgcttccagtaatgttagtaaagcttgtaaatcacttgttgttaaagttgaaggattattaattagaaaagatgaagaaggagaaaaagaaaaagaaaatattgatttgactaaacttactccatatgaaggtaaaactcttgaaatggaacaacaagtgaaaattcttaaattggaaaattcaattttagcagctcgtaaaagacttgcagaaattagaaaacaagaatataaaactccagaaactgtttttgattga

SEQ ID NO: 6553 - DNA, 2001 bp, Candida albicans
agattgaaatatggatatagaaatcgggatttcattgcttctttggcaacagttttccctagtcatggaagtgcttatgggagattaattaatcagtacgataaatatattcttcaaaaattggatttccatcgtaataatcctggttttaatgggacatttgaatatgaagaatatatctcattaagagccgttaatgatcctaatgaaggttatgaagcattattaaatttgatggatcttcaagatctgattaatgatttacaaaaacttatttttgccacaattaatcaaagtcatagtaatttatgtaaagttagtgccttagtgccattaattgctgaatcttatgggatttataaattttgtatttctatgcttagagccatgtatcaacaattgggagaagatgatgcattgagcggattagttgaaagatttgattctcaacatttcatgcttagagatttttatactgattgtcatgccattaaatttttaactagtttgatcactatccctagattaccaaatagtgctccaaatttaaaagtcaccgatgatggtcaaccaatttctagacctcgttctgttagtactaccgataccaacaacaacaacaacaacactaataatactaccccacaattgtcttcacaacctacatctcaatttgaacaacctccggtagctccggctattgatcaattagtaggtcaacaaacgggatatttgtatcaacaacaacaagaacaagaaagaatccaacaacaattggaattacaacgtcaacaacaacttcaacaacaacaagaacaacaaagattattcgaacaacaacaacgagaccaagaaagaaggtttatggaggaacaacaagcacttcaaatgcaacaaactcaacaacaacaacatattggcagagtttctgaattagaacatgatttattaatgttcaaaaatcaatatgataatgatcaacaattattacaacaatatgattctcgagttaaaagtttagaaaatgaaatgagtgcccttaattcaacggcaacacaacaaattgcttctaaagatgaacaaatcaaaaatttagaagatcaaattgccaattggacgaaaaaatatgaatcacttgcaaaattatattcacaattacgtcaagaacatttaaatttattagctaaattcaaaaaaattcaacaaaaaattagtagtgctcaagaatcgattatgaagaaagaaaaattggaaaaagatttaaaagcgaaaaatgttgaattagccgatttaattcgtgaaagagatagagctagattagatttagatcgattaaaagctaataaagatcaagaaattgaaaaattgcaagctgaagttcgagaattgactttaacccaacaagaatcgggtaaattacaaagtttgaatctttctagtattatgactaaacatcaatcagaattagataaattgaaaaatcaattagctgaaagagaattaaaattgactaatttgggtgattcagaacaattacaatcgaaattaagagatacagaaatggaattgcaaatcactaatgaatcattagataatgctcttgctgaattacatcgtactacagaagatcaagatgatattattaatgcccaaattgatcatattttacttgctaatgtggaaaaatttaaaaatcttattgatatttttttggaaaatagtgtgaaaagagtattagatactaaacatgaattagtatcaccggtacaagcagggaatttaaatgcatcaccagaatatgtattatcaattattgaactttgttctgatacagctactgaatttgctacaattttcaatagttttattgctgaagatagaaatgaagatgaatcgagtttttctgatatcattttaagtacatcatctttaacttcaagtattaatgatttaacattaaatgccaaaggggatgaccaaaaatattgttggtggggataa

SEQ ID NO: 6554 - DNA, 1746 bp, Candida albicans
ttttggtataagttgccggtgtcgatttgttgtcgtctttctttttccctcaaaacaccatattgttccttccaacaactacaacaatttaacgacaattcaaaaaatatgtcaaccgaggagagtcaattcaatgttcaaggttacaatattatcacaatcttgaaaagattagaggcagcaacgtctcgtcttgaggacattaccattttccaagaggaagcaaacaaaaaccactatggagttgattctctcactgaaaagggaacccccaaaagcagaactgttgaatcgtcagaagcaacttccgatggtaaatcactcgaatctacatcatttgccactttttctgaagctcctgtagaaaaatccaaattgattgtggaatttgagaactttgttgaaagctacgttcatccacttgttgaaacatccaaaaagatcgattccttggtgggggagtccgcccaatatttttatgaggcatttgtcgaacaagggaaatttttggagcttgtattgcaatcccagcaaccagatatgactgatccagctttggcaaaggcattagaaccaatgaatgctaaatgcaccaaaattaacgaattaaaagattccaatcgtaaatctccattcttcaatcatttaaacactttcagtgaaagcaatgccgttttttattggattgggatccctacaccagtctcgtacattactgatactaaagatacagtcaaattttggtctgacagagttttaaaagaatacaagaccaaagaccaagtgcatgttgaatgggtgaaacaaacattatctgtttttgacgaattgaagaattatgttaaagaatatcacacaactggtgttgcttggaaccccaaaggaaagccttttgcagaagttgtatctcagcaaacagagagtgctgctaagaattcttcgtctgcttctggttctgcaggaggagcagctccaccaccaccaccacctccacctccagcaacgttttttgatgacactgaaaaagacagtgaaaatccatctccagcttcaggtggtattaatgcggtttttgctgaattgaatcaaggtgccaacatcacatctggtttaaaaaaagtcgacaaatctgagatgacgcataagaaccctgaattaagaaaacagccaccagttgcaccaaaaaaaccagcacccccaaagaagccatctagtttatccggtggtgtgagttcagctccagtaaagaagcctgctaagaaggagttgattgacggtacaaaatggataattcaaaattttacaaaagctgatatttccgatttgagtccaattaccattgaagttgagatgcatcaatctgttttcattggtaattgtagtgatgtcaccattcagttgaaaggtaaagcaaatgcagtgtcggtatcggaaaccaagaatgtggctcttgtcattgattcgttgatttccggagtcgatgttattaaatcctacaagtttggtatacaagttttaggtttggtaccaatgttgagtattgataaatcagatgaagggactatctatttgtcgcaagaaagcattgacaatgatagtcaggtttttactagtagcactacagcactcaacatcaatgcaccaaaggaaaatgatgattatgaagaattggctgttcctgaacaatttgttagtaaggttgtgaatggcaaattagtcactcaaattgttgaacatgctggataa

SEQ ID NO: 6555 - DNA, 1227 bp, Candida albicans
attatttatacatcttcgtctcttccctatttacgaaaaatgccacgtttagaagaatcagaaatcaaaaaatattggcaaattttccaaagtttaaaaccacaaaataataaattaactggagatcaattgagttcaatattgaagaattctcaattaccacaacaacaattatcagcaatttgggaattaagtgatattgataatgatgggaaattagattttgaagaattttgtattattatgagattaatatttgatgtaattaatgggaaattacccaatgtcccacaagaattaccatcatggttaattcctgctagtaaatcagcaattattcaagccaataaagcagttaatcaaggaaataataacttcggtgacatagatgatgatgaagatgataaattgagtaatgattttgattggtatatttcacctactgataaatcaatttatgaaaaaatttatgattccaaatgtgattcatttggtagaatcaaatattctagtttgaatgaattatataatggattaactaatgttcctagtagtgaaatatcatcagcttggaatttaatcaatcctaaatcatttgaaactatagataaagatcaaacattagtttttttacatattttaaatcaacgagaaaatggtaaaagaattcctcgtggagtgcctgctagtttaagagctactttttcaaaagaagtaccaaattatgatttactggctcaagcaaaaccatcaatttcagcaactacagaaactgggaaaaaatcatttgcagaaaattatcttaataaaattggtggtggtgttggtgcgagtagtacaattaataatggtagaaatgaaaaaggaactgatttttcagctactcaaggtactgattgggaagaagttagattgagacgagaattacaagatttagaaagactattagataaagtccaaaatgatactaaaaatcaaaaagataattcaaataataatcaagacaataatgatatgttaattaaatatgaatttgaacaattactaaaatacaaacaaaatcaattaaattccaccaccaacgccagcaaaaattctactgatttatcttcagtaaaacaagacattgaagaaattcaaaatcaagtcaatacattacaagaatttttaactacaaagaatcaagaattattaaaattaaatcaacaaattgaatcattaaaataa

SEQ ID NO: 6556 - DNA, 1137 bp, Candida albicans
acaattatggttttaggttttggatcattactaggctccccacaaggtagatcgcaagctgaagcgccgcgtcctgaatttacacctattggtaaacgaagtggatcaacttcttcttttcaagtgtatcacagctacccacaagaacaaaaaacacaaacatcaccgcctagaaggaagttatttcgtccattagctgactcaaaccttgctgcacactattctcacgattctggtctatttgatgacaccgttgaagatttcgaaaaactctcccccatccgtccacaacgctcaccaatagcacaaagaaatagaaggagccccgatagacacgatttcatcaccgatgacagtggcgggattgccgcaagacaactggaagaaaccattaaagagttgcgactggagaattacggttggaaaatcaagtataaggaactcatcagatcattggaaaatatgcctgctcatgagagggaagtaagaaaggaaaacattcaactaaaggaaaagttggcaaccttgcatcaacatattcaacaattggaatcgcaaatcgccgaattacaaaataacaaggagaatattactaccaacaacaacgattcccgtgaaaaagacaacattatccagcagttgaataataaaatttatgagttgcaaagacagttatcgtctgaaaacaaactaaaagagtcacaacttgaaaatgaagagataattcaagctttgaaatctgaaagaaatgagttgacagcaaaagtttccgaattagaagactatatgaaacattctgaagttgaatttgatgttgtaatgaaacagaatgacgagtttcaggaaaggattcacgaattggaagctgcaattgacacgttacatcaaaccgaggccaccattcagcaacagtcccagctgagagaaaacactgaactccaacttcaaaaattatcaactgaattagataaacaacaagaaatgaaccgacttttagcatcaaaaaatgagaatcttgaaatggatttgtctgaaaagacagataacctcccagaactaaacaataaggttttgagtcaagcccaagaaatcaatttacttgaaaacaaattggatacattaaactccccaatttga

SEQ ID NO: 6557 - DNA, 987 bp, Candida albicans
acagataacaaagagaacatcttcactgaaaaacattttgacaacatttccactccaataagtaaaaagcacaacccaattaattctcatcacccattagcagttatttcagaagttgaaataacaacaagcaattcagtgtcggaaacccctatgccattaccagaaggaaaaaaccaaagaaaacaacaacaagagacaccacttccactcccactctcactcccaaaacaacaacaagacgaaagagaagtatctggagatgaatcaacacctcatttctaccatcctcatccacctaagttaaatgacgaaggaaagatagaagatactgaagataacgttgaacccaagttaccaatgtcagatttgtcttcgatgatatctggtatgattaattctttgtctcatacatatactagtgattcagcaaaattggatttagaaatcttcaagttgaaggagtccattaatttaaagcaacaagaaaatcaagaatcgttaactagggttcaaaaacttttgatcaattcaggaatacaagaactgcaaattgaatctattgaacaaggtcaagagttgattattgaaacaatcgaagtttgtgagagaacaataaaggaaaaggaacaagaactattaaaagttttacaacataaccaatcaattgaattagccaaattagttgaacaacatgagtcaagatatttggaagaagacaaaaagaatcattatgaaaatagtcataatagagatgatgatttaatagatcaaagtcgaattgatgatgctattgaattgagtaaattgcaacttgaacgtaatcgattggtcaatgaaatagtgcttcacacaaagtcttttggaattgatgaaaagatgtataaatatagaaaattgcttagtttgagttgtggtgttaaagttgaagaaattgacagtttaattgatggaattgccgaatcattaactgaaggtatgacgtga

SEQ ID NO: 6558 - DNA, 390 bp, Candida albicans
gcaactgaaactttggaatgtgataaatggaagatcaaatacgatgacatgaaggagcaaaatgatttgttacaggaaacactaaggaactgttttgcacaaaatcaagaatcaaatgatactgtatcacaactcatgcaacaacatgtggagcagttgaatacaataaagagtgaattgaatgctgaacgcaaaaaaacaacaagtttggaacaaacgaatttgaaattacaatcagaaatagaagccaaagagttatccatgaaactggaagagggtattaattattgtaaaaggatgtttgaagtagttggtgaaactttaaagaatggggtcgctgtaactaagggtgtgggagttcagatcaaagatatatcagagttcacgtag

SEQ ID NO: 6559 - DNA, 420 bp, Candida albicans
atatacaacagatctattaaatacaattgcagaatcattatgtcttggcaagcctacactgataacttaattgctaacggtaaagtcgataaagcagccttatattcaagagccggtgacgcattatgggcccaatcgggatcattcgaattacaacaaccagaaatcactgaaattgccaaaggtttcgatagtgctgaaggtttgcaaaccagcggtttacacgttcaaggccaaaagtactttttgttaagagctgacgacagatcaatttatggtaaacacgaagccgagggtgttatttgtgttagaactaaacaaactattttgatcgcccattatccaagtggtgttcaaccaggtgaagctaccactcttgttgaaaaattagccgattacttgatcaatgtcggttattag

SEQ ID NO: 6560 - DNA, 984 bp, Candida albicans
attactcaagcgcggctggccatccccgtggtgaaggacttagaacaacctaaacctagtagtagtactaataagcatgaccaagatgatgaaaatgaagaagaattagagtattatatcgatgaagaatttgatgaacaaaaagcaattgtcacaaaagatttccgagctagaatgaggtattataaacgaagaatattacctaattcacgagaaacagtgattaattttaataaacggcaagtatcggagaaaattgaggatcataatgatcccaataaaaaggaatggattaatcctgacaaacaaacaaataaacggttttttgttggagaagatgcattgaatttggcaacaaaaaaccccaatcaagtaaatacaagtaaagatggcgaatcacaatggattttaagatatccaatgattaatggtaatttcaatgaaaattcctattattatgaatcaagagaagagatcttgggggatatttgtaatattatatttgatgctcttaatcaattggagatcactactgatgttaataaatataaagtgatgttattaattcctgatttatatgataaagcatatgttgaaacttggtgtcaattattattaaaatttatcgggtttgggaaagttggaataattcaagaatcaatagcgacaacatttggagccacaatgtcgacggcctgtgttgttgatgttggagcacagacgacaaaaatcagttgtgttgatgaaggaatgattattagtgattcaagggttttattaaattatggtggagataacataacagagacatttgttaaattattaattgaggatcaattcccttatagagacattaatttaattaatgctatagattgggaattggcgcaaaatctaaaagaaaaatatattactttccaagatgctgatattgctatacaattatatgaattttataaacgcagatgttccccatgggaagag

SEQ ID NO: 6561 - DNA, 789 bp, Candida albicans
  unsure (8),(14),(58),(71),(182),(789): Identity of nucleotide sequences at the above locations are unknown.
ttgatganttcagntgctgcaacacctattttatcatctcaagctgatgatattattnttccatcagagantccagattcgccaactaatccaaatgctactgtactttcatcatctactaccactaatactgctactaacaagataaatgcaggtgtgccaccacaaccttcgacgacaanatcttcatcttcatcatcttcatctggtggtggagttattggagattcggaatcatcagcacagaagagacataaaccaggtccaacagcaggtaaaagaccgagtgcagaaacattacaacgtcgtaaagaaggacgaattaaagctgcagcaactttggcacaaaatttggctaaaactgggattggaagatttgaaaatgaaaatggtttcaatttaactagtattaaaccaattctggtgattaatcaaaaaaattattttactgattatttgaaaaaagatgaacaagttagttttattagaaattggcgtcaagaaagggcattacaacaaaaaatgaaaaaactcaaacaacaacaacaacaaaataatcaacaaaacaatcaacaacaattagataatggagagaaaaaagagactaagaattttgatgattttaatttgaatgatattgaacttgaaatgaaaaaagaaatggctgttagtggtggaaccacaaccactggtgctggaaatgatgatgatgaagaagttgatgatgaagaaaatgaaacagaagaagttcgtcttcaccacgcgctggaaggtccgagcttgcgctan

SEQ ID NO: 6562 - DNA, 573 bp, Candida albicans
caacatctattgaatcctccaataattaacgattatgttaaaactatgagtacagtaccgcaagttacacaggatgattatacggaaacacttaaagtgtggagatcttttaaagtggctcagttaaaagatgtctgtcgttctcttgaattaaatgttggtggtagaaaacaagacctcgtggaccgaggggaggcctttctcagctcaaaattcaataataatgaccaaattgggtttcatgccgctaagtcacttattttcatgcgtttacagggggacccattacctagttatcgtgatatgcattatgccataagaacagggcgatttaagttgactgctccaacattgattggtacaagttcctccacaaaccaactttcgaatatacactcaggtgactcaaagccatataagggacatactttgtactttaaagcgactcctttgtatcgatttttacgattaattcattcaacacccatgttacttatacctaatggaagaaatagtgtgcagacttgtcattttattttcacagaagaagagtataagttttttcaagacaag

SEQ ID NO: 6563 - DNA, 495 bp, Candida albicans
  unsure (4): Identity of nucleotide sequences at the above locations are unknown.
tccncctgccgcctgttgaaaacccctcatgttgaactatatattctttgtggtatccccgatatgcaacgatctaacgcgaccaacaacgtgtctattgagtatccagtcgaaacagttatatattttaacaagcacgaatttaaagacacttttcggggaatttcaggtgaaaccaatacagctgtaccggtagatatcacaaagtacataaactctccacctcaaagaaacgagattgtgttttgtcacctggcgaataatgcaggctatatgatgtatttgtaccttgtggaagtaatacctgcagaaaggctaatagaacaagttcaaaaccggccagctattccaaaaagtgaaacaatcagaaatataaaggatatgagtcgttatgatggtattcaaaccaccaaattgccattacgagatccgttatcatacacgaaattggcaaatccaacaaaatctgtccattgtgaccattatatgtgtatt

SEQ ID NO: 6564 - DNA, 1563 bp, Candida albicans
cgacctctctcagcggggggggcgggtgcgattagccatctcgtgggcaaagccattgttgacaaattatccaattatgcaatcaattatcaacaacaatcgatagaatttatactttcaaatttagatattactgatgatgtcagtatttcgaaaaatcatactattttattgacattggggtatttatgtttgaataaaacaatgtcgaaacagtacattggcaagttattaaatattgtccatgcgacaatgtttataaaaataagaactcatagtcaaaaggcagatttaggaaattgtattcgtgattcttcatgttttataacttgggctataatcaaaaatcaaaaatatcaaaatgaattgttagaaaccaccgatcaactaacaacgattttcactgatttaattaaattacttatatttgatcaagaattacttttgaagaaatgcagtattgccgtattacaagaattgattggtcgatatggacaacaaatatttcaaaattattatgtggacaaagaattattaggtgcattcataatcaattttatggaaagtttcagtgatcttagacttaaacaaaaatgtataacttttgaaatgattgatttgatgtatgataaaattgatttgaaatttttattaccaaatttattagatgaaatatatgataatgaggattctaatgatgaacttggtttatatttacataaattgttaactcaacaggataatttattatctgttgttcaatataattacaatctagatgaaataaaattgactttgattgataagaatcgttggaaatatttatatgatctacctaaggttccatatcaagaattatcagagaaattttcaaactttaattatcatgacaattcacaattattgagtggatatttaacatttcttttaaacaaaattgaattgactgatttagattgggagaatttatttcagattataaaattaaatgatgggaagtttgacagttatattgggaaaattatacgatcacaaaataccatccccaaaaattcaattttgcacttgttaatgaaaaataatgtaactttatccactactatctttaatttccaaaactggtcaactcaagatgttgaatttattgttaatattataaagaacccaaatattgatattgaaatcagacgaaatttgatatataacattaatgataattatactacttatccaataattgaacaaatgtatctgttatttgatgattatacattaacagtgcaaggtgacataggaagcaaactacgattagcaatggttgaattggtacaacagcacaatttactgaatgacacaataaaatcaaaattgattcgattatcaggtgaaataattgataagattagattatctgcatttcaattattggttgatgccaccgttgatggaaataaatattggcaagattggtttgaatattataattcattaaataatgattatgaaaaaattgaaattttgggaagtgtattctttcaactattgggaaattttaaaatgtga

SEQ ID NO: 6565 - DNA, 594 bp, Candida albicans
actacaataatgcccattcctcctacatctacagaaaataaaaacttagatgaagatatactgagttctagattatccagatataatgccattcaaccagaagtcaagcaatatctttatgatattttatcaccgaaatatcctgatttatttaatcacaaattctccatagataacactacatcttcttcttcttttcctgctgggaaatttctacaagacatagatttacgtgatttgttaaaagatggtgaattattatgtaaattaggccaattattaggccggaacaataatatcattcccaataatccaacgtttaaatttaaaaattcacaaatggcatttcatcaaatggaaaatattagttttttcttaaaattatgtgaattaattaaattacctcatgatgaaatatttcaaacagtagatttattcgatgggaaagatccttatcaaatatgtattacattaatgtcattttcaagaattgttcatgatttggataatcaagttttttataaagtcattggtcctaaaattgttaaagtgaaaccaacagtgccgataaaaccttataaattaagagcatag

SEQ ID NO: 6566 - DNA, 1212 bp, Candida albicans
aaagttaaaaaagaaagaaggggaaaaaaaaaacctgctaatgtattgggggcattttttcaaagagagactcagagagaaagagagaaaaaaatttttttcaaccataataataacgatcagaatttgaattatctaacaaaatcaatacaattcaaacattttgttaaaccaaaaccaaataagttcattatcaatttagcaatgtactcaagagctcgtaaatcgcaagaaaattcaaccaatgggaatatcgatgagatttcttcctataatcagcatcaatcccataacagcactaacagtaacaacaacaataaccatcaccatcatcaccaccaccataatcatcatcactcacaccagtatcctcacacaaatactatccctgcaaacaaagatggcaaacgttataccatgaatgaagtatttcaagtatggtatgataataaagaccagattttgaacaatagtgttcccgttggcgcggatgagccctataaattatccaagccagagcctatttatcatttagatttacaaagcaatttaactaaatctgaagattatcaactggaaaccactaaagaggtcactgattcattagataagcttaccattggtgcagattctgaagtagatacagctacccagcctagtactgcaacaggaggaccctcggcaacaacagggactgcgacaatttcttcgattcaacaagcaccaccagggatgtcgcaattacataaagatttccctagtgctgattccaaattcagaccattagtcacttctgataaaattgaatggcattacattgatccttcagggaacgaacaaggtccattcaatggtgacatgatgcaggactggttagctggaggttatttgaaccttgaattgaaaataatacggaaagaaaaagggtcgttcacgacattgagggatttatgtgaaagtttgcagaattatgtcactcctttcaaagttccattacctgatttaaccgcacctaggggtggtcctggtaccagtaatgataacgtcactggaaacggtgttagaaccaccaatggtgttggtggtggaggcagtcaattcttttcagatgatttactgggtaatagttttcctaattttcaatccaacttgttgtcttctttcggcagtacaccgacagaacaattcatctcaagcgaatttgtttggtaa

SEQ ID NO: 6567 - DNA, 810 bp, Candida albicans
acaaaagtcataaattgtatagtgtcaactaattacacaagaaccatgacatacactgccccagccgttgtgatagataatggttcatatactaccaaagctggattttctctggaagatttaccatctttagtatttaattctaattacatgaaacatgacaaaacacaacaagttataataggtgatgaactgatggaaaataatagcgaacaacaggttatgaaattgttggatgatggtttaatttatgattttgataatatagtttataattggcagtatgtctttgataatgttgacaataataatcctatcaattctagcgagttcccattagtggtcactgaacaaccttggaacacatcgaaaaacaaagttaattcatgccaagttgcatttgaaacattgcaagttccgatatttagtttggtgaaaactccattagcacagttgtaccgatgtggcaagtcaaccggattggtgatagatataggatccagtgtaaccagtgtgacaccaatcttggatggggttattcagctgaaatgttcctaccattcaaaatatgcaggcgattttgtgaatttacatgttttaaactatttggagagtaaaactgcaattaatagcttgctcccatccaaatttgccaactcatccgaatcatttaagcaatactatataagccgcaacatcttgcaagagtataaaaacttgtctttgaactatcaaattaaagattaccaattgtataatcatgaattcatcaatgtctcggaccgaccgaattatttaggtagtcgttag

SEQ ID NO: 6568 - DNA, 651 bp, Candida albicans
  unsure (43): Identity of nucleotide sequences at the above locations are unknown.
cgcggttccttccagcccccgtgggtgaagacaatccaccatnttgaaccaccaaaagagattcctgatgttgatgataaaaaacctgatgattgggatgatagagcatatattcccgatcctaatgttgaaaaaccagaagattatgaattgaaacatgaataccctcaaattagagatcccaatgctgttaaaccagatgaatgggatgaactggcaccaaggtatatacctgatccagatgccgtcaagcctaaagattggaatgacgccgaaaaacaatgggaaccaccattgattgttaatccgaaatgtgctactggttgtggaccatgggaagcaccattaattccaaatcatgattacattggtccatggttcccacctgatatcaaaaacccaaattataatggtatttggaccccaagattaattcctaatcctgattattatcaagtgaaaactccagggaaattagataaaccaattggtggaattggatttgaactttggagtattgaaagtgatattttatttgataatatctatttgggtaactccatagcagaagcagaattaattggtaatactacatttaaaatcaaatacgaattagaagctgatcaaagacgtgaaaacaaaccacgagtt

SEQ ID NO: 6569 - DNA, 768 bp, Candida albicans
aaggaaatatcatgttcccataaatgtaggcgcacaacacagtataatctcaaaaccagcactactttacagtctttcagcaactttcattgcatccttaaatacctgttgttttccctaatgagcaaattttttaaatcatttactaataagtactcgccattgagtcaaaatgacaacgaagatggagctccattgccaccaccagtcactcaaccaggtgcagcaccatcaaaccaatcattcaaaaccaaactacaacaattaaatccatttcgatcccaatcagtttatttagaagatgatgaaaactatgttacttcagatccagggatgttcgagttgctgcgatgggatagaatgttaatatttgctctttgctttgctgggtcagtatgttgttatttgattggtatctttttattccgtatattatcattaaaaccaaggaaatttgccttgatttggtcaattggatcgattttatttcttgttagtttcggagtattacaaggatttaaagcttacatgattcaccttttcctgagtactcgaatcattttcactattgtgtttggagccagtattatattgactttgataagtagtgtttcattgaaaagcaccttattgtcaataatatttgccgtaattcaattgttggcagccttgtggtacactgttagttacttccccatgggtaaacaaacattgaacttagctggtaatgtggcaagaagtcaggttgatacttggattagttcatag

SEQ ID NO: 6570 - DNA, 351 bp, Candida albicans
tcgttctatctatattataacatgtcgactgagtctgaaaatgtgttcaggcaactgttcagaaactggaatgaccggtcgaatagaactactacatcatctacttcaaacagacctgtcctatccgaatggacagattattttaaaactggggcaaacgatctatacaaccgattaccttcatcggttcaggatataggtgccacaaacaataatgtacaagagccatcatggtacaatttgtcaagactagagagattaattggttttgggtgttgtcttggagcatctgtgttatgctttgtgttgtgtttcttcatgttgccggttttggcattaaagaccaactaa

SEQ ID NO: 6571 - DNA, 342 bp, Candida albicans
tgtacaagagccatcatggtacaatttgtcaagactagagagattaattggttttgggtgttgtcttggagcatctgtgttatgctttgtgttgtgtttcttcatgttgccggttttggcattaaagaccaactaaaatttggtttgttatggactggaggatctgtactttttgttgtatcatttggtgttttacaggggccatataattacgttcgacatttactttctagagatcggatattgtttacaggggtattcttttcatctgtgtttttaacaatttactcggcctgtattttgaaaagtagtattttaaccattttcactactataatatag

SEQ ID NO: 6572 - DNA, 510 bp, Candida albicans
tctttgtacagaagatttcattccagacaccacagattatatgttccttatgcttttggggctttatacaatgatcccgttgaaggttttcttttggatactttaggaactggtattgattcattggtcacaggattatcgcaccgtgaatctatatttttgtacacctttgccactttgaagactgttgatgatcattgtggttacagattaccatttgatatattccaaatcatattcccaaacaattccgtatatcatgatattcatcatcaaatgtgggggatcaaaaataatttctctcaaccatttttcacattctgggatgttttgaataatacccagtacaagtttgttaatgaatacaaagatttgcaaaagcatatcacattgaccaagtacaaggaattcttggctaagaaatcgggctctaaactgaaatcaaaacaggaattggaaattgaagaagaagaaaaaagtattgacaaagaaactaagaaagagatttag

SEQ ID NO: 6573 - DNA, 765 bp, Candida albicans
aaccatatcattcatttgtttattggagagatgctgatattgaaacggtacccaccaacaattttggaagatttaatgcatcatgataaagatgttattgtccccaatgtttggcgtcatcttcctgattggttaggtaatcaacaaccatatgatttgaattcttggcaagaaagtgaaggaggtttacaattggccgatactttagatgaagatgcttgtattgttgaaggttatgttgaatatcaaacttggagacctcatttagcttatcttcgagacccttatggtgatcctgaagtagaaatggatttagatggtattggtggagtctctattttgactaaagcaaatgtattccgtcaaggatctcatttcccagcattttcatttgaaaaacatgcagaaactgaagcatttgggaaattaagtaaacgaatgggattttctgttgttgggttacctcattatgtgatttggcatatttatgaaccttcatctgatgatttaaaacatatggaatggatggcatctgaagaagttcgtcaacaagaagaagctaaaattaaaaaagtttacgataaagtatggaataaagcttttgaagatgttcaaaataattgggataaagaaagaagtaaatttttgaaaaataccgatatgagtaatgtaaggaaaattaaagttgattggtcaggagttgatgattttgatattgataaaaattctcatgatgataaaaaattagccgatttcaatccataa

SEQ ID NO: 6574 - DNA, 306 bp, Candida albicans
  unsure (83),(223),(234),(283): Identity of nucleotide sequences at the above locations are unknown.
cagctatttgcacgaaatagatccgtcattcagaaattaatgttcttcaccgcattaatggtggttttcccgttgttgacatnttttatcctacaatattttaccgacaactcaataataagtggaagagttgctgctttagcagccaatgtggttttgattagttatataattgttgctttcactgaagatactaccaaactcgatgaaaaagacgagtccnagagagatatntgggtcctgttatatgccttaaactgtgtaatgaaaactttacccgacncgagaggcccgcggttggattaa

SEQ ID NO: 6575 - DNA, 579 bp, Candida albicans
caagacatcatggctttatattataatttagtatttggtttattggtatttgaaatgatcttttttggggtcctttcattgccttatcctagaaaaattaggagatcaattttaagtactgtatcagcccctttcaaaaatgaacaatttcaaattgccatcaaatgtattcttgggtttgtattggtgttgttcattgattcggtcaacagagtttatgctgtaacaacagaattgcattcatccactgccagccctggctcaactgctgttgttgatcgttctgaagtgcaagctagaagattctatgttcaaagaaacatgtacctttgtggtttcaccttgtttttgactttgattttgacaagaacttactcattagttgcagaattaattgctaccaaagataaagtggacgacttaaagtctactgaaactgttactgaagactctgtaaccgttgccaaattgaagaaagaattggcacagaaagatgaagatttggaaattttgaaaaaccaagccaaaagcttatctagtgaatatgaagatgtttccgaattgaaagaaagaaaataa

SEQ ID NO: 6576 - DNA, 723 bp, Candida albicans
ataattcacagggactgcgttttgttctataatttttttttgctctctttcttccagaaaaataataaaacaatccaaatttcatcttatcaaataagcaaaccatctcgccgccactgcctcccaacaataacaacaacaattacaaccctagccaacacaatgagtcttcaaatgtcattagttttttgcaccttgattggtcaaatgattacgttattagttttagttttaccattaccttatgtcgtccgacaaaaaatcgttgacttgacatttgtattgcaaaagagtcaaaactttcgtgttgggattgtattttctatcattttgatgagtttacaacttttagattgcatacaaagattgaacaagtatgctgacgctgagaccaatccacatttccctggaattgattacgatcgattggccagtaagttctattcccaaagaaacctttacttaagtggcgcagtcttatatttgcaggttgcaattggaactgtcgtcactattgttagaaaaatggttttgaaggaaaagctttaccgtgaagcaaacataaagccagcaaccgatgatgaagctacagaaattgagaaattgaagcacttgattgaattgaaacaacaagatattgatacatttaagaaacaagttcaaggtttacaaaaagcttacaactctttgacaccagaagagaagaaaaataagaacgagtaa

SEQ ID NO: 6577 - DNA, 972 bp, Candida albicans
caatcaaaacaagtattcacacatatacacatcatgtctcttgttgcaataaaaaacggtatatctaaacttgtgctgagcaaagatgcctccgatgctgaacttgaaagagtggaaagattaatagacagcaatcaaattccatatggatcaactgacagtaacgatgaaagagctcaacaacttgccagagaggaagctatcattcaagctgctgcttctatatcggcagcatcatctagtgaaaacaaagaagaagaaggagtcgacagcattaccgcatttttcaatacttttgatccaagggttatgtcagatatcatcattggattatctgatgggttaactgtcccatttgcattgaccgctggtttatcatctttaggtgactccaagttggttatcactggtggtatggctgaattggtatcaggggccatatccatggggttaggtggttatttagctgcaaagtcagaatcagaatattactttagtcaagttaaaaaggaaaaattggaatttttcaagaaacctgaagcaattaaccaagatgctgccgaaatcatgtttgaattaggggctagtgaacaaactatcatatcattcttaaaagatttggatgcaaaaccgaaaaatttaatagattttgtcatcagatacggtaaaggcttggaagagccagcagccggtagagaattaacatcagcccttacaattggtgcttcatatttccttggtgggtttgtgccattattaccatactttttcactaaagaagtgggcacaggtttaataataagtgtggtggcaatgttggtggtgcttatgttatttggttatttcaaatgtagtatttctatgggtgaaggttgtccaaatcataaaaaatttgctgctggttttgaaatggttgttgttggatcaatagcagcaggtgccgcttggggattggtgttcttgatagagtaa

SEQ ID NO: 6578 - DNA, 1236 bp, Candida albicans
  unsure (47),(127),(318): Identity of nucleotide sequences at the above locations are unknown.
tacaattttaaggttttggttaaaaaaaagacgctagccgatttaanaacattgattgaattatgggatcttctgttgtacaatatttctgatattgcttcggaactagagctagaagctaaagganttgaaacatttgaacgttcacttgtgacattatatgacaaatctcacaatccatcaaaagctgtaccacatttaatacatttgagggatcctaatataattggatacttatctactaatcatattttggtcccctttgtatcagaattacctgtgatgatagacttgatgtttgacaagggagatttaaanacgctaccagtatcaaaaattgaaaagcgattgcaaggcgtaatttctattcttgtagatcacagattagaaatacctgctaaacaaattgtgaatttattttatgaatctggcttgtcatttgtcagctttttctacttggaaaagttagctgatattgataattttttggttcaaggttttggcaatgaacgtgttaaactatatgctgattacaaacgagaaaaattgttaccgtatttgacaaagaacgatgattatgacatagatacagcaattacgatctgcgagacgaacgactacaccaaagagttagtatacttgttggggaagattggtgagaacaaacaggctttgacattagtgataaataaacttgaggatcctgttatggccatagagtttgctaagcatcagaatgataaagagacgtgggatattttacttgaccaatccatgtcaaaaccaaaattcatcaaggcacttatcgaaagttcagatgaatcatcaaatgcattttatgatccaataactatattacagagaatgccacaggatttcaaaattgaaggattgaatgaatctgttattgaattttctaaaaataacgatttaaacatgctattgaatcaaataattttgaagatcatatataagcaatcacaagagacatcagaagaattcaaatcacaaaaattacgaggatttgaggttgaaatagataaaaaaatcaaaaagatgatacagcaatttcaaacaattgtggcttttgttcgagatgacaatgtgaaaggtggtccgaaaatggttgacattaaattagagtctgacctcacaagcgattattcaatggtaccatacagagatttggcgcagaagttagatcacttgagagaaatagaggagaattatttctga

SEQ ID NO: 6579 - DNA, 663 bp, Candida albicans
  unsure (621): Identity of nucleotide sequences at the above locations are unknown.
ttttttgttaaggacccagtctccaccagtacatttcatgaaacagtatttatattcgccacacattcaggtattattcatatttgtaaacccaattttgaaacaataagaacattcaaagctcatagggcgtccgtgctatcagttttcacagatggtacatactttgccactgcgtcgatggatggaacagttgtgataggatcaatattagacgaaaaggatatcgtggcctatgattttcaaagacctgtacacgctgttatattggatagcaactattataaaacacgaagttttattagtggaggtatggctggccaggtgatttattctagcaagggttggttggggaaacgatcagattttgttttggaacagggtcatggtccaattgtgtccatccaattgattgatgacttggttatatggatgaatgataaggggattagtgtgtttcatttagccacaagacaaattatatctgtattggaaaaacctgaagattctcctcgaagtgacttatattggccccgaattgcgtttcctgacccagatagattgatcattggatggagcaattatatatggtctcttcgagtgtcattgaagacggcccangatgaaaaagaaggaacaccaatctcatctggaaatgagtaa

SEQ ID NO: 6580 - DNA, 897 bp, Candida albicans
ccaatgtcaacaattactatcccccaagatatagaaattggtgggtcaacgtactatcaaattaatataaaactaccactccgatcattcacgataaagaaacggtacctggaattccagcaattggtgctggacttgagtcgtagtctaggtattgatagtcgggattttccatatgaattacctgggaaacggatcaactggcttaacaagaccagtattgttgaggagagaaaagtgggacttgcagaatttctcaataacctcattcaagactcaacacttcagaatgaacgagaagtgttgtcgtttttgcaattcccgtctaattttagattcaccaaggatatgttacagaataatcgagcagacttggattctgtgcaaaataactggtacgatgtgtatcgtaagttgaaactggatatactcaacgaatcgtctagtagcattagtgaacagatacatattcgagatcgcattagtcgggtctaccaaccacggattctcgacttggtcagggctattggtacagataaagaagaggccctaaagaagaagcagttggtttcccaattacaagagagtatagataatttgttagtacaggaagttccccgatcaaagagggtgttgggtggagcagttaaggaaacgccagagacattaccattaaacaataaagaacttcttcaacaccaagtacaaattcatcaaaaccaagacaaagaactagaccagcttagagtgttaattgcccggcagaaacagattggcgagctaattaatgcagaagtagaggaacagaatgaaatgttggataggtttaatgaagaggtcgactacacgtccagcaaaatcaagcaagcaagacgcagagctaagaagatattatag

SEQ ID NO: 6581 - DNA, 861 bp, Candida albicans
  unsure (138),(142),(374),(386): Identity of nucleotide sequences at the above locations are unknown.
tttgccctattcaatccatggggaatgccatctttcttacaaacaaccaattcattattcatgactataaaagacattaaatttactatttccaaaattaagttcaacttggatgaaataataaatttgcaagagggnaganacaacatatacgacttggatttaactccttcgaaaaatgataactttgaaatgataagcttgatactgaaaacacgacagtattttactttgatcgaacaagatatgaatgattactttgataatctagagaaaaatgggatactagatgagtttatgaatttagttaaccagtacaccaaaatatttgaggaactatccaatgacactaatatcgatatatcggaatatanatacgtgtatanacttccaactcccagccagaatggcacagaagccaatcccgttcaaaagtcggttaggtttagagatactcctgacgataacgatgctagtgagctaatgggaactagacatacatttcaaccatacaaggatgatccagacgaggacagctcagtcgagtatgaagatatatctgatcatcaaatgtttgcacaacatcaacaaacattgatgagacaagaccaagagctagatgttttgcaccaactgatatcgcgccagcatatgatgagtcaggatattaaccatgaacttgatgatcagttgattatcttgaatgatctagaacaaggtgtcgatctgtctttgggtcatttaaattctgcaaatacacgattaaggcattttagaactttaatgagagaaaacggtagtctagtcactatttgcaccttaacagttatattaatattattattagttatacttaactag

SEQ ID NO: 6582 - DNA, 636 bp, Candida albicans
accacaactatatatatatatatatacacatacttactatcaataatgtctgttccatcaatattagcaacaacagcattattaactgttggaggatatatgttattcactggagcaggagagtcattcaatattggagaatttttagaatcaacatcaccttatatgtggacatcattaggaattggatcatgtattggattctctgttgttggagccgcatgggggattttcattacggggacatcaattttaggtgctggtgtaaaagcaccaagaattactactaaaaatttaatttcaattattttttgtgaagttgtagctatttatggattgattatggccattgttttttctgctaaattaactagtgtaccatcgaaaagtttatatactaaagaaaatttatatacgggttattcattattttgggctggattaactgttggaatatcgaatttgatttgtggtattgctgttggaattacggggtctactgctgctattagtgatgctgctgattcttcactttttgtgaaaatattggtggtggagatttttggatctgttttagggttatttggattgattgttggattattaatgactggtaaagctcaagaatttagttaa

SEQ ID NO: 6583 - DNA, 675 bp, Candida albicans
tcacatctagcctcattagcttccccatacataatgacatcctttgaattgactcctactttgaaggaaaccataaatgcatcttctttaagcaaggatcagaaacaaaaactattatccaattcacacttaactcacgctgatttaataaaattctatcaaacatgtcacccaacgtctacccttttacaattgattcaacaaactaaattatatatccctccatacaaaacatacatccaacccaaaacttcagaattcataaaaacaatggaaaaacttcgtcttgaagccaaggaacaagaatacagacgattgattaatcctacacctcaatattcaactttatacgataaaaaattggaagattatgatttggcaccaactccccaacaagcactgaaagaattgaaaaatcaattaaccacaattataaatgtttttattagtgttggtagtgtatcatatgccatttggtattggacagaaacttcatggggtttaccagttagttatagagcattattgagtgtgtttttcggtcttttagtattggttgctgaagtggttgtatatatgggatacattaataaaatagaagacgctagggataaagaaaggaaaaagaaggaagtgaagaaagttgttagaagtataaatttgaaattggattag

SEQ ID NO: 6584 - DNA, 714 bp, Candida albicans
aaaatgtcttcacatacatattctccttcgaggacaatatcatctcctctattatcattatcatcatggagacagttccaattgtttgattatacaccaatacgagatcccaactatcactcttcccatgcattgtactctgacccaacattgagttgtattacagccactaccactagttatttaattatcgccattaatcattgcacaatcaaactaatcaatttatccgatttgacttgtcaattgacatttgatgcttataatatcgactatagaatcacatttattgaacctattcataattcaaataatttgtttgtcacattggcagaaaagcaaggaatgcccagtattatcaaactatgggatatttcaaaattattaaacttggccaataatgaaaacaatgacagcagtaaaaactccaaattagatcaatcagaatatagatttgaatttcaaacacaagtgttagtcaacgatcatagtagtggtacaacaggaatcggagataattcatatccaatcagttgttttaaattcaattatgatttaacatgtcttgccattggttacactaatggtaaagttattcttgtgcgaggggatttattacgagatcgaggggctaaacaaagattaatttataatagtggtaacaatgatccaataaccggagtacaatttaatgaaactgaacaagtattatat

SEQ ID NO: 6585 - DNA, 828 bp, Candida albicans
gcgtcaagagaaaatgggaatgaaatagatttgtttatgagttgtcaattgaaccaagatgtggaaggatgttttgaaattttagaaaaatacggtgacaccaaacctcaattatatgaactaatgctcaaatttataatttcatcgaaaaccatatttgatcagattaaatatgaagatatccaagtaatacttgaacaaatcaaaatttataaattattaactcccattgaattggttgatatattaacagaaaaccctgataatgaatttattacattaggattagttaaagattattttattgattatttccaacaacaaactaaagaaatttccaataatactaaattgattgagaaatacgaacaagaatcaacgaaaaattcttttaaattatctgaattgtcgaaaccatttgtcattcaaaataataagtgttctggatgtaatttgaaattggatttccccgtgattcacttcaaatgtaaacattcattccatcagaaatgtttatcgactaatttaattgccacttcaactgaatcactgacactgtcaactccaacatcaacgtcaacgtcgatgttgaatccaaataataacgttgttattaaccataacgatgatgataaattcacttgtccaatatgtattcataaattcaatgatatcaaaaatgctaaattgaatcaatataaacttggagatgctgctaatcagaataaagagaattttgatgttttcattaattcattgcattctagtaatgataaatttaaatttgtttctgattatattggtaaaggtgtaatggaagatcaatag

SEQ ID NO: 6586 - DNA, 534 bp, Candida albicans
ggtttggcattcgtcaacaaattttatcaagatacttcactggtaatattatggggagaatatcctgctttgtttaatgtcatttcgtgtattggttggcacgccgttactgttattccttgtgctcaattattaaactctgtaggtccattacctccttgggctggttgtttgatcttggttggttgtacaagtatctttgctgtgtttggttataaaaccgttcatttgtatgaaaaatactcttggatacctaatttcattgtgtttatgatcattattgctaaattctctcaaactcatgcatttaattggggtgaaaaaaaatctggtccaactgaagctggtaatgtgttgaatttcatatctgcaatatttggttttatgttgggatggattctttatgctggcgggttatacccgtatataatgcatgcaaatagtaatcagtgggaaagtcgcgtttaccatgaccaccgggttatcttaaccagcgatgtttacagcaattttgggagcagcaataggaactag

SEQ ID NO: 6587 - DNA, 702 bp, Candida albicans
ccagcgatgtttacagcaattttgggagcagcaataggaactagtgtaaatttaaagggatcaagatttgaacaggcatacaataaaaattccaccggaggattgatttatgagatattatgtggtgataataataatcaaggctatcgatttatcattgttgttttcgctctcggtgctatagcaaatggtattcctggatcttattctttgtctcttgccattcaatgtatatggagtcaatgtgctcgagtcccaagaattgcttggtgtattttgggtaatttggtagctttagcattttccatcctggcatattataaatttcaagacaccatgtcgaattttttgtcaattattgcttataatgtatccatttatttgagtatctcgttgacagaacattttatttatcgaagggggttttctgggtatgatgttactgatttcaacaattataaaaccatgcctgttggaatagctggcgttgtggcattctgttttgggatttgttccactgtgctttcaatgaaccaaacatggtatcaaggtgtcattgcaagaaagattggtgataatggtggtgatatatcctttgaaatgaatatcatgtttgcctttattggctataacttggttagaccatttgaattgttcttcaccaccggggaatggccggatccgacatataaggtgggggag

SEQ ID NO: 6588 - DNA, 414 bp, Candida albicans
atgttgatgagctccccattacatcccaccattgaacaaccatcaacgagtaattcgtcattaaaaagaccgacaaattgggctgataaaattggacttagaataaatgctgaaatcagaggtattgaaagagttcccgaatctgaacgtcatgacaattcattattatctcctttcttagtgtttttatcaccacatatggtcattagtggattatcaattggatcattaggacctgtggcatacaatttagatttcagaactagcattataataataaccatattttgtattattggaagcattccagtggggtttttcagtgcctatggaatgaggtttggcattcgtcaacaaattttatcaagatacttcactggtaatattatggggagaatatcctgctttgtttaa

SEQ ID NO: 6589 - DNA, 981 bp, Candida albicans
tttgcccaaatgtcttccgatcttgaacaaacaaataatcctcccatgcgaggtataccggcaattactggcccaatagattacaccaaggcatttcatgttttccccaaagaattacaaccattccgtaattctatcattgcatatggagcatccctattttctacattagtgggattccccctagacactgtgaaaactcgaatgcagacacataagaattttacaagttattttgattgtgttaaaaagaaatatgctaaagaaggtgtacgtgggtttttccgaggtatttgggcaccaatcatttcaacgtcattatctaaatctttaagtgtttctttatttaccacagtgaaaccatatacatatggactattatatgagacaccctggacgaaaaatattgaaagctcgcatccatttttacgaaatattcctgtttgttttatatctggtttaattgcaggtggtggtgtctctttatttgcttgtccattcgaatttaccaaagtatatgctcaattggagaaattagtggcgagtaaatcattgaaagaattatcaaatttaaataataatggtggcaccagttctgcacaattggcaaccaagttcaattcagtgaaaacaccttctacggcggtaattgtgaaagaaatcttgaaatatgaaggaatcaaaggattgtattctggttataaataccatttgatgagagattcaatttctactgggttttattattctatttacgaatccatgaaatggtcgataaataattttataaacaaagatccttcgatttcttctccattttcagtgttattggctggtgggatgtctggtgtgttcagttgggtattgattttcccgatagatacaactaaatctatggtgcataaagatgcggttgacaacattttacgacgatctcatggacttgaacccttaactcctagacttagaaagctacaataa

SEQ ID NO: 6590 - DNA, 876 bp, Candida albicans
aatttagacaaaacagaaaacatggacgacgttgattcagctttggcagataatgtcaaatcctttgccgctggtggttttggtggtatatgtgccgttttgactggtcatcctttcgatttggttaaagtgagattgcaaactggtttgtataactcatcagttcaatgtgtcaagcaaacaattgctaaagatggtttgactggtctttatcgtggggttttaccaccattattgggagttactccaatgtttgctgtgtctttctggggttacgatgttggtaaaagacttgtttcaacatacactggtaaatcaatcgaccaatttgaaatcaaagaaatttctactgctgggtttattagtgcaattccaactactttggttgctgctccttttgagagagttaaagttatgatgcaaatccaagaaggaaataaatcaaagtcaatggctggcgtggttgctgaaatgtataaaactggtggtcttagatcgattttcaaaggttcagttgctactttagcaagagatggtcctggttctgccttgtactttgctacctatgaatatttgaagaaagaattatcttctcctggtgaagacttgtcattgtttgcaattatgactgccggtggatttgctggtgtttccatgtggttgggtgttttcccaattgatactatcaaatcaacacaacaatcttcaaatgttccaatctcaatattacaaaccacaaaaaacatttacgccaaaggtggtattaaagcatttttcccaggggttggtccagcattagcaagatcgttccctgcaaatgctgctactttcttgggtgtggagttggctagaaaagcattagacctgattatataa

SEQ ID NO: 6591 - DNA, 723 bp, Candida albicans
cccaatagaaattctcaaagctctatacttttccaagcagtttctcttgctgtatttttagaagcatctcccgaggccataagtggtgctatgaatgcattgctaatgttattgacatccaatgaaaccaacactagatatttatcattagatgccttaatcaaactaactgcaagatcaaattcaaattatttatcatcactgaaagataattttgacaaggccttaaatataatcatgaaattattacgtgataaagacatttcagtacgtcgtaaggcattagatttattatacaccatttgtaattttgaaaattacaatattattattagtaaactattagattattttcctaatgcagatttcctattaaaatcagaattggccattaaaattgcagttatggcagaaaaatttgctactgattcaacttggtatgtaacaactatgcttaaattgttatctattggtggtggaagtaattcaaatggagttgggtttatgagtaatgaagtttgggaaagaattgtccaaattgtcgtcaataatgaatctttacagaaaaagacttgtaaattattgattaatttgttaagaagaccatttgatcaacgtaatgttgcctcacccctgcaacaccaacagcaacaaccaccaccaccacaggcattacccttatcagaaagtcttatcaaagtagctgcatttgtgttgggtgaa

SEQ ID NO: 6592 - DNA, 756 bp, Candida albicans
tactactcccctcactattcttttgctacatatgtcaatactatgctgaaatctcaacctaaaagtcaaatgaaaggattgactcaattcattgttgatcttcgaaattctaaagatcaagatgaagaagataaaaaaatcaatttagaaatcaataatattaaaactaaattcaataataacaatttaaatggttatcaaaagaaaaaatacgtttgtaaattaatttatatttatttaattgggaatcctaatttagttgatttcggtttaaaagaatcatttcaattattacaatccaatatattttctgaaaaaaaacttggttatattgctgtggcaacattattagataatgaaaagatactaataaatggtaagaaccaaaaaagtaaaaaattcacatcttctaaacaacggttgaattatattcttgaaaatattcatactgatcttgtacgagatttacaaagtaataatgaagaattcaattgtttagccattcaatttattgcttcagtgttcactattaatgctgatagtgataatactatcattaaggaatcagatgaaaattctcatttatggttggaattggttgatatggtttatgcttcagttacttctccaatatcaagtccaattgttaaaagcaaagccagtataactttaaaatctttattgaaattataccctcaagtcattataactaataacaattggatccctagacttttaaaacttattggacgataa

SEQ ID NO: 6593 - DNA, 954 bp, Candida albicans
agtgtcctaatcattaacttcatcctcatttacatttatcaccagcccattattttggcattgcattacccttttttttttgttttttttagttatccttctaatttatcaagggaagtattaatattatttcatttttatcattttggtttttgttttttgttttttttaatgacaagtcatttcccaccaaatacaaaaataaaagattttggatatcccgaaactcatccatttcatattggtaattatcttttaaaatctaatggttcaatatcatcatctcctacatcatcaacaacatcatcctctgcatcatcatcatcaactacttcatcttcagcattcatatcaaataaacatggaaatcatcaccatcaccatcaccatcaccatctacccaataattatatgacaaattcttcccaatttatactgtccaatgattataataatactaataatatcaatgacgatgacgacgatgacgatgataatgataatgatgatgacattatagatgacgattatgatcaagatgaaattaattgtaaagcaagagcaatatttgatttttctgccgagaatgataatgaaatatcattaattgaaggacaaatcatttggattagttatcgtcatggtcaaggttggttagttgctgaagatcctatactgggagaaaatggattagtcccagaagaatatgttgaaattatgcaaaatcttgataataagaataagaagaaacataagaataagagtataaatattaatggtgattatcaagaatttggtcatcaatatggaaatgcaagtaacaatcaagatgaagatgttccaaaaaggtttttaccagaaatatttaatgaccatatacaccaagatgatgatgatgataatgtggcttgtcatagtgtcttcaccatcggacctgcacggaccgaacttatg

SEQ ID NO: 6594 - DNA, 885 bp, Candida albicans
cagtttcttaatgtagttcgagcacatcagaaggatgcttactttgaatcctcctacagaacacagttacaagagttgtttcagtttttgaaaggacagcgatttgtcaatgcataccctcaagaaataacagttttagcgaaagcggtatacttactgttaaccactctattgggagctaggacgttgggtgaagaatatgttgatttaatatatgtgaaccgaataggaaatcggcttcccaaactattacccagattagggtttatagtatcatatgccttggttccgtatatcatcagcaagattgtgaaaaaattgaaaaacaaagaagatgattgggtaagcgaggccttatcaaactactacaaggtcttggatactattttgaatttacatgttgctctattttactttcagggagagttttattcactttcgaaacgtttatttggattacgctatgcatttggacaccacaaagaacccgaaaaaatgcaaggacgaaactattctttactaggtgggataattgttttacagtttattgtaaagtcccttgtgggaatgaagagtaaggaaaagaaacaaacagaagacacaacagaggatgccaaaattagaagtattaaccaattatcccagctcagtgagaactactcagctgaatatattatcgatttatcagatgaaaaacagttgccatatttaccagaagcatcaagaagctgtatgttgtgtttgtcaccaatggttaatccatcagctgcaaattgtggtcatttgttttgttgggactgcattgtggattggattcgagaacacccagagtgtcctctctgtcgtcaacaatgtttggaacaacatttattgcccttaaagtaa

SEQ ID NO: 6595 - DNA, 2115 bp, Candida albicans
ttaattcccttattaacaggggaagaagatgcattaccatactttgctgatgttgtgaaaaatataaccaatagtgatcttaaaattagacaattggtcgtaatctatttaaccaaatatgctgaggtcgaacctgatactgcattactttccatcaattcaatacaaaaatcattaaatgataaagatccaataaatagagctaatgcaattagatcactagctggtattaggattggatctattattcccattttggtgttgagtatgaaaagaacgtcaacggatcgatcaccattagttcgtgctgcaacagccatatcgattgggaaaatctatcaaatatctggtagatccaaacgtcaaatgattgaatatttgagtaaactattaactgacagtgaagtaatggttgttggtgcagctataaaaacatatgcaaagatcaggatggagttaaatgaagaaaagagatggacaccaatacatggcaattttagacgattttgcaaattattgaatcaatttgatgaatggactcaatcttatgtggttgagttacttactgaatattctcgtaagttcttactccgacctattaatgatgagataactgatgatgatcttgagttatttttgcggtcgatgaaaccgttggtacaaagcatttcagaatctgtcattttaagtgttgcaaagtcgatttaccttcttgcgccacgtcaattgttctgtgattttcaattggatcttgtgttgacaagaattgccacttcattaaatcaactggatgtatcgttgtttgctttggaggttgtatcgtttatcagtaagagtgataaattatttgaatcatactacaagagcttttatgtgacaccgagtgacctgaatgatgttgctatttgcaaaattaatatcctttcagcattatctaatcaagagaatttcaagtacatatttgaggaattgaaatactatgctatttattctactaacaaaagtatctctaaggagtcaataaaggctatggggaaatgttctggtttgtctttggaatggagtcagaaaattttaaaatggtgtttgaaaaagattaaaacatcacgtggagaaacattgaacgaattactaactgtcgtacgttatttgattcaacaaaaaagtgattccaatgacagtttaaacaaagcagaagttttgaaaacaacttttaatttagcagctattttggaagatagtctggttgaattggaaaccgaagcccgagcaagtattatttggattattggggaatatacggcactagccgaaaactcgtttgctcttgatgttttaagaaatctacttaaacaatttgcagaagaggaagaagaagttagatatcaaatattggttctagcaagtaaaatatttgcctatgaaatgatcaaaattaagaatgaagggggtgaccaattcaaggattatgtggaggagaaattttccaacagcattgaatacaagatgtttcaacatgcattgcatttagccaaatatgactcatcgtacgataccagagatcgtgctagaatgtttagtgtattattatcaagtgttgatagagcacagttggcatctttgttcttacaagttcctaaaccagttccatttgttaaatcggataccgcagattatcttaggcttagagccattgatgattactttgaagtttgtgattggagtgatcaagataaattaccaccaaagtctattagaactgaattcaccgtacaagttaataaactaggcaatgtttcattcacttcatcctcaacatcaagagagaaaactaaatcaccaagtcctgttggtgagcattctttttcatcacaacagtttgctcagcaacgagaactattgtctcaagttgaaaagaaacaaacactgaagtataaactacaaagtttggatgagtttttcgggagtgaggatgatgattcatcatcgtcatcttcggaggaagaggaagaggaagaggaagaagtcagtgaggaagttgagtctgatgaagatgaagacgaagacgaagacgaagacgaagagattagagaggaaacgaataaagaagcgtaa

SEQ ID NO: 6596 - DNA, 2028 bp, Candida albicans
acaatgactacctatgagaagattgtcaagggtgctactaaagtgaaggtggctgcccctaaaccaaaatatattgagcccatattaatggctacatcgttggatcattcccttatttctaaggagaacttcaacactataatgagaacattacaggcacgattgcacgacagttcctggtctgtcgtttataaagccttgattgtgattcatttgatgattagggaaggggataaaaatgtgacgttagattatttaagtaatcaagcatcgccaaatcttttaaatttgaacaataataacatcatcaaaaatagcaacagtttcaattctgatatcaaatttatcacgagatatgccaagtatttacacaccagagtcaagcaatttgagtcgacgggggtggattatgttagagatgaaagatcaaataacaataccaatcagcaaggtggtagattaagattacttgacgtggacaaaggtttgttgagagaagttgaaagtgtccagaaacaaattgattctttattgaagaataatttcatggaaaacgagataaataatgacattgtcttaactgcatttagattattggtcaatgatttgttggctcttttccaagaattgaatgaaggggtgataaacatcttggaacattattttgaaatgtcgaaaattgatgctgaaagatctttaaagatatacaaaaaatttgtagatcaaaccaagtttgtcattgattatttgagagtagctaagcatttggagtatgctacgaagttacacgtcccaactatcaaacacgcgcctacagctttgacaagttctttggaagaatatttggatgatccaaattttgaaattaatcgaaaacaatatttagcagaaaaaaaggggaaagacaatattgttctgaaaccgactcaatctatacttaataagaagagtaagaatgaaccgggccaacaacaacaacaaccaagagaacaacaacagaaattacaaggtactagtagtgatttgaatagacacagttcattggtcgtgcaacagacctacaatccgtggaataccatgtttgtcccaattgtcggagttgtggatccgctgcaacaagaccaagctcaacaacaggctcaacagcaagcgcaacagcaagcgcaacagcaagcattgcagcaacaagttcaattgcaacaggctcaacaacaagcccagcaacaggctcaacaacaagctttacaacagcgggccacacagcaggccacacagcagcagcaacagactttgttttcacaattgccatccatttctcaaggtaaaacattgcaatctacatttactggtgttgggtttggaggatatggctcgcagccacaacagttacaagcacagcacacaaacccattcatccaacctagtcaacaattacagcaaccacaacaaccactacagccagtagggttacagagatttaatacaaacccattttcaagtatggcaacaggtcaacatcaagtttcacaacaacagtttgctcaaccatatagccaactgaacatgaatcaacaaccacaacctttacaagcacaatcaactaacccatttgctaatacaagatttgcatctaccagtcataccacagcattcacattggataatggatcaattcaaccacaacagcagcaacaacaacaaaatcaaaatcaaaagattcaagctaacgcaactggcaataacccattcaaagtatcacaaactaccctgcagttatttgataattatgctctgacccaacaacaaaaccaacaccaacaattgaaaccacaagcaactgctggtggattggagcatttacctactattccagtcttcccggagacccaacaagaagctcaaagacaattttactttcaaaatgcccaaactgggctatacaaccaagcattccaaccacaacagcagcagcaacagcaacagcaagtgcaacaatataactatcatgatggtccaagcttaatttga

SEQ ID NO: 6597 - DNA, 306 bp, Candida albicans
cataatcattggatagtcaataatgatggtcttccgagactaatgaaattctataccaaagtcgatattccaacacagaaattgctcttgcaacaagtgcacctgttgatatctactagatcagcacaagagtgttcgtttattacccctccctctcttttggaagatttggatgatatcaaggtaatctatcgtcactacgccactttatattttgtatttattgttgacgatcaagagtccgagttggggatattggatttgatccaagtatttgtggagtgtttggacaagtgtttttactaa

SEQ ID NO: 6598 - DNA, 189 bp, Candida albicans
agacaagtactacaaactgtgttagaagaaatcgtgcaaggcgggatggtgatcgacaccaacattaatcgaatagttgctgctgtggatgaagccaacagtcagaaaaacgtcaactccaatggaagtacgattagtgcatcaatactcctgtcgttgtctcgagatagagggttctggggtaggtaa

SEQ ID NO: 6599 - DNA, 792 bp, Candida albicans
cgtcctagttcatttatagaacaagagattgacaaaccgacaactaatgatacagaagaacaggaagcaattggattagacaatacagttgaagatattattgattcatttattacatcagaaaatactgggactttagtatatgagaattctggtagtgggaaaactttattattgaaattagtggcacaacaattaaatcaacaacatggttatttcacaaaatatatatcatgtgacaccataatgaatgaaaatttccaaaatttatctaaaaaccattttttcaaatggattcaaacttgtgcatggaataaaccatcagttttgattttggataatattgataaattaatgagtgtagaaatggaaaatatggatgccaccaaatctaatcaattgacagaatttttcatatctaatttaacgaaaattcatcatcaattaaattccaatttatcaatattattatcagctaattctaaagataatattaataaattattattaggatctcatttaattgaaaatttccatcatttaaatccaccagataaatcattacgatttgaaattttagataaatatttaactaataaattaggattaaaaattaaggttgatttaatggatttagttagtgaaactgaaggttatttaccaaatgatttgaaaattttaagtgatagaatatatcatgaagttttgttcaacagcactgaaacagaaacagaaacagacactgaagccaccaccaatattgaccacgggcctggcaagatccgagcttaa

SEQ ID NO: 6600 - DNA, 282 bp, Candida albicans
  unsure (29): Identity of nucleotide sequences at the above locations are unknown.
ctttattacatcatgactagaactaacanatggactgtacatgaaaagagacctcaagaaccaaaatggtttacacacaatggccactccgataccgatccaaccaaagtaaagaagaatggtgctggtaagaacaattggggtcaaccaggtgatgaattagatgacaatgaggttcgtcattaccaaaagtcttcaggtagaagaaactccaaccacgaaatgaatcaggagagattaaacaacttgaatgacaaattagataaccaattgatgaattag

SEQ ID NO: 6601 - DNA, 1002 bp, Candida albicans
ttcaataaggaaaaaaataaaactttcaccaaagatatcaattcttatcctttcacaatcagaaaagatattaattttaaaaaccttgcgttacaatctgctggtttaactccacgagatttgatatctatcattaaaaaatcgaaaaaattggccattaaacgattaaccaaactatcaaaagattctcaaatttccattcagaacatagttaatattggtaatggtggagttattaattgggtgccagatgattttaatgccgctatcaatgaagcacgtaatcaatttagtgattctattggtgcaccccgtattcctaatgttaaatgggaagatattggtggattggatcttgttaaagatgagatcttggatacaattgatatgccattgaaacatccagaattatttaataatggattaaagaaaagaagtgggattttattttatggtcctccaggtactggtaaaactttattggctaaagccattgccaccaatttctcacttaatttcttttcggtgaaaggtccagaattattgaacatgtatataggggaatcagaagccaatgttcgtcgtgttttccaaagagctcgtgatgcaaaaccatgtgttattttctttgatgagttggattccgtggcaccgaaaagaggtaatcaaggtgattccgggggtgttatggatagaattgtatctcaattattagctgaattagatggtatgagtagtgaaggtggtgatggtgtattcgttgttggtgctactaatagacccgatttgttagatgaggcgttattaagaccaggtagatttgataaaatgttatatttgggtatttccgatactgatgaaaaacaaacgaaaatattggaagcattgaccagaaaattcaaattggacgataatgtgaatttagaacaagtcttcaccacgggctggaaaacgcccgtacgggtggagaaaggcggagagaagcgaatatatagaagatga

SEQ ID NO: 6602 - DNA, 1608 bp, Candida albicans
  unsure (367): Identity of nucleotide sequences at the above locations are unknown.
tttactgccattcaatcatttaaaattggacaagtattatttattgttacccattatccaaatccaaaaagaatgttaattcttcatattcaagttgatagtagattagcttttgagtgggattgccacaattgttacaccaaatttgggctaaagataattaatgatgatgtattgatgaaattaaatcattccaaaccatatattaggaaaaaactaatattggcaatgtataaaatatttttacagtatcctgaaagtttaagattaaattttaatagagtcattgaaaaattagatgattcagaaattgccgtggttagtgctaccgttaatgttatttgtgaaatctctaagaaaaacccanatattttcatcaattatttacctaaattctttgccattctagaagatacgaaaaataattggttaatcattagaattttaaaattgtttcaaagtttatctaaagtcgaaccaagaatgaaaaagaaaatactcccgacaattatagatttaatgttacgaactcaagcatcatcattgatatatgaatgtatcaattgtattgttagtggacaaatgctttctgcagattcatctaaagataaagaaacagcaaaactttgtattaatcaattgaaacttttctttttgacaaatgattccaatttgaaatttgttggattaatagcattaatcaatactttgaaaattttcccgattttgataaatgatgtggaaggtatatccgaaattgttttagaatgtttaaatgatcgtgatttgattattaaacgtaaggcattagaagtgtctaattatcttgttaatgaagataatataactgaagtcgttaaaattatgttaatgcaattagtgccagataacaatatgattgatgatatgttaaagttagagatcacattgaaaattcttcaaattgcatcacaaaataattatgtcaacatccctaattttagatggtatgttgctgttttaaaagatgttattaatttaactttattgccagtggaaggagccaccaattcgggtttaatagcatctcatattgctaatgaaatttcaactgaagttggtaaagaattcaaaaatttggcaaccaaagttccatcagtgagatcatacttgttacaaaatgtcgttttagaattagttcaagatgtgagattattggattcttctgcattaatattaaaagatttatattggattttgggtgaatatattagcgagttgaaagtaacccaaaatgatgacggtgatgatgacagcgacagtgacagtgatggagaagatgcacaagttatggttttagatatagataagaaaatcaaagtttttaacacattaattaattatcaaatagataagaaattgggtttaacttctaatattcattttccagtatcagcaaaactcatcaatttacattttacatctgtggtagcagtattaatacaagcattagtcaaattatataatggaattgctactgattacattaataattttgcaactaccaatggtcaatttcctttagaggactcacgattaggtttgcaacgccgccatgaaagtccgcat

SEQ ID NO: 6603 - DNA, 441 bp, Candida albicans
tattcaaccctattaatgtcatctttccaattacagaactcagaggttttggctcgacttaaaccatttggtattctgtttgaaaaatcacttaatgatttaatcaaaggaataagagctcatactaaggaatcaccagaaagtttaggtaattttcttgatgtggcgattcaagaatgtcgaaatgaattgacaacaacagatctagaaactaaagccatggcgattcttaaattagcatatttggaaatgtatggatttgatatgtcttggtgtaattttcaaattcttgaagttatgtcatcgagtaaatttcaacagaaaagaattggatatttagctgccattcaatcatttaaaaatgaacaagatttacttattttagccactaatcaattcaaaaaagatctaaattctcataatcatgggactgtccattag

SEQ ID NO: 6604 - DNA, 732 bp, Candida albicans
  unsure (726): Identity of nucleotide sequences at the above locations are unknown.
attattattaatgaacaaaaattaagtcaatttattgatgatttaattaataataccaatttttcggaatcagaaacaattcaattaacttcatatattttaactttaattattaaattatcaattaaatttaaagataatcaagtgattgacactttacgattaatattaaattcaaaaactcatgatcctaatttggaaattcaaactagagcagttgaatatcaacaaatttttggtcaagatagtactttgaaaagaggtttattagctcgtatgccagcaccaccagtgaaacaacgtgaagcattaacattacataaatctgccaatactacaaccaccaatacccataaatcattaaagaaatctaccaatgaaactagtggtggtggtagtggcagtgataatttattacttgatctaatggatgatattgtatcaccagcaagcaaccaacaacaactgtcacaacaaggagatgttatttcagatatatttggtggtggcggtggtagtggtaatgacacaaacaaatcaacaattaataatgccgcaattttggatctttttaatagtagtagtaactcgataaatcccgcggttagttctgtgtcagaaattcctgcatttgaaaataatgatgtgaaaatttcatttataccaaaatcattcccacgacgtgcgaagtactataatcgacacgccgtagaaagtccatgtccnggagaa

SEQ ID NO: 6605 - DNA, 513 bp, Candida albicans
ttctatggggtctcagttttggtttctattttccccaatcattccattattatcaattgcttgatatcgttagtgaatgttattgttacatttatttctgcaactatagttgacaagttgggcagaaagcctttattgttgttatcagtctcatttttaggaattgcaacggtgttaatggggttgggtattatttggacaagttctttgttatccattgcaggaacatttacctacattaccttctttgcaattggtatgggaccaattccatttctacttgttggagaagtgactcaaccaattgccaaggcactggcacaaagttgggggacaagtatgaactggattgctacatttattgttggctatactttcccagttttaaaggaatggttaggtgggtcagtctactttatttttactgtaatgtgttgtgtcagtgtatggtttatcaagactaaagttcctgagacaaagggtaagcattcgtaccaggaagtctggaattaa

SEQ ID NO: 6606 - DNA, 633 bp, Candida albicans
accatggcgatctctatcccaagtggattgacacttaatttgatttcaagtgtatcagttatatgtttgggatctttacaatttggctatcatatggcagaattgaattccccagaattagtactatcctgtaaacgatcacaacctggccctgtcccatatagagattctttttttggacgtaatgggtttaaacaatgtatccctatgacaccagatcaaattggattggtgacttctattttttcaattggtgggttattcggatcattttatgttggccatttggcagacaaatatggtagaaagaagacaagtttattacattgtttgctttatattattggttcaacaattaatggtttgagtaatacttacgcaagtttgttgcttggcagattcatttgcgggttgggtgccggatcagctttggttattacttctatctatattaacgaagtttctccaattgagacaaaagggttattggggtcaatgaaccaattcagtatcaatatcgggatcttgttcacacaattgttgtcattgaattggtcaaatgataatgattggagatggctacttttcgatcgccgcactcattgttgtagttgccaacacgccgctaacagg

SEQ ID NO: 6607 - DNA, 1515 bp, Candida albicans
accatgcctaatcctacttcgatacataactttcttgataaaagacatagcatcacccctcttctaggttggtctacgtttattatatgcctatctgctttgcaatttggatatcatttagcggagctaaatgctcctgcagatgtgttgtcttgtaatgtcaagaaaccaggacctttaccttcatacaacaatactatttggtcccattttcatttcaatcaatgcataaacatgacagaacaaggggttactttaatcacaacaatgtttactattggtggcttgcttgcttcaataatattaggaactacatcaatatctacaaattatggaagaaaacacttgtgtgttgttgctgctttattctatgtcctgggatcttttttgatgagttttagtcaaactaattggcaaattaacctaggtagattattgaatgggtttggggcagggagctcattgattgtatctccaatattgatcaatgagttagctcctctcaatcatagaggtctattggggtcattgatgcaatcagctgtgtcgattgggatatttattgctcaaattgtgtcatacctttactccaatgatcagcaatggagattgatatttttggttgcgggcttaattggctttgtacaatttgttggtttattgactgtccctgaatcccctaaatggttaaccatggcaaaaaatgatgttgagcgtgctacacttatattaaagggtttaagaaccgatgaatcaactgtggattatgagatccatcattggggaaatttgacaacaactaacctccctgatgatgaaactagtctgttgttatctgatgactctttactgtcacgaaaccctccactgattccaacgaaagattttattatggaaagaaagtaccgaaagcaattgattgctgttgtgttgattatgacgggtcaacagctagttggaataaatgcaattacatactacggtgttaaaatattgaacgaactattcagtggttctaacactgggaatcttgtcttgatgcttaactgtgtcttttccgggataaacgtggctgcatcgattgctgtagctccattaattgacagatggggtagaaagccgttgctcatgacaagtataacaatgtgtgcaatttgtaccagtattttggccattggtataccgaacagatatgatattgctgttgttacggcgtgtattggatttgtaacaggatgggcattgggtttgggtccacttcccttcttaatgataagtgagtttactggtcatgatgttgttgctacagctcaatctttaggtacggttatgaattggagtccaaatatgtttatagcaatattgttcccatttctaacaaatattttgggtattgggatggtattttgggtttttgtgataaactctttggtgtacggtttcggattctaccattatgttccagaaactaaaggcttcacccattatcgtgacgtatgggaacatttttcatag

SEQ ID NO: 6608 - DNA, 1068 bp, Candida albicans
attcatcaaaaacattcatcaactatgtcagaattgactgaacttcatcctcatcaccatgtacaaatcaaagagtcaattcttgtgggcaaagcattattaaatttcaccacatttttcgtgactcttgggattttagtaatgggatttgaacaatcagtttatgcccccattataaccaataaatatttcaaacaatattatcataatcctagtccaacagaaattgggttcatgattgccattttagaaattggagcattattttcatcaattattgctgggaaaattggtgatttagtaggaaggaaacgtgccactcgttatggtgcagtatttttttatattggtggatttattcaatgtatttctcccaatatgttcattttatgtattggtagattacttggtgggtttggtattggatttttaaccactattgtccccatgtttcaatcagaaattagtcctgctgaagctcgtgggttttatgcatgtgttgaattcaccgggaatattcttggttatgccattggtatttggttagattatgccttttcataccttgaaaatgattatagttggaaagcacctttgattgtccaatttttattaggggtggtgttatggttaggtacgtttattgttgttgaaactccaagatggttattgaatcatgatcatgatttagaaggaatgattgttatagctgatttatatgctgatggagacgttgaagatgatcatgctatgagtgaatatagaaatattaaagaatcagttttaattgatatatttgaaagtggagaaagatcatatgaatatttatttaaacgttatgctaaaagattatcagtggcttgctttggattaatgtttgctcaattgaatgggatcaatcttatttcatattatgcccccatgatttttgaaaaaacaggttgggtcggtaaacaatctatatttatgacgggtattaatggtattatttatgtcataagtactaatcctccgtgggtattatttgaatccttggggttaaaaccattattgatgagcggaacttaa

SEQ ID NO: 6609 - DNA, 609 bp, Candida albicans
aaggttaatgttggtatgactgtgccgggtattattttggttgaaacctggggtacaagaacattgttgatggccggtagtgttgttatggctgtctcccaattgattgttgccattgttggtgttgctgctagcagtcatgctgcaaatcaatgtttagttgctttcagttgtattttcattgctggtttcgcagcaacttggggacctctttgttgggctatttgtggtgaatcctttgctttgaacgtgagactgaaatcaatctccttgtgtaccgcaagtaactggctttggaatttcggtattggttatgctactccttatatggttgattcaggtaaagggaacgccgacttgggttcaaaggtgtttttcatttggggtggatgtaacgtcattggtgggttgtttgcatactttatggtttacgaaaccaagagtcttacattagaacaagttgatgaattgtacttgaaagttgatcacgcttggcaatctaaaggatttgttcctagtgtccacgcatttagagatgatggcgatattgagcacatctcttctgatggaaaagccgaaatggttgaagttgatgaaaattccgtttaa

SEQ ID NO: 6610 - DNA, 1659 bp, Candida albicans
  unsure (47),(71),(103),(134),(153): Identity of nucleotide sequences at the above locations are unknown.
acaagggataaatttcaaaacccaacaattattcataatgaatttanagatgaagatgaggaggaagaggnagaaggagacgatgttgacatttttgaaccanttcaattcaaaaatagtgatgatgatgatgnagaagaaggagatgttctntcatcatcatcactatcatcggatataaattcattcaccgacaatttcggtaatagttatcataatattgattttgataataaacgatacacattgaaattaaatttcaaaggtaaacgattagtttatttcacttcgggatttgttagtttatttgttagtttatttggttattctcaaggggttgtatcatcacttttagcatttgatacatttaataaatatttcaatcaacctagtgctgctactattggaattgttatatcaattcaagaaatcggggccatgataagttcaattatggtagcgaaattatccgataaatttggtcggaaacgaacattattattaggaacatttatatttatgattggtggatcattacaagctttttgtcccaatatttttatattggccattggaagagttttttcagggatgggtgtagggattttatctacgattgttccttcttatcaatgtgaaattagtcctagtgaagaacgagggaaattagtatgcggagaatttactggtaatatcactggttatgcactaagtgtatgggtcgggtatttatcttattttattcaagatattggtgattctcgtaatcaacctcattcattcacagctaatttgagttggagattaccattattcattcaagtggttattgcctttgtgttgtttcttggtgggtttttcattgttgaatcacctcgttggttattagataatgatatggatcaacaaggattccatgtattagcattattatatgattctcatgtggaatcgacaaaaccaaaatctgaatttttcatgattaaaaattctatattacaagaaagaatcactactccaaaactgcaaagaacttggaaacatttattaactcattataaaattcgagtatttgttgcttgttcatcattaatttttgctcaatttaatggtattaatattatttcttattatgctcctttagtgtttgaacaagctggttttgataatgctaatgctttattaatgacaggaataaatggaattatttatttattatcaactatacctacttggtttttagtagattcttggggtcgaagacctatattaataactagtggtatagccatggccatttgtttgtttttagtcgcagcttttatgcatataaataaatcatatactccatcagtagtggcagtatttgttattatttataatgcatcatttggttttgggtttggtcctatcccatttttattactgagtgaatcatatccattatcagtaagatcaaagggggcatcattagcagtatcatgtaattggtttagtaattttgttgttggattaatgacccctattttaaaacaagaaattaaatgggcaatgtatttattccctgctagttcttgtgttttgagtgttattgtggtattattattttatccagaaactaaaggggttgaattagaagatattacgaggaatatttga

SEQ ID NO: 6611 - DNA, 915 bp, Candida albicans
caagtcaaattcatgggtgaaagtttgaaaacagttacgattttcttgctattgatgcgagttttgtttgcaaatgcgccaattttaataattgatatgatgagaagaaaggatgtccttgtttttggtatgtttttgacaacgattgtcatcattagctatatgattttatttcttgggttttctatacctattcctaaaagcgaacagccaagtttggattgggctatgagagttgttttctacccagaaaaggcgtctgtggtgttagcattaacagtgtttctagatgttgtttactattcaatgctagtaccaacgtgttggttgtacattatagaaactttttcaaccagttcgagaataaaaggctgggttgtgatcatgagtttgcattggttatttgaagcatgtacttctttgtctttttcatttttaatggaggaactcaatggttggttatttttaattatttcatttatatgtttgggtgggttgtttttcacaacacaattagaagaaacaaagggtaaatttgaatttgatcccgagttcattatgaaggagagccaatatgagcttagtgacgacaaaacgctatctgcacaaccagccaacttgaaatgttttgatgaaagctcatcttctaattatgtcagttcaaggggaagcaaaaatattagagatttaactgtaccccaagattcaaatataaaaggtaaacctttcaattccttcaaaaaaagtgtcaaagaaagcaatattagtaaaccaattatgaatccttgggaaaccccatatggtagcatggagagttttcttaataatgaaaaattgaatcaacaaccagcaaatgcttctaatggcaatgttactgtaaccaaaaaattagctgatgcttataaccgattgtga

SEQ ID NO: 6612 - DNA, 1215 bp, Candida albicans
ttatcatcttggatatctcttcttataactgttatcaccaattatacttcaataatgccaactaataaaccagaaactacaccaggtggtgaaaacttacttgcagcattaatatcttgtactaccgcggcagcattttcagcaacttgtacttatccatttgattttatcaagacccaacaacaattgaataatgaaaaagtaatgaaaaaatggaatatccctggaaattaccccaattcgcttgcacaattatataaaggtgggagtgcattagtcttagggtcaattgttaagaatggaacaagaatcattgcttataattggctgacacaattcatgtccattgattcacataatgggaataataataaaaccacggcaccaagaatagtgattgctggtgttatgagtggatttattgaaactttatggttaattccatttgaaaatgtgaaaatcactatgattcaaaatcaaactttggccaatgaattgaaaagatgtaaaaatttaggatatgatataactgggaaagtcactcatagtcctctgactcatcacaaatcaactaaaccaatttaccttagacaatatgtatctcctcatgcatatttgtcatcagatgttattgatcagtacattaaacaaaaagtgaggtttggtggtgtccctattaaggataaagctttagaatcattaaaatttcattataataaacatccttcattgacattatttggaaccgtaaaggaaatgtatgagttaaaggggttaagagcatttacagctggtacttttataacttttacccgtcagattggtatatcttgggtatggttggcaacgtataatgccactagacaattgattgaccctcataatactaataacgaatggtttggtcataaacatactatgatacaactggtggggttacatttcttatcttcaatggctgtgattatggttactcaacctttggatgtaatcaaaactcatttacaactgaaaaatggtaacctgctttatcgcgactcattatcaacagcatataaattgtttttgcaacaagggccttgggcattgtttaaaggtgccttcccaagatttttaaaagtattgatcagtggtggattgacagccactgtatatgaatacgttgagagattggtagacgttgcaggtcatcaaaaaattttcagtcaagagtaa

SEQ ID NO: 6613 - DNA, 1353 bp, Candida albicans
accattagtggaaatgaatttacatcaatggaattttttctttttgggatttgggcatggacttgggatgctttggatttttttgttacttcattaaatgtatctaatattgctgaagatttagattctacagttaaagatgtatcttgggggatcacattggtgttgatgttgagaacggttggggcattaatatttggggcaattggtgatacatatggtagaaaatggccctatattattaatttatcatgtttgatggtgattcaaattggtactgggtttgtcacaacttttcaacaattcttagggttgagagcattatttggtgttgccatgggtgggttgtttggtatttgtgctgctgaagcattaggtgatgctcctaaaaaggccagaggggtgttatctggtattttccaagaaggttatgcatttggttatttgttagctgttgttttccaaagagctattgctgataccacagaaaaaacttggagatcagtattttggttcagtgctggtccaccaatcattcttatcatttggagattcatcaacccagaaactgactcttatcaacgtcaaaaggaaagatttgatcaaggtgctgtacaaaagaattctaaagctgctgaattcaaatctcaagccaaaaaggcattgaaccaatactggttgattattgtctacttgatctttttaatggccggatttaacttttcttctcatggttctcaagatttatatccaacaatgttaaccaaacagtatcattacggtaaagataaatcaactgttgttaatgtgtgtgccaacttgggtgcattagctggtggtattgtaattgctcatttatcaacttttatcggtagaagaactgcaattttgattggtaatgttattgctggtattatgatttacttctgggcattccatccaatgtggatcactgcttttttcatgcaatttggtattcaaggttcttggtcagtggtgccaattcatttatcagaattgtctcctccacatttccgttcatttgtcagtggtgtcctgtaccaattgggtaatttagtcagttctgcatcttctacaattgaagctacaatcgaagaacaaattcacgattatggtaaaaccatggctatttttattggtgctgttttggcttacttgatgtttgttgtttttattggtcctgaaaacagaggtgccgaattgggtgttgaaagagatgacgaatacagtgcgtacgatagtgatagggaagacagaggtgattctgatcttgaagaaggtaatattactcaaaagactttggaaaaaccagaagttgaacataaagagtaa

SEQ ID NO: 6614 - DNA, 555 bp, Candida albicans
  unsure (14): Identity of nucleotide sequences at the above locations are unknown.
atattcgtggtccncgcgctctgtagtgaagaatccagtgtcggtggtattattggtggtattatcatgggtcaagcatcagagttattgggtcgtcgattaaccgttgtgattagtattgtttgcgccggtgcattcttatatccatcatttttcaacccagacagaaactggcctgcttatatctttttaaatgcatttgtatttggatcatttagtgttggtccagcatatcttttagaattggttaattctactcatagaactttattgtccggtgttgcttatcaattgggtaatttagtgagttcagctagtgccaccattgaagcaaaaatcggggaaagattcccacttaaagaccaaccaggaatgtttgattatggtaaagtcatgtgtattttttgtggggcaattttcgcttatatgatctttattattttcttaggaccagaaaggttccatagagatttgcaaattcatgacacagacgaaatcgaagagttacaacaagatagctctagtaataacgagagtgttaaagaaagagtttaa

SEQ ID NO: 6615 - DNA, 645 bp, Candida albicans
ggccgccattctaacgcaattgcgcatcctcagggcgtggtgaaaatccttcttaatattgcttcaatactttttataaatattaagataaactccatatcacacctacacacacacaatatggaggaaaaagcaagagctgatcatatttcaattactaattctaatgaattaaactatgatgattatagcaactcctataaaaatcaaccagaattagacgatgaattatttaatgaaaaaccagacctttcattatcttcaatctctagatattttgccactagattaaccacattattagatttaccattatatcatacccataaaaaatggtatgaagtgatcaatcctataccaggattaaaatcaatgagtaaatctgattggaatttttattgtttagggttttttgcttgggcattagatgctatggattttttttgtgtttcggtggctgcaccagagattgccaatacattaaatattagtgttactgatgttacttggggtgttacattagtgttgatgttaacatctgtcggagcagttatatttggtattgcatcagattattttggtcgtaaatggacgtatatttctattgtcactttatttgttgttgttgaagttggtactgggttt

SEQ ID NO: 6616 - DNA, 930 bp, Candida albicans
actaaaatggcatcgtcaataccaggtccagtttctttaccccagtcaaaatatgacttaaccacttactggggaagagtgaaacattgtgctgaaatttctgatcccacaatgttgttgaacactactcatgacatagaaactgctaaaagaatggtttgggactacaaaaatggagtgacttcaaaaatgagtccagagctttggagagcaaagaaagttttggattctactttacatccagacactggtgaaaccgtgtttttgccatttagaatgtcttcttgtgttttgtccaaccttgttgtaactgcaggtatgttgacaccaaacttgggaacagcaggcactttgttttggcagattgccaatcagtccttgaatgttgcaattaacactgcaaacgccaataaatcacatcctttaacaactaaacaaattgtcactaattatacattggcagtttcagcctcatgttccgttgccttgggattaaattctttggtacctagattaaagtcattaaaaccaaacacgagaatgattcttggtagattagtcccatttgcagctgttgtttcagcaggtattgtgaacgtatttttgatgagaagtgaagagttgaaaaaggggataactgtgtttgatagaaaaggaaatgagattggaacttctaaacaggcagcctggtatgccgtaggagaaactgcagcaagtagagtgattaatgctacccctatcatggtcattccacccttgattttagtgaaattgcagcaaagtagatttttaaagggtaaatccaaaggagttgaaactttggtaaacattgggttaatctttgccacttcattagttgctttgccttctgcattggcagttttccaaaaaagccgattcttaaagaccgtctcgcagataatcgtgggg

SEQ ID NO: 6617 - DNA, 780 bp, Candida albicans
aaagaatgtttgggaacaacaaaaaagggaggaatttcaaaaatgagtccagagtttgggagagcaaaggaagttttggattttactttacatccagacaatgttggaacgggttttttgccatttagaagttcttatggggttttgtccaaccttgttgtaactgcaggtatgttgacaccaaacttgggaacagcaggcactttgttttggcagattgccaatcagtccttgaatgttgcaattaacactgcaaacgccaataaatcacatcctttaacaactaaacaaattgtcactaattatacattggcagtttcagcctcatgttccgttgccttgggattaaattctttggtacctagattaaagtcattaaaaccaaacacgagaatgattcttggtagattggtcccattcgcagctgttgtttcagcaggtattgtgaacgtatttttgatgaggagtgaagagttgaaaaaggggataactgtgtttgatagaaaaggaaatgaggttggaacgtctaaacaagcagcctggtatgctgtaggagaaactgcagcaagtagagtgattaatgctacccctatcatggtcattccacccttgattttagtgaaattgcagcaaagtagatttttgaagagtaaatccaaaggagttgaaactttggtaaacattgggttaatctttgccacttcattagttgctttgccttttgcattggcagttttcccacaaagaagagttttagactgtgaacaaattagaaagtaa

SEQ ID NO: 6618 - DNA, 540 bp, Candida albicans
ttaccaaacacaaaaatacactacattgatgaacttgccttgtttgatcgtttgagacttaaatctactccaaagcacagagctaaagatagcactagaagacctcaagataccgattcttctgcttgtgctttgatttacacatctggtaccactggtttacctaaagcagggataatgtcttggagaaaggcatttatggcttcagttatctttggccacattatgaaaatcaaggaaaactcgagtgtgttaacagcaatgccattataccattctacggcagcaatgttgggggtatgtccaactttaattgtaggcgggtgtgttactgtttcccaaaaattctcggcaacatcgttctggactcaagcaagattatgtggagccactcatattcaatacgttggtgaagtttgtcgttatttattgaattcaaagcctcaccctgatcaagatagacataatgttagaattgcttatggtaatgggttgcgtcgtgacatttggtttgaattcaaatctagattccacatttaa

SEQ ID NO: 6619 - DNA, 282 bp, Candida albicans
aagaacttggatcctcagcgcctggtgaatacttatatcttgaataatgagtatggtgttacatccaacgataccattggtgttgcttgtatgaacaaaccacttttcattatattatggttggcattatggaatattggtgcattaccagcatttttgaatttcaataccaatgataaacctttggttcattgtcttaagattgccaatgttagtcaagtttttgttgatccagattgtgacaaaccaattatagacactgaatcccaaattgtcgaataa

SEQ ID NO: 6620 - DNA, 1185 bp, Candida albicans
cagccgaaagagaccaatctagaaggtcaattacgttcagcacattccaaaattgtttccaataatgaggaaattgcatttttgagaggtcattacagagaactagattacattgattattgttactacaccttagaacgattttctaaaggtgaatactggaaaaaagccattcatgaaattgcccaaactttcattgtaaaatacttttggggtgctgcagggttagttttatgttctgctccaattttcattgggaaatattttggagaatcagatgataaaaatgctgcaggaaatttcattacaaatagaaggttattgttaagtgcatctgattccttagatcgtttgatatattccagacgttacttgcttcaaatagttggacatgctagcagagtttccgatttcttagatacattagatgatgttgatcgcaaaaagaaaacaatcaccgctaatgtaaaatataacaacaatgaaattacttttgataaggtgaaattaatgactccagctgatgtaacgttaattgaaagtttggacttttccatcaaatcgggtgatcatttattgattgctggaccaaacggatccggaaaatcttcattatttagaatgcttggaggattatggccagtcaaaaaaggtgtgattactattccacatactgataatatgttctacttgccacaaagagcatatcttgttgaaggtactttgagagaacaaatcatttatccccatgcactcgatcaacaaaagaaaactgataacgaattgaaacaaattttgcaagttttgaaattggatcactattttgatcaattagattctgataagaactggggtgaagaattgtcaattggggctcaacaaagattagctatggccagattgtattaccataaacccaaatttgctgtgttggatgagtgtacttctaccgtctctcctgatatggaacagttcatgtataagcatgcccaggaattgggaatcactgttttgtctgttgctcatagaactgcgttatggcatttccataaatatttattgaaattcgatggtaaaggtggttatacttttgataaactagatgaggaaacgattttgaaattacaaaaggaagggtcagggttgacaaagaaaccagaaaataaaagtgaatcaacgaaatga

SEQ ID NO: 6621 - DNA, 1107 bp, Candida albicans
tacacgaccttttccttaacagtccagatttttttttttccttgtgcgtggctctctcactcactctttatctctttcttttcccttccccactttctttccagttttcaacgaaatcacagttttaacaaaataaagcaaaaaaaaactaagagaggattatttataacactctttttgtatgaagaattaatcaacaatataccccataacctaaaaaccatgtcaatagagaactcaaaactacaaaagaactcgttggcactatcattgttgaaggtatacaagtccaatagatcgttgctattgaacacttcctatataatattgttaactgctgcttttgcaggtgcaacaaacacaggcaaaacatcatcatcttcaagaccaccaaacaaagaagatagtcaagatgaaaaagagttgaaaaagaaatcacataagttgtcaaaggagtcgttcaatagattggcaagggctattttaccttcatttcttgacaaatctatattttatttacttgccaatttagttttattggttgtaagagcattgttaactattaaagtggcaacattagatggtcagttagttggtgctcttgtatcgaaaagattaaaattatttggaaggtatttggcttattggatgcttcttggtattcctgctgcctttaccaatgcattgttaaactggaccaaacaaaatttaagcaagaccatcagaactaacttgaacaaaaatattatggaagagtatttacctgatagtttagatgcaaattattattctttgatgcatttatctggaaataaaattaaggatccaaaccaaagaatcaccactgatgtttcacgtttgagttatgcattagctagtttaccaggacaattattgaaacccactttggatttgatattatgtgctagacaattgagtaaaagtggtgttggttatggaggagggaatttggcattgggattgttggcttatttcttaactatgattattcgtatcttttcacccccatttgccaaattagcagccgaaagagaccaatctagaaggtcaattacgttcagcacattccaaaattgtttccaataa

SEQ ID NO: 6622 - DNA, 2316 bp, Candida albicans
gtttcattgattgttgaaatgatcaacatatcacgattagctggatataataaacaggatgttaaaaacatcttgttattactacatgagtttatcaccacctatagagataacaaagtcaagttaaattatcagagtagaccagttatattattcttcagtacattgattgccactgctggatttggattatattttacatttcgaaacatcattaccaaatataatgaatatgcattgaacaagaaattaagacgtccaagtcttattagacagtcatccaatattttgaaaaatggggcaagagagatatacataccaaaggggaaaaacaaagtcacaagaataattattcctaaacctaacaacgatcaatatgctgctgataaatatctatataaagattttgttagaaaccaaaggattttacaacagcaacaaaagggagttatattcaattcgaaattccttaatcaattgatgatcatttggaagatcttgatccccaaattttattgtcaaaacacatctttgttagtctcacaatgtttctttttaattttcagaacgtggttatctttgttggttgctaaattagatggtcaaattgttaaaaatttgattgcagcaaacggaagaaaattttctcgcgatttgatttattggttattgattgccttccctgcctcttatactaatgcagctataaaatatttggatcttagattagccttgggatttagaaccaaccttacccgatacattcatgatatgtatttggacaaaagtatggcctattataaaattgggttaaacaattcagatatcttaaacattgatcagtatattactgacgatgttaccaatttctgtcaatccttatgttcattattctcgtcaatgggtaaaccatttattgatttgattttctttagtgtttacttgagagataatttaggtaccggggcaattataggtatctttgccaattatatggtgaccgcattaatgttgaaacgggcaacaccatcatttggtaaattatcgtcacaaagagcacatttagaaggtatttattacaaccaacatttgaatgtgatgaccaatagtgaagaaattggattctacaagggatcattaattgaaaaatttaagttgaatgaaaatttccaaaaattgattcagcatattagtaaagaaattaatatatcatttgggtatgcagcattagaggattatgttttgaaatatacttggtcagcatggggatatatttttgctggtttgccagtgtttttagatgaattgtggcctaaagaagcagtagcattaactggagatgacgacgacgacgatatcgctgctgtcatagccaagaagaaaaaacaaaagcaacaagatggcaaagatgcacaagtagattcagctactgaaggcaagaatatgagacaattcattaccaacaaaagattattgttatcactagctgatgctggatccagattaatgtactctattaaagatgttaacacattgactggatacactgatagagttttcaatttattgactcaattacaccgagttcatgcccctaagtttgattatggtgacaagaatggttacgctgatatccaaggtactattcaagacaattaccctgatggattacgatttgaaaatattagggttattattccaactgccgaaggatcagaatatgcaccattggttgacaatttgaatttccaattgaaacacaagagtatgttaattttgggatcaaatggatgtggtaaaacagctattgcacgtattattgctggattgtggccattgtatagtggattattatcgaaacctaatgatgatgatattttttacttgccacaaaaggcctatttcaccactggtaatttacgagaccaaataatttatcctcacacatacactgaaatgttagaaatgggatataatgatgattatttgtatcacattttgcgtgaagttaaattggaatatttattgaaaagagagaagagtcttaatactgttaaaacttggtcgctggttttgagtggtggtgaaagacaaagattaagtattgctagagctttgtttaaacatccaaaattgattgtattagatgattgtaccaatgcagtcagtactgatgttgaagaatacctttatgaattgttgatcaagaagaaacttacatttatttcattatcgaatagaccatctttggagaaataccatgaccatgttttggaaatagaggaaggagattggaaattgaaaactgtccattga

SEQ ID NO: 6623 - DNA, 492 bp, Candida albicans
acaacgttgcaattgaaattcactgctcatggtggattagaagctttgtcagtagattggaataaatacaagtctactgtgattgcttcgggaggaactgataaatcagtgagaatatgggatttacgatcaattacaaaaatcgaccaacctatagcccaatcaccaatggcaagtgggcatatacgtggtccaactccattaaacgaattaattggtcatgaatttgctgttagacgagtacaatggtcacctcacaatccaaaagaattaatgtctacttcctatgatatgacagccagaatatggaatgatgaactggacgaaagagcaagattcttgaattcacgagtaggtggattgaaaggagtgtttggaagacacaaagagtttgttataggcagtgattacagtttatggggagaacctggctgggtagcaactacaggatgggatgaaatggtttatatatgggactctaaacgattataa

SEQ ID NO: 6624 - DNA, 282 bp, Candida albicans
tcatcaaagacacagtacttagttatgctttcatttagaactaaaggatataatggttatggaatccaatattcgccattctacgataacaagctagcggtggcaacagcagcaaattatggattggtaggtaatgggagattatttatattaaatatagaacccaatggaactgtatccgatcaaatatcatgggagacgcaagatggtttattcgatatcgcatggagtgagattcatgaaaatcaagccgtagtggattcaggagatgggactttttaa

SEQ ID NO: 6625 - DNA, 894 bp, Candida albicans
aaactactattgcttctgattattatattttattcccagaaaaatactccagattgggaaatctttgccattacttttttcgggatctctataccaacaacttttgttggagtagctggtattttaattggtaatgtagcattaacttatcaaccttggggtgatgcttataaaaaattaggaatgggtggattattaaatgaagcatttaaaccttggggtgctggaggtaaatttcttttaatgataattttcttatcattaatttcaaataatattattaatacttattctgcagcatttggagtacaattagctggtactatgtttgctaaagttcctagatggttatgggcaatccttttaacagcaatttatttaatttgtgcgttagtgggtcgtaatgaattttcaactattttaggaaatttcttacccatgattggttattgggtatcaatgtatttcatcatgttattagaagaaaatactattttcagaactgataaatttaaatatttattcacaaaggaattccctcgtgttaataaagaagaagaacaagaagaagaagacggtttggattcgtcaattgtacatcatcccattgatgcaagaattattggtacaccattgagacaaaatcaacattataatttcagtatttggaatgattatgataaattaactcaaggtttagcagcaacagcgtcatttataattggtgctacaggtgctgctgtgggtatgtcacaagcatattggatcggacctcttgctagacgtataggaggtgaatttggtggtgatattgccatgtggttatgtatgggatttagtggattggtttatcctccattacgttatttagaattgaaaaaatttggtagataa

SEQ ID NO: 6626 - DNA, 1587 bp, Candida albicans
atggaaatccccgagagtaaaaattcaattgtatctcaagatacaatttcttccaatgaaaccgatattcgtgctcccaaatatatcaattggatttacaatttagatagatggggagttgaagtccgaggaattgaaagagtaagtgaacaagaacgaattgaacttggtcaaaaaatccctacatggcatttattcattcaaacacttggtctttggtggtcggcatgtggaggactcacgacaatgtcatcatttttcttacctacccttttatttggtttgaacttacgtgatgcgatgatcagtggattaataggaatgattattggttgtcttgttcctgcttatagttcgacaatgggaccaaaatctggttgtcgacaaatggtcacggcaagatttttatttgggcaatggggggtcaagtttgtggcattaatttgtattgttggcggtattggatggtcagtggtcaattgtgtattgggtggacaaatgctccttgcgataaatcataatatttcattggcagtagggattgttgttattgcaataattagtttaattgttgcagttttcggaattaaagtgttattaaaatttcaaactgttttttcaattccaatttttattgctagtatattgttttatgttgttgtttgtcaaaaagctaattatattggtgaatcaaataaattgataaatgacgctggttattcaaaagtgactttcaggggtaattggctcagttatttttctctttgttattcagtcacagctacttggggtagtggagccgctgattattatatattgtaccctgcaagtaccccttcatatcaaatattcttaattacatttttgggtattgccgtgccatcgacatttgtcgcaatagcaggaacaatatgtggtaatttcgccttgtcatacaagccatggaatgatgcttacaatgaatttggtgtgggtgggttaattgtcgggacattttctcattgggggaaatttgggaaatttgttgctgtattgttgtacatttccttgatttgtaacaatattatgaacacttattcagttgcatttgaatttcaattagtggatctgagattgacatatgttcctcgatggatatgggctactatagtcaccattatctatcttgtattatctgtctgtggtagaaatcatttcctgacaattttaagtaattttttacccatgctaggatactggatcacaatgtatattgcattattgttagaagaaaatttcattttccgatctactttcaaagttagaaaattacacgaacatgagtttgatggagattataaacaaatgtataattggacaaattggaataaccctaagggtagaacattggggcttgcagcttgttttgcatttctttgtggatgcgctggagcaattattggaatgaatcaagtttattataaaggccccattgctagaaaagttggtgaatatggtgctgatttagggatgtggatttcatttggatttaccgctataacatatccagtatttagatatattgagttgagactattgaagaaatga

SEQ ID NO: 6627 - DNA, 534 bp, Candida albicans
  unsure (500),(513): Identity of nucleotide sequences at the above locations are unknown.
cccccaatcatgtcaaaaataaagaataacagtcttacaataaagcaacgaccaattggtgtaacaacaactaattattcttcatcaatagacgttgtaacgacttctgcacctagatatgaagacaattttttcaatgctgaaacaactcatgaaataactagtgaaactaactctacttccagctcatcgacaattttccaatatcttgccaccatttctaaaaaacttgattctttaggtgttgaaactagaggtattgaacgtatacaaccttatgaacgttccactaatcgtaccaaacaattcattagtgtcatgggattatggttatctgcatgtggtggattatcatcaatgtcatcattttatttaggtccattattatttgaattagggttacgtaatactttacttgccggattattaggagaaattttggggtgttttattgctgcttattgttcattaatgggacctcgttctggttgtcgccagtnttcacctctgcanaagagcaaccacgctatatat

SEQ ID NO: 6628 - DNA, 906 bp, Candida albicans
atgtcaactaaaagagaagaccatttgagaaagggagcagatgttactcctacagaagccttagtggctggttcaatagcaggtgcgatctctcgagcattcacggctccattagataccataaaaatacgacttcaattacaacctaaaggatttaaacatcggaaatcagtggtcactatagtgaaaaatctattagaaaatgaaggaataattgcattatggaaagggaatgttccagcagaaatactatatattttatatggaggagttcaatttggttcatattcaataattagtaaactggtttccaaattagaaaacaattatcgtatcaatctatcttcagctaatcattcattgattgttggtataggttctgggattgttagcactttggttacttacccatttgacttattacgaactcgattgattgccaataaaaatcgtggtctactatcaatgacagggacaattaaagatataattaaattggaagggatacgtgggatttatgcaggtataagaccagcaatgttatcagtttcaagtactacagggctaatgttctggtcatacgaattagcacgtgagctttccaataattatcagcgagttccatttatagaggcaatttgtgggtttatagctggggccacttccaaaggtataacgttccctttggatactttgaggaaaaggtgtcaaatgtgttctgtggtccatggaagaccgtatacagctctgcatatatttgtaaccatactaaagaatgaaggtgtttttggtttatataaaggttttggaataagtgtattgaaaactgcaccaacaagtgcaatttcattattcatgtatgaatattcattatcattcatcaggaaaattagagttatagagtga

SEQ ID NO: 6629 - DNA, 339 bp, Candida albicans
agtatgacccaatttaatagtgactcgtcaagtactggcgacgtacccaatatcaacacttcgctaataccgtcgatctcaaaaccagtatactcacgtatccctatcccgggccatttaagcaatgatcaatccacccccattgaggatattaagattatcgataaacagagcatagactatataataaggtcaggtctagctggtggcttagctggatcttgtgccaagaccttagtggcacctttggacagaatcaagatcttgttccaaacatcaaacccagaattcataaagtatagaggaacatttggcgggttcagtcttcaccacgggtag

SEQ ID NO: 6630 - DNA, 810 bp, Candida albicans
gtggtgaatatggatcgcaacaagcataccaagggaatgttccccacaatactaaagatgtaccgcgaagaaggctggaaaggtttattccgagggaacttattaaactgtattagaatatttccttatagtgctgtccaatttgcaacttttgagaaatgtaaagacatcatgttgcattacaacccacgtgacacacaacaagtaaatggatatgaaagattaatagctggttctgttggtggtatagtgtctgttgccgttacatacccattggatttagtcagagctcgtatcactgtccaaactgcgtcactaagcaaattaaacaaaggtaaaatggtccgggcaccgaaagtaatggaaactttaaaggacgtttacaaaaacgaagggggaattttaggattatattgtggaataataccaacgactttgggtgtggctccttatgtagctatcaattttgcactttatgagaaattgagggagatgatggatagttcaccacgtgacttttccaatcctgtatggaagttatcagcaggtgcagttagtagctttattggaggagtattgatctatcccttagatttgttaagaaaaagataccaagtagcaagtatggcaggcggggaactcgggtttcagtatagatcagttgcgcacgctttgcattcaattttcaccaccgagggtttctttggtgcttataagggattaacagcaaatttatacaagattgtaccttcaatggcagtcagttggctatgctatgatacattaaaagactggataaatagatggtaa

SEQ ID NO: 6631 - DNA, 579 bp, Candida albicans
caccaccaaaatctccaaaatctctacatatttagccgggggattcggtggggtggttgctcaattgacagtttatcccatcgatactttaaagttcagattgcaatgctccaacctagatcatcctctaaatgctattctgacagccaaagaaatgttgaaagatggtggagtcaaaatattttatcgagggattggtgttggtcttgctgggatgttcccttatgcagcattggatcttggaccttttccactatcaaaaaattattagtgaaaaaatatggcaataaagatgatcagctgctacccacgtatttgactttgagtcttggtgcgttttcagggtcgtttgccgcaaccattgtctacccagtgtacttgttgagtacaagacttcagtcacagggaacttatgcccatccatttagatacgaggggttctatgatgttttctctaaaacggttgctcgtgaaggttattctgggttatggaaaggattggtcccgaacttagccaaggttgctccagcagtgtcgattagttattttgtttatgaatcattaattagacgcttttaa

SEQ ID NO: 6632 - DNA, 267 bp, Candida albicans
tacatgatgcgcggttccgtcgactcccgtggtgaagacatcccggcaaagggacaacatttggttttgaatgagttaatgagtagaaattcgccatctgataaaacccacattatttttagtacattacctgctccatcaaacggtactcatttaaacgatactgattcctttgattacactaacaatttggctatttggttagatgatttaccaccaattttgttagtcaattcgcaaaccgtaactgttacaactgcattataa

SEQ ID NO: 6633 - DNA, 1458 bp, Candida albicans
tgtattacaagcaattttcgcagttgcaccaatttcacccaaatgtttttgcctaaaacagaaaagggaaaaggatttttcaaattgaaaaaacattttataaatgagaaaccggcagagaaatatattgacttgtacccaattcaaatgtcttctgtggcacaacttgacaatggtcaatcggtaatgtcaactaactttgacacttatactttgattttacaattagggtacatcctatcaactgttgatgaatgggaaatcaacaactacagagtacgtgttattgtttttgtcgagtttctgaatgaagtcgctgatgaaaaggaaagattagctggattgttatcaagtttgagaattgatgcagaaattagggtcatttgtttggaaaatgcaaatttagattcttataattatatgatcaaagggtacacgaaatcacagctgaataagactcagtatgataaagttgacagagtcttggcatgtgatcaatggtggaagaacttgtcgaaagcaagagaaacattacgtgaaattgaaaaaaggaaaactttaggtaaacaaaaattgagaattataccaacaagaacagactcaaattcatcactccttccagagacattccaaccattgaatttaacttccagaagtccacaaggggttcaagttcaaggcttgaagaataatagaagatatacactttccaatttacaagaacaagggatgtcattatcatttaatttgagagctgccaatctgacgacaggaaaagatttactatatgctgattcaatagttgatagtagtgacagtgaatcagaagactcgtcatcagttgccacttcaaacactactgccaatcttggctatgtgtcgtctagagataatagttatgtcaatcttgcttcctcgcaagctacattagaaaacacgcaaaggggagatcttcctaaagtcaaaaatacgttaaaagagcaaaatgtgtattcaagaacccatacaccagagatattatccagtagatcttctgtcatcaatttgagaccaaatttcctgtctgttaaaatcccaactgcaaaaattaatgacgaagatgaagatggggatgaccaagaggaggatgaagaggaagagggagctgaaacagataacgttcaaggcaaagaagaggatgaaacaaataaagaaactgccgaaaagggaagtattatcatcaaggataaacagtccaagacaaaagatagatctaaacaatcgattcaatttgttgcagatgaacctccaaaggatttactggtaaatcctgaatcatcacaaagtaaccagaaaggtggtaaacccaaaaccaaaaatcttattgtcaacgatgatgaaataatccatcatatggaaacgccacaatttttagctgccgaagatgatgatgagacagatttcctacacatgtcttga

SEQ ID NO: 6634 - DNA, 1434 bp, Candida albicans
agatccaaaacagcattatttctatttatcatattgacaattagtactttatctattccagtatcaactatttttgtgaagtccttttaccccttaccgcctccatgtgccgatatactatacactggtttgtcctggaaaacatttttcgaaaacttgtatcctaatttcacaagtggtgctgctggttcagtattgccttcaggtcaaaaagaaaatttcactgacttgtttggaattttcttccctgcaactgctggtatttttgccggtgcttctatgctgggtgaattgaagtctccatcaaagtcaattcctaagggaacaataaaaggtttgtttcttacatttgtcttatacatttcagttatcgtttctatgggggcagctatacctcgagagttattatacgttgatatcaaggtcattcaaactgtcaatatatcgagtattgttattatattaggagaattttccacatctttgttttcagtgatcatgggtattgttggtgcctcggcaatgattactgccattgctgatgataagattatcccagggttgtcaagttttacaactttgaaaaagtcaccaaaggagaagaagaaagcacaaatatatagtatcattgctacttggtccgttgcacaagtatttttgtttgctgatatcaatcaaattgccacatttataacaatggcatttttaatgacattcatagttactaacattgcttgtttcttattaaaagtgggctcagctccaaatttcagaccatcgttcaaatatttcagtagcaaaacggctttcgctggtgctacagtatgtattatagcgatgtttattgttgatggtatttctgccacattggttatattttgcatgactttcttgatcttgttaattcattatctgtctccaccttccaaatttggtgacatttctcaattattaatttaccatcaagttagaaaatatttgctaagattgaagttggaaatgagtgtaaaatactggcgtccacaaatattattgctttgtgataatccacgtacttcatggaacttgattggattttgtaatcacttgaagaaaggagggttgtacgtccttggtcatgtggtgctaatgaacgatgacaccaatccatcatgtaattcagataaaaattaccgaacattttcaacagcaacttaccaggaggtgagaaaacaaaagcaagcgtggatcaaattaagagatatgtccaaaatcaaagcatttgtgcagattgctttgggacctactttaccttggggtgtacgtaatgtttatcttggttcaggattgggtggtatgaaaccaaatattactgtgttgggattttatgattttaaaaagcatgggcttgcattacgtatattacttagttacgatagcaacccaaagtttatc

SEQ ID NO: 6635 - DNA, 1530 bp, Candida albicans
attcaaatatatacaatggctttacatcaatttgattatttgtttgcaattgccatgatctttgcgttcttggacgcttggaacattggtgccaatgatgttgcaaattccttctcttcatcagtttcatccagatctttgaaatattggcaagctatgattttggccgctatcatggaattcttgggtgcagtgttggtcggttcacgtgtgtctgatactatcagaaacaaaattgttgatattgctgtgtttaaaaatgaacctgctgtgttgatgttgactatgacaactgccttgattggttcatcaacttggttgactattgccacctccattggtatgccagtctctactacccattctattgttggtgctgttattggtgcctccattgctgccaaaggtgctgagaacattatttggggttggaaaggtgttgctcaaattattgcctcttggttcattgcccctgctattgctggtgcctttgcttctattattttcttgatttctaaatttggtgttttggaagttaaaaacccaagaacatctttaagaaacgccatgttgcttgttcctttgcttgtgtttgtcgcattttccattttaactatgcttatcgtttggaaaggtagtccaaaattgaagttgaacactttgtctactggtaccactgtcggtgctattttcggaactggtggtgttgcaactgctatctactttttgtttgcttacccatactacaaaagaaaattggtttacgaagactggactttgaaatggtacgacattttcagaggtccaatttactggttcaagtccactgacaatattccaccaattccagaaggtcaaactttgaccaaagattattacaagggaagaagatacgatgaagctggaaatttggttgtccttcaaactgatagagatgtttctgctggtgttgtcgaagctcacgatggtgaagactccaactctgatggtgaaaaaacatctgctgttatccaaaaccaacctgccccagttgattctgaaaaacaacctgccccacctgctgctggtactgctgaatacaaaggtgaaaacacaagatggccaaataaatttgctggttacgttaaattggtcaaagaatcaccaaagaactggccattagtgtttttcttgcttttgactcatggtgttagacaagacattattgccaaccaagctggatccaaagatgtgttagctggtgatttgcacaaaatgcacactgcttccaaatattacgacaacaagattgaatacatgtactcacttttgcaagcaatcactgcttgtaccatgtcttttgctcacggtgccaacgatattgctaatgccactggtcctcttgctactgtatatttagtttggactaccaacactaccgcttctaaagctgaagttccagtttgggttttgtgttacgctgccggtgctttagttgtcgcgttatgtcttcgaccacgggcctggcaggatccgagcttaggttacggg

SEQ ID NO: 6636 - DNA, 792 bp, Candida albicans
tacgatgaagaagaagaggaagaagaaactcatagtcatgattcagtattacttaatcatacacattttaatgttaaacaacaattaaaaatcacattaaaacgtaaagccattacattatttataaatctttctgaattaaaatcatttattgaattgaatagaattggattcacgaaaatttgtaaaaaatttgataaaacttgtggttattcaattaaacaagattttattaatgaatttttacctcaatattctcgagtatttgaaaatgataccattgaagaattagattataaattgaatcaaattattaaaatttatgcctttttatcaaataaattaactactcaatcaacaactaaagaagatttggataatataaaatttgaattaagatcttatttacgtgatcatattgtatttgaaagaaataccgtttggaaagatttattatcattagaaaagaaatcttataatattgatttagataattctgtggttcaaaataataaaatgggtgatgaaggtcatataattaattcaatgatgaatttatccatgaaaagaattaatttaccacaatgccttaaaaaattgattaaatatgatcatattgatattccacaatttttattaactactcaaatgcttaaaattattattattgtcattgttttcattatattattagcagtgaaaacttttaatgatccagttcaaggtcgttgtttagcagtattagttgctgctcccatgctttgtatctcacaacgccctggacggacacag

SEQ ID NO: 6637 - DNA, 504 bp, Candida albicans
accggtttattaaaagttgatgatttaaataattatctttggtcaattgttatgttagccatgggtggtattgcattagggaaagccgttacttcttcgggtttattgaaaactattgctttagcattacaaaaacgaattatgcattatgatgccattgttgtattaatcatttttggagcattaattttggtggtagctacatttgtaagtcatactgtatcagcacttattattatcccattggttaaagaagttggagattcattacctaaacctcatccattaatgcttattatgggtgtagctttaattgcttcaggggcaatgggattaccaacttcaggattccctaatgtgacggcaattggtatgagagatgaagttggtaaaccttatttgacggttaatttatttattactagaggggttccggcaagtataattgtttatgtttgtattatcaccattggttatggtattatgtcatcattgaacttttaa

SEQ ID NO: 6638 - DNA, 969 bp, Candida albicans
  unsure (145),(241): Identity of nucleotide sequences at the above locations are unknown.
aggaaagattttggaggaagaaccttgataattttgaagagagattttgaagatttctttggcattaacttggaaccaaacaagattttttcaaggtgtttgttaaacaaatttggaggagttttgggtagttcaacgggttatntacattaccaaccacaccggatcctaacagggaattcaatcaaccaggaagatgatgacgacgatgacgatgaagaggatgcattaactagcgctnttcaagagaccagggggagaggaagaggaggatctgttccagaacttcatgaaaatgcacatcaattgcgtcatacacgatctatagatgattatgctacaaattcaccaaaattctggaacgatttaaataatgctacttgttcaaataatgttccaccacaattactcttgttgagtgagaatagaatcattttaagaaagcgagtcattggattatacaccacattatctgaattaaaatcttttatcgaattgaattacaccgggtttaaaaaagcattgaaaaaatttgataaatcattgaatactaacattaaagataattatttggaaaatttacccaacaattcgtacatttttaaaaaatcaaccatgaaaaaagttgatgaacatttggattcattagtcaaactttatgcattaatttgtaatcatggtgatgatttagaagctgccaaacaagaattatcaatccatttacgtgaacatgtggtttgggaaagaaacaccgtttggagagatatgataggattagaaagaaaatcatatgctgccaattcaaaattgatgaatcgaagtgatgggaataatgatgaaaaagaggatggttcaggtaatatgaaattgatgctgaaattcaatatatctttgaaaaacccggttgtgataaaattgatattgatttttgctgtcacagtgttttatattgaatgtatctccatttga

SEQ ID NO: 6639 - DNA, 246 bp, Candida albicans
acaagtcaatatccaaccactactactactactactaccactactgctactgctaccactgttaagatgaagttttctcattcattgaaatttaatgctgttccagaatggcaagataattatattaattatcctacattgaaaaaaactatttataaattacaacaagatcaacttgttcataatgggaatcaagatcaaggttttattgttggtactaatcaaactactgttagtcaattggtt

SEQ ID NO: 6640 - DNA, 960 bp, Candida albicans
  unsure (899): Identity of nucleotide sequences at the above locations are unknown.
aattcaaccaccactttacatattggcatgaaatttgctgaatctttgaaagaaggtttagtccctgaatggcaggatcaatatgtggattataaagaagggaaaaaattaattaaaaaatgtaaaaaattacaagaagagtatgcttttgaagacactttgaaattccaaaagaaagatattaacaatactactgatgatagaacacctttgattgtccatacagaacctcagcaagtgtatactacaggagccatagatgagaacaatgagaatgaagttgaaggaataccacccttatcagctagtcaatattctaactccgggtatagtcgacgccgattatctatctttgctacttcagttagatcctctagcaaaaaagatgactatataaaagaaaaggcaaactttaccaaatggttgaatgaacaacttatgaaagttgatgatttttatattgaaaaggaacaagatgtgtatgaacgattcttgctcttacaagatcaattatatcaacttcgagatcaaaagactcaacttatcaaagagaaaaatattcatgacaacaaaaaccatccagttaaatctaatactgatcacgttgtcaacaaagtcaatgatttcgctttccatacaaaatcaatcatcagtaatttgaatagatttgaattacctagcttaccgtcattacgattcttgaaaaaatggaagacaaaaaataaacgggacaatcaatttcaagatgagatatctttgcaaatccaagataaagcagatctaaactatgcggagaatagggtgagaaatgggattgttgatataacggaaggcgcaaccattgatctgacatcacttgaagaatctgatggtgaatcgattttcatccctaacgttgntgcaccacaaccaccaccacctcaaactgaagaacttttacggcaaagagagccgacgtga

SEQ ID NO: 6641 - DNA, 729 bp, Candida albicans
aaagaaaagaaagatttcatatttccatttttcacaggtttccctttgtttgccaatgtttttgcttccttgggatttttagcctacattgttggggaagatatggggattattacttcgaaattctatgcacaaaagtattgtgattatatattcggatttgatatcaaatcatattcacaaaatgaaactgggaaagacaagaaattgaccaggaaaagtctagacacacaattaattgtttatcgtgactcacctattgctatttgttcattagttgttgatgaaacccagtcaagtgcagcaaatttcattgtgaaaatcactggtattcatgtgagaaaagtctttcaaaaagttaactttgacgaagtcttaattgattgggcagttgtcagagccagagaattataccaggaatttctcacttcaaaaaacataaagactcctccagaaaacagttccattttaatcaccatagacgcttattcgtttgacaatgctttcgagaaaaccttgtacaaccatggttttagaattttggattcttcatttgaattaaatccttttagcccagctgtttcctggtataaggagagattgtacagattcttgaatgtttcaagagacacatttggattaatgttaactattgctaaagacgatatcgaatcaatcaacagcgataccaagcaaaataaccaaagtaaaatcaaaaaaagacattaa

SEQ ID NO: 6642 - DNA, 219 bp, Candida albicans
aaagctatatcttctattataatggtggttcagaaagaaattgatttaaacaaaccattagacgccaatgcagcaccggtattggccaaaacaactttgaaaccggagttatcaaaggccgccattgttttgcacggagatcgttacaaacaattacaagcgaagttaactaagtatgttttatctcttaaccgggcggaaatggaaggacatgcgtag

SEQ ID NO: 6643 - DNA, 2487 bp, Candida albicans
tacataatgacaggcgtgcttgaagtggtcaaatccataacatcgaacgaaggatttgtatctgaagttcctcatttatatggaggggaagaacatcataaagtcaaatcacatgaattcgattcaaacagtataaataataccaattacaatagcaatgtttttgttccagcatacgatgaaagagaagttactgtaaaagaatggtttcaatatatctttgctaacccactaaaaatgatagctgattatcttatttcattgtttccaattcttaaatggattttgcattacaatattagatggttatatggtgacttggttgctggtattactgtgggagttgttttagtgcctcaatctatgtcatatgcccaattagctgggttagaagctcaatatggtttatattcttcctttgtcggtgttttcatttattcatttttcgccacctcaaaagatgtttccatcggtcctgtcgctgttatgtccttgcaagtgtctaaggtcattgctcatgttcaagataagtttggtgacaagtatgctgctcctgaaattgccacatttttgtcattgatttgtggtggtatcgctcttggtattggtttgttacgtttaggattcattttagaatttatttctatcccagcggtcatggggttcatgactggttctgcatttaacattatcactggtcaagttccagggttaatgggttataacagtaaagttaacacaagagatagtacatatcttgttgttgtcaacacattgaaacacttgccagactccactgttgacgctgcctttgggttgattccattattcattttatacttgtggaaattcctgactgattatgctcaaaaaagatacccaagacacaagatgtactttttctatttccaacaattaagaaacgctattgttattattgttgctacagctatatcttggggtattgtccatcctaagaaagttgcattcaatggtccttcctccaaattcaaaccaccaatcaagactattggtgatgttccaagtgggttgcgtcacgttggtgttatgtccattcctgatggtataatcagtgctatggcctctgaaattcccgtctctactgtcattttgttgttcgaacatattgctatatccaagtcattcggtagaattaatgattataaagtggttccagatcaagaagttattgctattggtgtcaataacttaattggtactttcttcaacgcttacccagctactggttccttctcaagatctgcattgaaagcaaaatgtggtgttagaactccattggcaggtattttcactggtgctgtcgttttgttggctttgtatgctttaacaaaggctttctactacattcctaaagcaactttatctgcagttattattcatgctgtttcagatttgattgcaaattacaaaatcacttggtcattctggaagatgagtccaatcgactgtggtatctttttaattgctgttatcttgactgttttcgttaccattgaagctggtatttactttgctattgctgcttctgttgttgtattgttggtgagagttgctattccacatggtcaattcttgggtaaaatccaaattgccgaagttgttaacccaatcattgaacaaacaggctctcatgatgaacacaatgcttctgcatctgatggtactagctactctagtgatttggaaattcatcaagttttatctgaaggtactaactacaagtcaactgatgaagctggtaaattgaaagctaaagaagatataaaaccagttgaaggtgtgactacttctgctttacagagaaataatccacaagtgaaattccatacacgttgggtgccattaaataacgagaatatcaatgctggtatcaaagttcaacctccacctccaggtgttttggtattcaaacctgttgaaacctttacatatcctaatgcatctagacaagttgataaagtttctgatgaagcaaaaagattaaccagaagagggaaaccgtttgactattctaaaattgggtcaagaccttggaatgatccaggtccattgagatggaacttgccatggtccaagaaagaaaaagttgaagaaaaagttgaagataaccgtcctattttgcgtatagtgcatttcgatttttccactgttgcttctattgatgtaactgctatacaggcattagttgatttaagaaaagctttaaatgcttacgctgatcgtgaagttgaattccatttctcaggtattttaagtccttggattagaagaggtttgttgaatgccggatttggtacatatgaagatggtttgctttctactaataactatgtcaatattgctgctggatacaaagatttggaagatcacgttgatgaaccgtattacgctgctactggtacaaatactccatttttccatttagatataccaaactactcatga

SEQ ID NO: 6644 - DNA, 765 bp, Candida albicans
  unsure (533): Identity of nucleotide sequences at the above locations are unknown.
agaccattattagaacattatagagcattatcattattaaaatcatttaaaaccatgaatcgaactgcatttagaaaaatcaccaagaaatatgacaaggcattgaaaacagaacttatgcaaccttttatgcataaaatagacacaacatcttatttcttaactagtgatttactagacaagttaatcaaccatgtcgaagaattgtacattgtattcttcgattcagcatcaaccgatagaaagcattcattggaaaaattgaaaaccattgcatacgccatcaatgcatcagaaatgagaccgccatcattttataaggaattttttgttagtggattatttcttggatttggattgccgttatttgtgttggcactttacacggtgttagataaaactttgaatatagacatgacagaggggaaatacttgttacaaatttgggcagggtttttccttttgaatttaacgtttattttatttgcagttaatatggcagtatttgataaatttaaaatcaattatagatntatttttgaattcaatattgctacaacattaaattataaacaatttttagtgttaccatcatttggatttgcatttttcactattttagcatggttcagttttaacaattattggccatctgattttccctggaagggattggccatggatttattttgctgtcatgttaataatttttttcttaccgggggaatatactttacggtaatagtagaagatggttacaagtag

SEQ ID NO: 6645 - DNA, 264 bp, Candida albicans
cactattatcccttattaggatcaaccatgaagttttcccactcattacaattcaatgctgttccagaatggtcctcgaaatatattgcttataccactttgaagaaattgatttactctttacaaagagataatttgagaaggacttatcaacaagatgacgaagaagcaactttagaaggatcacatttgatcggtgcaaattatgcttccacggttcaaactcaagatgaatctgcatcagccgtgtctatagctgcactt

SEQ ID NO: 6646 - DNA, 1266 bp, Candida albicans
gaagctattccattatttgttacgtctttagttatcccattattgattgttgtgttaaacgttgttaaaaatgacgatggttcaatcatggaaactgtagatgcatcaaaattcatattatcaacaatgtggaattcagtcattttattattgttgggtgggtttactttggctgccgctttatcgaaatatcatattgctaaattgatttcaacttggatattatctaaagctggaactaacccagcagttgtattattgactattatgggagtggcccttttcgcctcaatgtggatttcaaatgttgctgcaccagtcttgtgtttttcattgattcaaccattaatcagaactttaccaaaagggtcaagatttatcaatgcattgataatgggtattgcccttgcttctaatgtaggtggtatggcctcaccaattgcttctccacaaaatatgatcgctattggtgctatggaacctcaaccatcttggggtgaatggtttgttgtggctcttcctgtttgtgttttggcattgttgttgatttgggtatttttgttaattacttttaattgcaattctagaaacactcatttagtagcaattaggacaattgacgataaattcactggaattcaatggtatatcattatagtatcatttggaactattttgctttggtgtttagcttctagattgacaggtatatttggagaaatgggtataattgctttgataccggtaatcttgtttttcggttctggattattgactacagaagattttaacaattatccatggaatattgttatcttagccatgggaggtaccgctttgggtaaagctgttgcctcatcaggtttattgaatacaattgccgtcactattcaaagtcaaattgaagggttttcattatttggaattattttaactattggaatttttgtattaactattgctacttttattagccataccgtgtcagcattgattcttattccattggttagtgagcttggtcacaacatgcctgatcctcatcctagaatgttgattttatctacagcattattgtgtagtgcagctatgggattaccaacctctggattccccaacgttactgctatttgtatgacagacgaatttggcaagccatatttgacagtggggacgtttattaaaattggggttcctgcttcagtgatagcttatgtcattattgtaacagtcgggcatgcaactatgaaaattatcaatttttga

SEQ ID NO: 6647 - DNA, 420 bp, Candida albicans
tctatacacatcatgtcagcagaagaagtaatacaatacatttctagaaggaaattattcacggaaaataatgaatataatgaaagttatttattactatttacaattgcatcatcaatgatttggatcatgatacctggtttagcatttttatattctggattagcaagaagaaaatcggcattatcaatgatttggatagttataatgtcatcatttgttgggatcttccaatggtatttttggggttattcattagcatttagtgatacttcaaaaaattcatttattggtgatttacattttttcgggtttaaaaatttattaggtgcaagtgatgataaaacaacttatccagatatagcatattctttatttcaattacaattcttagttcgtgactttcgcaattatagatag

SEQ ID NO: 6648 - DNA, 528 bp, Candida albicans
aattatcgtcctcataatatttcgacaatttttttgggaacatcattattatatgttggttggttatttttcaatggattttcttgtggtaatccttcacttaaagtagcttattcaatgatgaatactcatttatgtggagcttttggagccatatcttggtgtttattggatttccgtttggaaaataaatggtctatggtagcagtttgttctgggtgtatttctggtttagtggctgctactccttcttcaggaatgattccattatgggcatcagtaatattaggtattactgctgggatagtttgtaacttgtcgactaaaatcaaatatttattacatgttgatgattcattggatgtatgggcagagcacggtatggccggagttgttggattgattttcaatgcattatttggttcagctacagttattggttatgatggagttactgaccatcaaggtggttggattgatcataattggacacaattacatattcaaattgtgtccaccacggcgtaa

SEQ ID NO: 6649 - DNA, 678 bp, Candida albicans
atattttccattggtaatgtaattaaagtcaaagttgacggtgataaattggggtatttacaattagaaggaatctctatggctaaactttttttccaagatttattgacttattggattttattttccaatttggtccccatttcattgtttgtcacggttgaattgatcaaatattatcaagcatttatgattggaagtgatcttgatatgtattatgaagaaactgatacacccacgggagtaagaacatcatcacttgttgaagaattgggacaaattgattatattttcagtgataaaaccggtacattaaccagaaatgtcatggaatttaaatcatgttctattggtggtcgatgttatattgaagaaatccctgaagatggacacgcccaagtaattgatggcattgaaattgggtatcatacttttgatcaattacatgcagatttgaaaaatacttcgactcaacaatcagcgataattaatgaattcttgacattactaagtacttgtcatactgttatccccgaagtgactgaagaaaaaattaactatcaagctgcctctcctgatgaaggagcacttgtacaaggtgccgctgatttgggttataaattcaccattcgtagaccaaaaggtcttcaccacggggctggcaggatccgcgcttaa

SEQ ID NO: 6650 - DNA, 975 bp, Candida albicans
ttggaaaaagatttatttttacttgttcccacagtttttgaagataaattaccagatggcgtccccgacacaattcatactttacaccaagcaggaatcaaaatttgggttttaactggtgatagacaagaaaccgccatcaatattgggatgtcatgtaaattacttagtgaagatatgaatttattaatcattaatgaacaaacgaaaaatgacacaagattaaatttacaagaaaaacttactgctatacaagaacatcaatttgatgctgaagatggatctttagaatcatcacttgcattaattattgatggacattccttaggttatgccttggaaccagatttagaagatttactcattgagttaggttcacgttgtcgagctgtcatttgttgtcgtgtttcaccattacaaaaagctcttgtggtgaaaatggtgaaacggaaaaagaaaacctcattattattagccattggtgatggtgccaatgatgtttctatgatacaagcggctcatgttggtgtaggtattagtgggatggaaggtatgcaagcagcaagaagtgctgatgtatcgattggtcaatttaaatttttgaaaaaattattattagttcatggtgcttggtcatatcaacgactttcaaatgcaattttatattcattttataaaaatattgctttatatatgactcaattttggtttgttttcactaatggattttctggtcaatcaattgctgaatcatggactttgacattttataatgtattatttacttcattacctccatttgtcttgggggtatttgatcaatttgttagtgctagattattggatagatatcctcaattatatcaattgggtcaaaaacggaaatttttcaatgtggcgattttttggacttggattttaaatggattttatcattcagcagtgattttccttgtgttcatttttcatttatag

SEQ ID NO: 6651 - DNA, 1353 bp, Candida albicans
ttttttgttgttgtttttttattaaaggctgtgttgtttaataaaacattgacaatgtccaattataatcggacagataatagcaaatctaatgctaatcccaatcccaatgctaatcctaataatcccttttcagataatgctaataatcttattgatttagatatagaatcaaatccttatggagatttcaaccctaatcatgtatatcctcaaacacaacgaaacacgaccactaacacgaccaccaccacaacaacaccccatgatccatttgctgatcaatttgttttaacagatgattcagatgaagacaatgatgatgatgatgatgtagatggacataatgctcataatacttctttcgcttcatcttcacaaaatagacaagtacctttactaaatacagctaatattcctaaatctcctactaatagatttttcaacacccataataccaacaacaatgaatatattaatatgacagataaacaagaaacgtcacgagattttgatataacccatattttccgaaaattgaaaagtaaaataactggtaaaccagccaatttaggtttaaatgatcgacaacaatctcatcaacaacaacaaccaagagaaatcaatataatgaatcattcagctaatgccgggtttggttattatgggaaccatatatcaacgacaaaatataatattgccacttttttaccaaaatttcttttcgaacaatttagtaaatatgccaatttatttttccttgttacatcgattattcaacaagtacctcatgtttcccccacaaatagatatactaccattggaacattaattgtagtgttggttgttgctgccattaaagaaatgtttgaagatataaaacgtgccaatgctgataaagaattgaatcgaactaaagttttggtgttggaccctgtaaccggcaattttaccttgaagaaatggattaaagttcaagtgggagatgttgtccaagtattaaatgaagaaccattccctgctgatttaatattattgagttcttctgaaccagaagggttatgttatattgaaactgcaaatttggatggagaaactaatttaaaaataaaacaagctataccagaaactgctcacttggtcaatcctcgagatttagttaaagatttaaataacgcccaaatattatctgaacaaccaaattcttcattatatacttatgaagggaatttgaaaaatttccgtcgtggtcccgatatcccgttatcaccagaacaaatgttattaagaggtgccactttaagaaatactcaatggattcttcaccaggcggatgggccgacaacgctcgga

SEQ ID NO: 6652 - DNA, 390 bp, Candida albicans
  unsure (6): Identity of nucleotide sequences at the above locations are unknown.
cgtggntccttccagcccggtggtgaagatgatgaatatagaggagttttaagaatgacttatccacttataacgttttggggaatggtatttggagtagcaatattatgtttattacgagattttgcttggaaatattttaaaagaagatataatcctgaaagttatcattatgttcaagaaattcaaaaatataatattcaagattatcgaccaagaatggaacaatttcaaaaagcaattagaaaagttcgacaagttcaaagaattaaaaaacaaagaggttttgccttttctcaagttgaaggtcaagatcaagataaaattgttagattatatgatactactaaaaaaagaggagtttttggggaattatcagaaagtaagtaa

SEQ ID NO: 6653 - DNA, 684 bp, Candida albicans
ggatcaaaaaagaaaacaagaatgtccagtctaacgatatatgctgccaagatattgctaaaacgagctatatctggtgatttggaagaagataccccagatctaactactcctgatgacgccgaagattcaaatccagttgaaaatgaaattttctcaagttgggcgttgttcattttattgtttttgttaatgagtgccttgtggtcatcatatttcttacagcaacgaagaatcaaggccgtccatgaaacagtattgagtattttttgtggtatgattgtgggattgatcattagaatgtcaccgggtcattacatccaggatgcagttaaattcaatccaggttattttttcaatattttattgcctcccattatattgaacagtggatatgaactacatcaagcgaacttctttagaaatttgggtagtattttgacatttgctatcccaggaacatttatatctgccttggttgtgggaataattctttacatttggacagctttagggttggataacgttagtttagaattcgttgacgccttggcagtcggagcaactttatcggccactgaccccgttacaattttgtctattttcaatgcgtacaaggtggaccccaaactatacactattatatgtgtccaccaacaggcaaagaaggtccattgtcggggg

SEQ ID NO: 6654 - DNA, 948 bp, Candida albicans
cccgacgtcaacacatggagagaggcgttattctgtggccatttcgggccaatcggtgtcggtgccatatttgccagtatcttggccagaaaagatttggaagcccactacaccaccgaagaaacgccgctacaccacctccccaatgaggatttccctcactaccagttgctcgccacaatctggccaatagtctgctttattgttattacatcgatcatcgtccatggatcttcagtagcagtgctaacactaggtaaaagactaaacagaatggccatcaccatgtccttcacaaccgaccaagaaggtaatggaagtggcgggtggatgcagagactccagaaactcgaccgtgccaccacctccttctccttacatcgtgtggatacaatggcaccaaccgaaaaactgcaaccagaaactaccggcacaaaagtgcgtccaacaggcggagccaagagaaagaagaaccacagagatgacagaacacccccagaagcgcagatcttacaactagggggcaacaaaacgccagaacccgaatcagcctcagacacccttgccatcccaaacaaaacatcagggttatctgcatttggagagaaaccacccacaaaagccgaaaaggcacctgtcccaaccgttgcttaccaagatggtgaccaagttattatcgaagaccagtatggtgaagtaatggaaaacttgaaattaaccaccaaaccagtacgcgcccctgatatcggaagtatccattctatggaatccttggagaggcacctcacacaatactcaactgggtctggcgaatacacaaccgacgaggatacccacggcttacaagaaaaattatctcggtcgttatcacgccggtcatactataaaaaagatgatccaaataaacgtcaagtatacgcccaccgtgttggagaatttgaatggtga

SEQ ID NO: 6655 - DNA, 1239 bp, Candida albicans
  unsure (1187): Identity of nucleotide sequences at the above locations are unknown.
caaatatcggtgttgttcaccgactcactatccgactcaacaaacaacatggcaagaacgtgttgtccaatttcaggtgatacaatttcttggcgcaatgtaacatttttccattacaaaaaaaaaaaaagaaccaccaaaatttttttttttcttatcaactcttcatcaccacactttgccatggcttggagtcagttagaattagaaccaccacacatagcctacgcttgtgtgggtattttcagtaccctattctcattagtctcccttttcgtcaaagaacgtctatacatcggcgaggccaccgtcgcatccatagcagggcttatcttaggcccacattgtctaaactggtttgaccccgtcagctggggtaattcagactacatcaccctagaaatctgtcgaatagtattatgtatccagatcgtcgccgtggcagtagagttgccgaaaaagtatatgatgaaacattggctctcagtgactattttcttgttgccggtcatgacatgtgggtggttgattgttgggctctttatctggtgtctcatcccccatttcacattcaacgatggattgctagtcagtgcatgtgtcacagccaccgacccggtcttggctgctgctgtcgtcggtaaaggaaagtttgccgaaagagtccctggccatttgcgtaatttgttgtcagcagaatcggggtgtaacgacggtatggcattcccatttattttcctatccctaaacttgattatccattctgggcacgccggcgaaattgttaaagactggtttttgttgaccatcctttgggagtgtattttcggctgtttattggggacagtcattggctatgtcttgcgtaaactagtcgcttttgcagaaaaccaaaaccttatcgaccgtgaatcgtttttggccattttcgtgtttattgcatttatttctgctggtattgggtcgatgttgggtgtggacgatttattggtttcgtttgctgcacgtaccgcctttggctggaatggggcattcgcaaagaaaaccgaagagtcacacgtgtctactgttattgacttgttgctaaacttgtcgtttttcgtctacttcggggcaatcattccttggccacaattcaataacgccgacttgggattgaatgtatggagacttgtcgtgttggcatntgtcatcatattcttgagaagaatcccgccgttgtcgccctcaaaccaataa

SEQ ID NO: 6656 - DNA, 1434 bp, Candida albicans
  unsure (45): Identity of nucleotide sequences at the above locations are unknown.
cgccgacttgggattgaatgtatggagacttgtcgtgttggcatntgtcatcatattcttgagaagaatcccgccgttgtcgccctcaaaccaataacccccgacgtcaaaacatggagagaggcgttattctgtggccatttcgggccaatcggtgttggtgccatatttgccagtatcttggccagaaaagatttggaagcccactacactaccgaagaaacgccggtacaccacctccccaacgaggatttccctcactaccagttgctcgccacaatctggccaatagtctgctttattgtcattacatcgatcatcgtccatggatcttcagtggcagtgctaacactaggtaaaagactaaacagaatggccatcaccatgtccttcacaaccgaccaagaaggtaatggcagtggcgggtggatgcagagactccagaaactcgaccgtaccaccacctccttctccttacaccgggtggatacaatggcaccaaccgaaaaactgcaaccagaaactaccggcataaaagtacgtccagcaggcggagccaagagaaagaagaaccataaagacgacagaacacccccagaagcgcagatcttacaactagggggcaacaaaacgccagaacccgaatcagcctccccttcagacacccttgccatccccaataaaacatcagggttatctgcatttggagagaaaccacccacaaaagccgaaaaggcatctgttccaaccgttgcttaccaagatggtgaccaagtcattatcgaagaccagtatggtgaagtaatggaaaacttgaaactaaccaccaaaccagtacgtgcccctgatatcggaagtatccattctatggaatccttggagaggcacctcacacaatactcaactgggtctggcgaatacacaaccgacgaggatacccacggcttacaagaaaaattatctcggtcattatcacgccggtcatactataaaaaagatgatccaaataaacgtaaagtatacgcccaccgtgtggacgatttgattgtgattgaaaatgaagatggtgatatcattagaagatacaaggtcaacaaacacgcacctgcaccaagagcacggtcggggtctatcatgggcatggtaaagtctatggtggggatcaagccaccaccagaaatcagtgtaaccgacctcgagcacggcacccagcacaagatcatactaccggaagaagaaaacacaccaatgagcagcaaaaccgaacaaaagttggaagacacaatagctaatatcctacaagaaaaccacacccaacccatctccgaagagagtgcggacgaggaggagacggaagttgaaaagaaaagaagattgcaagctttgggttacttgccaagtagtcgtcgcgatagagaagacgaagaggagtag

SEQ ID NO: 6657 - DNA, 1653 bp, Candida albicans
agacgtatttgtgtgaaaaagtgtccatttgatgctataaccattattaatttaccaaccaatttggaaggcgaaactacccatagatactcagctaattccttcaagttgcatagattgccaactccaagaccaggtcaagtgttaggtttagttggtaccaacggtattggtaagtccacagcattaaaaattttggctggtaaacagaagccaaatttaggtagatatgatgatcctccagactgggaagagatcttgagacatttccgaggttctgaattgcaaaactatttcacaaaggtgttagaagacaacatcaaagctattatcaaacctcagtatgttgataacattcctagagctttagccaagtctaaagttaaacaagtcggtgccattttggaatccaaaaacgagaagaatgatgactacaattacattttgaatgttttggaattgaagaacgttttgaaccgtgaagtcgagaatttatctggtggagagttacaaagatttgctttaggtatgacctgtgttcaagatgctaatgtttatatgtttgatgaactttcttcgtacttggatgtaaagcaaagattaagagctgcagaaatcattagatcattgttaaatcctactacttatatcatttgtgtggagcacgatttatctgttttggattatttgtccgattttgtttgtatcctttatggtgctccatccgtttatggtgtggttacattaccagcatctgtcagagaagggatcaatattttcttggatggtcatatcccaaccgagaacttgcgattcagaactgaatcgttgcaattcagattggccgacgccgcagatgatttgattttggacaaatctaattctttggaatatccaagcttgcaaaaaacccaaggggactttaaattacgtgttgaagctggtgatttcacaaattcagaaattttggttatgatgggtgaaaatggtactggtaagaccactttctgtaagcttttggctggagccattgccccagatggtggccaagaaataccaaaattgaacgtctcaatgaaaccacaaaagattgctccaaaattcactggtacagtaaggcaattattttttaaaaaaattagagcagcctttttgcacccacaattccaaactgatgttgtgaaaccattaaagatcgaagacatcgtcgaccaagaagtgcaaacattgtctggtggtgaattgcaaagagtcgctattgtgttggctttgggtatcccagccgacatttatttgatcgatgaaccatcagcttatttggattccgaacaacgtattatttgttctaaggttatcagaagattcattttgcatgccaagaagaccgcttttattgtcgagcacgatttcattatggccacctatttagccgatagagtcattgtttttgaaggtcaaccatctaaggatgctgttgctagaagcccagagtctttattaacaggatgtaaccgtttcttgaagaatttgaatgtcactttcagaagagatcctaactcctacagaccaagaattaacaagttggactctcaaatggataaagaacaaaaggcttccggtaattactttttcttggagaatactgaattgtaa

SEQ ID NO: 6658 - DNA, 627 bp, Candida albicans
atggttatttatactgggtttgtaattcctaaaccaagtatgttgggatgggccaagtggattacttatattaatcccgtaagctatatatttgagtcgattatggtcaatgagttttatgatcgtcaatttgaatgttcacaatatattccgtctggacccggatatgaaaatgttgattctaaaaataaagtgtgcactgctgtggggtcagttccaggagaaccatttgtcaacggaaccaactacttgaaatatgcttacgaatattataattcccacaaatggagaaatttgggtattgctattgcatttgctgttgtattcttgggagtttacatttggttaactgagtataataagggggcaatgcaaaagggtgaaattgtattgtttctcaaaagtggcttgaaaaaacacaaaagaaaaaatcaaaaagctactggtactgctcttgaagatattgaaacgggtaaatttagcaatgacaaattaatttatccaagtgacattgaagaagaagaaggaggtgctactgataagagactcaatctttccggcactgacaaccgaccagagatttttttctggaattttcaccacgggctggacgatccgcgattgcat

SEQ ID NO: 6659 - DNA, 1833 bp, Candida albicans
  unsure (1776),(1783): Identity of nucleotide sequences at the above locations are unknown.
cacgtttgggaatttgctgcaaaaatgagaacacctcaaaatagaccattgggtgtaagcagagatgcatatgctcgccacttggctgcagtggtaatggcagtatatgggttatctcatacaagaaacacaaaggtcggtaatgatttcattagaggggtttctggtggtgagcgtaagagagtgtcgattgctgaaataactcttaacaacgctatggtccaatgttgggataattctacaagaggtttagactcggctactgcgcttgaatttattagagcgttaaaggctagtgccgatattgtacataccacgccattggttgctatctatcaatgctcacaagacgcttacgatttgtttgacaaagttgttttgatgtatcaaggttatcagatttattttggaagtgccaaaaaggcaaagcaatattttattgacatgggatatgagtgtcctcagaggcaaacaaccgctgatttcttgacttcattaacaaaccctgcagagagaatagttagacaaggttttgaagggaaagttccccaaacaccacaagaattttacgagtactggaaaaagtcaccagagggacaacaaatagtggcagatgtggaccagtatttaactgaacatagtagtgctgccgaaaaagaggcaataaaagaagcgcatcaagcacgtcaatcagatcacttgaagcctgcatccccttacacagttagttttttcatgcaagttcgatacattgcccatagaaatatacttagaataaaggggaacccaagtatccatcttttccagatttttggcaacattgggatgtcttttatattgtcttccatattttacaatttacccactgcaacatcctcattttatcatagaactgcggctttatttttcgctgttttattcaacgcgttttcgtgtttgttagaaatattttccctttatgaagccagatcaatcgtcgagaagcacaagaagtatgcactttaccatcctgcagcagatgcgtttgcatccatagtcactgaattgccaacaaagtttattattgccattggattcaatttggtgtattattttatggtcaatttccgaagaactcctggcaactttttcttctatttgcttataaacttttctgccaccttggctatgtcccatatttttagaaccattggtgctgcgacaaagaccttgcaagaagcaatgaccccagcagctatattattattggcattgacgatatttactgggtttgtgattcctacaccaaatatgcatggctggtgtcgttggattaactatttggacccgttggcctacgcttttgaatcattgatagcaaatgaattccacaatcgtgattttgaatgctcacaatatgttccttctggtggcagctaccctactgccggacccaatcgaatctgtactcctgtgggaagtgtgcccggccaagactttgttgatggaacaagatacatggagatgtcctttgattatagaaatctgcacaagtggagaaattttggaattgtcattggctttatagtgttcttcttctgcacctatatcttgttgtgtgaaattaacaagggtgcaatgcaaaagggtgaaattttgttatttcaacaacgtgcattgaaaaagagaaagaaagcaaacaacgatattgaaagtggggaactagagaaagtaactcaaagtttgacaccgagtttgagaattaacaagaacaatggtacaatctggcgggagacnccttctnttggagagaattggacgtttccagtggaaattcaatccggaagaatgaat

SEQ ID NO: 6660 - DNA, 804 bp, Candida albicans
ttaatatcatttttagctatggcagatgccgatacgagttcaaattcgtcaaagacgaatgaagatagaagtcaagagggtttcggaacttaccaaggttacactgatagagttgctctggaagttcaagaattggccagaataatttcacacgcaagcattcagcagttgaaacttaaaagacaacacagcagacaagaatcacaaaagtccaatgaacaggaaagtgaattatcgggtaaactaggggttattcctgtggatgaaaatggtaatttcgttgatcaacgtttgaacccgaactcacctgaattcaacgcagcttattggatccaaaatgctcataagctagtatcttccgacattgactactttaaacctgttactattggtgttgcttataagaacttgcgtgcttatggttcggcttctgatgccgattaccagagtactttggtcaatctcattcccaaatatctttcgttgttttttagagagtacattttgagacatactggtcccacttttgatattttaaaaccaatggatggattgattaaaccgggcgagttgaccgttgtcttgggtaggccaggtgctggttgctcgacatttttgaaaacaattgcttcacagacttatggttaccacattgacaaagattctgttatcagatacaactcgttgacacctcatgaaatcaaaaagcactatcgaggtgaagttgtatattgtgccgaaactgaaaaccatttcccacaattaacagtccgtgacacgtttgggaatttgctgcaaaaatga

SEQ ID NO: 6661 - DNA, 1842 bp, Candida albicans
caacaactgataatgtcgatttctgcatcaaaagctaaaagagagcaaaagcgtttagaaagagaagccaaaaaggctgctgttggtaaaagcactaaaaagaccaagaagcaagctgaaaaagatgctgctgaagatgaagtcgaaggtgctgaagaacaaattgccaaaatgaaattacaaacagatgaacatggcttgtccgatagagtcactactggtgttttggaatccttggaaacctcaagagatattaaattgtcatctgtttctcttttattccatggtaaagttttgattcaagattctacattggaattgaattatggtcgtagatacgggttattgggtgaaaatggttgtggtaagtctactttaatgaaatctattgccgctagagaattccctattccagaacatattgatatctacttgttgaatgaaccagccgaagctactgaatactctgccttagaatacgttgtcagagaagccgaacatgaaatgaaaagattggaagatttagttgaagagttgattgttaaggaaggtccagaatgtcctgcattggaaggtctttacgaaaagattgacgaaatggatccatcaacatttgaaagtagagcagcaattattttgactggtttgggtttcaactcagttactattaaaaaaaaaaccaaagatatgtcagggggttggagaatgcgtgttgcattagcaaaagctttatttgtcaagccaaccttgttgctattggatgatcctactgcccatttggatttagctgcttgtgtctggttggaagaatatttaaagagatttgatagaattttaattttggtctcccattcccaagatttccttaatggtgtttgtaccaatatgattgatatgagattgaaactcttgacaacgtacggtggtaactacgattcctacgttaagaccagagccgaattggaaaccaaccaaatgaaacaatataataaacaacaagaagaaattgcccatatcaaaaaattcattgcatctgctggtacttatgctaacttggtaaggcaagccaaatctagacaaaagattttagataaaatggaagctgacggtttgattcaaccagtcgttccagataaagttttcacttttagattccccgaagtggaaaaattgccaccaccagttttagcattcgacgatatgtcattctcatactctggtaaaccagaagataacttgtatgagcacttggacattggtattgatatggattccagagttgctcttgtgggtcctaatggggttggtaagtctactttgttaaaattattccaaggaaaattgcaaccacaaactggtagagtgatccaacatacacacatcaaattgggtgtctattcacaacattctgctgatcaattggatttgaccaaatctcctttagagtttgtgcgtgacaaatttgcaaacatttcacaagattatcaatactggagaggtcaattgggtcgttatggtttaagtggtgaagcacaaactgcccaaatggctactttatctgaaggtcaaagatcccgtgttgtttttgcattattggctttagaaggtcctaacttgatcttgttggacgaacctacaaatggtttagatttaggtactattgattctttggctgatgccatcaatgcctttaatgggggtgtggttgttgtttcgcacgatttcagattattggataaagtggcaaaagacattttcgtcattgaaaataaaacagctacaagatggaatggatctattttggattacaagaaatcattggcttccaaagttgtattatag

SEQ ID NO: 6662 - DNA, 843 bp, Candida albicans
  unsure (756): Identity of nucleotide sequences at the above locations are unknown.
atacccattgattacactttagcattcgaggttaaaaaccttacttacgaattcccaaacagcaaaaagatcgggttacaagatttcaatttagccatcccctggggcacaacgaacttggtagtgggaccgaatggtgccggaaaatcaacattattacgtatattagctgggaagacattgatcaagaaaggccatctcagacttggtggatttgacccgtttcatttttcatctcaacgtcacgaacaagccaactccgatattaataattatataacatacttgggcacagaatgggcaactaattccatcattaaaagggatatacctgtcaacttgttacttgcttctattggcggagaaacatatcaagatagacgcaatttgttaatcgacatattggatattgatccaagttggtcaatgttgaatataagtgatggcgagagacgtcgagtgcagattgccatggggttggtgaagccttggaagttattacttttggatgaagtcaccattgatttagatgttgtagtcagactgaagttgttgaactatttgaaacaagagtgtcaggagcgaaactgtactgttgtgtatgctactcatatatttgatgggttgggacataagtggtgtgatagagtgatacatatagatgctggtcttaagttgaatgatgtgaaaatcaaagacatagagtttgtgaatgacgatggtagagttgaagttggcgacgaaaagatcattgtnagcaaagctgaatccttacatccattggcattattctggttaaataaggatctaaaaagaagaagaccagagatgacgaaaaattga

SEQ ID NO: 6663 - DNA, 825 bp, Candida albicans
ccgaatggtgccggaaaatcaacattattacgtatattagctgggaaaacattgatcaagaaaggccatctcaaacttggtggatttgacccgtttcatttttcatctcaacgtcacgaacaagccaactccgatattaataattatataacatacttgggcacagaatgggcaactaattccatcattaaaagggatatacctgtcaacttgttacttgcttctattggcggagaaacatatcaggatagacgcaatttgttaattgacatattggatattgatccaagctggtcaatgttgaatataagtgatggagagagacgtcgagtgcagattgccatggggttggtgaagccttggaagttattacttttggatgaagtcaccattgatttagatgttgtagtcagactgaagttgttgaactatttgaaacaagagtgtcaggagagaaactgtactgttgtgtatgctactcatatatttgatgggttggggcataagtggtgtgatagagtgatacatatagatgctggtcttaagttgaatgatgtgaaaatcaaagacatagagtttgtgaatgacgatggtcgagttgaagttggcgacgaaaagatcattgtaagcaaagctgaatccttacatccattggcattattctggttaaataaggatctagaaagaagaggaaccagagatgacgaaaaattgaaaatgagtaaacgacacaacgattacgtcaattccagagatggtaaatattttgatgctgacgactcaaaacttgcacaatatttcaaaagcacaagaagcagcaaatag

SEQ ID NO: 6664 - DNA, 276 bp, Candida albicans
gatgaaacaacgtcctcaattgactacaaaacagattacatattccaacgaagtgtaagagaacactttaataatctggatattttaactattgctcatagacttagaatattcatggattatgataaaatgttattcttggatgctggtaaagtagtagagtatgataatccgtatgtattaattacacacacagattcattattttacagtatgtgggaaaatagtggtgaattggaaagtttgattaaattagcaaaagaagcttatatgtag

SEQ ID NO: 6665 - DNA, 336 bp, Candida albicans
ttcaaattatacgcaattgatagtggacaaaaacagagagtgtcattagcaagaacattgatacgtgaccccaaaattttaattttagacgaggcaacctcagcattggattctgtcagtgaagaaatagttatgctgaatttgattcaattgaataagaatagaggtgtgacattgatttcaattgcccatcgtttatcgacaattaaaaatagtgatagaattattgtgttcaaccaagatggccagatagtagaggatggtaaattcaatgaattgcataatgatccaaacagtcagttcaataaattgttgaaaagccattctttagaataa

SEQ ID NO: 6666 - DNA, 501 bp, Candida albicans
gcccccccctacgatgatcctcgcccggcggtgaagatggatgagttgaatggagatattgagttcaagggaattgatttcacatatccatctcgtccggagtctggtatctttaaagacttgaatcttcatattaagcaaggagaaaatgtttgtttggtaggaccatcgggaagtgggaaatctactgtgagtcaattgctcttgagattttatgaccctgaaaagggtactattcaaattggcgatgatgttattacagatcttaacttgaaccattatagatcaaaattgggatacgttcaacaagaacctttgttgtttagtggtactatcaaggaaaatatcttgtttgggaaagaagatgctactgatgaagaaatcaataatgctttaaacttaagttatgcttctaactttgtcagacatttaccagatggtctaaataccaagaatggtgcttcaaatcctacgcaattgagtggaggacaaaaacagaga

SEQ ID NO: 6667 - DNA, 900 bp, Candida albicans
ttgcaaataagtcaattaaacaagatgctggttgaaacttattcttggtcaaatattagtttgacattacaaaatggcaagacaattcttgatgatatttatggctctgttagtgctggagaaatgttagctattatgggtccatctggctgtgggaagtcaactttgcttaatgtgttggcatatagaactagtccacgttcctcgacccttgaaggtggtatatttatcaacaatgaacgtgcaactttaaacaaaatcaagcaactttcgagctatgttgaacaagaagattctttgatcggctctttaaccgtcctggaaacagtcgattacagtgcacagtttgctggtattgataaagcacacaaaaaagaacttgttagcaaaacaatcaagtcacttggattagagggtcaggctatgctgaaaattggtactccgattcaaaagggcatttctggtggacagaagagaagagttagtattgcttctcaaatcattacctccccatcaattttatttttagacgagcccacatctggattagattctgttgcgtctcgtgaagtcattagcactattaaaaaaatcgcaaagagagagaatatggttattatttgctccattcatcagcccagcacatacacatttgaactttttgacaaggtaatgtttctttccaaaggtagaacagtctataatggcgctgttagcaatgtggtcaagtatttcaactcaattggacacacgatgcctccgtacattaacccagctgaatacgttttggatttgattaatacggattttcagggtgattctagtgttcttgatgacttggtatctaagtggaacagcggagacgttcacaatgtgtattcgccacggggctggaaggaa

SEQ ID NO: 6668 - DNA, 861 bp, Candida albicans
aggtttatcaacgtgggaatagttattattggtgtgacagttggttggatgttctatcgtccaaagcacgaccttgccggtataagatcattgacatccactctttatgtcgccatggaaattatgggatttgtaccaatgtattttgaaattgcacgtttgtgggaaacagatggtgtatttttttatagagaatatctggaaaatcaagtgagtattcctggatttttgatttcccgcagattaggaaaactctttttagaagatttgcccatgtcattattgttttccattattacgtttttcatgtgggggttaagattaggagatggaagccattttggaatttattttgtcgtcgtgtttttaatagaattatgttgtatgggaacagctatgttttcatttgctattgcccccagctatcccatttccgccttacttatcaacttaatttatcaaatccaaaatagtgcttgtggatattttgtcaatgcagcaaccatgccagtttatgtgaaatggacaaaatatctcgcttatttttggtatgcatttggtgcgttaacaaacaatcaattcagtggttggcatgggaaatgtccatataatgatatcaacgatccaagatgtcaagaattttctggggactatcaaatcaaaatactagggttcccagttggatgggttggtgcaccaattggttacttggtgctttggacagtgggatgctttgtgttgagtggtattctattctatttcaaacagcatgatgtatgcatggctaaaactaagaaaaacactattggagaaagcgatgaagatcatgaagctttacatcaaaagaaaacagaaagataa

SEQ ID NO: 6669 - DNA, 1557 bp, Candida albicans
atggtaatccagggatattgtgggattcgactttctgaattttctgcctatggaattcaacatgacagttttttgattgaacaattgactgtccgtgagactttatactaccaagcaaaacttcgtttgcctttggatcagcataaatttatccccactattattaacaaattaattagacaaacagggttggttgattgtgcagatacgttgattgggtcggaatatgtcaagggtattagtggtggtgaaaaaagaagggtttctattgctattcaattgttgagtaaacctaaagttttatttcttgatgagccaacttccgggttggactcatccactgcagaaacaattcttacattgttgggtgaattagccaaggaaaacaataccaccattattttaaccatccatcaaccaagtgaacaattgttttataagtttggatctttgttgttattgggtagaggaggaaaagttatatatgatggaacttcagtcggtattgttgaatatttggaaagtttagggtataataatccagagggccacaatattgctgattatatattggatttaatatctcgtgggatgaatgaagacaaaatgcaactggaaagaagagtagccgaattgatttcttattggcaagctaatagcatcaagaaattatgcagcacagccactttcctgcaagagattattgatttaccccagtactattatcaaagattgccaatatttattacgttcccaactatattccgaagacaattattgacgtcataccgtgccaaggatgttgttattaatcgagccggacaaacaatttttttggcaattgtccacaccttatattttacaccattaagaaacacacaggaagggattagcaatagattggggttggtgcaagaagtgcttaacttatatttcgctggattgattaacaatatcacattatacccatttgaaagaaacttgttttatcaagaataccgtgatggaatatatggggttactgagtttgggttatcatatttaatcaacgaattaccaacagaagttattccatgcttcttttttgcggctttgattgtttttgcttgtggattacccagaacgccacaaatgttttttgcaatgtttggtactgggtttgtttctatcaactgtggtgaatcattagggatttttgtcaatagtatttttactcatatgggagtggcaaccaatgttttgagtacctttgtttccttggctattttcatgggaggtacaatgtcattgcatatgcctggatttttcaaaggaatcaattttattagtcctatgaagtatgctgtcgctatctgtgccaatttaggtttcaaaaaccagagtttcaaatgtaatagcgaagcggctgattgtcttttaacaacaggggaagatgtattgagctactacaatatgaaacaaaatttgggcccaatggtcggtggattaattggatgtcttgttatttatagagtggttgctattttatcaatttacgtcagagttaaatggttttag

SEQ ID NO: 6670 - DNA, 2232 bp, Candida albicans
atgataatattaccgtctgtaaggaatttgttattcctttctagtaggaaaagtataaaggtactacctgctcgacagtatcttcaaaaccttacatttacaagcacaagactcaacttaatacattcaacaccttcatcatatctactaaaaactgcatgcttgtcacaattcagaacgtatgccactacacctctgtataatttacccccttctcaagttttagtgaaatcacacctcgatgcaactaatttgaaaaagaaagagatcaaacaggaaagatttgaagaatttcaaaaacaagaaaacaaaaaaacgtttaaacagaatcttcgaaccattggaagaattatcaaattaggaaaaccagattggaaattgtttgtgttagccattggatttatattatgtgcggttttatacccaactacagccgttaaattagtggggtcggtattagattcatttaacaataacataaaagatgaagatggcgatttaattgtctggggatataaagtttctactgtatttgcagtaatgataccgtttatggctgttagtgccgtttgcttctgggccagaatttgggtattgaaattattgggagagagattagtagccagattgcgtgctagagtgatgaaaaacttattgcgtcatgaccaagaattctttgataatgataaacacaaagttggtgatttgatcagtagattatcgagtgatgcatacattgtcagtcgatcaatcacatctaacctacctgatggattgaaaaacttattatttggattgttaagttcatatatgatgtatctgattaacccgatgctatttggaatgatgttgttaatctcacctccaataacaattggttcagtattttatggtgagaaaatcaggaaattatcgaccaatttacaaaatgccactgctgggttaactaaagtatctgaagaaactttgaattccataaaattaattaatgcatttactggtgagcaaaaggaattaagaaaatattctacgcgtttgagaagggtagttgatgttgcaaaacaagaagcatttgctcaatcaaactattcagtatctatttattcattgtaccacactggttatttggcatgtgtggccttgggagtttatttgatgacaaaaggtacaatgtcagctggagatgtggtggcattcaccatgtatctggaattcttcaattcagcattatacagtttaactactacatatttggaattaatgaaaggtgccggtgctggtgttaaactttttgcattgatcgattataaaaacaaggtccctgctatccaaggagaaaaagtgactacatggagacctacttccgtcaaggacgatatacagtttaatgatgtcacatttagttatccaacacgtccgaatcatacgatatgtgaccattgtaatttcaagattgttggaggaactagtacttgtatagttgcgccaagtggtgcaggaaattcaacagttgcttcgttattgctcagggcttatgatatacaactgggtgagattttaattggtggcaaaaatataaaagatattcaagtgcgggatttgagacgttatattgtcggtattgttcaacaagaaccagtgttattgtcagggactatattggaaaatattgtttatgggttgacttcttctgaaatcaacaagttgacaatgcaggatattatcgatgtttccaaacaagccaattgtcatgattttattgttactttccctgatggatatgataccataattgggaacagaggtgcttcattatcaggtggtcaaaagcaacgtatagctattgctagagcattgattaaaagacccaaagttttgattttggatgaagcaacttctgctctcgattcaaaatctgaaagtttgataaatgaaacattgaaaaatttgacaaatgaagggtcaatgacaataatttctattgcccatcgattatcaacaatttccaaatcggagtttgttgttgtgctaggtaaatatggccaagtcgttgaaacagggaaatttgttgaattatttagtaatcctgattcagagttgtcgaaattgttagatgaatctgcaacttcacaagcagcagcggatcgacaagaggaagaagaggaattacaacaagagaatcgtcataaaactcaagaagatgaacgagagcatattaagtgtctcaacacg

SEQ ID NO: 6671 - DNA, 1278 bp, Candida albicans
ctcaataatctaatacaaaagctatcatcatcatcgagtgaagaaacaaataaaaagtcatttagtagtgacaaagacaatattctagaaccatttgtatctgaagaaggaacatcgttagtagaccaacaacaccaccaccaacagggcaatactgacaccaccacgacaatggaaaccactccccattctacatcaagaataccgtcattaaacgaagatactagactttcttcatcttccgaactgatgccaatacaatcatcatcatcagcaaccgcgccatcatcaaatagatcagagcaaagagatttagaagatttagaactgcagactccacctagattaaccactaagcaacgaatacaaagagtgttgcaccatttttttcctgttagacaaacatatgaaagaataaacaatggattaaccactggaagaatgcaaaccaacaacggaagatttattggtcaaggtaccgatggggttttccggaacttgatggcaaaaccggatactgaagaaatgcgacaacaacaagagttaaaccctccgagttatgaagaagcagcagctgatgcatcaccagaatattgggaactgacaatgatatctcccatgtatgaagatgaagtatttgttcaaggtttacccgtgggtaatattgccaattttgtatggaacgccttggtatcagtagcatttcaatttgttggatttatcttgtgttatttacttcatacatctcatgctgctaaacaaggttcacgagcaggtttaggaataaatctaattatgtatggttggaatttggtaccacaaaatttcggtcatcctgataaattgccgaaaaaatatcaaccggaaaaccctaatgattttgatattaataaatcaaccaaaatatctggcaaagttgatggatataattcagggatattcatacagaattcaaatgccgacactaaggatagtaatggaggtgattggttaggtggttcagggagtgccccttatgttgcctatgggttaattgcctttggattatttataatattaaaatcattggttgattattatcgtgttaaacagttggaacgtgccattttaaatccaccttcaaatatgccggttaatacaaactcgattacaggggtagttgatgagattgacgaggaaaaccgtcatcgagagcaacaacaacaacaacaacaacaccaacaccaagaggaagaagaaccttattctcatcagcatcgaaatcacgatgatcattaa

SEQ ID NO: 6672 - DNA, 423 bp, Candida albicans
atcccctttgataacgttttttatgaagtttcccccatacataaagataatgtcattactgatttacataatcgtcttggaggcaaccaaagtagtagtgttaatgttgcatttattggtgacggtataaatgatgccccagcattagctaaagctgatattggaatggctattagttctggtaccgatattgctattgaaagtgctgatattgtattgattggtggacgtattaatcaaactgatttacatggagttgttaatgccttacaaatctcaaccgatactttcaatagaattaaaatcaatttcttatgggcaataatttataatattttcatgttaccatttgcccatgggttgctttttaccattgaatattgttttaccaccagttgcagctggtgctgccatgatgtttag

SEQ ID NO: 6673 - DNA, 2880 bp, Candida albicans
aagatgaagtcactggccatccttgaatcaaatcccaaccaaaataataatgtcacggtggttttggaagttttagatttacatactgctaaggatataacggatgttattaatatactagatgaattattccccaaactcaaatctaaagatttcgatcatcaagaacttactcttatatatgattctaatgattatgacgatatgagtatattaaatgccatatcagaaattggattccccgtgaaaatcttgtctagtacagcaccacaatgtaaaacaacggttaatattcaaggcatgacatgtggtgcatgttcagcttctataactgaagcattagagaaaactcctggggtttataaggcatcaatttcattggttaccgaaaatggattaattatgcattcacctaaattatcccctgaaaatattataactattattgaagattgtggatttgatgcacaaattgaaagttcaaaaactaaacaatcactggcaccagaatctctgcaagatcaactgaaaagattaaatactactattggaataattggaatgacttgtggtgcttgttcggcttcaataactaatgttttagaaaaattacctggagtggaaaatgtatcagtttcattgatcactgaagaagcttcgattgttcatgattctacgatcactacggttcaacaattaaaagaggcgattgaagattgtggatttacgccaacattcaataaatcaataaatttaaatcaataccaaaataccaatgattctaatgaagaagttactctaaaaattgttggagttaatcatactactgatttaattggtttacgttataatattgaagcttatttaagaagtatatcaggggttcaaaaattcgaactaacattacgtggtatgaatgctagttctaatataatgccgacccaagttggtacattaataactgaagaagatactattgctgatgttaaaagtcttgttaacgaattagttttccaatatgattccgatagtgttgggataagagatattatcgatggattaaatactatcagtgataatatcgaatttatggtgataaattcattggatcaatcatcagctactcaattgaaattattatcaaaagtcaaagatatcaattattggaagaaaattttcattcaaagtcttttatttgggatcccagtattatttttaaatcatactaagaattggcccatttggaaaactaccatgattttcccaggattatatttggtttcattattggaattgattctaagtacatatattcaattttatttgggttcagtatttataaagaaattctcatcatttttacgtaaaaaatttaaaggggctacaatggatgtattggtttgtatatcaaccatgtgttcatatattttttcattaacaactattatagttagtgtttggaatggacaaaaaaatggtcctccaccagtattatttgatactttggtgatgttgatttcatttgtgtcctttgggaaattattagaaaataaagctaaaggtgccacctcaactgcattatcgagtttattgtcgttaacaccatctacttgtactattattaatgatattcctggatatcagaaatttattgaagatcaacaatctttggaaaaatcagaaaagagtaatctgttatccatgcaagaattccccactagagtcataagtattgatttagttcaacctaatgatattgccattgttttaccaggaggtaaagttccagctgatggtgaaattgttttcggtgaaaccgaaattgatgaatctttaataacaggtgaaccattaccagtttataaaaaattgaaagataaagttataggtggatctattaatggacctcatttaattcatattaaagtgacacatactgggaaaaaatctcaattacaacaaattatcaatttagttaaagaatctcaagttaataaagctccagtacaaaaattctctgattatattgctgctagatttgtcccctttgtattgttattggcaatatttacatttatactttggatgataatttgttttactatccatcaagataaattaccaaaaattttccaaaatgaaactaatgggaaatttttcgtttgtttaaaattatcaatttcagttattgttgttgcttgtccttgtgctttgggattagcagcaccaactgcagttatggtagggacaggtgttggagcaattaatggagtattaattaaaggggctaaagttttagaaaaaatcactggagttaatataatactttttgataaaaccgggactttaaccactggtgaaatgtcattagttaatttccaaccaattatgtcaaaatcaagtataactatttctgattggtggaaattagtggggtcagtagaatgtcattcggaacaccctattggtagagctttaactaaactggctaaaacaaacttgaatttaaattttgatgatgatcattttgacaccacagtaaatgatattaatgtattgataggattaggaattcaagcaaatgtaacattagctaataacccacaaactcaatttaatgtttatgttggtaatgataaattaattgaatcaaaattcccaaatttattaaacaatattgatgaaaaattattacattcggccaatactgtatcacatgtcattattgacggagaatatagtggatacattgaattaactgatgcattaaaatctggttcttgggaagtggtcaattatttgaaaactcaaggctatattgttggtatggtcacgggtgataatcgtggtgccgctttaaaaattgctcaagaagtatga

SEQ ID NO: 6674 - DNA, 1911 bp, Candida albicans
gtccgcataatgcagaaatttatcattaattttgcaaatatccattgcgataaatgtgaaggaatcataagaaacgttgtgagtcgctattacaaaattagtgatgagaccgatttaaatgcaaacataaagccatctgaggttattttcaaactcgaaaacaatgaagttacgttgtatggtaatgatttaattgatttccatggcgatatcaagagtatcattaaaagtttggggaaatctgggtttgatattttgtcctgggatttacacaatggtgacgaaaccgtgagttcatcacaaattgtcaatactaatatccaaggagccaatgaacctgacggttttatagatattgttggaatgtaccacaaatttattaactcaagaaacaaaaagaagcatatgaaatactgtaaagtgtgtcaagagtcagaacaacacaagaagaagtcgacggattcagatttttcctcgagcagtgaggatacagtggttgaaataccacaccaagagtttagagcttcatttttggttacgggaatgacatgtgcgtcatgtgcacaatccatcactgacaacttaagatcgattttaggtgaatcaaaaaaagaagatgaacccaatttttctgtcaatgtgattcagcaatcagtggttgtgattattcctaacaaacagattattaacaaaatagttgatgcgatcaatgacatggggtttgattgtaaattaattgaagttctaccagtgcaaagatcggttaatactaaagttacagcattgattggaggaatgacatgtgctgcttgtgcaaattcgattgacagtgctgtcaaagaattaccttttattttggaaagtggaattaatgtggtgactaaagctgctcaatttgttttagaggatgacggcggtctgaatatcgccaaattaaaggagacaattgaagattgcggatttgattttgaattgttaagcaccgagaaagtcaattatacatcggggaaacaaaaaccaagatctatcaatttaaaagtaaatggaatgttttgtaaccattgtccagatattataacacaatatttaaccaattacggtgatgctgttgtcattaatgatccaatatctcttgaccacccagtgatcaagtttacatatgtgccactgcaaaccttaaaaacgaggaaaatcttgtttgatttgaaccacctcaaagatgatggtaatggtgggtatactataactcctgatgaaaaaggcgcttttgaatgtgaaattattaaaccagtgacagtcgatgagcacgttagaaagttggctcacagagaagttttaggcttagcaataaggttggccatagcaactttgtttgcaattcccacatttatatttggtattgttgctatgtcgttgttgcctaaacatcaccctttccgagtttgggtcgaagatccattatgggtgggaaatgtttcacggaactcatggatcttgtttattttcgcaacactggtttatttttttgcagctgatactttccatcgtaaggcaattaaagagataaaatctttatggtttcataaaaattcttttaaatctagattactcaagtttgggtctatgaatttattgatgagtttgggaacaactgtggcttattttgctagcattgttttaattgggttaagtgcaacacagaaacccatgacccatcatggattgcacacgacatattttgattctgtcgtatttttgtcattctttttgttaattggtaaattattacaaagttattctaaaagcaaaactgcggacgctatttcggagttatcaaagttgaaacaaacggaagctacattaatcgaggataacaaagatacacgtgttgatattcagttgcttgaaatc

SEQ ID NO: 6675 - DNA, 369 bp, Candida albicans
cgtggtcgaagacatcaatttttcgaaggtttggctttgtcttcgagaattatatctattaccaatgcaagtttgtcaactaaattagtgatggcactcatgtttgcattgatcacccctattggaatggcaattggtatcggtgttttgaacaaattcaacggtaatgacccctctactttaattgcattgggaactttagattctttttcagcaggtgtgctcctttggactggtttaattgaaatgtggagtcacgattggttacacggccacttgagaaacagttcttttgtaaaaactacagttgccttagtaagtttgattttgggaatgttgctcatgagcttattgggtaattgggcgtaa

SEQ ID NO: 6676 - DNA, 387 bp, Candida albicans
agatacattgttttggtgttccatcaaatgtttgaagggttaggtttaggtactaggattgcaactaccaattgggccagacacagatatactccatggattttagcaatttgttatactttgtgtacaccaattgctattgccgttggtttaggcgtcagaaaatcctatccaccaggttccagaagagctttaattaccaatggggtgtttgattctatatctgctggtattttgctttacactggtattgttgaattgatggcacacgaattcttatactctggcgaatttaagggccctggagggttcaagaatatgttattagcatactttgtcatgtgttggggagccggtcttatggctttgttaggtaagtgggcttaa

SEQ ID NO: 6677 - DNA, 1035 bp, Candida albicans
actttaaacatggttaatcataagaactcaggagggttagctacgaaagataacgtcagcatcactcaagatgaaatttcgcatgacgagatatctcaaagcgacactccatatattgacattagtttggatatagacgaagaagaagtacagcgccgcaacaactcgaaatggtttcaagtcaagaaattttggtgggatgggactgggaaacacccgaaggagcaacaatatttaatgaaattggattttttcttattaacatcgtcatgtttggggtactttatcaagaacttgaaccaaacgaatgttactactgcctttgtcaatggtatggatgaatactatggcatgaacaaaaaccaatacaactaccttttgacaatgttcaccatcggatacattattggccaaataccatcgaatatgcttttgcacaagatttctatcagatactatcttggtgggttggagattttttgggcgttcttgactctcatcatgattactgttccatctcataaaatcaaggcattgtatgcattaaggtttctttctgggtttactgaaagtgcatatttcccatgtttggagtatatccttggtgcacattatagcaaagacgaagtcagtaaacgaagtgcatggtttgccatttctggtaatttgagtggtattgtatctggtccgttgcaacaggcaatcattaaacgctttagcaaatcaggcatgccaccgttcaaatggatgtttgtgtttgatgcagttattagtttccccatcgggatatacactgtttttgctaaccccaacaccccatcaacaacaaatctgtggtatttcactgaagacgataagaaggttgggctagaacgccggagattgattggagctgagattaataccaaaaccaactattcgtggaagaaggtaaaatcgtttttcaacacctggcacatctacgtgtttcctattgtgttcttgtgttacaacaattcgtgtgctgcccttggccagcttcttgttatcgacact

SEQ ID NO: 6678 - DNA, 246 bp, Candida albicans
ctttatggactattttcctgttggaataattctaatgctagttccggtgcttatgcattatggttaaaatctttaaccgatagtgatggcaatcaaagatttacgggtgggaaattacaagattatactgctttgacacctggtttaggtttaatatggttaattttagcaagtacttttgctgatttgttcagatctcgatgggtgtattttatttatcttccccacgcgtggaaatcccaatcc

SEQ ID NO: 6679 - DNA, 1293 bp, Candida albicans
aggagatacttttatcctaagatctatcttataaattcattagatattccccataagagtttcaaaaatttcctccatttttttgtaaataaacaaattataaagacaagccccaatacaatcatgtctttcttttcagaaccaatatcaagattgaaatgggggattttcccaactagaagaattgttgatgaagatgaacatggaaattttatagatccagataccatcatggctaattcctctttagccccttcatctgataatgatgatgacgtcgcatcaatatcaaaaaccaatttggaaaaacttaaaactaaagaagaaatcaagtttatatcatcaacacccaaggctactcctgtggtgttagaatatcgtgatgaaaaaaatcgtccatggtggaaatttttcgatgaatatgaatatcgagtcactagtaatgtgaaatcaaaaagaaaatggtataaatggtttcatgaagatgatactcctgaagaacgtcgagtgattatgaaaattgatattttattaacattatattctttggcggcttattttgttaaatatcttgatcaactgaatttaactaatgcttatgttggtggattaaaagaaggtcttggtatgaaaggtaatgattttgttaataccggtgtaatgttttctgttggtaatatcattttccaaattccattcatgtatattgtttatgcccttcccttgaattatgttttacctgcgttagaattaggttggtcagtcttaacagtttgtttatatcgttcaggtaatgttcatggattaaaagctcttagattttttattggagcatttgaagcgcctgcatatcttgcatatcatgccttatttgcttcatggtttaaagcaagtacaggagaaattgctcgtcgagccgggttttattatcttggtcaatatcttggaattcttacatcggggcttttatcagggactatagttagacatttagatggtgctgctggtcatgctgcatggcaatggatttttattatcgatggaataatttctgttgttattgctatttttggattttatatgatcccggggacaccacaagattgttatagtattttcttgagtgatgaagaaattagaattgcaagaagaagaatgaaagctgatcaaaaagattctaaaccaagagaaaatgccgttaaatattttttcaataaagatatttggaaaaaaattttcacttcatggcatttctatgttttaactttatggactattttcctgttggaataa

SEQ ID NO: 6680 - DNA, 861 bp, Candida albicans
ttccggggacaccacaagattgttatagtattcttcttgagtgatgaagatattagaatggccagaagaagaatgaaagctgatgcgaaagattctaaaccaagagaaaatgccgttaaatatttgttcaataaagatatttggaaaaaaatgtttagttcatggcatttgtatgtgttatcattatggaatatgttttgttggaataattcaaatgctggatctggtgcttatgcattatggttaagaactcttaaagatagtgctggcaatttaagattcaccggtgggaaattacaagattatactgctttaacacctggtttaggtttaatatggttaattttagcaagtacttttgctgatttattgggatctcgatggggggccatattatttactcaagttttcaatatccttggtaatgtattattagcagtttggcatattccagaaagagcaaaatggtttgcttggtgtatgcaatatttcggttgggccatggctccagtattatattcctggcagggggatatatgtcgaagagatattcgtgaacgacaagtggttttagtatcaatgaatattcttgctcaacaatcaacagcatggattgctgtacttgtttggaaaaccgttgaagcaccaaggtttttaaaaggttatacttttactgcctgtagtgcttttgccttgtcggtttggactatggtggtattatggctttataaacgtgaagaaagagaaaatgctagagctaatggtattattctttacgattcttcaaaagaggatttagaacaagtacaagtacaattacaagctgaagctaattcaataaattctaaatctgaaaaatag

SEQ ID NO: 6681 - DNA, 1092 bp, Candida albicans
tcagatatttcccacaatagtttaaaattctgtttcaataatttttttaaaattatctttttaactattccccaaaccatgtcttttttcacagaaccaatatcaagattgaaatgggggattttcccaactagaagaattgtcgatgaagatgaacatggaaatttcatagatccagacactatcattgctgattcctctttagctcctccttcttccgatgatgttgcatcttcagatgaacattctggttcacaggaaaaacttgaaagtaaagaagctactcaattaatatcaacaacaacaacaacacccaaggctactcctgtggtgttagaatatcgtgatgaaaaaaatcgtccatggtggaaatttttcgatgaatatgaatatcgagtcactagtaatgtgaaatcaaaaagaaaatggtataaatggtttcatgaagatgatacacctgaagaacgtcgagtgattatgaaaattgatattttattaacattatattctttagcggcttattttgttaaatatcttgatcaactgaatttaactaatgcttatattggaggaatgcaagaaggtcttggtatgaaaggtaatgattttgttaataccggtgtgatgttttctgttggtaatatcattttccaaattccattcatgtatattgtttatgctcttcccttgaattatgttttacctgcattagatttaggttggtcgattttgacaatttgtttatatcgatcaggtaatgttcatggattaaaagctcttagatttttcattggagcttttgaagcaccttcataccttgcttatcatgcattatttgcttcatggtttaaaggaagtaccggagaaattgctcgtcgagccgggttttattatcttggtcaatatcttggagttcttacatcggggcttttatcaggtgctatagttagacatttagatggtgctgctggtcatgctgcatggcaatggatttttattatcgatgggataatttctgttgttattggtattattggattttatatgattccggggacaccacaagattgttatagtattcttcttgagtga

SEQ ID NO: 6682 - DNA, 663 bp, Candida albicans
tttgtgggagaaggtaaaattgtttttcaacaactggcaaataaaagtgtttccaattgggttctgggggaacaacaaatcgggtgttgcaattggccagcttatttttcgacatggcttagacttactctaaagaaaccttcgagtgtttataatagttaccgttctatcatcagtggtgttggcattgccatggcgttgttgtctgcatatctcaacgattatcttggtggtaggaaaaatgtttggtttgttagtgggttctttgtcccgttgataattggctgtgcgttgttggccaagtggaatatccccattggactccattacgtgtggtactttttgttcggggtacccacttcttggggccagccatttattttttcatggatcaaccggttattgtaccacaatgacatgaaacgaaattttgttgttgttgtcacgaatacattgccttacgttactggagcttttgtccccatatttgtttggaacaccaacgataaaccggaatattttattggctttagctatactgctgcattgtctgcattggggttggttgcaacgtttgttgcccactacttgactatacaggatgaaaatggggttaccctcaaagatttagagctgtatgggtctaccgagtttagcaaataa

SEQ ID NO: 6683 - DNA, 396 bp, Candida albicans
cttcttacttctaggaacatgtcattttttgttgaattatgggaatctgtttttacgccaggtactactcctgcattgattacagccacacatgcctcgttcatattgttaataatatccttattggtattaatattccttacaaaatcaatacattttattaatttattagtcatagcggtgttattgtatgcgtcagtattttggttcattaatgaattgcagcaagtgaagttacaaagcaataacgaactctcccaaaaagaacttgaaaaggaaagtgaatcggagaaattgtctgctaatgctactgaatcctcccaagaccactggcaaccgtcagaagatatcaaacttagaaaggagaaaggtataaatccaagctctactttgtag

SEQ ID NO: 6684 - DNA, 2466 bp, Candida albicans
gaatgtgacgcaccaaatgcaaatttatactcttttaaaggtacaattcattacgaaaattttgactctaagggcaatttagtcaatgaagatgaaaaagaggccatcactccagaaaatgtcttgttaagaggatgtacattaagaaatacaaaatgggtcattgggttctgtatatatacagggccagaaaccaaaatcatgctcaattctgggatcacaccaacaaagacatctcgtatctctcgtgaattgaacttgtctgttataattaattttattttgttatttgttttatgttttgtctctggtttgattaatgggttattttatcggaatgaaaacaattcaagagtgtttttcgatttccatccctatgggaaaactccagccattaatggtgttattgcattctgggtagcattgattatttaccagtctttggtgcccatttcattgtatatttccatcgaaatcatcaaaactatccaagcttattttatatatgccgacgttaaaatgtactatgatagattggatttcccttgtattgcaaaggcatggaatatatctgatgatttgggtcaaattgaatacgttttcagtgacaaaacaggaactttaacacaaaatgtgatggagtttagaaagtgcacaatcaacgggaagtcatacggattagcttatacagaagcacaacaaggcttggataaacgtgcaggcattgatgtaattgaaaatgccaataaatggaagaataaaattgctgcagataaagaagtaatgatggatgatttgacaaaatattccaataatgatcaattacgtgaagaaaatattacctttgtgtcgagccagtatgtaagggacacgtttttaggggactcgggagatgatcaaaagcaagcaaatgaaagattcatgtttgctttggcattgtgccacacagttatgaccgaagaaagtgaaagtgattctacattacgtgatttcaaagccgagtcgcccgacgaagcagccttagtttctgttgccagagatatgggtatcgttttcaaaaagcgattgagaagctccttgcttttagaaatatatggagaagaacaagaattccacttgcttgatattattccttttacatcagcaaggaaaagaatgtcttgtgttataaagactccagacaataagatcattttatacaccaaaggtgctgattctgttattttccaaaggctcaatcctcgagagaatccgaatgagcttgtgagcaaaactgcgctttaccttgaagattacgccaacgaaggcttgcgtacattatgtattgcatccaaagtattggatccacaagtttatgacaattggaacaaacgttacagagaagccagctcatcaatctctgatgatcgagaagtcctaatgggtcaactagaagaggagattgagcaagatttggtattattaggcggtacagctatcgaggacagattacaacacggtgttcctcaatcgatatctattttgagtgaagctggtatcaaattgtgggttttgacaggggatagagttgaaaccgctattaatattgggttctcgtgtaacttgttagaaaatgacatgaaattattggttgtgcgacccgaatcaaacgacactcaagattgtgaacaaattgacgacttgattaccaagtacctacaagaagagttccacattgacgccagctctccaagtttagttgcagatgctataaaacaggctagaaaagaccattcaatcccacaagcaaaagttgcattggttattgatggagctgctttgtcattgattttccaagatttgaaagactgtcctaatgataccataagggtattgcaggataagtttttgttgttgggaaaacaatgtcgatcagtactttgttgccgtgtctccccttcacaaaaggcccaagttgtaaaattggtgaggactgggttgcaagtaatgacattggctattggtgatggtgccaacgatgttgccatgatacaagccgccaatgtcggtgttgggattgctggtgaagaagggagacaagctgttatgtcctcagattacgctatagggcaattcaggttcttaacacgtttacttttggttcatggaagatgctcttataaaagattggccgaaatgattccttgttttttctacaaaaacgttgtctttacattaacatgcttttggtatggtatttacaacaattttgatgggtcgtacctttatgaatacacttatttaatgttctataacttggcgtttacttccttaccagttattgttttggctgtgtttgaccaagatgtttctgataccatttccttgttggttcctcagttgtacactagtggtattttgggtaaagattggtcgcaatataaatttgtatggtacatgtttgatggtctttaccagtcggtaatc

SEQ ID NO: 6685 - DNA, 2445 bp, Candida albicans
aaacaaagagacatcgttggggtactactcgtcataaaacatcgtagacttaaaaatgaaaatatcaatcgatcgaaaacttttgaagaaaaatattggcacctcattaaaattaaaggaaaatctcactcaaagaattcccattcccttaataaaagattactttcgatacggaaaccaaacactcatcgagtgaattttcatcatgataatcagccaccaccacaagatctagatttcgaagaacagaatgatccgaaaaatagaaaatcagagaaaagaaccgtcacattcaatcgaccattacctccccatttagttgatcccgaaactaataaaccactaacaaattatcctcgtaataaaattagaacaacaaaatatactcccttgagttttttcccgaaaaacatttggaatcaatttatgcataatgttgctaatatctattttcttgtacttattattttgggtgcatttgaaatctttggggttccgtccccagttttagcagccgtcccgttaattgttattgttattataacagccatcaaagatgccatagaagattcaagaagaacagtgactgatttggaagtcaataaccaaatcacccatatcttaactcaagttaatgaagacgctgccaatggatatcattatgaaaacgtcaatgttgatgacgaacaagtttcttattggagacaatttaaaaaatggaacactcgattattaatcagattctggggagccctgaaacgtaatttaactaaagagggaagagccaataagattcgtgaacgatataatcgagagaataatattgatggtgacggtgaccaacaacaaggtagaaagtcattcgatagcgatattgtgtctaacagaacctcatttgaacaaactgaaaatccatttaatgacacattaagacaatcattccaacaacaacgtcaaaaacagcaacgccaatcctcatcataccgtcacaaaacaatgaaatttgccaaaaagtattggaaagatgtcaaagttggagatgtgttacgaatttataataacgatgaagtccctgctgatcttgtaattttggcaaccagtgatgaagataattgttgttatgttgaaaccaagaatttagatggtgaaaccaatttaaaggttaaacaagcattgaaatactcttcaatcaatgaaaaaatccacaaagccgacgatttgatcaatcacgattttgaaatcgactctgaaggacctcatgcaaacttgtattcttatcaagggaatttaaaatataccaatagaatgaataactcacaatcatacgacaaccacgaagattctcaagaagcaatcactattaacaacttattattgcgtggctgtacattgagaaatacaaagtgggctattgggatagttgtgtttactggtgatgataccaaaatcatgcttaatgctggggtaacgccaactaaacaatcaagaatgtcgcgagaattgaattattatgtcttgttaaattttattttattgtttgtcatttgttttatttctgggttagtcaatgggatatattatcgagaaacaaacacttcacgagattattttgagttcggtaccattgccagtacaccagcattaaatggtttagttggattttttgtatcattgattttgtatcaatcattagtgccgatttctctttatattaccattgaaattatcaagactgcacaagcattttttatttattctgatgtggggatgtattattctaaattggatttcccctgtactcccaaatcatggtcaatctctgacgatttgggacaaattgaatatattttcagtgacaagaccgggacattaacacaaaatttaatggaattcaaaaaatgtacaattaatggagtttcttatggtaaggcttatactgaagcattggctgggttacggaaacgtatgggaattgatgttgaaatcgaagcagcacaagaacgtgagttaattagtcgtgacaaagaagttatgattgagaaactacacactattaataaaaataaaacttatgatgatgaaataacatttgtctccctggaatttattgatgatttgactgactcttcaattaacaaccaactgcaacgtgaaagtaatcaccactttatgttagctttggcattatgtcattcagttatgactgaaccagatccaaaacaaccaaataaattaatgcttaaagctcaatcacctgatgaagccgctttagtgggaacagctcgttctttagggtttcatttcaaaggtacaactaaaactggagtaatagttgacgttcatggagaaaccaaagaatatcaagtattgaacacattagaatttaactcaacaagaaaaagaatgagttcagtcttcacccacgcgggcaggaaaatccacgct

SEQ ID NO: 6686 - DNA, 555 bp, Candida albicans
gatgaacccagggcattattgatatgtaagggggctgattctataatttatgaacgtttatctgctactgaaaacgatccttccatgttggaaaagacttcaaaacatcttgaggaatatgccaccgaagggttgcgtacattatgtattgctgaacgtgaattgagttggaaacagtatgttgaatggaataaacgtcaccaagctgctgcttcttcattagatgaccgtgaagcaaaaatggaggctgtagccgattccattgaacgtgaattgactttgttaggtggtactgccattgaagatagattgcaagatggcgtaccagatgctatttccattttggctgatgctgggatcaagttatgggttttaacaggtgataaagttgaaactgctattaatattgggttttcttgtaatttgttaggtaacgatatgcaattgcttgtgataaagactgcctataatgatgatgaaaacggtagcaacgatgacaattcttcagaggatcttcacccacgcgggctggaaggacacacgctcgcgggtgca

SEQ ID NO: 6687 - DNA, 390 bp, Candida albicans
ccatttgctatgtcagagtccaaagatcaatcaacagactcaaccggttcacctggtctccaatcacgtggggagcctcaaccgccaagttttagagaaaagatacatcgatttttctttttgaaaggattggcagatcggccaccatatttacaggaaatttatgacaatacccctagaactgttttttacaattatgatttgccagattatatgatagattcacagggtcgtcccatcactcagtaccctcgtaataaaattagaaccactaaatataccccaatcaccttccttccgaagaatttgcttttacaattcacaaacgtagcaaacagttattttcttttgattgttattttgtccttcaccacgcgaagaaggaccgaa

SEQ ID NO: 6688 - DNA, 501 bp, Candida albicans
tttagtgcaatgatcccaagttttttctacaaaaatatcattttcaatattgcattgttttggtacggaatttattgtgatttcgatggaacatatttatttgaattcacttatttgatgttttacaatttagcatttacttcgttacctgtgattttcttggggatttttgatcaagatgtggaagcaaaagtatcattgttagtaccacaaatttatcgtacaggtattactagaacagaaatgagtgatctcaaattttatttgtattgtcttgatggaatttatcaatcagcaatatcatattttttcccctatttgttatacatggtggcattccctaatatgaatggtaaaccagtggatcatcgattttggatgggggtgttagttacatgtattgcttgtatttcatgtaattgttacatattattccatcagttccgatgggattggttgagttcattgattgtcttcaccacgcggtggaaggaccacgct

SEQ ID NO: 6689 - DNA, 2457 bp, Candida albicans
  unsure (93): Identity of nucleotide sequences at the above locations are unknown.
aacatgggaccccgcaaaaatttcataagtaaagggaaaggaaggaaatttccttcaccaagaaacaagcacggcaggttagaaattcatggngacaacccaaacaaagtgcaggaatatccaaattcgttgcagttgttaagacattattcattcacaccctcaaactttgtttgccaaaaaacccaattcttattattatcaattgcattatgtaacacatgcttaccgaaaaagaaggagaacgagtcaaagtgtaattctaataattcgactttttcattagaggagacaggaacggaagaggatccacaagatgacgcttgtattacctaccaagctgcttcacctgatgaattggcattggttcaagctgccagggatttgggatttgttgtatatgatagacaaaatagcaaattaactataaagacttaccctgatggatttagtaatgagccaaaatatgaagagtatcaagtcttagatgttatagagttttcatcagcaagaaaaagaatgtcaattgtggttcgattccctgataacagaatttgtttattttgtaaaggagcagataatgtgattttagaaaaattgaaaaattctaaattggcacaagctaaagccagagagatttccttacaatccgcagaaagaaaaacacaagaagcggatgttattttgcaatcacgactttctcaagaggttgaagcaagaaaatctggattatcgttccgtcacagtttgaatttggggagtgccaattctacacggattaacactatagataacgccttaatgggcacagaagatagggagattgcagatatagcattaaaggcaagaaaatcattacatttccaacaatcaaaaaagtacaacttggattcagaagaatgcgaagatggtgcagaaacgtctcccaacacaaccaccgttggaggaatatcttccgaattacccccacattatattcccaatgataagcttttagtcaatgatgagtttttaattgaaaaaactttacaacacatagaagagttctctactgagggtcttagaactttactttattcgttcaagtggatggataagaaagaatatgaaatatggagtcaagagtatggcgaagcaaaaacagctttgagtgatagatccaagttagtagaaaaagtgggagcaaaagttgaaaccaatttgcagttattgggcgccacagctattgaagataaattacaggatggagtaagcgaagctattgacaaattgagacgtgcaggtatcaagttatggatgcttactggtgataagagagaaacagccataaacattgggtattcttgtcgtcttattaaagactattccacggttgtcgttctttcaaatgacgaaggtagagacgcgttagtggatcgattaacttcttcgacccaagaaatcaaggcaggaagagttgcacatagtgttatggtaatagatggtggtactttagctgatgttgagctggatccaactttattaacttcttttctcgaattatgtgtcgaagttgattctacaatatgttgtcgtgcatctccttcgcaaaaagctaatatggtgacagcaattcgaaatttgaaaaaagattgcgtcactcttgcaatcggtgatggtgccaatgatattgccatgattcaaagtgctgatattggagtaggaatcacaggaaaagaagggttacaggcggctcgttcagcagattatgcaattgcacaatttaggtttttgttaaagttgttacttgtcaatggtcggtacaattatgtcagaacatcgaaatttgttctatgcacattttacaaggaattgttgttttacttgacacaatgtatttaccaaagaaataccttattttctggatcttcaatgtatgagagctggtctttatcaatgtttaatacattgtttacatcgttgcctgttatttgtgttggtatgtttgacaaggatttgaaaccagcaaccttattggcggttcccgagttgtacgccaaggggagactttatcaagctttcaatttaaaacttttcatttcgtggatggtgcttgcaaccttgcaaagtgtggggatttcctttttatcgttctacgtttggggatttaccgcattgcgtgacaacacaacgtttgctctaggttcattagtatttacagtattggttgtggtaatcaacgccaaatgtactttgattgaaatgcagaatagacaatggctagcttgggcttcgtttatcatatctgttggaggctggggaatttggaacgtgttgataatgggtttgtacagacacaagcagccaacaatattttttgtcgattatggcttaataatgtggggccgtgatcaaagctggtgggccacattgttgcttatgataactattccgttgtttttcgatattttgggttaa

SEQ ID NO: 6690 - DNA, 990 bp, Candida albicans
agttttcgggaacatcatactagtgataataacaacaagaatatgagtgatacacaaacctcactgacatctcagacaggaatacagaataattcaaattctctggaacctagcaacaataattcactacaagtgcctaccccacctactactagaagaaaacgtggtttatcgttgaggtcccagcttttcaataaagcattcaatatccaaccacagccatcagaagaaatacaatcatctgtaccacatttgcaatcaccggaatcaaacaacaatctagcgaatgaaacaaatacatatccaacttttgaccatcctcaacaaaatatagaacttcaaaatattccaataacacctgaaatcaatgtttatgaagcaccagatcaattccccacatccttgacatctatatcgaataatgatttacatacaaattatccatcgcatttaagcagatcaaccacacatttgacagcggggtccaacaggacaagtattagcacacagtcttttatttccaaaagagaaagatccgactggaaacgttatggcagcaaaaatagattctaccaagttttagtagacatcaaaaataggattttccacataaaagatttaccccctactgaagaaggacgtataattcctttgacggttgaccccaaatttacaaattcatattaccaagatgagtattacgataaaaaatccaaaggatatattgacgaaagatctaatgaaccatatatcgacaatatgataacctcttccaaatacacagtgtactcttttttgccaaaacagttgaaggcccaattttctaaagttgcaaactgttattttatggttgttgccattatgcaaatgattcctggatggtctactaccggtcatttcaccacaattatcccgttatgtattttcatgtccatatcaatagctcgtgaaggtttcgatgactggaaaagagatcgtcacgataaagag

SEQ ID NO: 6691 - DNA, 579 bp, Candida albicans
agtctaaataacttattggcaatttcatcagcctcttcactctctgacattgacgattcagtttccaaagaagatctttgttttacaaattctgaattgatgcgacgctacaatcttaaagaatataccacgaaatggaaaaatgtgaaagtcggggacatagtcaaaatcaatgagaatgaatggtttcctactgacgtgattttgatagctaccagtgaattggaaacccaagaggcttttgttgagacaatggctcttgacggggaaacaaatttgaaacaaaaaagtccgcatccagagatagctaaaaaggcatcgactgtaaccggattaaagaatctacgcacactagttacagttgaagatccaaataaggatctttataattttgaagggtcttttattttaaacggcgcaaagcatccacttggaccagataatgttgtttaccgtggaagtattttgaggaataccaaatcagtattgggactcgtaatattcactggagaagaaacaaaaattagaatgcacaatattaaaaacctagtattcagcccggggtggaaggaccgcagt

SEQ ID NO: 6692 - DNA, 993 bp, Candida albicans
acattgatgggatttattattatgtataatacactcattccgttgtcactttatgtaacaatggaaataatcaaagttatgcaattgtgttttcttcaatttgacatagatatgtaccatgtggaaaccaacactccagctgatgcaaagacagcaacaattttagaggaattgggtcaagtttcttatattttcagtgacaaaactgggacacttactgataacaaaatgattttcagaaaatttagtgtttgcggagtaagctggttacatgatttggatattatgttgagtgaaaagcaagaacccaatagtcaggtgacagcacctttagtaccaaggcacagtgtacatattcaatccccagtgacgaacagaaaaagcatcaatggcaggtcatcaatagaatctacacatagagacagcacaacctcaatagtacgtgaaagtatggatattccatcaccaagaacaagtacggcagcttggaaatcatcggcacagccaaacaaagtgcaggacttatcaaattcgttgcagttgttaagacatattcaatcacaccctcaaactttgtttgccaaaaaagccaaattctttttattatcaattgcattatgtaacacatgcttaccgaaaaagaaggagaacgagtcaaaatgtaattctaataattcgactttttcattggaggagacaggaacggaagaggatccacaagatgatgcttgtattacctaccaagctgcttctcctgatgaattggcattggttcaagctgccagggatttgggatttgttgtatatgacagacaaaatagcaaattaaccataaagacttaccctgatggatttagcaatgagccaaaatatgaagagtaccaagttttggatgttatagagttttcatcagcaagaaaaagaatgtcaattgttgttcgattccccgataacagaatgtctttattcttcacatcgcactgccgatccagt

SEQ ID NO: 6693 - DNA, 801 bp, Candida albicans
  unsure (768): Identity of nucleotide sequences at the above locations are unknown.
atatatggggtgctatttctaactcccacgggtgccggttcaaagtttgggtggattggtcgcagtccgtgtgttgcttgtgtggtcggatccgcatttccccgtgggcccttgatgatctgttcaagttggtatgacaaaaaaacacttgcctccagaaactctattttatacgctgggctgttaattagttctgcattcagtggtttgattgctgctggtatattgaaaatggatggcttgggtggtgttcaaggttggagataccttttcattattgaaggtggtattactgtgctcacagtcccatttgcttactttattttaccagataacccatcaaataccaaattcttaagccaagaagaaaaagacattattatgtggaaaatgaagagagatcttggaaatgtcaatgactctgataaagaagcccaagaatctgaaatacaaggatttatgcatgcatgcaaagatatcaaggtctggcttttgtgtgctattcacctgttcttagttgctgcttgtggtgttaccaattttttcccatcagtggtgcaaacattgaatttcgatagcactaccactttatgtttgactgttcctccatatgttatagctgttgttgcaacttatctttgggctaaacacgcagatcattctggagaaagattctaccatgttactattccgttagtgttatcgttagttgcatttatcatttctgctgcttcattaaacactggtgctcgttactttagtatggtnttcaccagcgggctggccggaccgaacttgcgt

SEQ ID NO: 6694 - DNA, 1446 bp, Candida albicans
ccattccattttgttaataacatgacaactcttgctgaagaaaaacacacgacagatatgtcgaaagatcccgaatacatcagttctgatgattctttcccagaagatattgctgaaaataaagtagatccagaaattgaagttgaacaattagctcaagaacttgggataaatcaaaagaaattaatgtggaaaattgatctttgggttgtgccaccattttgtcttttatatttcctttcatttttggatcgtgtcaatatttccaacgccaatatttatggattaactgccgatttgaaattaactggtaatcaatataatactgccttgacagtgtttttcgttccttatgttgtatttgaagttttagccaattattgtataaaatttgtgaaacctcacatttggttatccactttggtgttacttttcggaggtatttccatcggtatgggatttgtacaaaattttggtggattacttgcttgtcggtttttaattggtgtcactgaagcttccactttcccatctatcttttatttattatcaacttattattctaaagcagaatctccacgtaggttttctgccttcttttcatgtacagcattatctggtgctgcctcgggagccattgcttacagaatcaatgaattaaatatggtacatgggttagaaagttggcgatggattttcattatagaaggagctataactgctggttgcgccattcttttgtttttcattattgctgatttccctgaagaagcaagatttttgaatgctaatgaacgtacttttttgaaacgtaaattagaaattttggctggtactaaatcagcatatgaaatcaaaaacactatcaaagatgttgctaaatgtttcaaagattggttaatttggttaccagctttgtcatattttggtttaattatcccatcttacggttatgcatatttcgcagccaccattatcaaacaaatgggatacactgcggtgtcagcacaacaacattcagtttatccttgggtatgtgcatttggtgttattaatgttgttgcctttatttccgatcgtttcaaaagaagattaccatttgccattggtacttgtataatggctattgttggtcttgccatgattttgggtgcaactcatagccccaaagtgcgttatgttggttgtttccttactgctagtggtttatacaccgccatgcctatggttgtttgttgggcagctttgaataatgggtctcatattcgtaaatcagtgggtactgcttggcaaattggatttggtaacattggtggtattattgccacatttatatttttggccaaagatgctccagtttataaacctggtttggcaacttcaattgctggtgtttgcttttcatattgtgctccttgggctatttctttgtttgtcataaaatga

SEQ ID NO: 6695 - DNA, 1533 bp, Candida albicans
acaccatttttagatcccaaggtcgccgagtattatgacacaatgtatcgaacctccaactatgaaagctactctgcatttgatcccttttttgagtgggatgaaaaagaggagaaaaaactaattggcaaattgaattaccgtgttgctttgacagcttgctttatgtttattgcccttcaagtcgatagaggtaacttgagtaacgcaacaagcgacaactttttggacgacttaggtttgacaacaaacgattacaacgctggcaacactattttcagagttgcattcttgttggcagaaatcccttcccagttgatctcaaaggctttaggtccagacattttcattcccattcagatttgtgcttggagtatcgttgccatgtgccaagctgccttgtcaggcaaagcatcattttttgtcacaaggttattgattggggcaatagaaggaggtttcatcgcagacttggtgttatggttgagctactttttcacgggggaaagagttgccagtttagattatcctggtgtttggacaactttgtcattggtggatatattcaattctttagcagccttcggtattttgagaatgaagggtcttgctggcatggcgggttggagatggttatttttgcttgaaggtgcctttacgttactaattggtatattttccttctacttgatggtcccctcagctgtgcagacgaaaaattggatgcatcccaagggctggttcactgaccgtgaagtgaaaattgttgtcaacagaatattgagagatgatcctacaaagggatccatgcacaacagacaaggattgaccatcaaacagatcatcaagagtttccgtgacgtcgacatcttcccgcttatagcaattggactaattaacttcattggatcttctacgtttgggtcttatttcgctctattgaaccgtcaaatggggttttccacttttgacacaaacttgttgatgattccacctaaggtgttgcatattggctttttgctattaattacctggctctcagaatttatcaacgaaagatccggtgtctgtcttatagctccgatttattcggccacaataatggctgtaattagatggtggcccggatcaggcaagcaagtgtggcctacctacgttctcaacactttatattctgggcagccatatattcatgctattttagttgcatgggtctcaagaaattccaatggagtaagaacaagatcgattagttctgctttgtacaacatgtcggttcagttgagtagcatcattggccaaaatgtataccggaaagatgatttgccattgtataaaagaggaaacatgcagttgttctttgttgaaatggccacgatacctataataatgttgactaaagcgtactatgtgttcaagaacaaacgaagagataagatatggaatgcaatgtctgaggaggaaaaggatgactatcgtaagaatagcaaagttgagggtgctagaagattggattttcgatttgctcattag

SEQ ID NO: 6696 - DNA, 1242 bp, Candida albicans
ttcttggttgatgagcttctttctcaattaatgtcaaaagcattaggtccagatatctttattccaatccaaatgtgtgcgaggtcaatagttgctatgtgccaagcagctttaaaaggaaaaacatcattttttgtaactagagctctcattggtattttagaaggtgggttcatcgctgacttggtgttatggttgagttatttcttaacaagtaaagagttaccagtgagattatcatggttctggaccactttatccttggtgcaaattggtacatcattgttagcgttcggtattttaaggatgagaggtgtggctggattagaggggtggagatggctctttttacttgaaggtataattacacttataattggtattgccgcattatatttaatggtcccatcagcagtgcaaacaaaaaactggatgcaccccaaaggttggtttactgaccgtgaagagaagattgtcgtcaacaggattttgagagatgaccctacaaaaggatccatgcacaatagacagggaatcactcctaaagcactttggaacagtttaactgattacaatctttggcccatttatgctattggtgttgttgcttacatcggtactagtaccttcggtgcatactttacattgatgaataagcaattgggattctcgacttttaacactaacttattaaccatcccgcaagctgttttgcatattatactattgttagcgattacctggttttcagaaaaggtgaatgatagggcatttgttgctttaattgcaccattttatgctctcccactcatagctattataagatggtggccatgtgctggtaaaaacatttgggcaacttatgttttaaacacattatacgttgggcagccttacatccacgcaatttgtgtttcttgggtatcgagaaactcaaaccatgtcagaaccagatcaatatcatcggcagtgtacaatatgtttgttcaattgggttccattatcgcctccaacatttacagaaaggatgatttgcctttatacaaacgtggtaatatgcaattgttttttataactttgactttaatccctgttttgctcttagccaagggctattatgtttggcaaaacaagagaagaaataaggtgtggaaggccatgactgaggaagaaaaggatgcttacagaaaaaccaccaaagatgaaggcgccaagaggttagattttagattttcccattag

SEQ ID NO: 6697 - DNA, 324 bp, Candida albicans
tacacaatgcctgtgacagaaaaagacatagccaacctgggtgcaaactcaattgcttccaacaacacttcaagctccttaaaaaaacaagacaataaaataatcacatacactgaatcaaattcatctttagagtcagatgagatttcaaagaacccgtttttagatcccaaagttgaggaatattaccgtgatttatacgaagattcaaattacgaaagttatcgtgctttcgatccacaattcacctggagcaaagaggaagaaaataaagtgattaaaaagatcaacctccgagtagcattaacagattatttcttttag

SEQ ID NO: 6698 - DNA, 1794 bp, Candida albicans
tctacccatgttagtttgatctactgcttagtttcctctcttatagtatataaaaggccaggatattcctctatttatacaaaacaatttcgtgaactagtggttgttatttatcaatttgatgccacagttatgactgctaccaaattatcgcgctcattgtcgagctcctctaatgtcaccacacctttgcttaaaaaagatgattacacaattactatcgtaccatcgaactcgtcttccgaggcaaacgaaatcggggataacccatttttggatccgaaagttgaagagtattatcgagaggtataccagacatcaaattatgaatgttatcctgcatttgatccgcagtttgaatggacaaaagaagaagagcagaatgttgttcgcaagctcaactatagagtggctttagcagcatgtcttcttttcgttggcttgcagattgacaggggaaatcttcaacaggcaatcagcgataatatgcttaacgatttggctctaacaaccaatgagtataacttgggaaacaccttattctacagctgcttcttattggcagaagtaccttcacagttaatttcaaaaagtttgggaccagacattttcattccgattcaaatgtgtgcttggtccgttgttgcaattagtcaggcagctttgtcagggaaagtatccttttatttgacaagagcattgatagggatgctagaaggcgggtttattgctgacttggtactatggctaagctattttttcaccagcaaagagttgccaattagattgtcgtggttttggaccactttagcagtagttcaaatcggttcttcattgcttgcatgcggtattttgaaaatgaggggccttgccggattagaagggtggagatggttattcttgattgaaggcgtaatcacttttttcattggactttcggcgttctacttgatggtaccttcagcagttgaaacaaggaactggatgcacccaaaagggtggtttagtgaccgtgaagagaaaattgttgtcaaccgaatcttgcgtgatgatccaaccaaggggtcaatgaataacagacaagcacttggtattaaagaattgggggctagtttgatggactataatctttggccaatctttgctattgggtttattgcacatatcggaaaatcaaccatggggacatattttacattaatgaacaaggagttgggcttttcaacattcgaaacaaacttgttagccataccgccgtccattttgcatatttcattcttgttgggaattacgtggttatctgaacgagcaaatgagaggtcatttgtatccttggttgctccattatacgcagttcccctaatagcaatcattcgatggtggcatgggtcaggtaagcaggtatgggcaacatggatgttgtcgactttgtttctaggacagccatatattcatgcaatctgtgttgcctgggtttcacgtaattcgaattctgttgggtcaagatcaatatgctctgctctatacaatatgtttgttcaaatgggggccataattgctctgaacatttatcgagaagacgatttcccattgtataaaaaggggaataccatattgtttttgatagaattgctgttaatcccgttgttgttgtttacgaaatgcttttatatttggaaaaacaaccaaaaaggtaaactctggaataaaatgactgaagaggaaagggagtattatcgtaagcacagcactgataggggcaacgaaaggttagattttgtatttgaacattaa

SEQ ID NO: 6699 - DNA, 1254 bp, Candida albicans
tatggtcaaagatattcatggtgtgctgctatttttaattttggttatcttgctggtgcattaccagcaaattatgttattcaaaaattacccgttgctaaattcactggatgtatgttgttcttatggtcgattattttgattggtcatattggtttacaaaattatggtgggattttggtgattagatttctcttgggattatttgaatcaatgatcagtccttcatgtatggcaatttgcaacaatttctacactgtgaaaaaccaaccattaagaatgtgtatcttcttatcatttaatggggtagctactattgtcgggtcacttcttagttggggacttggacatgctgatgaatcaaaattgaaaatatggaaattgatttttttggtcattggtcttatgaactttgtttggtcagggatttttctttggttatgtcctgattcacctaaactggtcaaatttttaactgaagatgaaaaagctgttttgattaaagaagttgctactaataatcaaggtttaggagaaactagatttaaaaagagtcaagcagttgaagcattacaagatttgtttgtatattttgttgccttaataggtcttgcatgtggagttatcaatggtggcacatcaaattttgcctcttcattaattaaaggatttgggtttacgggaatccaggccaccgcattacaaatgcctcttggtgctgtggaattagttgtcgttgtagcagctggtattgttgtctttactgtcaagaacatgcgttgcatagtattatttgtcatttgtatccctcctttacccggtcttattggccttcatgtcataccattaacgcatagatgggctctagttggatgttcattcttgcagtttattattgggggtccagttatcttgtgttggattctatcgaatgccaatgtgtcagggtcttcgaaaaaaactatagctaatggaatttggtttgtgatgtatgctgctggcaacataatatcaccaaatatcttttatgctcgagaagctccaaaataccgtagtggtataattggccttatttccagttattgtggaataatggttttggcaatagcaatacgtttggtgttcatgcatcgtaatagaaagagaaacttggaacaaggtggctacaatgaacaaattgctgaacaagcagtattagatggatttaaaggcttgactgattttgaaaatgccggattccgatactctttgtag

SEQ ID NO: 6700 - DNA, 1563 bp, Candida albicans
attaaagcgttgttccaatatgaaatagttctttctttttttttgctttgtttgggcaatatctatatgagtgaaaaattatctactgctgtcacacaagacgaatctgtcacggatactagtgaattcgataatgtcttgtattttatcaaggaaaatgaacagataattgatcctgattctactattgatggtgctaaaatagttcggaaattggacctcatcatccttccgttgttgtgttgtatatatttcttacaatttttagataaatcgttgttgaattatgctgccgcaatgggaattaaaaaagtcttggataaccatggtgttggcaacaatcaatttgctaatttgtccacaatgttttatgcatcatatatatttggagaacctataatgtcatatattttgcaacgatacccactaggtaaatcacttggtgtttgtattgttctatggggtgttgtggttacttgtcattctgcatgttctagttatgcctcattgatgatagttagaacactattagggatatttgaatccagctctgctgttgggctaattactattagtggcatgtattataataaacgacaacaagttgctaggatgggtatatggtcagtcatggctggtacagcaactatctttggtgggttattatcatttgcattccaacatatacatgttcaaaaattcaaatcatggcaaatattatttcttgttattggattgatcacaatcgcttttgggttttttgtcatggtttatttacctgacaatattgatactgtgtggttcttaaacaagcaggaaaaactatatattctaaatcacacggtgagaccaaatcaaacagggactaaaagctcgaaattcaaatggaaacatataaaagaattattaatacttgataaattcacttggctctattttttgttaactatttgttctcagattgtgactggtgctattggtacttttagtgttaccattacactttcgtttggatttgattcttatcaatctgctttattgcaattacccattggtgcattgattataattatcattttgacagcaacacaattagtgtctcaatgtggtcacatcacatatattataatatccatgtatattccaaccatagtaggtgcgatagtcttaataatttcccctaacaaaattggaaacattatggcattgtacttgctttatagtggatcgtcggtgataacattaatctattcttggacaagtgtacatactgctggtacttcgaaaaagattttccgcagtggtatgataatgattgcattttctatagcttgcatcattggtcctcaattgtttcaaaattatagtgctccaaagtatcatccagcaaagattgttattttgattacacaatgtatgtgtattcctataacttggttaattggctggatgtgccaacaagagaattcaaaaagagaccaaatcaaagatcagatgccagaaaattttgaattttttgacttgacagatttagagaatactcagtttagatatagttattag

SEQ ID NO: 6701 - DNA, 681 bp, Candida albicans
cctcataattcaatttcttcattgattggaagattatgtattgtggttatggtaagtttatcattccctttacaatgtcatccttgtcgtggttcaattaatcatgtgatacatttttgcacccatggagtacaacaatccaagtttagatccaccaccaccaccaacaacaacaatggcgatcaacatggatatacttctttgagttctgatattgaaagtttacaaagtattggtggtaatgatacaactgcgggtagtattggtagtattggtggtggtgatagtgttgttggtgatgctgatgaatcatttatatctactaccccagtagaaggagctcaagatactgatggtcatgatccaatcattgtccccatgaccacgaaaaaattttatataatcaccactgtgattgtagtattatcttatcttgtggcaatttctgtgacttcattagctcatgttttggcatttgttggttccactggttcaacatcaatttcatttatattacctgggttatttggatatttattaattaaacctatcgacggtaatacttcattaaataatttacaaaaattttgtaaatatggtggattatttttagcaatttgggggattttagttatgatcgtttgtttaagtgctacaatctttttaggtgctactcattaa

SEQ ID NO: 6702 - DNA, 513 bp, Candida albicans
attttaagatttttaaaggtactgtttttttatttttttctctcgttttttgttttgtttctacatcatcaacatatggcaccatcatcatcatcatcgttggatttgcattatgaacggcccaaatggtatcgtttagcaatttatgatactttattatggctattatcagttatctttgattgttttttccgagaaattcgaccaagaggagcatttaaaattcctcgtgaaggtccagtcatctttgtggcagctcctcatcataatcaattcgttgatcctgtacttttaatgaatcaaatcaaaaaagaggccaatagaagaatttcgtttttaattgctgccaagtcttataagttaaaagcagtggggacaatggccaaatgtcaattgtcaattcctgttgtgagaccacaagattgtttagttaaaggaacggggaaaatttttgttgatttcgataaggatccattgagagtcactggtaaagacacaaaattcaccaaataa

SEQ ID NO: 6703 - DNA, 1794 bp, Candida albicans
tcattcgtaaagaatttcaatcttgtggataaagttaaagttttattaaccaccggtactggttataaaggagcgaacaaaattgaccaaaaacaggtttatccaaatgtatttgatcatttgttagatgatggaagtaatggtattttcccagaaggtggttttcatgatcgtcatgattattggccattaaaggctggtgttgcggtaatgcaatttggtgccatggataaaaatcctggttgtaacattaaaattgtcccttgtggtatgaattatttcaatgctcacaagtttagatctagagcagttgtggaatttggtgatccaattgagatccctaaggaattggtgaaaaaatacgccaacccagaaactaaccgtgaagctgttaaagaattattagatacaatcaccactgggttgaaagctgttactgttacttgtgaagactatgaaactttgatgttaattcatgccgttagaagattatacgctgggaactttgctcaacaattacccttgccattaattgtggaaatgaatagaagattggtaattggatatcaacatttcaaaaatgtccctaaagttcaagaaatcaaagaaaaagtattacattataatgattttcttaaaactttgtatttaccagatcatgacgttgaaagttgcaacgacgaagctcataaaattacattgatcccaatatttttcttcagagttttcaaattattaattttattcattttagcattaccaggggctactttattctcacccgtgtttttgtctaccaaaataatctcgaaaaagaaagccaaagaggcattagcaaactcagttgtcaagatccaggctaatgatgttattgccacttggaagattctagtttcaatgggtattgcccccatagtttattctttttacgccagtgttggtacttattactgttcaactcatgactattttctgcattggaaattattttgggtatggatttttttgtatagttgtggtgtattggtcacctattctgcattaattactggtgaacaaggtatggatttgttcaaatctatccgtccattatacttatcaattacatctggttcgtctataaaagaattgaaaaaaatgagacacgaattgagtgaggaaattactgagttagtcaatcactatggtccacaattattccctaatgatttcaatttgttagatttgcaaaaatcattgaacataaatggtgatgttgtttacgctgatagtgacgaagaagaagatatgaaaactgaagagttgcgtaacagaagaattgccagacgtaaagctgaaaagaaaaagaagcagactcaagaaaatgaagatacccaagaacttcaaagttctgatatgaaacactcttcatctatgagtgatggtatttccttgttgaattccgataattcattaactaatttaccaatgttttccgattatgtcttgcacaaaaatgccaagaatcctgatctacaattggacccacaatcccattatggttcaagagtgaattcgaatctcaactctagtgccaattcttcagtttctatttatgatgattatcgatttgcatcacaatcagaacatggcggtactgcatcacctgtaagatattcaagactccctcatttacctgaaacatcatcttcagatcatatggaattgaattttgcttcaaaacctgaagggcagaaaatgcgtttgagagatagaattaaaaccaaacttcgggaaaatagaaaagaaaattaa

SEQ ID NO: 6704 - DNA, 672 bp, Candida albicans
cgccgattcggccagctcccgtggttgaagacaggtcctgttatatttgtcattgctccacatcataatcaatttgttgatggattagtggtaatgacaaaagtgaaggagattctgaaccgaagaattgcctttttgattgccaaaaaatcttatgatcgaatggttattggtcaagctgccaaactttgtggatgtattcctgttgaacgagctcaagattttttaaaattgggacaaggtaaagtttttgttgacccaaatgatgactgtgttttaattggtgaaaacactgcattcacaaaacaatgtcagaaaaaggggttgattggattaccgaattcattgggtaattgtcaaattgctagtattgaagatgatactcatttaaccttgacaaaaccatttggctcaaaaaattcagaaattcaatccagaattgataaagcctttcgtgatggtacatcttttaaaatagccccacatattgacaaccacgtggtgtttgaaaatgtgtttaatcatttgaatgatggtaatatattaggaatcttccctgaagggggttctcatgatcgacctgatttgttaccattaaaaccgggagtggcaattatggcacttggtgccattgcacagcaaatggaaggattgggaagagaacgattataa

SEQ ID NO: 6705 - DNA, 507 bp, Candida albicans
tcgatatttatatctcgtattaaaattatcaatatttgtatggcgatttctggattcatattatcaatttgttggatatcgttaatatctgatgaaatcatcaatattttacatattatttcaataatttatcaattaagtgaagatattttaggattaacgattttcgccttggggaattcaattggtgattttatatcaaattatactattgccatgatggggaaacctataatggcattcactgcttgttttggtggtccattattagctatttgttcatcaggattaagtgggatgataattagagacggtaatgataagaaacttgaaatgaagttgacaaatacgttgattattatttgtttatcattgtttgcaactttatgttttttaatgtatattgtccctaaacatgattggcaaattaataaaaaaattgggattatacttgttagtatttggttgattacttgttcattatgtataattaatgaaattaaataa

SEQ ID NO: 6706 - DNA, 1527 bp, Candida albicans
  unsure (22): Identity of nucleotide sequences at the above locations are unknown.
atattttaccgttttttctttntatggatatcaccaacagcattagcatttaatccctccaccaatacgtcatttctgtattacaaaacaaacagttcagattgttcattggtgataaatcaaccattatcacaacaatgtcaattcatcaacgacaacaattgtcaatccactggattaatcaattattataaattatattactgtcgattatcattccttcataatccgtcatcaccgttccttatacaaacactttcaattttaccattgactatttgtttaatactttgctttatatcagtgggtataactgcatcagaatatttatgtcctaatttatatactatatctcaatttttaaaattacccgacactttagcaggattaacattattagcatttgggaatagttcacctgatgtatttgggacttatcatgccattggatcaaattctttaaatcttgccattgcggaattaattggtgctagtttatttattatgacggttgttgttggaacaattgctataattgaaccatttaatgtgccgaaaaatttatttattagagattgtatgatgtatattatggtgtttgcattggtggtgatttcacttattattggtgaattgacatcaataatttgtatattattggtgagttgttatatcatttatgttggtatcgcaatctattctcattcacaaaagaaaactagaattaatagattgttaagagaacaaagatcaagaggtcaatatagtgttgaaaatgatggtataaacaacgataatgccagtgttgatgaaatttatcttgattcaattgcttcattgccaactatagatgatttggatttacaacaaattaatgatgaagttgataacttacaatttgagttagctaatggtaatagtagtaccgctggtggtgctgcaactgcaacatctgtgggaggtaattttggattgaaaatgttaattaatgatttacatcaacattctaaaatcaaggggacaattcaattgaattcaaatagacaattaatttccagtacagaaaatgaagttcttccaacagctattcccactttaactcctactcctactaacgatcatcccatattaaatttgaagacaaatgatttactatatttattattaccacaactaaatcaatggccagaattttccctatatgaaaaaatttattttattattagtttaccaattcaattttcattaagattaacaacaccaattagagatgaaaatatcataaacaccataatgaatgatattcataacctaacctataacaatagtaataacaataataacaataatagtgattcaacaggaacaactactacacccatgggtagttcatttgattatttacaagataaaaaattattactcgtacaaacattcccagcaacattatttttaatatctagtttatttggtaaaatatcatcatcaaaacccatgttaaaatttttatcaattattaatagctaa

SEQ ID NO: 6707 - DNA, 624 bp, Candida albicans
  unsure (11): Identity of nucleotide sequences at the above locations are unknown.
tcacaaacaanatcttaccaagacactgtaaattattgttttggtgtttggggtaaaattgttttattagtttcaatttgttcctttgcatacggtggatgtatggcattctgtgtcatcattggtgataccattcctcatgttttaaaagcattcatcccggagtcaataacgaggtcagatggtccattgggttggttgtttgctagaaataccattattgttttgttcaccacttgcatatcctatcctttatcgttaaaccgagatatttcaaaattagcaaaagcatctggatttgctttagttggaatgttcatcattgttgtccttactatttttagagcaccttttgtttcacctactataaagggtgaattgacagtaaaagagtggactgtcaatgccaatattttccaaggaatttcagtcatttcatttgcattagtttgtcatcataacacaatgttcatttatcagtcaatgaaaaacccaagtttagccaagttttccaaattgacacacatatcgtgccttgtttccatgattttttgtatgatcatggccataaatggattaatcaatttcggagacctcttcaccacggaatggaaaacccgcgtc

SEQ ID NO: 6708 - DNA, 399 bp, Candida albicans
  unsure (376): Identity of nucleotide sequences at the above locations are unknown.
aaaaaaaaaaaaagactcaagtttataaaacacactattggtgttatgggacgtgctacgataaaatctggatcaatcaatttattaaacaccataattggtgctggtatacttgccatgccatatggattgaaaaataatggattattatttggttgtatattaattatatggtcatcattaacttcatcaatgggactttatttacaaaataaagtggctaaatatactggtcaacgaggttcagtatcatattttagtttatcacaattgacatatccaaatttaagtatattatttgatagtgctattctgattaaatgttttggggttggagttagttatctcgttgttagtcttcaccaccaggcgacanggatcatcgctatggttaggaaa

SEQ ID NO: 6709 - DNA, 798 bp, Candida albicans
aaaaaaaaaaaaagactcaagtttataaaacacactattggtgttatgggacgtgctacgataaaatctggatcaatcaatttattaaacaccataattggtgctggtatacttgccatgccatatggattgaaaaataatggattattatttggttgtatattaattatatggtcatcattaacttcatcaatgggactttatttacaaaataaagtggctaaatatactggtcaacgaggttcagtatcatattttagtttatcacaattgacatatccaaatttaagtatattatttgatagtgctattctgattaaatgttttggggttggagttagttatcttgttgttattggtgatttaatgcccaaaattgttgaaagtcttgttggtggtggtaatattaacctggattcattattaatggcacgtaatttttggatcactatatttatgattgttattgttactcctttatcatatttgaaaaaattggattctttgaaatatactagtatattggcattattttctgttggttatttaatttgtcttgttgttgcccattattttacaacccccaccacatcaccatcaggaggaggaggaggagacgacgacgacatagtttatcattatattggaccaatatctttaaagtcaacattaagttcattcccaatatttgttttcgcttatacttgtcatcaaaatatgtttgccataataaatgaattaaaaccaagtgataccgatggttcacaaactagacaatcaaatttaatcatttcgtaa

SEQ ID NO: 6710 - DNA, 1200 bp, Candida albicans
ctaatgccttcaatagataatgatgccggtgcatcaacagtttcttcatcgattagtttggttaaaaccattataggtgccggtttattatctatgccattggcgtattctacagatgggatcatttttggtacatttatcatattactagctgctttcactagtggatttggtttattcttgcaatgttatgtaagtagatatgtcccggttaagcatgcaacttttttcaatttatgttcaatcacgtatcctcatttatctgtggtgtttgatttcgctattgctgttcaatgctttggttgtgcagtatcttatttagtgttgattcgtgatttaatgcccactatagtgacttatgtcccatatattgatgagaaacattatccactgttttggttattagtgtccacagtgttgactattccattatcatttttgaaaaatttggattcattgaaatattcatcaattttaggacttgtggccattttttatatgacaattttagtgattggacattattttgctggtgatattgaacgacaaggacaaatcactttattcccaactagtgttactggggtatttagcaccttttcaattattgtatttgcatttaccggtcaccaaaacatgttttccattatcaatgaagctagagataaatcattgacaagtctcaccaaattggtcaattttgccattggtatatccagtttgttatttattgctgttggattatcagggtatttgacatttggtcaagatgtcgatggtaatgtgattttactgtatccaaatgggttaaccaccacaattggtagattttgtattgtgtttatggttacgttttctttcccattgatgattcatccagcaagaatttccatcaataacatttatcattgggtaacaaccaattatttcgacaaagacgaagctaatgaaagtactgccttgttaggaaatgaatcccaagaatctcaaattgccgaagatgaagaacagggtaaaactcacttatctcatgtcgttcctttccctcataaacattttgtgattgtcacaacatcgttattaattattggttatttgttagccatttctattaaatcatttgcattaattttggcaatcgtcggtgcttcaggtcttgacttcgatttcctttattttgcctgctttatttggttataa

SEQ ID NO: 6711 - DNA, 720 bp, Candida albicans
atctacatatttatttattcaattcctaacttacctgatcatacactatacaagaagatgtcaaatgatccaacaccaatactagataatgcaaaggattcatcccaagtgcctgatttttccgatatagtacagggagaagacctagaatttcgtcaatcaaaagctcccactttccccgtagtgcataagattgaaaagctaggagagataccaccacctaccatactatctcgactttcaaacaaccaactaattaccattgctggggcagcatctgggtttcttgcaggaatagtggtgtgtcctttggatgtggtcaaaactcgattgcaggcacaaggtactgtgggggaaaatttaaagtataatgggtttttagggacatttaaaaccattcttcgcgaaaaagggattcgcggattataccgtgggttagtgcctaccatgattggatatttacctacatggacgatttatttcactgtatatgaacaagccaaaagattctatccatcatttttacaccaatacaatatcgagaatccatcgattatacatttttgttcagcattgactgctggaatgactagttcaattgcagtaaatccgatctgggttgtgaaaactcgattaatggtacaaactgggaaagaaggccaacaagtttattataaacgcacttttgatgcattcaaaaaaatgtatcaacaccaatga

SEQ ID NO: 6712 - DNA, 1452 bp, Candida albicans
atatatggaatctccactacaaataccatcaagaccttttacatgaaagataacgacgcattttatagttatgatgacaactccataccctcggaaaacaacagtaacaaccaaactgagcacatggatttcccattaccgcctcctattgactggtcaaataattcggtattcgatgaaaccagcgaattattaccaactttatcacgagtatcgaccaaaagacattcatttagtctaattactgggaattctacagcagcacagactatatttaattcaataaatacgttaattggaattggaatgttatctttaccacttgggtttaaaatgtcaggttggttatttggttcgttgttgcttgttgtatcggcatttttaacaaatacaacggctaaatatctagggaaaatattgtatcgacatcaagaattaatgacttatggagatattgcttatgcatatggtggcaaatatttcctgtacttggtcaccttattttttgttattgatttgtttggtgcttccttgacgttaatcatattgtttgctgatagctttactattgtttggcctcatgtgcctgccctcaaagcaattattgttgccgtggtatttgtgttatccttattgccattaagtatgttatcaattttcagtctattgggaataatttcaacagtggggataatactctcagtgtttatatgtgggttcctcgttgacacatctccaggttctttgttgatacctgcaacaactactttattaccaccgaaccccataaatttattgtttagtttggggatatttatggctccctggggtggtcatccagtatttccagaattatatcgagatatgagacatcctttcaaatttaccaagtcgagtaatatttcatttcttgtcacctatcttttagacttttccattggtgccactggttatttaatgtatggcttaatggttgacgattcaattgtgaaaagtatcatgcaaaatccaaattatcccccaatcataaattcaatattatgtatcttaatgggtatcttaccaatttcaaaattaccattagtcacaaaaccaatcatcacttcctatgagaatatttttggtatcactgcaaaatacgttaaattggatgaaaatgggaaattaactgatacttatggaccaacacgagtgtttagtacattgtcattttgttgtgtgttattaataagtgcattattattaacttcatttggcaaattagtggcatttttacggagtgccatatgtgatacagtatgcttgacgttgccattattgttttatttaaagttaaatagatcaagtgtcggtaagttagaacgattgttaattaaaattggaattgttttttcaattactgccaccatactaggaacgtatgcatctattggattgacaatacctgaataa

SEQ ID NO: 6713 - DNA, 1536 bp, Candida albicans
  unsure (1300): Identity of nucleotide sequences at the above locations are unknown.
tatatcatgattgaggaagacgaaaatacttctttactttctagacgtccgtctcacagctttcttgacactccaataggctctttcaaaggacccaactcattacacaactttgcaagttctttcaccagagcccagtcctttgctgccaataaaatcgataattcgattcataagaaaagatctttctttgttagtggtgatggcggaactgttgaagatgacgaaacttttgaccctgagttattagttccctcgtatcgcggtgaaaggttaagcacggttatgcacgatattcagagcagaaaccagttattcatgaatcctcccaaccagttggaccagagtgtttctcccaacaacgatgtgtttttccatgatgatgtaatgaacgcattaaacgaatccagatcaagacagaattcgacatttggcaactcacaatttaaacacagaatatactcggccccatccttttcgagtttcagatcttcaatctcagctgctaccacaccttcaattttccaggtgagaaaaatagaagatgaagacggtaatgtggttactgttttggctggtcagtcaactgccccacaaacaattttcaattccgttaatgttttgataggtgtgggccttttagcattacctgtgggattaatgaaagcaggatgggtttatggtattcccattttgttagtttgcggtttgacgacatattggacagcatgcttgctctcaaaggcaatggataccgacgacactattatgacatatgctgatttgggatatgccgcatatggttccatggccaagttggtcatatctgtacttttttctattgacttgttgggtgctggtgtatcattgattgttttgtttagtgattccttgtatgcattattgggggatgaccaagtctggacaaggactcgttttaaaatattgagttttattgtgcttactccatttacatttgtgcccttgcccattttgtcaattatatccttgtttggtatactctcgacaatttcaatcaccattttggtaatggtgtgtggtttgctcaagccaactgcaccaggatcattattggagacaatgccaacgaacttgtatcccaaatcgttacccgatttacttttggccattgggatcttgatggcaccgtttggtggacatgccattttcccaaatctaaaatctgatatgaggcacccatacaagtttacacagacactacgctctacatattcaatcacattactaactgattgttcaatggcggtgttgggatttntaatgtttggacaaaactgcagtaacgaagtcaccaatacattattaactactgcagggtatccgaaatggtgttatcccttgatcagtgggttgatttgtttagtcccactagctaaaacaccattgaattgcaaagcccattatttcaacattggatttgttatttgggggtcgcccaatttagcccccaaccagattggagataccgtccattccttaaggaagaattggtga

SEQ ID NO: 6714 - DNA, 471 bp, Candida albicans
gcaattgaaaaaaaaaaaaaacaaaaaaaaactccactcccttcgttcctatcatcagcagattcttttacaccttctgtttcattcattcatttatttcttcaaagtacccccccccccccccccctttccccaataaatatgcatttatggaaatcattatcacaatcaaataaaaatattaaaattctttgggggtcagttttcctaaaaatggcaaattatggattaacaaatcaagtattaaccttatatttaaaatctttaaatattaatgaaaccaaaataggattatttatgacattgactttaattggtgatacaattatatcatattatcttacttggaatgctgatgaaaaaatcggtaaacggaatgtaatgattttaggtaccataatgatgttttttctgggtattgtgtttggatcaaatattcaagttgataacaataataataataataattaa

SEQ ID NO: 6715 - DNA, 294 bp, Candida albicans
tgttttttctgggtattgtgtttggatcaaatattcaagttgataacaataataataataataattaatatggaggtacatttgtatatattatcgatggcggcgatatttggagttatatcaccaggtggtgatgaaacaggaccatttaaatctgtggaagaagcaagtattgctcatttgacacctcataatcatcgaccggaaatatttgccttttatggattatttgctactgctggtgctggcagaggaacatcattatgtggaatatcagttgattattggaattaa

SEQ ID NO: 6716 - DNA, 576 bp, Candida albicans
ttgcggatcttccaggtcggttttgaaaataggttatggatggtgcctaatgcatggatagtttattatttaaaaatcacatttgaattaactgccattagtcttggaatattatttttcataaccaattctgttgattcaatttcttcattaccttcagcttatttatcgaaattaattggtcccgttaaaaccattttatttacccaaatcccatcagcaattttttttggattaacaattattccatcaaattatccattggtggccatattattaatattatatttcactacttcaactatggatgttgttcctagacaagtattattgacttcaattatgccaaaacaagatataactaaagttatggggatagtaaatattgggaaaactttggctcgttgtattggaccaataataacggggaaattggcaagtattaataaattatatgttgggtttattattaattcttgttgtgtattgttggctgatatgattttggcaattaatttcttacatttagatgaagaaatattattaaaacaaagtataattcaagaaattgagtaa

SEQ ID NO: 6717 - DNA, 1443 bp, Candida albicans
aatctccttttttctatcatcccttcattgctgcttattgaaatatatcgacttttaaaatcatcaacaatgtcagaaggatggatttcatttctaattgatgagattggtctttataccctctccaatgccggaacagatgtatacattatcattcttcttagaatgattagattaattgggtttggtgcaacatctttaatccttgcattattcttaaaatcactaggcattccagaacaatatatcggattatttatgacattgacatttattggggatttggtgtcttcattcttattatctatcataactgatcaaattggaaggaaaaaaatgttgcttgcttgttcggtcttgatgactttgacaggggctgttttcggtttgtctgaaaattactatgttttggttataactgctattcttggaattttgacaccctctggaggggaagttggtccatttagaacagttgagcaaagttctattgcatcattggttcctcatgagaagagatcagacatttatgcttggtatacgtttttgggaacattttgtgctgcctttgggtcattcttggcaggagcattgatcgacattgttcaggacaactatgggttcaccatagtgcaaagttacaaatgtgtattttgggtctacacgttgttatctggtatatgtgttattttatgtttattcatcacgggaaatattgaagtgaagccagaccctgggcttgaagaaccagcaaccacaccagaagacaatgagtctgaaccaactgaaacatctcaattaataccaacaacaggtaatgtgaccaataaacccaagaataagttcagattattgccacatttatcgccagatacctacttacttgtcattaaattgtccttattatttggacttgattcatttgcctcatcattaactccaatctcatggatttcatattatatcaaaaacaagtttgatgtaccatcatcttatttgggttcagtttttttcaccactggatttgtgagtggtttcacatcacttggtagtacaccattaaccaaaagatttggggcagttgtgacaatggtcttcactcacttgccagcatcgatattgttagcccttgtcccactcccatcttctttctccttgactatgggcattttggtcgttcgagcatgtacgcaaacaatggatgtagcacccaaacatgtattcttagcaaccttggtgtcagatagtgataggactgcagtgtttggatttgtcaatgttgtcaaaacattagcacaagttgtgggtccaagtattgttggtgtaatcacccaacgtggtgcccaatggatttcgtttgttattgctgggtcattgaaggccacctacgatatcggaatgttggtaacatttttaacttacaatcgtcatgctgtacactag

SEQ ID NO: 6718 - DNA, 1332 bp, Candida albicans
cacacactcatcaagatgataaaaacgaaaaaaaacctatcatcggaagagaccacggattccatcgaacttcaacagcctgatacaagccccgagcaattggaatctgctaccgaaaaacaggagcacgaccctgacattgacggtgggtatgcttggatcatattgtttgcttgtgttctattcaatttctgtacttggggaatgaattcaggatttgcaatttattttgccaattacttatcacagggcacattcaaaggagccgacaaaatggactatagttatattggaggaatggcatttggtgtcggtatatttttttctccagtaatcactgtcttgatgggagtattgggatttagatcagtgcttatcatcggtaattgtcttcagtttgcttctttgatgttggccagttggtcaacaaaactttggcagttgtacttgacccaaggattaatgcagagttttggcttagcatttatttcaatcccgacaatcacaatcttgccacaatttttcaagaaaaaaagagtgctagctggtggaataggttctgctggatctggtttggggggtattgttttcaacttggcaatgcaaaaagttgttgacaccaagaatgtgcattgggctttaagggcacaaagtataattgcatttggattgacttggattgctattgtgcttgtcaaaacaaagaattcaaaacataatatccaattcaagctatttgatttcggtgtaataaaaacggctccattctggttgttgatttttttcatcatcacgtgtatatttgggtatgtcatcgttttatacacattggcaaacttcaccactagtttgggttacaccgaacgtgaaggttcttatgtttcagccaccattcaaattggctcgtgtgtaggcaggccattgatgggattgttgtcagacaaatatggaggggccacagtagcatcggtcggttactttattgctggtattttttgcttagcaatgtggattcctgtaagaaatcttgctaccgtgatcatatttgctcttataatgggggcaataatgggtgctatttacggaatgattgcaccagtagtggccaggttgtttgggattctgaaaatgaatgttgtcttttcccagatatggagttttatgggggttgccggtttgttctcgccagtcataggtgtgaagctcacaaaaggcagtggtgtgggaattgacccaacaagatatgtaaactgttcaatttttacaggagtgtgttttattgtttgctccgcaactttattgataataccaaggttacgtcaatgctcgtga

SEQ ID NO: 6719 - DNA, 864 bp, Candida albicans
agcgcggttccttccagcccccgtggtcgaagaactaaagctatacaaaagaatcaacaaccacctaatttccttactcaaaattttatggaatttttaagtatttatggtcattttgctggtgaagattttagtgatgaagaagaagaaggtgatgaaggtgatgaagagtatgataatgggcatgatggtgatgaagttttcgatgaagaatcaagtttattgggtaatgaacgaagaggaggtggaagcggcggcggacaaccatttagacaattaccaaagaaacctcattctcatcctcaaaaacaaccaccaaaaggtactgcatcggttttcaaaacctttttattattatttaaagcattagttggttcaggagtgttatttttaccaagagcattttataatggaggaatgttattttctatgattactttgagtttatttggcttattaacttttttttgttatattggattaattgaatctaaaactatattgaggttgtcttcatttggtgaattaggttataaaacttatgggaaacctttgaaatattgtattttggtgtcaattcttttaagtcaaattggatttgtcactacttatattttatttacagcagaaaacatgattgcatttttatctcaatatgtatctaccaaaaacaatttgttgtcacaggaggttcttccaaattggttaaatcgtggtaatttgattttgattcaatgtattctattaatccctttggtattaattcgaaatttggctaaattatcaatggtttcattaatttcatccgtatttatggttattggattattaattatattttgggtattcaggaagttaatttaa

SEQ ID NO: 6720 - DNA, 432 bp, Candida albicans
  unsure (16),(28): Identity of nucleotide sequences at the above locations are unknown.
ccccccacgcggatantccagcgccgtntggcaagtatacatggtagtactgacgaaggtaatactaataatactgatgataacgatggtaaattatatcatcaatcaggtaaatataatccacaagtgaaatggttgaaaaatggatttagagcaatttcagtgatatttatttgttcacttgcttatttaaatgctgataatattgataaatttgtttcatttaatggttgttttgcttgtatccccttggtatacatttatcccccattaattcatttgaaatcaattcaatcaaaacaacaacaacaacaacaacaaacaggtagatcaaaatcagatcaattatttatttggttagattatttgttgattgtagtaggaattgccacagtgatttattcaagttatcaaattatattcttaaactaa

SEQ ID NO: 6721 - DNA, 1248 bp, Candida albicans
  unsure (174): Identity of nucleotide sequences at the above locations are unknown.
actatttccattccaaataaatttagatccagggttgttatagaatttggaaaaccccttgtggttgatcattctatggggaaggagtacatggaacaccatagagacacagtggataaattgttgaaagtggtgacatttggattaaaacaagtaactctcacttgtgacgantacgatacattgatggtgttacaagcagcaagaaggttatacacttcgaccaatagagaacagatcccattaccaatggttgttgaaatggaccgaagattaatcaaaggttaccagcagtataaggatgaacctgatgtcaaaaaattgagagatgccgtttatcattataatcgtactttgatgaggttaaatttgcatgaccatcaagtggaatcattggataaatttgataagttgaaaacatttcagatgtttgtcagtaggtttttcaagttttcgttattcatgggattaagtttacctggtataattttattcagtcctgttttcataacttcaaagaaaatttctgtaaggaaagcaaaagaggctcttgctgcttctctggtcaagattaaagctaaggatgtgatcagtacctggaaaattttggttgcattggtgttggcgccagcattgtatattttttattcagttattggaacgtatttgattgtcaagctgcaaatagttcctcaattgtcaacaataatcatatttattatttgttatggctgggcagttttaactacttatgcttcattgagagttggcgaaataggagttgactattataaatcgttgaaaccgttgtttatctcattaattagctatgagaaagaccaattacaaatcagagaattgaaaaagacaagagaagagttacgtcaacgtgttaatttgttttgcaataattacggtcctgggatgtttcaggattacgatgagttttatcgcaactataatcaaatggaaacagagacggattatgatgaattcaaacagtcacataaaccattgcgtcgtcaaaatagttggacttctatggatttgacactaaacaatttatcggatattcccatcttttcagctgcagatttggaacaatccaatgatatatccacatcagagctgtctgacgaagtgaatgatgaaaaggaagtcgaagtcgaagatgtaggtgaccattcaaatgaagtgagtgtgcgtcttagaaacgctattagagaaagacgacagaatagtttttga

SEQ ID NO: 6722 - DNA, 1344 bp, Candida albicans
agaaaattttacattcttggttatagtctttttttaaaaaaaacaaagtataaacacatctcaaaaatggttaatactacatcaacttcaagaagacgagaagaagaagaaaatagtcctaccaaatcaagtgtttcttctgatatgtcacataattcatttgatgatgatgatggactagaagatgtggaagaaataaacactaatcaagtggaagagtatcaaattcgtccaatacaatctcaacaatccacttcctccagactttcacgaacaagaactaatcattccgaactttcacgtattattagtgggattaaagatgaccaacaacttgatgaacaaaatagaaacaactacaaacatacaggtgatgctgaatatatattagctaatgaaattgatcgagtagcgaccaatattattgattctcgtcaacattcaactacagatttagaactgcaacgacgtcatttacatttacaagaagtgaatggattatcaagaaatccacgattcagtggatcacctgacgatttatcaataaatgacgaagaagaagaagaagaaaatgaaaaaaagggagaatttttgcaggaatcaagtcataaaccagatggtgggatggcttggttaatggctatttgtgccatgatggcaatgttttctacttggggtgcaaatgccggttatggggtatttttgaattattatcttgatagtaatacattcccagaagctactaaatatgattttgccttgattggtgggattgtggtgtttatggctaatattttatcaccattaagtgctttattgtataaaatgttgggatttcgatttgtttgttgtattggaatcattttccaaactcttggttggatttgtgcttcatttgctaaacggatttggcatttatatttgactcaaggtgttttagtagggatttcattcctgttgatttttataccagcaacattggtattacctacttggtttgaaaagaaaaaggcaacatcaatgggtatttgtgtttctggtgctgggttaggtgggttgattttttcattaagtgttaataaagtcattcaagagactggaaatcaaagatgggctttaagaatggtggggtttgttacgttattttctgcattacttagtgcattaattatgaaacctcgaaatttcacccaacctccacttaaagaaagtttgagtaaaacgtttattatagaaagtgtcaaagctatctttgatgttcgtgttttcaaaaatcgtggtataattttaatagctctttggttttcaattgcacttattggatataccttgatcgttgcttag

SEQ ID NO: 6723 - DNA, 498 bp, Candida albicans
tggtgtgggttttctttaggtcaaccattggctgctgatgttttagaccctcatatggaacaaatgccagcagcatggtcaggtattaatattaccgtgtcattcttttgtcttgtttcagaagttatagcccttgcattggttattcctggggctaaaagaccttacttgcacacacagatatttgctggctcttgcttttttgcttgtttcttgttaatgatattgattcgagagtttttaatcaaaaaacagttaactagcagattggaatttacaaagaataaattacataaggtggctggaactacaaagagtgattatttgaggtgtcaggacgatgaacaacaagccaagaaagatagtgaagacaccaataaaaaagaggaagaagaagaagaatcaattttaatagaacgagtagaaagatatgagcaattgttaaacaacacttttactgggtttttcattcgtgctttatatcccatcaaagtttaa

SEQ ID NO: 6724 - DNA, 690 bp, Candida albicans
acactagcatactctcaatcacctctctctaatcatatgtctgagtcaacattttttacatcattgattagtggtgcttgtgctggtatcgcaacagatatagtatttttccccattgacaccatcaaaacaagattacaagctaaaggagggtttttcacaaatggtggatatcatggaatttatcgtgggttaggttcatgtgttgttgcgtcagcacctctggcctcgttattcttcattacttatgattcattgaaaagagacttgccgcctgcggtaagttcacttggggttagacatatgatcgctgcgtcaatgggggagattgctgcatgtatagttcgtgtgccagctgaggtaattaaacaacgtacacaggcatcccatatgggtaatcaaacatcgtggagtaatttgttgcatattttgagaaactccaacaatgaaggggtgttgaaaggtttgtatcgtggttggaatagtaccataatgagagagatcccattcacgatgattcaattcccattatatgaatatttaaaagtgcaatggcaacaaaatttaaatagttttataccacagggattcaaaggtgccgcgtgtggaatgattgctggtggagttgctgctgcattgactacaccacttgatgtgataaaaacaagaataatgctacataaggataga

SEQ ID NO: 6725 - DNA, 423 bp, Candida albicans
  unsure (29): Identity of nucleotide sequences at the above locations are unknown.
aaatacctggatttgtgtctgacatttantggtagatataatgtttatgttttcatgttaatattgtattgtctttgcatatttgtgttattgtatccatttggttcaagtgagaaaatattgtatgcatttgctggtgtcggtggttattgttctggttctatacttggtttattaccagcatgcttatcccaaattactccagttaatgaaatcggtaccaaatatgggattctcaatgcagtattatccttagcaaacttgtttggtatacctattgctgcttcaattattaaggatggtacacccaaggagtataataattttgtcgtcttggttggttgtttggctgttgctggtacattgttttggtattttagtaaagtagccattctgggtttcaaactaaacatcaaggtgtga

SEQ ID NO: 6726 - DNA, 315 bp, Candida albicans
  unsure (299),(308): Identity of nucleotide sequences at the above locations are unknown.
atatacctggttttattacaaatacccaactcaatgaccaacaccatatcttcatttgaaagtgttgagcttactgctgtttccttaagacatcaaatccaattccgtccagaagatgaactgtccagcgattcactaactcccattgccacagtcaccgaggatgatagctctatagaatatcctgaaggtggattaaaagcttattcagtcatacttggatcattcctaggattaatagttaatctagggttgattaattctatggggcccattcaagcagtggccgaccgggccgntaacaaatncaatgtc

SEQ ID NO: 6727 - DNA, 984 bp, Candida albicans
atatacctggttttattacaaatacccaactcaatgaccaacaccatatcttcatttgaaagtgttgagcttactgctgtttccttaagacatcaaatccaattccgtccagaagatgaactgtccagcgattcactaactcccattgccacagtcaccgaggatgatagctctatagaatatcctgaaggtggattaaaagcttattcagtcatacttggatcattcctaggattaatagttaatctagggttgatcaattctattggggccattcaagcatatgtctctacacatcaattactgaatttaaaagctacttctatatcctggattttctcaatttatttatcattagcttatgctggtgggatcattactggaccaattttcgataaacgtggacctttagaaatattaattgttgccacggcatttattttccttggattaatgggggcagcacaaagtgtggaaatttggcaatttatattgagttttataagtttaggggtaggtagtggattagggacaactccattaattgttgttattagtcattggttctgtaagaaaagtggtagttttacagggtttgctacaagtggtgggtcaattggagggttgattttcccattaatgttgagacacacctataatgtgtatggatacgtttgggcaattagaatcttagcattcatgtctttgggttgtatggtgtgttcaatttttttagttaaagaacgattccataaagtgaaaactgaagttattgcccaacaaacacaaaaaacaaaatttctgattcaagttttgatgaacaaattgaaatcggttaatgctagtgatttcaaatacatttatgtaatattaggggcgtttttcgcagaattgtcattgattttgttggttacttatttcccttcttatgcaattgctcacgtgcttcattttcaccaggcggctggaaggacaaagatcaag

SEQ ID NO: 6728 - DNA, 1035 bp, Candida albicans
  unsure (152): Identity of nucleotide sequences at the above locations are unknown.
ttaatttggatagttgtaatcatttctggttttgtcaagttgaattatggatatagttataatatggacacatgtacgacaataacaccaaatgattcaaatccccaagaatacggtccacaacttatagaactcacaacttctaacagtanagatgatcgacacaacgtcaataataatgataactgtcttaatgaaaataatcattcaataatcacacgatcaatcacacgatcaaccaccactatatctcatcaatcgtcgtcattacatttattagatgatccatctaaattccccgatggttggaacaatagagccatgataactttgtttggttcatttttaggtatgattggatcattaggatatgtgaattcaggaggtgttatacaatcatatatatcaaccaacattttaattaatgattctcaatcatcaattggatggatttttctgatttataattttttcgcctttggagggattttaattctggggatcatatttgataaatttggttgtaaaataccgatttttgttggagtgataattatgtttagtggattattagcaacgagtttttgtcattctttatatcaatttatattggcttatagcatcttagctggattaggcaccgcgtttgtatttggaccatttgttgcttgtttaagtcattattttttacataaacgagcattagtgattgggatttcttatactggtggtggattaggtggtgtgatttaccccttaatgtgtcgatcattattttcgaaaataggttatggatggacaatgagaattggtgcatttataagtttattttgttgtggtataggttggttattagtaagtgatcgacatgaagagttttcaccagatttagaaaagaagaagaagaagaagaagattaatcaagagattaccactacttcaagtaacaatagtgttattgatcaagtagaaaatgaatttattagtatcattaaatcttccccacgggagctggccggatccgcgcttatgtta

SEQ ID NO: 6729 - DNA, 1146 bp, Candida albicans
tttaaatatccggtccggccgctcccggtggtgaagactactagatcatggatattttcaatttatacagcgatttcatttgccaattgtatggtagttggtccattatttgatgttaagggtgctatgttacctatggtcgttggtactgtaatgatatcaagtgggtttatggcggtagccaattgcgacaccgtgccccagtttatcttggcattggctatatgtgtaggattaggtaattcgctaaacataactccattgattggtgttttgagtcactggtttaacttgaagcgtggtagagctattggaatggctactattggtgggtccgttggtggtattattgttcctttaatgttgagatcattatataccaacgttgggtttgtgtgggcaattagaatcttggggtttttctgcttagcttgtaatggtattgccatattattgtgtcgatctagaatatgtcaagaatctgatactgtaactcctaagaatctgttgtggacgaatttggtacaaatcaaagatcaatttgaatttagtgctcttttggatcctaaatattccttttgtattgttggtacttttttcactgagatttccttattgtcaatgttgacgtatttggctacatatgcaatagctcaaggtatgtcggaatctcaatcgtatgtattgttgactgttttcaatactactggtgtgttgggaagattggtccctggcattttatctgacaaatttggccatttcaatattatgattgctatgctcatagggtttactttatccatgttgatactttggcttccatttgggtctaacattggtgctctttatgcatttgccgctatttctggatttttcagctcatcgatattgagtttaactccagtgtgtttaggaagtatcacaccagtacagaaatttggtcaaagatatggactattgtatttttttgttagtttgggtaacttgtttggtatcccagtgagtgctgctattattggtaatggttctaaacatctgtatgatatgtttgcagtttactgttgtgtatttggcgttgtgggcacttgttgctggtttatcagtaggttctacatagttggactaaaattgaatgtaagagtataa

SEQ ID NO: 6730 - DNA, 1848 bp, Candida albicans
gtcgaagatatcgataatatgaagacagttcgtactaatgatcacgatacgaataatgggaaattcttgctagggtgtttgaccacatgccactccttgagaaacattgataatgaacttctaggtgatccattagatgtcaagatgtttgagtttacgagatggaattacaaagaagattcaaagaccactaacccgatcgtattcaagggcaatgatagttatgaagtgaacaaagaatttgagtttttagctccattaagaagaatgtcagtggtggtctctcaaaaccacaaacattatatattcacaaaaggtgctccagaagtaatgttggacatttgtctgccagagtctttacctacaaattttgaggaattgttacaccattatacacattccgggtttagagttatagcttgtgcctacaaacaggtaagttccgctgacattgatagagaaaccgctgagtcggacttagcatttgctggattcattatttttgaaaacaaactaaagaagagtactaaaagtactcttaaaactttgaaggaagcagaaattcgaaccattatgtgcactggagataatattttgaccgcaatcagtgtctcaagagaatgtggtcttattccaccatccattgagaatatttacattccagtactagatgagaagaacgaggaaagatacatatcttggcaggaagtcaatgatccggaaaataaattagatccaattacaataaagccaatagatattagacaagataacaattataaattagccattacaggggatatatttagattcttgcttacagaggttaaaaatattagcgtcattcaaaatatcctcatgaactgtgacatttttgccagaatgtctcccgatgaaaagcatgaattagtggaacaattacaaaaaattgattatacagttggattttgtggtgatggtgcaaatgactgtggggcattaaaagcagcagatgttgggatttctctttcagaagcagaagcatcggtggcagcaccatttacgtctcgagtctttgagatatcgtgtgttttagatgtcattagagaaggtagatccagcttggtaactagcttttcttgtttcaagtacatgtcattgtattcagcaattcaatttgtcaccgttaccattctttacaaaactggtaccaatttgggtgatttccaatttttatatattgatttgtttttgattttaccgttagctatattcatgtcatggtcaaaaccatacgcaaagattgttttgaaacgacccactgcaaatttggtatctccaaaaatcctcataccattagtttgtcatattatggtgatattgatattccaagtattgttatggtcttgggtaagaaaagaaccatggtatatcaagcctattccgggatctgatgatgcagtcaaatcttcagataacactgttttgtttttgttttcaaactttcagtacattttgatagctgtggtattatcacaaggaccgccatatcgtgaaccaatggtgaaaaattacccattcatgatcaatttggttgtggccacattcttgtctgcttgcttgtttcttatcgatggagagtcgtcgttaggagatttgatgcagctaaccaatttgcacggatggttctattggtacatcatcatattttctattattaaccttggatgtatgatgattggagaagaacgttggttcccagccttggctaaagtgtataagagagttttccagagactgaagattggcaagagtaagaaagtattcaaaaacttgaaaaaagaatttaaccaacttcaaagcgtatga

SEQ ID NO: 6731 - DNA, 1443 bp, Candida albicans
aaaatggtcagaaacctggtgactagtcgcaggtcttcttcaatagacagaaggagatctcggtcaagacataattcagttgcttcagcaagttcttcagttaatctactactcgatgataataattatgaaatgtattctggggcagcatctgaaattatcccatcttcaattacttcattgcattatcctcatagttttggtgggagaagaatatcacgtgtatctcgagaaacatcacctttacttagtgctgatgaaaatgataatgacttgcaacgagttagatcaaacgcctcgaggaattctattgatactcaggctaattttaggtttttctctccccatgaaattgaacatgcccaaggtggttcaactttagagaaccccgaggaccctgtggattataatactgactgggactactcgatcgataagtatctcgatgaagatgaacaataccaagaggaagctgtagctgacgaaggagaaggagacggagaaggagatcaacaacgagggacagcattttatcaacaagatggtgttaattttagatatctgtcacccgaagcccctgattatggttctgttgatttcgagaatcataatagacgtgattctggatcaagcagcaaatcgagcttggacgaagcaaatagtattgttgatgataatcaatatgaagatttctacaaacaatttcctacaaaattagattatcaaagatactatcttgcagaagaggatttggttattggtattgctggttatgctgatagatggtggaaaacagcaatctattatttcctttgtattggtactttggggattgcctatttgattttaagatggcttcctcgttatcgaattaatttaatgggtactagatgtcccttgggtaaagctgattggtgtgttattgaaaatgagtttggtgaattgcaaattgcccacgttgagaaacaacgatttaatgagagactttccagcttccttgttggtacagatgatcaatttgattttgaaaaagaccctgttgtcccacatattcaatcatttgtttatagatacatcaaatttttctacaatccaatggaggacatgttcaagacgaactcaaattggtttgatgcacgttggttgaatgttaaaaatctcaaagatggtgtatctcattctgttcaggatcaaagacaagagatatttggtaggaacactattgaaattgaggataagacggtattacagttgttgacagatgaagtgttacacccattttatatttttcaagtattctcaattttcttatggcttgcagatgattactactattatgctacatgtatatttctcatttcaatgatttctattatcaattcattaattgaaacaaaatcaacccatgaaacgtttacaagaaatttcaaaattcaattgtga

SEQ ID NO: 6732 - DNA, 240 bp, Candida albicans
ttgaaacaaaatcaacccatgaaacgtttacaagaaatttcaaaattcaattgtgaagtgagagtgtggcgaaatgagttttggaaacaaattgattcaaatgaattagttcctggtgatttgtttgaagttgacccttccttaaatgttattccttgtgatgcattactagttaatggagagtgtgttgttaatgaatcaatgttgacagggggaaagtgtccctgtttccaaaattaa

SEQ ID NO: 6733 - DNA, 1437 bp, Candida albicans
tttgtggaccaatttcacagaaaaaaacgtaaaggttatattaaagttgacggtagcaaattacctcaagattttaaattacccaccctaatattccattatactgatcttttgaatttcaccaatttacctaatgttgaaaaatattttgaagattatgctaaacatcaaatatctgattctttacttgatgacgatcaaagtaaatttaatttaaaagttgcttctgatttccaaatcgatgatgccaaattgtataatgggtatattgataccaataagaatgtggaatacattgtatatgataccgggatttattgtgtttatattggtaaacttgaggataaaaagattgatatcccagttgtttttaaaaactcttatggtaacttgacatatatcgagtacaccatatattcacaaatgaaatacgttatagtattagccataattttattcatatatcttttgaattatatcttgaagtttaaagtgggtaaagattttaaagatttggattccgtttccgttatttcaaaagcggttatttttttagttttattcccatttattcttgtcaattcttatatgtggattgggtcatttttggaaaacaacttctttgacaccagtaaagattcaatgttgatgaatttagctaaacaaggagcacagtttttgtcaattgctttcaatacttatactatttgtattttattattattctccatgggatacggggttatatattatcacaatggaaattcacatcgatacagattattccctcatcaaacttttgtcagaatagttggatttttcgttacaaacttggtggttatctacatttatttgttgttactcaatggatcaaaatcagatacaccatttttaactggatttgatcaacttgaaccaccatcttcaggaagtgcagtattaaatctttttgctggattaacaggtttattttccatcacttggtttattttgattgtttacttttattttaaaactaaaaagacaatttctcattttcctccaaatccaaatgacgaagattccactcaaagagtagttttagcattcaaaagatcgattttgataattttgatattgccaattatcgtgatgtttatcgctggactcattacagcttcaagagttgttagaggcatagcagattccttaccagactacccatcgggtgatactttgaattttgattccgttatatgtatgctagcattagaaaaaagtatggaagttgcagtgctgccattattgatatctaattggatttatttcttttctgcagttattgggctctttttcatttggataaaagacaacaatggattaatcattgatcgaaatgtcgatgatccaattgaaaatgccgatgtttcacaatttaacattagtgatgaagagtag

SEQ ID NO: 6734 - DNA, 1860 bp, Candida albicans
tcaatggaaaaagaaatctttcaatttgatcaaaaaaaaaaaaaaaactacagcaaggccgaatcaacccaattcaacccaacccaactcaaccaaaccaaccaaaccaactgttataccacaattatgcaacttttgtttgtttcattgtcattttatattggggttgtactagccaatttagctagatttgatgagaatagtttatctcaagtatgttcgggaatgtattccaaacaagattggggtggatcattcaaaccacatattggattgacattaaatcaatttgatactttgaaatatgatccgaaaaataacaataaagatgaaaaagtcaatgataaagatatttcagttagttatattatatttgaatataaagatttagtgaatattggagctgatttaggtgatggacgatacaaatttatatgtgatgattatgccattaatgaattaaaagtttgtgatgaaaaacaaaaggggaaatttattgttaataaaaatgttactaatagtactatattaaccgcccaattgactcatttaggacatgcaaatatcaattatcccgtgaatgtcactgggtattattgtgtatcaacattcactcaatatgaaaacactgtttataatggacaagtgaattttcaaaatgcttttggtcaattaagtgctagtgaaataccaaaattaccagcttatggtatattagccatttgttatgccattgccttggcattatttggtttccaattttttaaaaaaagaaaggaaaatcaaatattacctttacaaagatatttattggcaatgttgggatttttaacgtttgatactgtagtagtttggtcatattatgatttggtcaatagaattgaatctcccagtagtggatttgctaggttttatatgatattccttgcattattaaatgctgccaaaatcacgttttcattttttttattactttgtatttcccttggatatggggttgttaaattgaaattggacaaaaaagtcatgtttggatgtaaagttttggctggatttaattttattgcttcatttgtttatttatttttcaattattatggtggttcatcaaatgccttggtgagtactgatagtattgacactgcggcatcaggtagttttttgggattattaccaattatccctattgcaattattttatcgatttattatgtaacaattttggcttccattcgaaaaactacggaaagtttacataaacaacgtcaaattattaaattgaatttatatcaaaatttatttaaaattatttttggatcagttatactaacatttttaggattaacattatcatcatttgtttatttaagtatgtcatctacagaaatgtttgaacaacattggaaaggatcatttttcatttatgatttttggcccagtgtagtgtttttcattgtgtttatggcagttgcttggctttggagaccaacagaaacaagttatatgcttgccatttcatctcaagttgctaatgatgatgaaaatggggaatatcaacaaggtatggaattagatactttttcactaatgagtcatagtgatgatgatgatgatgatgaaggaggtaatggagaacataatcctcaaagacaagttgaacgtgatagttttgaattacctaccaccaccaataataaaaataaaaatattcaaccggaaaatccaccacaatatgatcaattgagtactcatgaaccacatgaagctccaagtagtacattatttgaattgggtgaagatgatgaaattagtgatcatgaaggtgataatagattgaaagatgaaaagcataaagaatag

SEQ ID NO: 6735 - DNA, 447 bp, Candida albicans
tcaatggaaaaagaaatccttcaatttgaccaaaaaaaaaaaaaactacagcaaggccgaatcaacccaattcaacccaacccaactcaaccaaaccaaccaaaccaaaccaactgttataccacaattatgcaacttttgtttgtttcattgtcattttatattggggttgtactagccaatttagctagatttgatgagaatagtttatctcaagtatgttcgggaatgtattccaaacaagattggggtggatcattcaaaccacatattggattgacattaaatcaatttgatactttgaaatatgatccgaaaaataacaataaagatgaaaaagtcaatgataaagatatttcagttagttatattatatttgaatataaagatttagtgaatattggagctgatttaggtgatggacgatacaaatttatatgtgatgat

SEQ ID NO: 6736 - DNA, 1767 bp, Candida albicans
acaacgttcaaagatttccaaatgacttctccagtttcatatgctaatgtggctgccattggaacttcaccatctccttctgttccagcagcttcttctgaatcaaaaccaacctcaaaatcaacatctgtatctagtgaacccgttgaaaaagaagctactaaggaatccacaaatgaagaagattcaactaaagaatcaaacaaagttttttcaacaacagaatctgcaccttcaccttccaaaccttcaaagaaaactttagctccagcacctgtaccttcaaaatctgtttggggtgatgtaactgctggtgttaaagaattgtcagttgatgataaaaaatggcctgcccctgataaggctccattattaggagaacaacctactagtaaaccacaatcacaaaaattcattaaaccaattactaacaaatgggttccaatcaatgctaaagtgatattaccaagttcaagaaatagtagtggtagtggtggtaaccataatcaaaaacacaacagaaatagaaaaaagaacaccaacaataatcaacatcatcaccaaaaatctgggtctaagaaaagagatgataaaggtgaagaaagtgctaataaggaatcaatcaaatcttctgacgcaaacacatcttctgctaatggatctgtgacgactgataagaaagatagtaacgccaaagaccaaactcaagcacctgcttcgtctgctgatactacttctacttccactgtttctgctgaacaacaacaacaacatcaagaacaacaacaggaagaagaatcttttgaacaatcaactccccaagaatctcaaccacacgctcaacaacaatcacagcaaccaccacaacaacgttttaactctaacgggcaaccaaagaaacgttttaacaacaaccaacagaatggtaattataacggacaataccaaaaaagatacaccaacaacaacaatcaaccacattcacaaaatcaacaagcatttaatccacaaaatgttggatttttccaacctcaaccatacccacctaatttccaatataacgtgaacaataacaatggtaatgggggtaaccgtccgtatagaaacaataacggtggacaatacagaaataaccgaaataataacaaccataatagtaacggcaattatcgtaatggtggatatcgtcacaacaacaacagtaataacccaatgatgacaccaattccatttataccattcccacctcatacccttcctggagttccaggaataccagcccaaccattcccaatacctcatcaacatcttcaacaacaccttcaacatcaacaatatccaccacaacaaattcctccaccaatttcacctaaacaagatcctcaacaagcattaattcaacaaattgactattatttttccttagaaaatttgattaaagatttatatcttagaaaaaatatggataatgaaggatgggttaatttgaaattaattttagatttcaaacgtgtcaagattattattaatggattattgaatggattagaaaaggaaaagaaagaaggtgaagagaaagaagaaactaatgtcactactactactaatgataattatgataagattattttggaaagtatcaaatcatgtcagaatttagaaatcaattatggtaaagaaattgatgaaaataacgatgttaaattagaagatgttaaattaagagttaaagataattatcaacaatggttagtacctgataattaa

SEQ ID NO: 6737 - DNA, 1107 bp, Candida albicans
cgcacaatcactcagcaggacgataatagaaccaatttatcgtcaagaaattcaaaggaacaaaaatggaaaaacaattcatattatagaaatattcaattcacaaatttgactgataaacccccaaatctaactgaagacatcgagatgatatccaacaatatgaaattcatttccttttctcaatcccccattttgccaccaactagagatacaggtacaacttctgtaccgttcccaacatcaatctcagattataactataagctcgccaatatggctaacactaatgataatcacaaatacacccatctgggaaaatatgaaaatgtgacagaagaagacgacagagagatccttattagcgttgggaaaaatacaaaaatcaaaaaacccaaatttccaaaatccaccaagattaaaggtggcactggatggtataagtataggatcagtggtgacagtcccaaagaaataccggcatataccacaaacgcaataaacacataccctataccatttgaaattctaccattcgaggctcaaccatttgacattatcccgtctcctcatgactcgatcaccaccagtattggctcggctctgtcatttcccaattctgccccaccaatggtattttacccgcaatttggaatcccagtttaccaaataccaatttttaatgaaggacatccatcttcatctttaccaatctcaccaatttcaccactgctacagtctcaacaatcacactcatcaccaatattcccaccaccaccatcatcatcgtctcaactacaacaactttcatctgcaattactgttaaaaaggaaaatattaagcatcagattgaatactacttctcaactgaaaatctctgcaaagatacttatctaagatctttattcaataaatctgatggtagtattcagttaagtcaattgttgagtttcaacagaatgagaatgcttaccaataatgggaaatacacaaacttggttttggaatccattgaagaaataccaatcttggaattattgcttgatgaaaatgataaaaataatgatagtgtgcgacttgtgaactggaagagttggattatttaa

SEQ ID NO: 6738 - DNA, 336 bp, Candida albicans
caaaatagcaatcaacaaacaacaaccaggaatcaaaaaaaaaaacaagggatgcggtttattgtatcatcatttatattttttatctcatttttgctgtcattaataaccgctgaaactcacacatggtactttaaaaccagctgggttgatgcaaatcctgacggggtttttcctcgtaaaatgatcgggtttaatgattcttggcctttacctacattaagagccaaaaaaggtgacagaattcaattgtatttaatcaatggttttgaagatttgaatactactttacacttccacggtattcacccacggcgggtcgaaggaccaacgtaa

SEQ ID NO: 6739 - DNA, 1617 bp, Candida albicans
actatggacgaggttgttccaagacatggtgatcatcataacatcaatatcaaatatgggtacttcatatttgccctaacaataattcaaataatatttttcctccaagtgaaatttattcaaatcaagcgatggaatagtactggtcgattcagtaaattctggtcccaattaacgaaccctccaatatggttaatggttactatttggctattaattgtaattttcactggtggtcataagatatctgatttcctggaagaatatatcatatctgcaaaaagatatggcagaatggcgtattgtttaataccattgaatatttatttggtgttacgtcctacaaactcgccattattgaaaccaggttattacttagagaatatgaatttgcataaatggacgtcacgaataattgtcttttgtagtgccattcatgctgctggatatatatataagtgggttaaagaggggaccatattaaataaacctttcagatttcttaatttattaggggtgattgtatttgtatttttggttgttttggcaattatttcagttagaacatttagaaagaaaatctattcaacgttttacctcatccataatatcactgcttggtcaatggtcattcttataactttccatgcacgtcccggggttacaatttttgcaataattagtatattattattaggctatcaattgtatttgagatactattcttcctatttggtcaattcattaaaggtcattgacatacctacttcaactttacaaatcataaagatccctcaaccaaataaattccccaattggttaccaggatcacatattagattgagctatacaattctgaaattcaaatcatggacaacggcaactcatccgtttacaatagtcaccatcccggaagattctgccaataatcttactttgattgttaaaaaaccaaaccaatttgttgtttacccattggatagttatcttttaactggtccttatccatctcttgctcctccgttttttactactgctaacattgtcaacataatatgtggtgggtcagggatctcattgggtttaccaatctatcatcatttcaagagcattaatctgacggtacctgtaaaattggtatggacagtaaggaatcagaacgacacttttataatgaatcaattggatatgactggggttcaagtatatgttacttctattggcgatactaactcggaactgcaagaaaatcaacagcatcaggctgttccattatttgtgattgaagaggaagaagaggaagaaggtcatggattattaaataatgagagtgagaatggaattgaacttcaaaatatgccagaaagtaacgaggaaaatagtgaaaccattactatcaatagtaaaaacaataaagacaatgaagaaagaaaggaatatttcaaatttggtcgaccaaaatttgatgaagtttttgctattgatgacccaacgacaactcatgatttagacaatagttgggttattgcgtgtggacctgatgaattgatatcggatgctaaacgttggtcgaaagatagaggatatagattttactatgagaagtatgaaatgtga

SEQ ID NO: 6740 - DNA, 1137 bp, Candida albicans
agatctagagtaatacatttcaattcattacatacgatatctagattaaccccacgctcatcgaaattactgataatacgaccaatcattggcaaagcccaattatctttgtcatcgtcaataacaacaacgaaaagtagaacaacatcacctaaaatggcattaacagttcaatcgtgttctcaattacctacggggaaattacctgaatatattaaatcttcaaaaagccgattatataacattatatggctgtcatcatctccaccaacgaatatatacattgccaaaaagcctggtgatgctagtgttcgagaagcaatgattgaatttataaatcatttacatcaacaatatccatcaataaatgttattgtcaatcaagaagttgctgatgaattaatgcatgaattgaaatccaccaccaccaccaccaaacaagacagtaaatcgattcaagaattaatggatccattaaccgatcacgtcatttatactggtaaaaatgaagatattgttgataaaaccgaattaatgattacattaggaggggatgggacaattttacatggtgttagtttatttctgaatgttgttgtcccaccaatattatcatttgctatgggtacattaggatttttattaccatttgatttcaaaaattataaacaaacatttcgagaagtttatgaaggtagaagtaaagcattacatagaaatcgattggaatgtcatgttataagaaaacaaataggcaaatcaaatgatgatgatgcagaacaagaagaagaaagaacaaatattaaaaaattgaaaactaatggggaaacaagcataccaatgcctacaaatgggagtagtgatgattctaaaaaaattaaagaaatgattcatgctatgaatgatgtcactatccatcgtggaagttcaccaaatttgacatcattagatatttatattgataatgaatttttcactactacttttgctgatggtgttatatttgctacaccaactgggtcaactgcatattcactatcatcgggtggatcgataactcatccttctgtaccctgtgttttattaactccaatttgtccacgttccttatcatttagaccatggaccttgccctag

SEQ ID NO: 6741 - DNA, 1026 bp, Candida albicans
caaagtcgaaaaagattcaatccggaaagtcccattgccaattatacaaatggttgtaagaaattaaaatattggaataaaaaattaactacgaaaaatccagaaattttcgatttagtacttacattaggtggtgatggtactgtattatttgcttcaaacttatttcaaaaaattgttccacctatactttcattttcattgggctcattaggttttttaaccaattttgaattcagtgcatttagaacagtattgagcaaatgttttgattctggagttaaagcaaatttgcgtatgcgattcacttgtcgagtacacactgatgaagggaagttgatttgtgaacaacaagtgttgaatgaattggtagttgatagaggacctagcccatatgttactcatttggaattatacggcgatggatcattgttaacggttgcccaagctgatgggttgattattgcaactccaactggttcgactgcttattcattatctgctggtgggtctttagttcaccctggtgtgagtgccattagtgttactccaatttgtcctcacaccttatcgttcagacctatactattacctgatgggatgtttttgaaggttaaagtcccactgagcagtagagccactgcgtggtgttcattcgatggtaaagtgcgtactgaattgaagaaaggttattatgtcactattcaagcttcaccattccccttacctacagtaatgtcttccaaaacagaatatattgattctgtcagtagaaatttacattggaacatcagagagcaacaaaaaccatttagttcatatttgaaaccagaaacgcgacaaagtattgctgaaagtgaaagattggataatttacatatttcaagtgaacaagatgaatcgaatcatgaggaacctgaaataactgaagattttgatattaattatactgacaatgaacgtgattcttctagttccactcctagtgaagaaagcaacgaagaatgtgctaataccacgacataa

SEQ ID NO: 6742 - DNA, 915 bp, Candida albicans
acgcaatcgcggatcttccacgccgtggtgaaaaccttgtacaatgaccaaatttacaatattacaccattatggaatgtttatggagaaattgaaggtcagaacaaagacgaggtaattataattggtaatcacagagacgcatggatcaaaggaggcgcatcggaccccaatagtggctctgctgctttgttggagattgctcgtgctttaaacgaattaaaacagcaaaattataaattcaaacgtacaataattttgcacagttatgatggcgaagagtatggacttttgggttccaccgagcaaggggaatactatgctgaaaagtatcagcgcaatgttgtggcatacttgaacttggacgacgctgtttcaggaaaacatttcaagttgagtgcatctccagtattagatgaggtattgttagctgttgccaaagaattagaatacccagaaaagggggccgctagtttgtatgaccactggttggccaatggtggtagaatcaaacctcttgggtctgggtccgattatacagtttaccttgaccatctcggtattccctcagtggacttgggttttgctggtgggaaaggtgacccagtatatcattatcattccaactacgactcttaccactggatgaagaagtttggcgacgaggggtttgtattccacaatttgtgtgccaaatatgtactgttgcttgcattacagttgtcagagagagaagtcattgatttcagactttccatctactcaaaaaagttgcaagagtattacaactccactgtttcaaccattcccaagtcgtggttgaacaaaacggtaaaatcctcacacacagactgggaagaatataattttatcaataaagccaccaatggttattatacagacgagattccatag

SEQ ID NO: 6743 - DNA, 1584 bp, Candida albicans
cgtcgtacatcattagctagagatgatagaaactggcatggtattcgattaactaaaacggatgttaaaagacattatttacaaatgacagggataggtaaatcacaaaacacattgacgactgaagaatatattgatagcttattaaaaaatttcactgaaataaatcaacaatcttcatataatttgatgtctcaagataatcccaaattaactgaatttgtcatttctggatttacagatttgaaggcattccaaacccaggtggttaaacgtaaagttaatattggtacgccagagagttcgagtgttaagctatttgatgaacagggtaagaccatttatataccaagtttacttgaactagattatagcactccagcttactttgctttggggaaaagtgggcattttgttggagagtatgtgtttgtcaattatggatatccacgtgattacagtttattgttagacaataacgttgaggttaaagataaggttgttattataaaatcaagttatcgtgatcgtaacgtcactatatgtgagaaagtagctattgctgaacaccatggtgctaaagcagtgcttagttattacgatatcgagagtgattataattcatttggaaaggataaagtcaaactgttgaagaatgctataacaagaggtagtttacttaacaacaccaagattccagcaattccaattagccaagacgaaatcaaacctattttgaatacatttgcatttcctggaaacggtccatattcaaattgggagtttgctcccactactactgctaaatataaacttcaagtggatacacggtttgcaaactctgaggaacctaaagaatttactaatattgtgggaacaataaagggaataatcaacgatgctgatattgtgattggtgccaggcgtgattcatatacttcatcaaatccactttctggacacgctgtcttattggaaattatgaggtattatcagaaattagttaacgttggatggaaaccgttacgtaatataaaatttgtttcatgggatgcatcatatttgaatttattaggggtcgaaagttttatcaatgatactactgttttcaacccaaaaagaactattgttgcttatataagtattgatggtgatgctgttactggcagcaaatttgccgtagatgctaatgctgttttcaacagtgttttacgtcgtactgcaaaatccatcccaatccccaaggaatcggtttcatatactaacaaaatgggcgaacataatattggggatgatgatgtatatataacagataacaagggcaacaacaacaacaacaacaacaatgataatgatattctcattgataattttgttcataatgattttactacgttatatcgttattggtggaagcaagataagacaagtataaacaacaatttgggattacctattgactctactgaatcaatgatatttcaaaagcatttagccacaccaattataaatgttagatttgaaaatgatcctgaacatgacaaagctatttatatttcttcaccacgcgtgcagatcccatga

SEQ ID NO: 6744 - DNA, 276 bp, Candida albicans
aatttaccattgtgggagagaatcaaattacatttccgtatcagacaccacaataaattgttacagtattttgaaagaaactttcttcatcaaaagggattacacaacagattctggttcagacacattgtttatgccagcggaagatacattgggtatgcgggacaaacattgccgggattaaatgaagctattgaagatggtgatttcgatagatttgtgcattgggtcaatatctttgccagaactttgaagagaatcaatagacattcataa

SEQ ID NO: 6745 - DNA, 1023 bp, Candida albicans
tttttgaaatttctcttctttctcttcaacttatcagccatggacgaagaacttcagaagcatttagaaatttcaagaaacaccaagtaccagtggattgcgtgcattttcagtttagttatatttcttgccaacggcattgttttttactggattcctagacttcttagagataaacgatttgtcaaaacaaacagattcaaaccgtattttgctttcgttgacatttggcaaaccattaataccccgttctcaattaaagtcggaaagaaaacccactacttcaaacccagtctacttgccttaggtgcatgtttcattttattaaatggcaagctatgctacattgagaccgacgatttggactacaaaccccgcatatttataattgggaaacgatgtgctagaattgctttgggtcagatgccagcaatgtttttatcagttaccaaaggtgatttcattaccgcccttacaggcttgacatacgaacgtgcggcattcttccatgcctggtttgctacattaatgttcctgatgatgacagcacatgtggggataatcgggttttattgggctcatccaaattacgacattgctcctaaatatccaaaaaacgtttatggaattatcggctatgcgtgttttgtgtttttggtatttggcaatgtggccttgattagacgttatgcgtttgagtttttgatggtaaaccaccgggtccattcattcattatgttgttgatggctttcttacacaatgacagagccaaagccatggtcatccttgctatccatttgcttgtgttggacaaagtgcttggcagaatctacggtatcgtacactctttaaaatctccaacaaaagggttgtcagaatctgagatactcgacgatgagactttgcgtgtcagtatccccgtgaaaacatcaaagactgatccaacaccttggtacagattatttctattcaaatatggaacttgttcttcacccaccggggctggaaggaaccgcgcttgg

SEQ ID NO: 6746 - DNA, 2178 bp, Candida albicans
  unsure (110),(182),(205),(273): Identity of nucleotide sequences at the above locations are unknown.
ggttcacagagggaggttctcccaacatttgttcaactcaaggtgaaatttcataattggttattttatgagttggatttttgtttgcaattaccaccaatgcagccaanaccaggaaaatataaacggtatggccagttgaatcaatttattgttgtaatttttcagattgacaattcgtnttctttctgtcggtcccctaganatacgacttgtttgtgctttagtgaaaatgctttggcaacgtatgctggatgctttgcttatgacaanagaaacaaaaccgaagtggtagactatttggtagaatactgtgaagaaagaggtaatgtcactattgataaggattggtatgagaaatcgtaccaaaactttcttgagaaggctaaaactgcacaagaaatccccaatttcaataaaactatcccgatcaacgtgccattcaaacttaatgaggctcaaatgcaactctatcaagaaggatacaatcattttatgggtaactacgatgattcattgtattacggggttggtgctttaggttattggttgttgattatgttgtttggagccattttccattggagtaaattcttattcccaggtttaaccaaaaaactaacttttaaacccattaatctttggagagaatatgtatcgatgcctgctacgtttagaaaaaagaaagctgaagagtttagatttttaaagatttttgattctttaatcccaactagatttgaatcaatagttattttcttctactatgtctacaccattgttacccatgcaattaacatggaagctttagatagcgacccagtgttttacagtaaatacaaagcacagataagatattgtgctgacagaacaggtattactgcaactattgtcatgccattggttttcctttatgctggtagaaataattttttgcaatggttaactggttggcaatatcaaacctttgttgcttatcatcgtcatactgctagagttatgttctatttggttgtcattcatgcagtattatttacagttgccttagcagattactattctacagatgtcaaagaaacttatttgatttggggtatcattgctaccattgccggaggtataattcttgttcaagctatgctttttttcagaagacgttggtacgaaatctttttatttattcacattgttttagctgcgttatgggttgctggcgcttggatccatgttgaagagttgggttatatttggtttgtttatccaacagttgctgtttggtgctttgatagggccgtcagaattggaagattgattgttttcggattccctaaggcacaagttactttaatggctaacgaaactttaaaagttgtcattccaaaaccaagacattggaagtctgtccctggtggccatgcttttattcatttcatcagaccaacatgcttttggcaaaatcatcctttcacttttgttgagtctccagatggtaagagtatccttgtctattgcaaagtcaaaggaggaatcactcacagtttatatagatacttgtccaacaatccaggtcaaactgcttccatcagagttggtgttgaaggaccatatggtgaaccaactcctgctaaatatgctgatacagcagtatttgttgctggtggtaacggtattccaggtatttattcggaagttacagatatggctagtagaatgccaaaggaaactaaaactgtcatcaaattgtattggattatccgtgaatacaagtctttggaatggttccgtgacgagctcatggaattggcaaataccaacatcgaaacaactgtctacgttacaaaaccagaattatgttgctcatctaccgacgacggtagtgatgatgctggttccaaaaaagaatatgtggcacacgagattaaagcagagggtgatgaatcttctcaaggtccagaatctattagatctagattatcacatgtaacatttaaagaaggaagaccttgtattaaagatatggttgaaaccaatttacacgagtcaaatggttctgtcgcatttgtctcctgtggtcatccagctatggttgacgaattacgttatttctgttctaaaaatgtcgataactccgaaaagaagagagtcgatttctatgaacaagttcaagtttggatttag

SEQ ID NO: 6747 - DNA, 837 bp, Candida albicans
aaagttgttgtaccaaagccagacaattgggaagctgttcctggtggtcatgcatttatccactttttgagatttgattgcttttggcaaagtcatccatttacctacactacatcaaaaagggatatcacattatttataaaggtaaagataggagtcacgacatcattatgtcggtatatgaaatctaacgaaaactgttctgccagtattcgagttgcaattgaagggtcttacggtgaatcaacccctgcaaaacatgctgacatggcagttttcattgctggtgggaatggaatacctggtatatttgctgaagcacttgatatcaatagacaccaagaactgaaacatacagtgaggttgatttgggtggtcagagaatataattcattactttggttttatgaagaattgatgtcattaaaagatacacaaattgaaaccactatatatattacccgaccaggtatattggtaaacgaggatgatttcaataaaagattgccaagaatgggtcaaaatatggaaaatgaattacagcatttgttgcagaaatcagtacctgctgcttataattcagaaccagtgaattcagttggaggaatacacagccaaattagagaagagctatttcatataaaaatcattgaaggtagaccaagtatcgaaaaggtaattgcaacatgcattgaggatagttcaggatcagcatgctttgttacgtgcgggcatcctgcaatggtagatgatataagagctgcagtagctaataatattgataacaaagagggaaaaagagtagattattatgaacaattacaggtttgggcatag

SEQ ID NO: 6748 - DNA, 1800 bp, Candida albicans
ggacttgaagcttcaattgatcaatttttaaccaattggcaaagatcatttttctatgggatggccatgtcttcttattgggggtttgtattattatttggaaccatttctaattggacccaatatttattccctggattaatgacagatcttactggtccattttctaattggtggagaaagaatttaagtttacctgctacatttggcaccaaaaaaactcaagaatatacattttggtttaaatatttacaaggatatataccatcaagattagaatcaattattaatagtgggttttgtttagtggtgattattgttttatcaattaatacttattatagtgttggtaatgaaattattttcactaattatgttgcacaattacgttatcttgctaatagaaccggaatcaattctacaatattaatgccatttcttgttttgtttgctggcagaaataatattttacaatggattacaagatggaattatggagtatttatgatgtttcatcgatttattggtagaatgatatttttatttgttgttttacatgcagtgacgtttagtattgccttgggagtcgattattatccattgatgtctttcccatttatgatttggggaacaatttctactgttgctggtggcataataatggtccaagcaagtctatatgtaagaagaagatggtacgaggtgtttttaggattacacattttattggcattatttttcatgattggtggttgggttcacattagttatttgggttatgaatggtgggtatttgtagctattggattatgggggattgatagaattgttagggttttacgaatgatatcatttggatttccggaagccgatatcactttaatgtcagatgaaactttgaaaatcaagattcctagaccagattattgggaaccaataccgggaggtcatattttcattacatttttaagaaaagactgcttttggcaaagtcatccatttacatttgccccctcagtcgagaactccaacaccattgttttatataccaaagtcaaacaaggtgtcactcgtaaattatacaattatcttgttacttgtcctggaagaagagctaaaattaccgttggcgttgaaggtccatacggtgagtgttgtgctgcaggaaaatcacaaacagcagtatttattgctggaggaaatggtgttccagggatgttttctgagatttatgatttggctaaaagaagcacacccgattcacagaaacgattgagattatattggacaattagagaataccgtagtattcattggttatatgaagaattgaacgagttgaaaaaattccataacgtcgaagtcacagtgtttgtaaccaaaccagactccaatacatacatcaatgagttgagttcgagagttatttctggtaaatgtaacagcacagaaaattttgatggggctaccactgccaccactagtttatatgaaaaggtttcatttgatgataaggcaactattgtggtaacaaatagagatataacttccaaatatgatccaaattcagttaaagatgctatcattgcccaattatcccacgtacatttccgtgaaggaagaccaaaaataaataccatcattaaagaggagattgaagatgcacaaggctcaatatgttttgtgacctgtggccatccagcaatggtggatgacatacgtgctgaagtagtggggactattggtaaatataaagaaaaaagaatcgattattatgaacaattgattggctgggcataa

SEQ ID NO: 6749 - DNA, 1560 bp, Candida albicans
aaaggaaaaaaggcggaagaacaacgattattcaagattgtttctcatttaatcctttcaaggtttgattcgatgattgtgtttggtttttatatcttggtaattgttctccatgccattaattatccggccattgagaatgaagtacgctataaaagtcagtacttggcccatatgaagattcttggagatagaacggcaatggttggtattatgtcgatgcctttgattttcttatttgctggcagaaataactttttgcaatggataattggtctcaattacagtacttttgttggttatcatagacatcttgcaagaattatgtttgcattgtttgttattcatgctgcagcattttcctatctatttggtgacaactacaatttggttatgtcagaaactaactttatatgggccgttgttgccattgtatgtggtggtataattatgtttcaggctttgctttatttcagaaggaaatggtatgaagtatttttagttgcccatattgtcttggccatattttggacagttgggttgtggtatcatgtccaatacagagggtatgtttggttagttcttccaagtatcgccgtttggagttttgatagggcggttagacttgcaagattatttgcttttggtttcccacaagccgatattaccttgatagctgatgaaactttaaaagtccaagttcaaaagcccaaatattggaaatcggtccccggcggacatgcttttattcattttttggatacaaaatatttttggcagagtcatccattcacgtttattgaagaagaactgggtagtattattttcttttgcaaagtcaaagatggtattactagatctttatacaataggttgctttcttccccaggtaaatctacaaaggtgagagttacagttgaaggtccttatggcgaacccacaccagctagatatgccgacagtgctgttttcttggccggtggcaatggtattcctggtatttattcggaggttgtcgatgccgcacaaggcagtagtactggcgagaagaagaataaattcaaattggtttgggttgttagggaatggaaatcattgttttggttctatcaagaattggttaatttgaaagatttggatattgacactaccatttatgtcactagacccggtattgagtcatttgttgaagagtataacaacagattttcagaatcccaggccattcttagtggtgacattcatgaaaaaccaaaaaaagacggtgttaaagtttctgtaaataaggtcgacggggaagaagaagaagaagatagtgaaagtgatggcatgattgacaatattaagctggagctcgatcatattcaatttcatgaaggaagaccaaacattgaattcttggttgatagattcgttgaacaatcaaatggatctattgcttttgttgcctgtgctcaccactcaatggttgatgagattcggtactattgtgcccacaaaattgacaatccagagaagaagagagttgatttctatgaacaagtccaagtctggggctaa

SEQ ID NO: 6750 - DNA, 1296 bp, Candida albicans
atacttgttaaacccacccttcatctcttaggtttttggatttatgtattctttgtattgttgaaatttgtagttattttcatttattttccacaatttgataatttagtttgtcaaccaccacattcttttccaaaaaacatgaactcaattgcatttatattaacatcattactatgtatacccattgttgtcattgctgaatcccttctgttaccgaaaaatagtattcaactggctaaatccatatttgcatgtaaattaaacgttcacgaagaagttaaatattgtaataccaattcaccagaagattatggttgtatatgttccaataaagatgccattatggaattcgttggttgttatgcttattcccaaaaagatccacatgaagcaatagatttctttgttgaattttgtcaagaatatggaaatactaccgttgatatggatagtatctatactgcttatgaaaattatactgcaaaaggttactataatgtttctatgccatcatcgaatcatcataaccattcaaacaattcaaatgtgtttgaacctaatcttcctaaagaaaaaatggcaaattatactaattctttgaaactagctatagatcaatatttggtgaattgggataatacattttattatggagcagggattttaggttattgggctctagttatattaattgctgctatatctaattggactagagctttgttccctggtcttatgacagacttaactggtccattatccaattggtggagacaaaatatctctttaccagcaacttttggtagtaaaaaatctcaaagttccaccttatatcgattccttgatttctatataccttcaagatttgaatctattgttattactggatttgttattgtttgtatcataacgttatcaattaatacctattttgctcaaggtgatgaacttatacattcaagttatgatgctagattaagatatgttgctaatagaaccggtacaaattccaccatgatgttacctcttgtgatattatttgctgggagaaacaatatccttcaatttattactggatggaattatacaacttttttaactttccatcgtcatattgccagaatgatgtttgcctttgttgttattcatgctggttgtttcactattgctcttggatcatcatatggaccagtgatgaaattgccatttatgatttggggcacagcagcaaccgtgattgctggattaatgttattgtcttacaccacggtggctggaaggtcgcgcgattgc

SEQ ID NO: 6751 - DNA, 1650 bp, Candida albicans
gtatttttcctaattggttttgcccgtaaaggtttgttggctggtaattggaaatttgaattatttctttttccgctggctatgttaattcctggaaaggggggaatttctaatgctttcagaaaatacatcacttacccaccattgttcaaggaaactcatgcccaccataaatccatttttgggtttttccatgctattttaccaacaagattagaatctattttggttgtcgcttggtttatcatggctttgattatgaatttgaccaattacgttcatgtcaaaccaaactacatctggccacaaaaaagcaatgaattgggaagaaaaattgctgatagaactggtcaaatttccatgtggttgatgccaccattggttttgtttgccggtagaaacaattttatgcaatgggttagtggttggccatatgcccgttttgtctacattcataaatggatcagtcgtgttgtatttatgatgagtattgctcatggggtcggtatgacttataacggtaaaggtattggcaaatactacacaagaaatgccaaaccatacgttagatggggttatgttgctttggtcgccatgtcaataatggttttccaaggtttctcatatttcagaagaacaaactacgaagttttcgttggtgttcatattattttggcagtgtttgccattgctggtacttggattcatactactgaacaaggttatcaaatgtggatgtacggtgctgttgctgtttgggttttcgatcgtgttgtgagaattgctagattagctactttcggacttagatctgctactgtgcaattaattgctaatgaaactgtcaaagtaactgtatcgagaccaggctggtggaaaccattcccaggttgtcatgcattcattcacttcatgagaccaacctgtttctgccaatcacatccattcactattgttgattccgtcaccgaatccaacaccattactttgtacattaaagtcaaaggtggtatgactcatggcttgtaccaatacttggctcaacaacctgctcaaactgctcaaattaaggtctccattgaaggtccatatggtaacagaatggcaatcgatagattcgaaaacgatgttttcattgccggtggtaacggtatcccaggtatttattatgaagccactgatattgctaagagactcggtgaaaaacgtaatgttaaattatactgggttgttcgtcattaccgttccttagaatggttctatcaagaattactcaagttgaaggatttaccaattagcactactgtatatgtcacccaacctaatgttggattagctgacccaatcaccacagacttaaccgatgatgaagaacaacaagaacatgaacaagaaaagaaatctgataccgaagaaagtaatgactatgttgctcaagttaaaaagaatttatcattcattcaattcattgaaaccaaacctgatttctaccaaattgttggcgaagaaattaaacaactgacaggtcctattgcatttgcttcttgtgctcatggtaacatggttgatgatgtcagaaaatcagttgttgataatttgagcaattccaaccacagagttgaattgtttgaacaaatgcaaaactggtag

SEQ ID NO: 6752 - DNA, 903 bp, Candida albicans
agtgcggtccttccatgccgtggtgaagagctaatctattttgggttcccagttgctgaggtcaagttgctaactgatgactatagtgaagaagttgttttgagagtaactatccctaagcccaaatactggaaatctattgctggcggtcatgtgtttattcattttttgaaacctgcatacttttggcaaagtcatccttttacttttgttgattccacggtaagtgatggtcacattgtttgttattgcaaaatcaaagctggaattacgcgtgctttgtatcaaatgttgatgaatactcctgatagatgtatgccaattagggtcggtgtggagggcccctatggagaatctactccagctcgttacgccgatacttgtgtttttattgccggtggaaacgggattccgggtatatattctgaaattgtggatattgcaaacaaacaacagctgtcaaaagaagaagggtgcaaacggagattgaaattaatttgggttatcagaaagtgtaatatgctactgtggtttcacaatgagcttgccaatcttaaaaatacgaatattgaagttacaatttacgttacacaggctacgcaaaaggatttaggggaccatgataatgataagttcacaaaaagttctgagagtttatcgaaaagtgcaaacgacactgattcaagtctttcaactatttcacatgcaaaattcatacatggtagaccttgtcttgaggatattataaaacaagaaatatctgagtcaaatggatctgttgcttttgtttcatgtggacatcccgctatggtcgatgagatacgttatcagattctgcaaaacattaacaatgatgaaaggaaaagagtggatttttatgaccagctacaaatatgggcttag

SEQ ID NO: 6753 - DNA, 822 bp, Candida albicans
gcaaaaccagtggaggaaatacacaaacttcccaattatagccaagccaattttccagtgcagttgaatgagtccgaaatatttatcttcaaacagtcatatgaacagttcttagggaattatgacaaatcggtggattacggatggtatctagtattatactgggtcgtcgtgatagcagtagtaagcataggtaactggatcaaaataatttttcctaatctcaccaaagcattgacagatccagttagcaattggtatagaaaacacatcagcactccagccacgggctccagaaataaaaccaacgagcttcatctaacaaaaggtcttgagatgttagtgccatcaaggcttgaaacaataatattaactggtatgacagttatatgtctcaaaatgcttattggagattttcaatacgtcgaaggtaacccaattttccattctaaaataaatgctttattgagattttacgctgtgagaacaggtttgcttgcaagtgctctaatgcctttattgattctatttgcaggaagaaacaattttcttcaatgggtgacccgatgggattactcaacctttatcatgtttcacaggtggctttcaagaatcattgtgattttattcttagtacactcagtatgctactctttgtatttgaaacaacactcaaaaaagcctgaggcgtacatttattggggatttactgcaatgttggccggtcttattattttggttcaaggtttgctagtattaagaaggcgatggtacgaaatgtttttgatattgcatattattttggctatagttttcattggt

SEQ ID NO: 6754 - DNA, 2043 bp, Candida albicans
cccaggattctcgtatttggttattttttgagttggtattttttgccaacaagtgtcaaggcagttaaaatgcccaaattccaactttttggtgatatcacatacttttatacctgtaaccttcaaataagtctgtcagtttcctattgtgcaactccatataatgctacctgtttatgtgccaataaaaacgctttagctacatacgctggttgtttggcctttgataatcgaaacacaactacagccgtaaattatatgatgaattactgtgaagaaaatggtaatgtcactgttgaaaaagattggtatgagaaatcgtaccaatattttctttctaatgccaaaactgaaaaagaaatccccaatttcaataaaactatccccattgatgtgccattcaaacttgatgaagctgaaatgaaactatatgaaagagcttataaacagtttttgggtaactatgatgattccttgtattatggagcaggtatcttgggttattggttattaattatgtgtattggggctattgtcaattggggtaaagttatgtttccaagtttgaccaagaaattaacttcaaagcctattaacttgtggagacaatacgtttccatgccagcaactttccgcaaaaagaaagctgaagagcttagaatctttaaattttttgattctttaattccatcaagatttgagtcaatcgttatttttctattctatattgtggtattgatgatccatgccatgaacatgcattatgttgatggtgatccagtgtttgaaaataataaatataattcacaagcaagaaatgttgctgatagaacaggtatcactggaacgataatgatgccattagtttttcttttttcaagcagaaacaatttcttgcaatggttgacaggttggaattatagtacttttgtcacttatcatcgtcacattgccagagtcatgtttattttgattgccttgcattctattcttttcactgtcttattacgtgatgatatgagtgagttttctgaaacatatatgatttggggtgttcttgctactgtttctggtgggatcattttattccaagcaatgttatttttcagaagaagttggtacgagatattttcgcttattcatatattatttgctgcattatatgtcgccggtacttggattcatgttgatgaattacggtacgtttggtctgtgtatcctgctgttgccgtatggtgtgctgatagagtagttagaattgctagattggtgatatttggtttccctaaagcccgagtctcattattagcagacgacactataaaagtggaaattcttaaaccaagctactggaaaactatacccggtggtcatgcatttattcattttttgaaacctacatatttctggcaaagtcatccattcacttttggggaatcgccagctgatactcatattattttgttctgtaaagtcaaaggaggtatcacccacagtttataccaattgttagtacgcagccctggacaagccattaccatgagagtaggagtcgaaggcccttacggagaaccaactcctgctagatatgccgatactgctgttttcattgctggaggtaatggtattcctggtatttattcagaggttatggatatgactcgtagaatgccaaatgaaaccaagaacgctatgaagttgtactggattattcgtgactacaaatcattagaatggtttaacgatgagcttactttgttaggaaacacaaacattgaaacaacaatttacgttaccaagcctgatttatctaatttgttaactggtgatggtagtgacgatactagttccaaaaaggaatcagatagtcaagatatgaatctcgagagtaaagagtcgttgcaaggtgttgacttggtcaaatctagattttcacatatcacgtttaaggagggaagaccaagcattgaagacatagttgacttagaaattaaagaatcaaatggatctgttgcttttgttgctcctggattttcaccacgg

SEQ ID NO: 6755 - DNA, 2097 bp, Candida albicans
  unsure (1868),(1877),(1878),(1880),(1883): Identity of nucleotide sequences at the above locations are unknown.
tatccttttctggtgttgtctctccctctttctataatctgcatcaatacatccaaaatgaagatacaaagtttattttatcttttaacaattctttccacaactttagcaataaaagttactcataaaaaagaagttgcttatgctgcttgcaagtctttgctcactcaatttgctggttccacatcactgggctcgcctgatccattctgtgacgtgacaaaccaaccagctatgggatcgatggccatttgtttagtcgaaaactttaaagaatcttccaaagactattaccgtccatatttaaaaacgtgttcaatttccgaacataaattttttgcatcatataagaatgccacgaatcacatactagaaatatcactgagtcaagattctaacaccactcacccaaccaggctctcatatgataatgtgcagttgctgtttaatcagttgtatcgtcaagctttgaatgataattatagtatttggtttggaacggttttattggcatattggggacttgtcatgctagtagccagtttgaattactggtctcattttttgttccctcggtttgtaaaatctttacatggttcaatttccaactttgttagagtgcattttatactttcaccaacagttggaaatacacatgcttcatcggtgaaatatttaaaagttgtccaagcgtatgtgccattgaggtttgagtcaataatagtgttggcttggacagttttatgctttgtattctgtggtataaatcattatccaacgaggccgaatttgacttcgctagtcggaaatcgagctgctctacttgctggattctgtgtacctttactaatcttattcgctggaagaaataattttttgcaatggttaactggttggtcacatgccagatttcttttgtttcaccgctggcaggcccgggtagtatttatcatgatattaatccacgtcagtgcaaaaacttctgttttgataaagtttgatagctacccttctattttcttgcaaaattacgtggcatgggctatggttgctgctatttccttgggactcttgattgggcattcttggcaatactttagaaactcgagtaatgagatattcttgattgttcatcacattttggctgcgttatttatagcaggtgcgtggattcacactagaggagccgacaccccttatgcttactatgctgccacaacaatatggctgtttgacaagttggctaggttaattagagtatccctgtttggtgttaaaaaggcaaaggttgaattgatctctgacgaagttttgaaggtaattgtaccccgaccaagatggtggaaaccattccctggatcttatgcctatatttactttcttaaaccaacaactttctggcaatcacacccattcactatcattgattctgttgacgatgctaatactttaaccttttgtataaaaatcaaaggaggtataactcatggaatttgtcaacagttggttaagaaaactaatcaaatggattatttccatgttcttattgaaggcccttactcccgacctcattctggaagacattttgaaaaccttgtcatgttgagcactggtacaggtattccaggaccttactatactgcccttgatttgattagaaaaaacgacaactcaaccaaacgtattaaattctattggattattcgtgatgtgaagtcaattaattggtttttggaggagctctgtaagttagaagggacaattgttgagacggttatttatatttgcaacacaaatacaaatttcccttttttaaaatctcaggaaatgtcaaagcaatttgatagtgatgcagagaaggtttcttnatttccaannanggncgactatttgaaacatcggttgcagtttgtggatttcaggtatggtcgaccaagtattcgtgagattgttcatcaggaagttaaagaagcacgcaattcgattgggtttattacctgtggtgcaccccaaatggtaaatcatgcccgaatgacaattgttgactcattgaaacatgacaccagtaaaagagtcgaactctttgaagattttcag
